United States Patent 8,461,315 (MICRORNAS AND USES THEREOF) - sequence listing, part 3

SEQ ID NO: 53399 - RNA, 64 nt, Homo Sapiens
uaacuuaagcacaaaauacaguuauuagagugccaaugaauaaaaaaaauaaaaaaguagggcu

SEQ ID NO: 53400 - RNA, 64 nt, Homo Sapiens
uuuuaaagacaaaacuugaaaaucugaauauguaaaugaauacauugauuaauaaacuuaguuu

SEQ ID NO: 53401 - RNA, 64 nt, Homo Sapiens
uggcuggcacauuguuggcacucaacaaugguugaaugaauaaaacaauaaaugaaugaauaac

SEQ ID NO: 53402 - RNA, 64 nt, Homo Sapiens
cucaacaaugguugaaugaauaaaacaauaaaugaaugaauaacuaagauauagaaacucucau

SEQ ID NO: 53403 - RNA, 64 nt, Homo Sapiens
cucauuagaauuaccauuugaaaacauuguccccaaugaauauaauuucuuaacccaagugacg

SEQ ID NO: 53404 - RNA, 64 nt, Homo Sapiens
gccuuuguaaccacaacuuugaaaaaugccaucaaaugaauaauuggaagucuaagaacccaug

SEQ ID NO: 53405 - RNA, 64 nt, Homo Sapiens
uuuguucaugucuagcccacugugccuuuuggggaaugaauacuaaaaaaccguuauaaagaaa

SEQ ID NO: 53406 - RNA, 64 nt, Homo Sapiens
cuuucauuaaauagggagguauaguuucauauuuaaugaauauguccugguuuuuaauguaugc

SEQ ID NO: 53407 - RNA, 64 nt, Homo Sapiens
agccauuugauuuauguuucgaauaacagccaaaaaugaauaacauuaacugguauucaaaaau

SEQ ID NO: 53408 - RNA, 64 nt, Homo Sapiens
agccaaaaaugaauaacagcaacugguauucaaaaaugaauaacacuuugaaagcaguaauauu

SEQ ID NO: 53409 - RNA, 64 nt, Homo Sapiens
ccugaccccagcagcaaagagguggcaggucgcuaaugaauauaugcuuuauaauguccuucuu

SEQ ID NO: 53410 - RNA, 64 nt, Homo Sapiens
uuuagguaccacuugauauaaaaaggauauccauaaugaauauuuuauacugcauccuuuacau

SEQ ID NO: 53411 - RNA, 64 nt, Homo Sapiens
auuugaguuuaaaggaauugaaauuacuucaggaaaugaauauaaaauagguucacaguuaaau

SEQ ID NO: 53412 - RNA, 64 nt, Homo Sapiens
uucaggaaaugaauauaaaauagguucacaguuaaaugaauaagcuuuuguuuauuugugggug

SEQ ID NO: 53413 - RNA, 64 nt, Homo Sapiens
cuguacugagguaagauaugugugaccuucuuggaaugaauauugucuuuagaauacccuuuga

SEQ ID NO: 53414 - RNA, 64 nt, Homo Sapiens
gaauugaguauguggucacaugaaaacacggaugaaugaauaaaacacucuuugguggugacug

SEQ ID NO: 53415 - RNA, 64 nt, Homo Sapiens
guuacuuuuugccuugucuggcauguuuguuuuaaaugaauacauuaaugggguuuuuauccuu

SEQ ID NO: 53416 - RNA, 64 nt, Homo Sapiens
uggugcaugcaaguaacuaggguuuauucuauauaaugaauauuuauagaucuguaacauuugu

SEQ ID NO: 53417 - RNA, 64 nt, Homo Sapiens
aucgguuucagugcaacugggauuaaaacuauguaaugaauauauugccaguucaccggacagu

SEQ ID NO: 53418 - RNA, 64 nt, Homo Sapiens
aauggcagagauuaaaaguauauaagcagcuggaaaugaauauuuggccaugaggcgcugcuau

SEQ ID NO: 53419 - RNA, 64 nt, Homo Sapiens
ggaacacgucauugauagcaugaguuacacugagaaugaauaugacagaaaaugaaaaagaaaa

SEQ ID NO: 53420 - RNA, 64 nt, Homo Sapiens
uuuuuuugaggucggaaacuagauggaaauacagaaugaauaugggauuucuucugggaaauac

SEQ ID NO: 53421 - RNA, 64 nt, Homo Sapiens
auaaauacaauauugcauucguucaaguauuguuaaugaauagaguucaaugaauauuguaaau

SEQ ID NO: 53422 - RNA, 64 nt, Homo Sapiens
guaaauguucaaguauuguucuuagauuauguucaaugaauauuaaaauguaaguugaccuucu

SEQ ID NO: 53423 - RNA, 64 nt, Homo Sapiens
gaaucuacucuuggcuggcuagaaaaaaaagagaaaugaauaaaaaugaauacuuuuuuuuuua

SEQ ID NO: 53424 - RNA, 64 nt, Homo Sapiens
uuuuuuuuuaagaaaaaaaauauuuuuuauaccaaaugaauacuaaugucauauuuaaaauauu

SEQ ID NO: 53425 - RNA, 64 nt, Homo Sapiens
gguaaaggaauccuuucagcugccaguuuugaauaaugaauaucauauuguaucaucaaugcug

SEQ ID NO: 53426 - RNA, 64 nt, Homo Sapiens
uuaacugaguuggucuuuagguuuaagauggauaaaugaauaucacuacuuguucugaaaacau

SEQ ID NO: 53427 - RNA, 64 nt, Homo Sapiens
auauaccuaauacccaguuuaagacaccaaauauaacaaguauaauuacauccuccaauguacc

SEQ ID NO: 53428 - RNA, 64 nt, Homo Sapiens
ggugagguuuaaaggauaugaaacucuacauuuaaacaaguauuuuauauuuggguacagagga

SEQ ID NO: 53429 - RNA, 64 nt, Homo Sapiens
uauuguuaugucauaagcucuauuauguuauucuaacaaguagcaauuucacaaaauuuguaug

SEQ ID NO: 53430 - RNA, 64 nt, Homo Sapiens
ucucaacaaaaugugcuagccacuggggacgcaaaacaaguaagaucccuguugcaagaaauuc

SEQ ID NO: 53431 - RNA, 64 nt, Homo Sapiens
uuccuuuaucaaucucuuuugauacaacauuuaaaacaaguagcuucaagaaaccacugguguu

SEQ ID NO: 53432 - RNA, 64 nt, Homo Sapiens
uugaacauuguaaguuccuaaaaacauuuuauuaaacaaguagacauuuuguuauuaaaaaaau

SEQ ID NO: 53433 - RNA, 64 nt, Homo Sapiens
augugaugaaaacauuucaugaauucauacagaaaacaaguacuuuuuauugcucaaaaguucu

SEQ ID NO: 53434 - RNA, 64 nt, Homo Sapiens
auggggcauguugugucaugucuacuuuguaugcaacaaguagaauuuguccucacauuccucu

SEQ ID NO: 53435 - RNA, 62 nt, Homo Sapiens
ugaggcaggcagccgaccugaggccugggggcaccguggaccccuaugcccgggucagcguc

SEQ ID NO: 53436 - RNA, 62 nt, Homo Sapiens
agccccugggugagcuccgucugccacugggcaccguggaucugcagcauguucuggagcac

SEQ ID NO: 53437 - RNA, 64 nt, Homo Sapiens
uuaccuauuuuagugguugaaaugagagcuagugaugacagaaggauguggaaugucuucuuga

SEQ ID NO: 53438 - RNA, 64 nt, Homo Sapiens
ugcucgaaaagaguguccaagaggaguaaaggucaugacagaauuuacucccaggacaaucuaa

SEQ ID NO: 53439 - RNA, 64 nt, Homo Sapiens
aaaaaaaaaaaaaaaaaaaaguuaauguccaaaaaugacagauuuacaaguguaagcuauauga

SEQ ID NO: 53440 - RNA, 64 nt, Homo Sapiens
aagaaagcgaaugaauuugacaccuguugguuggaugacagaccacacagagggagagugacca

SEQ ID NO: 53441 - RNA, 64 nt, Homo Sapiens
gagacacugucucaaaaaaauacacuccagccugaugacagacccagugagcagagcgugccgc

SEQ ID NO: 53442 - RNA, 64 nt, Homo Sapiens
aaaacccugucucaaaaaaagcauuccagccuggaugacagagcugagcugagauugcaccacu

SEQ ID NO: 53443 - RNA, 64 nt, Homo Sapiens
uaaucaucuggaaaccgauuucaguggcgauggcaugacagagcuagagcucgggcccagcccc

SEQ ID NO: 53444 - RNA, 64 nt, Homo Sapiens
uagcugcuugccugauguguguaucaucggugggaugacagaacaaacauauuuaugaucauga

SEQ ID NO: 53445 - RNA, 64 nt, Homo Sapiens
gcaguuucuuguacacauuuggauacuuugaaagaugacagauuguuaaauccauucaauggua

SEQ ID NO: 53446 - RNA, 64 nt, Homo Sapiens
gaguuguguagacacagucuuaauguuucugguuaugacagauaaguuugcucaaaaaaugugg

SEQ ID NO: 53447 - RNA, 64 nt, Homo Sapiens
ucgcaucgucaaaagauuuuugcuuggaauaagcaugacagaaagauuuaaccuaaguguuaga

SEQ ID NO: 53448 - RNA, 64 nt, Homo Sapiens
uucuuuuuucucaaaaagaaacuguaggaaauacaugacagagaaaguuacacucagggagcag

SEQ ID NO: 53449 - RNA, 64 nt, Homo Sapiens
auuucacccucauuaccuucugcuuccaaggaauaugacagaucaccaggaugcugcucgucgu

SEQ ID NO: 53450 - RNA, 64 nt, Homo Sapiens
agccuuugaccuucccgcuauggaagugcacuggaugacagaaacugaauacauugcucccuuu

SEQ ID NO: 53451 - RNA, 64 nt, Homo Sapiens
acuguuugaaaucuggucuguuugcauuucuguuaugacagagagaugauguuugcauuucugu

SEQ ID NO: 53452 - RNA, 64 nt, Homo Sapiens
guuaugacagagagaugauguuugcauuucuguuaugacagagagaugaugaaaguaggcaggg

SEQ ID NO: 53453 - RNA, 64 nt, Homo Sapiens
cgggacuuuuuuucuuuuuucuuuuuuuuuugcuaugacagaguaaugcuaacguaaggacaac

SEQ ID NO: 53454 - RNA, 64 nt, Homo Sapiens
uucuggucuccaaguaucguuaagcacaggugcuaugacagaaaaaguucugggguggaaguuu

SEQ ID NO: 53455 - RNA, 64 nt, Homo Sapiens
aaaauaaauuuacuaaguacucccuuuuauuuuggucaugcaucuaugauauacauguuaaauu

SEQ ID NO: 53456 - RNA, 64 nt, Homo Sapiens
uaaagcaauuuucaaauguaguuuaugcugucuagucaugcacugaguacauaugcaaucacuc

SEQ ID NO: 53457 - RNA, 64 nt, Homo Sapiens
agcauuaauuacuacaaugaaacaucugugcugggucaugcauuaauaaggcucuucuguuuuc

SEQ ID NO: 53458 - RNA, 64 nt, Homo Sapiens
ugccccauuugauaauaaucagccuuagaacaaagucaugcagaugacccugaaaugaaccuua

SEQ ID NO: 53459 - RNA, 64 nt, Homo Sapiens
acagacauagcaagccuuguagucaacaguguaugucaugcagugauguuauauugguggcauc

SEQ ID NO: 53460 - RNA, 64 nt, Homo Sapiens
accgauauuuuuuuaucauggaaccagaacaucugucaugcaguguugucccuuccuaccuucu

SEQ ID NO: 53461 - RNA, 64 nt, Homo Sapiens
uauggaauggaacugcagcaaaugcaaacuugaagucaugcaaaaguaugaaauggauuucuuc

SEQ ID NO: 53462 - RNA, 64 nt, Homo Sapiens
acagaaagauccauaaagaugcagaguccgcccagucaugcacagacuccaguggaaguuuugc

SEQ ID NO: 53463 - RNA, 64 nt, Homo Sapiens
gucuguguuguguuaugugagaauuuucuccuaagucaugcagguaaugacaauauacuguaaa

SEQ ID NO: 53464 - RNA, 64 nt, Homo Sapiens
cagcucaucucugucccacuuggcaucagcuggcgucaugcaaagucaugcaaaggcugggacc

SEQ ID NO: 53465 - RNA, 64 nt, Homo Sapiens
cugucccacuuggcaucagcuggcgucaugcaaagucaugcaaaggcugggaccacgugagauc

SEQ ID NO: 53466 - RNA, 64 nt, Homo Sapiens
aacaaaauaaaaauuagcuuaauacuaucuuaggcucaaggagaaaaggagugguuucuggcug

SEQ ID NO: 53467 - RNA, 64 nt, Homo Sapiens
gggaaguggggcuauaggcaaggagcugagccugcucaaggaguaugggaagggggcaggggug

SEQ ID NO: 53468 - RNA, 64 nt, Homo Sapiens
caaaccaccccauugaacagaugaggaacugaggcucaaggagguuaaguaacauuuccagggu

SEQ ID NO: 53469 - RNA, 64 nt, Homo Sapiens
cccaacuuaccugcagacacuccuuuugcuaccacucaaggaaggaagucaccaguggccuuag

SEQ ID NO: 53470 - RNA, 64 nt, Homo Sapiens
uauuuuuuccuucuugaagaggcaccuaaugcuucucaaggacucgagguagguagcuaugaua

SEQ ID NO: 53471 - RNA, 64 nt, Homo Sapiens
acaauuucccucccuaucaaugggggcgagcaaccucaaggaacgaagggcugauuucaaaauc

SEQ ID NO: 53472 - RNA, 64 nt, Homo Sapiens
uggugucccugcaugaggcauacugggcgugcaccucaaggacccgcggguuuccggcugccug

SEQ ID NO: 53473 - RNA, 64 nt, Homo Sapiens
cccaugcccaccugagcccugugccaucuccagacucaaggacucacagggggccugugucaca

SEQ ID NO: 53474 - RNA, 64 nt, Homo Sapiens
accugccaaagauggagaagagugccagggaccccucaaggagggagacgcuccauaucccagg

SEQ ID NO: 53475 - RNA, 64 nt, Homo Sapiens
gauacaggagagaaucaagcguaaagucuuuguucucaaggaauuugcauucuagaaaguagaa

SEQ ID NO: 53476 - RNA, 64 nt, Homo Sapiens
agguagguaguucaaucuaguuguuagccaaggacucaaggacugaauuguuuuaacauaaggc

SEQ ID NO: 53477 - RNA, 64 nt, Homo Sapiens
ggaaaauaauacuuaucuuacaagguugcaagagcucaaggagaccauguauguaaaguuccug

SEQ ID NO: 53478 - RNA, 64 nt, Homo Sapiens
gauaaagcugggcggaaggagggugaagucacagcucaaggaaaaacaacucugagcacaugcu

SEQ ID NO: 53479 - RNA, 64 nt, Homo Sapiens
ugcagguggggggcucagccccccugacaguggccucaaggagcagguuucugccaauagacag

SEQ ID NO: 53480 - RNA, 64 nt, Homo Sapiens
uuucauaagacuauuuuaaauagaaauuauuucaacaauuaaaguaauguugaccaucccccuc

SEQ ID NO: 53481 - RNA, 64 nt, Homo Sapiens
agaucaguauuguaacguaugugaauagaugauaacaauuaauauuacuaaaagucccacauga

SEQ ID NO: 53482 - RNA, 64 nt, Homo Sapiens
ccuggucuaguuuccugggcaaaacugaccaaagacaauuaauuaaccagcaaguuguucauuu

SEQ ID NO: 53483 - RNA, 64 nt, Homo Sapiens
uuuagccaaugccacucaccuuuuuaaaaaggcuacaauuaaauguuaaaaugugaaauuguaa

SEQ ID NO: 53484 - RNA, 64 nt, Homo Sapiens
ugaguguaaugaaacaagguauucagggcuccucacaauuaaaagucgucacuacccuuuuugg

SEQ ID NO: 53485 - RNA, 64 nt, Homo Sapiens
cuauucuucuuuuagaaauuucccauuguugucaacaauuaaguuaauuugccuuuugauuccu

SEQ ID NO: 53486 - RNA, 64 nt, Homo Sapiens
aucuaaaaaagagaggagauagacuugagaggugacaauuaaaggcaucucaaaauguauagcc

SEQ ID NO: 53487 - RNA, 64 nt, Homo Sapiens
agaaauagguuuucuugaugccuuagcacuuagcacaauuaaauggaaaaccuaaagaguaaaa

SEQ ID NO: 53488 - RNA, 64 nt, Homo Sapiens
cugacauuaguaucugauaucagaaaauaaagauacaauuaaggaaucucugcauuguuucaug

SEQ ID NO: 53489 - RNA, 64 nt, Homo Sapiens
auugguuggaagauggagcuuacauaccaaugagacaauuaaaaacagccauuuaguccuaaua

SEQ ID NO: 53490 - RNA, 64 nt, Homo Sapiens
gcacauuguuggaccaugacuuugugugucaauuacaauuaaaacacagauuagcuguguaauu

SEQ ID NO: 53491 - RNA, 64 nt, Homo Sapiens
gacccccgucaacccacugcugaacaaacuagcaacaauuaaguuuaugcagugaaucucaguu

SEQ ID NO: 53492 - RNA, 64 nt, Homo Sapiens
aaaauuagcacaucccuuuaugugaaugucaucuacaauuaaaaggguacaggggaauuaugug

SEQ ID NO: 53493 - RNA, 64 nt, Homo Sapiens
cugauuuggguacaggggaacuuauauaagaaggacaauuaauggggaucccaaauucauggga

SEQ ID NO: 53494 - RNA, 64 nt, Homo Sapiens
guauuagaaaagguuuuagcugaaaugaggagucacaauuaaggauggaggugauauuuuccuc

SEQ ID NO: 53495 - RNA, 64 nt, Homo Sapiens
uauuugauauuaaaguaugagauagaguugagagacaauuaauuauccccucuuacacacaaac

SEQ ID NO: 53496 - RNA, 64 nt, Homo Sapiens
gaauugagucccuggucuaggaagggaucuaagcacaauuaaguugacguaucaguacuucuaa

SEQ ID NO: 53497 - RNA, 64 nt, Homo Sapiens
auuaugcuccccuuuucuugcuugguugaguaccacaauuaaaguucugcuguuuguuguccug

SEQ ID NO: 53498 - RNA, 64 nt, Homo Sapiens
cuaaaaugcuuaauccaauauuuugugucauuuuacaauuaaauuuggaaauagaugauuagau

SEQ ID NO: 53499 - RNA, 64 nt, Homo Sapiens
uacugacaucaaauuguugcaaaaaguuaaugacacaauuaagauuugauaaucuguucucuua

SEQ ID NO: 53500 - RNA, 64 nt, Homo Sapiens
gagcugagagggagcucaacccuggccucugcugggcccugaagcagcccagccccuugugagu

SEQ ID NO: 53501 - RNA, 64 nt, Homo Sapiens
cacacagcccagccccuuguggcugcaccccauaggcccugaggaaaugucugugcagugucag

SEQ ID NO: 53502 - RNA, 64 nt, Homo Sapiens
cccucagggcucauuccugggaggcccugaggguggcccugacccuaaagcaaacaguccuccu

SEQ ID NO: 53503 - RNA, 64 nt, Homo Sapiens
guggcccugacccccucaggaacaguccuccugaggcccugagggcauguuaucugcuaaagca

SEQ ID NO: 53504 - RNA, 64 nt, Homo Sapiens
ugugcagccuguccugggcugguggcucccggagggcccugagcugagggcauugcuuacacgg

SEQ ID NO: 53505 - RNA, 64 nt, Homo Sapiens
cugagggcauugcuuacacggaugccuuccccugggcccugacauuggagccugggcauccuca

SEQ ID NO: 53506 - RNA, 64 nt, Homo Sapiens
caauuguuuuugacugaguaaaacugauccagcuggcccugaacugggagguucauuuuccuuu

SEQ ID NO: 53507 - RNA, 64 nt, Homo Sapiens
ccaggcgugaguauggggaacaccccagugcacuggcccugacuuuuccuguuuggccccuguu

SEQ ID NO: 53508 - RNA, 64 nt, Homo Sapiens
aagucaggcuccuggcucugggucccauucccuaggcccugagcgaagaagcuggaucacucuu

SEQ ID NO: 53509 - RNA, 64 nt, Homo Sapiens
aauaaacccucagacccaggaugacaucugccugggcccugacccguggggacaacaggggcac

SEQ ID NO: 53510 - RNA, 64 nt, Homo Sapiens
acgagaagagccuccgcccggcacaccagaaaccggcccugagcaagagccaagcgcaucggga

SEQ ID NO: 53511 - RNA, 64 nt, Homo Sapiens
cggucuguggggacgagggaacagaggcucgccaggcccugaucccucacaccgcacggcaggc

SEQ ID NO: 53512 - RNA, 64 nt, Homo Sapiens
uggccugucccuagggcucuuuugggaaaggcagggcccugaaagccagugguggaggugggug

SEQ ID NO: 53513 - RNA, 64 nt, Homo Sapiens
ggccuuccuccucucaaaccggacaugagaguagggcccugacaggcaggccucccaagcugau

SEQ ID NO: 53514 - RNA, 64 nt, Homo Sapiens
ucugcugcaguggccgcccugggguggagauggaggcccugaccgccgggcucggggccccacc

SEQ ID NO: 53515 - RNA, 64 nt, Homo Sapiens
cacauccaggugcagcuggacugugccaccacguggcccugagcugaccagccagcugaucccu

SEQ ID NO: 53516 - RNA, 64 nt, Homo Sapiens
guggccucugcagaggggaccucagccugucacuggcccugaagacuggccccacuucuggucu

SEQ ID NO: 53517 - RNA, 64 nt, Homo Sapiens
gugaccagaacagggcagaguagguccccuccauggcccugaauccuccucugcuccagggcug

SEQ ID NO: 53518 - RNA, 64 nt, Homo Sapiens
cggaggcugugcuccgccaucacacccaggggaaggcccugagggccugagaagaaguggcugc

SEQ ID NO: 53519 - RNA, 64 nt, Homo Sapiens
ccucuggcuuucccaggagacccaccagacgucaggcccugacuagugcucaccagcccugcag

SEQ ID NO: 53520 - RNA, 64 nt, Homo Sapiens
cccuucuccagggccagguauggaacgaggcaguggcccugagcggcagcuggccuuccugggu

SEQ ID NO: 53521 - RNA, 54 nt, Homo Sapiens
gugggggaugcaccgaggccgccgggcccugaggagugggagaccuucgaguga

SEQ ID NO: 53522 - RNA, 64 nt, Homo Sapiens
ccccuccaccugccccagugcccagaccaaccaaggcccugacagcccugccuucugcccucug

SEQ ID NO: 53523 - RNA, 64 nt, Homo Sapiens
uguucccuaccuggguggccugcuccccugccugggcccugacuucagcucccuguagugaagu

SEQ ID NO: 53524 - RNA, 64 nt, Homo Sapiens
aagaggagaaccggcagcugcuggcugaaguucaggcccugagccgggagaacagggagcuccu

SEQ ID NO: 53525 - RNA, 64 nt, Homo Sapiens
ccugcaggaacacgaaacagaugccaaccgagagggcccugagguacaggaaccggagaaacgu

SEQ ID NO: 53526 - RNA, 64 nt, Homo Sapiens
gaccccaaggggaguccuuggacaaggaggccugggcccugagauccuccacggucagcgccgg

SEQ ID NO: 53527 - RNA, 64 nt, Homo Sapiens
cacugccuccugcaccuucaaccccagccaccaaggcccugacgggcagcgggcuucuccaccu

SEQ ID NO: 53528 - RNA, 64 nt, Homo Sapiens
uaagcugucuggccucucugggucaugcguuucuggcccugacacuggggucaggacaugucgg

SEQ ID NO: 53529 - RNA, 64 nt, Homo Sapiens
aggcauuguuccagcacggaggugaugugucacgggcccugacugagcuacagcgccaacgccu

SEQ ID NO: 53530 - RNA, 64 nt, Homo Sapiens
ccuagagcccuuccgccagcgccucugggacaguggcccugagcccaccccuuccugggauggg

SEQ ID NO: 53531 - RNA, 64 nt, Homo Sapiens
uguguggcugggcccugccccacaaccggaugcaggcccugacuuccugugagugcaccaucug

SEQ ID NO: 53532 - RNA, 64 nt, Homo Sapiens
aaucccgggcgccggcaagggcugagaccuuccaggcccugaggccugcaacccagggcagggg

SEQ ID NO: 53533 - RNA, 64 nt, Homo Sapiens
ccgcgccccacauuucugucccggcgggcgccccggcccugaaccccgcccgcgccccucccca

SEQ ID NO: 53534 - RNA, 64 nt, Homo Sapiens
ggcugcagccugcuuugggaagggcccggcccacggcccugagcuacacuucugacuggugauc

SEQ ID NO: 53535 - RNA, 64 nt, Homo Sapiens
gguggaccaccagccugggcagggcgggcuugaaggcccugaugaugggcucugcucugagagu

SEQ ID NO: 53536 - RNA, 64 nt, Homo Sapiens
ggacccaaagccucuuuuugccucccggaaucaaggcccugagggcagcaggaugguggccugg

SEQ ID NO: 53537 - RNA, 64 nt, Homo Sapiens
cuggcgcucuugaccccugauuccagugaggacuggcccugaggaguccuugcagaccugcugc

SEQ ID NO: 53538 - RNA, 64 nt, Homo Sapiens
uggcagcaggggucagggaagagagcggguggagggcccugaggagccgcuaaaaugggcaagg

SEQ ID NO: 53539 - RNA, 64 nt, Homo Sapiens
augccccgccuuaguuuuccgaggcaccugagguggcccugaagcagagguggaggcccgggga

SEQ ID NO: 53540 - RNA, 64 nt, Homo Sapiens
ucucaccugacuugaggugaauuuuggagugaagggcccugaggucagcucccaggucggucgu

SEQ ID NO: 53541 - RNA, 64 nt, Homo Sapiens
cugcucuccuuuggguguaugcagguguguggggggcccugaguggcaaguugcuuagcuaaca

SEQ ID NO: 53542 - RNA, 64 nt, Homo Sapiens
cuggcuuuauuuaccguggugguucagagucccaggcccugaccucuaaagacuuuucauaaca

SEQ ID NO: 53543 - RNA, 64 nt, Homo Sapiens
cugcacacccaccucuccgggggacuugacaaggggcccugaggccaagggaggucacuccucc

SEQ ID NO: 53544 - RNA, 64 nt, Homo Sapiens
gcggggugggggugacugaaugcccugccucccuuucugggagggcccuuccuccugaagccuc

SEQ ID NO: 53545 - RNA, 64 nt, Homo Sapiens
uguguucuugcugagcacccaacaccuucuuggcuucugggaccaauucaaugacagggaugcc

SEQ ID NO: 53546 - RNA, 64 nt, Homo Sapiens
uaugauggggcuucaagggacuaacuuacuguccuucugggaaccaaguacucuauucucugca

SEQ ID NO: 53547 - RNA, 64 nt, Homo Sapiens
augaaaacauggggacaaaaaaauuugagcuuaguucugggauuuaguuuagucaggacucaga

SEQ ID NO: 53548 - RNA, 64 nt, Homo Sapiens
aguaaguuugauuucauuaauagcagacaguguuuucugggauaugaccaggcauccuccacaa

SEQ ID NO: 53549 - RNA, 64 nt, Homo Sapiens
ucaguuuuaucauuuucaaacaaauagcauaaguuucugggaccguugcugaugaacucuuaau

SEQ ID NO: 53550 - RNA, 64 nt, Homo Sapiens
auaaacuuguauauggagaauuuauuugcugcuauucugggagagcuguacauccaauucaagu

SEQ ID NO: 53551 - RNA, 64 nt, Homo Sapiens
uuuuaaaugaaaauguggaauggauaguuuauauuucugggacuuacccaccuuaguuguaaau

SEQ ID NO: 53552 - RNA, 64 nt, Homo Sapiens
cgcucucugcugcucuuuccuguaagcccucgcguucugggaauucuuuugcuucucggggaac

SEQ ID NO: 53553 - RNA, 64 nt, Homo Sapiens
agaggcugccgcauucugcucccagauuccucgauucugggagguuuggggauguccugugccu

SEQ ID NO: 53554 - RNA, 64 nt, Homo Sapiens
uaaaugaugagaacacauggcuauguugaaaauuuucugggagcacuuuucucuccacuuuugu

SEQ ID NO: 53555 - RNA, 64 nt, Homo Sapiens
uugaaaguggggaaugaagauuguuuaaaauuaguucugggaagaaucauaucaucuuuagaaa

SEQ ID NO: 53556 - RNA, 64 nt, Homo Sapiens
ucaucaccuccaguuuguugcuugccucauaggcuucugggaugcaaaaugcaaaccuauuucc

SEQ ID NO: 53557 - RNA, 64 nt, Homo Sapiens
ucuucucacaggcccaauccggcagguuacagaguucugggauuauaauguaagaagcuuuggu

SEQ ID NO: 53558 - RNA, 64 nt, Homo Sapiens
cacauauuugaacagugaugaguuuggggcugguuucugggaagggaacguuuauuuaguaaag

SEQ ID NO: 53559 - RNA, 64 nt, Homo Sapiens
gucugcucccacugcagcucccggugcucucguguucugggaaggccugggugugugcacaagg

SEQ ID NO: 53560 - RNA, 64 nt, Homo Sapiens
ucgggccauaggggugagcagcugccuggaagaguucugggaaguauaacccuccauuuuuucu

SEQ ID NO: 53561 - RNA, 64 nt, Homo Sapiens
cuugaggugguucggauuacaguuuccaaaugcauucugggauugccuauuccagagaggguac

SEQ ID NO: 53562 - RNA, 64 nt, Homo Sapiens
gggcuccggggcggcagcagagcuggcacaccgauucugggaagccccgcgaaugauggcuuuu

SEQ ID NO: 53563 - RNA, 64 nt, Homo Sapiens
cuaaaagugaucugcccaccucggccucccaaaguucugggauuacgggcgugagccacuucac

SEQ ID NO: 53564 - RNA, 64 nt, Homo Sapiens
guuuagaauugggaggccuaucuggcuuguguuuuucugggacaacuauugcuaaguuuucuuu

SEQ ID NO: 53565 - RNA, 64 nt, Homo Sapiens
cacuucagccuuuccccuccauuuacuuagccgcuucugggagcaaagaauugaagcaaauugu

SEQ ID NO: 53566 - RNA, 64 nt, Homo Sapiens
agauaaaugaccacaguaccacacacuccuguuauucugggauaaacuaaagcuuccuguuuau

SEQ ID NO: 53567 - RNA, 64 nt, Homo Sapiens
uuuuuugggggcggggggguagcagaaaaugaauuucugggaacaaacaauuuugaugaauuua

SEQ ID NO: 53568 - RNA, 64 nt, Homo Sapiens
ugacaguuucuuugacauaucugggaaaugacuuuucugggaaauguagaagucauggacuuuu

SEQ ID NO: 53569 - RNA, 64 nt, Homo Sapiens
ugacuuuucugggaaaugacgaagucauggacuuuucugggaaacaguugguagaauccaugua

SEQ ID NO: 53570 - RNA, 64 nt, Homo Sapiens
ggccuucacuuuggagccacccaaaagcuggugauucugggacacucuccacuugcccaaacug

SEQ ID NO: 53571 - RNA, 64 nt, Homo Sapiens
uggggaaccuggucucaagguguccccacagccauucugggagccccuucccuccccguugucc

SEQ ID NO: 53572 - RNA, 64 nt, Homo Sapiens
caagaagaguaaacaggaaaccgcacccccucccuucugggaaacucccuccuccuguccuccc

SEQ ID NO: 53573 - RNA, 64 nt, Homo Sapiens
aacaacaucauuccaaaaagaauuggacagcuacuucugggaaagcucagcgcuuaaaaaaaca

SEQ ID NO: 53574 - RNA, 64 nt, Homo Sapiens
acugccccagggcuuugggggcggcacuugggguuucugggaaugacaucaucucuguucccca

SEQ ID NO: 53575 - RNA, 64 nt, Homo Sapiens
cuuuagcaggcugggcccuaggcaggaagcuggcuucugggagaggagugagaacgugcagggc

SEQ ID NO: 53576 - RNA, 64 nt, Homo Sapiens
auaaguuuacugaaucuucaggcuuuggagcagcuucugggaccuucugggaauccacagcucu

SEQ ID NO: 53577 - RNA, 64 nt, Homo Sapiens
ccacagcucuggcuuuggagaggaacaaaaugaauucugggaaucagucuuccgacaaacuaac

SEQ ID NO: 53578 - RNA, 64 nt, Homo Sapiens
cagucccgcgugcaaaggaagugcgugcgcgcgcuucugggaaagaugcagaucugcguggcug

SEQ ID NO: 53579 - RNA, 64 nt, Homo Sapiens
uccuagccccucacuuccagaugcccuguaauuuuucugggaagaccccagucaagcuccuagu

SEQ ID NO: 53580 - RNA, 64 nt, Homo Sapiens
aaguuuaauacauccaauaugucaaguuaaaccauucugggauuugcaaaguuuaauacaucca

SEQ ID NO: 53581 - RNA, 64 nt, Homo Sapiens; identical to SEQ ID NO: 53580

SEQ ID NO: 53582 - RNA, 64 nt, Homo Sapiens
aaguuuaauacauccaauaugucaaguuaaaccauucugggauuugggaacuucuuuaaaggaa

SEQ ID NO: 53583 - RNA, 64 nt, Homo Sapiens
gccaaggaggccuuggaaacgauucccccagucauucugggaacauguuguaagcacugacugg

SEQ ID NO: 53584 - RNA, 64 nt, Homo Sapiens
cucccuucuacagccucagaaaccagacucguucuucugggaacccugcccacucccaggacca

SEQ ID NO: 53585 - RNA, 64 nt, Homo Sapiens
aggacaguugaacucagaugggguucaugugggauucugggagcuuucugggaauucaguugga

SEQ ID NO: 53586 - RNA, 64 nt, Homo Sapiens
acucagaugggguucaugugggauucugggagcuuucugggaauucaguuggagucaagucagg

SEQ ID NO: 53587 - RNA, 64 nt, Homo Sapiens; identical to SEQ ID NO: 23154

SEQ ID NO: 53588 - RNA, 64 nt, Homo Sapiens; identical to SEQ ID NO: 23155

SEQ ID NO: 53589 - RNA, 64 nt, Homo Sapiens; identical to SEQ ID NO: 23156

SEQ ID NO: 53590 - RNA, 64 nt, Homo Sapiens; identical to SEQ ID NO: 23157

SEQ ID NO: 53591 - RNA, 64 nt, Homo Sapiens
uguaagauguugcacuaaaacuguuuuuuuaaaggaaaacuauuagagagcuguugauuuguuu

SEQ ID NO: 53592 - RNA, 64 nt, Homo Sapiens
caugcaugauguagagagcuaaaagaugggguaagaaaacuacccguuaauuauugaggaaaaa

SEQ ID NO: 53593 - RNA, 64 nt, Homo Sapiens
uuuuuggagauguuacugaacauaauuguuagaugaaaacuauuccugccuuucaaauuuguuu

SEQ ID NO: 53594 - RNA, 64 nt, Homo Sapiens
ugggaucauaguguuucugugaaauuuuaaaacugaaaacuacccuguacuuacuuuacaggaa

SEQ ID NO: 53595 - RNA, 64 nt, Homo Sapiens
uaaagggugauuuucuguuauauagugucuuuuggaaaacuacucuuuuaacugagcugcugcc

SEQ ID NO: 53596 - RNA, 64 nt, Homo Sapiens
accucaaagacagauguuacgugaucuauaguuugaaaacuaaauuaguugcaacuucuuuggg

SEQ ID NO: 53597 - RNA, 64 nt, Homo Sapiens
uuuuuaagugcuuauuuuuagcacccaaccccuggaaaacuaaagauugcaggcaugagccacu

SEQ ID NO: 53598 - RNA, 64 nt, Homo Sapiens
uuuuuuuuuucucuugagacgaaaacucauacuggaaaacuaaaaaauauaauugcgaauauca

SEQ ID NO: 53599 - RNA, 64 nt, Homo Sapiens
cagaacuuauuagaaacgauuccggauggcauuggaaaacuaaagaaacugucaaucuugaagg

SEQ ID NO: 53600 - RNA, 64 nt, Homo Sapiens
uuguuauuuuaacagacccugccuaaaagcauuggaaaacuaaagaaguugagcaacuugaaug

SEQ ID NO: 53601 - RNA, 64 nt, Homo Sapiens
agcaacacaguaaacagacagccuguagaauggggaaaacuauuugcaaacucugcaucugaug

SEQ ID NO: 53602 - RNA, 64 nt, Homo Sapiens
ucaaugaaaaaaaaugugguacauagauacgauggaaaacuaugcagccaugaaacacaagaaa

SEQ ID NO: 53603 - RNA, 64 nt, Homo Sapiens
auaaaauuagaaagaccuauaaccccaagaaagugaaaacuaauggucugcugauaaaauauuu

SEQ ID NO: 53604 - RNA, 64 nt, Homo Sapiens
gaagaaaacacuguaauugccauuaccaguguuggaaaacuaauuaguaauugcaucauaauua

SEQ ID NO: 53605 - RNA, 64 nt, Homo Sapiens
gaucaauauuuccagugaacacauuacaagaaaggaaaacuacaaauaccaaagccaggcaaaa

SEQ ID NO: 53606 - RNA, 64 nt, Homo Sapiens
aaaagaagagcaaauuaaauaagcuuccacuuuggaaaacuagacuagauuacacaaguaaucu

SEQ ID NO: 53607 - RNA, 64 nt, Homo Sapiens
aagaauaaagaaacuuaggacuauuuguucauuagaaaacuaugaucuuacucaggaaaacuaa

SEQ ID NO: 53608 - RNA, 64 nt, Homo Sapiens
uauuuguucauuagaaaacuauaaucuuacucaggaaaacuaacgaagaaugguuaacuuuuuu

SEQ ID NO: 53609 - RNA, 64 nt, Homo Sapiens
uauauggaguugcuuuaugaacauuaggauaucagaaaacuaaacuuaaaagguuuguggaaau

SEQ ID NO: 53610 - RNA, 64 nt, Homo Sapiens
uaaaauuguagacuuaaaaguugccucccugauggaaaacuauaaaaaagaaauuauauauauc

SEQ ID NO: 53611 - RNA, 64 nt, Homo Sapiens
agcagaaaauguaaaaugcucuucucauuuuauugaaaacuaagaccaaagugagcguuuaaau

SEQ ID NO: 53612 - RNA, 64 nt, Homo Sapiens
uuacuuauaaugcaaggaaucuaauauggguguugaaaacuagguagaaaaccacgcccacaug

SEQ ID NO: 53613 - RNA, 64 nt, Homo Sapiens
uuuccuuuuauuuuuuaguaaucaagaaaggcuggaaaacuacugaaaaacugaucaagcugga

SEQ ID NO: 53614 - RNA, 64 nt, Homo Sapiens
uuuuccugugguugaccuauacgaccaggauguagaaaacuagaaagaacugcccuuccucaga

SEQ ID NO: 53615 - RNA, 64 nt, Homo Sapiens
cauauuccaaaaguagauuugcuugcuaauaauagaaaacuacccuuacuuuguuccagccaaa

SEQ ID NO: 53616 - RNA, 64 nt, Homo Sapiens
gaaugcaaaacuuuugcuauuugacucaaagggggaaaacuaaacuguuuucucuuucaguuag

SEQ ID NO: 53617 - RNA, 64 nt, Homo Sapiens
caacagacuucucaauaaucaaugaaguagcugagaaaacuaagucagaaagugcauuaaacug

SEQ ID NO: 53618 - RNA, 64 nt, Homo Sapiens
caauguaaauauuacacaucaagcgaugaaacuggaaaacuacaagccacgaaugaaugaauua

SEQ ID NO: 53619 - RNA, 64 nt, Homo Sapiens
agaacagagaugagauuugaguaaauauuucugugaaaacuagguuguuucaaccuuuauuccu

SEQ ID NO: 53620 - RNA, 64 nt, Homo Sapiens
ggggcaggggaagugaaagggauuguuuuuaauagaaaacuaaaaauauagaugcuaugguuca

SEQ ID NO: 53621 - RNA, 64 nt, Homo Sapiens
ucaauuaauuauucaauuagucucuuccuaggaugaaaacuaaauaggauugaaaugauuuguu

SEQ ID NO: 53622 - RNA, 64 nt, Homo Sapiens
gcuuuuuuuuuucuuuuguuuugguuugguuuuggaaaacuaauuaauuagacuuguguggggg

SEQ ID NO: 53623 - RNA, 64 nt, Homo Sapiens
gaguguuccugagacagaauuaauggucauuugggaaaacuaucgccauggcuucccaucugug

SEQ ID NO: 53624 - RNA, 64 nt, Homo Sapiens
cccagacuaagguugaacaaccugcaugcccagagaaaacuauggcgacaaaggggaaaaggcc

SEQ ID NO: 53625 - RNA, 64 nt, Homo Sapiens
uugucuaaaauaaaaggcauuauuggaaauauuugaaaacuagaaaaugauggauaaaagggcu

SEQ ID NO: 53626 - RNA, 64 nt, Homo Sapiens
augcaggacuacccccuuaccauuuuaagaagguacuuuauacauuuauuuaauccuacuaaug

SEQ ID NO: 53627 - RNA, 64 nt, Homo Sapiens
aguaugaaugauuagagaaaauuugagucaguguacuuuauagugugaauccugugagcuaaua

SEQ ID NO: 53628 - RNA, 64 nt, Homo Sapiens
agcuggcugggcaguggaauuuugagcgaccuuuacuuuauacuuuucugugcuugacagauuu

SEQ ID NO: 53629 - RNA, 64 nt, Homo Sapiens
ugugcuugacagauuuucagccaugaccauguucacuuuauaaucaaaacaaaaauaaaggucc

SEQ ID NO: 53630 - RNA, 64 nt, Homo Sapiens
caauguauauaagacagguagugccugauuuacuacuuuauauaaaauaguaccuccuucaguu

SEQ ID NO: 53631 - RNA, 64 nt, Homo Sapiens
auuacacuacaguuuacuuuucagaauacuaaagacuuuauaacugcaugaacuuggauuuuuu

SEQ ID NO: 53632 - RNA, 64 nt, Homo Sapiens
guauacagauuuugcacgccguacgaccggcaugacuuuauauuaccuggagguugcauggacu

SEQ ID NO: 53633 - RNA, 64 nt, Homo Sapiens
ccuuugagggaaacccugaugucagcaagcgagcacuuuauauccuugggggcacuggcuggga

SEQ ID NO: 53634 - RNA, 64 nt, Homo Sapiens
guccauaauacaaaguaucagauuacaguauagaacuuuauagaucacuuuauauaaaugucuu

SEQ ID NO: 53635 - RNA, 64 nt, Homo Sapiens
aaugucuugauuacaguauaaaucccaaagugucacuuuauauaucuagcuuaugaggccaaau

SEQ ID NO: 53636 - RNA, 64 nt, Homo Sapiens
uuaguucuuuuuuccaaacucaugugcgcacauaacuuuauaugcaaugcaauuugcaugugca

SEQ ID NO: 53637 - RNA, 64 nt, Homo Sapiens
aauauuauuauuuaaguuaaauggaagcagcauuacuuuauaugaaagugaauuaaagugaauc

SEQ ID NO: 53638 - RNA, 64 nt, Homo Sapiens
aagcaaaggggcugaaaaacugaauaaggaaacaacuuuauaagagaaacaguggucuucaauc

SEQ ID NO: 53639 - RNA, 64 nt, Homo Sapiens
uauauucaccaauuucaggaaaaccaaccauagaacuuuauaauaggacaguuauaaccugacu

SEQ ID NO: 53640 - RNA, 64 nt, Homo Sapiens
gaaauggugagauguauguuuggcucugcuuuuaacuuuauaaauccagugaccucucucucug

SEQ ID NO: 53641 - RNA, 64 nt, Homo Sapiens
agacagguccugauuucuagaacccgugacuguuacuuuauacagcaaaggaaacuuugcagau

SEQ ID NO: 53642 - RNA, 64 nt, Homo Sapiens
gcccaacuucagaaaauacuauuguuuuucuaauacuuuauaggugauuauugcacauuauaaa

SEQ ID NO: 53643 - RNA, 64 nt, Homo Sapiens
uauucuucugaacuaagacaaaaagcaaaucaacacuuuauagugcaagaugugcagagggcau

SEQ ID NO: 53644 - RNA, 64 nt, Homo Sapiens
aagagacuugaagcugggugugugcguggccagaacuuuauaauagauuacaguugcgagccac

SEQ ID NO: 53645 - RNA, 64 nt, Homo Sapiens
uuuuuuuuuuuuuuuuuuuuucagaugaaggggaacuuuauaguuuuaaaaucacauucaauuu

SEQ ID NO: 53646 - RNA, 64 nt, Homo Sapiens
ucauagcugugguuauguuauuuuuuauuuaaaaacuuuauauuaaagucauuuguaauguuau

SEQ ID NO: 53647 - RNA, 64 nt, Homo Sapiens
gauuucaauucuuggauaaucaggcucuguuugcacuuuauauuuuagcagauacagucucuua

SEQ ID NO: 53648 - RNA, 64 nt, Homo Sapiens
ucucaauuuuuaaaccuuugcuguuaaaugcaauacuuuauaaagaaugaacaaaauuacugga

SEQ ID NO: 53649 - RNA, 64 nt, Homo Sapiens
gaaacuggcagucguauguuaguuucacuugucuacuuuauaugucugaucaauuuggauacca

SEQ ID NO: 53650 - RNA, 64 nt, Homo Sapiens
gaaaaacaaaagguuugaggaaaucaggcauaugacuuuauacuuaacaucagaucuuuucuau

SEQ ID NO: 53651 - RNA, 64 nt, Homo Sapiens
gaucuuuaugcuguuauuacaggagaagugacauacuuuauauauguuuauauuagcaaggucu

SEQ ID NO: 53652 - RNA, 64 nt, Homo Sapiens
uuuauauuagcaaggucuguuuuuaauaccauauacuuuauauuucuauacauuuauauuucua

SEQ ID NO: 53653 - RNA, 64 nt, Homo Sapiens
uauucucaagcagggcauguuuuuaacggcaagaacuuuauauuacuacauguucuacccagca

SEQ ID NO: 53654 - RNA, 64 nt, Homo Sapiens
cuacaaaggagagagauguauuaguaucacucuuacuuuauauucuguaaaaacuguuaaauau

SEQ ID NO: 53655 - RNA, 64 nt, Homo Sapiens
aggaguaacaaaaugucauuucugaaagaggcuuacuuuauaccaacuagugucagcauuuggg

SEQ ID NO: 53656 - RNA, 64 nt, Homo Sapiens
gcagcaguuugcaauacuaaaauauuuuuuauagacuuuauauuuuuccuuuugauaaagggau

SEQ ID NO: 53657 - RNA, 64 nt, Homo Sapiens
uaacuauauauaauuuucccaccacuaauaccacacuuuauauucaguucugugucuuacuuau

SEQ ID NO: 53658 - RNA, 64 nt, Homo Sapiens
acacaauagucagaaaacauuuuagaaauugaugacuuuauaaugcaaccaggaguauugaaaa

SEQ ID NO: 53659 - RNA, 64 nt, Homo Sapiens
cuuggagagugucaaauacauacuuugaggauugacuuuauauaaggugcccuguagaacucug

SEQ ID NO: 53660 - RNA, 64 nt, Homo Sapiens
uccaaaaucagccuucugucuguaacaaaaauguacuuuauagagauggaggaaaaggucuaau

SEQ ID NO: 53661 - RNA, 64 nt, Homo Sapiens
uauaauguguauaaucagagugccucuuauacauacuuuauagaauaaaggaacauuuugacag

SEQ ID NO: 53662 - RNA, 64 nt, Homo Sapiens
aauuucacucuacaaugcauauucuaaugaagcuacuuuauauaaauuggagagcuuauaaaau

SEQ ID NO: 53663 - RNA, 64 nt, Homo Sapiens
caucaacaagaucaccagugauauaugccagauuacuuuauaugauaacaucuugaauuuaacc

SEQ ID NO: 53664 - RNA, 64 nt, Homo Sapiens
uauuacuuaaaauuaaauggauuuuaaaaugagaacuuuauauagcuacaucccuacuaauaua

SEQ ID NO: 53665 - RNA, 64 nt, Homo Sapiens
aaucuugaguuuguucacuaggcccaaagucagaacuuuauaaauaugggacauuuuaucuucu

SEQ ID NO: 53666 - RNA, 64 nt, Homo Sapiens
aaguaguuuuugcauuuguuaaauagagaaccacacuuuauauaguuuuauauuuuauauugcu

SEQ ID NO: 53667 - RNA, 64 nt, Homo Sapiens
guaaagaagguagguauauuuaaaguaauauuucacuuuauauuagauacaaaaaauuuucauc

SEQ ID NO: 53668 - RNA, 64 nt, Homo Sapiens
uggugguuugaaguaucuugaaauuaagaagcugacuuuauauuucaaauaacuaaauuucaga

SEQ ID NO: 53669 - RNA, 64 nt, Homo Sapiens
uguuguaguuuauuuugugauuuuuuggaaucguacuuuauauuuccaaauuuaaauuuaaaug

SEQ ID NO: 53670 - RNA, 64 nt, Homo Sapiens
accgaacacuaguaccauugacucucguugaauaacuuuauauuuccauaauccugaauugugu

SEQ ID NO: 53671 - RNA, 64 nt, Homo Sapiens
uaaagagguauuuucuaauuaugcacagauaucuacuuuauacaaauacuuuauauggcuauuu

SEQ ID NO: 53672 - RNA, 64 nt, Homo Sapiens
ucuaauuaugcacagauaucuacuuuauacaaauacuuuauauggcuauuuuugagaaaacccu

SEQ ID NO: 53673 - RNA, 64 nt, Homo Sapiens
aaccagcaugccgauuucauaccuuaugcuacacagacauuaagaagagcagagcuggcacccu

SEQ ID NO: 53674 - RNA, 64 nt, Homo Sapiens
uuauuauauugaaggcuuuaauaaaggccacaggagacauuacuauagcauagauugucaaaug

SEQ ID NO: 53675 - RNA, 64 nt, Homo Sapiens
ggccuggaaguacuauaggacacagaggaagaccagacauuaugauccugauaaauauuaacau

SEQ ID NO: 53676 - RNA, 64 nt, Homo Sapiens
augucugggaaaauauuucucucaaauggcauuuagacauuagaggauugaagaagauugucua

SEQ ID NO: 53677 - RNA, 64 nt, Homo Sapiens
gcauacuaauauccaccugauuuauugacgaaguagacauuaggcaaagccaaacaauacucuu

SEQ ID NO: 53678 - RNA, 64 nt, Homo Sapiens
agacguccauagccuuagguauaucauuuauaccagacauuaugaaguuauuaaagucuccuau

SEQ ID NO: 53679 - RNA, 64 nt, Homo Sapiens
auggcaugacuuaagggaacaguucuuaauggggagacauuaucuuuuugggcaauacaaguua

SEQ ID NO: 53680 - RNA, 64 nt, Homo Sapiens
uguaaacuuaaaaauguuuaaaaagaccuuuuaaagacauuaaauaauagaacuuauagcuuuu

SEQ ID NO: 53681 - RNA, 64 nt, Homo Sapiens
cuauuccaccuuacucaagguguuauuaugccacagacauuaaccuauugugcauucagugaag

SEQ ID NO: 53682 - RNA, 64 nt, Homo Sapiens
auaugagauguaugaugaaacuuugcuaugaaaaagacauuaaaaggugagcauuauuuauaaa

SEQ ID NO: 53683 - RNA, 64 nt, Homo Sapiens
guagauucuucuugaaaucccacauccagaaacuagacauuagaauguugaggcaguuucccag

SEQ ID NO: 53684 - RNA, 64 nt, Homo Sapiens
cccuggcaggagacuaaucagauaggccggucucagacauuaauccuaccaucugauauuuuug

SEQ ID NO: 53685 - RNA, 64 nt, Homo Sapiens
ccauuucaaucucauucugguugagaggcuccugggcauugauugcuacagggagaugcucucu

SEQ ID NO: 53686 - RNA, 64 nt, Homo Sapiens
uggggcugggucaccaaaccgguccuagucugcuggcauugagccugaauaauggguuuuagcg

SEQ ID NO: 53687 - RNA, 64 nt, Homo Sapiens
gcacuugauuaagcuuuuguugcaaagaucccaaggcauugauuacacaugccccccagauugc

SEQ ID NO: 53688 - RNA, 64 nt, Homo Sapiens
ugccucuugaccuuccccuccgguuuuuggaucuggcauugaaaacagcugacugaaugcagaa

SEQ ID NO: 53689 - RNA, 64 nt, Homo Sapiens
uauaauuuuucucagccaauccauucacaagcuuggcauugacaugugcugcuaguuuauaaac

SEQ ID NO: 53690 - RNA, 64 nt, Homo Sapiens
cuuggcauugacaugugcugcuaguuuauaaacuggcauugacgaaaaucauuugaaucucuuc

SEQ ID NO: 53691 - RNA, 64 nt, Homo Sapiens
ucccugcaaggguccuuucuuugucaccagccaaggcauugauaaccaaguagccauuuuccuc

SEQ ID NO: 53692 - RNA, 64 nt, Homo Sapiens
gacuuucaugauuauccucagggacaggauuggaggcauugagcguguuuauuaacaaauuguu

SEQ ID NO: 53693 - RNA, 64 nt, Homo Sapiens
uagagcgagugccugccucgcauugggcauugauggcauugaacccucagcacccagcuugugc

SEQ ID NO: 53694 - RNA, 64 nt, Homo Sapiens
gcauugaacuagagcgagugagcuugugccauugggcauugauguugucaugcccucagcaccc

SEQ ID NO: 53695 - RNA, 64 nt, Homo Sapiens
ccugcuuccuacaggaguaggagccccaucuucuggcauugagucagccccaucucccggcauu

SEQ ID NO: 53696 - RNA, 64 nt, Homo Sapiens
cccaucuucuggcauugagucagccccaucucccggcauugagccuccuucucuagcugucaaa

SEQ ID NO: 53697 - RNA, 64 nt, Homo Sapiens
uauuuaugaauauauaaauccauuugguaauuuuucaugccacccagcgcaaguauuccauuug

SEQ ID NO: 53698 - RNA, 64 nt, Homo Sapiens
uggggucacagaugccuagcaccugcccuuuuauucaugccauucccuccccuggcucuuagca

SEQ ID NO: 53699 - RNA, 64 nt, Homo Sapiens
gcccuuugggcggccucugggcuugggcaccagcucaugccagccccagagggucaggguugga

SEQ ID NO: 53700 - RNA, 64 nt, Homo Sapiens
cagaggcuaacagauccaaugggaguccauggugucaugccaagacaguaucagacacagcccc

SEQ ID NO: 53701 - RNA, 64 nt, Homo Sapiens
ggcgcaaucucacugcaagcuccacuuccuggguucaugccauuuuccugccucagccucccga

SEQ ID NO: 53702 - RNA, 64 nt, Homo Sapiens
cauguuuagauguuggagcagauuagagcagcauucaugccacucggagcaaccagacuuacag

SEQ ID NO: 53703 - RNA, 64 nt, Homo Sapiens
uuaacagaucauuuauaaagcaggaguccauuuuaacacuuaccgacuuuuuuugguuuggaaa

SEQ ID NO: 53704 - RNA, 64 nt, Homo Sapiens
gaaucacauaauugucuuuggaacuuggucucccaacacuuauugugauugcaaaguguuuacc

SEQ ID NO: 53705 - RNA, 64 nt, Homo Sapiens
guugaguauauucaggggagauguuauuaaguuaaacacuuagaugacauuuugugauauuuga

SEQ ID NO: 53706 - RNA, 64 nt, Homo Sapiens
agcucuacacagucugugaggauagaugaguaucaacacuuacaccugaauauauauacagaua

SEQ ID NO: 53707 - RNA, 64 nt, Homo Sapiens
uacaacuguagugacagugaaaaaaccgaagaaaaacacuuaaggacaugaaaacugugcaagc

SEQ ID NO: 53708 - RNA, 64 nt, Homo Sapiens
uauuauagugccccuuuaagcuggcaauuagguuaacacuuacaccaggauggcauagagaaag

SEQ ID NO: 53709 - RNA, 64 nt, Homo Sapiens
cugcuucugagauaagaaccauuuguguaacaccaacacuuaacuucagaaagacaugcauuau

SEQ ID NO: 53710 - RNA, 64 nt, Homo Sapiens
ccaguugacuuuuaaauguaagaauggaauuccaaacacuuaacacauucagcuauaugacaga

SEQ ID NO: 53711 - RNA, 64 nt, Homo Sapiens
ucuauaauacccaugaaaugauaauuuguaaaauaacacuuagugauaucuggaaauaauaauu

SEQ ID NO: 53712 - RNA, 64 nt, Homo Sapiens
uuuaugaauauuaaaauuaucauuaauaauauaaaacacuuauuugagauuaaauuaaauuuuu

SEQ ID NO: 53713 - RNA, 64 nt, Homo Sapiens
aucguagaucucaaaggaucuugcuuuaacuuucaacacuuagaaaaucuacaaacauucagac

SEQ ID NO: 53714 - RNA, 64 nt, Homo Sapiens
ugcugguagaucuacugacuguagccaucaccagaacacuuaguuucuucccagacaugaauuu

SEQ ID NO: 53715 - RNA, 64 nt, Homo Sapiens
aauaaauaccacuuuuaaaaaugacacauauuuaaacacuuagaaaauaaaguuaacacuuacu

SEQ ID NO: 53716 - RNA, 64 nt, Homo Sapiens
augacacauauuuaaacacuuagaaaauaaaguuaacacuuacugaagugcuaguacuaaacug

SEQ ID NO: 53717 - RNA, 64 nt, Homo Sapiens
uuccacguuuuguagcccacugcaucuggauauauaccaguauuuucuuuuuuuuuuuuuuuga

SEQ ID NO: 53718 - RNA, 64 nt, Homo Sapiens
gggauuacaggcgucagccaccgcgccuggccuauaccaguauuuucuaguuuaaaggaggacu

SEQ ID NO: 53719 - RNA, 64 nt, Homo Sapiens
gauaauaugcucaguuuggaccuuuuuuucaguuaaaugcuaaauauaugaaaauuacuauacc

SEQ ID NO: 53720 - RNA, 64 nt, Homo Sapiens
aggaaccuucuuaaucucuucugugggauuuucaaaaugcuaaagacucacacugcagcaauca

SEQ ID NO: 53721 - RNA, 64 nt, Homo Sapiens
ugagaaaagugggacaaaauauacuuuugaaauaaaaugcuauauggcaccuaauuauuuuuuc

SEQ ID NO: 53722 - RNA, 64 nt, Homo Sapiens
auuacagcuguaaauuauaugagacuugccagucaaaugcuauuugguuuaaaaaaauuauugc

SEQ ID NO: 53723 - RNA, 64 nt, Homo Sapiens
uguuaacaugaaagucaaccacuggcuuugugaaaaaugcuaugucacuauucagaauaugcug

SEQ ID NO: 53724 - RNA, 64 nt, Homo Sapiens
agauauguacuucaugguuaaauucuaaaucugaaaaugcuagugggagauaucaagaaauuuu

SEQ ID NO: 53725 - RNA, 64 nt, Homo Sapiens
gaacaggcuuacaacauaggaagugaccaauuuaaaaugcuaggcuuaccacucccagaaacau

SEQ ID NO: 53726 - RNA, 64 nt, Homo Sapiens
gaaaaaccuuuguuuuggugcaugcucuucauauaaaugcuacacagauugagaauguuuuaca

SEQ ID NO: 53727 - RNA, 64 nt, Homo Sapiens
aaaaaaaaaaggccuaaugcauuauuuugucauaaaaugcuauuuuaaaauucauggaacuuuc

SEQ ID NO: 53728 - RNA, 64 nt, Homo Sapiens
aagaaucacugcacuuagcuguuggaauguuguuaaaugcuauggaaauacauuuagaaccugc

SEQ ID NO: 53729 - RNA, 64 nt, Homo Sapiens
aagcauucaaaucaaagcuaaaagccuaaaugugaaaugcuaaugacaagccugagaagguaaa

SEQ ID NO: 53730 - RNA, 64 nt, Homo Sapiens
uagauauuggaucaauauauuuaggugguauugaaaaugcuauuggaggagucacacuaauacu

SEQ ID NO: 53731 - RNA, 64 nt, Homo Sapiens
ggaaggauuuguuauguuuaaugcauacacgaagaaaugcuaacuuugaacaggaaguaggaac

SEQ ID NO: 53732 - RNA, 64 nt, Homo Sapiens
ugaaaguaauagagacugucgauuuuauuuuuuaaaaugcuaacgaaaauauaaaaucacagua

SEQ ID NO: 53733 - RNA, 64 nt, Homo Sapiens
uuaauaaaucuguaguguuuguuagggugugggaaaaugcuauacuuuuaaaguucuuuauagg

SEQ ID NO: 53734 - RNA, 64 nt, Homo Sapiens
auaauuugggagaaaauauuauuaaacuagucaaaaaugcuaaauuuuuggcaguguucauauu

SEQ ID NO: 53735 - RNA, 64 nt, Homo Sapiens
uaaugaacagaaauagcgcuaauuuucugcuuauaaaugcuaucauuaugaaaaggcuaaugca

SEQ ID NO: 53736 - RNA, 64 nt, Homo Sapiens
auuacagaaaucuucuauugaaugggaaagguuuaaaugcuaaccaaagcaauuuauuuuuaau

SEQ ID NO: 53737 - RNA, 64 nt, Homo Sapiens
aaagauaaauuuucauacauuaguagcuuauggaaaaugcuauugauguaucaauaaauuguua

SEQ ID NO: 53738 - RNA, 64 nt, Homo Sapiens
caggcagugcucuauaauuuagguuuucuacaccaaaugcuaccucauacaaaauaaucaaaau

SEQ ID NO: 53739 - RNA, 64 nt, Homo Sapiens
aaauauacacacacacucacugccacaaaacuucaaaugcuacaauucaauuugauagaaaucu

SEQ ID NO: 53740 - RNA, 64 nt, Homo Sapiens
ccaaucugaaugauuacuucaguaacacaugaaaaaaugcuacuuggaaaggaauggaaaauau

SEQ ID NO: 53741 - RNA, 64 nt, Homo Sapiens
cucaagucaucuuucuugcuuaggauuuaaauagaaaugcuauuuuuauuaauuuauuuuccaa

SEQ ID NO: 53742 - RNA, 64 nt, Homo Sapiens
ugaaaaaaagacuuggccagaaaugcuaauauaaaaaugcuaaggaaaggguggggaugauaag

SEQ ID NO: 53743 - RNA, 64 nt, Homo Sapiens
auaaaaaugcuaagugaaaaguggggaugauaagaaaugcuaauuacaaacugucaaagaaagg

SEQ ID NO: 53744 - RNA, 64 nt, Homo Sapiens
acaacacauuuuuaguuuuaaccaguuguagucaaaaugcuacaauaaaacaaaaaagagaaag

SEQ ID NO: 53745 - RNA, 64 nt, Homo Sapiens
cauucuuaacaguaugugcccauuugcaaaacaaaaaugcuaauaaucaguaauaguccuauaa

SEQ ID NO: 53746 - RNA, 64 nt, Homo Sapiens
gucuagcccuggguaagggcguaguucaacaugcaaaugcuagguauuugcacuuaaaaucaaa

SEQ ID NO: 53747 - RNA, 64 nt, Homo Sapiens
aaaagcugccucauacauacugugaguccugauuaaaugcuaguuuuuaguggaaagauugggg

SEQ ID NO: 53748 - RNA, 64 nt, Homo Sapiens
gucuguugguuccaauauuccacugacagagaaaaaaugcuacuucucuugccuucaacaagca

SEQ ID NO: 53749 - RNA, 64 nt, Homo Sapiens
aaagacuuuguuuaaagauuaucagcagcaauugaaaugcuacagaaacaguaucuucaaaaaa

SEQ ID NO: 53750 - RNA, 64 nt, Homo Sapiens
guugauccucaucugucugguuucagagggagagaaaugcuacaggguaccuaucccagccacg

SEQ ID NO: 53751 - RNA, 64 nt, Homo Sapiens
cacugucuuaagagguagaguaucuuggcacacuaaaugcuaagacauacauacaaacauaggc

SEQ ID NO: 53752 - RNA, 64 nt, Homo Sapiens
guaauuaaccaacgaaaaagcuuuccggacuuuuaaaugcuaacuguuuuuccccuuccugucu

SEQ ID NO: 53753 - RNA, 64 nt, Homo Sapiens
aaaugcuaacuguuuuuccccuuccugucuaggaaaaugcuauaaagcucaaauuaguuaggaa

SEQ ID NO: 53754 - RNA, 64 nt, Homo Sapiens
uauauacaucuguaguuauuauuuguggacaguuaaaugcuaauaugauaggauuuccuaaagu

SEQ ID NO: 53755 - RNA, 64 nt, Homo Sapiens
uaauauacaucuguaguuauauuuguggacaguuaaaugcuaauaugauaggauuuccaaaagu

SEQ ID NO: 53756 - RNA, 64 nt, Homo Sapiens
cauggagaaucugcucuguuugaacaguagagcgaaaugcuagauauugaugcacggaugcuuu

SEQ ID NO: 53757 - RNA, 64 nt, Homo Sapiens
aaauggugaaagcuuccuucaaaaaaaaaaaaaaaaaugcuauauaaaaaaaaaaaaaaaaaaa

SEQ ID NO: 53758 - RNA, 64 nt, Homo Sapiens
uggauaauaucuacaugaauccggcaagcauauaaaaugcuacuuucauucuaucucagaguua

SEQ ID NO: 53759 - RNA, 64 nt, Homo Sapiens
ccauuauaagccaguggaguaggcucugaaaucaaaaugcuacggugguuuauuuuauuuuggu

SEQ ID NO: 53760 - RNA, 64 nt, Homo Sapiens
uacugcaaauagaccgcagacauaaauaucuaccaaaugcuaucuuaaauuuugguccaaacug

SEQ ID NO: 53761 - RNA, 64 nt, Homo Sapiens
ugcuuuuagaagucuuuuucuuuguaagcauuguaaaugcuaauaaauccuguuaauuuuuuuu

SEQ ID NO: 53762 - RNA, 64 nt, Homo Sapiens
auccagugaggguucaaacuuccaauugccucauaaaugcuacuuguuuuauuauuuuuaauua

SEQ ID NO: 53763 - RNA, 64 nt, Homo Sapiens
ucuuuguagaguuacuaagcauuagcaaaggaggaaaugcuauguaauagaaauauuauucaau

SEQ ID NO: 53764 - RNA, 64 nt, Homo Sapiens
cccucagacauucuccucauggcacauuuucuucaaaugcuaacauuuacugaguguacauuga

SEQ ID NO: 53765 - RNA, 64 nt, Homo Sapiens
aacaucugaagguuuaguauauuagaaacacccaaaccaguaauaugcuaaccugaugcacugc

SEQ ID NO: 53766 - RNA, 64 nt, Homo Sapiens
guuuugccaacuuuaaaugcuuaaacauaagcgaaaccaguagcaaguaugugggucagcuuaa

SEQ ID NO: 53767 - RNA, 64 nt, Homo Sapiens
uuauuuuuugccacggagaucauuauauugucccaaccaguaguggacugacuuuaauaauuug

SEQ ID NO: 53768 - RNA, 64 nt, Homo Sapiens
gauuugcuuuucuaagccucucuugugugugaugaaccaguaugauuuuagccagguauuucuu

SEQ ID NO: 53769 - RNA, 64 nt, Homo Sapiens
ccaucaaaauguaagcugugucuucugcagacacuguggguagcgaauuaguggagcuuuugua

SEQ ID NO: 53770 - RNA, 64 nt, Homo Sapiens
ugugaggacugggggcaccuuuaggggaaguauguguggguacaguguggugugugugcuuggu

SEQ ID NO: 53771 - RNA, 64 nt, Homo Sapiens
auuguccccugacuauccccagcccugaaaaaaagagcaggaggggacaccccuccauaugccc

SEQ ID NO: 53772 - RNA, 64 nt, Homo Sapiens
ucuccgugaccuuucucuagccagggagaagggagagcaggaguauuggggcugggcccugggg

SEQ ID NO: 53773 - RNA, 64 nt, Homo Sapiens
ucuucagucccaguagacucugcucccuagcccugagcaggaggcugggagcagcucuguuucc

SEQ ID NO: 53774 - RNA, 64 nt, Homo Sapiens
ugaugagcuaagauccagccccagaauccuggaggagcaggagguagcaggagaggaccagguc

SEQ ID NO: 53775 - RNA, 64 nt, Homo Sapiens
gggcccugccugagggugggcuuuucccuggguggagcaggacucccaccuaaacggggcagua

SEQ ID NO: 53776 - RNA, 64 nt, Homo Sapiens
uuaaggcguggcuucugcaggaaucccggcuccagagcaggaaauucagcccaccagccaccuc

SEQ ID NO: 53777 - RNA, 64 nt, Homo Sapiens
cggcauugcgcgucuacagcaugacacacgcaaggagcaggagacaccugccgcgugcaccugc

SEQ ID NO: 53778 - RNA, 64 nt, Homo Sapiens
uccguaggcagccgggcgggugaagcagaagaucgagcaggagcggccaagaagauggaguucc

SEQ ID NO: 53779 - RNA, 64 nt, Homo Sapiens
ggcagugagugucacacaccuguuaauccaucuugagcaggacaguacuauacaaauagaaugc

SEQ ID NO: 53780 - RNA, 64 nt, Homo Sapiens
aagauugugccacugcacuccagccugggugacagagcaggacccugucucuauuuuauaaauu

SEQ ID NO: 53781 - RNA, 64 nt, Homo Sapiens
aaagggaaacuggugggauauggaacauggcucugagcaggacuguugagcucacauaguguuc

SEQ ID NO: 53782 - RNA, 64 nt, Homo Sapiens
uugagcucacauaguguucugacuccaaaucugggagcaggagaauguguaaacaagaauaaag

SEQ ID NO: 53783 - RNA, 64 nt, Homo Sapiens
cauguuagucuuuaauucacugaagaaaaaugaagagcaggauggccaggcauuacuacuauca

SEQ ID NO: 53784 - RNA, 64 nt, Homo Sapiens
gaaguuuucauuccucuaccaguggugcuugacagagcaggacuuaaaagaauuaaaaaaggac

SEQ ID NO: 53785 - RNA, 64 nt, Homo Sapiens
cuggcaagagcucuuugucugaaccagcccuccagagcaggagaggugccuccucuggggaagg

SEQ ID NO: 53786 - RNA, 64 nt, Homo Sapiens
uuaggcccgggccccuggcaugagugcagaggcugagcaggacggccagggcccgaccuggggc

SEQ ID NO: 53787 - RNA, 64 nt, Homo Sapiens
ugacuagaaucuggauccugacgccugcagcugagagcaggagcaggaaaaggaggcucagcac

SEQ ID NO: 53788 - RNA, 64 nt, Homo Sapiens
gaaucuggauccugacgccugcagcugagagcaggagcaggaaaaggaggcucagcacugucuc

SEQ ID NO: 53789 - RNA, 64 nt, Homo Sapiens
gaaaagagagaucuacuuugguuucauuuuaauggagcaggagaucuuuuucauuuucauggag

SEQ ID NO: 53790 - RNA, 64 nt, Homo Sapiens
cugaaaucgauauuaauuccgagaaacuuugaaggagcaggagauaagucucgccaucgucaaa

SEQ ID NO: 53791 - RNA, 64 nt, Homo Sapiens
cuuauaaccuguggucauuacucccugagaaucugagcaggagcagucaagucauacuuggccu

SEQ ID NO: 53792 - RNA, 64 nt, Homo Sapiens
uggaauaugcgggucacacuaaauaagcaagacagagcaggaaaaucauacucuuguuucuuag

SEQ ID NO: 53793 - RNA, 64 nt, Homo Sapiens
uuacauuaagggcccugggggagaauaaagcucagagcaggagggaguaaggaaacauuuccuu

SEQ ID NO: 53794 - RNA, 64 nt, Homo Sapiens
augaaguucuuucucugugcagcuuucccccuuggagcaggagugaagauguuucauuaucuug

SEQ ID NO: 53795 - RNA, 64 nt, Homo Sapiens
gccagguggggcuagguguggcugggggccaggagagcaggaacagaacagagaaaugcccuug

SEQ ID NO: 53796 - RNA, 64 nt, Homo Sapiens
gagcugaguaggccagguaggcgauuggaagagugagcaggacacagaggggaggggaauguuu

SEQ ID NO: 53797 - RNA, 64 nt, Homo Sapiens
uaaauaugaccucaguguccuauaaauaauguaagagcaggauuugaaacuuggagagcuguuu

SEQ ID NO: 53798 - RNA, 64 nt, Homo Sapiens
ccagcugccuuugaucaagauucgggugcaaguggagcaggagccauauaccuggagggaaugu

SEQ ID NO: 53799 - RNA, 64 nt, Homo Sapiens
agguugcuggagcaagaggagucgccugaaccaagagcaggaaggcaagaaaaugagggcuuga

SEQ ID NO: 53800 - RNA, 64 nt, Homo Sapiens
agguugcugagauuguuggagucgccugaacgaagagcaggaagggaagaaaaugagggcuuga

SEQ ID NO: 53801 - RNA, 64 nt, Homo Sapiens
agguugcucagguuguuggagucaccugaaccaagagcaggaagggaagaaaaugagggcuuga

SEQ ID NO: 53802 - RNA, 64 nt, Homo Sapiens
cacacccuggacgggaagggacagcugcauuccagagcaggaggcagggcucuggggccagaau

SEQ ID NO: 53803 - RNA, 64 nt, Homo Sapiens
cugguggccugccccagcucucuucuggcuuucugagcaggaagcgagcagaggcuccacaggc

SEQ ID NO: 53804 - RNA, 64 nt, Homo Sapiens
uuuugcaacaaaaagcugacccagaggccauacagagcaggaauaucccauugcccccuccucc

SEQ ID NO: 53805 - RNA, 64 nt, Homo Sapiens
gcuucuguugucuaacguauggcaggcagacugggagcaggaaaacagagggccccaaagccca

SEQ ID NO: 53806 - RNA, 64 nt, Homo Sapiens
aguaaacuuuacugaaacaucuucugaaugaguagagcaggaaaauucauucagaaaguugcca

SEQ ID NO: 53807 - RNA, 64 nt, Homo Sapiens
uggcgggugucuuccugcggccugaccccacccagagcaggagcgcagcugcucugcucaccag

SEQ ID NO: 53808 - RNA, 64 nt, Homo Sapiens
auucugaaguguauucuacagcuucauuguccuugagcaggacacaauaaggagcaggaccuca

SEQ ID NO: 53809 - RNA, 64 nt, Homo Sapiens
ucagcuucauuguccuugagccugagucaauaaggagcaggaccauguccccaggagcagcaac

SEQ ID NO: 53810 - RNA, 64 nt, Homo Sapiens
aauugacucaagcuauuuaacucgcacggccuuggagcaggaggugggucuggcaugcugcuau

SEQ ID NO: 53811 - RNA, 64 nt, Homo Sapiens
gggacccacuguugcccuggaccucagcgggaaggagcaggagagagcugcugucagugagaau

SEQ ID NO: 53812 - RNA, 64 nt, Homo Sapiens
cucugugucguguuugcuguggccgcagggagaggagcaggacacgcaccuuuccaggggccuc

SEQ ID NO: 53813 - RNA, 64 nt, Homo Sapiens
gaccuuuguuucacuugccucugcucgacuccgagagcaggaaacccggccguggccuggcagc

SEQ ID NO: 53814 - RNA, 64 nt, Homo Sapiens
ggggcaagaguuugaaaauauuguggggguacaagagcaggaguuaccaaccccuggauuuucc

SEQ ID NO: 53815 - RNA, 64 nt, Homo Sapiens
cuugcacuucacacuucuugaccuauagcuugcugagcaggaacucagggaccucaccugucgg

SEQ ID NO: 53816 - RNA, 64 nt, Homo Sapiens
ucuccuccucaaaaacugauccuauaaaucuuggaggaaucauucuccuuucuuuugggugcug

SEQ ID NO: 53817 - RNA, 64 nt, Homo Sapiens
auuuacaagguggacaaauguuguguggaagaggaggaaucaccucuugaccuaccccagauau

SEQ ID NO: 53818 - RNA, 64 nt, Homo Sapiens
ucauagaaaaaguagguacacguaaaucuguucaaggaaucauuguuuggcauugaaaauagga

SEQ ID NO: 53819 - RNA, 64 nt, Homo Sapiens
gagauacagcucagagugccacgcccccagaaagaggaaucaggcaaguacugucccaaggcag

SEQ ID NO: 53820 - RNA, 64 nt, Homo Sapiens
aaaagacuuagaauagucagcuauccugagcaaaaggaaucaaacuggaggaaucauauuaccu

SEQ ID NO: 53821 - RNA, 64 nt, Homo Sapiens
agucagcuauccugagcaaaaggaaucaaacuggaggaaucauauuaccugacuuccaauuauu

SEQ ID NO: 53822 - RNA, 64 nt, Homo Sapiens
aaucccccuucuaccaggcuaacacagaauuauaaggaaucagaaagcucucccuuacagaggc

SEQ ID NO: 53823 - RNA, 64 nt, Homo Sapiens
agucaccccagcugcugggcaggggucguguccaaggaaucaagaugggugugugugugacugc

SEQ ID NO: 53824 - RNA, 64 nt, Homo Sapiens
aucauuucaggagaaaaccacauucauguuuuuuaggaaucagaaugccauuuugcuauagacu

SEQ ID NO: 53825 - RNA, 64 nt, Homo Sapiens
uggaauugaagacacguucuauggaugcugcuggaggaaucaguucacuuguauuauuauuuga

SEQ ID NO: 53826 - RNA, 64 nt, Homo Sapiens
uacuugaaguugcuuuuuugacucuuuuggacaaaggaaucaaugcauauacuuuaauguuuua

SEQ ID NO: 53827 - RNA, 64 nt, Homo Sapiens
aauaguaacucuuucuuuccuuagacacagcccgaggaaucaacaccauucagaauaucaucuu

SEQ ID NO: 53828 - RNA, 64 nt, Homo Sapiens
gggauagaugugcuagucuucuagcauaggagcaaggaaucagaggugggguuaaaggcauuuu

SEQ ID NO: 53829 - RNA, 64 nt, Homo Sapiens
uacgugugggcacuugugcuugagccuguauuaaaggaaucaggccaggcacaguggcucacgc

SEQ ID NO: 53830 - RNA, 64 nt, Homo Sapiens
cugcacagaaacacuaugaacucaaaaacaugagaggaaucacacuucaguuaccacuguacug

SEQ ID NO: 53831 - RNA, 64 nt, Homo Sapiens
cuguacagaaacgcuaugaacucgagcacaugaaaggaaucacacuucauuuaccgccauucug

SEQ ID NO: 53832 - RNA, 64 nt, Homo Sapiens
guccuuucuccaguuuuuguucauugcuuucugaaggaaucauuaaguaacaaccugaauugag

SEQ ID NO: 53833 - RNA, 64 nt, Homo Sapiens
ugcuuuuauguccacuuuuuagugaugggcaaacaggaaucacucucagcuauguagcugauau

SEQ ID NO: 53834 - RNA, 64 nt, Homo Sapiens
ggaaagugauuuuaaaggugucacuuaggaucgcaggaaucagggcagcaaauuugacuugaau

SEQ ID NO: 53835 - RNA, 64 nt, Homo Sapiens
uaauucaucaugauuuaaauuugugaaauucuaaaggaaucaaauuguuauuagcuuuguggcu

SEQ ID NO: 53836 - RNA, 64 nt, Homo Sapiens
gagguacuuugcuuggauuggaagggucuugauaccuacucaguagaaugauggaauucugccu

SEQ ID NO: 53837 - RNA, 64 nt, Homo Sapiens
cuggaaaugccgaugcaauucuaagaagauaagaccuacucaagccuuggcuucugagcauccg

SEQ ID NO: 53838 - RNA, 64 nt, Homo Sapiens
uugugacugcccaggacucucagguugggcuggcccuacucaggauuacacugaaaguaauggc

SEQ ID NO: 53839 - RNA, 64 nt, Homo Sapiens
cccacauguuuuggccauggauaaagugaagaggccuacucaccauuaucccugcagcgugaca

SEQ ID NO: 53840 - RNA, 64 nt, Homo Sapiens
cccuugaggcuauuaggagaccucucuccuccccccuacucaggauaaagauuccaccuccagu

SEQ ID NO: 53841 - RNA, 64 nt, Homo Sapiens
cuauaccuuccuguaccugggcuggucuccuuuuccuacucauaggggauggaugggcugguca

SEQ ID NO: 53842 - RNA, 62 nt, Homo Sapiens
cuacuccuuccuguagagcagaaauuguauuuugcacgaacaugcaguuauugaagauuagg

SEQ ID NO: 53843 - RNA, 62 nt, Homo Sapiens
aggguguaaguauuccaccagcccgcugagugugcacgaaauguucgcagugcaacaaaaag

SEQ ID NO: 53844 - RNA, 62 nt, Homo Sapiens
ucuuuuuuuuuaaaacugucugguggcuuaaaugcacgaaugauauuagagucagagacuaa

SEQ ID NO: 53845 - RNA, 62 nt, Homo Sapiens
cacaaugcaccauccaugagauggccauggaaugcacgaaguuccuuugguugccauaugga

SEQ ID NO: 53846 - RNA, 62 nt, Homo Sapiens
uggagaaccugacagggcugacccagucucaaugcacgaaguaaacccguaggcacggacac

SEQ ID NO: 53847 - RNA, 62 nt, Homo Sapiens
cccgccgaaacugcugcgagcagcacagcaccugcacgaacacgugcugcagcgacaggcgg

SEQ ID NO: 53848 - RNA, 62 nt, Homo Sapiens
guggcccaggagagaggaucccuugcccucaaugcacgaaagugggcugguacaggccucag

SEQ ID NO: 53849 - RNA, 62 nt, Homo Sapiens
gucacuuuuuaugcuauuucuguauauaaaggugcacgaagguaaaaaguauuuuuucaagu

SEQ ID NO: 53850 - RNA, 62 nt, Homo Sapiens
uuucucucuugccuugaggaccaaagucugagugcacgaaaaugaaagacaugagugcccuc

SEQ ID NO: 53851 - RNA, 62 nt, Homo Sapiens
aaacugaaucaagaaaugaaugcuccaugaaaugcacgaagucuguuuuaaugacaagguga

SEQ ID NO: 53852 - RNA, 62 nt, Homo Sapiens
ccccgccuaccuguacucguggccguaccugaugcacgaacaugcuggugccaaccucuggu

SEQ ID NO: 53853 - RNA, 62 nt, Homo Sapiens
auggacauaaauccaaguuguggauagcuauuugcacgaaucuuaggguggcuguccauccc

SEQ ID NO: 53854 - RNA, 62 nt, Homo Sapiens
uuaaaacauggcaauaaaugcuucagauauuuugcacgaauuuuuguauucucuguccaggg

SEQ ID NO: 53855 - RNA, 62 nt, Homo Sapiens
augugaguugcacagcuaugaaggcuguacacugcacgaauggaagaggcaccugucccaga

SEQ ID NO: 53856 - RNA, 62 nt, Homo Sapiens
ccaacacaugccuucccuccccagccacaccgugcacgaagggggcacaggagaggagaggg

SEQ ID NO: 53857 - RNA, 62 nt, Homo Sapiens
uccagaaccuggaaccuagaggccuuucucucugcacgaaaaacagguaguuugcagucuga

SEQ ID NO: 53858 - RNA, 62 nt, Homo Sapiens
guacuguaauuuugaauggaacugaaaaauuaugcacgaauaaaguacuuuucucaugccau

SEQ ID NO: 53859 - RNA, 62 nt, Homo Sapiens
cagcugccaauaauaucuaauauuuuucaucaugcacgaauuaauaaucaucauacucuaga

SEQ ID NO: 53860 - RNA, 62 nt, Homo Sapiens
ugacagcccugaucuguauuccuugaguggccugcacgaacacuggaauccacuaugguuua

SEQ ID NO: 53861 - RNA, 62 nt, Homo Sapiens
uuacuauagauaauauauguggccuuaugauaugcacgaauuaguugaaguacaaauuaaua

SEQ ID NO: 53862 - RNA, 62 nt, Homo Sapiens
cuggccucuugcuuggcguggcugcccuucuuugcacgaagcguuggcgcucggggcgagau

SEQ ID NO: 53863 - RNA, 62 nt, Homo Sapiens
guagugcagcuguggguggaggcuggggugucugcacgaagucaggccagcguccuccucca

SEQ ID NO: 53864 - RNA, 62 nt, Homo Sapiens
augucuuuuaaauuaaaauauaccaacaguuuugcacgaacaaagggauguuuuguaagaac

SEQ ID NO: 53865 - RNA, 62 nt, Homo Sapiens
ggcugaugggaaccauuucacccuuggauuccugcacgaaguguguguguauguuucuuagc

SEQ ID NO: 53866 - RNA, 62 nt, Homo Sapiens
aggaacugggguugcuaaccagggaaccacaaugcacgaaagggcuggguuaacguuuucuc

SEQ ID NO: 53867 - RNA, 62 nt, Homo Sapiens
cagccuucagcacaggcaacuguuacugagucugcacgaacuuagauaaugaggugcagggu

SEQ ID NO: 53868 - RNA, 62 nt, Homo Sapiens
ucccauauuguuuggagacuuccagauggcucugcacgaaggagaaccacgcauuuaugaag

SEQ ID NO: 53869 - RNA, 62 nt, Homo Sapiens
caugaauguauuguaaauaagggaugggcaguugcacgaaggggcucccuguuggcuacgca

SEQ ID NO: 53870 - RNA, 62 nt, Homo Sapiens
gacuuuccaaauauggaacuaacuggagaaggugcacgaaggagacaccacuuggggaccuc

SEQ ID NO: 53871 - RNA, 62 nt, Homo Sapiens
gaagauccaagcuucgaaagagcacgaccuacugcacgaaggggucaaagugaggggaaaaa

SEQ ID NO: 53872 - RNA, 62 nt, Homo Sapiens
uuaauuuacucauguccacgguguagcugacaugcacgaaguugagaaaggagacgaugaac

SEQ ID NO: 53873 - RNA, 62 nt, Homo Sapiens
ccuucaggcucuguugcucccuccucugcagcugcacgaaggcgccaucuggugucugcaug

SEQ ID NO: 53874 - RNA, 62 nt, Homo Sapiens
cccuggccuccagagguggcgugggcuggcuuugcacgaagguugugcugggagaccggacc

SEQ ID NO: 53875 - RNA, 62 nt, Homo Sapiens
gugaaguucuuugucacuguugaccaaagaaaugcacgaaaucauucuaaugaaagaaaaug

SEQ ID NO: 53876 - RNA, 62 nt, Homo Sapiens
uugaacauucguuauggggaacagcagagugaugcacgaacuuucccgguuauguguaggga

SEQ ID NO: 53877 - RNA, 62 nt, Homo Sapiens
caagaaccaaacagcucaggagcuacgcucugugcacgaagugugggucccugacaaagaag

SEQ ID NO: 53878 - RNA, 62 nt, Homo Sapiens
uuucauuguuaauguauauuuguuuuacucuuugcacgaaacuguggcacaaaaagggaaca

SEQ ID NO: 53879 - RNA, 62 nt, Homo Sapiens
gaaaugccucuucuuuauguacaaagauuauuugcacgaacuggacugugugcaacgcuuuu

SEQ ID NO: 53880 - RNA, 62 nt, Homo Sapiens
agccaacagaugugucagccaggauugaccuuugcacgaacaccaagugucugcaaguaaac

SEQ ID NO: 53881 - RNA, 62 nt, Homo Sapiens
cuacagcgagagugacgaugccaggaagggccugcacgaacccaggccccgcgggccgggcu

SEQ ID NO: 53882 - RNA, 62 nt, Homo Sapiens
gagcaccguggagaagacgggcugccaggucaugcacgaagggaggucccgcagaagcuaca

SEQ ID NO: 53883 - RNA, 64 nt, Homo Sapiens
ggcuacuccuuccuguagagcagaaauuguauuuugcacgaacaugcaguuauugaagauuagg

SEQ ID NO: 53884 - RNA, 64 nt, Homo Sapiens
agaggguguaaguauuccaccagcccgcugagugugcacgaaauguucgcagugcaacaaaaag

SEQ ID NO: 53885 - RNA, 64 nt, Homo Sapiens
ucuuuuuuuuuaaaacugucaaugguggcuuaaaugcacgaauguuauauuagagucagagacu

SEQ ID NO: 53886 - RNA, 64 nt, Homo Sapiens
cacaaugcaccauccaugaggaauggccauggaaugcacgaagucuuccuuugguugccauaug

SEQ ID NO: 53887 - RNA, 64 nt, Homo Sapiens
uggagaaccugacagggcugacacccagucucaaugcacgaaguagaaacccguaggcacggac

SEQ ID NO: 53888 - RNA, 64 nt, Homo Sapiens
cccgccgaaacugcugcgagggcagcacagcaccugcacgaacaggcgugcugcagcgacaggc

SEQ ID NO: 53889 - RNA, 64 nt, Homo Sapiens
guggcccaggagagaggaucagccuugcccucaaugcacgaaagucugggcugguacaggccuc

SEQ ID NO: 53890 - RNA, 64 nt, Homo Sapiens
uugucacuuuuuaugcuauuucuguauauaaaggugcacgaagguaaaaaguauuuuuucaagu

SEQ ID NO: 53891 - RNA, 64 nt, Homo Sapiens
uuucucucuugccuugaggaucccaaagucugagugcacgaaaaggugaaagacaugagugccc

SEQ ID NO: 53892 - RNA, 64 nt, Homo Sapiens
gaaaacugaaucaagaaaugaaugcuccaugaaaugcacgaagucuguuuuaaugacaagguga

SEQ ID NO: 53893 - RNA, 64 nt, Homo Sapiens
ccccgccuaccuguacucguguggccguaccugaugcacgaacaggugcuggugccaaccucug

SEQ ID NO: 53894 - RNA, 64 nt, Homo Sapiens
auggacauaaauccaaguugccuggauagcuauuugcacgaaucgauuaggguggcuguccauc

SEQ ID NO: 53895 - RNA, 64 nt, Homo Sapiens
uuaaaacauggcaauaaaugggcuucagauauuuugcacgaauuacuuuguauucucuguccag

SEQ ID NO: 53896 - RNA, 64 nt, Homo Sapiens
ugaugugaguugcacagcuaugaaggcuguacacugcacgaauggaagaggcaccugucccaga

SEQ ID NO: 53897 - RNA, 64 nt, Homo Sapiens
ccccaacacaugccuucccuccccagccacaccgugcacgaagggggcacaggagaggagaggg

SEQ ID NO: 53898 - RNA, 64 nt, Homo Sapiens
aguccagaaccuggaaccuagaggccuuucucucugcacgaaaaacagguaguuugcagucuga

SEQ ID NO: 53899 - RNA, 64 nt, Homo Sapiens
uuguacuguaauuuugaauggaacugaaaaauuaugcacgaauaaaguacuuuucucaugccau

SEQ ID NO: 53900 - RNA, 64 nt, Homo Sapiens
aucagcugccaauaauaucuaauauuuuucaucaugcacgaauuaauaaucaucauacucuaga

SEQ ID NO: 53901 - RNA, 64 nt, Homo Sapiens
ugacagcccugaucuguauuuaccuugaguggccugcacgaacacucuggaauccacuaugguu

SEQ ID NO: 53902 - RNA, 64 nt, Homo Sapiens
uuacuauagauaauauauguuaggccuuaugauaugcacgaauuauaguugaaguacaaauuaa

SEQ ID NO: 53903 - RNA, 64 nt, Homo Sapiens
cuggccucuugcuuggcgugaugcugcccuucuuugcacgaagcguguuggcgcucggggcgag

SEQ ID NO: 53904 - RNA, 64 nt, Homo Sapiens
cgguagugcagcuguggguggaggcuggggugucugcacgaagucaggccagcguccuccucca

SEQ ID NO: 53905 - RNA, 64 nt, Homo Sapiens
augucuuuuaaauuaaaauaacuaccaacaguuuugcacgaacaggaagggauguuuuguaaga

SEQ ID NO: 53906 - RNA, 64 nt, Homo Sapiens
ggcugaugggaaccauuucagccccuuggauuccugcacgaaguguguguguguauguuucuua

SEQ ID NO: 53907 - RNA, 64 nt, Homo Sapiens
aggaacugggguugcuaaccucagggaaccacaaugcacgaaagggggcuggguuaacguuuuc

SEQ ID NO: 53908 - RNA, 64 nt, Homo Sapiens
cacagccuucagcacaggcaacuguuacugagucugcacgaacuuagauaaugaggugcagggu

SEQ ID NO: 53909 - RNA, 64 nt, Homo Sapiens
gaucccauauuguuuggagacuuccagauggcucugcacgaaggagaaccacgcauuuaugaag

SEQ ID NO: 53910 - RNA, 64 nt, Homo Sapiens
caugaauguauuguaaauaacagggaugggcaguugcacgaaggauggcucccuguuggcuacg

SEQ ID NO: 53911 - RNA, 64 nt, Homo Sapiens
gagacuuuccaaauauggaacuaacuggagaaggugcacgaaggagacaccacuuggggaccuc

SEQ ID NO: 53912 - RNA, 64 nt, Homo Sapiens
gaagauccaagcuucgaaagaaagcacgaccuacugcacgaagguuggucaaagugaggggaaa

SEQ ID NO: 53913 - RNA, 64 nt, Homo Sapiens
uuaauuuacucauguccacgacguguagcugacaugcacgaagugcugagaaaggagacgauga

SEQ ID NO: 53914 - RNA, 64 nt, Homo Sapiens
ucccuucaggcucuguugcucccuccucugcagcugcacgaaggcgccaucuggugucugcaug

SEQ ID NO: 53915 - RNA, 64 nt, Homo Sapiens
cucccuggccuccagagguggcgugggcuggcuuugcacgaagguugugcugggagaccggacc

SEQ ID NO: 53916 - RNA, 64 nt, Homo Sapiens
gugaaguucuuugucacuguugugaccaaagaaaugcacgaaauuucauucuaaugaaagaaaa

SEQ ID NO: 53917 - RNA, 64 nt, Homo Sapiens
uugaacauucguuauggggagaacagcagagugaugcacgaacuguuucccgguuauguguagg

SEQ ID NO: 53918 - RNA, 64 nt, Homo Sapiens
caagaaccaaacagcucaggagagcuacgcucugugcacgaagucugugggucccugacaaaga

SEQ ID NO: 53919 - RNA, 64 nt, Homo Sapiens
uuucauuguuaauguauauucauguuuuacucuuugcacgaaacuuuguggcacaaaaagggaa

SEQ ID NO: 53920 - RNA, 64 nt, Homo Sapiens
cugaaaugccucuucuuuauguacaaagauuauuugcacgaacuggacugugugcaacgcuuuu

SEQ ID NO: 53921 - RNA, 64 nt, Homo Sapiens
ggagccaacagaugugucagccaggauugaccuuugcacgaacaccaagugucugcaaguaaac

SEQ ID NO: 53922 - RNA, 64 nt, Homo Sapiens
cuacagcgagagugacgaugcuccaggaagggccugcacgaaccgccaggccccgcgggccggg

SEQ ID NO: 53923 - RNA, 64 nt, Homo Sapiens
gagcaccguggagaagacggcagcugccaggucaugcacgaagguggaggucccgcagaagcua

SEQ ID NO: 53924 - RNA, 65 nt, Homo Sapiens
aggcuacuccuuccuguagagcagaaauuguauuuugcacgaacaugcaguuauugaagauuagg

SEQ ID NO: 53925 - RNA, 65 nt, Homo Sapiens
aagaggguguaaguauuccaccagcccgcugagugugcacgaaauguucgcagugcaacaaaaag

SEQ ID NO: 53926 - RNA, 65 nt, Homo Sapiens
ucuuuuuuuuuaaaacugucuaaugguggcuuaaaugcacgaaugcuuauauuagagucagagac

SEQ ID NO: 53927 - RNA, 65 nt, Homo Sapiens
cacaaugcaccauccaugagggaauggccauggaaugcacgaaguccuuccuuugguugccauau

SEQ ID NO: 53928 - RNA, 65 nt, Homo Sapiens
uggagaaccugacagggcugcacacccagucucaaugcacgaagucagaaacccguaggcacgga

SEQ ID NO: 53929 - RNA, 65 nt, Homo Sapiens
cccgccgaaacugcugcgagcggcagcacagcaccugcacgaacauggcgugcugcagcgacagg

SEQ ID NO: 53930 - RNA, 65 nt, Homo Sapiens
guggcccaggagagaggauccagccuugcccucaaugcacgaaagaucugggcugguacaggccu

SEQ ID NO: 53931 - RNA, 65 nt, Homo Sapiens
auugucacuuuuuaugcuauuucuguauauaaaggugcacgaagguaaaaaguauuuuuucaagu

SEQ ID NO: 53932 - RNA, 65 nt, Homo Sapiens
uuucucucuugccuugaggacucccaaagucugagugcacgaaaaaggugaaagacaugagugcc

SEQ ID NO: 53933 - RNA, 65 nt, Homo Sapiens
ugaaaacugaaucaagaaaugaaugcuccaugaaaugcacgaagucuguuuuaaugacaagguga

SEQ ID NO: 53934 - RNA, 65 nt, Homo Sapiens
ccccgccuaccuguacucgugguggccguaccugaugcacgaacaaggugcuggugccaaccucu

SEQ ID NO: 53935 - RNA, 65 nt, Homo Sapiens
auggacauaaauccaaguugcccuggauagcuauuugcacgaaucagauuaggguggcuguccau

SEQ ID NO: 53936 - RNA, 65 nt, Homo Sapiens
uuaaaacauggcaauaaauggggcuucagauauuuugcacgaauucacuuuguauucucugucca

SEQ ID NO: 53937 - RNA, 65 nt, Homo Sapiens
gugaugugaguugcacagcuaugaaggcuguacacugcacgaauggaagaggcaccugucccaga

SEQ ID NO: 53938 - RNA, 65 nt, Homo Sapiens
accccaacacaugccuucccuccccagccacaccgugcacgaagggggcacaggagaggagaggg

SEQ ID NO: 53939 - RNA, 65 nt, Homo Sapiens
aaguccagaaccuggaaccuagaggccuuucucucugcacgaaaaacagguaguuugcagucuga

SEQ ID NO: 53940 - RNA, 65 nt, Homo Sapiens
uuuguacuguaauuuugaauggaacugaaaaauuaugcacgaauaaaguacuuuucucaugccau

SEQ ID NO: 53941 - RNA, 65 nt, Homo Sapiens
aaucagcugccaauaauaucuaauauuuuucaucaugcacgaauuaauaaucaucauacucuaga

SEQ ID NO: 53942 - RNA, 65 nt, Homo Sapiens
ugacagcccugaucuguauuuuaccuugaguggccugcacgaacaacucuggaauccacuauggu

SEQ ID NO: 53943 - RNA, 65 nt, Homo Sapiens
uuacuauagauaauauauguauaggccuuaugauaugcacgaauuuauaguugaaguacaaauua

SEQ ID NO: 53944 - RNA, 65 nt, Homo Sapiens
cuggccucuugcuuggcguggaugcugcccuucuuugcacgaagcgguguuggcgcucggggcga

SEQ ID NO: 53945 - RNA, 65 nt, Homo Sapiens
ccgguagugcagcuguggguggaggcuggggugucugcacgaagucaggccagcguccuccucca

SEQ ID NO: 53946 - RNA, 65 nt, Homo Sapiens
augucuuuuaaauuaaaauaaacuaccaacaguuuugcacgaacauggaagggauguuuuguaag

SEQ ID NO: 53947 - RNA, 65 nt, Homo Sapiens
ggcugaugggaaccauuucaagccccuuggauuccugcacgaaguuguguguguguauguuucuu

SEQ ID NO: 53948 - RNA, 65 nt, Homo Sapiens
aggaacugggguugcuaacccucagggaaccacaaugcacgaaaggggggcuggguuaacguuuu

SEQ ID NO: 53949 - RNA, 65 nt, Homo Sapiens
ucacagccuucagcacaggcaacuguuacugagucugcacgaacuuagauaaugaggugcagggu

SEQ ID NO: 53950 - RNA, 65 nt, Homo Sapiens
ggaucccauauuguuuggagacuuccagauggcucugcacgaaggagaaccacgcauuuaugaag

SEQ ID NO: 53951 - RNA, 65 nt, Homo Sapiens
caugaauguauuguaaauaagcagggaugggcaguugcacgaagggauggcucccuguuggcuac

SEQ ID NO: 53952 - RNA, 65 nt, Homo Sapiens
ggagacuuuccaaauauggaacuaacuggagaaggugcacgaaggagacaccacuuggggaccuc

SEQ ID NO: 53953 - RNA, 65 nt, Homo Sapiens
gaagauccaagcuucgaaagaaaagcacgaccuacugcacgaaggguuggucaaagugaggggaa

SEQ ID NO: 53954 - RNA, 65 nt, Homo Sapiens
uuaauuuacucauguccacgaacguguagcugacaugcacgaaguagcugagaaaggagacgaug

SEQ ID NO: 53955 - RNA, 65 nt, Homo Sapiens
uucccuucaggcucuguugcucccuccucugcagcugcacgaaggcgccaucuggugucugcaug

SEQ ID NO: 53956 - RNA, 65 nt, Homo Sapiens
ccucccuggccuccagagguggcgugggcuggcuuugcacgaagguugugcugggagaccggacc

SEQ ID NO: 53957 - RNA, 65 nt, Homo Sapiens
gugaaguucuuugucacuguaugugaccaaagaaaugcacgaaauauucauucuaaugaaagaaa

SEQ ID NO: 53958 - RNA, 65 nt, Homo Sapiens
uugaacauucguuauggggaggaacagcagagugaugcacgaacuuguuucccgguuauguguag

SEQ ID NO: 53959 - RNA, 65 nt, Homo Sapiens
caagaaccaaacagcucaggaagagcuacgcucugugcacgaaguccugugggucccugacaaag

SEQ ID NO: 53960 - RNA, 65 nt, Homo Sapiens
uuucauuguuaauguauauuacauguuuuacucuuugcacgaaacuuuuguggcacaaaaaggga

SEQ ID NO: 53961 - RNA, 65 nt, Homo Sapiens
ucugaaaugccucuucuuuauguacaaagauuauuugcacgaacuggacugugugcaacgcuuuu

SEQ ID NO: 53962 - RNA, 65 nt, Homo Sapiens
uggagccaacagaugugucagccaggauugaccuuugcacgaacaccaagugucugcaaguaaac

SEQ ID NO: 53963 - RNA, 65 nt, Homo Sapiens
cuacagcgagagugacgauggcuccaggaagggccugcacgaaccggccaggccccgcgggccgg

SEQ ID NO: 53964 - RNA, 65 nt, Homo Sapiens
gagcaccguggagaagacggacagcugccaggucaugcacgaaggguggaggucccgcagaagcu

SEQ ID NO: 53965 - RNA, 64 nt, Homo Sapiens
gccugucuccaaucagcaaguggucgugccuggcucuagagagcguggggagcuggucucaagg

SEQ ID NO: 53966 - RNA, 64 nt, Homo Sapiens
aaaauugugcucuagaagaauaaaacugaaaaacucuagagaauuuuuuuuccccauugauguu

SEQ ID NO: 53967 - RNA, 64 nt, Homo Sapiens
uuuuuugggggggguggucucuuccugucuggcuucuagagaugugccugugggagggggagga

SEQ ID NO: 53968 - RNA, 64 nt, Homo Sapiens
gccaaguacauaaaaaaaaaaaaagcagauuaucucuagagaguuugagccuuugcuggucaca

SEQ ID NO: 53969 - RNA, 64 nt, Homo Sapiens
aaacccacauuccaaagugguaggcucauuuguuucuagagauuucaucaugucgcuuuuccuu

SEQ ID NO: 53970 - RNA, 64 nt, Homo Sapiens
cucucuuuugaggcucucucauaaccccucuauuucuagagacaacaaaaaugcugccaguccu

SEQ ID NO: 53971 - RNA, 64 nt, Homo Sapiens
auguugccgcucuccaaucucccagagcucgcucucuagagaaucaccuucuuucgcuuuuuuu

SEQ ID NO: 53972 - RNA, 64 nt, Homo Sapiens
cccucucuccuuccuccccaucucucgcacgcagucuagagauggacugagccuugcuucucac

SEQ ID NO: 53973 - RNA, 64 nt, Homo Sapiens
uauauaucuaucuuauauaguuuacuauuuuacuucuagagauaguacauaaaggugguaugug

SEQ ID NO: 53974 - RNA, 64 nt, Homo Sapiens
ucaggugucuggucuugggggcacugugcucacuucuagagagaagaaaaaggcuggguuugga

SEQ ID NO: 53975 - RNA, 64 nt, Homo Sapiens
uauauaaugugcuaaauucauacuuuuugggaagucuagagauggccacuuauaucuuagacua

SEQ ID NO: 53976 - RNA, 64 nt, Homo Sapiens
aguugagagagaaucucaagagcacaagcguguuucuagagaaccuuuuaaaaggcagauuaaa

SEQ ID NO: 53977 - RNA, 64 nt, Homo Sapiens
ugcgacuuuaauuaaaaacaguggacagugcuccucuagagagcccuccuacuuuccucccuag

SEQ ID NO: 53978 - RNA, 64 nt, Homo Sapiens
ccaagcuggugaacuauuaagguugcaauaccaaucuagagagugucuguacagaaaugaagcu

SEQ ID NO: 53979 - RNA, 64 nt, Homo Sapiens
cuuaacuucuuaaaccauuuuuagucuuuagaacucuagagagcuauaauaugugccuuaaguu

SEQ ID NO: 53980 - RNA, 64 nt, Homo Sapiens
aaaccacugugccauuuuuacuguugucugagauucuagagauuuaggaaugaauaccucaaau

SEQ ID NO: 53981 - RNA, 64 nt, Homo Sapiens
gcugggacacuuuucuuggauucuuucugcagggucuagagacuaaauggaguguuggaaaaug

SEQ ID NO: 53982 - RNA, 64 nt, Homo Sapiens
aggaaaagagacuaggauaagccaguaacauacuucuagagaacuuuugugaaaucuuuuaaga

SEQ ID NO: 53983 - RNA, 64 nt, Homo Sapiens
uggcuguggcuuuuugggagaaaccaaaaaaaaaucuagagaugaagcaucuaaagcaaaaaaa

SEQ ID NO: 53984 - RNA, 64 nt, Homo Sapiens
ccguucuuccugucucagcuccaaagcuagagcuucuagagacgcuuacugaagugccugaaac

SEQ ID NO: 53985 - RNA, 64 nt, Homo Sapiens
cggcucuggugccccuccucuccucccagcaugcucuagagaggggaggcggcucuggugccca

SEQ ID NO: 53986 - RNA, 64 nt, Homo Sapiens
cggcucuggugcccauccucgucucccagcaugcucuagagagguuggagauguacuggugucc

SEQ ID NO: 53987 - RNA, 64 nt, Homo Sapiens
gugaucaccaagcugucucaagcauggcucagagucuagagaaauugccacauuaagguugaac

SEQ ID NO: 53988 - RNA, 64 nt, Homo Sapiens
cugauucgguugaucuggggcaugcagacucgccucuagagauucaagccucuauuauacaaac

SEQ ID NO: 53989 - RNA, 64 nt, Homo Sapiens
uucacuugaagagcaaggauguagugaugguggaucuagagacaacuuagcuuccugauacuag

SEQ ID NO: 53990 - RNA, 64 nt, Homo Sapiens
aacuuuaugaagguaucgaaauaacauaacucauucuagagaaauuccagugguauuugauggu

SEQ ID NO: 53991 - RNA, 64 nt, Homo Sapiens
gcugcagggaggagaggugagaaaggaagcgucuucuagagacauuggcccaggagcucuguuc

SEQ ID NO: 53992 - RNA, 64 nt, Homo Sapiens
uagacugaagagaccacagcaauuggcuccuccaucuagagauuuucuuggcaguauuccaugg

SEQ ID NO: 53993 - RNA, 64 nt, Homo Sapiens
caccuggguccgugccagcacaaucugccaaaguucuagagacccuguucccuuccccaucacc

SEQ ID NO: 53994 - RNA, 64 nt, Homo Sapiens
uuaugcaaguuuugaaagauagguauuuauuuuuucuagagacaggaguuuugcucuguugccc

SEQ ID NO: 53995 - RNA, 64 nt, Homo Sapiens
uguuguaaaguauuguuugcagcucuuuccaauaucuagagacauuuuuauuuaugaauauuua

SEQ ID NO: 53996 - RNA, 64 nt, Homo Sapiens
gucuggcagaagccacgcuuguuccccauguaccucuagagaagcagaaaccaaagucccccug

SEQ ID NO: 53997 - RNA, 64 nt, Homo Sapiens
acaaaagcuuacacuggugauuccauuaaacuuuucuagagaagacuguuuguacaucguuuuu

SEQ ID NO: 53998 - RNA, 64 nt, Homo Sapiens
guuuuuguuaaaucuacuaagcacuauuuugaauucuagagauguagaaccaacggaaauaugg

SEQ ID NO: 53999 - RNA, 64 nt, Homo Sapiens
cacuguccaauccgguagccuuugaaaaacacacucuagagauguggccuuuuuccucagguag

SEQ ID NO: 54000 - RNA, 64 nt, Homo Sapiens
auugcaugucaaaaaauguaagguaucagagcagucuagagacaucaaguagcacauugguaau

SEQ ID NO: 54001 - RNA, 64 nt, Homo Sapiens
guaagaguuaggaaaauaucaucugacagaucauucuagagacuuccaguguuguugagugaaa

SEQ ID NO: 54002 - RNA, 64 nt, Homo Sapiens
uaaaggguugaaugacaauacgggcauuaggaaaucuagagaucauucuguauuuggccuuauu

SEQ ID NO: 54003 - RNA, 64 nt, Homo Sapiens
aauaaaugcagucuugaaaggcccaggguuaccuucuagagacacaaguaugaaaaaugaaaag

SEQ ID NO: 54004 - RNA, 64 nt, Homo Sapiens
gucucagaugugcuuauaaaacaaauauuuugauucuagagaacaacugcaaaaacaaauauag

SEQ ID NO: 54005 - RNA, 64 nt, Homo Sapiens
ugaugauuuugaaacugauucuagaaauaugcuuucuagagauaugugugguaacuguauuguu

SEQ ID NO: 54006 - RNA, 64 nt, Homo Sapiens
ugaaguuauuauuaauuuuuaccuugcuuuuaucucuagagacaauguuaagugccuuguccgc

SEQ ID NO: 54007 - RNA, 64 nt, Homo Sapiens
uccacuuuguugcugaaguauacaacaaauaaucucuagagaggguauuaaggcaacaagacag

SEQ ID NO: 54008 - RNA, 64 nt, Homo Sapiens
gaaaguauuuuaguauguguuguucugaguuauuucuagagaaagucuuauaaugauuagguuu

SEQ ID NO: 54009 - RNA, 64 nt, Homo Sapiens
acaguguuguucaaagacagaggacuacauacauucuagagauguguaaugcuggaagaucuua

SEQ ID NO: 54010 - RNA, 64 nt, Homo Sapiens
ggaucauggagaaaaaaugagacccuaaaaaguuucuagagagagaaaacaaaagaucagaaau

SEQ ID NO: 54011 - RNA, 64 nt, Homo Sapiens
aaauccaugcugagcuguaccaggaacuugcauaucuagagacagagacugagucacuggccca

SEQ ID NO: 54012 - RNA, 64 nt, Homo Sapiens
guuucagucuugggcucuugacuccucacuguugucuagagauggagccagcaggcugguagcc

SEQ ID NO: 54013 - RNA, 64 nt, Homo Sapiens
ucaucggcaggcgcaugaguaucugugggaguccucuagagagaugagaagccaggaggccugc

SEQ ID NO: 54014 - RNA, 64 nt, Homo Sapiens
agaucuauguacuguaauagugugauuacuaugcucuagagaaaagucuaccccugcuaaggag

SEQ ID NO: 54015 - RNA, 64 nt, Homo Sapiens
augauauagcuuugccauguggcagaucuacaugucuagagaacacugugcucuauuaccauua

SEQ ID NO: 54016 - RNA, 64 nt, Homo Sapiens
cucuauuaccauuauggauaaagaugagaugguuucuagagaugguuucuacuggcugccagaa

SEQ ID NO: 54017 - RNA, 64 nt, Homo Sapiens
aaacuuuaggguaaaaauugccauuggacaguugucuagagauauauauacuugugguuuucaa

SEQ ID NO: 54018 - RNA, 64 nt, Homo Sapiens
caacauaguggaaaaccgaaaguaagcuuacauaucuagagaaagcugagauuuugguuaauag

SEQ ID NO: 54019 - RNA, 64 nt, Homo Sapiens
ugauaccuuuuuuuuuuuuuuuggauagcacaggucuagagaaauguggcagguggcugcccua

SEQ ID NO: 54020 - RNA, 64 nt, Homo Sapiens
ccuguuucagugccuacucacagacuucauugauucuagagagaccucauccaaggagcugggg

SEQ ID NO: 54021 - RNA, 64 nt, Homo Sapiens
uaaggggaaaagcugcuuucuacucauggcagguucuagagacuuccucaaagacugucuuaau

SEQ ID NO: 54022 - RNA, 64 nt, Homo Sapiens
uggguuuucucccaguacucccccacccccugacucuagagaacgggaugggaggccucucucu

SEQ ID NO: 54023 - RNA, 64 nt, Homo Sapiens
uugguuaaucuuuccauauuacauuuagaguuuaucuagagagcaucauccugguggaacuuga

SEQ ID NO: 54024 - RNA, 64 nt, Homo Sapiens
agauucauuugcuuaauuuucgagaaaaggcauuucuagagaacauaaauauaauacuauaacu

SEQ ID NO: 54025 - RNA, 64 nt, Homo Sapiens
acuagagcacuuuuguuguggggggaccaaauuuucuagagagauguacuguagcuuguuguuu

SEQ ID NO: 54026 - RNA, 64 nt, Homo Sapiens
aauuauaguacucaaacuggucauuugucauuuuucuagagauauaaaaaucaauugcagaagu

SEQ ID NO: 54027 - RNA, 64 nt, Homo Sapiens
acgucuucuaaaaggggcauuuuuagaaaugagaucuagagaacgaaaugagaaaaauacagag

SEQ ID NO: 54028 - RNA, 64 nt, Homo Sapiens
aaaugcaaugugacaguguugcuaucaguauacaucuagagaggaucugaacaucuuucccagu

SEQ ID NO: 54029 - RNA, 64 nt, Homo Sapiens
caaacuacuguuuuauuaaaauagacaagaugucucuagagacuuucaccaguuguacugcaau

SEQ ID NO: 54030 - RNA, 64 nt, Homo Sapiens
aauuaaaaugcaaugaguuauagcuauuugaguaucuagagaaaggcauguaccuucauuugcu

SEQ ID NO: 54031 - RNA, 64 nt, Homo Sapiens
uuaugcccuccagagcuccaucucucaggaagcuucuagagacugcaaaaugccucucccaucc

SEQ ID NO: 54032 - RNA, 64 nt, Homo Sapiens
ugauugguauucucaacagcaaaggggugaaaaaucuagagacagaggaggccuggcaggggug

SEQ ID NO: 54033 - RNA, 64 nt, Homo Sapiens
gugacuuagacauguuugcaugaauaaauauauuucuagagaacaguuuacaaagccucaucuu

SEQ ID NO: 54034 - RNA, 64 nt, Homo Sapiens
gccuuguuuuuucccagagcaccaguccagcuggucuagagaaaacuuuuuacucucccuccug

SEQ ID NO: 54035 - RNA, 64 nt, Homo Sapiens
gguugcaaugacaaggggggaauuaccacaguauucuagagacgcgcagguacaugcuaguuuc

SEQ ID NO: 54036 - RNA, 64 nt, Homo Sapiens
aggugaucuauucccacaugaaaugggauauuagucuagagagagccauggagaccacugucag

SEQ ID NO: 54037 - RNA, 64 nt, Homo Sapiens
uacaacuuuggugauaaacaucauuuucugaaagucuagagaauacaaaauagggauuuuuacu

SEQ ID NO: 54038 - RNA, 64 nt, Homo Sapiens
auguaucuaguggucugauuuuaauuugggcaucucuagagaacgcuuucagggaaaaauacuu

SEQ ID NO: 54039 - RNA, 64 nt, Homo Sapiens
gaucucaaagaaagcauuuucauuucacugcacaucuagagaaaaacaaaaauagaaaauuuuc

SEQ ID NO: 54040 - RNA, 64 nt, Homo Sapiens
ucagugauuuguaauuugggacuuggauuauuuaucuagagauguuuguauauuuugucaguaa

SEQ ID NO: 54041 - RNA, 64 nt, Homo Sapiens
ccagauaauguccuugcuuuacaaaccaaccauuucuagagagucuccuuacucauuaauucaa

SEQ ID NO: 54042 - RNA, 64 nt, Homo Sapiens
gcauuccuaggggagaaaauaaaauuuguaauguucuagagaucauuuggaaaaaaagauccaa

SEQ ID NO: 54043 - RNA, 64 nt, Homo Sapiens
ggcuaccaggucucuaggggccugagagaggcccucuagagaauccagggaaacugugagccca

SEQ ID NO: 54044 - RNA, 64 nt, Homo Sapiens
caucaccacacccugcuaauuuuuuaaauuuuuuucuagagagagggucucacuguguugccca

SEQ ID NO: 54045 - RNA, 64 nt, Homo Sapiens
uauaaacacaccccauaaugcaaguaauagguaaucuagagauguggacuuuauugcuauaugg

SEQ ID NO: 54046 - RNA, 64 nt, Homo Sapiens
gcucuccauuuugacguuaaaaaacaacaacagaucuagagauaccucaaggauaucauuuuug

SEQ ID NO: 54047 - RNA, 64 nt, Homo Sapiens
auagugcuuacauuguauuagguguuauaagcaaucuagagaugauuuagcaaguauacaggag

SEQ ID NO: 54048 - RNA, 64 nt, Homo Sapiens
gaguagaugaauuauugaaugugagauaauccguucuagagaauaacuaugaaagcuugcauca

SEQ ID NO: 54049 - RNA, 64 nt, Homo Sapiens
uccuagucugcucacuggcuagaugaguuuccugucuagagaugcagguuguccuccgauuuuu

SEQ ID NO: 54050 - RNA, 64 nt, Homo Sapiens
ugaguacucaacauuugguaaacguaaauagguaucuagagaaguuaauaaagaacauucucaa

SEQ ID NO: 54051 - RNA, 64 nt, Homo Sapiens
gcaaaacauaguaguucacaugaaucaguaagauucuagagaaaaaguaaguauauuuuagagc

SEQ ID NO: 54052 - RNA, 64 nt, Homo Sapiens
ucuggucuauagaaacccaaaauagagacuggguucuagagagucugaaaguauagauccaaca

SEQ ID NO: 54053 - RNA, 64 nt, Homo Sapiens
augaugcuaguuugcauauguaagaagaaccuagucuagagacauugugaugacgugagaucaa

SEQ ID NO: 54054 - RNA, 64 nt, Homo Sapiens
uuguucaagaucauuucagguugcaagccacacuucuagagauuaauaugucugaagaaaaaaa

SEQ ID NO: 54055 - RNA, 64 nt, Homo Sapiens
aggaaauuaauguuucuuaauaaaguaccagucaucuagagagauauugcagaagcuaaaaagc

SEQ ID NO: 54056 - RNA, 64 nt, Homo Sapiens
ugucugcacccccagcaagaaggcgaguuaguuuucuagagacuugaaggagucucccccuucc

SEQ ID NO: 54057 - RNA, 64 nt, Homo Sapiens
aagcccaagauccgcaggaagaagccagauacauucuagagaauugugagacuuugcccuaagc

SEQ ID NO: 54058 - RNA, 64 nt, Homo Sapiens
caaaugaguuacugaauaaggugcuucugcuucuucuagagauggugcuaaagaaaggacuagc

SEQ ID NO: 54059 - RNA, 64 nt, Homo Sapiens
ugaauaacaaaacuagcaauauuuuaauuaucuaucuagagauuuuuuagauugaauucuuguc

SEQ ID NO: 54060 - RNA, 64 nt, Homo Sapiens
uuguguuugauuuuacuauagggguuuugcuuuuucuagagauacuuuucauuuaacagcuuuu

SEQ ID NO: 54061 - RNA, 64 nt, Homo Sapiens
aaguaauagagaaaauuuacuuagcauuuuagauucuagagacauggaaaugaaaauuauuuua

SEQ ID NO: 54062 - RNA, 64 nt, Homo Sapiens
aaauaaaauaaaaugacguacagagauucuauauucuagagagucaaauggucuugcucaauuc

SEQ ID NO: 54063 - RNA, 64 nt, Homo Sapiens
aaaguacucuuuguaagguacaguuaccgauuaaucuagagauaaaauauuuucuuaaaaauau

SEQ ID NO: 54064 - RNA, 64 nt, Homo Sapiens
uccuucaaaggacaguguuguuuugaccgggagaucuagagagugcucagaauuagggccuggc

SEQ ID NO: 54065 - RNA, 64 nt, Homo Sapiens
ucugaaaaaaacacccuuaucauccaguguaccaucuagagaucaccacagaauccauuuuuuu

SEQ ID NO: 54066 - RNA, 64 nt, Homo Sapiens
guaugaacccuuaauuugaagaacuaacuugauuucuagagaaauauccacacuaucucagugg

SEQ ID NO: 54067 - RNA, 64 nt, Homo Sapiens
gaauuggagagcaggcacaucaacugaucucauuucuagagagccccugacaauccugaggcuu

SEQ ID NO: 54068 - RNA, 64 nt, Homo Sapiens
cauuuacagccauuucuaaaauggcagcuucaguucuagagaagaaagaacaacaucagcagua

SEQ ID NO: 54069 - RNA, 64 nt, Homo Sapiens
gaggcaagcccuguugacacuggcugagccccugucuagagaggcagcagggaugcccuggagg

SEQ ID NO: 54070 - RNA, 64 nt, Homo Sapiens
ucaaaaguguuugaaaguacggacaagcuaaaauucuagagagucucauuucucucaagagauu

SEQ ID NO: 54071 - RNA, 64 nt, Homo Sapiens
auggagagagaaagagagagcuugccacaguuuuucuagagacacgauuaugauugucucuguc

SEQ ID NO: 54072 - RNA, 64 nt, Homo Sapiens
uuuuaacuugcugguuaaaacauuuuagaaauauucuagagaugggcaggagagucaaagggcu

SEQ ID NO: 54073 - RNA, 64 nt, Homo Sapiens
auguuuuuagaagcaagagcaaaauuaugaaaccucuagagauuugggucauguuacuccauuu

SEQ ID NO: 54074 - RNA, 64 nt, Homo Sapiens
aaugucacuugcuacagacaauagugcaugagagucuagagaaguagugaccagaacagggcag

SEQ ID NO: 54075 - RNA, 64 nt, Homo Sapiens
ggauauuaggguaaguggcuaauuauaaaucuacucuagagacauauaaucauacagauuauuc

SEQ ID NO: 54076 - RNA, 64 nt, Homo Sapiens
uuuugaaaacugaagcuaagagagauaauaaauaucuagagauaacuauuaacaguauucuuuc

SEQ ID NO: 54077 - RNA, 64 nt, Homo Sapiens
ggggaauggucaccagugagccauauuuauuauuucuagagaaaucacgaacugcuuucuguaa

SEQ ID NO: 54078 - RNA, 64 nt, Homo Sapiens
cucuuacaugauuucuaggccccaugacccagugucuagagacauuaauucuaaccaguuguuu

SEQ ID NO: 54079 - RNA, 64 nt, Homo Sapiens
uuucacacuggagugaaugaaguuguacuucauuucuagagaaaaguuauacccagguccccaa

SEQ ID NO: 54080 - RNA, 64 nt, Homo Sapiens
guguguguguaguuuauccucucucucaucuuuaucuagagauugacugauaccucauucuguu

SEQ ID NO: 54081 - RNA, 64 nt, Homo Sapiens
gucaaaucaacuaauugauuccuugugaccuaauucuagagaaugggaagaaggccuguuauuu

SEQ ID NO: 54082 - RNA, 64 nt, Homo Sapiens
aaguuugauauuaaaggaguuaagaguagcaaguucuagagaagaggcuggugcuguggccagg

SEQ ID NO: 54083 - RNA, 64 nt, Homo Sapiens
ccauguauauuaucacuauauuuaauaaucacagucuagagauguucaugguaaaaguacugcc

SEQ ID NO: 54084 - RNA, 64 nt, Homo Sapiens
aguucuguaauucuaaguguuguucuagauuuccucuagagaagguuauuagaaucuccauugc

SEQ ID NO: 54085 - RNA, 64 nt, Homo Sapiens
uaaccaauuugaugaauacccaguucucuucuuuucuagagaaagauaguugcaaccucaccuc

SEQ ID NO: 54086 - RNA, 64 nt, Homo Sapiens
cuggagcuggauaacuaaaagagaaaauggacagucuagagacuugucauuguuuccagagaag

SEQ ID NO: 54087 - RNA, 53 nt, Homo Sapiens
uuaaccaguuucuaucccuuucuucuagagaucccguucccuccuccauauaa

SEQ ID NO: 54088 - RNA, 64 nt, Homo Sapiens
uagcauauggaaaacuauaagauuuuuugaaaaaucuagagaagggauuuuugugaugaaaggg

SEQ ID NO: 54089 - RNA, 64 nt, Homo Sapiens
aacuucaucuucaucucggaccaucagucauaacucuagagaaauuuccaaauuauugcuucaa

SEQ ID NO: 54090 - RNA, 64 nt, Homo Sapiens
agauguuuguuuacauaagaagugcccugagaccucuagagaaaguuacuuaaguuuguaagac

SEQ ID NO: 54091 - RNA, 64 nt, Homo Sapiens
aaugauuugucucugccuacgucaauaaauauuuucuagagaguuggaaagaaaauuaaaaugu

SEQ ID NO: 54092 - RNA, 64 nt, Homo Sapiens
aagauaaucugaagcucacauaguccaaucuuuuucuagagaaagagaaagguauuucaagauc

SEQ ID NO: 54093 - RNA, 64 nt, Homo Sapiens
auuuugagaaccacuguccagcuguuguugcuggucuagagacucuagcaaguuuccaggugau

SEQ ID NO: 54094 - RNA, 64 nt, Homo Sapiens
uucuucucagcuaacaggcauauaaggaaaaccaucuagagaguuuucuuuagaagugacuccc

SEQ ID NO: 54095 - RNA, 64 nt, Homo Sapiens
agggagaauggagcaggaggaaaagcagaguuggucuagagaggaggagggcggggcuggagga

SEQ ID NO: 54096 - RNA, 64 nt, Homo Sapiens
cggcacagccugacucacaccccgcggcaggacuucuagagaagcccaggaucugucccgugcc

SEQ ID NO: 54097 - RNA, 64 nt, Homo Sapiens
gcaccaccauaccuggcugauuuuuaaaauuuuuucuagagaugaggucucacuauguugccca

SEQ ID NO: 54098 - RNA, 64 nt, Homo Sapiens
acacuaccgacagugugggcccuuuuauuacuguucuagagacuuaucagcuuucuuguaauaa

SEQ ID NO: 54099 - RNA, 64 nt, Homo Sapiens
gacagcuugguuaccuccacccacacuggacuuuucuagagaugugugugcacccacccaccca

SEQ ID NO: 54100 - RNA, 64 nt, Homo Sapiens
gucagcuugguccacaucacaaaaauucauugucucuagagauuuauuacaggugauucguugg

SEQ ID NO: 54101 - RNA, 64 nt, Homo Sapiens
agguuuucaauaacagggcucagugacucucucuucuagagaaggcgacuguguuaagagagag

SEQ ID NO: 54102 - RNA, 64 nt, Homo Sapiens
ggauuguguuagaggaaucggcucuguauuugccucuagagaaacacaguguucucuuuguauu

SEQ ID NO: 54103 - RNA, 64 nt, Homo Sapiens
uuuucuuuuuugaaauucccugaaaugauguuauucuagagaacuucuaugucagguuccuuug

SEQ ID NO: 54104 - RNA, 64 nt, Homo Sapiens
auuauagcuucuaccaagagaaacacucaauuuuucuagagauuugccucuaucuuccuuuccu

SEQ ID NO: 54105 - RNA, 64 nt, Homo Sapiens
aauauaauuuuuuccuguacuggauggcuaggauucuagagaauugauuauaaaauauuuucaa

SEQ ID NO: 54106 - RNA, 64 nt, Homo Sapiens
ucuauuuaacuccucagagacaugcacaaacuauucuagagaggcuugugccuacgaagauuac

SEQ ID NO: 54107 - RNA, 64 nt, Homo Sapiens
gcugcucucccaaggguuuuauuuuauuucugaaucuagagaacaguauugggcaggaggaaaa

SEQ ID NO: 54108 - RNA, 64 nt, Homo Sapiens
aauugcauaggagugugggaugugguuucugccuucuagagagagaucagaauuaaacuaguac

SEQ ID NO: 54109 - RNA, 64 nt, Homo Sapiens
gugucccgucauuucuagaaacagaauggucucuucuagagagcuuggauaaggaccuugcugg

SEQ ID NO: 54110 - RNA, 64 nt, Homo Sapiens
gcggggggagggcugggacuguuucguuucugcuucuagagauugaggugaaagcuucguccga

SEQ ID NO: 54111 - RNA, 64 nt, Homo Sapiens
uacaaacaucugcuaauucagggucaguuaaauaucuagagacaguauccuugaggaauauagu

SEQ ID NO: 54112 - RNA, 64 nt, Homo Sapiens
aaagccaauuaaaguccauuaacggguggguaauucuagagacaggagaaccguagagcgcagg

SEQ ID NO: 54113 - RNA, 64 nt, Homo Sapiens
uauaauaaccuugcucaccaagcuguuccacuucucuagagaacaugcccucagcuaagccccc

SEQ ID NO: 54114 - RNA, 64 nt, Homo Sapiens
ugcuauagaagcaaagaggacuaaagggcaaaauucuagagagugguaaaucucagaaagcaca

SEQ ID NO: 54115 - RNA, 64 nt, Homo Sapiens
caggccacuuugccucuaaauuaccucugauaauucuagagauuuuaccauauuucuaaacuuu

SEQ ID NO: 54116 - RNA, 64 nt, Homo Sapiens
ugcgaaucuaaaccugggacucucagcaggucggucuagagagugaaugagagcaguggacaca

SEQ ID NO: 54117 - RNA, 64 nt, Homo Sapiens
ggaaauuagauuuaguggguuagccacaguagcuucuagagauaguaacugguuucuaagaguu

SEQ ID NO: 54118 - RNA, 64 nt, Homo Sapiens
uaagaucuuuuuugucaguuuacuuucccuacccucuagagaaacaugaaaauucagaauuuua

SEQ ID NO: 54119 - RNA, 64 nt, Homo Sapiens
uguauuuaugagggugauaaagccuuguagaguuucuagagagacuauugauugcuucuucuau

SEQ ID NO: 54120 - RNA, 64 nt, Homo Sapiens
uuuuucauuaauacuuuuaacugaauacaggcuuucuagagaucuccuuuuuuauugauugggc

SEQ ID NO: 54121 - RNA, 64 nt, Homo Sapiens
uuguuuuuguguucuauguaaccagucuguuccuucuagagaaucuugggaaaugcuucagaac

SEQ ID NO: 54122 - RNA, 64 nt, Homo Sapiens
uguagaggaugauguuuacacacuuggcacuuguucuagagaagcuugcaaacagaauucauaa

SEQ ID NO: 54123 - RNA, 64 nt, Homo Sapiens
caaacugcuccagcaauuucggaggugaauguuuucuagagauuuggguugggguagugggugg

SEQ ID NO: 54124 - RNA, 64 nt, Homo Sapiens
auacuaagaaagcaauuccaaauagauguauacaucuagagagagugguauuagagauucagug

SEQ ID NO: 54125 - RNA, 64 nt, Homo Sapiens
acagcagaaauacuuuuaaauuuuuccuucaugcucuagagaaaauaauuuuauuuuuaaauaa

SEQ ID NO: 54126 - RNA, 64 nt, Homo Sapiens
gagaccccagcaacuggcccaggaugcaggcugcucuagagaccaaaggaacaccaggcccagc

SEQ ID NO: 54127 - RNA, 64 nt, Homo Sapiens
guaucuucucacauucuguauacuguauccauuuucuagagaacccaguagcuuuuauacaguc

SEQ ID NO: 54128 - RNA, 64 nt, Homo Sapiens
ccagaauuuucuaccuaaggaccagaauuuuuuaucuagagaccagcauguucuccccaaagac

SEQ ID NO: 54129 - RNA, 64 nt, Homo Sapiens
ccagaauuuucuaccuaaggaccagaauuuuuugucuagagaccagcauguucuccccaaagac

SEQ ID NO: 54130 - RNA, 64 nt, Homo Sapiens
ccaggauuuucuaccuaaagaccaggacuuuuuaucuagagaccagcauguucuccccaaagac

SEQ ID NO: 54131 - RNA, 64 nt, Homo Sapiens
ccaaggacguuaaaggcauuuuauuccagcgucuucuagagagcuuaguguauacagaugaggg

SEQ ID NO: 54132 - RNA, 64 nt, Homo Sapiens
ugccugugggacagcccaggugaggcucucaaguucuagagagcgggcuucaugaggccccuuu

SEQ ID NO: 54133 - RNA, 64 nt, Homo Sapiens
gaggcuaccugcccagggucaggguaggugaaagucuagagaaaaucucugucucaaggagagc

SEQ ID NO: 54134 - RNA, 64 nt, Homo Sapiens
gcauuucauauuugggggcucugaauccuuuuaaucuagagaagagugcaauagugcaacaucu

SEQ ID NO: 54135 - RNA, 64 nt, Homo Sapiens
uacugaacaccuaaagauuuuaccacuuaaaaucucuagagaaccuccggaugggcuguuguga

SEQ ID NO: 54136 - RNA, 64 nt, Homo Sapiens
guaaaaaugaauuacacuguagaugggagaaaccucuagagagaauaaaagauuuguacuguuu

SEQ ID NO: 54137 - RNA, 64 nt, Homo Sapiens
aagggaucuaggaaugcugauuagaaagaauucuucuagagaaacaugucauuuaucaacgucc

SEQ ID NO: 54138 - RNA, 64 nt, Homo Sapiens
agcucaacucucucccaaccaccugggccccuccucuagagaagcggagcccccucucagccuu

SEQ ID NO: 54139 - RNA, 64 nt, Homo Sapiens
acguaccuuaauccaaucuuuauaaaagaggcagucuagagaacuaggacugcucagccuuauc

SEQ ID NO: 54140 - RNA, 64 nt, Homo Sapiens
auaauucuuacuaacacagauuaggguauaggcaucuagagaugcacuguccacuguaaauacu

SEQ ID NO: 54141 - RNA, 64 nt, Homo Sapiens
gaaaauggggagguuagcucagagcagaguagucucuagagaaaggaagaauccucaacggcac

SEQ ID NO: 54142 - RNA, 64 nt, Homo Sapiens
uauaguuauuguuuguuuuuaagaaaagcucaguucuagagacauacuauuacuuuaggacugu

SEQ ID NO: 54143 - RNA, 64 nt, Homo Sapiens
uacaguuguaagucagaguuuuuucuguuuuuucucuagagaggugccuucccuuuguuccuua

SEQ ID NO: 54144 - RNA, 64 nt, Homo Sapiens
ggucaugauaucauaccaacuuggggaccacugcucuagagagaggucccuggugccaaaaaug

SEQ ID NO: 54145 - RNA, 64 nt, Homo Sapiens
aaaagugaagaagucauguuuaacucaagaaaacucuagagaagucuucuucaagccauuauuu

SEQ ID NO: 54146 - RNA, 64 nt, Homo Sapiens
gaaaaaucccuacuaaguccuccgaaggccaugaucuagagauacuuuuuugguuucuuggcuu

SEQ ID NO: 54147 - RNA, 64 nt, Homo Sapiens
uuuauagagcauuugaagugaacauaggccaaauucuagagaugucuuaagucagcugguucau

SEQ ID NO: 54148 - RNA, 64 nt, Homo Sapiens
ugauguuucaauuuaccccucauuuccugacuggucuagagaaccuuauaaagcacaaagcaua

SEQ ID NO: 54149 - RNA, 52 nt, Homo Sapiens
acauugcaccuuugcugcugagucuagagaggaagagaacauagaugaguaa

SEQ ID NO: 54150 - RNA, 64 nt, Homo Sapiens
gucgucuggccugcuugcugcaaaggacagguagucuagagaggggaaugcugguuuugaagag

SEQ ID NO: 54151 - RNA, 64 nt, Homo Sapiens
gggguuucuucauagguuugcccugaggcugucuucuagagacuccauuuucugcucugcuccc

SEQ ID NO: 54152 - RNA, 64 nt, Homo Sapiens
uauguuuuauuagcauuuucaagaagacggauuaucuagagaauaaucauauauaugcauacgu

SEQ ID NO: 54153 - RNA, 64 nt, Homo Sapiens
uuguauaucuuuucuauuuauugacuucucauguucuagagaguaggacuuuuauuccguguac

SEQ ID NO: 54154 - RNA, 64 nt, Homo Sapiens
cuuuccuucagcuaucuguggggaccuuguuuauucuagagagaauucuuacucaaauuuuucg

SEQ ID NO: 54155 - RNA, 64 nt, Homo Sapiens
auuucuauuuuuuuuuucuuauaaguucguugugucuagagauuguuaauauuguaauuuaaug

SEQ ID NO: 54156 - RNA, 64 nt, Homo Sapiens
ucuguaguccugggaggccuagcaucaagucuucucuagagacccugaacuaugcguacugcau

SEQ ID NO: 54157 - RNA, 64 nt, Homo Sapiens
ucucgggggaggaagcccagaaaauuggguauguucuagagauuuaccaccauugcuuauugcu

SEQ ID NO: 54158 - RNA, 64 nt, Homo Sapiens
auauuugcuuauuuaagguacauuucuuuggguuucuagagacgccccuaagucaccugcuuca

SEQ ID NO: 54159 - RNA, 64 nt, Homo Sapiens
cuaaaaacuaaccaaacuugaauuugauaauaggucuagagacuauaaguaaccauugaacauu

SEQ ID NO: 54160 - RNA, 64 nt, Homo Sapiens
uaagagauaugauguauaaaccuucaguguuccaucuagagaaugucacuuacuuaauuccugu

SEQ ID NO: 54161 - RNA, 64 nt, Homo Sapiens
accaauauaugguggugcuguuuaaaauuccaacucuagagaaaguaccuucaaguucuugauu

SEQ ID NO: 54162 - RNA, 64 nt, Homo Sapiens
gcuugucagcacuuccaguuuagaacgcaauguuucuagagacauauuggcuguuuguuuugau

SEQ ID NO: 54163 - RNA, 64 nt, Homo Sapiens
ggaccaagauguacauaagacaaagcuacugccuucuagagacaaccggcagugaccucacuga

SEQ ID NO: 54164 - RNA, 64 nt, Homo Sapiens
uucaucuccauaagacuuuuagacuuaagacuauucuagagaucuuaaugauagcaguagucau

SEQ ID NO: 54165 - RNA, 64 nt, Homo Sapiens
guccugagugccaagcacguaccaaguuacauauucuagagauccuuucuccccagagagcuug

SEQ ID NO: 54166 - RNA, 64 nt, Homo Sapiens
accccuuguagguuauaaggcagauuuguuuacaucuagagagauuggauuaaaauauuucauc

SEQ ID NO: 54167 - RNA, 64 nt, Homo Sapiens
uuugaguuuuguuuugccugcuuaagucuuugagucuagagagaaacaaauagguuggcauagu

SEQ ID NO: 54168 - RNA, 64 nt, Homo Sapiens
cacacuucaaccccagcuugcuggucggcuuuccucuagagagagccgguuuuggggccauuuc

SEQ ID NO: 54169 - RNA, 64 nt, Homo Sapiens
uggcugugagaagaaaccugcuuuugaucauuuuucuagagaucugggugugaauccuuuuuug

SEQ ID NO: 54170 - RNA, 64 nt, Homo Sapiens
guguagggucacugggagagcagaggucacagccucuagagaagggagaggggcgugugcaugg

SEQ ID NO: 54171 - RNA, 64 nt, Homo Sapiens
gcugcagggacccguuuggacccacagccucuguucuagagaugcuuguauaggcuguuaauug

SEQ ID NO: 54172 - RNA, 64 nt, Homo Sapiens
uguagcauuuacauuuauuagguauuauaaguaaucuagagauuauuuaauuaaaauauacagg

SEQ ID NO: 54173 - RNA, 64 nt, Homo Sapiens
uaccccucaguuuuccuuaaaacgcgcacacaacucuagagaguguuaagaauaauguuacuug

SEQ ID NO: 54174 - RNA, 64 nt, Homo Sapiens
caaaaguugcugaaagaugcugugccuaugggguucuagagaguguugagugugguacauuaac

SEQ ID NO: 54175 - RNA, 64 nt, Homo Sapiens
ugccucccuggaauguuccagagacggaacauucucuagagacaacagucugugcugcagauug

SEQ ID NO: 54176 - RNA, 64 nt, Homo Sapiens
ugagggacauaaaugggccugggugacgagaaaaucuagagacaacacauauauuuuugaggcu

SEQ ID NO: 54177 - RNA, 64 nt, Homo Sapiens
ccugacauuuacaauggauugccucucaccccccucuagagaaagagguguccgcugacgggug

SEQ ID NO: 54178 - RNA, 64 nt, Homo Sapiens
ccagcugccuuugagaccagcuuaccuuucaaccucuagagagacagcaccuuagggccagggg

SEQ ID NO: 54179 - RNA, 64 nt, Homo Sapiens
cagccgaugugguaggugauaaagaggcaucuuuucuagagacacauuggaccagaugaggauc

SEQ ID NO: 54180 - RNA, 64 nt, Homo Sapiens
agaggaggaccccugccuuccucugaggacaggcucuagagagagggagaaacaaguggaccuc

SEQ ID NO: 54181 - RNA, 64 nt, Homo Sapiens
uucuuuauauauauuuuuuguugcaaagugucucucuagagaaacucuauauauuauucgaauu

SEQ ID NO: 54182 - RNA, 64 nt, Homo Sapiens
aaauuguacuuccaggcuuggauguaauuuuugcucuagagagaagcaaguggugggaaggagg

SEQ ID NO: 54183 - RNA, 64 nt, Homo Sapiens
agagaggcauagcaaaguggggguugcuaccauuucuagagagagaggacacagucccggccug

SEQ ID NO: 54184 - RNA, 64 nt, Homo Sapiens
ggccuuauuuugcaauuaugggaguaaacaauagucuagagaagcauuugguaagcuuuaucau

SEQ ID NO: 54185 - RNA, 64 nt, Homo Sapiens
agcacccacauccccuuucuugacaaaugauuuuucuagagaacuauguucuucccugacuuua

SEQ ID NO: 54186 - RNA, 64 nt, Homo Sapiens
caccuuccuccuacaggagguuaaggaugaacucucuagagaagggucagagcuaaauggcucc

SEQ ID NO: 54187 - RNA, 64 nt, Homo Sapiens
gccgcguugccaguuccucuggacagcacggacuucuagagagacccaccacugggcagaggcu

SEQ ID NO: 54188 - RNA, 64 nt, Homo Sapiens
gagaaauaggggugguuauuuaaaauaaugcugaucuagagauaauguuuuaguuugcuucacc

SEQ ID NO: 54189 - RNA, 64 nt, Homo Sapiens
uguuccuuaauagcauuguaggggcagaugaaagucuagagaacaaacagggaugucacuuuga

SEQ ID NO: 54190 - RNA, 64 nt, Homo Sapiens
gauacaaggcauaggugauuuaguagauuguguuucuagagaaauuucaaauugguuuuucuac

SEQ ID NO: 54191 - RNA, 64 nt, Homo Sapiens
ucaaacacugcuaaaggccuacugugcuaaucuaucuagagacccuaacuccccuucaucugua

SEQ ID NO: 54192 - RNA, 64 nt, Homo Sapiens
gacgauuuggcugucuaggcgucauuuggcaaugucuagagacauuuuugguaguuagaauggg

SEQ ID NO: 54193 - RNA, 64 nt, Homo Sapiens
uucugucagugccuuuuuuaauacaugaaagaauucuagagagaagccauauacauguaaguaa

SEQ ID NO: 54194 - RNA, 64 nt, Homo Sapiens
ggaccuacauuaucuggacuguaugcuggucauuucuagagacagcaaucaauauuugagugua

SEQ ID NO: 54195 - RNA, 64 nt, Homo Sapiens
gauucacuacaagguccaaguacuugggaagcuuucuagagauuacuuguacuuucuaaucugc

SEQ ID NO: 54196 - RNA, 64 nt, Homo Sapiens
uucuaagcgaacugccagaaguucuugauacauuucuagagaauuauaucauuggcuuucuuua

SEQ ID NO: 54197 - RNA, 64 nt, Homo Sapiens
ccaccucugugaacuuauuugugccuuacuccugucuagagaccgucagccucacccacaccgu

SEQ ID NO: 54198 - RNA, 64 nt, Homo Sapiens
cuuccggaauagucugggaaacugggucagcaauucuagagaacgagcccagagauccuacuag

SEQ ID NO: 54199 - RNA, 64 nt, Homo Sapiens
guuucccuuuuucugggacaugccaacagcuuguucuagagaagugaagaccugagcaggguuu

SEQ ID NO: 54200 - RNA, 64 nt, Homo Sapiens
accagguuugaugccugugaagagggagacuuguucuagagagguguguuucuggagugauucu

SEQ ID NO: 54201 - RNA, 64 nt, Homo Sapiens
cagcuuuauucaccugacugguucccuggcuguuucuagagaccuuuccagagacccagcuaca

SEQ ID NO: 54202 - RNA, 64 nt, Homo Sapiens
uauuuuuaauauagagaggaagauugaauauuuaucuagagaauacaaagacccacauguaaau

SEQ ID NO: 54203 - RNA, 64 nt, Homo Sapiens
uuuuugcuuuaacaacuauaaauauucuuagcugucuagagaaaagauguauguuauuuugaaa

SEQ ID NO: 54204 - RNA, 64 nt, Homo Sapiens
cagaguuuucucaaccuuugcuaugguuauucugucuagagacccugagccaacuuucaaauug

SEQ ID NO: 54205 - RNA, 64 nt, Homo Sapiens
guuacacuuucuuaaaauuugauuugucauauuuucuagagaaacuugaauuuaauuguguuau

SEQ ID NO: 54206 - RNA, 64 nt, Homo Sapiens
aggaaggcagacacccacaagaagaugacugaguucuagagaccccacaagcacuauggacgaa

SEQ ID NO: 54207 - RNA, 64 nt, Homo Sapiens
gagccuggagacaauggugacuucuucccugccuucuagagaaacucucuggucuuccucccca

SEQ ID NO: 54208 - RNA, 64 nt, Homo Sapiens
uugcccaagaagcccaccuucaccuuggaugaccucuagagaaacuuggagacacagaggguuu

SEQ ID NO: 54209 - RNA, 64 nt, Homo Sapiens
uaaacuggcuuaacgagucauuggacagcacuauucuagagaacagcgagagcauguccaucug

SEQ ID NO: 54210 - RNA, 64 nt, Homo Sapiens
ugaauuggaugaugacuauauugaggauaaaauuucuagagaagaaacaauacaugcuugcuau

SEQ ID NO: 54211 - RNA, 64 nt, Homo Sapiens
ugguuggagacuguuaacacugagcucauugacuucuagagauuuuauuuuuacugguugaucu

SEQ ID NO: 54212 - RNA, 64 nt, Homo Sapiens
uguuuccagagcaaaguaacagagaccagguuuuucuagagagcuaagugggauguguagcuca

SEQ ID NO: 54213 - RNA, 64 nt, Homo Sapiens
agcuauagcagaucucggacucaggucguucuuaucuagagaaggaguaaagcagcuuauguug

SEQ ID NO: 54214 - RNA, 64 nt, Homo Sapiens
aaaaaaauacagagucauccccuacccccaccccucuagagacccuccagcuaaaaacagagcc

SEQ ID NO: 54215 - RNA, 64 nt, Homo Sapiens
gggccaugaacuuuguccgguggaaggccuucuuucuagagagggaauucucuuggcuggcuuc

SEQ ID NO: 54216 - RNA, 64 nt, Homo Sapiens
ggccgucuccauuuuaugguugaggaaacugaggucuagagaggucaagauuacuugcccagaa

SEQ ID NO: 54217 - RNA, 64 nt, Homo Sapiens
uuugccugaaguaacagcaucuucuacuucuccaucuagagauuuuugugugugugccaucaag

SEQ ID NO: 54218 - RNA, 64 nt, Homo Sapiens
uuuguaguuaaaggguccaguucugacuggagccucuagagagcugggcuuguauguucuuuug

SEQ ID NO: 54219 - RNA, 64 nt, Homo Sapiens
uccugccugaucauuucauugguggcugaaggauucuagagaaccuuuuguucuugcaaggaaa

SEQ ID NO: 54220 - RNA, 64 nt, Homo Sapiens
ccucugggugcacccccugccuaccacccucccuucuagagagcacaucgccugaccggggaga

SEQ ID NO: 54221 - RNA, 64 nt, Homo Sapiens
gaauuaaccaacugaugacucuaacuucucaaguucuagagaaaaaauuuucaaugagcuuuuu

SEQ ID NO: 54222 - RNA, 64 nt, Homo Sapiens
aaauccaguuuccuggagcuccuuugagcugcccucuagagagcuggauugugagugaaugggc

SEQ ID NO: 54223 - RNA, 64 nt, Homo Sapiens
gggcuugcucuaaaucguuuagaggauaacaggaucuagagaugcucucugcuugacaacaaaa

SEQ ID NO: 54224 - RNA, 64 nt, Homo Sapiens
ggcugaagccucagauuccuucuaaacacagcuaucuagagagccacauccuguugacugaaag

SEQ ID NO: 54225 - RNA, 64 nt, Homo Sapiens
cucuauccucuguuucuuuaauuugcuaguuaugucuagagacuugaugagauugaaacauggc

SEQ ID NO: 54226 - RNA, 64 nt, Homo Sapiens
uccauuacaccacagcauuguguggaauuugaggucuagagagaaccaauaaaagugguaauug

SEQ ID NO: 54227 - RNA, 64 nt, Homo Sapiens
aaaauugcggcaggaugcaugucugucuguucuaucuagagaucacccauauaccuauauaugu

SEQ ID NO: 54228 - RNA, 64 nt, Homo Sapiens
uuuugauuauaguuaauccuucuaucuugaaucuucuagagaguugcugaccaacugacguaug

SEQ ID NO: 54229 - RNA, 64 nt, Homo Sapiens
ucuuaggcccucccuucaucguguguauauaaacucuagagacacaaaacagugacacucacuu

SEQ ID NO: 54230 - RNA, 64 nt, Homo Sapiens
caaguuuuaugguucuguuuuuaagagaguuguuucuagagaaaaccuuuguucugccuugguc

SEQ ID NO: 54231 - RNA, 64 nt, Homo Sapiens
ugacuaaugaugaacggaagcagauuugacuuucucuagagagccgcccgcuccgagagccaca

SEQ ID NO: 54232 - RNA, 64 nt, Homo Sapiens
gaaguaauugcagaagcaguaaaugcaaagugauucuagagaguggaugacaggccuccgcugg

SEQ ID NO: 54233 - RNA, 64 nt, Homo Sapiens
uugauuuuuuuauaauguuucaugauuuaaauuuucuagagauuaaaggaaucaaauaauucau

SEQ ID NO: 54234 - RNA, 64 nt, Homo Sapiens
ucucuugccccacgccgcuggcgaaaaugggacuucuagagagcgcaaaaauaagucaggagca

SEQ ID NO: 54235 - RNA, 64 nt, Homo Sapiens
uggacuggaggagcugggccuuucacccuucuacucuagagaagccacccugaacaacgagccu

SEQ ID NO: 54236 - RNA, 64 nt, Homo Sapiens
ggugugaccucucugugccuuacugaggcaccuuucuagagauuaaaaggggcuugauggcugu

SEQ ID NO: 54237 - RNA, 64 nt, Homo Sapiens
ccucucucucuccuuguccccccaaccuuccccaaugcacgaguaagcuggacagucacccagg

SEQ ID NO: 54238 - RNA, 64 nt, Homo Sapiens
gucuuuuuuuuuaaaacuguuaaugguggcuuaaaugcacgaaucuuauauuagagucagagac

SEQ ID NO: 54239 - RNA, 64 nt, Homo Sapiens
ucacaaugcaccauccaugaggaauggccauggaaugcacgaagccuuccuuugguugccauau

SEQ ID NO: 54240 - RNA, 64 nt, Homo Sapiens
uuggagaaccugacagggcucacacccagucucaaugcacgaagcagaaacccguaggcacgga

SEQ ID NO: 54241 - RNA, 64 nt, Homo Sapiens
agauugccuaccauuuuauaagcacaaaaagauaaugcacgaugugaaugugaagucaagucug

SEQ ID NO: 54242 - RNA, 64 nt, Homo Sapiens
gguggcccaggagagaggaucagccuugcccucaaugcacgaaaaucugggcugguacaggccu

SEQ ID NO: 54243 - RNA, 64 nt, Homo Sapiens
uuuuggaaucuuccuccugaggacacugacucccaugcacgauuacugggcaccuucccggagc

SEQ ID NO: 54244 - RNA, 64 nt, Homo Sapiens
auuuuagauuucuaccaccguugauauuucuaucaugcacgauuuugaaguugaggaaauauca

SEQ ID NO: 54245 - RNA, 64 nt, Homo Sapiens
ugaaaacugaaucaagaaaugaaugcuccaugaaaugcacgaagucuguuuuaaugacaaggug

SEQ ID NO: 54246 - RNA, 64 nt, Homo Sapiens
ccggaagcuggaccucacggagaugaaacggaagaugcacgaggauaugaucuccauacagaac

SEQ ID NO: 54247 - RNA, 64 nt, Homo Sapiens
accccgccuaccuguacucggguggccguaccugaugcacgaacaggugcuggugccaaccucu

SEQ ID NO: 54248 - RNA, 64 nt, Homo Sapiens
uuuguacuguaauuuugaauggaacugaaaaauuaugcacgaauaaaguacuuuucucaugcca

SEQ ID NO: 54249 - RNA, 64 nt, Homo Sapiens
aaucagcugccaauaauaucuaauauuuuucaucaugcacgaauuaauaaucaucauacucuag

SEQ ID NO: 54250 - RNA, 64 nt, Homo Sapiens
ggugcggggugcugggagcgcugcccccugucucaugcacgaguucugcagccuuucccaugcu

SEQ ID NO: 54251 - RNA, 64 nt, Homo Sapiens
uuuacuauagauaauauaugauaggccuuaugauaugcacgaauuauaguugaaguacaaauua

SEQ ID NO: 54252 - RNA, 64 nt, Homo Sapiens
uaauuuaaugcuaaagaguaggguguaguuguauaugcacgaugauuccaaggcaaaucuaaau

SEQ ID NO: 54253 - RNA, 64 nt, Homo Sapiens
gcagcaaacauucuggggcucaauggugucguccaugcacgacaagcacuagugcuuuuaugug

SEQ ID NO: 54254 - RNA, 64 nt, Homo Sapiens
aaccuugacucuaaaauucugugcugugcgaaacaugcacgauuuuuauuaugcuuacugcgua

SEQ ID NO: 54255 - RNA, 64 nt, Homo Sapiens
gaggaacugggguugcuaaccucagggaaccacaaugcacgaaagggggcuggguuaacguuuu

SEQ ID NO: 54256 - RNA, 64 nt, Homo Sapiens
uacaagccacuggagaccccuuuuuucugauacaaugcacgauucucugcgcgcaaggacccuc

SEQ ID NO: 54257 - RNA, 64 nt, Homo Sapiens
caauuuugggucaugaaaguuugcaauauaguaaaugcacgauugacuguugcuuugugccuca

SEQ ID NO: 54258 - RNA, 64 nt, Homo Sapiens
ugauagugcaauaaucagugaucuauagacccucaugcacgauucaaguuucacucuuguggcu

SEQ ID NO: 54259 - RNA, 64 nt, Homo Sapiens
ggcauaaacaagaacaacaaaggaaguguaauagaugcacgacaacccuuaaggucuuuaaggg

SEQ ID NO: 54260 - RNA, 64 nt, Homo Sapiens
ucagcaugggcccaggaaugccaaggagacaucuaugcacgaccuugggaaaugaguugauguc

SEQ ID NO: 54261 - RNA, 64 nt, Homo Sapiens
guugaaguggguaagcagcaggguaccuuguauaaugcacgacaguugcaguaugggaagaaug

SEQ ID NO: 54262 - RNA, 64 nt, Homo Sapiens
auuucucuauuuuugaauacuacaucagauuuagaugcacgacuaccuguugacuuguuuuaua

SEQ ID NO: 54263 - RNA, 64 nt, Homo Sapiens
uggccauggauccgacuacugucucuagauacagaugcacgauuuggagcgagaauaaaaaguu

SEQ ID NO: 54264 - RNA, 64 nt, Homo Sapiens
uuuaauuuacucauguccacaacguguagcugacaugcacgaagagcugagaaaggagacgaug

SEQ ID NO: 54265 - RNA, 64 nt, Homo Sapiens
cagaguuucgcuuugucgcccaggcuggagugcaaugcacgaucucaguucacugcaaccucug

SEQ ID NO: 54266 - RNA, 64 nt, Homo Sapiens
agcccuuuuccccaagagucccaucucuucugccaugcacgacaugaaaauccacuucucuucc

SEQ ID NO: 54267 - RNA, 64 nt, Homo Sapiens
uuuuuuuuuuuugucaagagccaagacacagguaaugcacgacauugauugcugcauuuuaccu

SEQ ID NO: 54268 - RNA, 64 nt, Homo Sapiens
ugugaaguucuuugucacugaugugaccaaagaaaugcacgaaaauucauucuaaugaaagaaa

SEQ ID NO: 54269 - RNA, 64 nt, Homo Sapiens
cuggggucaaagacuuguguugcuagugccugagaugcacgaugagaaacagagguggcugcug

SEQ ID NO: 54270 - RNA, 64 nt, Homo Sapiens
gaauuguguuuugcguuuuuuuggagcccuuaagaugcacgauguuuuuuccuauuuuugacga

SEQ ID NO: 54271 - RNA, 64 nt, Homo Sapiens
uuugaacauucguuauggggggaacagcagagugaugcacgaacuguuucccgguuauguguag

SEQ ID NO: 54272 - RNA, 64 nt, Homo Sapiens
guccuuguucccccaggaagaugucgucacucacaugcacgacaacaguauguaaaugcuauua

SEQ ID NO: 54273 - RNA, 64 nt, Homo Sapiens
ggagccggccgcccucggucugguguaagcacacaugcacgauuaaagaggagacgccgggacc

SEQ ID NO: 54274 - RNA, 64 nt, Homo Sapiens
gagugugggggucuggagggcgauccugcaaugaaugcacgauggaacccgucgcuaaacugca

SEQ ID NO: 54275 - RNA, 64 nt, Homo Sapiens
ggagcaccguggagaagacgacagcugccaggucaugcacgaagguggaggucccgcagaagcu

SEQ ID NO: 54276 - RNA, 64 nt, Homo Sapiens; identical to SEQ ID NO: 52236

SEQ ID NO: 54277 - RNA, 64 nt, Homo Sapiens; identical to SEQ ID NO: 52237

SEQ ID NO: 54278 - RNA, 64 nt, Homo Sapiens; identical to SEQ ID NO: 52238

SEQ ID NO: 54279 - RNA, 64 nt, Homo Sapiens; identical to SEQ ID NO: 52239

SEQ ID NO: 54280 - RNA, 64 nt, Homo Sapiens; identical to SEQ ID NO: 52240

SEQ ID NO: 54281 - RNA, 64 nt, Homo Sapiens; identical to SEQ ID NO: 52241

SEQ ID NO: 54282 - RNA, 64 nt, Homo Sapiens; identical to SEQ ID NO: 52242

SEQ ID NO: 54283 - RNA, 64 nt, Homo Sapiens; identical to SEQ ID NO: 52243

SEQ ID NO: 54284 - RNA, 64 nt, Homo Sapiens; identical to SEQ ID NO: 52244

SEQ ID NO: 54285 - RNA, 64 nt, Homo Sapiens; identical to SEQ ID NO: 52245

SEQ ID NO: 54286 - RNA, 64 nt, Homo Sapiens; identical to SEQ ID NO: 52246

SEQ ID NO: 54287 - RNA, 64 nt, Homo Sapiens; identical to SEQ ID NO: 52247

SEQ ID NO: 54288 - RNA, 64 nt, Homo Sapiens; identical to SEQ ID NO: 52248

SEQ ID NO: 54289 - RNA, 64 nt, Homo Sapiens; identical to SEQ ID NO: 52249

SEQ ID NO: 54290 - RNA, 64 nt, Homo Sapiens; identical to SEQ ID NO: 52250

SEQ ID NO: 54291 - RNA, 64 nt, Homo Sapiens; identical to SEQ ID NO: 52251

SEQ ID NO: 54292 - RNA, 64 nt, Homo Sapiens; identical to SEQ ID NO: 52252

SEQ ID NO: 54293 - RNA, 64 nt, Homo Sapiens; identical to SEQ ID NO: 52253

SEQ ID NO: 54294 - RNA, 64 nt, Homo Sapiens; identical to SEQ ID NO: 52254

SEQ ID NO: 54295 - RNA, 64 nt, Homo Sapiens; identical to SEQ ID NO: 52255

SEQ ID NO: 54296 - RNA, 64 nt, Homo Sapiens
uaccuggugauaaguuccaaauauguuaagggcuuuaauacaaaaagcaaaaauugucaguguu

SEQ ID NO: 54297 - RNA, 64 nt, Homo Sapiens
uccugguaggcuuacaaguguuuacuauaugcuauuaauacauuauacuuuauaacuaauagau

SEQ ID NO: 54298 - RNA, 64 nt, Homo Sapiens
ccuuuuccucccauccaccuagcagcaguaucuauuaauacauguauaauuuaugucauuuuau

SEQ ID NO: 54299 - RNA, 64 nt, Homo Sapiens
uuugcuuuauucucacaugcgucaucaguaaaucuuaauacacugucagauaccaugaaugcca

SEQ ID NO: 54300 - RNA, 64 nt, Homo Sapiens
uuaccucaugauuucuuuuggucaaucaggaucuuuaauacaauauagaaauuguguaauaguu

SEQ ID NO: 54301 - RNA, 64 nt, Homo Sapiens
caauauagaaauuguguaauaguuauuauaaauguuaauacacaacuuucagguaauuuuaacu

SEQ ID NO: 54302 - RNA, 64 nt, Homo Sapiens
ugcguuuaaucauugucucuucauuuuaagacuuuuaauacaaaugucauuuuuaaagaaacaa

SEQ ID NO: 54303 - RNA, 64 nt, Homo Sapiens
auuguuuguguuucuguguuucauauucagugauuuaauacaguaucauggcugagguggaugg

SEQ ID NO: 54304 - RNA, 64 nt, Homo Sapiens
ucacaugauuucuauguuuccauaugucauaguuuuaauacaauuuuucuuuauauaauauugu

SEQ ID NO: 54305 - RNA, 64 nt, Homo Sapiens
uauacauaauacauuuguacuaugaagcuugcauuuaauacauuuagagacauuggugucauua

SEQ ID NO: 54306 - RNA, 64 nt, Homo Sapiens
guuauuucaucuuuuauucaaggaaguuuuaacuuuaauacagcucaguaaauggcuucuucua

SEQ ID NO: 54307 - RNA, 64 nt, Homo Sapiens
caauuagaucuaaacaguuauuucuguuuccuauuuaauacagcugaagucaaaauauguaaga

SEQ ID NO: 54308 - RNA, 64 nt, Homo Sapiens
aaugcuuagauuaaaaaaaaaaaauuacguaggauuaauacagaaauuuaaucaugucugauua

SEQ ID NO: 54309 - RNA, 64 nt, Homo Sapiens
aggagguugguaagagugacuaaccagccuaacuuuaauacacauguauaaagauguucacaga

SEQ ID NO: 54310 - RNA, 64 nt, Homo Sapiens
gccauuucucagagaaugaucaggccuuaggaaauuaauacaguaguaguaaucauuuucuagg

SEQ ID NO: 54311 - RNA, 64 nt, Homo Sapiens
auacauuaagucaucucuagauuauuuauaacacuuaauacaauguaaaugcuauguaguuguu

SEQ ID NO: 54312 - RNA, 64 nt, Homo Sapiens
aaauuuuuauaauugucucagccuugucuugauauuaauacauguuacaacuaagcuggcccca

SEQ ID NO: 54313 - RNA, 64 nt, Homo Sapiens
auuauuugguauucuguauagaaauacugaauuuuuaauacauugaugaagaagucuuaauacu

SEQ ID NO: 54314 - RNA, 64 nt, Homo Sapiens
uucucuuuguaugucuguuaccuuguuaauagacuuaauacaugcaacagaagugacuucugga

SEQ ID NO: 54315 - RNA, 64 nt, Homo Sapiens
cagaaaccauucuagguguuucaacagagggaguuuaauacaggaaauugacuuacauagauga

SEQ ID NO: 54316 - RNA, 64 nt, Homo Sapiens
uuauuauguacuauucaauccuugacaaaaucuuuuaauacaguacauaccaugugccacacac

SEQ ID NO: 54317 - RNA, 64 nt, Homo Sapiens
cacccagauaaucauuaaaaacuuuccccuuuuauuaauacauuccccccaugccaccggcucc

SEQ ID NO: 54318 - RNA, 64 nt, Homo Sapiens
uauauuaauugagauuauuacagcucugggaaauuuaauacauuucuauuuuccuuaaucaaac

SEQ ID NO: 54319 - RNA, 64 nt, Homo Sapiens
uggggccucuuuauguuuaggaauguuuaaaauauuaauacagaacuuacauagcucaaauauu

SEQ ID NO: 54320 - RNA, 64 nt, Homo Sapiens
cagaagguuucgaaauguaauaaaccagaucaaauuaauacaauaagggggaauauuuuaaaaa

SEQ ID NO: 54321 - RNA, 64 nt, Homo Sapiens
uguuuaccacuuguuuauguuuaguauuucuauuuuaauacauuucuguugcaccacucuaguu

SEQ ID NO: 54322 - RNA, 64 nt, Homo Sapiens
uugaaguauuuuauucuuuuaaagagaaauugcauuaauacagauaaaaacguuuaaaaguuuu

SEQ ID NO: 54323 - RNA, 64 nt, Homo Sapiens
uuaaagcaauaacuuucauaguuucuuucaaaguuuaauacauccaauaugucaaguuaaacca

SEQ ID NO: 54324 - RNA, 64 nt, Homo Sapiens
augucaaguuaaaccauucugggauuugcaaaguuuaauacauccaauaugucaaguuaaacca

SEQ ID NO: 54325 - RNA, 64 nt, Homo Sapiens; identical to SEQ ID NO: 54324

SEQ ID NO: 54326 - RNA, 64 nt, Homo Sapiens
accggcaccugccagacagagcugguucuaagauuuaauacagugcuuuuuuuccucuuugaaa

SEQ ID NO: 54327 - RNA, 64 nt, Homo Sapiens
uggaaaagccaccaauucuagaucuugauuugaauuaauacacacaauaucugagacacuuaca

SEQ ID NO: 54328 - RNA, 64 nt, Homo Sapiens
gagugugcaugaaccaaaggaaauaacauugaagaaggaaaacaauauguagaaaguauuuuag

SEQ ID NO: 54329 - RNA, 64 nt, Homo Sapiens
uacaucugaauaauuauggaaguugggacauguuaaggaaaacaaauauguucaucaccaacaa

SEQ ID NO: 54330 - RNA, 64 nt, Homo Sapiens
aauaaacuuuuccagaagcacgagguaguuugcaaaggaaaagucugcacuguuugcucuaaag

SEQ ID NO: 54331 - RNA, 64 nt, Homo Sapiens
uguuuugcuguauuucaaaauuuuccuucuguuaaaggaaaauauugugaauaaccacuggugu

SEQ ID NO: 54332 - RNA, 64 nt, Homo Sapiens
aauugcacuuucugguaaaaaguuaaaaauuuuuaaggaaaaaauaauuucaaugguuaaaguu

SEQ ID NO: 54333 - RNA, 64 nt, Homo Sapiens
guguuuacauuuaaagaucauuugcaccuuuuucaaggaaaaaaaguauugaguaaacaauugu

SEQ ID NO: 54334 - RNA, 64 nt, Homo Sapiens
gaaaguggcuuucuacuuucaaaaaugaaacaaaaaggaaaaauggcaaaguacuguuuuagcu

SEQ ID NO: 54335 - RNA, 64 nt, Homo Sapiens
cuguagaaaauguuaaaaauaccaacucacuuggaaggaaaaauaaaaaucacaaagguauauu

SEQ ID NO: 54336 - RNA, 64 nt, Homo Sapiens
uuguaucgggaauuucucagagcugaguaaaaugaaggaaaagcauguuauguguuuuuaagga

SEQ ID NO: 54337 - RNA, 64 nt, Homo Sapiens
aguaaaaugaaggaaaagcauguuauguguuuuuaaggaaaaugugcacacauauacauguagg

SEQ ID NO: 54338 - RNA, 64 nt, Homo Sapiens
agaagcccugcugucugucuaaggaaaaaaaaaaaaggaaaaccaaaaaaaaaaaaaaaggaaa

SEQ ID NO: 54339 - RNA, 64 nt, Homo Sapiens
aaaaaaggaaaaccagaagcaaaaaaaaaggaaaaaggaaaaaauaugcuuucuucuuaaaaaa

SEQ ID NO: 54340 - RNA, 64 nt, Homo Sapiens
gaaaaaaaaaaaaggaaaacuaaaaaaaaaaaaaaaggaaaaagcaaccucuaugcuuucuucu

SEQ ID NO: 54341 - RNA, 64 nt, Homo Sapiens
auuuguaagauguugcacuauuucuguuuuuuuaaaggaaaacuuguagagagcuguugauuug

SEQ ID NO: 54342 - RNA, 64 nt, Homo Sapiens
agaaaccgaagccaguauuuuguaggaaauuugaaaggaaaaaaacacaaauauguaaagcaau

SEQ ID NO: 54343 - RNA, 64 nt, Homo Sapiens
cuuuuugucaauaacucuguguaagaacaggcagaaggaaaaccuuuuucugaaaguggcugau

SEQ ID NO: 54344 - RNA, 64 nt, Homo Sapiens
ggugccugaauuuccuggggcaggaaaugaaacaaaggaaaacacaggcagaacagucauaagc

SEQ ID NO: 54345 - RNA, 64 nt, Homo Sapiens
cuauuuugggguaucaguguucuucagaggaaggaaggaaaaucucuuggauuuuuugaaauaa

SEQ ID NO: 54346 - RNA, 64 nt, Homo Sapiens
cuuaguuuaaagggggaaagaaaagggaagaagaaaggaaaagagaaauccaacuccuuuuuca

SEQ ID NO: 54347 - RNA, 64 nt, Homo Sapiens
caccuuuguauuuucaagaacucuucuauuuauuaaggaaaaugucacauugugauguauuaag

SEQ ID NO: 54348 - RNA, 64 nt, Homo Sapiens
cagagucugucugcagcuauguggugagcuauguaaggaaaaaaaucugggcuguuagagugaa

SEQ ID NO: 54349 - RNA, 64 nt, Homo Sapiens
uagagugaaaaaguguguuuuaugucaauugugaaaggaaaauguuaggaguaugguuuuuaaa

SEQ ID NO: 54350 - RNA, 64 nt, Homo Sapiens
ucaugccacggauaaaugaggcaaauccgaagaaaaggaaaaucgaauaaaaaauagucccaca

SEQ ID NO: 54351 - RNA, 64 nt, Homo Sapiens
auucauccauacagaauuuggaugacuauguauaaaggaaaacuuaaaucuuaauuauuaucag

SEQ ID NO: 54352 - RNA, 64 nt, Homo Sapiens
gguuuuaaacgacuuuuguuugcggggcuuuuaaaaggaaaaccgaauuagguccacuucaaug

SEQ ID NO: 54353 - RNA, 64 nt, Homo Sapiens
cgaauuagguccacuucaauguccaccugugagaaaggaaaaauuuuuuuguuguuuaacuugu

SEQ ID NO: 54354 - RNA, 64 nt, Homo Sapiens
gaaagucaaaaaaacgaaagagaaggagaagaaaaaggaaaagggcaaauugaaagucaaggag

SEQ ID NO: 54355 - RNA, 64 nt, Homo Sapiens
agaaaaagcgcaaagaggagaaugaagauccagaaaggaaaauaaagaagaagggcuucggcgc

SEQ ID NO: 54356 - RNA, 64 nt, Homo Sapiens
uucuuaaaaguguaaagaagccucauaagaucauaaggaaaauguauauaugcuuuucacagcu

SEQ ID NO: 54357 - RNA, 64 nt, Homo Sapiens
guuaacaaugccaugaaagcauuuucuuucuccuaaggaaaagugaauuucuuaucagaauauc

SEQ ID NO: 54358 - RNA, 64 nt, Homo Sapiens
ucagaagaccaguacuggagggugaaaagcccagaaggaaaauuuuguauccaaauguagugca

SEQ ID NO: 54359 - RNA, 64 nt, Homo Sapiens
uuaaagcaaggcggaacagaugaaacagauuucaaaggaaaagcgagcccauauaugcggucca

SEQ ID NO: 54360 - RNA, 64 nt, Homo Sapiens
cuucuuuugagauuaauucuacugauuuuuccauaaggaaaauguauuagauccuauaaauuga

SEQ ID NO: 54361 - RNA, 64 nt, Homo Sapiens
guaauuaugagguguagcagaauagucacuguuuaaggaaaaaaccuugaaugucuguugauga

SEQ ID NO: 54362 - RNA, 64 nt, Homo Sapiens
caugacauuguguaucgauuaaaaaaaaaaggaaaaggaaaaaggcugagcugcuuguuuaaaa

SEQ ID NO: 54363 - RNA, 64 nt, Homo Sapiens
aaaaagcaugacauuguguauuaaaaaaaaaaaaaaggaaaaggcaaaucgcugagcugcuugu

SEQ ID NO: 54364 - RNA, 64 nt, Homo Sapiens
aaaguguauugcacaaugaggacugcaaagguaaaaggaaaauacacaacgauuacucgaagau

SEQ ID NO: 54365 - RNA, 64 nt, Homo Sapiens
aguuauuuauaauugccuugaaauauauauuacuaaggaaaaaauuuaauguacuucaaaaagc

SEQ ID NO: 54366 - RNA, 64 nt, Homo Sapiens
uugcuaguuuauaaugucuuacuaaugcagaaacaaggaaaaaagcaaaauuggccugaauauu

SEQ ID NO: 54367 - RNA, 64 nt, Homo Sapiens
uuauuaguugauucacaguacagaacaagguauaaaggaaaaaacccugcuagguaguguuaua

SEQ ID NO: 54368 - RNA, 64 nt, Homo Sapiens
agguucauuuuaagauuuacuuggaagagcaaagaaggaaaaauuauauuuuuaaagaaagaga

SEQ ID NO: 54369 - RNA, 64 nt, Homo Sapiens
ccagucccccaaccccagccgcucggaggccccaaaggaaaaagcacaagaagcgugagacgcc

SEQ ID NO: 54370 - RNA, 64 nt, Homo Sapiens
cucauucucguagcuuuuuaaaaaaaugaaaguaaaggaaaaaaaaaaaacugcaaaucuagaa

SEQ ID NO: 54371 - RNA, 64 nt, Homo Sapiens
auuuuccuucauccuugugacauuucauuucaguaaggaaaagauaacaaagugcaauuaucag

SEQ ID NO: 54372 - RNA, 64 nt, Homo Sapiens
guuggaauccuccuucuagcugaaggugauugaaaaggaaaagagugagugaacagaaccauag

SEQ ID NO: 54373 - RNA, 64 nt, Homo Sapiens
accucguuuuucuuuuguuugcauuuucugcaaaaaggaaaaagaaaccacaaauuggggaaaa

SEQ ID NO: 54374 - RNA, 64 nt, Homo Sapiens
augggaagagaggagagggagaaaaauaaaaugaaaggaaaaaaaaaaguuugcaaauucagac

SEQ ID NO: 54375 - RNA, 64 nt, Homo Sapiens
augcaguugaauggaaaauuacucaguguauagaaaggaaaaaaaccagaaauuuaaaauagau

SEQ ID NO: 54376 - RNA, 64 nt, Homo Sapiens
aaauaacauaagucugaaagcaaugaaaacgucaaaggaaaauguuuauauacauccacauguu

SEQ ID NO: 54377 - RNA, 64 nt, Homo Sapiens
agcauggagaaaacccgguacgcucaaaaagaaaaaggaaaaaaaaaaaucccaucacccacag

SEQ ID NO: 54378 - RNA, 64 nt, Homo Sapiens
auuuggacauuuuaauuguuuaaaaauuguacaaaaggaaaaaauuagaauaaguacuggcgaa

SEQ ID NO: 54379 - RNA, 64 nt, Homo Sapiens
cugauuuagaauuacugguagcuuauuuuaaagcaaggaaaagcagcugagcucaaguuugcug

SEQ ID NO: 54380 - RNA, 64 nt, Homo Sapiens
auauuguauauaaacaaaacaauaugcuuuguugaaggaaaauuuucuuuauuggaaugugguu

SEQ ID NO: 54381 - RNA, 64 nt, Homo Sapiens
aaaacaggaccuagguguuuagauccugucucaaaaggaaaaagccagcuugggcaacagagca

SEQ ID NO: 54382 - RNA, 64 nt, Homo Sapiens
augcauuuaaccaugccaccuuauauacaacuacaaggaaaaaauugauaaauggaaccagagg

SEQ ID NO: 54383 - RNA, 64 nt, Homo Sapiens
ugaaucaauacucauugauuuaaggaaaaauagaaaggaaaacucuacuguaagaaacuuauca

SEQ ID NO: 54384 - RNA, 64 nt, Homo Sapiens
agaaaggaaaacuugaaucaaagaaacuuaucauaaggaaaaauguuguuguauaagcuacugu

SEQ ID NO: 54385 - RNA, 64 nt, Homo Sapiens
uuguauggcaucgaauagccauuguuuuauguaaaaggaaaaucuuuuugagauguaauuuaag

SEQ ID NO: 54386 - RNA, 64 nt, Homo Sapiens
uaaaucagaacuccauaaaucacacuuaaaagcaaaggaaaaaauucacgugcacaaagauuag

SEQ ID NO: 54387 - RNA, 64 nt, Homo Sapiens
gucaaaguuucaaagcaagauaguuauuaagcaaaaggaaaaaugguaaugauagaaagucagu

SEQ ID NO: 54388 - RNA, 64 nt, Homo Sapiens
gagaaggacugaaaagguacauuaagugugcuguaaggaaaagucuuagaaacauaauaagcua

SEQ ID NO: 54389 - RNA, 64 nt, Homo Sapiens
uauuguaaauauguuuuuuagaucaaauacuuuaaaggaaaaaauguuggauuuauaaaugcua

SEQ ID NO: 54390 - RNA, 64 nt, Homo Sapiens
auaaaugcuauuuuuuauuuuacuuuuauaauaaaaggaaaagcaaauugaugaccucaccuug

SEQ ID NO: 54391 - RNA, 64 nt, Homo Sapiens
uagcaagcaugaauuuuucacccaagagugaaaaaaggaaaaucuaccauggcuugaaguuaaa

SEQ ID NO: 54392 - RNA, 64 nt, Homo Sapiens
guggcagguacuaugaauguaauucauaauuuaaaaggaaaacuaaaaacuauuuugauuuggg

SEQ ID NO: 54393 - RNA, 64 nt, Homo Sapiens
cacacacacacguuugcagggaaaucuaccgagcaaggaaaagguccacguaacuggcugcaga

SEQ ID NO: 54394 - RNA, 64 nt, Homo Sapiens
aagacaaauuaaaggagggggguuuaaaaaacauaaggaaaaaaaaaagccaacaacccagaaa

SEQ ID NO: 54395 - RNA, 64 nt, Homo Sapiens
uuaaauagcuuaauaucaauagaguugguuugcaaaggaaaaguugaaaguuuaaagaggggga

SEQ ID NO: 54396 - RNA, 64 nt, Homo Sapiens
ugauagaauaauauucaagauguggaaacaugcaaaggaaaaagaggaugagaaguaagcaaac

SEQ ID NO: 54397 - RNA, 64 nt, Homo Sapiens
gccugcucuccaguagccugcaggcaaaguagugaaggaaaaaacagcacugcagaaaccacuc

SEQ ID NO: 54398 - RNA, 64 nt, Homo Sapiens
uauggacucuguuaagaaaugucuggccuuuggaaaggaaaaaucuaucuguaacaucagagcu

SEQ ID NO: 54399 - RNA, 64 nt, Homo Sapiens
uauucuaguagguaagacugucccaguaaauagaaaggaaaauaaaauugcgaaggcuuuugcc

SEQ ID NO: 54400 - RNA, 64 nt, Homo Sapiens
aauggugaauuuuggagagcagucauacaaauagaaggaaaaacgucuugcccuugaauaacua

SEQ ID NO: 54401 - RNA, 64 nt, Homo Sapiens
ugaccuguuaggcugagcucaggaauuguccaaaaaggaaaaagcaaaauaauuaauugagagu

SEQ ID NO: 54402 - RNA, 64 nt, Homo Sapiens
ucugaguccagauuucucaucaacuggcaauacaaaggaaaauaugguacaggaguuaguuaga

SEQ ID NO: 54403 - RNA, 64 nt, Homo Sapiens
aaaggguuggagugugccagugcacagguagacuaaggaaaacauuauagaggagugaagagaa

SEQ ID NO: 54404 - RNA, 64 nt, Homo Sapiens
gacaagaugucuaauuuuuuuuuaaguaggaccaaaggaaaacaagauuuagauagucugacuu

SEQ ID NO: 54405 - RNA, 64 nt, Homo Sapiens
gauucagagaugucugcucuuuuaaauuauauauaaggaaaaaaaauagccugccuugggacag

SEQ ID NO: 54406 - RNA, 64 nt, Homo Sapiens
aauuuuuuuuccaguguauugcucauauuaucagaaggaaaaguuauuuaaguaugucaguuaa

SEQ ID NO: 54407 - RNA, 64 nt, Homo Sapiens
uucauguucauauguacuugcucuguauaaguugaaggaaaaugcaugugguucacguacaaaa

SEQ ID NO: 54408 - RNA, 64 nt, Homo Sapiens
aguugcaagacucgaauaaaaaugaagagaaaaaaaggaaaagaacuucggagaggccaagucu

SEQ ID NO: 54409 - RNA, 64 nt, Homo Sapiens
cucuuuauuacuuaaaaguagaaaaaagaaaagcaaggaaaaggaaaaagaaaagaaaaaaagg

SEQ ID NO: 54410 - RNA, 64 nt, Homo Sapiens
uuaggaggggaauauuuauucuggucuguagcuaaaggaaaaaggagcuuuguguuuggacugu

SEQ ID NO: 54411 - RNA, 64 nt, Homo Sapiens
ugauagcaccguuuguucugugagcuggaaacagaaggaaaaaacauacccuuggguacccaua

SEQ ID NO: 54412 - RNA, 64 nt, Homo Sapiens
uugagauaaugaaaagugauaucuucgcauacgaaaggaaaaaagguugagguauauaugauuu

SEQ ID NO: 54413 - RNA, 64 nt, Homo Sapiens
agcauccuuaagauuuaaaaaaaaaaaaaaaaaaaaggaaaaaaaagugauggaagccguaagu

SEQ ID NO: 54414 - RNA, 64 nt, Homo Sapiens
ucuugucuauuuuuucucuucauguuguaacaaaaaggaaaaaagaaaaaaaaaucccaucccu

SEQ ID NO: 54415 - RNA, 64 nt, Homo Sapiens
ccaacugaccuagugaagguucagaugcaaauggaaggaaaaaggaaacuggaaggaaaaccau

SEQ ID NO: 54416 - RNA, 64 nt, Homo Sapiens
guucagaugcaaauggaaggaaaaaggaaacuggaaggaaaaccauugcgguaaguucuccaau

SEQ ID NO: 54417 - RNA, 64 nt, Homo Sapiens
agaaacacaggaaaugaaaaauuuuuaaaaaaagaaggaaaaauguuuuaaauacaaaaggaaa

SEQ ID NO: 54418 - RNA, 64 nt, Homo Sapiens
uuuaaaaaaagaaggaaaaauguuuuaaauacaaaaggaaaaacagacaaaaauuuaauuuuag

SEQ ID NO: 54419 - RNA, 64 nt, Homo Sapiens
uaugucugccaaguuguuagaaucuuugaaucagaaggaaaaaaagcagcgcugguugacaaag

SEQ ID NO: 54420 - RNA, 64 nt, Homo Sapiens
cuucuauuuugugaagggacuauauuuuuugagaaaggaaaaucucaguuagauauauuuugug

SEQ ID NO: 54421 - RNA, 64 nt, Homo Sapiens
caaagaaaugcauucauaucaaaauuggaauagaaaggaaaaccuauuuuuaagauaucaaccu

SEQ ID NO: 54422 - RNA, 64 nt, Homo Sapiens
gucugucauaaauuauuuccccgguaauuuuugaaaggaaaaauguauaacaaguacuauuuac

SEQ ID NO: 54423 - RNA, 64 nt, Homo Sapiens
ggauuuaauuugacuggguuaacaugcaaaaaccaaggaaaaauauuuaguuuuuuuuuuuuuu

SEQ ID NO: 54424 - RNA, 64 nt, Homo Sapiens
cagacaaucuuauguagcaaagauuaugccugaaaaggaaaauuauucagggcagcuaauuuug

SEQ ID NO: 54425 - RNA, 64 nt, Homo Sapiens
cccacaaaauuccuguuacccaugaaggagaggcaaggaaaagcaaaugagugugucauuucca

SEQ ID NO: 54426 - RNA, 64 nt, Homo Sapiens
gcugugguugcugcugcuucaggcagccauuuggaaggaaaacugugaccaaauagucuacagg

SEQ ID NO: 54427 - RNA, 64 nt, Homo Sapiens
uuaccaaaaauauauuuugauaaagcaugcuuagaaggaaaagcacuuacuauuuucagcuuuu

SEQ ID NO: 54428 - RNA, 64 nt, Homo Sapiens
gaaucaauauacucuuuguuugaagaggaguaggaaggaaaaugccuauauaugauuauuugaa

SEQ ID NO: 54429 - RNA, 64 nt, Homo Sapiens
auauuuuaggguagaugaauaaauaucuauuccaaaggaaaaucucuccaacucucugauccug

SEQ ID NO: 54430 - RNA, 64 nt, Homo Sapiens
acaccuaucucuccaacucuuguguuugaagauuaaggaaaagaugugugugugugugugugug

SEQ ID NO: 54431 - RNA, 64 nt, Homo Sapiens
gaaggucuguucuugcucucuuguaggaaauugcaaggaaaauagaacauacucuccuaagugg

SEQ ID NO: 54432 - RNA, 64 nt, Homo Sapiens
uuuuaguguguauuguacauguuacuucccuuugaaggaaaaguuaauuuugaucaaaagacgu

SEQ ID NO: 54433 - RNA, 64 nt, Homo Sapiens
augucauugguauaugguggcuguuuaccaauaaaaggaaaaaauucauuaaccgguugcuucc

SEQ ID NO: 54434 - RNA, 64 nt, Homo Sapiens
cuuccuugucucaugaaaaccuaaauauaaaaaaaaggaaaauacuggaguuuuuauuucucuu

SEQ ID NO: 54435 - RNA, 64 nt, Homo Sapiens
agacaguuauuccauaaagcauuuguauaauuaaaaggaaaacagaaaaaggaaaaguaggcaa

SEQ ID NO: 54436 - RNA, 64 nt, Homo Sapiens
uaaagcauuuguauaauuaaaaggaaaacagaaaaaggaaaaguaggcaaaugugaaaauaguu

SEQ ID NO: 54437 - RNA, 64 nt, Homo Sapiens
ucaaaaugcauuguugcauuaagcuuuuucaauaaaggaaaauuacggaaggaaaauaggcaac

SEQ ID NO: 54438 - RNA, 64 nt, Homo Sapiens
ugcauuaagcuuuuucaauaaaggaaaauuacggaaggaaaauaggcaacaccagcaaauuaua

SEQ ID NO: 54439 - RNA, 64 nt, Homo Sapiens
ccaaaugcuuugguuauuagaggacgaaguugagaaggaaaacgugaaacuccauguagcaacc

SEQ ID NO: 54440 - RNA, 64 nt, Homo Sapiens
aacucuaggauuucuuuuuugguaaacccuuuucaaggaaaaaccuuccucuucacuggcucga

SEQ ID NO: 54441 - RNA, 64 nt, Homo Sapiens
gaucaaaaacaaaguaagguccaaaauucagcuaaaggaaaaaugaguaagugcuauuggcauu

SEQ ID NO: 54442 - RNA, 64 nt, Homo Sapiens
gaauaagaaugaaaacugcuaaaaugaaaaaaagaaggaaaaaauguguuaacauugcaaugaa

SEQ ID NO: 54443 - RNA, 64 nt, Homo Sapiens
gagaggagagucuuacggagggcugggagcuuaaaaggaaaacaauguccuuacuuguaaacag

SEQ ID NO: 54444 - RNA, 64 nt, Homo Sapiens
acgacuucuguuucacaguucagaccggucuucaaaggaaaagccuguccgauuuuuccauggg

SEQ ID NO: 54445 - RNA, 64 nt, Homo Sapiens
agcugaaaucuauucucauucuuguuugucaagaaaggaaaaucuguuauucaagguaaauuau

SEQ ID NO: 54446 - RNA, 64 nt, Homo Sapiens
gaaggaggcuuuucuucucagcuaacaggcauauaaggaaaaccaucuagagaguuuucuuuag

SEQ ID NO: 54447 - RNA, 64 nt, Homo Sapiens
caggcaugcuagcuggcccguguaaucccaagacaaggaaaacauucguuuuccucaugggucu

SEQ ID NO: 54448 - RNA, 64 nt, Homo Sapiens
uucuaaauuuauuuaaaugcuuagcaggaagcauaaggaaaagccaucggccuccaauacccau

SEQ ID NO: 54449 - RNA, 64 nt, Homo Sapiens
auuggugacagagcacaaauuaaucaccauauaaaaggaaaaaaauuaguguucaauauugcuu

SEQ ID NO: 54450 - RNA, 64 nt, Homo Sapiens
aacccuaaacacaaagcaucuauuaugagccuuuaaggaaaacagcuaaaauauuugccaucuu

SEQ ID NO: 54451 - RNA, 64 nt, Homo Sapiens
aauguagcucaacuugugauuguucaacucuauaaaggaaaagggugcaaucaccccugccuuu

SEQ ID NO: 54452 - RNA, 64 nt, Homo Sapiens
gacagaaugauuuccaaaauguaaaccaaguucaaaggaaaauauaacccuuucaaaaguguuu

SEQ ID NO: 54453 - RNA, 58 nt, Homo Sapiens
agaucccacuggauggguagcugaaauaaaggaaaagacagagaaaggggcuguggug

SEQ ID NO: 54454 - RNA, 64 nt, Homo Sapiens
uuuaagaacuauuuuaaaguguuccagacccaaaaaggaaaaauaaaaaaaaaggaauauuugu

SEQ ID NO: 54455 - RNA, 64 nt, Homo Sapiens
uuagcuuuaaaucauuuuugcuuuagucuuuuuaaaggaaaauaacaaaacuaugcuguuuaua

SEQ ID NO: 54456 - RNA, 64 nt, Homo Sapiens
gcuguuacuuuuuauuuuuacacccaucagauuuaaggaaaagacuuuuuagccauuauaaucu

SEQ ID NO: 54457 - RNA, 64 nt, Homo Sapiens
acaguuugaacacaaaggcuggaaaaaaagaaaaaaggaaaaaaaagaaaaaaugaaaaaaaaa

SEQ ID NO: 54458 - RNA, 64 nt, Homo Sapiens
agaaaaaaggaaaaaaacagaaaaaugaaaaaaaaaggaaaaaauuugaaaucuuaaaaaaaga

SEQ ID NO: 54459 - RNA, 64 nt, Homo Sapiens
ggaagacuggacaaaacaacuuuaaauaaaaaaaaaggaaaagaauaguuuaagaaauuuuuuu

SEQ ID NO: 54460 - RNA, 64 nt, Homo Sapiens
auaaaaauuauuccagugcacuugacuuuuugccaaggaaaaaacuguuuuuaaaaauguagca

SEQ ID NO: 54461 - RNA, 64 nt, Homo Sapiens
cauauuuauuccugcaccccucccauuuuggggaaaggaaaaguacucugcuuuucugucaaca

SEQ ID NO: 54462 - RNA, 64 nt, Homo Sapiens
aauuaccacugggaaaaucugaaguaaaaacagaaaggaaaagaucuaacaacacugauaauag

SEQ ID NO: 54463 - RNA, 64 nt, Homo Sapiens
aaaaugaaaguacuuuuuacuaaaaacauuuucaaaggaaaaaucaaguaguccuguuugccac

SEQ ID NO: 54464 - RNA, 64 nt, Homo Sapiens
aguaguccuguuugccacuauauaaaaaugaaguaaggaaaacaugacauauaacuacuaugcu

SEQ ID NO: 54465 - RNA, 53 nt, Homo Sapiens
cagcacucuaaauggccacugggaaggaaaaugggacccagcaggaaucauga

SEQ ID NO: 54466 - RNA, 64 nt, Homo Sapiens
ggcccaagugcaaaagaaaauuuccugaauuggaaaggaaaagaauaccaggcacuuaaagccu

SEQ ID NO: 54467 - RNA, 64 nt, Homo Sapiens
ugaacaaacuuagaaagggaguuccguuuuagaaaaggaaaacgcaauacagucuaguuuccug

SEQ ID NO: 54468 - RNA, 64 nt, Homo Sapiens
agaaucaaauauucccaaggaggauuugucaaucaaggaaaacaugacagauggugagguaaag

SEQ ID NO: 54469 - RNA, 64 nt, Homo Sapiens
aacacuaggaaaaucuuuccauuucagcauguuuaaggaaaauagcccacaaugucugcccuga

SEQ ID NO: 54470 - RNA, 64 nt, Homo Sapiens
uacaaggccuaugaguauggauugggggggccaaaaggaaaaagcuccaugugccucuuugucu

SEQ ID NO: 54471 - RNA, 64 nt, Homo Sapiens
uguaguuuuauuuuauguuuagauagggcugggcaaggaaaaagaaaauaaagacaaccauauu

SEQ ID NO: 54472 - RNA, 64 nt, Homo Sapiens
aauuuaggguggcagccaauaauauuacuguuuuaaggaaaacuaaaaaaaacaguaaaaguga

SEQ ID NO: 54473 - RNA, 64 nt, Homo Sapiens
uuuucuuaaugagaugaugucaaacgaaaugucuaaggaaaauguuucaacagaaaaccaaaac

SEQ ID NO: 54474 - RNA, 64 nt, Homo Sapiens
gcaugcuuucugacugacauuuuuuuuuguuuuuaaggaaaaaguuucaaaaguuggcagauuu

SEQ ID NO: 54475 - RNA, 64 nt, Homo Sapiens
aaaauaguuuuuuacuggauaguuuguuuucaaaaaggaaaaacauuacuggcucucaagcuau

SEQ ID NO: 54476 - RNA, 64 nt, Homo Sapiens
acuggguggaccuacaaaaaagaggaagaugaggaaggaaaaaacugcugcugcugcugcccuc

SEQ ID NO: 54477 - RNA, 64 nt, Homo Sapiens
uagacaucaccuguaccuauccacauccaucccaaaggaaaauggugaucuuagccuagguagg

SEQ ID NO: 54478 - RNA, 64 nt, Homo Sapiens
gacaagggaauuccagucaguacuuuuaucaucuaaggaaaaaauccucagcaaggcauguuac

SEQ ID NO: 54479 - RNA, 64 nt, Homo Sapiens
aaaaacaaaaucuccgcaguagaucggacuaaaaaaggaaaaaggacccaucuggaggaaaacc

SEQ ID NO: 54480 - RNA, 64 nt, Homo Sapiens
ugggggugggggguggggggacgaacaaaagggaaaggaaaaaacccacuggaugagcggugag

SEQ ID NO: 54481 - RNA, 64 nt, Homo Sapiens
gacugucucaucaacccuccauggaagaugguggaaggaaaauagaacccuuuuccugacucuc

SEQ ID NO: 54482 - RNA, 64 nt, Homo Sapiens
acaaauugcccccagauuggcaccuuugcaaagaaaggaaaaacacaggagcugucuggagcuc

SEQ ID NO: 54483 - RNA, 64 nt, Homo Sapiens
agcuuuuaucaauuuuuuucuuuaagaaauggagaaggaaaaauuuuucauaaaaauuaaaugc

SEQ ID NO: 54484 - RNA, 64 nt, Homo Sapiens
uuguuacugaaagagacuacagaaagaaggaaggaaggaaaaacaauuggacaaagagagagaa

SEQ ID NO: 54485 - RNA, 64 nt, Homo Sapiens
uugaaaagaaaaggggaaugugucccacuagugaaaggaaaacuuuucaacacuaucccugcuu

SEQ ID NO: 54486 - RNA, 64 nt, Homo Sapiens
uauucaaauuugauuguggcgaaucuacuucaaaaaggaaaaauaauccaacuuuguggauauu

SEQ ID NO: 54487 - RNA, 64 nt, Homo Sapiens
cauucuugggcccccccucauucccuuuccgaaaaaggaaaacuugcguuugagccguugagcu

SEQ ID NO: 54488 - RNA, 64 nt, Homo Sapiens
cgaccaaaauuuugacaacgaugauguucaccagaaggaaaaaaaaaaaucaguuuuaugcacu

SEQ ID NO: 54489 - RNA, 64 nt, Homo Sapiens
uccagaauuccacuucuaguuauuuauucaagagaaggaaaaacaaugaucacagcaauacuug

SEQ ID NO: 54490 - RNA, 64 nt, Homo Sapiens
ucaauaaaugcaauauuauuggcagacauuguugaaggaaaaaagccagacaaacaacuacaua

SEQ ID NO: 54491 - RNA, 64 nt, Homo Sapiens
uuacagaaccuuuaaacacggcaaaaacuuuuucaaggaaaaucguuuucacacuauuucagca

SEQ ID NO: 54492 - RNA, 64 nt, Homo Sapiens
aucuggccagggguagcuuguucaaaucaauuucaaggaaaaacuaauaggcgagcaaauaaaa

SEQ ID NO: 54493 - RNA, 64 nt, Homo Sapiens
aauaccuuuaaccucacuaguagcugaagcaaagaaggaaaaguaguuauuugguggugggaag

SEQ ID NO: 54494 - RNA, 64 nt, Homo Sapiens
uuucuucauuuagcugcugaaaucuuuuuuuagaaaggaaaaguaaauguacuuuuacauucuu

SEQ ID NO: 54495 - RNA, 64 nt, Homo Sapiens
aaagauauugaggucuuccuuuuuuuaaauuaaaaaggaaaauauaucuggggaaaaaaaacuu

SEQ ID NO: 54496 - RNA, 64 nt, Homo Sapiens
agguggaucagugauuuuacuguguguguccaggaaggaaaaaacccaaggcagggaagaagga

SEQ ID NO: 54497 - RNA, 64 nt, Homo Sapiens
aacacccaucccucaaaaaguuuccugauagcaaaaggaaaaaaugacaccauuuuuaguuuua

SEQ ID NO: 54498 - RNA, 64 nt, Homo Sapiens
auauauagaauaccagaaauaaaggugacaguuuaaggaaaaauugucuuuuaaaauguagaga

SEQ ID NO: 54499 - RNA, 64 nt, Homo Sapiens
cuuugcuauccgacauguacuuaguugggucugaaaggaaaaguaaaggcagaaaggagaucau

SEQ ID NO: 54500 - RNA, 64 nt, Homo Sapiens
guaucaaaggcagaaaggaggaugaaagacaaagaaggaaaagaucugugaggugauaggcaag

SEQ ID NO: 54501 - RNA, 64 nt, Homo Sapiens
cuggcaagguggguuccaggcugccuugauggagaaggaaaagguccccacccaccaaaugccu

SEQ ID NO: 54502 - RNA, 64 nt, Homo Sapiens
uguauugaguaccuuuuugcagcuuguuugauauaaggaaaauaaguuauauuguacugaaauu

SEQ ID NO: 54503 - RNA, 64 nt, Homo Sapiens
auuuugauguaacaauuuuuaggacacagauuugaaggaaaaaaagaaacuguuguuugguuaa

SEQ ID NO: 54504 - RNA, 64 nt, Homo Sapiens
gguuaaacaaacaaaaaaaaauuuuaaacaaagaaaggaaaaaaauugacaauaaaagucacuc

SEQ ID NO: 54505 - RNA, 64 nt, Homo Sapiens
cugaagauucuuucuucugaaagccaagcaccacaaggaaaaaaaaaauuauuaauagcucagg

SEQ ID NO: 54506 - RNA, 64 nt, Homo Sapiens
gauacacuuuacuaaucaugaaauucuaaccuaaaaggaaaacauuuuccugcuugucuuagaa

SEQ ID NO: 54507 - RNA, 64 nt, Homo Sapiens
gaaagggaaagagaaacaaguuuucaaaagcacaaaggaaaaguaacaccugcuuuagccuuug

SEQ ID NO: 54508 - RNA, 64 nt, Homo Sapiens
aaaaggauucuaaaaguuuguucucuuuucagagaaggaaaauauucuugcugaacauauuuua

SEQ ID NO: 54509 - RNA, 64 nt, Homo Sapiens
uugcaauagagggaaaagccuugacuguccuuucaaggaaaaaccucugauucuagguguggug

SEQ ID NO: 54510 - RNA, 64 nt, Homo Sapiens
agguagauggugcuuuuuuuuauugggaugaggaaaggaaaaucgaguuagcauguagauggga

SEQ ID NO: 54511 - RNA, 64 nt, Homo Sapiens
cucaaggccuuuugaagagcuuuucuuaaucagaaaggaaaauuaaaaauauugcagugcuauu

SEQ ID NO: 54512 - RNA, 64 nt, Homo Sapiens
guaauaauugauaugauuuugguuauuaacaaaaaaggaaaaauccaagagacuuccauguccu

SEQ ID NO: 54513 - RNA, 64 nt, Homo Sapiens
auuuggcuccuuuaauuccucagaugcauuaucaaaggaaaaauguuauucaguguugcgguag

SEQ ID NO: 54514 - RNA, 64 nt, Homo Sapiens
aaaucuaaaacugcgaagaagugguuuucgcuuaaaggaaaaaauuggaauuuuuuucagugga

SEQ ID NO: 54515 - RNA, 64 nt, Homo Sapiens
gaaaaaaaggagaaaaaacgcaucuuuuuaaaacaaggaaaaggcgcugcauaacaacacagug

SEQ ID NO: 54516 - RNA, 64 nt, Homo Sapiens
acauuaaaggagacuuauguagaugaguuaaccaaaggaaaauaaugcccugaugccuaaccaa

SEQ ID NO: 54517 - RNA, 64 nt, Homo Sapiens
gauuauuguaaauauuuuauuguauucaaagaaaaaggaaaaaaaaacauuuuugucauauucu

SEQ ID NO: 54518 - RNA, 64 nt, Homo Sapiens
cuuuagaaauuuuaacuccgacagaacaaaagcaaaggaaaauguaaagacaaacuaaaacaaa

SEQ ID NO: 54519 - RNA, 64 nt, Homo Sapiens
agauuaucuaaagccaucucaacauugguuugugaaggaaaaacaucauggcaugacuuaaggg

SEQ ID NO: 54520 - RNA, 64 nt, Homo Sapiens
uggauaguaaaacccaccuccguuacacuaagaaaaggaaaaugaguuugccuuugagauaaua

SEQ ID NO: 54521 - RNA, 64 nt, Homo Sapiens
aguuauaaauaccaugucaaauacuuuucauuacaaggaaaauauaaacaacuaauuauuguug

SEQ ID NO: 54522 - RNA, 64 nt, Homo Sapiens
cucuaguuuugcaaguauaucauuuucccauuuaaaggaaaacagaagccccaaggacacaaaa

SEQ ID NO: 54523 - RNA, 64 nt, Homo Sapiens
guagacucugacuuccguccuaugaccauugaaaaaggaaaaauaauaacuuuaauuaggauca

SEQ ID NO: 54524 - RNA, 64 nt, Homo Sapiens
agugggucugguggugcuggcaugauaccuauuaaaggaaaaccucaguggguuaauuauaccc

SEQ ID NO: 54525 - RNA, 64 nt, Homo Sapiens
cagcaucaugaaaggcaaaacacccguggcuccuaaggaaaaaagaauaauugaaguucagagu

SEQ ID NO: 54526 - RNA, 64 nt, Homo Sapiens
auuguuuucaguuaaacacuucaccaacagaaaaaaggaaaaaaguguaaugcauaaugcuuuc

SEQ ID NO: 54527 - RNA, 64 nt, Homo Sapiens
aaaaucacucuauguugcccugcaucugucaauuaaggaaaaaauuuagcuuguugaaauguuu

SEQ ID NO: 54528 - RNA, 64 nt, Homo Sapiens
aaaaaaacuucuuuaggcauuuccaucuuuggaaaaggaaaaaauagauaaacuagcucauuau

SEQ ID NO: 54529 - RNA, 64 nt, Homo Sapiens
uugccaccauuuguagaccaagaacuacucucccaaggaaaauauuuaaaaaauauauaccaac

SEQ ID NO: 54530 - RNA, 64 nt, Homo Sapiens
aaagaaaaaauuuaaaaaauaaacaaaaaaaaggaaggaaaaaaaaacaaaacaaaacaaaaua

SEQ ID NO: 54531 - RNA, 64 nt, Homo Sapiens
auauucaucauacucuaaucaucuagcaaguagaaaggaaaaaacauauuuauggacuuugagu

SEQ ID NO: 54532 - RNA, 64 nt, Homo Sapiens
aaauauacaugaugggauucaucucaaaaacaaaaaggaaaagagaguaacaaaaugagacccu

SEQ ID NO: 54533 - RNA, 64 nt, Homo Sapiens
cgguuuuaguugagucuucacauuuagaauuugaaaggaaaaacagaacauuucucaugugcuu

SEQ ID NO: 54534 - RNA, 64 nt, Homo Sapiens
cagaacauuucucaugugcuuuguagcuuaaaaaaaggaaaacucaccauuucauccauauuuc

SEQ ID NO: 54535 - RNA, 64 nt, Homo Sapiens
auuacccccccacuaugcccucauuuuuuuaaaaaaggaaaaaaaaaagaaacuggguuccagu

SEQ ID NO: 54536 - RNA, 64 nt, Homo Sapiens
aauaaaaaaauaaauaaaaauaaaaaaaauaaaaaaggaaaaaaaaaaaagaagaaacaagaca

SEQ ID NO: 54537 - RNA, 64 nt, Homo Sapiens
uuuuaucgcaaugauagucauuuauugucaucauaaggaaaaacaaagucuuucagcaacauuc

SEQ ID NO: 54538 - RNA, 64 nt, Homo Sapiens
uuccacauagcucugggccuacuugaaagguauuaaggaaaaaaguugccgucuucacagacaa

SEQ ID NO: 54539 - RNA, 64 nt, Homo Sapiens
cucccauuuuugagccauucucuuuuuaggaaugaaggaaaauuagcuucuauuggacauauuu

SEQ ID NO: 54540 - RNA, 64 nt, Homo Sapiens
cauuggaauuuuuguuuuagccgucucauaacaaaaggaaaaaaaacacugaaauuguugaaaa

SEQ ID NO: 54541 - RNA, 64 nt, Homo Sapiens
aaauacaaaacugagaagucagccauggagacauaaggaaaauucuggcaacagaacguuauua

SEQ ID NO: 54542 - RNA, 64 nt, Homo Sapiens
acuaggucugacucuggggauuuuuuuccagccgaaggaaaaucacuuccguuaugucccccuc

SEQ ID NO: 54543 - RNA, 64 nt, Homo Sapiens
gaucauccuuaagcaacugaaguuaaaauuguugaaggaaaaggcacuuaaauugguuacuuuc

SEQ ID NO: 54544 - RNA, 64 nt, Homo Sapiens
gagggguuguacacacugccauuuuuguauuuuaaaggaaaaaugacuuucauucccaacugau

SEQ ID NO: 54545 - RNA, 64 nt, Homo Sapiens
cagcagucaugaauacauuuuuagccauuuaccuaaggaaaaagacaguuuuucuagguaccau

SEQ ID NO: 54546 - RNA, 64 nt, Homo Sapiens
uucaaaagcagaaaaagacaacaaauauuaaagcaaggaaaaguguaacugaaacacugcacuu

SEQ ID NO: 54547 - RNA, 64 nt, Homo Sapiens
aguguucucaucucaaagcaaacuaucauuccagaaggaaaagugugucagggcaagcagacaa

SEQ ID NO: 54548 - RNA, 64 nt, Homo Sapiens
guucugccuuaaauugggaggacuccaagccgggaaggaaaauucccuuuuccaaccuguauca

SEQ ID NO: 54549 - RNA, 64 nt, Homo Sapiens
uggggaaauugaucuuuaaauuuugagacaguauaaggaaaaucugguuggugucuuacaagug

SEQ ID NO: 54550 - RNA, 64 nt, Homo Sapiens
gcuuccagaauguggugguuucuuaaauaugaucaaggaaaauagauuguagacauuuuuuuuu

SEQ ID NO: 54551 - RNA, 64 nt, Homo Sapiens
ugcugucaucaaaauggcaggagugcaguuuuaaaaggaaaaguuugacaaaugggaauuagag

SEQ ID NO: 54552 - RNA, 64 nt, Homo Sapiens
caaaaaacaaacccagacccaguauauauuugaaaaggaaaaaagacauacagagguugaauug

SEQ ID NO: 54553 - RNA, 64 nt, Homo Sapiens
augugaaauucuggaaauuucaagauggguuuuuaaggaaaauaaauauauuuuauuacuagag

SEQ ID NO: 54554 - RNA, 64 nt, Homo Sapiens
uccuucccuagagcuaguauauacgcuguuuaaaaaggaaaaaaccauccuaggcaacagagug

SEQ ID NO: 54555 - RNA, 64 nt, Homo Sapiens
ggagaagguggaaaugggugacagaaggaaaaaaaaggaaaauacagagugagacuccaucuca

SEQ ID NO: 54556 - RNA, 64 nt, Homo Sapiens
aaggaaaauaggagaaggugcuccaucucaacagaaggaaaaaagccugggugacagagugaga

SEQ ID NO: 54557 - RNA, 64 nt, Homo Sapiens
acuugguacaauaauuauuguaaagaguucauuuaaggaaaauuauacuguaaauuaugcauua

SEQ ID NO: 54558 - RNA, 64 nt, Homo Sapiens
aaaccaaugaagaagacaaagacaaaacauuuugaaggaaaauuucuuggcugugagcaacugc

SEQ ID NO: 54559 - RNA, 64 nt, Homo Sapiens
aguuaaaccauucugggauuugggaacuucuuuaaaggaaaauuguaguagaggucaucuugau

SEQ ID NO: 54560 - RNA, 64 nt, Homo Sapiens
uagucuugugugucucacauaucagcuuuuucauaaggaaaauacuuuauuugcuuuuaucuga

SEQ ID NO: 54561 - RNA, 64 nt, Homo Sapiens
uaaauacauauuguuuaaaaaaaagcaagaaaaaaaggaaaacaaaggaaaauauccccaaagu

SEQ ID NO: 54562 - RNA, 64 nt, Homo Sapiens
uuguuuaaaaaaaagcaagaaaaaaaggaaaacaaaggaaaauauccccaaaguuguuuucuag

SEQ ID NO: 54563 - RNA, 64 nt, Homo Sapiens
gaguguccuaacaguccccgggcuagagaggacuaaggaaaacagagagaguguuacgcaggag

SEQ ID NO: 54564 - RNA, 64 nt, Homo Sapiens
gaucuagggcccugggaggagguugagccuggggaaggaaaaagcaggaaacugaaggaagcag

SEQ ID NO: 54565 - RNA, 64 nt, Homo Sapiens
uggauuggauucgguaaaaagaggggguugcuagaaggaaaaacaggugugaccugauccugcc

SEQ ID NO: 54566 - RNA, 64 nt, Homo Sapiens
ggcauaaaaugaccuucuacuuaucacugcuaaaaaggaaaaaaauuaauagguugcuaauuau

SEQ ID NO: 54567 - RNA, 64 nt, Homo Sapiens
aaaagcacuuuuuucuuaauaaaaaaaagaaagaaaggaaaacauacuuuucuggcaaaaaaaa

SEQ ID NO: 54568 - RNA, 64 nt, Homo Sapiens
guauagguauguguacauauaaggcauugcuuuaaaggaaaaaauacagugaacagaguuuuga

SEQ ID NO: 54569 - RNA, 64 nt, Homo Sapiens
ccuucucauuguuaacuggauguauauuggaaauaaggaaaaacguguacagaguuggacuaug

SEQ ID NO: 54570 - RNA, 64 nt, Homo Sapiens
uuaucccauauucaaauaauuaacuuaugaauaaaaggaaaagugguauacuuacaaugugaag

SEQ ID NO: 54571 - RNA, 64 nt, Homo Sapiens
gauuucaaacauugacaagauuaccaagcauauaaaggaaaaaucuuucuuggaaagacucacu

SEQ ID NO: 54572 - RNA, 64 nt, Homo Sapiens
aauaaaucauuaauaguuaauccuaaguaccuuuaaggaaaauuugaauaugugacacacacac

SEQ ID NO: 54573 - RNA, 64 nt, Homo Sapiens
uugucacuuuuauguuauaaguuuuuuucuucuuaaggaaaacguucuucccaagugcuguugg

SEQ ID NO: 54574 - RNA, 64 nt, Homo Sapiens
aaacucuauauuguucagcauuaaaaucaucagaaaggaaaaaccuuuccuguucuuuaagagu

SEQ ID NO: 54575 - RNA, 64 nt, Homo Sapiens
uuagcuuuagaaacagugcaguaccaaaauaaauaaggaaaagcaaaaccaagucacuuaggua

SEQ ID NO: 54576 - RNA, 64 nt, Homo Sapiens
accacaggacugcagggugcacaacuccccugccaaggaaaaccaugcaguccuccccucccug

SEQ ID NO: 54577 - RNA, 64 nt, Homo Sapiens
uccucaucauguuguauuccagcuucuuaaguggaaggaaaagagugcugagaaauggcucugu

SEQ ID NO: 54578 - RNA, 64 nt, Homo Sapiens
aaaaaaaagaauguacucaugacucugucucaagaaggaaaaaacagccugggugacagaguga

SEQ ID NO: 54579 - RNA, 64 nt, Homo Sapiens
uagcaacagguaauugaaguuaaggagaugggugaaggaaaauuaagcccuuuaagagucaugg

SEQ ID NO: 54580 - RNA, 64 nt, Homo Sapiens
aguuugguuuuauaaaauucuuccuucaaaguugaaggaaaaaauuuucaacuuuuuaguuuug

SEQ ID NO: 54581 - RNA, 64 nt, Homo Sapiens
aaagcccaaacuuaaccucuaauugaauuaaaagaaggaaaaaauuuuuuuguauaaaaauuua

SEQ ID NO: 54582 - RNA, 64 nt, Homo Sapiens
gaggaggauagagucaagguaagagcaucagacaaaggaaaagaauacagauuuagacaaagac

SEQ ID NO: 54583 - RNA, 64 nt, Homo Sapiens
aguuaugaagauacagauuucaguccaagcauaaaaggaaaaagaagaaaggccagagaaagag

SEQ ID NO: 54584 - RNA, 63 nt, Homo Sapiens
ucugcauagauuuucuuuuaaauugguucuuuguuucugaagaaagaauuuuuuuuaacuuca

SEQ ID NO: 54585 - RNA, 63 nt, Homo Sapiens
uuuuaacuucaugguuuuauuuauaauaauuuguuucugaagaaauuugccgagaguuacagg

SEQ ID NO: 54586 - RNA, 63 nt, Homo Sapiens
uuuuaaaaaacaaaacaauguaaguaaaggauauuucugaaucuuaaaauucaucccaugugu

SEQ ID NO: 54587 - RNA, 63 nt, Homo Sapiens
gauaccugguuguauauuauuugaugcaacaguuuucugaaaugauauuucaaauugcaucaa

SEQ ID NO: 54588 - RNA, 52 nt, Homo Sapiens
augaugaagcuaacacuugaauuuucugaagucuagcuuaacaucuuugguu

SEQ ID NO: 54589 - RNA, 63 nt, Homo Sapiens
uuuuugaaucgagguuuuuuuguuuuguuuuguuuucugaaaaaaucauacaacuuugugcuu

SEQ ID NO: 54590 - RNA, 63 nt, Homo Sapiens
augcuaucaguaauagucccaguuccauccaacuuucugaaauuucauuuuuuuuuuugagau

SEQ ID NO: 54591 - RNA, 63 nt, Homo Sapiens
gauuacaggugugagccaccgcacccggccaacuuucugaaauuucaaaacugaauugauccu

SEQ ID NO: 54592 - RNA, 63 nt, Homo Sapiens
cuuguuuuuaguccucauugaccagcccuuuuuuuucugaagguaaaggucuagggagcaaua

SEQ ID NO: 54593 - RNA, 63 nt, Homo Sapiens
caagugccuaaaaagaucuuuauaaaaggaauguuucugaaugaacuguuauaagugcuuauu

SEQ ID NO: 54594 - RNA, 63 nt, Homo Sapiens
aaagagaaagauggacuggucuaccucuuuuauuuucugaaccggcauuuucuuuauuugaac

SEQ ID NO: 54595 - RNA, 63 nt, Homo Sapiens
gaagugaugaaauuauauuucacagugguggaauuucugaagguucagcugaauacgaaugaa

SEQ ID NO: 54596 - RNA, 63 nt, Homo Sapiens
ucagagucuucaccuauaagauaucacuuuaacuuucugaaccaccagucaggaacccuggcg

SEQ ID NO: 54597 - RNA, 63 nt, Homo Sapiens
cggugacaagguuaacauaaucaaagcccagaauuucugaaaauccugauggacgcagcacca

SEQ ID NO: 54598 - RNA, 63 nt, Homo Sapiens
gaaaacauaggauugacuagcaaguuuuuauacuuucugaaauacgaaauauauauuucucgc

SEQ ID NO: 54599 - RNA, 63 nt, Homo Sapiens
uucuauuuauuuaccauacaaggucgacaaacuuuucugaaggugaaucccaaacuuugcacc

SEQ ID NO: 54600 - RNA, 63 nt, Homo Sapiens
gaguuauuuuguauuuuguuuaaauauuucuguuuucugaaaacuaauuuguggaaaaaggau

SEQ ID NO: 54601 - RNA, 63 nt, Homo Sapiens
accauucagagguguggcuugaaaaauguugaauuucugaauguaaguaacaagauagaauua

SEQ ID NO: 54602 - RNA, 63 nt, Homo Sapiens
auauauaguaggaggggguaugugucucaggcuuuucugaaguugcaagacuuaaagaaauaa

SEQ ID NO: 54603 - RNA, 63 nt, Homo Sapiens
uuaagacauccaaucaauaaugaaggaaauuuuuuucugaauguagguuugagugaggggcac

SEQ ID NO: 54604 - RNA, 63 nt, Homo Sapiens
aagcaguucaaguuacugaaaaccuuuuaaaccuuucugaaguucguuaguauaaauuacuuu

SEQ ID NO: 54605 - RNA, 63 nt, Homo Sapiens
uacccuaacaguuuuaccaccuaguaacagucauuucugaaaauauguuggauagaaagucac

SEQ ID NO: 54606 - RNA, 63 nt, Homo Sapiens
aaaaauauggagaagaguaauuugaaagccuacuuucugaagaaaauggugggauuuuuuuuu

SEQ ID NO: 54607 - RNA, 63 nt, Homo Sapiens
gggaaaggauuuuuacauuuuuuaaacugcuauuuucugaauggaacaagcugggccaagggg

SEQ ID NO: 54608 - RNA, 63 nt, Homo Sapiens
gggcagcucccaggauauccugccuuccaacuguuucugaagccccuccuccuaacauggcga

SEQ ID NO: 54609 - RNA, 63 nt, Homo Sapiens
auagccagaguaaguaagcauaaggcagcuaaauuucugaaaguuaguuaaaugagcuauaga

SEQ ID NO: 54610 - RNA, 63 nt, Homo Sapiens
guaauauuuuuaaacuauagcuugggcuccaaauuucugaagaaggaaucucuguaauuccug

SEQ ID NO: 54611 - RNA, 63 nt, Homo Sapiens
ccacaucugccaucauuucuccgucuuguguuuuuucugaaccuuuuuccccucuuccccuuc

SEQ ID NO: 54612 - RNA, 63 nt, Homo Sapiens
uuuuuuuuaguaagaugguugguaaagaguguuuuucugaaacgcauucauaaguuaacccau

SEQ ID NO: 54613 - RNA, 63 nt, Homo Sapiens
aacaagacaccuagcaacuauaugaagccuuuauuucugaaguaguguccuucaguuucucag

SEQ ID NO: 54614 - RNA, 63 nt, Homo Sapiens
cuugcuuguacauuuuuuuuuaaaucuuuuuccuuucugaauuuucugaaugguaauaauguc

SEQ ID NO: 54615 - RNA, 63 nt, Homo Sapiens
guaauaaugucuaaaucuuuaccauuuagcaauuuucugaaugugaauuuuacauuuuuccuc

SEQ ID NO: 54616 - RNA, 63 nt, Homo Sapiens
cugaggaacaaugccuuaaguuuguggcuggguuuucugaaguuuuuauugcucugguggauu

SEQ ID NO: 54617 - RNA, 63 nt, Homo Sapiens
aagccucucucucuuucucuccuccccaacuuuuuucugaaagccuugauuucuguagacaga

SEQ ID NO: 54618 - RNA, 63 nt, Homo Sapiens
aguggauguuucuauuuggcaaggaagguaggauuucugaaacucaggccuuaaccaauaggu

SEQ ID NO: 54619 - RNA, 63 nt, Homo Sapiens
acauacagucucugucauaacuacucaacucuguuucugaagcaggaaagccaccacagacag

SEQ ID NO: 54620 - RNA, 63 nt, Homo Sapiens
auauauuagaagcaauuauaauuacaucugugauuucugaacuaauggugcuaauucagagaa

SEQ ID NO: 54621 - RNA, 63 nt, Homo Sapiens
uuuugcacauuuaauauuuuucuuauaucuacauuucugaauauguaaagcaaguuauugaaa

SEQ ID NO: 54622 - RNA, 63 nt, Homo Sapiens
aagcaucucacauugguuuucuuucuuguaucuuuucugaaacuccuugcuguaaggcagcuu

SEQ ID NO: 54623 - RNA, 63 nt, Homo Sapiens
ugagguauaacaccagagcugaaagaaaaaugcuuucugaaacggcagguucaaaauucuguu

SEQ ID NO: 54624 - RNA, 63 nt, Homo Sapiens
cuguuucaaucuaaaauagcgaaauguacuuuuuuucugaaugaauccugaugcugaccaucu

SEQ ID NO: 54625 - RNA, 63 nt, Homo Sapiens
cuuaugcucuuuuaaagccauuguagaauauuuuuucugaaucaauaguugauuuugaugccu

SEQ ID NO: 54626 - RNA, 63 nt, Homo Sapiens
guauccauuuuguaggcuuguuaaguauauacuuuucugaaagauccugacgucuugggucuu

SEQ ID NO: 54627 - RNA, 63 nt, Homo Sapiens
gaauagucaucaaauuuauauccagguaugucauuucugaagagcuugucaugauuaacauaa

SEQ ID NO: 54628 - RNA, 63 nt, Homo Sapiens
ccucuccgcggcgcucacccuccucagucccaguuucugaaaggacucagcugagaaaggaca

SEQ ID NO: 54629 - RNA, 63 nt, Homo Sapiens
aauuuuuauuuucuucauucuacuuaucuuuauuuucugaacuuucuacaaugaacauguuuu

SEQ ID NO: 54630 - RNA, 63 nt, Homo Sapiens
aagugcuuacuguguaagcccaagaacaaaggcuuucugaaucuucucaggcaguucagauuu

SEQ ID NO: 54631 - RNA, 63 nt, Homo Sapiens
caaguuucuuauauuuauguauuucuauucugauuucugaaaugauaaccuaguagugucuga

SEQ ID NO: 54632 - RNA, 63 nt, Homo Sapiens
cugaauucaauuacaauuuuuuuacuucacaauuuucugaaguauauuucuccaucauggccu

SEQ ID NO: 54633 - RNA, 63 nt, Homo Sapiens
ggauaccaaagugcgauaacgagauuuuuuuuuuuucugaaaaugcuuauguuuauaaguuuu

SEQ ID NO: 54634 - RNA, 63 nt, Homo Sapiens
cuacccauaaaaucacuuucagugcaguacauuuuucugaaagagacagaacuuugucacuuc

SEQ ID NO: 54635 - RNA, 63 nt, Homo Sapiens
accauuuuuucaagaauguuuugguuuuuguguuuucugaauuuuggggauuauuuuaaauaa

SEQ ID NO: 54636 - RNA, 63 nt, Homo Sapiens
ugcaaucauuccuuugacaauuacaaagcacauuuucugaaucacuuuauguuaacaggguua

SEQ ID NO: 54637 - RNA, 63 nt, Homo Sapiens
cagaaaacguucagauuuuggguacacuagaauuuucugaaaggaaauaucuaagcuguacau

SEQ ID NO: 54638 - RNA, 63 nt, Homo Sapiens
aauaucacaagucagucagucacuggguuuccauuucugaauuuuaugcacuccaaccaugaa

SEQ ID NO: 54639 - RNA, 63 nt, Homo Sapiens
gggcuuuagccaucagcuuuguacaucaucauuuuucugaaugaccaaucccacuaaacaucu

SEQ ID NO: 54640 - RNA, 63 nt, Homo Sapiens
aguauuucuaauuagccuaauaaauucccacacuuucugaagugaacacuaaugguauugucc

SEQ ID NO: 54641 - RNA, 63 nt, Homo Sapiens
auuuguuuggcugacuggcaguaaccuagugaauuucugaaagaugaguaauuucuuuggcaa

SEQ ID NO: 54642 - RNA, 63 nt, Homo Sapiens
aaauuagcaggugcaccuucuguggcugucuuguuucugaaguacuuaaacuuccacaagagu

SEQ ID NO: 54643 - RNA, 63 nt, Homo Sapiens
agcucagggccugacuguauuuuucauccaucuuuucugaagugucuuugggcaguauguagu

SEQ ID NO: 54644 - RNA, 63 nt, Homo Sapiens
acuuugauuugggguuuugauuaauucuuuauuuuucugaaaaaaaguuuaaauaaugucugu

SEQ ID NO: 54645 - RNA, 63 nt, Homo Sapiens
guuuuacccagaugggccugcaccuccagcuucuuucugaagcaugacccaucuccagagaug

SEQ ID NO: 54646 - RNA, 63 nt, Homo Sapiens
auugugguuugugaauugcaccuuugugccauguuucugaaucugguuuucaaauccagugga

SEQ ID NO: 54647 - RNA, 63 nt, Homo Sapiens
uguuacugagcuugcuuguggcuacauuaagaauuucugaauacaaaaccacuuauauugcua

SEQ ID NO: 54648 - RNA, 63 nt, Homo Sapiens
gccagaagaccauucgaaauccaguuaaguaguuuucugaacguguccagaauuucguuccua

SEQ ID NO: 54649 - RNA, 63 nt, Homo Sapiens
uaguuucuuaagugaguuuuaauaaaugguuuguuucugaaguuaauuuacauuagagugaaa

SEQ ID NO: 54650 - RNA, 63 nt, Homo Sapiens
aucaaugcauuucaauuuacuugcaagaaaucuuuucugaaugguuacauuuauuuauauauu

SEQ ID NO: 54651 - RNA, 63 nt, Homo Sapiens
guggauaucaauauaaaauuauguccuguucuuuuucugaaguaucaggggaaaaagcuauaa

SEQ ID NO: 54652 - RNA, 63 nt, Homo Sapiens
gagugggcugauaaacuugugauuucaaucaccuuucugaaaacauuucuguagcaugacagg

SEQ ID NO: 54653 - RNA, 63 nt, Homo Sapiens
ucuagcucuggguucuguuuagagauugguuuauuucugaauauucaagaaaggaaaaugacu

SEQ ID NO: 54654 - RNA, 63 nt, Homo Sapiens
caggucacaccaggggcagacccugucgcugcguuucugaacugugaaggagcccauucgggu

SEQ ID NO: 54655 - RNA, 63 nt, Homo Sapiens
cauugcauugaauucuuccuauuuaaauguaacuuucugaacaccuuuuucucuuuauuaacg

SEQ ID NO: 54656 - RNA, 63 nt, Homo Sapiens
acuguuguaauggcuaaaauaacauuugagauauuucugaauuaauauugaugacaucaaugu

SEQ ID NO: 54657 - RNA, 63 nt, Homo Sapiens
ugacuugcucuagggugcuucuuucuaaaucauuuucugaagcccccugacucuuacauuuau

SEQ ID NO: 54658 - RNA, 63 nt, Homo Sapiens
uuuuuuugaagauuaauuuaaaacaaagaauauuuucugaagacuaaacucuaccaagaaugg

SEQ ID NO: 54659 - RNA, 63 nt, Homo Sapiens
agcuuuuaaaauaauucaauggauauacauuuuuuucugaagauuaagauuuuaauuauucaa

SEQ ID NO: 54660 - RNA, 63 nt, Homo Sapiens
uuuucuuaauuguuauuuuuuauaaucauuauuuuucugaaccauucuucuggccucagaagu

SEQ ID NO: 54661 - RNA, 63 nt, Homo Sapiens
cuccgaagaaaagaauuuuaguguuaaugacucuuucugaaggaagagaagacauuugccuuu

SEQ ID NO: 54662 - RNA, 63 nt, Homo Sapiens
caggcagcucggauucaacuaccuuagauaauauuucugaaaaccuaccagccagaggguagg

SEQ ID NO: 54663 - RNA, 63 nt, Homo Sapiens
ucuucugaaauacaaccagaaacaaugugucuauuucugaaagaauaggauuaaugaucauac

SEQ ID NO: 54664 - RNA, 62 nt, Homo Sapiens
uaaaguugucuuuuaaacuacucggauguguccuuucugaacaaaacuauuaaauauaauaa

SEQ ID NO: 54665 - RNA, 63 nt, Homo Sapiens
caguauagggaacaugaauaaccagggauugcuuuucugaaggguuacaugaauaauuugugg

SEQ ID NO: 54666 - RNA, 63 nt, Homo Sapiens
cagaucaaacuguuaccuuguauguggccuccuuuucugaagcgaguaaaaugagaaaguuaa

SEQ ID NO: 54667 - RNA, 63 nt, Homo Sapiens
aacugcuaguaguggaauacuggaaaagcuucauuucugaagaugaauuuuauuuuuaaaaaa

SEQ ID NO: 54668 - RNA, 63 nt, Homo Sapiens
caaaacuuuuagcuuugaucacaaguggacaaauuucugaaaccaaaggcaacuaaguugcug

SEQ ID NO: 54669 - RNA, 63 nt, Homo Sapiens
aaucauuugcauuaucagccguaaauacaaugguuucugaaagcuagguauuuucuucaaaag

SEQ ID NO: 54670 - RNA, 63 nt, Homo Sapiens
acggaagggaucagaagauaugauuuuaauuacuuucugaauagucuuuguaaucuauuuagu

SEQ ID NO: 54671 - RNA, 63 nt, Homo Sapiens
uugcuauucuuuuugcuuaaauacuccuaucauuuucugaauuacuugguauuuagaacuccu

SEQ ID NO: 54672 - RNA, 63 nt, Homo Sapiens
aauauguuuguuaauuuacuucauguuggguucuuucugaaauguacaucuuuacauauaaaa

SEQ ID NO: 54673 - RNA, 63 nt, Homo Sapiens
aauaugaauaugauuggauucagaaaaauuaacuuucugaauuugaucugucuucagucuugu

SEQ ID NO: 54674 - RNA, 63 nt, Homo Sapiens
acaguucuucucaaacauuuucauucagauagcuuucugaaaguucccuaucccucuuuacca

SEQ ID NO: 54675 - RNA, 63 nt, Homo Sapiens
acauuuuuuuccaauuucucucaagaaaguuuuuuucugaauagcuacaggaaacaagcacac

SEQ ID NO: 54676 - RNA, 63 nt, Homo Sapiens
gcaguguacaaugaaucuuacuuugacaaagccuuucugaaacugacaggccauuauuaucug

SEQ ID NO: 54677 - RNA, 63 nt, Homo Sapiens
aacuuuugcaauaaaaaaaaacauuuaaaaaguuuucugaaaaauucaggugguuuauuaauu

SEQ ID NO: 54678 - RNA, 63 nt, Homo Sapiens
uuaaagaccauuauugcuacugcaaaacaguuauuucugaaaaauagugaaugguaagacuag

SEQ ID NO: 54679 - RNA, 63 nt, Homo Sapiens
uguagagacuacuacaaaauuuuaacagcagaauuucugaauggaaauauuuuauaaauccug

SEQ ID NO: 54680 - RNA, 63 nt, Homo Sapiens
aaauauuuuauaaauccuguagcauugugaugcuuucugaaagaacauuauuugccuaaaauu

SEQ ID NO: 54681 - RNA, 63 nt, Homo Sapiens
uaaaaugaaaauucauguccgaguaucuaugucuuucugaauugaaauacuauaaaacacuga

SEQ ID NO: 54682 - RNA, 63 nt, Homo Sapiens
uuaaauugacaagcaauguuuuuguacaaauuuuuucugaaaucauggauuauuuuuauauga

SEQ ID NO: 54683 - RNA, 63 nt, Homo Sapiens
agccaaccagaaugagugggucaucuuauaaccuuucugaagcuccaugaggacauguauaga

SEQ ID NO: 54684 - RNA, 63 nt, Homo Sapiens
acauaaagcauauuaaaauaucugcuccuuaauuuucugaaggaaauagauguaaguuucugc

SEQ ID NO: 54685 - RNA, 63 nt, Homo Sapiens
uucacuuucuaugucuaccuuuuuuuuaaacccuuucugaacugacaaguuuuuuuuuuuuuu

SEQ ID NO: 54686 - RNA, 63 nt, Homo Sapiens
ugaaauauaacaagugggugaaugaaugaugcuuuucugaaaacuguuggacaaaccgagugc

SEQ ID NO: 54687 - RNA, 63 nt, Homo Sapiens
uaaacagaucuguuuauuucguaaauguuuggguuucugaauuauguguaagcacauuuuacu

SEQ ID NO: 54688 - RNA, 63 nt, Homo Sapiens
gagauacuuugaaauuccaacaguagucaaagcuuucugaauuaauugugggcuggggagaaa

SEQ ID NO: 54689 - RNA, 63 nt, Homo Sapiens
ggcaauuccagaaaucuuaguuccugugauacauuucugaaugauauuuuaucucaacuuugg

SEQ ID NO: 54690 - RNA, 63 nt, Homo Sapiens
uaaaacaauuuaugcgaaccagagguucuggguuuucugaaagcauaauuuuaguaauuuccu

SEQ ID NO: 54691 - RNA, 63 nt, Homo Sapiens
auacauuuagauuaguuuagguauggaggaaauuuucugaaaaguauguaacacauacaugga

SEQ ID NO: 54692 - RNA, 63 nt, Homo Sapiens
uccuaaaaauagcucagaugugaaucacaccaguuucugaaggucuaucucagagggccaaag

SEQ ID NO: 54693 - RNA, 63 nt, Homo Sapiens
cucuauugucacacaugguuauauuuaaaguaauuucugaacuguguaaugugucuagaguaa

SEQ ID NO: 54694 - RNA, 63 nt, Homo Sapiens
cgacguguuccuaaaacauguuugaaaggugaauuucugaaagucuacaauaaauguaggugu

SEQ ID NO: 54695 - RNA, 63 nt, Homo Sapiens
gccuccgacuucacaccggaugagagagcuauguuucugaaguucgugaccagcugcuccaga

SEQ ID NO: 54696 - RNA, 63 nt, Homo Sapiens
aaagccuacugugcgugagauccucuccuuccguuucugaaaucucuuacucagguaaggccu

SEQ ID NO: 54697 - RNA, 63 nt, Homo Sapiens
uagacggaacaguguggaagauauuuuuacugcuuucugaauggaaaguguucauugcacaau

SEQ ID NO: 54698 - RNA, 63 nt, Homo Sapiens
uuuauauaacuguuguugauacaaaguggguacuuucugaaaaccuuuuaaguggacucucug

SEQ ID NO: 54699 - RNA, 63 nt, Homo Sapiens
cucaugaacgcagaauuauuaccugcuguuugcuuucugaaagaauuucagaaaucagagcaa

SEQ ID NO: 54700 - RNA, 63 nt, Homo Sapiens
auuggcuaugaaguacuguggcagagcugcuguuuucugaaggugagaagccauuuuuagcuc

SEQ ID NO: 54701 - RNA, 63 nt, Homo Sapiens
uaugagggaugccagauguugauaaacuuacucuuucugaaucuggacaaagucgacuuaaca

SEQ ID NO: 54702 - RNA, 63 nt, Homo Sapiens
acuuaaucucuuccccuauccuucuaaauuaauuuucugaaguuggaguguagucuuuucccc

SEQ ID NO: 54703 - RNA, 63 nt, Homo Sapiens
aaagcaaaugcauuaguauguuuauaaguaugauuucugaagagggacagauuuuauguaauc

SEQ ID NO: 54704 - RNA, 63 nt, Homo Sapiens
uuaaccuuuucagaaugcauuaccuuuaaauaauuucugaaauuuauggcugccacucuuauu

SEQ ID NO: 54705 - RNA, 63 nt, Homo Sapiens
uuucuauuuaacauuuucagaacugaugaauuauuucugaaauagccacuguaccccgccuaa

SEQ ID NO: 54706 - RNA, 63 nt, Homo Sapiens
aauauaaugugucuauaaaagaaauacuuaaucuuucugaauauagcuucauuuuuuaccuuu

SEQ ID NO: 54707 - RNA, 63 nt, Homo Sapiens
auguggugaaaagaauuggcuagauaggggauuuuucugaacacugcaaaaauagaacguagc

SEQ ID NO: 54708 - RNA, 63 nt, Homo Sapiens
guuaucacuuuugggugucuguauccuaagaaguuucugaaaagaucuaaagccuuuuuaucc

SEQ ID NO: 54709 - RNA, 63 nt, Homo Sapiens
guaauaaaauagagcauaacgaaacugugaaacuuucugaagccuugucagugguuaaaagua

SEQ ID NO: 54710 - RNA, 63 nt, Homo Sapiens
gacaauagaaauaaaaagaucuucagccaggccuuucugaaggaguuauucugcuaaaaaugg

SEQ ID NO: 54711 - RNA, 63 nt, Homo Sapiens
ucugaguaauucaaagcauguuuugucaaauguuuucugaaaauaacuuuuauagagaaaggg

SEQ ID NO: 54712 - RNA, 63 nt, Homo Sapiens
uaauguucuuccuguuuucauuagauuucuguguuucugaaggacacaacagcuguuuugcuu

SEQ ID NO: 54713 - RNA, 63 nt, Homo Sapiens
caauauuaauacuguuuauagcuagaaguuugauuucugaauucuuugagauuuuagcaaaac

SEQ ID NO: 54714 - RNA, 63 nt, Homo Sapiens
uaaagugcgcuugcaaacguuugcucuccuuuuuuucugaauguugauugccuuagcuggcca

SEQ ID NO: 54715 - RNA, 63 nt, Homo Sapiens
uuaagugaaaagcaaguucuagcauuuucauuuuuucugaauaaagagggaaaacugcaucuc

SEQ ID NO: 54716 - RNA, 63 nt, Homo Sapiens
agacguuucuuuuaguaaguuucucaucuuuguuuucugaaacugcagucauuugcacgugag

SEQ ID NO: 54717 - RNA, 63 nt, Homo Sapiens
ucuugugggcugugguugcugugacaguuucguuuucugaaucuuuguaaugcucuuccaccc

SEQ ID NO: 54718 - RNA, 63 nt, Homo Sapiens
cccaggaccuucuauucacauuucaagaaucccuuucugaaauucuccaacucucuggucagg

SEQ ID NO: 54719 - RNA, 63 nt, Homo Sapiens
ugcuuccucuuauaaaauagauggccuuggcccuuucugaagcuacuuuaaaccccgcuccuc

SEQ ID NO: 54720 - RNA, 63 nt, Homo Sapiens
caagacugggauuggaucacauucaacuuggccuuucugaagguugcccuggcagaaaaaugg

SEQ ID NO: 54721 - RNA, 63 nt, Homo Sapiens
guacuucguauuuuuuuuuaugaugaggaguacuuucugaagauaaaacauauuuauauauug

SEQ ID NO: 54722 - RNA, 63 nt, Homo Sapiens
augugccuacauuaccagcuaacuuggccacaguuucugaacaucuuacuuuuucucuugugg

SEQ ID NO: 54723 - RNA, 63 nt, Homo Sapiens
gcuugguuggaagacugugauaaaagaaauucauuucugaaaucuguaaucuuuuuugacucu

SEQ ID NO: 54724 - RNA, 63 nt, Homo Sapiens
cuguuccuggccgggcaucccagcccuuucccuuuucugaaaggaguuggaggaggcuguucu

SEQ ID NO: 54725 - RNA, 63 nt, Homo Sapiens
cgguuugcagagaauguuagccaugacuugggcuuucugaaaguuggcuauaauuucucuauc

SEQ ID NO: 54726 - RNA, 63 nt, Homo Sapiens
cucaaagucuaacauauucaaugcaaguaagacuuucugaaaacacuugaugauguggaaaug

SEQ ID NO: 54727 - RNA, 63 nt, Homo Sapiens
guuuuucaaaaauggaagcccacuucucagauuuuucugaagggcauacaaugaaaagugaag

SEQ ID NO: 54728 - RNA, 63 nt, Homo Sapiens
aaaaagcuacagcugagaaaagauggucuccaguuucugaaugggaauaacaacucagugaaa

SEQ ID NO: 54729 - RNA, 63 nt, Homo Sapiens
uuguccuacaauuuggauuuuuacauuccaucuuuucugaagaucuaaauugaacucaacauu

SEQ ID NO: 54730 - RNA, 63 nt, Homo Sapiens
agaacuuauaaugaagcuacguaggggagaacauuucugaaaaggcaguagggaugggguuag

SEQ ID NO: 54731 - RNA, 63 nt, Homo Sapiens
ucgaguacuucccaaugccgccccaaaagguuguuucugaagcucagugaugugaaauugagc

SEQ ID NO: 54732 - RNA, 63 nt, Homo Sapiens
gauggcccugggcgcgcugggagugugguuguguuucugaaggggauaaaagagggcacggug

SEQ ID NO: 54733 - RNA, 63 nt, Homo Sapiens
uaaauuugacaucgcguugcauuuauuuuuauauuucugaaaacuguugcuuuuucuuuuucc

SEQ ID NO: 54734 - RNA, 64 nt, Homo Sapiens
aaagagagggauggagucaaaaacaaaaaaccacauacaggaaaccuugucuugaaaaaaaaaa

SEQ ID NO: 54735 - RNA, 64 nt, Homo Sapiens
aacgaggcaggcagaucacuaauaacauuagaacauacaggaaagaggcaaaggggaucccuga

SEQ ID NO: 54736 - RNA, 64 nt, Homo Sapiens
uacuaugugucaggcucuaugcuagguacuggggauacaggagagaaucaagcguaaagucuuu

SEQ ID NO: 54737 - RNA, 64 nt, Homo Sapiens
ggacggccauggcaggaagcuuuuaguuggagagauacaggaagccuccuaggguucugagcag

SEQ ID NO: 54738 - RNA, 64 nt, Homo Sapiens
gcaauacucaguaacaguguaguacucaguaacagugaaguacucaguaauacaguacaguauu

SEQ ID NO: 54739 - RNA, 64 nt, Homo Sapiens
uacucaguaauacaguacaguauucaguaaggcagugaaguacucaguaauacaauacaguacu

SEQ ID NO: 54740 - RNA, 64 nt, Homo Sapiens
auucccuuuuucuaaggcacagagcugguaaaaugugaaguaauagugaaccuaacagucagag

SEQ ID NO: 54741 - RNA, 64 nt, Homo Sapiens
acauaaaauugaauaguaccguaaaguagauuaggugaaguagaaaguugaaagaugggguugg

SEQ ID NO: 54742 - RNA, 64 nt, Homo Sapiens
agagguccucgaucauggugggccgugauuggaugugaaguagaaggcauuggaggugguuucu

SEQ ID NO: 54743 - RNA, 64 nt, Homo Sapiens
gauagcaaaauuuuacuacccugagggucaguaagugaaguacaugucuucuagccuugagccu

SEQ ID NO: 54744 - RNA, 64 nt, Homo Sapiens
augugugaguuauagaucucgauuauaguugagagugaaguacuuaguaugaauguggucagag

SEQ ID NO: 54745 - RNA, 64 nt, Homo Sapiens
caugugcagauaaaagagguuuaugaaguuuagggugaaguaggcaagggaaucuguuuacucc

SEQ ID NO: 54746 - RNA, 64 nt, Homo Sapiens
ucacaauuugugucucguuguucagaacaacccugugaaguaguuuuggcaaugucuguguuac

SEQ ID NO: 54747 - RNA, 64 nt, Homo Sapiens
uugugccaguguugcaacguuuuaaacugcuaacagaccuuaaaauaucccccuaccugggucc

SEQ ID NO: 54748 - RNA, 64 nt, Homo Sapiens
uuaccugauaacagucuuguuauuugggucucuuagaccuuaccucucaacucccucaagagua

SEQ ID NO: 54749 - RNA, 64 nt, Homo Sapiens
gacacaaacacacauaagaauacacucuggagaaagaccuuauaaauguaagacaugugggaaa

SEQ ID NO: 54750 - RNA, 64 nt, Homo Sapiens
gacacaaacacacguaagaaugcacucuguagaaagaccuuauaaauguaagauaugugggaaa

SEQ ID NO: 54751 - RNA, 64 nt, Homo Sapiens
cuuuuuguccaguuucaucugccuugcuggguuuagaccuuaugagaagcaucuggacagacag

SEQ ID NO: 54752 - RNA, 64 nt, Homo Sapiens
gaacaagaggcaucacucagugcaaagacucuccagaccuuagguggaaaugucguuggaaacu

SEQ ID NO: 54753 - RNA, 64 nt, Homo Sapiens
gguuucagggggacccaaaucugggcccaccuccgauucacagacugcugcguccugcacccuc

SEQ ID NO: 54754 - RNA, 64 nt, Homo Sapiens
gguuguguaucucuauaauguguacucauacuuagauucacaauaaugccuccaaacauuuuuc

SEQ ID NO: 54755 - RNA, 64 nt, Homo Sapiens
guaauucagcauguuggucagagacacggucacugauucacacccagucccugccacagaccgu

SEQ ID NO: 54756 - RNA, 64 nt, Homo Sapiens
accgucucagacacgcacagugggccugcugcaugauucacacccagucccugccacagaccgu

SEQ ID NO: 54757 - RNA, 64 nt, Homo Sapiens; identical to SEQ ID NO: 54756

SEQ ID NO: 54758 - RNA, 64 nt, Homo Sapiens
ugaguuaaauuagacaacugugauccucaauacugauucacaaugaauuggggcaauuaccuuu

SEQ ID NO: 54759 - RNA, 64 nt, Homo Sapiens
ccaugugggauggagcagaacacaagaaaaggaugauucacaucauggguggguaguguaaaua

SEQ ID NO: 54760 - RNA, 64 nt, Homo Sapiens
ugcaucuuaacugcucuuuauuguauugaagagggauucacaucaacagagaaccaucccuauu

SEQ ID NO: 54761 - RNA, 64 nt, Homo Sapiens
guauuugaaaaauguauauauguuguucaaacgggauucacagaaagccuguuuugucuuuugu

SEQ ID NO: 54762 - RNA, 64 nt, Homo Sapiens
aauuaacucuuccucucuucuuuagaaagaaugagauucacaaucuuaguuaagauucacaauc

SEQ ID NO: 54763 - RNA, 64 nt, Homo Sapiens
cuuuagaaagaaugagauuccaggucuuaguuaagauucacaauuuuuauuuuccgucaggugc

SEQ ID NO: 54764 - RNA, 64 nt, Homo Sapiens
aggaacucuccaaagccuauuccacauauuuaaaccgcauuaaucauggcaaucaagcccccuu

SEQ ID NO: 54765 - RNA, 64 nt, Homo Sapiens
aucuuuggugagcuucagugggcagagugaagucccgcauuagcauuuaggugcccugagcugu

SEQ ID NO: 54766 - RNA, 64 nt, Homo Sapiens
cuggcuucauuacacuuguacagccgaguucuucccgcauuacugcuguuuaauagaacgugau

SEQ ID NO: 54767 - RNA, 64 nt, Homo Sapiens
agccacagcagguccuccaucccaacagccaugcccgcauuagcucuuagacccacagacuggu

SEQ ID NO: 54768 - RNA, 64 nt, Homo Sapiens
cuccucuguaaaaugggcaugauuagagugcccaccgcauuagggauguuggggugagucagug

SEQ ID NO: 54769 - RNA, 64 nt, Homo Sapiens
gagcuuugccugggaccugaaccuggagcacuuaccgcauuaggaagaaaggagcuccccguaa

SEQ ID NO: 54770 - RNA, 64 nt, Homo Sapiens
aaaagcauaacuggcuaagucaccgccccacccgccgcauuacauuuccuaaaacauacugcug

SEQ ID NO: 54771 - RNA, 64 nt, Homo Sapiens
auguaguuguucagaagcugcuucaggauucuccccgcauuauuugcuugugggaugcaguggu

SEQ ID NO: 54772 - RNA, 64 nt, Homo Sapiens
aaaaugaacuaaacauugccauguaucaggauuuccgcauuauaaguucaaagaugaaagcacc

SEQ ID NO: 54773 - RNA, 64 nt, Homo Sapiens
gugcuuuguuuuuggaagaucugguaacagcagcccgcauuagcagagagcuguagcugaguag

SEQ ID NO: 54774 - RNA, 64 nt, Homo Sapiens
guuuuacuguauugagcggcggcacccgccggacccgcauuauggcugggggcgccagcccaag

SEQ ID NO: 54775 - RNA, 64 nt, Homo Sapiens
gcuccuucccauacacucugcagacccaacagucccgcauuagcucuagcaaugagguucacug

SEQ ID NO: 54776 - RNA, 64 nt, Homo Sapiens
acugugugauggucucagucuggcgccgccccacccgcauuaucuauaaauaacgggauuuuca

SEQ ID NO: 54777 - RNA, 64 nt, Homo Sapiens
aguguguuuuuggaagaugugauugauuuguaaaccgcauuaaaugcucugaaauaaaaugaaa

SEQ ID NO: 54778 - RNA, 64 nt, Homo Sapiens
auggaaggaucuuaaccagugcaucuggugugguccgcauuaugagcuguuugguggaacccau

SEQ ID NO: 54779 - RNA, 64 nt, Homo Sapiens
aacacaggagaauaaucaauccccacccugccgcccgcauuauagagaagcauuuuaaagaaac

SEQ ID NO: 54780 - RNA, 64 nt, Homo Sapiens
ugugcaaacucacuucugaggggggacccuggcaccgcauuagagcucgaaauaaaggcgauag

SEQ ID NO: 54781 - RNA, 64 nt, Homo Sapiens
uaggagaaacagacaagcaaaacaaagugaaaaccgaauggauuaacuuuugcaaaccaaggga

SEQ ID NO: 54782 - RNA, 64 nt, Homo Sapiens
cuuuuaauuuucuauuuagaaagaaaaguugaagcgaauggaaguaucagaaguaccaaauaau

SEQ ID NO: 54783 - RNA, 64 nt, Homo Sapiens
uuggccuuccauuuuuacugagauuuggcgagaccgaauggaagcguccgcacaguaacugcag

SEQ ID NO: 54784 - RNA, 64 nt, Homo Sapiens
gaugguuugaacuuaacguccauacagcuagugacgaauggacuuaaaauaauuugcccgaaga

SEQ ID NO: 54785 - RNA, 64 nt, Homo Sapiens
gagcccaggcccucccuccaggguagagaugcaccgaauggaaauugcacuaaggaccucuucc

SEQ ID NO: 54786 - RNA, 64 nt, Homo Sapiens
cagcuccacucugcucuugcccacaaagcugacccgaauggaccacagcagugggcuccuaugc

SEQ ID NO: 54787 - RNA, 64 nt, Homo Sapiens
uauguuacgggcgcuuuaaccaucagcugccucucgaauggaagaacagugguaauggauuaac

SEQ ID NO: 54788 - RNA, 64 nt, Homo Sapiens
acugcuguaggcugucccagugcgaggccgggagcgaauggaaaagcugaggcuuugccuggcu

SEQ ID NO: 54789 - RNA, 64 nt, Homo Sapiens
aaagaauucccugcaaauacugaaagcagucaugcgaauggagggugcucuuguguagcugguc

SEQ ID NO: 54790 - RNA, 59 nt, Homo Sapiens
cuaugggacuccucuuuuccaagacuuuucgaauggaccucuuacaaagauguaacuga

SEQ ID NO: 54791 - RNA, 64 nt, Homo Sapiens
uuggccugguuguuuccguagugagaaaugaaaucgaauggagauuaauaugcaagugaacaaa

SEQ ID NO: 54792 - RNA, 64 nt, Homo Sapiens
gugaguugcacagcuaugaaggcuguacacugcacgaauggaagaggcaccugucccagaaaaa

SEQ ID NO: 54793 - RNA, 64 nt, Homo Sapiens
cgcguuagccaugaaggagucggagcccuggguccgaauggacccgccugcggucugcaucagc

SEQ ID NO: 54794 - RNA, 64 nt, Homo Sapiens
uguuuggaaagcuacaucuugugauaauggucaucgaauggauuaauuagaauaaaauauaguu

SEQ ID NO: 54795 - RNA, 64 nt, Homo Sapiens
uugucuuuuuggagacacagugaacacugcuucucgaauggagucuaauggucaagguaagaca

SEQ ID NO: 54796 - RNA, 64 nt, Homo Sapiens
aaaggaaugcugguuuaucuuuguagauuguaaucgaauggagaaauuugcaguauuuuagcca

SEQ ID NO: 54797 - RNA, 64 nt, Homo Sapiens
uucauguauaauacucauuuaaggaauugccuuccgaauggagguagauguucuauagugcuac

SEQ ID NO: 54798 - RNA, 58 nt, Homo Sapiens
ugcaggagcugcgggagccgaaucuagacgaauggagaucaaugcaaagaagaaauaa

SEQ ID NO: 54799 - RNA, 64 nt, Homo Sapiens
guucugaggggcucggccuggucaggcccuggugcgaauggacuuuggaagcagguagguugca

SEQ ID NO: 54800 - RNA, 64 nt, Homo Sapiens
gugaacauuagaaagagccaggguucaaagcuggcgaauggaugacgcacccuagccacuggcc

SEQ ID NO: 54801 - RNA, 64 nt, Homo Sapiens
ggcuuaaaccaguguucagucuggugccaaacuucgaauggaauacaaauucacauaaucugaa

SEQ ID NO: 54802 - RNA, 64 nt, Homo Sapiens
gccauuugcagagauuuagaaagauuuacaguaacgaauggauuccuauauaaagauuauuuuu

SEQ ID NO: 54803 - RNA, 64 nt, Homo Sapiens
ugugcugccugucuucgcgccacuguugucccaccgaauggacagcuuugcaggugcuggcacu

SEQ ID NO: 54804 - RNA, 64 nt, Homo Sapiens
cagcugagcugaggccugacccaccaagcugagccgaauggagaucuacuaugggcagggcccc

SEQ ID NO: 54805 - RNA, 64 nt, Homo Sapiens
gggagcucuuggauaucauuggccauguuucaaucgaauggagccacugggccccaacacuggc

SEQ ID NO: 54806 - RNA, 64 nt, Homo Sapiens
ggcguucagcagcggguuuggaacauagcgaauccgaauggaucugaugaaaccuguaccaggu

SEQ ID NO: 54807 - RNA, 64 nt, Homo Sapiens
agagagggagcccuguauucuuggcuguacccgucgaauggaguuuugaucucgcugaguuugg

SEQ ID NO: 54808 - RNA, 64 nt, Homo Sapiens
cucuccuggacucgcguuccgggugguuuucccacgaauggaccgacgcgcgugacacaaugcu

SEQ ID NO: 54809 - RNA, 64 nt, Homo Sapiens
auccaugugugucccugugacgcacccaauaaagcgaauggaccgaugucaugacaacacuaca

SEQ ID NO: 54810 - RNA, 64 nt, Homo Sapiens
gggggaauugggguccaccaggaggagccaggaucgaauggaagcagagccugggcacuucaga

SEQ ID NO: 54811 - RNA, 64 nt, Homo Sapiens
uucacuucaggcuuuccuucaagagcaccaggaccgaauggauuaauuugccucucuguguuua

SEQ ID NO: 54812 - RNA, 64 nt, Homo Sapiens
ccagaccugggcccugguucagcugggaaggucccgaauggaguucuguguugugauuccccgg

SEQ ID NO: 54813 - RNA, 64 nt, Homo Sapiens
auggccuaaguucccucuguuccuuccucugaaucgaauggaugugggugaccgcccgaaggcc

SEQ ID NO: 54814 - RNA, 64 nt, Homo Sapiens
uaagaauuggcucuccuguacagggcacuuacuacgaauggagcuugcagggcugagaguugcu

SEQ ID NO: 54815 - RNA, 64 nt, Homo Sapiens
aucccacauugccugggacaucugaaugcugauacgaauggacaggaaagggagccagagcugu

SEQ ID NO: 54816 - RNA, 64 nt, Homo Sapiens
aauguuuucaaagauugauucuguauguaugaaccgaauggaggggcagccacagugguuucua

SEQ ID NO: 54817 - RNA, 64 nt, Homo Sapiens
ggcuccuaagauccagcccccauacugacagacggacagacagacaugcaaacaccagacugaa

SEQ ID NO: 54818 - RNA, 64 nt, Homo Sapiens
ccuaagauccagcccccauacugacagacggacagacagacaugcaaacaccagacugaagcac

SEQ ID NO: 54819 - RNA, 64 nt, Homo Sapiens
cccucugaucuaugaagucucugcaggacagacagacagacaaagcaggacauaugggcaagcu

SEQ ID NO: 54820 - RNA, 64 nt, Homo Sapiens
caaacccucugaucuaugaaagcucugcaggacagacagacagaaccagcaggacauaugggca

SEQ ID NO: 54821 - RNA, 64 nt, Homo Sapiens
cagacaaacccucugaucuaggcaagcucugcaggacagacagaugggaccagcaggacauaug

SEQ ID NO: 54822 - RNA, 64 nt, Homo Sapiens
cacuggcuccuggaccuaaacccagaggagaggagacagacacaucaccuaagcaaucacuggg

SEQ ID NO: 54823 - RNA, 64 nt, Homo Sapiens
agcuggacuugaagguuugagacaggaggagugggacagacagcccugaugggaguaggcucca

SEQ ID NO: 54824 - RNA, 64 nt, Homo Sapiens
caggcagaccgauaaaaagaccuccagauaggcagacagacagauggaccaccaaccuggacag

SEQ ID NO: 54825 - RNA, 64 nt, Homo Sapiens
agauaggcagacagacagauggaccaccaaccuggacagacagccaaagcuucagagauacagu

SEQ ID NO: 54826 - RNA, 64 nt, Homo Sapiens
cagccagagagaccaccaaacagagcccccaaaagacagacaucucugcuagcuggacagccag

SEQ ID NO: 54827 - RNA, 64 nt, Homo Sapiens
ggaccccagcuagucagacaugauccuccagauugacagacaagucccccaaaugaguacacau

SEQ ID NO: 54828 - RNA, 64 nt, Homo Sapiens
uucucuaaucucuuugguacuauauauggaaagugacagacaaacuuguacagccaaaauaaug

SEQ ID NO: 54829 - RNA, 64 nt, Homo Sapiens
caggcugaaauggacaguuccagagugucaugaagacagacagucuccugaaguagcuucauca

SEQ ID NO: 54830 - RNA, 64 nt, Homo Sapiens
gcuguggaggucacagcugcgaugaagcaagcaugacagacacauagcuacuaacuagaaauua

SEQ ID NO: 54831 - RNA, 64 nt, Homo Sapiens
cugugauaugguguuuuauaaacagcagauuacugacagacaauccuuugaacucucuuggcug

SEQ ID NO: 54832 - RNA, 64 nt, Homo Sapiens
ugaaguauucagagccccccaggagagacggauggacagacagacagccagguucuccaguggu

SEQ ID NO: 54833 - RNA, 64 nt, Homo Sapiens
guauucagagccccccaggagagacggauggacagacagacagccagguucuccagugguaucu

SEQ ID NO: 54834 - RNA, 64 nt, Homo Sapiens
gauggaguaaaccgaagucagacacugccagcaggacagacaggucgacuuguuuuuuagcaug

SEQ ID NO: 54835 - RNA, 64 nt, Homo Sapiens
uaaaaacaaccuucagcucccgcguuucuccacugacagacauuuuccucagagauucgugaua

SEQ ID NO: 54836 - RNA, 64 nt, Homo Sapiens
aaucuccugugaucugugcugucugguggguauggacagacaguguguggguguucaguucugu

SEQ ID NO: 54837 - RNA, 64 nt, Homo Sapiens
cugggacgucagggaaaugaucuuaugacaaggggacagacaagagagcguguguagugcugca

SEQ ID NO: 54838 - RNA, 64 nt, Homo Sapiens
cacacacacccaucucuguccagacagacagacagacagacacgggcucuggacccaggacaga

SEQ ID NO: 54839 - RNA, 64 nt, Homo Sapiens
cacgcacacacacccaucuccagacagacagacagacagacagaugacggcucuggacccagga

SEQ ID NO: 54840 - RNA, 64 nt, Homo Sapiens
cagacagacagacagacacgaggacagacagacagacagacagagaauugacggcucuggaccc

SEQ ID NO: 54841 - RNA, 64 nt, Homo Sapiens
cagacagacagacagacagaacccaggacagacagacagacagaugaagaauugacggcucugg

SEQ ID NO: 54842 - RNA, 64 nt, Homo Sapiens
cagacagacagacagacagacuggacccaggacagacagacagaaggcugaagaauugacggcu

SEQ ID NO: 54843 - RNA, 64 nt, Homo Sapiens
cagacagacagacagacagaggcucuggacccaggacagacagaacugaggcugaagaauugac

SEQ ID NO: 54844 - RNA, 64 nt, Homo Sapiens
uccccgcccgcccuccucugcccccucccccgcagacagacagacagacggacgggacagcggc

SEQ ID NO: 54845 - RNA, 64 nt, Homo Sapiens
cgcccgcccuccucugcccccucccccgcagacagacagacagacggacgggacagcggcccgg

SEQ ID NO: 54846 - RNA, 64 nt, Homo Sapiens
aacgcguccacgagcuauauuauauacauauauagacagacaggacaaaauauguguggagaua

SEQ ID NO: 54847 - RNA, 64 nt, Homo Sapiens
aaccaaccaacgacaaaacaauuuauauucaacugacagacaaacucggcuguuuuucugcauu

SEQ ID NO: 54848 - RNA, 64 nt, Homo Sapiens
cacacacacacacacacacacggacagacagacagacagacacaucuccagacucuaccacuua

SEQ ID NO: 54849 - RNA, 64 nt, Homo Sapiens
cacacacacacacacacacacuuacggacagacagacagacagauccaucuccagacucuacca

SEQ ID NO: 54850 - RNA, 64 nt, Homo Sapiens
cagacacacacacacacacaaccacuuacggacagacagacagagugguccaucuccagacucu

SEQ ID NO: 54851 - RNA, 64 nt, Homo Sapiens
cagacagacacacacacacacucuaccacuuacggacagacagaaacugugguccaucuccaga

SEQ ID NO: 54852 - RNA, 64 nt, Homo Sapiens
aguugguucuguguccauuuuccucugugccaaagacagacagacagaggcugagagaggcugu

SEQ ID NO: 54853 - RNA, 64 nt, Homo Sapiens
gguucuguguccauuuuccucugugccaaagacagacagacagaggcugagagaggcuguuccu

SEQ ID NO: 54854 - RNA, 64 nt, Homo Sapiens
accaagauguuggggcugccuggcgcccacuggagacagacagacagacgccugucccccggga

SEQ ID NO: 54855 - RNA, 64 nt, Homo Sapiens
agauguuggggcugccuggcgcccacuggagacagacagacagacgccugucccccgggaccga

SEQ ID NO: 54856 - RNA, 64 nt, Homo Sapiens
agagcagacacacauacagccugaaacagaccuggacagacagacacagccugaaacagacccg

SEQ ID NO: 54857 - RNA, 64 nt, Homo Sapiens
cagacacacauacagccugaaacagaccuggacagacagacacagccugaaacagacccggaca

SEQ ID NO: 54858 - RNA, 64 nt, Homo Sapiens
ccuggacagacagacacagccugaaacagacccggacagacagacacagccugaaacagaccca

SEQ ID NO: 54859 - RNA, 64 nt, Homo Sapiens
gacagacagacacagccugaaacagacccggacagacagacacagccugaaacagacccagaca

SEQ ID NO: 54860 - RNA, 64 nt, Homo Sapiens
gacagacacagccugaaacagacccagacaaacagacagacagacacagccugaaacagaccca

SEQ ID NO: 54861 - RNA, 64 nt, Homo Sapiens
gacacagccugaaacagacccagacaaacagacagacagacacagccugaaacagacccagaca

SEQ ID NO: 54862 - RNA, 64 nt, Homo Sapiens
aacagacagacagacacagccugaaacagacccagacagacagacagacagccugaaacagacc

SEQ ID NO: 54863 - RNA, 64 nt, Homo Sapiens
gacagacagacacagccugaaacagacccagacagacagacagacagccugaaacagacccaga

SEQ ID NO: 54864 - RNA, 64 nt, Homo Sapiens
gacagacacagccugaaacagacccagacagacagacagacagccugaaacagacccagacaca

SEQ ID NO: 54865 - RNA, 64 nt, Homo Sapiens
gaaacagacccagacacagccugaaacagauccggacagacagacagaaacagccugaaacaga

SEQ ID NO: 54866 - RNA, 64 nt, Homo Sapiens
cagacccagacacagccugaaacagauccggacagacagacagaaacagccugaaacagaccca

SEQ ID NO: 54867 - RNA, 64 nt, Homo Sapiens
gacagacagacagaaacagccugaaacagacccagacagacagacagacacagccugaaacaga

SEQ ID NO: 54868 - RNA, 64 nt, Homo Sapiens
gacagacagaaacagccugaaacagacccagacagacagacagacacagccugaaacagacccg

SEQ ID NO: 54869 - RNA, 64 nt, Homo Sapiens
gacagaaacagccugaaacagacccagacagacagacagacacagccugaaacagacccggaca

SEQ ID NO: 54870 - RNA, 64 nt, Homo Sapiens
gacagacagacagacacagccugaaacagacccggacagacagacagacacagccugaaacaga

SEQ ID NO: 54871 - RNA, 64 nt, Homo Sapiens
gacagacagacacagccugaaacagacccggacagacagacagacacagccugaaacagacccg

SEQ ID NO: 54872 - RNA, 64 nt, Homo Sapiens
gacagacacagccugaaacagacccggacagacagacagacacagccugaaacagacccggaca

SEQ ID NO: 54873 - RNA, 64 nt, Homo Sapiens; identical to SEQ ID NO: 54870

SEQ ID NO: 54874 - RNA, 64 nt, Homo Sapiens; identical to SEQ ID NO: 54871

SEQ ID NO: 54875 - RNA, 64 nt, Homo Sapiens; identical to SEQ ID NO: 54872

SEQ ID NO: 54876 - RNA, 64 nt, Homo Sapiens; identical to SEQ ID NO: 54870

SEQ ID NO: 54877 - RNA, 64 nt, Homo Sapiens
gacagacagacacagccugaaacagacccggacagacagacagacacagccugaaacagaccua

SEQ ID NO: 54878 - RNA, 64 nt, Homo Sapiens
gacagacacagccugaaacagacccggacagacagacagacacagccugaaacagaccuagaca

SEQ ID NO: 54879 - RNA, 64 nt, Homo Sapiens
gacagacagacagacacagccugaaacagaccuagacagacagacacagauugaaacagaccca

SEQ ID NO: 54880 - RNA, 64 nt, Homo Sapiens
gacagacagacacagccugaaacagaccuagacagacagacacagauugaaacagacccagaca

SEQ ID NO: 54881 - RNA, 64 nt, Homo Sapiens
gacagacacagauugaaacagacccagacaaacagacagacacagccugaaacagacccagaca

SEQ ID NO: 54882 - RNA, 64 nt, Homo Sapiens
gaaacagacccagacacagccugaaacagacccggacagacagacagacacagccugaaacaga

SEQ ID NO: 54883 - RNA, 64 nt, Homo Sapiens
cagacccagacacagccugaaacagacccggacagacagacagacacagccugaaacagaccca

SEQ ID NO: 54884 - RNA, 64 nt, Homo Sapiens
cccagacacagccugaaacagacccggacagacagacagacacagccugaaacagacccagaca

SEQ ID NO: 54885 - RNA, 64 nt, Homo Sapiens
gacagacagacagacacagccugaaacagacccagacagacagacagacacagccugaaacaga

SEQ ID NO: 54886 - RNA, 64 nt, Homo Sapiens
gacagacagacacagccugaaacagacccagacagacagacagacacagccugaaacagaccca

SEQ ID NO: 54887 - RNA, 64 nt, Homo Sapiens
gacagacacagccugaaacagacccagacagacagacagacacagccugaaacagacccagaca

SEQ ID NO: 54888 - RNA, 64 nt, Homo Sapiens
gacagacagacagacacagccugaaacagacccagacagacagaccgacgcagccugaaagaga

SEQ ID NO: 54889 - RNA, 64 nt, Homo Sapiens
gagagacaggcagacacagccuaaaacagaccuggacagacaggcagacguagucugaaacaga

SEQ ID NO: 54890 - RNA, 64 nt, Homo Sapiens
gacaggcagacguagucugaaacagaccugaacagacagacagacgcacacacacaacagaugc

SEQ ID NO: 54891 - RNA, 64 nt, Homo Sapiens
aagccaucucagugaagauaugcgugcacgcacagacagacagacacacacacacacacacaca

SEQ ID NO: 54892 - RNA, 64 nt, Homo Sapiens
caucucagugaagauaugcgugcacgcacagacagacagacacacacacacacacacacacaca

SEQ ID NO: 54893 - RNA, 64 nt, Homo Sapiens
uaacaggaacucggaagguaauuuaggggcaggagacagacacgagggaugggagccaggaaag

SEQ ID NO: 54894 - RNA, 64 nt, Homo Sapiens
ggcacuccugguccugcuguccucaggcaaccccgacagacaguuccaccuccuuccccuucuc

SEQ ID NO: 54895 - RNA, 64 nt, Homo Sapiens
acagccuccccuucccagacgagauggauggacagacagacaccagccucuucuccugcagccu

SEQ ID NO: 54896 - RNA, 64 nt, Homo Sapiens
caccacagccuccccuucccgccugagauggauggacagacagaaauaagccucuucuccugca

SEQ ID NO: 54897 - RNA, 62 nt, Homo Sapiens
auuacuugcuuccuugcaugauugucuuuaugcauccccaaucuuaauugagaccauacuug

SEQ ID NO: 54898 - RNA, 62 nt, Homo Sapiens
uggaauugcacaucuaccuuacaauuacugaccauccccaguagacuccccagucccauaau

SEQ ID NO: 54899 - RNA, 57 nt, Homo Sapiens
ucucuuuccugaaagaauaaucauggccauccccacucccuuuguauuuccucuuuc

SEQ ID NO: 54900 - RNA, 62 nt, Homo Sapiens
ugucuauaguguuggacagcacauucuuagagcauccccaaucaauaguuucagaaguuaua

SEQ ID NO: 54901 - RNA, 62 nt, Homo Sapiens
gguaagagcuucgaucucugaugacuugugcacauccccaagcgcccagcagugcugcucug

SEQ ID NO: 54902 - RNA, 62 nt, Homo Sapiens
cuaccuccuuccuucuacccuucagcuugucucauccccagugugacugagagcacuuaaca

SEQ ID NO: 54903 - RNA, 62 nt, Homo Sapiens
ucuaacuucagccagaccugagccuaggaaaacauccccauucuaacagguugggcuggccc

SEQ ID NO: 54904 - RNA, 62 nt, Homo Sapiens
gcugcccaaaccaccacugccccccccuccaucauccccaaguaggccuugguaacuaugcg

SEQ ID NO: 54905 - RNA, 62 nt, Homo Sapiens
gguggggaggggaggcagguguggguagcgcacauccccacagaucaaucucugcagaugac

SEQ ID NO: 54906 - RNA, 62 nt, Homo Sapiens
uaggaugagagucagagccuuuggaaaggcugcauccccagggcuagagcucagaugaccuu

SEQ ID NO: 54907 - RNA, 62 nt, Homo Sapiens
ccacucgaugacugccucaucuuccucaguuucauccccauccccaggucuuccuagacgcu

SEQ ID NO: 54908 - RNA, 62 nt, Homo Sapiens
gaugacugccucaucuuccucaguuucauccccauccccaggucuuccuagacgcucagcac

SEQ ID NO: 54909 - RNA, 62 nt, Homo Sapiens
cugcccuggccuggguggaggaacugugccuccauccccagaagaaacagcccccucugcug

SEQ ID NO: 54910 - RNA, 62 nt, Homo Sapiens
gagccccucccgccgccucagaccccugugcacauccccagggccucagccgucucauuggu

SEQ ID NO: 54911 - RNA, 62 nt, Homo Sapiens
ggucuguggcuccucccgaaacccaaguuaugcauccccauccccaugcccucaucccgacc

SEQ ID NO: 54912 - RNA, 62 nt, Homo Sapiens
uggcuccucccgaaacccaaguuaugcauccccauccccaugcccucaucccgaccucuuag

SEQ ID NO: 54913 - RNA, 62 nt, Homo Sapiens
ugggagagggugagguucagcacaucacacaccauccccacugucauucagggccugggucu

SEQ ID NO: 54914 - RNA, 62 nt, Homo Sapiens
ccauggagccacuaggccuggccuccucuacacauccccagggcuaucugguuaauuccauc

SEQ ID NO: 54915 - RNA, 62 nt, Homo Sapiens
cuuuuuuuuuuuucuucugucauuuuccaauccauccccagcaucccaguaacuccucuucc

SEQ ID NO: 54916 - RNA, 62 nt, Homo Sapiens
augguuaauuccaacucucacucuuuaggggacauccccaacacacuuuggggcugauuugu

SEQ ID NO: 54917 - RNA, 62 nt, Homo Sapiens
cugguccugguauugauacacuuaagcccucucauccccacgagauuucaggcugaucccug

SEQ ID NO: 54918 - RNA, 62 nt, Homo Sapiens
gcaguuucaggugccggcugccaggagaggcccauccccaggggcguuuggccccggccugg

SEQ ID NO: 54919 - RNA, 62 nt, Homo Sapiens
ugcaacugguuuuacuagugugcaaguguguucauccccaaguucucuuuuguccucacaug

SEQ ID NO: 54920 - RNA, 62 nt, Homo Sapiens
augagcccagcauggaugugucucaggcaccucauccccaccccaccucaccccaacaaacu

SEQ ID NO: 54921 - RNA, 62 nt, Homo Sapiens
ggcagagaggcuccauggccgugcugcugggccauccccaacucccuaucccauccccagcc

SEQ ID NO: 54922 - RNA, 62 nt, Homo Sapiens
cgugcugcugggccauccccaacucccuaucccauccccagccuccacccccauccagaugg

SEQ ID NO: 54923 - RNA, 62 nt, Homo Sapiens
ccgugugucacaacaggcuagggcggcguguucauccccacaacgccgugugucacgggcua

SEQ ID NO: 54924 - RNA, 62 nt, Homo Sapiens
ccgugugucacgggcuagggauguggcguguucauccccacgaacagggucaccagugcauu

SEQ ID NO: 54925 - RNA, 62 nt, Homo Sapiens
gccgggcucugcguccccacguccccucgucccauccccacguccccucaucccgucaccuc

SEQ ID NO: 54926 - RNA, 62 nt, Homo Sapiens
ugucaccucguccccacguccccucgucuccucauccccacguccucucguccccuuguccc

SEQ ID NO: 54927 - RNA, 62 nt, Homo Sapiens
gccagguacgacgcuugccccggcccacccuccauccccacccuccauccccacccuagaug

SEQ ID NO: 54928 - RNA, 62 nt, Homo Sapiens
cuugccccggcccacccuccauccccacccuccauccccacccuagauggagcgagggccuu

SEQ ID NO: 54929 - RNA, 62 nt, Homo Sapiens
uuacccagcucuuggggugucucuguuuuuuccauccccacuuccugccuucucguggcccu

SEQ ID NO: 54930 - RNA, 62 nt, Homo Sapiens
cucagccaccuuccucaggcucacuccaccuacauccccagucugccacaccccaucccuuu

SEQ ID NO: 54931 - RNA, 62 nt, Homo Sapiens
cauagggcuggcucacauccguagggcggugccauccccacccagcuucaacucucucggcg

SEQ ID NO: 54932 - RNA, 62 nt, Homo Sapiens
ucuaaaaccaguaaaucagcgcacugggugcccauccccauccuucucuggucuucagucca

SEQ ID NO: 54933 - RNA, 62 nt, Homo Sapiens
uuagugccaggcagcccugccagccaugccuacauccccaugggcacagaacaagccaaagc

SEQ ID NO: 54934 - RNA, 62 nt, Homo Sapiens
gguggcugcacacucuuccuggcccgcacccccauccccagucccuguuccccaagaggaua

SEQ ID NO: 54935 - RNA, 62 nt, Homo Sapiens
ugcuaucugcaaugaccaccauagcuuaaccccauccccacccucaaccccaagcucaaccc

SEQ ID NO: 54936 - RNA, 62 nt, Homo Sapiens
uccuccaccccacaucccaccacauccaccuccauccccaacccauccucauccccaacuac

SEQ ID NO: 54937 - RNA, 62 nt, Homo Sapiens
caccacauccaccuccauccccaacccauccucauccccaacuacagccccaaacccagccc

SEQ ID NO: 54938 - RNA, 62 nt, Homo Sapiens
gccccaaacccagccccagacuaauccacagccauccccaacucauccucauccccaacugc

SEQ ID NO: 54939 - RNA, 62 nt, Homo Sapiens
agacuaauccacagccauccccaacucauccucauccccaacugcagccccaaacccaaccc

SEQ ID NO: 54940 - RNA, 62 nt, Homo Sapiens
ccccaacugcagccccaaacccaacccagggccauccccaaacccauccccaagccaaacuc

SEQ ID NO: 54941 - RNA, 62 nt, Homo Sapiens
ccccaaacccaacccagggccauccccaaacccauccccaagccaaacucaacaccaucccc

SEQ ID NO: 54942 - RNA, 62 nt, Homo Sapiens
ccuaaucaccucuccugccccuagcucagccucauccccaacuccaugccugucuccaaucc

SEQ ID NO: 54943 - RNA, 62 nt, Homo Sapiens
uccucaacuaagcuccucuccagcccuggccacauccccauccucccccaaccuccagcccc

SEQ ID NO: 54944 - RNA, 62 nt, Homo Sapiens
caccgucccgaagccaacuucacccauguccccauccccaaucuuguccccauuccugacuc

SEQ ID NO: 54945 - RNA, 62 nt, Homo Sapiens
acugccgggaagugucggccccacugcccugccauccccaguccccuugcauccugggagcc

SEQ ID NO: 54946 - RNA, 62 nt, Homo Sapiens
cucucaaccgucucccucggacuugacaucuccauccccagggagccacgcccaguguguga

SEQ ID NO: 54947 - RNA, 62 nt, Homo Sapiens
gggaccaggugggcuguguccgccacaucacccauccccauccccugacucuuucaccggca

SEQ ID NO: 54948 - RNA, 62 nt, Homo Sapiens
agcugggccccucuuccagcagcggccguauccauccccaggggcugugcuccgggccaaug

SEQ ID NO: 54949 - RNA, 64 nt, Homo Sapiens; identical to SEQ ID NO: 47016

SEQ ID NO: 54950 - RNA, 64 nt, Homo Sapiens; identical to SEQ ID NO: 47017

SEQ ID NO: 54951 - RNA, 64 nt, Homo Sapiens; identical to SEQ ID NO: 47018

SEQ ID NO: 54952 - RNA, 64 nt, Homo Sapiens; identical to SEQ ID NO: 47019

SEQ ID NO: 54953 - RNA, 64 nt, Homo Sapiens; identical to SEQ ID NO: 47020

SEQ ID NO: 54954 - RNA, 64 nt, Homo Sapiens; identical to SEQ ID NO: 47021

SEQ ID NO: 54955 - RNA, 64 nt, Homo Sapiens; identical to SEQ ID NO: 47022

SEQ ID NO: 54956 - RNA, 64 nt, Homo Sapiens; identical to SEQ ID NO: 47023

SEQ ID NO: 54957 - RNA, 64 nt, Homo Sapiens; identical to SEQ ID NO: 47024

SEQ ID NO: 54958 - RNA, 64 nt, Homo Sapiens; identical to SEQ ID NO: 47025

SEQ ID NO: 54959 - RNA, 64 nt, Homo Sapiens; identical to SEQ ID NO: 47026

SEQ ID NO: 54960 - RNA, 64 nt, Homo Sapiens; identical to SEQ ID NO: 47027

SEQ ID NO: 54961 - RNA, 64 nt, Homo Sapiens; identical to SEQ ID NO: 47028

SEQ ID NO: 54962 - RNA, 64 nt, Homo Sapiens; identical to SEQ ID NO: 47029

SEQ ID NO: 54963 - RNA, 64 nt, Homo Sapiens; identical to SEQ ID NO: 47030

SEQ ID NO: 54964 - RNA, 64 nt, Homo Sapiens; identical to SEQ ID NO: 47031

SEQ ID NO: 54965 - RNA, 64 nt, Homo Sapiens; identical to SEQ ID NO: 47032

SEQ ID NO: 54966 - RNA, 64 nt, Homo Sapiens; identical to SEQ ID NO: 47033

SEQ ID NO: 54967 - RNA, 64 nt, Homo Sapiens; identical to SEQ ID NO: 47034

SEQ ID NO: 54968 - RNA, 64 nt, Homo Sapiens; identical to SEQ ID NO: 47035

SEQ ID NO: 54969 - RNA, 64 nt, Homo Sapiens; identical to SEQ ID NO: 47036

SEQ ID NO: 54970 - RNA, 64 nt, Homo Sapiens; identical to SEQ ID NO: 47037

SEQ ID NO: 54971 - RNA, 64 nt, Homo Sapiens; identical to SEQ ID NO: 47038

SEQ ID NO: 54972 - RNA, 64 nt, Homo Sapiens; identical to SEQ ID NO: 47039

SEQ ID NO: 54973 - RNA, 64 nt, Homo Sapiens; identical to SEQ ID NO: 47040

SEQ ID NO: 54974 - RNA, 64 nt, Homo Sapiens; identical to SEQ ID NO: 47041

SEQ ID NO: 54975 - RNA, 64 nt, Homo Sapiens; identical to SEQ ID NO: 47042

SEQ ID NO: 54976 - RNA, 64 nt, Homo Sapiens; identical to SEQ ID NO: 47043

SEQ ID NO: 54977 - RNA, 64 nt, Homo Sapiens; identical to SEQ ID NO: 47044

SEQ ID NO: 54978 - RNA, 64 nt, Homo Sapiens; identical to SEQ ID NO: 47045

SEQ ID NO: 54979 - RNA, 64 nt, Homo Sapiens; identical to SEQ ID NO: 47046

SEQ ID NO: 54980 - RNA, 64 nt, Homo Sapiens; identical to SEQ ID NO: 47047

SEQ ID NO: 54981 - RNA, 64 nt, Homo Sapiens; identical to SEQ ID NO: 47048

SEQ ID NO: 54982 - RNA, 64 nt, Homo Sapiens; identical to SEQ ID NO: 47049

SEQ ID NO: 54983 - RNA, 64 nt, Homo Sapiens; identical to SEQ ID NO: 47050

SEQ ID NO: 54984 - RNA, 64 nt, Homo Sapiens; identical to SEQ ID NO: 47051

SEQ ID NO: 54985 - RNA, 64 nt, Homo Sapiens; identical to SEQ ID NO: 47052

SEQ ID NO: 54986 - RNA, 64 nt, Homo Sapiens; identical to SEQ ID NO: 47053

SEQ ID NO: 54987 - RNA, 64 nt, Homo Sapiens; identical to SEQ ID NO: 47054

SEQ ID NO: 54988 - RNA, 51 nt, Homo Sapiens; identical to SEQ ID NO: 47055

SEQ ID NO: 54989 - RNA, 64 nt, Homo Sapiens; identical to SEQ ID NO: 47056

SEQ ID NO: 54990 - RNA, 64 nt, Homo Sapiens; identical to SEQ ID NO: 47057

SEQ ID NO: 54991 - RNA, 64 nt, Homo Sapiens; identical to SEQ ID NO: 47058

SEQ ID NO: 54992 - RNA, 64 nt, Homo Sapiens; identical to SEQ ID NO: 47059

SEQ ID NO: 54993 - RNA, 64 nt, Homo Sapiens; identical to SEQ ID NO: 47060

SEQ ID NO: 54994 - RNA, 64 nt, Homo Sapiens; identical to SEQ ID NO: 47061

SEQ ID NO: 54995 - RNA, 64 nt, Homo Sapiens; identical to SEQ ID NO: 47062

SEQ ID NO: 54996 - RNA, 64 nt, Homo Sapiens; identical to SEQ ID NO: 47063

SEQ ID NO: 54997 - RNA, 64 nt, Homo Sapiens; identical to SEQ ID NO: 47064

SEQ ID NO: 54998 - RNA, 64 nt, Homo Sapiens; identical to SEQ ID NO: 47065

SEQ ID NO: 54999 - RNA, 64 nt, Homo Sapiens; identical to SEQ ID NO: 47066

SEQ ID NO: 55000 - RNA, 64 nt, Homo Sapiens; identical to SEQ ID NO: 47067

SEQ ID NO: 55001 - RNA, 64 nt, Homo Sapiens; identical to SEQ ID NO: 47068

SEQ ID NO: 55002 - RNA, 64 nt, Homo Sapiens; identical to SEQ ID NO: 47069

SEQ ID NO: 55003 - RNA, 64 nt, Homo Sapiens; identical to SEQ ID NO: 47070

SEQ ID NO: 55004 - RNA, 64 nt, Homo Sapiens; identical to SEQ ID NO: 47071

SEQ ID NO: 55005 - RNA, 64 nt, Homo Sapiens; identical to SEQ ID NO: 47072

SEQ ID NO: 55006 - RNA, 64 nt, Homo Sapiens; identical to SEQ ID NO: 47073

SEQ ID NO: 55007 - RNA, 64 nt, Homo Sapiens; identical to SEQ ID NO: 47074

SEQ ID NO: 55008 - RNA, 64 nt, Homo Sapiens; identical to SEQ ID NO: 47075

SEQ ID NO: 55009 - RNA, 64 nt, Homo Sapiens; identical to SEQ ID NO: 47076

SEQ ID NO: 55010 - RNA, 64 nt, Homo Sapiens; identical to SEQ ID NO: 47077

SEQ ID NO: 55011 - RNA, 64 nt, Homo Sapiens; identical to SEQ ID NO: 47078

SEQ ID NO: 55012 - RNA, 64 nt, Homo Sapiens; identical to SEQ ID NO: 47079

SEQ ID NO: 55013 - RNA, 64 nt, Homo Sapiens; identical to SEQ ID NO: 47080

SEQ ID NO: 55014 - RNA, 64 nt, Homo Sapiens; identical to SEQ ID NO: 47081

SEQ ID NO: 55015 - RNA, 64 nt, Homo Sapiens; identical to SEQ ID NO: 47082

SEQ ID NO: 55016 - RNA, 64 nt, Homo Sapiens; identical to SEQ ID NO: 47083

SEQ ID NO: 55017 - RNA, 64 nt, Homo Sapiens
uuucuaaugaagugcuagacuauccaauuacuuaauuucuuauaccuuuagauaaucaguauga

SEQ ID NO: 55018 - RNA, 64 nt, Homo Sapiens
uuucaccauuuugauuuuuaaaguaugcuguagcauuucuuaauaacaucguugugauguucuu

SEQ ID NO: 55019 - RNA, 64 nt, Homo Sapiens
auaaauauuuuacuuuuucacauguauagauugcauuucuuagguguuuuaauuuuuuaaauau

SEQ ID NO: 55020 - RNA, 64 nt, Homo Sapiens
ggauguaacuuuuuauaaccauuuaucccuaaauauuucuuaaggucucaaggauuugauccau

SEQ ID NO: 55021 - RNA, 64 nt, Homo Sapiens
agcuuuuaagaaauuaaauaacauugaucuuuucauuucuuacuaagaaaucauacuucucucc

SEQ ID NO: 55022 - RNA, 64 nt, Homo Sapiens
uguaguaguaacaagaauuuuucauuuaggaaagauuucuuagguuuugaaagaauacauuaaa

SEQ ID NO: 55023 - RNA, 64 nt, Homo Sapiens
gcauaagccacugcgcccagccagaagaugcaugauuucuuaggaucauaugcuguuuguagcc

SEQ ID NO: 55024 - RNA, 64 nt, Homo Sapiens
uauagagaguuuuuaaaugucucccauucuuuugauuucuuacuguacuggcuaucuuaauauu

SEQ ID NO: 55025 - RNA, 64 nt, Homo Sapiens
uuauacauuguuuuaagaaaaaacuuuuaaaaauauuucuuauagucuccuaacauuugucucu

SEQ ID NO: 55026 - RNA, 64 nt, Homo Sapiens
acagugaauuuugcacaggagaagcagcuaccugauuucuuacuuucucucuccuuaucaugga

SEQ ID NO: 55027 - RNA, 64 nt, Homo Sapiens
augaaucuuaaaaucauuucacuucacuccuaacauuucuuacauugcagaacuaaugguaaag

SEQ ID NO: 55028 - RNA, 64 nt, Homo Sapiens
guguuuuacuauagaucaguuaaaauuggacugcauuucuuagauagggaugccuggaagugua

SEQ ID NO: 55029 - RNA, 64 nt, Homo Sapiens
acacuagaaaggggaaauaauuaaagugcaugucauuucuuaaucaagcauugcuuuuggcaaa

SEQ ID NO: 55030 - RNA, 64 nt, Homo Sapiens
uucuuuaauuacuguaccauccauaaugcaggacauuucuuacugccuaaauuucacaccauug

SEQ ID NO: 55031 - RNA, 64 nt, Homo Sapiens
uuuuuuuuugauuguugaagcauuuaucuuguugauuucuuacaaaagaaaaaggacgauguca

SEQ ID NO: 55032 - RNA, 64 nt, Homo Sapiens
uauuauuuuuacuguuauguauguuuuuaaucauauuucuuaggaaguauaggcuacuggacuu

SEQ ID NO: 55033 - RNA, 64 nt, Homo Sapiens
cauucauuugcuuuguacuauaaaaauaaaaaugauuucuuaaguuaaugacaucccagugggg

SEQ ID NO: 55034 - RNA, 64 nt, Homo Sapiens
uugccauuuuguaaacuaaggauuuuggacugagauuucuuaaaucuuucuucaaaucucccac

SEQ ID NO: 55035 - RNA, 64 nt, Homo Sapiens
auaucaugggcucugcagaacauaucaaaauaggauuucuuaaauuuuucaacccccagaccau

SEQ ID NO: 55036 - RNA, 64 nt, Homo Sapiens
ccauaaaguccuagacuucuuauuugaaguuaaaauuucuuauuugaaaaguugaaauuuauga

SEQ ID NO: 55037 - RNA, 64 nt, Homo Sapiens
gaguuacauuaaccuuguuguuuaccuuucacugauuucuuauaugguauaaauuaaaguucag

SEQ ID NO: 55038 - RNA, 64 nt, Homo Sapiens
uaaauacaauucuuaucuagccacacuaucauagauuucuuaggcuaaacugguuuaucuccac

SEQ ID NO: 55039 - RNA, 64 nt, Homo Sapiens
aggugaaaauuaagaaagauaggacauuguaaucauuucuuacagggguguauaacaagccuga

SEQ ID NO: 55040 - RNA, 64 nt, Homo Sapiens
guauuaucaagugucaagauaggaaaaccuuuccauuucuuaaaauuaagcagguauuagauuu

SEQ ID NO: 55041 - RNA, 64 nt, Homo Sapiens
gucugcucugagccuuaaaaaaaaauuguuugauauuucuuaaucauuugaaaaacuuuuuaua

SEQ ID NO: 55042 - RNA, 64 nt, Homo Sapiens
ggaagcaguggauggaccaggauuaauuccuuucauuucuuaguaaauuaaaaccugcagcugg

SEQ ID NO: 55043 - RNA, 64 nt, Homo Sapiens
auguucucaagucuguaucugccuccccugccuuauuucuuauguuuugccacaguuaacccau

SEQ ID NO: 55044 - RNA, 64 nt, Homo Sapiens
uaagaagcuuuuaacugaagccucacauguggcuauuucuuaugaacaaaugccaggcuagauu

SEQ ID NO: 55045 - RNA, 64 nt, Homo Sapiens
guuuugguuacuuaugauaggcaguaagagaaauauuucuuaaugaugagacugagccauaucu

SEQ ID NO: 55046 - RNA, 64 nt, Homo Sapiens
gaaagcuuuguagcagaauauuucuuauagagauauuucuuacagaaauguuaaugagauguau

SEQ ID NO: 55047 - RNA, 64 nt, Homo Sapiens
gauuggccauaaccuguauuacagagagaucauuauuucuuaaauauaugugggaaaagagcua

SEQ ID NO: 55048 - RNA, 64 nt, Homo Sapiens
agcucucuaauagaaguccaugaguugaguggguauuucuuauuugaaaguguuuuucuuuaau

SEQ ID NO: 55049 - RNA, 64 nt, Homo Sapiens
uguuacacaauauguguuuuuuaauauacuaaccauuucuuauggaaagguccuguggggagcc

SEQ ID NO: 55050 - RNA, 64 nt, Homo Sapiens
auuuuaaaggaaaaaaauacaacuaaugaugcacauuucuuagaacacaauaguccauugauau

SEQ ID NO: 55051 - RNA, 64 nt, Homo Sapiens
uuagagaaaguuguauuccacacacaaccuaauaauuucuuauaaaaauuuuaaacuacaaagc

SEQ ID NO: 55052 - RNA, 64 nt, Homo Sapiens
ucuugggcaggcaauuugagucacuuguacuuugauuucuuauuugggcagaagcucugcauuc

SEQ ID NO: 55053 - RNA, 64 nt, Homo Sapiens
gcagaaauaacauuauuaauuauauuacuguuaaauuucuuaguagaaauauggaaaugcuuua

SEQ ID NO: 55054 - RNA, 64 nt, Homo Sapiens
cuuuuugcucuuuagaaauuuauagcuuugucccauuucuuaucgaaucuucugacacauuuau

SEQ ID NO: 55055 - RNA, 64 nt, Homo Sapiens
cuggagugcaguggcacgauuagggucuugcucaauuucuuaggauuauuuuauuuuuucgaga

SEQ ID NO: 55056 - RNA, 64 nt, Homo Sapiens
aaaaaauuaauauauauccuauuacauaaauguuauuucuuagguguuccauuaagaagagcaa

SEQ ID NO: 55057 - RNA, 64 nt, Homo Sapiens
guuaugauaacaaguaaauaagagcaaagaauguauuucuuaauucaaaacuauacguuugaau

SEQ ID NO: 55058 - RNA, 64 nt, Homo Sapiens
uuucuguaauauugagaguuauuuuauagaaaugauuucuuaauuagcuguugugagauauuuc

SEQ ID NO: 55059 - RNA, 64 nt, Homo Sapiens
uuuuucacugaucaaaauguuguucugcuuuuucauuucuuaaggaauacauguuugggauuuu

SEQ ID NO: 55060 - RNA, 64 nt, Homo Sapiens
ccauauaaggauaaaauaauacaacucauaaauaauuucuuaacacauugguagauuucuaaag

SEQ ID NO: 55061 - RNA, 64 nt, Homo Sapiens
ucagaauuuuuuaaugccaucuuccugcauuuugauuucuuagauuaaucuaaggaauaauuau

SEQ ID NO: 55062 - RNA, 64 nt, Homo Sapiens
cagguuaaugauuuauuuuuugacuaaaugugcaauuucuuaucacuagauaacuuucaguauc

SEQ ID NO: 55063 - RNA, 64 nt, Homo Sapiens
auuauuuuaauacaggaaaagaaaagauuuaguaauuucuuaccaugcuaauauguaaaguuca

SEQ ID NO: 55064 - RNA, 64 nt, Homo Sapiens
gagcuguaucaugcuacuuagcuuuuauguaaauauuucuuaugucuccucuauuaagaguauu

SEQ ID NO: 55065 - RNA, 64 nt, Homo Sapiens
ggcuaaugagcucuaguguuaaacuaccugauuaauuucuuauaaagcagcauaaccuuggcuu

SEQ ID NO: 55066 - RNA, 64 nt, Homo Sapiens
ugugaaauuuuaacuacuuuaacuaguuuuauaaauuucuuaauauguuacaauaacuuaggga

SEQ ID NO: 55067 - RNA, 64 nt, Homo Sapiens
ggcaaaugugaaaauaguuucaauauaucuuaugauuucuuaauguaaaauguuuuguugaagu

SEQ ID NO: 55068 - RNA, 64 nt, Homo Sapiens
aaaaucaauuuaaugcccuaacuuacacacaugaauuucuuaaaacucauagauaauacaaucu

SEQ ID NO: 55069 - RNA, 64 nt, Homo Sapiens
gugaggaacuguccaauguauagggugcagaguaauuucuuauuugagacauucaaaauucgua

SEQ ID NO: 55070 - RNA, 64 nt, Homo Sapiens
aagaaaaauauccauuuuauauauuuaugaacauauuucuuaauauuuuaacauuugauaaagc

SEQ ID NO: 55071 - RNA, 64 nt, Homo Sapiens
uagggggaaauuauuugaauaauuauaucuuacaauuucuuauugugucccuuauaggcucaaa

SEQ ID NO: 55072 - RNA, 64 nt, Homo Sapiens
ggcauucaacauauguaaaaagaguucuuuauguauuucuuauuaaagcucuauauaaaugcuc

SEQ ID NO: 55073 - RNA, 64 nt, Homo Sapiens
auaaagccuucaguaaauguuauguuuaaaacuaauuucuuaaacaugucuuagagcccgucuu

SEQ ID NO: 55074 - RNA, 64 nt, Homo Sapiens
ccuugucuuaggauauucuguagauugauugcagauuucuuaaaucugaaaugaucuuuacacu

SEQ ID NO: 55075 - RNA, 64 nt, Homo Sapiens
uaaaaugcccccacccugauguaauugacauuacauuucuuaacauuuuaaaaucuagaauuuc

SEQ ID NO: 55076 - RNA, 64 nt, Homo Sapiens
cuauaauguccaaaacauuccuuucagccuuuuuauuucuuacuguacugucucuuacuguacu

SEQ ID NO: 55077 - RNA, 64 nt, Homo Sapiens
cauuaccucucccuggaggcaacuguuuugauccauuucuuacacacacugccagagauacucu

SEQ ID NO: 55078 - RNA, 64 nt, Homo Sapiens
uucacucaauuuauauuuucaucauugacuacauauuucuuauacacaacacacaauuuaugaa

SEQ ID NO: 55079 - RNA, 64 nt, Homo Sapiens
guauuugugcaauaaauuggaauaauguaacuugauuucuuaucuguguuuguguuggcaugca

SEQ ID NO: 55080 - RNA, 64 nt, Homo Sapiens
ucaaaugucugcuaaugcaguggcaugcuugacuauuucuuauuuugauuuuuagaccaccaca

SEQ ID NO: 55081 - RNA, 64 nt, Homo Sapiens
ugaaugcuuuaaagucauuuugcaauaugcauuuauuucuuauaacauaugcuuucacuguuug

SEQ ID NO: 55082 - RNA, 64 nt, Homo Sapiens
aauauaaucuauuuuuguaugaugaacacuaaauauuucuuauuaaagccuagauuuacaauuu

SEQ ID NO: 55083 - RNA, 64 nt, Homo Sapiens
uuguucagcgcucagaacaauagauugcgcuaaaauuucuuagauugugguaagucuuuuuucu

SEQ ID NO: 55084 - RNA, 64 nt, Homo Sapiens
agauuaguuguuucaaguaguuauuuuucccauuauuucuuaugcuuguguauuuuagaaacaa

SEQ ID NO: 55085 - RNA, 64 nt, Homo Sapiens
auacuauuauuagaauaguaacaacacuaaagaaauuucuuaauaagaugaagaaauaagucug

SEQ ID NO: 55086 - RNA, 64 nt, Homo Sapiens
acuucaaauacaugcauuuuucaauauaggguauauuucuuaacugaugagagaggcuuagaca

SEQ ID NO: 55087 - RNA, 64 nt, Homo Sapiens
ugcaaaguauuacagccaaauauuaucuuaauuaauuucuuacacuuaaaaguguccaucaaca

SEQ ID NO: 55088 - RNA, 64 nt, Homo Sapiens
ucccucaugcaagggugcguccagcugcuagcacauuucuuaccacuggugugagccaccacgg

SEQ ID NO: 55089 - RNA, 64 nt, Homo Sapiens
auuuucuguagacagaucauuaauacuuuugcggauuucuuagacugaaguuguuuaccggcuc

SEQ ID NO: 55090 - RNA, 64 nt, Homo Sapiens
cuaggaaucucauuugcauuaaauguuagaauauauuucuuauaauaaacagaauauuuauuac

SEQ ID NO: 55091 - RNA, 64 nt, Homo Sapiens
auacccugaucccagacuccccccaucagcccucauuucuuauaggggccccuuucuggggguu

SEQ ID NO: 55092 - RNA, 64 nt, Homo Sapiens
uggcuuacagauuuacaugugcacacacacacaaauuucuuaucacauuuucgacuucuucacu

SEQ ID NO: 55093 - RNA, 64 nt, Homo Sapiens
uucagguuuuuguacuccagcauagcuuggucuuauuucuuacuguaugaaagcuuaacagcaa

SEQ ID NO: 55094 - RNA, 64 nt, Homo Sapiens
ucaugcagaugauugauugugauuauuguaagaaauuucuuacauguauauuucuuauguagaa

SEQ ID NO: 55095 - RNA, 64 nt, Homo Sapiens
auugugauuauuguaagaaauuucuuacauguauauuucuuauguagaaaauacuguuucuacu

SEQ ID NO: 55096 - RNA, 64 nt, Homo Sapiens
auuuuuaauacauuggaggcuuuauuuugaacuaauuucuuagagaauaguuauauuuucuauu

SEQ ID NO: 55097 - RNA, 64 nt, Homo Sapiens
cuauauauguaaauagcuuuucaucaauucuuaaauuucuuaaccuaggcuucagggagcauau

SEQ ID NO: 55098 - RNA, 64 nt, Homo Sapiens
aaaaagaguugaaugagguaauuuaaaaagacacauuucuuacauuaacagaagucuuauaaaa

SEQ ID NO: 55099 - RNA, 64 nt, Homo Sapiens
cauucugaaucugggaugaguuacacuaaaaauuauuucuuaggcuaaauuggagugauacuuc

SEQ ID NO: 55100 - RNA, 64 nt, Homo Sapiens
caucuggccccuaaagagacauuguuuguugaauauuucuuaagaaaaaaaaagccaagauuuc

SEQ ID NO: 55101 - RNA, 64 nt, Homo Sapiens
cuauggaguucgugaacacauauucaugguuuauauuucuuauugaauggaaauuaagaguacg

SEQ ID NO: 55102 - RNA, 64 nt, Homo Sapiens
auugucuacagauuucguguacaaacuccaagacauuucuuagaguguuuguuuuguucuuauu

SEQ ID NO: 55103 - RNA, 64 nt, Homo Sapiens
agucuuacauguuuaggucaugucugcuuucuuaauuucuuauaucaucuuuuucugucuguuu

SEQ ID NO: 55104 - RNA, 64 nt, Homo Sapiens
uagaccuuaggaacaguguuucagugaucuggcaccaguuuauuuuguucugcugaaauucugu

SEQ ID NO: 55105 - RNA, 64 nt, Homo Sapiens
uacgucaaaagaauauguuuuguugcagcugauuccaguuuauaauagaucccuaguaaaaagc

SEQ ID NO: 55106 - RNA, 64 nt, Homo Sapiens
uucucuaauuuaauggauaaagauguaggcuuagccaguuuauuacauguuuuucugaaugacc

SEQ ID NO: 55107 - RNA, 64 nt, Homo Sapiens
acuguaugucuaguaagauguccucauauucaguccaguuuaauuuaaugaccacuagagcuug

SEQ ID NO: 55108 - RNA, 64 nt, Homo Sapiens
uuuuuucaacccauauuucuagaaauuacagcugccaguuuauaguaguuugagcagaggauga

SEQ ID NO: 55109 - RNA, 64 nt, Homo Sapiens
uagauuuuucggauggguggguauauuuuauuuuccaguuuauuuucauauuucuuuacugugu

SEQ ID NO: 55110 - RNA, 64 nt, Homo Sapiens
uacuggaagacccaugucgguuuccggaaccccaccaguuuacccauaagcaagacuaaaccug

SEQ ID NO: 55111 - RNA, 64 nt, Homo Sapiens
acuuguucuccuuucuuuugcuauagaaaaucuaccaguuuaaaugagcuucaccuucugggug

SEQ ID NO: 55112 - RNA, 64 nt, Homo Sapiens
uucuucuggacuuuccuuacgaaccguaccccuuccaguuuaguccaaaucuucuugauauugu

SEQ ID NO: 55113 - RNA, 64 nt, Homo Sapiens
auaaauauuccauagugguggacaacugcagucuccaguuuagaguucccuggugccacaggcu

SEQ ID NO: 55114 - RNA, 64 nt, Homo Sapiens
ccauacacuacugucucuucagaucugaaauacuccaguuuagagccaggaaauuucacagguc

SEQ ID NO: 55115 - RNA, 64 nt, Homo Sapiens
auauacuuagcacuuacuuaaucuuuucaguuuuccaguuuacgucucaggaaugaaguguagu

SEQ ID NO: 55116 - RNA, 64 nt, Homo Sapiens
aucuuaguggaagaugguacgucaugcucaguguccaguuuaauucuguagaaguuacgucugg

SEQ ID NO: 55117 - RNA, 64 nt, Homo Sapiens
gacaaauccuaacccaaccaugguccagcaguuaccaguuuaaacaaaaaaaccucagaugagu

SEQ ID NO: 55118 - RNA, 64 nt, Homo Sapiens
augaauuauuuuaaaaaaaaccaugaaauuauagccaguuuaaaucuuuuaaagaucaaauuau

SEQ ID NO: 55119 - RNA, 64 nt, Homo Sapiens
gaaaauucaaggaauggaagucaagagccaacucccaguuuagaauugaaccugaauuuaagcc

SEQ ID NO: 55120 - RNA, 64 nt, Homo Sapiens
cgauuuucuacaccugucauugagccaagaaaguccaguuuaugacacguauguacuagugaac

SEQ ID NO: 55121 - RNA, 64 nt, Homo Sapiens
guaaguucuuugaagacuuagugcuguuuuuaauccaguuuagaaaguaacuuaauuuuaauac

SEQ ID NO: 55122 - RNA, 64 nt, Homo Sapiens
cgcuggcuuuacauaaaugaagaugcuugugauuccaguuuaucucugaaacuauucaacaugg

SEQ ID NO: 55123 - RNA, 64 nt, Homo Sapiens
caaugauguaaacuuuguucuugcauuagacugaccaguuuaaaaauaugaacuaaaaccuaau

SEQ ID NO: 55124 - RNA, 64 nt, Homo Sapiens
gacauuccuugagcaaaauauacugcugugaauuugcaaacaagaaaucugagccaaaacuuga

SEQ ID NO: 55125 - RNA, 64 nt, Homo Sapiens
aaaauaucugaauaggugcaguuuuaguuuaacaugcaaacaaccauuguugcuaccuauccug

SEQ ID NO: 55126 - RNA, 64 nt, Homo Sapiens
gauuucuuuuauaacuuuguuagguuuuugaagcugcaaacacuacaaugcuuugagggggucu

SEQ ID NO: 55127 - RNA, 64 nt, Homo Sapiens
cucaaugaggaaaaaucccuacaggaucuuuuuuugcaaacaacugauauaugcagacaaauuu

SEQ ID NO: 55128 - RNA, 64 nt, Homo Sapiens
ggagacccuaccucuuaaaaccaguuuucauuuaugcaaacaaggacaauuaagggaacccuga

SEQ ID NO: 55129 - RNA, 64 nt, Homo Sapiens
cgauaggaggagaguccuucucggcagagcucacugcaaacaacuggaauugagguugcacacu

SEQ ID NO: 55130 - RNA, 64 nt, Homo Sapiens
aaaggaaugaaacaaugaaauacuaaucuaugucugcaaacauuauuacuaaucuagguccuau

SEQ ID NO: 55131 - RNA, 64 nt, Homo Sapiens
acuaaucuagguccuauuaccuaaggucuaugucugcaaacauugucagaugugcagaccauua

SEQ ID NO: 55132 - RNA, 64 nt, Homo Sapiens
aacugacccuaucaccucugaggauguugguuccugcaaacaagaucuugacauuuucuuuuuu

SEQ ID NO: 55133 - RNA, 64 nt, Homo Sapiens
caugauugauagcuggacagggcuugggauuuggugcaaacaaaaaaauuagucguauuuuaau

SEQ ID NO: 55134 - RNA, 64 nt, Homo Sapiens
cugaauguacaaaucuuagugcucacaagucaauugcaaacaaauacuauccacuauguaaaug

SEQ ID NO: 55135 - RNA, 64 nt, Homo Sapiens
uugauaauauaaacaguuauuguacuuuugguuaugcaaacacuggcauuuucaucuuuauuau

SEQ ID NO: 55136 - RNA, 64 nt, Homo Sapiens
uuuaguuuacaucccucauuuaaagacaguaacaugcaaacacucccaaucaugucucuuuaug

SEQ ID NO: 55137 - RNA, 64 nt, Homo Sapiens
uuaaaacaguuguauggugcguauaagaaaauauugcaaacacauuuggaacgaaaaaggguaa

SEQ ID NO: 55138 - RNA, 64 nt, Homo Sapiens
uucaacaauuuuaaauguguugagcaaguugcagugcaaacacugucauuauguagagaguuua

SEQ ID NO: 55139 - RNA, 64 nt, Homo Sapiens
gcgacuauuuugccauggagaaaucugacagcauugcaaacaauaguauuguuugauguaguua

SEQ ID NO: 55140 - RNA, 64 nt, Homo Sapiens
uucagaucuaaugguuuaauugauuauccgcaaaugcaaacaguucuggggucaugaccuuucg

SEQ ID NO: 55141 - RNA, 64 nt, Homo Sapiens
ugagucaccccuuugaucccccuuuuguuuccugugcaaacaaggaugccaacacuuccuuuug

SEQ ID NO: 55142 - RNA, 64 nt, Homo Sapiens
gccuucuagggucacugucauucccuggccauguugcaaacagcgcaauuccaagcucgagagc

SEQ ID NO: 55143 - RNA, 64 nt, Homo Sapiens
uucuguuagaggccaaguauuauugacacaggauugcaaacacacaaacaauuggaacagagca

SEQ ID NO: 55144 - RNA, 64 nt, Homo Sapiens
aaauaugcuuccuguaucaaagguacguauguggugcaaacaaggcagaaacuuccuuuuaauu

SEQ ID NO: 55145 - RNA, 64 nt, Homo Sapiens
aaguauacuuuugcauuaauuuuuugagcuuauaugcaaacauaauaaauauuauuaaauauca

SEQ ID NO: 55146 - RNA, 64 nt, Homo Sapiens
uuuuaauugacaacacuaggcaccgugcccggccugcaaacacacugggauuacgggugugagc

SEQ ID NO: 55147 - RNA, 64 nt, Homo Sapiens
uuuuuuuugagaugaagucuacaaauggugcuguugcaaacacuuuugagcaucuuugaauuug

SEQ ID NO: 55148 - RNA, 64 nt, Homo Sapiens
uccaaauucgaacauucuuaaucucaguugcacgugcaaacaaaugacaacuaauguuaauaag

SEQ ID NO: 55149 - RNA, 64 nt, Homo Sapiens
acuuaaagagauaagcauuaacuugacauuauacugcaaacaaaauuugugcugggacugcuau

SEQ ID NO: 55150 - RNA, 64 nt, Homo Sapiens
uuggugauacuucuaaacuagcuguacauuugauugcaaacaaaaaacauuuuucauaauuagu

SEQ ID NO: 55151 - RNA, 64 nt, Homo Sapiens
uacucugguuaauaaaugcucacagauaaaaaauugcaaacaaguaagagcuuuaaaauauuuu

SEQ ID NO: 55152 - RNA, 64 nt, Homo Sapiens
uuuguaccuuguuauuuccacucuuaaagucuuuugcaaacauuugaaguccagugaagucucu

SEQ ID NO: 55153 - RNA, 64 nt, Homo Sapiens
cggacuguucaagagaauugaugaaggcucucauugcaaacauguauuacguccuuuccuacag

SEQ ID NO: 55154 - RNA, 64 nt, Homo Sapiens
aauuauggguuuaugagucuguaauguuauaugcugcaaacauuuacuauguaaacgugaagua

SEQ ID NO: 55155 - RNA, 64 nt, Homo Sapiens
uuaacccuauguuggagcacuggaaaccguuauuugcaaacauugcuguuaccauuuagaaaua

SEQ ID NO: 55156 - RNA, 64 nt, Homo Sapiens
cuagucagcauaaugcuuugggcuuuauuaucuugucagucacuaccuccuaaagaaaaaaaaa

SEQ ID NO: 55157 - RNA, 64 nt, Homo Sapiens
guacuucucccucagggacguagaacaauggaaugucagucagucucuguaguuaaaacuuuuu

SEQ ID NO: 55158 - RNA, 64 nt, Homo Sapiens; identical to SEQ ID NO: 55157

SEQ ID NO: 55159 - RNA, 64 nt, Homo Sapiens
cuggucaguccaagagcagacaaaaauaucacaagucagucagucacuggguuuccauuucuga

SEQ ID NO: 55160 - RNA, 64 nt, Homo Sapiens
ucaguccaagagcagacaaaaauaucacaagucagucagucacuggguuuccauuucugaauuu

SEQ ID NO: 55161 - RNA, 64 nt, Homo Sapiens
acuaaaacugucauuguuucuuuuuuuuuaacuggucagucauucacaauaagcuaugagggua

SEQ ID NO: 55162 - RNA, 64 nt, Homo Sapiens
uaaacauccuguccuuuuuuaaaaucuuugcuuagucagucauauuuuugucuguaugauuaga

SEQ ID NO: 55163 - RNA, 63 nt, Homo Sapiens
cuggaugcaauuuuucaaauauuaaaauuauacagucagucaggcuucaguuuauuuuuugaa

SEQ ID NO: 55164 - RNA, 64 nt, Homo Sapiens
auguucuguauugaaauaggucugguugaucgaugucagucagucaguagaaccuacccacccu

SEQ ID NO: 55165 - RNA, 64 nt, Homo Sapiens
ucuguauugaaauaggucugguugaucgaugucagucagucaguagaaccuacccacccucacg

SEQ ID NO: 55166 - RNA, 64 nt, Homo Sapiens
uccuucuauccgaugaguaaauuacaacagugagaaaccauauuuaugauguaaggaauuauca

SEQ ID NO: 55167 - RNA, 64 nt, Homo Sapiens
cugcucugccuguggaguagacguaaaaagaaaaaaaccauagguaggagaaguuucuuuaaag

SEQ ID NO: 55168 - RNA, 64 nt, Homo Sapiens
agcauccuuucaagaauauuggggggacacaaccaaaccauauccaauucaaguugagauuugu

SEQ ID NO: 55169 - RNA, 64 nt, Homo Sapiens
auucuaccccuggccccuccguggggacauagccaaaccauaucaauuucaaguugagauuugg

SEQ ID NO: 55170 - RNA, 64 nt, Homo Sapiens
aauauuuggaacacucuuagaauucccauuuaauaaaccauaugagaaaacccucuauuacucu

SEQ ID NO: 55171 - RNA, 64 nt, Homo Sapiens
acaauucaagaugagauuuggaugggacacagccaaaccauaucaauagguauuauuuuauccc

SEQ ID NO: 55172 - RNA, 64 nt, Homo Sapiens
cugcugcagcuacugauaucuggccccuggaauaaaaccauaguuccuaaaauugagcaucccu

SEQ ID NO: 55173 - RNA, 64 nt, Homo Sapiens
aaaucauucugcuuuugaaucuuaaaagcuagaaaaaccauaauguaauauucuuuuuaaaccc

SEQ ID NO: 55174 - RNA, 64 nt, Homo Sapiens
ccauuuaaguugagauuucaguggggacacagccaaaccauaucauucuaccccuggcaccucc

SEQ ID NO: 55175 - RNA, 64 nt, Homo Sapiens
aaauucaaguugcaauuucaguggggacauagccaaaccauaucacuggugaugccacuucuuc

SEQ ID NO: 55176 - RNA, 64 nt, Homo Sapiens
uuauuuaaucagucccucacuccauugaauggauaaaccauaauauuuuacagcuguauacuau

SEQ ID NO: 55177 - RNA, 64 nt, Homo Sapiens
gagauccuuuuuaaaacuguagaaaugcaacuuaaaaccauacuauucuuucacucauaauaaa

SEQ ID NO: 55178 - RNA, 64 nt, Homo Sapiens
cagggaaccuacauuuauuuauguggcagccaaagagaacaaucggccuccacucaggcuccaa

SEQ ID NO: 55179 - RNA, 64 nt, Homo Sapiens
uagaaaguuaacuaacaauagcugaagcuaaauagagaacaauuccauuguagaccugacucag

SEQ ID NO: 55180 - RNA, 64 nt, Homo Sapiens
ggcccucccgucgagaagcugguagucagugagugagaacaagagaacaagaacacccugaaca

SEQ ID NO: 55181 - RNA, 64 nt, Homo Sapiens
cgucgagaagcugguagucagugagugagaacaagagaacaagaacacccugaacaguccuggu

SEQ ID NO: 55182 - RNA, 64 nt, Homo Sapiens
cccgcaaaccggggacggaaugggaauuccaccugagaacaagucuggccucgcgcugggcggc

SEQ ID NO: 55183 - RNA, 64 nt, Homo Sapiens
gcuugacucugauucacagucguuuauuuaaaaggagaacaaaaauuucauauuuauaaauaug

SEQ ID NO: 55184 - RNA, 64 nt, Homo Sapiens
cauuuuucaacuaaucuuauguggaauugaauuagagaacaaggcauuauucuuuuagggaagg

SEQ ID NO: 55185 - RNA, 64 nt, Homo Sapiens
uuucuggagcuuggcagauuuuccucugacaccagagaacaauaguagucucaagaauggaaac

SEQ ID NO: 55186 - RNA, 64 nt, Homo Sapiens
uuugauuauauguugauugauaacauauuaaauagagaacaaauaagagagguccuuuacauga

SEQ ID NO: 55187 - RNA, 64 nt, Homo Sapiens
cagaaacugcagugguaauuaaauuaauagaaaagagaacaaacugcagguuuagaaaaauggu

SEQ ID NO: 55188 - RNA, 64 nt, Homo Sapiens
ccaaugugaugcacaccuaccaaaccagaugggugagaacaagcucccaccaaggaggaauggc

SEQ ID NO: 55189 - RNA, 64 nt, Homo Sapiens
acccagauuggugagauagggaaggaaaguuacugagaacaaaaaugaagauguuguaugacaa

SEQ ID NO: 55190 - RNA, 64 nt, Homo Sapiens
uugcuagaagaaauagcaaauucaaccuuauuuuuacuugaaaucauccaaaacaaauuccucc

SEQ ID NO: 55191 - RNA, 64 nt, Homo Sapiens
aguaguuuucauguuuucaauuuuuugaagaaauuacuugaauacacagucagaacaugcaaac

SEQ ID NO: 55192 - RNA, 64 nt, Homo Sapiens
aggauuaagggacuuaaucugcuaggaacaccuguacuugaaguggaggaggcuagggggccac

SEQ ID NO: 55193 - RNA, 64 nt, Homo Sapiens
ugucaacugucauuuugcuacuuuucaaauaaaauacuugaaaacugucauuuaaugguaaaca

SEQ ID NO: 55194 - RNA, 53 nt, Homo Sapiens
guagggcugcguuuaucuaauaguacuugaauguuguauguuuucacugucac

SEQ ID NO: 55195 - RNA, 64 nt, Homo Sapiens
guuaauuuuauaccaaaauguuaaauauuuguauuacuugaauuuugcucuuguauggcaaaau

SEQ ID NO: 55196 - RNA, 64 nt, Homo Sapiens
aguuaauaauguauaucaguacuguacauaacauuacuugaaaagugcauauacuggcaauaaa

SEQ ID NO: 55197 - RNA, 64 nt, Homo Sapiens
uauugauccugaugagagagccaugaaauugucuuacuugaaaauggaaccugguuuccuuuua

SEQ ID NO: 55198 - RNA, 64 nt, Homo Sapiens
uguuuguagagauacuauuuccaaaacaaauaauuacuugaauaauuucauguuacauaauaac

SEQ ID NO: 55199 - RNA, 64 nt, Homo Sapiens
auuuuggaauuuuaugucauuuuauuagcucuacuacuugaaugcacuaaaaauacaauucaaa

SEQ ID NO: 55200 - RNA, 64 nt, Homo Sapiens
accaauccaagugugugcccuuggaaaaaauauauacuugaagacucuucacugaagcuaaugu

SEQ ID NO: 55201 - RNA, 64 nt, Homo Sapiens
gauguagaauguagcaaauuuagaaauauuaauuuacuugaagaaaucacuuuaccuagcguuu

SEQ ID NO: 55202 - RNA, 64 nt, Homo Sapiens
uguauggucauauuaguagcuauuuguugcaagauacuugaagccaaauguuugcaguauaggu

SEQ ID NO: 55203 - RNA, 64 nt, Homo Sapiens
uuguuugauauuuaacaauaaguauauggugauauacuugaaauuuauguccagaaugucacug

SEQ ID NO: 55204 - RNA, 64 nt, Homo Sapiens
uuuaaauuaugucaaaacuuaauuuguuuacaacuacuugaauuugaauuguuuaacaaauuag

SEQ ID NO: 55205 - RNA, 64 nt, Homo Sapiens
uauuuaaggaagagaugaaguuguguucuuacaguacuugaaaauaaucaguuuuuucauggau

SEQ ID NO: 55206 - RNA, 64 nt, Homo Sapiens
ggcuggaaaguagcccauaaauaguuguguccuauacuugaagaucucccuacugguaggaacc

SEQ ID NO: 55207 - RNA, 64 nt, Homo Sapiens
gucacauauauacaguagcagcuguaaauaagcuuacuugaacuaauuacuugaaaacuggugg

SEQ ID NO: 55208 - RNA, 64 nt, Homo Sapiens
aguagcagcuguaaauaagcuuacuugaacuaauuacuugaaaacugguggaaaaaagagacca

SEQ ID NO: 55209 - RNA, 64 nt, Homo Sapiens
ccagcccucgauuagcccugccugaaucaguagauacuugaacgaguccccagucugcgggagg

SEQ ID NO: 55210 - RNA, 64 nt, Homo Sapiens
acaaaaauacacacacguguguuuuucuuugcaauacuugaaauauugccacugugcuuggacu

SEQ ID NO: 55211 - RNA, 64 nt, Homo Sapiens
aaauuucauuuagaaaccuaauuaauauuauacauacuugaaaagauaaaaauaucuuuaccuu

SEQ ID NO: 55212 - RNA, 64 nt, Homo Sapiens
gcccaaaagcauuaaaaaucgguaaagcugcacuuacuugaacauauaacuuaauguuagagau

SEQ ID NO: 55213 - RNA, 64 nt, Homo Sapiens
ggcgccccaacccccugcccgccucuccgcacaauacuugaacauucaucuguacugaaguguu

SEQ ID NO: 55214 - RNA, 64 nt, Homo Sapiens
cacaauacuugaacauucaucuguacugaaguguuacuugaaccgggggaaucucggaccuggg

SEQ ID NO: 55215 - RNA, 64 nt, Homo Sapiens
ucugauaaaauaaaggcagggaaacaagcugaauuacuugaaauuacuugaauuuucuugucuu

SEQ ID NO: 55216 - RNA, 64 nt, Homo Sapiens
uaaaggcagggaaacaagcugaauuacuugaaauuacuugaauuuucuugucuuaaaacugaaa

SEQ ID NO: 55217 - RNA, 64 nt, Homo Sapiens
ucugggcaccacaaaauauacaaaacuuuaucagggaaacuaagauucuuuuaaauuagaaaau

SEQ ID NO: 55218 - RNA, 64 nt, Homo Sapiens
uguugacuuuauaaauuucgcuucuuagaacaguggaaacuauguguuuuucucauauuugagg

SEQ ID NO: 55219 - RNA, 64 nt, Homo Sapiens
auggaggggacauuuauggugcuuuggauuguguggaaacuaugcauuuucuguucaaaugcua

SEQ ID NO: 55220 - RNA, 64 nt, Homo Sapiens
caguugcuuaccuccaguacugagccuugcuuugggaaacuaaaagauuuagaccaagucacug

SEQ ID NO: 55221 - RNA, 64 nt, Homo Sapiens
uuuguuuuauucuuccuaagacugaggauugugcugaguccagagucauugugguaacugacau

SEQ ID NO: 55222 - RNA, 64 nt, Homo Sapiens
gcucacacaagcaccagguacccugagcuuauacugaguccagugguuccuauuuuaugugugu

SEQ ID NO: 55223 - RNA, 64 nt, Homo Sapiens
cggagugcccuguguuccugaccccagccaccacugaguccacuaugccugggccugcaggccc

SEQ ID NO: 55224 - RNA, 64 nt, Homo Sapiens
uccccguuuagaacucauuagagucagacaagccugaguccaguuggaaagaaugugggauuug

SEQ ID NO: 55225 - RNA, 64 nt, Homo Sapiens
uuguuuacucuguuccucuccucacuguuucagcugaguccaagccccauuuucugugccuuau

SEQ ID NO: 55226 - RNA, 64 nt, Homo Sapiens
ucauuaaaaaagaagaaucucaccauguuuucuuugaguccaaccuugggugaggcuguccagg

SEQ ID NO: 55227 - RNA, 64 nt, Homo Sapiens
uccuggucuccaccucugucccauaggaagguccugaguccaccgguggggaggggacccagga

SEQ ID NO: 55228 - RNA, 64 nt, Homo Sapiens
ccuggggaagauuccuggggucuacuugcugggcugaguccagcccaacgcccaggcaccccag

SEQ ID NO: 55229 - RNA, 64 nt, Homo Sapiens
ugggaccaaaaccuggguguccucacugcugcccugaguccagccaugguuuucagggggacag

SEQ ID NO: 55230 - RNA, 64 nt, Homo Sapiens
ccagcacuuugggaguccaaggagggggaucgcuugaguccaggaguuugagaccagccuggac

SEQ ID NO: 55231 - RNA, 64 nt, Homo Sapiens
uuauuuuuauuaacuuuuuucaguuucuuuuuauucaaagaaacaaaauucaaucucugauaau

SEQ ID NO: 55232 - RNA, 64 nt, Homo Sapiens
auccaagugacucuauugauguauguauguucauucaaagaaugggaaaaggauaugacauaua

SEQ ID NO: 55233 - RNA, 64 nt, Homo Sapiens
ucaaccucugugguggucaagcaaccuugagaguucaaagaaaaccauucuccuucacugguug

SEQ ID NO: 55234 - RNA, 64 nt, Homo Sapiens
gauccucuuucaaaggcuacagcauucugucaauucaaagaaggcuuggcagugcuuuuucuuu

SEQ ID NO: 55235 - RNA, 64 nt, Homo Sapiens
cugccuaauauaaaaaucaugucaguacaacucaucaaagaaaacugccucuguauuuggaguu

SEQ ID NO: 55236 - RNA, 64 nt, Homo Sapiens
uggucauaaauaugauaaugaaauuccaaagguuucaaagaacugcacacauuaaagagagagu

SEQ ID NO: 55237 - RNA, 64 nt, Homo Sapiens
ccccagaugcugccaggcagccccuccccaagccucaaagaagcauuugcugaggauggagagg

SEQ ID NO: 55238 - RNA, 64 nt, Homo Sapiens
agugaccuguacaagugaugcagaaaggaggguuucaaagaaaaaggauuuuguuuaaaauacu

SEQ ID NO: 55239 - RNA, 64 nt, Homo Sapiens
gggggugugguacuaccuucaggcauuugguaacucaaagaaggcuguacagauauauuuuuuc

SEQ ID NO: 55240 - RNA, 64 nt, Homo Sapiens
aaagagagggcuacacugcuauggaaacuuagcuucaaagaaaaugcaauguaucugcaauuag

SEQ ID NO: 55241 - RNA, 64 nt, Homo Sapiens
acucucagaagagaaaugggaaauauaacuuuugucaaagaaauucaaauguguuugguuuugg

SEQ ID NO: 55242 - RNA, 64 nt, Homo Sapiens
ggcauucuucugggugguuccagaggaccgugucucaaagaaguguucuaugagacagguaugu

SEQ ID NO: 55243 - RNA, 64 nt, Homo Sapiens
ggaaacuuaagaugugcaaggagauuuaaugauuucaaagaaaauaaugguucuuuguuuuuaa

SEQ ID NO: 55244 - RNA, 64 nt, Homo Sapiens
cauuuggaaaaaugaaauuuaguaguuccaaguuucaaagaaaugucaacauuuuauuccauuc

SEQ ID NO: 55245 - RNA, 64 nt, Homo Sapiens
aguguucauucauccuauauuuuuauucucagauucaaagaaagagcaacuacuuuggaccaaa

SEQ ID NO: 55246 - RNA, 64 nt, Homo Sapiens
cuucccuaccuuucccauguacucaguuuagcucucaaagaaggggugaaucauaaagccagug

SEQ ID NO: 55247 - RNA, 64 nt, Homo Sapiens
gcugauggauaaccuauaugauuuuuuguaggggucaaagaaauuuuaucaugacauguuauau

SEQ ID NO: 55248 - RNA, 64 nt, Homo Sapiens
auggcaccuaaaccaccagucguaaucuccacagucaaagaagguagaaaccuuaauaugugga

SEQ ID NO: 55249 - RNA, 64 nt, Homo Sapiens
uacggaauuuagcauuuugagaaagucacuggucucaaagaaucuggaaauggauugaaagagu

SEQ ID NO: 55250 - RNA, 64 nt, Homo Sapiens
gcuguggaaagaagucacaaauguuugaacaaacucaaagaacaacacauuugacuuggaagca

SEQ ID NO: 55251 - RNA, 64 nt, Homo Sapiens
aagacuucagauugaauucacaucuuauucagcaucaaagaauucacacaggagagaaagcaca

SEQ ID NO: 55252 - RNA, 64 nt, Homo Sapiens
uccauugcugcaaugaaugugaaaaagccaucagucaaagaaacuaccuuguuuaguaucaaau

SEQ ID NO: 55253 - RNA, 64 nt, Homo Sapiens
ggagauucagucauaacccaacgcucauucaacaucaaagaauuuauaccuaagagaacuuauu

SEQ ID NO: 55254 - RNA, 64 nt, Homo Sapiens
cugucugggagauuccucagccagaucaaagaacucaaagaaaagcaguaucagcagcucuuuu

SEQ ID NO: 55255 - RNA, 64 nt, Homo Sapiens
caaagaaaacugucugggagagcucuuuuccagaucaaagaacugggaccgaugcaguaucagc

SEQ ID NO: 55256 - RNA, 64 nt, Homo Sapiens
ucgguccaugugguuuaucuuuacauuuuaaagaucaaagaagucuuuacaaccugaauccagg

SEQ ID NO: 55257 - RNA, 64 nt, Homo Sapiens
gcaaccuggaaaguucaucucuuguuuccuucagucaaagaaaguccauuguacauaacaaaac

SEQ ID NO: 55258 - RNA, 64 nt, Homo Sapiens
guguuuuuuacuugcuaaauuagaaguauuuuuuucaaagaaauauauguuaagagccugagcu

SEQ ID NO: 55259 - RNA, 64 nt, Homo Sapiens
uugugacacaugaaaauuauaaugguugaaagaaucaaagaauaagaaugguuuuauauuucua

SEQ ID NO: 55260 - RNA, 64 nt, Homo Sapiens
aaggaacaaagucuaugaguccuaaaauuuuaagucaaagaaaacugcucuguuuccccuuuag

SEQ ID NO: 55261 - RNA, 64 nt, Homo Sapiens
guuuguguuucacaaacauggcuuaucaauuuuuucaaagaauucuuuuuucccaaaaagagga

SEQ ID NO: 55262 - RNA, 64 nt, Homo Sapiens
acuuaacuauugcugcaacauauauguauacaagucaaagaacaagaauugugaaacagauagu

SEQ ID NO: 55263 - RNA, 64 nt, Homo Sapiens
agaaaaaagauaaaguagaaugccuccuacacagucaaagaaaggcagguuacucagcaguuug

SEQ ID NO: 55264 - RNA, 64 nt, Homo Sapiens
auugcugacuaacuuucagguaaccagacccaucucaaagaaccaagaaaaggcuuuagcauga

SEQ ID NO: 55265 - RNA, 64 nt, Homo Sapiens
ccgcccuagaggccacagaauuagcccaaaauuaucaaagaacauuaacuggaaggucagguuu

SEQ ID NO: 55266 - RNA, 64 nt, Homo Sapiens
aguguaggcaaagguuuagaaaauggacauaaagucaaagaaugauggcagguaggaugaagga

SEQ ID NO: 55267 - RNA, 64 nt, Homo Sapiens
cucccuguuuuagauauucagauuuaaaagguuuucaaagaauuacuuucuuccauguucaaag

SEQ ID NO: 55268 - RNA, 64 nt, Homo Sapiens
ucaaaauuuaaacugaugugguacucccaaucaaucaaagaaccauccaacucccucuucacug

SEQ ID NO: 55269 - RNA, 64 nt, Homo Sapiens
acccaccgaaugcaguuucugauggacaaccacuucaaagaaaggcuugaacacagaacaggga

SEQ ID NO: 55270 - RNA, 64 nt, Homo Sapiens
aaucaaagcucaucaguucccauaaaugcaguugucaaagaaaagauuugguugccauagucau

SEQ ID NO: 55271 - RNA, 64 nt, Homo Sapiens
uuaacugguaucaaacgcugucauugagauguuuucaaagaacauugaguuguauuuaaucagc

SEQ ID NO: 55272 - RNA, 64 nt, Homo Sapiens
agaaaaggaaaaggaagaagcagagaagaaaaaaucaaagaaaucugucuaauucuuaggauga

SEQ ID NO: 55273 - RNA, 64 nt, Homo Sapiens
caaauaaacuaaauauaauauugagcugcauuucucaaagaaugacaaaagcauccuuauacug

SEQ ID NO: 55274 - RNA, 64 nt, Homo Sapiens
auaugggauagaaacuacaaaugcaacaaaugcgucaaagaauuuagugugcacucaagccuua

SEQ ID NO: 55275 - RNA, 64 nt, Homo Sapiens
auaagugggagcuaaacauugauuacacauggacucaaagaagggaacaguagacacgggcuua

SEQ ID NO: 55276 - RNA, 64 nt, Homo Sapiens
ccuacuggugagaaacccuacaucuuacucaacaucaaagaauuaggccuuuaggcagagggcg

SEQ ID NO: 55277 - RNA, 64 nt, Homo Sapiens
cauaccagugugaaacccuaacucuuacucaacaucaaagaauuagguuuuuaauaauuaucca

SEQ ID NO: 55278 - RNA, 64 nt, Homo Sapiens
agguucuggugacauuauuuagccguuuugauuuucaaagaagcgucauuuugauuuucaaaga

SEQ ID NO: 55279 - RNA, 64 nt, Homo Sapiens
cguuuugauuuucaaagaagagucauuuugauuuucaaagaagcuuuuuucagaccauacaaga

SEQ ID NO: 55280 - RNA, 64 nt, Homo Sapiens
gaaguguuucuuauuauuauuuuauauugaguugaauauugaacucuaacaguuuucuacauac

SEQ ID NO: 55281 - RNA, 64 nt, Homo Sapiens
uuucauuacaagucuuucacagaaguuuggugguaauauugaaagaacuagcauugggcagaau

SEQ ID NO: 55282 - RNA, 64 nt, Homo Sapiens
guuuccuguccauaucuggcuagaaaaaugaauaaauauugaggucauccuagaaagccuugac

SEQ ID NO: 55283 - RNA, 64 nt, Homo Sapiens
gugaagcaacuaugugacuggguuauuuccuaagaauauugaaauauuuguagcucauuuauuu

SEQ ID NO: 55284 - RNA, 64 nt, Homo Sapiens
cuucccuuggaccaccuucaaauauguuauuuaaaauauugaucacuguaugauauuuuaagca

SEQ ID NO: 55285 - RNA, 64 nt, Homo Sapiens
uaauuuugaccucugguuuaucauuucgaaucaaaauauugauuaccuuuggauauguuuguaa

SEQ ID NO: 55286 - RNA, 64 nt, Homo Sapiens
cugaugagagagaagaugguuugucuuacuugaaaauauugaucgguuuccuuuuaccaugaaa

SEQ ID NO: 55287 - RNA, 64 nt, Homo Sapiens
cacuguacaccauaguuuacuuuuaaaugaauuaaauauugaaacacucguaaaaagguaucuu

SEQ ID NO: 55288 - RNA, 64 nt, Homo Sapiens
ccucacaucuuuaacuuaguaaugccagaaggauaauauugauuuauuauguagcugaaacaaa

SEQ ID NO: 55289 - RNA, 64 nt, Homo Sapiens
auauauuaaaaaagagcuugcuuacuacaagaaaaauauugaaauauugaaaauauugaaaaua

SEQ ID NO: 55290 - RNA, 64 nt, Homo Sapiens
aaaaagagcuugcuuacuacaagaaaaauauugaaauauugaaaauauugaaaauauuauuauu

SEQ ID NO: 55291 - RNA, 64 nt, Homo Sapiens
uugcuuacuacaagaaaaauauugaaauauugaaaauauugaaaauauuauuauugaaaauaaa

SEQ ID NO: 55292 - RNA, 64 nt, Homo Sapiens
aaaaacaagaaaaacaacaacuaugaguuaucaaaauauugacuccauuuaugacuagacuaca

SEQ ID NO: 55293 - RNA, 64 nt, Homo Sapiens
auuucugaaagaucuuugguuuaugauucuuaagaauauugacaauaccuauaaaacuuugaag

SEQ ID NO: 55294 - RNA, 64 nt, Homo Sapiens
caaagagauaaaguuuagcuucuuuuuacuauucaauauugaacauaauauuguuaaauauuga

SEQ ID NO: 55295 - RNA, 64 nt, Homo Sapiens
uuuuuacuauucaauauugaacauaauauuguuaaauauugagaugaaaugcuguuggauuuga

SEQ ID NO: 55296 - RNA, 64 nt, Homo Sapiens
acuuugggauguuaaauucauuguuaauaaacucaauauugaaugacuauguacacauccacuu

SEQ ID NO: 55297 - RNA, 64 nt, Homo Sapiens
uuauaaagauaaaaauuuaugcugagaaagcagcaauauugauaugucuugacuguugcaccag

SEQ ID NO: 55298 - RNA, 64 nt, Homo Sapiens
uuuguuugaaauuucagaacuguuuuucuauguaaauauugaaaacuuaugauuugugcaauaa

SEQ ID NO: 55299 - RNA, 64 nt, Homo Sapiens
aucuguaggccuguacuaaucucuacgcauuagcaauauugacuguaaacccacauuaaggaaa

SEQ ID NO: 55300 - RNA, 64 nt, Homo Sapiens
uucagccauacugggaaaacuauaugaugaccucaauauugacuuuaaaagccuuaggauauuc

SEQ ID NO: 55301 - RNA, 64 nt, Homo Sapiens
gucauaaucagugauuuuuguuccaugcaucaguaauauugaagaaaaucugcaucaaaucagu

SEQ ID NO: 55302 - RNA, 64 nt, Homo Sapiens
auuugcuucauuucaaauacaauuucuguuuaaaaauauugaauuucuagaaacuuucugaaau

SEQ ID NO: 55303 - RNA, 64 nt, Homo Sapiens
cugagguucuucuacugcuauaaauaauuaaaacaauauugaugcagccuugccucacagcaug

SEQ ID NO: 55304 - RNA, 64 nt, Homo Sapiens
cuuuaccaaugagccuuaauuuuuauauagguccaauauugagcuuuuacuuaaaauuuagaua

SEQ ID NO: 55305 - RNA, 64 nt, Homo Sapiens
gaagggacuaaauaugacuuuaaagagacuucaaaauauugaguauuuuaaaaauuuaaaagua

SEQ ID NO: 55306 - RNA, 64 nt, Homo Sapiens
aauaugucagucacuaaaagguuucugagcaccgaauauugagccaggaaaggagaguacuuug

SEQ ID NO: 55307 - RNA, 64 nt, Homo Sapiens
agaauucauucauacuuaaauuugaagacuucaaaauauugagcuguuaccucaacaagaagaa

SEQ ID NO: 55308 - RNA, 64 nt, Homo Sapiens
aucaggcagauuugaaaacaacaaaacaaagcaaaauauugaugagaaccauuaauaaaacaaa

SEQ ID NO: 55309 - RNA, 64 nt, Homo Sapiens
aucucuuuaaaaaaugaaaucugugguuccuuagaauauugaggcccaaguagucugguaugau

SEQ ID NO: 55310 - RNA, 64 nt, Homo Sapiens
aauguuggaugacauuuaaugcuguaacuaagacaauauugauaugaauuuagauagguaucaa

SEQ ID NO: 55311 - RNA, 64 nt, Homo Sapiens
ccaaaguuacuuugacugcacucucgaaacugcuaauauugaucucuaacggggagcaaucuuu

SEQ ID NO: 55312 - RNA, 64 nt, Homo Sapiens
ucaugaaaucauuuugcuguuugacacugaauaaaauauugauucacaauucaguuaagaugcu

SEQ ID NO: 55313 - RNA, 64 nt, Homo Sapiens
uuuucuacaaauguuacuucguagcacaacugauaauauugauauaacuccuucaauauuucua

SEQ ID NO: 55314 - RNA, 64 nt, Homo Sapiens
uuccuuacuuuuaguuagaaaccccuaaaacgcuaauauugauuuuccugauagcuguauuaaa

SEQ ID NO: 55315 - RNA, 64 nt, Homo Sapiens
auaaccucaccaaugaauacaaauguuuaaauaaaauauugauuaaaaaaacauuaaaagugca

SEQ ID NO: 55316 - RNA, 64 nt, Homo Sapiens
ggucuuuuuauuuggcuuggguuauacugcuuuuaauauugauuuauuuuuaagaaaguaacca

SEQ ID NO: 55317 - RNA, 64 nt, Homo Sapiens
caauauggcagaugggucaucauguccugaaauaaauauugauuuuuguuuuauuuugacaugg

SEQ ID NO: 55318 - RNA, 64 nt, Homo Sapiens
aauugacaaauuguguacaauguacagaaaauugaauauugaaaagaauugucccaaaaguacc

SEQ ID NO: 55319 - RNA, 64 nt, Homo Sapiens
aaccauugacaaaaacacuauuaauuuacagcaaaauauugaaugaugugagaaacaauucuuu

SEQ ID NO: 55320 - RNA, 64 nt, Homo Sapiens
ggcucagaagccgcgucccuaaacagguguggagaauauugaauauguagagaugccugauucc

SEQ ID NO: 55321 - RNA, 64 nt, Homo Sapiens
auuuuaauauuaaaaauauuccuugaaauaagaaaauauugaacugugagacuucucucacugg

SEQ ID NO: 55322 - RNA, 64 nt, Homo Sapiens
aaacuuguauacacaagcguccaugucucacacaaauauugaugugauuauucuuaaguguuaa

SEQ ID NO: 55323 - RNA, 64 nt, Homo Sapiens
guuaaaucauuaacacuuaaaugacuucauugggaauauugagcagagggacugugcuucuaug

SEQ ID NO: 55324 - RNA, 64 nt, Homo Sapiens
aucauguugugggaaucuuuuuuuuaaauagugaaauauugaggcagcaauuuuuuacaaaaag

SEQ ID NO: 55325 - RNA, 64 nt, Homo Sapiens
guuccaaauuuguagccaguuccaaacaaauuuaaauauugaguugagaccuguauggaauugu

SEQ ID NO: 55326 - RNA, 64 nt, Homo Sapiens
uaauuaaaaaaauuuaauaauuuggugauguuugaauauugacugucaguuaaggacauagcua

SEQ ID NO: 55327 - RNA, 64 nt, Homo Sapiens
uuaaggacauagcuauuccaaauaaacuaaauauaauauugagcugcauuucucaaagaaugac

SEQ ID NO: 55328 - RNA, 64 nt, Homo Sapiens
auauuagauaauauuaagaaaauugggagaauggaauauugacaaagaagagauacuuaacaau

SEQ ID NO: 55329 - RNA, 64 nt, Homo Sapiens
cugaauuuaagccucaagagcacaucuugccaaaaauauugaacaugugcuacaguaagauaua

SEQ ID NO: 55330 - RNA, 64 nt, Homo Sapiens
guaaucugcuuuguuaaugaaaaugauaaaacagaauauugacaagcuaggacaccugugguau

SEQ ID NO: 55331 - RNA, 64 nt, Homo Sapiens
aguuugcuucuuaugguauaauaaaguauggaagaauauugaguauauguuuacucugggccug

SEQ ID NO: 55332 - RNA, 64 nt, Homo Sapiens
gcuucauuuauuuauugcuuuugcccaugcauucaauauugaucagcucagcacuuccaugggc

SEQ ID NO: 55333 - RNA, 64 nt, Homo Sapiens
gcucccccuagccgcacacuagugugggaaggaaaauauugagcuaggcacauuacucucugaa

SEQ ID NO: 55334 - RNA, 64 nt, Homo Sapiens
uuuuauuuuugaaguuuuugggcuuacaaaaagaaauauugaauugauagcaaaaucaagagau

SEQ ID NO: 55335 - RNA, 64 nt, Homo Sapiens
ggcaaacauuugaaggagggugccugccuaacaaaauauugaaauuggcaugacucuugacucu

SEQ ID NO: 55336 - RNA, 64 nt, Homo Sapiens
guuuucuuuccacacaggauuccguuggugaaccuguaaaaacaaaacaaacaaaacaaaacaa

SEQ ID NO: 55337 - RNA, 64 nt, Homo Sapiens
cacagagcaggacgcucuaggccaaaucuauuuuuguaaaaaugcucaugccuaugggugacug

SEQ ID NO: 55338 - RNA, 64 nt, Homo Sapiens
gauuuauugagauugaauuaugccaccacguuuauguaaaaaugaagguggcaccguggugaga

SEQ ID NO: 55339 - RNA, 64 nt, Homo Sapiens
cguggugagaccuaaugagaaauaguuacucaguuguaaaaauuuugauuuauucucuuucuuc

SEQ ID NO: 55340 - RNA, 64 nt, Homo Sapiens
ccuuugucaucuguuagacucuguaugugugauuuguaaaaagcaggcugaaacuauggacaug

SEQ ID NO: 55341 - RNA, 64 nt, Homo Sapiens
uuugaaccccuaggcuucaggaaaacugcucuuuuguaaaaagaauagcgaugacauuuucuaa

SEQ ID NO: 55342 - RNA, 64 nt, Homo Sapiens
ccauuugcacuguucagacauauauauguauguauguaaaaauuauauauacacaaauuagcug

SEQ ID NO: 55343 - RNA, 64 nt, Homo Sapiens
ugcuaaagagacuuggcaccagcuuuguucaaacuguaaaaauagcaauuugccccuacucgcu

SEQ ID NO: 55344 - RNA, 64 nt, Homo Sapiens
ugccuuuuaaguuacugacaucagcuuccaccaguguaaaaauugaguaaaaccugaaguuuug

SEQ ID NO: 55345 - RNA, 64 nt, Homo Sapiens
uauagauauauuccaagccgccugacgaucuaauuguaaaaaguaaagcauacaaauacuagaa

SEQ ID NO: 55346 - RNA, 64 nt, Homo Sapiens
gacaacuuuagauucugaggaaucaagacuugauuguaaaaauuaggcaagacagaaauaagag

SEQ ID NO: 55347 - RNA, 64 nt, Homo Sapiens
gauguuucauccucugauugaccuuuucaugacguguaaaaaaugcagcguccuauaauccuag

SEQ ID NO: 55348 - RNA, 64 nt, Homo Sapiens
ggagauuucagaagacgggcucgguaggcacagguguaaaaaggaguuguaaaaaggggagauu

SEQ ID NO: 55349 - RNA, 64 nt, Homo Sapiens
ggagauuucgguaggcacagguaguaggcacaguuguaaaaaggggacuuggaauaucagcaga

SEQ ID NO: 55350 - RNA, 64 nt, Homo Sapiens
aaaaaaaaaaaaaggcaaagucuuguaaaacuuauguaaaaaaagucacuguaaaaauguauua

SEQ ID NO: 55351 - RNA, 64 nt, Homo Sapiens
uauuaucuuguaaaacuuauccacaucaggucacuguaaaaauggccaaguugcaaaguuguau

SEQ ID NO: 55352 - RNA, 64 nt, Homo Sapiens
uugaaaaaaugaagaaaaauguauuuucccuuuauguaaaaauuagugaauaucuuaugaauua

SEQ ID NO: 55353 - RNA, 64 nt, Homo Sapiens
cgggaacuugagagcuuuuacugugauucuucaauguaaaaaauaaacaacaaugucaaacugu

SEQ ID NO: 55354 - RNA, 64 nt, Homo Sapiens
auauauacaaguguaugaugccuuuuuaccucuguguaaaaaauauugauuuuuuuauaauaag

SEQ ID NO: 55355 - RNA, 64 nt, Homo Sapiens
cuuccaaugccuaagugucuaaaacaaggccauauguaaaaaccccucauuuauacuuggggaa

SEQ ID NO: 55356 - RNA, 64 nt, Homo Sapiens
aaauaaguuauaacuguuaucuguauuuaaauauuguaaaaagaaaauagcuggcgagugcuuu

SEQ ID NO: 55357 - RNA, 64 nt, Homo Sapiens
aacagcaaacaaaaaggugaacaaaggaaucuaguguaaaaaacuuucauuaucuuuaaugaag

SEQ ID NO: 55358 - RNA, 64 nt, Homo Sapiens
gcaguaaauauuuacuauuuaaaaaugucuuucauguaaaaaguaaccaacaacaauguguugu

SEQ ID NO: 55359 - RNA, 64 nt, Homo Sapiens
ucuuucauguaaaaagugcacaacaacaauguguuguaaaaaugcuuuguguugcagccucaac

SEQ ID NO: 55360 - RNA, 64 nt, Homo Sapiens
agaucuagaguuuagagacagucucaaguguggcuguaaaaaucaaguuuaaguuuacgucauu

SEQ ID NO: 55361 - RNA, 64 nt, Homo Sapiens
uuauuugaaaucuccuaaguguaaacaugagcgauguaaaaacucagcucagauugucgaguua

SEQ ID NO: 55362 - RNA, 64 nt, Homo Sapiens
guuaaaagaccauaagcaaacugguuauuuaaaauguaaaaaggaauaugaaagucuuauuaaa

SEQ ID NO: 55363 - RNA, 64 nt, Homo Sapiens
auaaaggcauugauauuuuagaugcacccguguuuguaaaaauguagagcacaauggaauuaug

SEQ ID NO: 55364 - RNA, 64 nt, Homo Sapiens
uuaguguauuagagaaguuuuuccagagaugucauguaaaaaagucauuucuuccauuaacugc

SEQ ID NO: 55365 - RNA, 64 nt, Homo Sapiens
guugaguucuguuuaaagaaauuuuuuuuaaaauuguaaaaauugggcuauuuuugagggaugu

SEQ ID NO: 55366 - RNA, 64 nt, Homo Sapiens
ugcaugggauauuugauuaccccaccugaucaaauguaaaaacacaugaguccuugugauuagg

SEQ ID NO: 55367 - RNA, 64 nt, Homo Sapiens
gggcugcauucuuguugguaccuucugccuaacuuguaaaaaggaucagcaagacuuuauaauu

SEQ ID NO: 55368 - RNA, 64 nt, Homo Sapiens
aaaggggaaauacuuuaauuuuuuuucuuaauaguguaaaaauucccugagcuaagcuaaaacc

SEQ ID NO: 55369 - RNA, 64 nt, Homo Sapiens
guucuucaaacacucuuaaauuuuucuuaaguaauguaaaaauggaacugccaauuuuauuucu

SEQ ID NO: 55370 - RNA, 64 nt, Homo Sapiens
uuucuuauucauuaaaugaauucaacauuuucucuguaaaaacaauagaguuucaguacaugaa

SEQ ID NO: 55371 - RNA, 64 nt, Homo Sapiens
auaauguacauaaauguuacauuuguaaagaaaauguaaaaauguaacuauagcauaugaauug

SEQ ID NO: 55372 - RNA, 64 nt, Homo Sapiens
uacuacauuugaaauuauuucuuacaaaauuuccuguaaaaaaauaccaguaccuauuuuuacu

SEQ ID NO: 55373 - RNA, 64 nt, Homo Sapiens
uuuguuuauauagaccuaucggaauaagaucauuuguaaaaauggaaggauaccuggagcacaa

SEQ ID NO: 55374 - RNA, 64 nt, Homo Sapiens
aguauauauacauaucuuuuuuugugauguuacuuguaaaaaaaagcaugugaagaugugauca

SEQ ID NO: 55375 - RNA, 64 nt, Homo Sapiens
acuguagcuuauauucuuuacaucuguguuauuuuguaaaaauagaauuaacacaguauucauu

SEQ ID NO: 55376 - RNA, 64 nt, Homo Sapiens
uuucuucuucugagaaugugacuuuuucugguguuguaaaaaagaaaaaaaaaagaaugcucau

SEQ ID NO: 55377 - RNA, 64 nt, Homo Sapiens
guguuguaaaaaagaaaaaaaaaagaaugcucauuguaaaaauaaaaaaauaauaauaagcaag

SEQ ID NO: 55378 - RNA, 64 nt, Homo Sapiens
gugggaauuucuuuuccuacgggguacgugauuuuguaaaaaggaaguauuucucccaaaauug

SEQ ID NO: 55379 - RNA, 64 nt, Homo Sapiens
uaugcuaguuuaaaaaagaaaauauguaauauaauguaaaaaaaaacaaaaaaaagcuuuuaug

SEQ ID NO: 55380 - RNA, 64 nt, Homo Sapiens
augaaaacguuugauuauuuucucaguguauuuuuguaaaaaauauauaaaggggguguuaauc

SEQ ID NO: 55381 - RNA, 64 nt, Homo Sapiens
ccugccaccaguguccacccuccggcccccgucuuguaaaaaggggaggagaauuagccaaaca

SEQ ID NO: 55382 - RNA, 64 nt, Homo Sapiens
guacgucucacuugaaauugcuuuguauacauuuuguaaaaauauuuauaaaauguuuuguaaa

SEQ ID NO: 55383 - RNA, 64 nt, Homo Sapiens
guauacauuuuguaaaaauauuuauaaaauguuuuguaaaaaaaaaaaaacuauaacaaauugc

SEQ ID NO: 55384 - RNA, 64 nt, Homo Sapiens
uucugauaaaacucagaauuucuuuuuaagcaguuguaaaaauugucauguuguaauucauuac

SEQ ID NO: 55385 - RNA, 64 nt, Homo Sapiens
ugugaaccucaugcaugaaagcagcacauuaaauuguaaaaauacaaacagaucgugugaucau

SEQ ID NO: 55386 - RNA, 64 nt, Homo Sapiens
uaauuaaagaaaugcaugugaugugagaaaucuauguaaaaaaaaacccaugaagcaagaauag

SEQ ID NO: 55387 - RNA, 64 nt, Homo Sapiens
uccuuaugucugaugcugucucccaaauggccaguguaaaaaugcagagugaauagauccuaag

SEQ ID NO: 55388 - RNA, 64 nt, Homo Sapiens
auuguuuuuggauauaaagccaguauuauguauuuguaaaaaccgugacuuuuugagcaccuuu

SEQ ID NO: 55389 - RNA, 64 nt, Homo Sapiens
uuuaugguaacugguuucuuauuacauuuaucuuuguaaaaagauuuuaaaaguaguaagccac

SEQ ID NO: 55390 - RNA, 64 nt, Homo Sapiens
ucaccauggcuuucauccaacuggguacagcuuuuguaaaaaugagaggacguugaguggauuc

SEQ ID NO: 55391 - RNA, 64 nt, Homo Sapiens
guuuccuuagaagucauaaaucuuuauuauuuauuguaaaaaaauucugcaaaucccaaaucuu

SEQ ID NO: 55392 - RNA, 64 nt, Homo Sapiens
uaagaguauuuauacuggaaagaaacccuacaaauguaaaaaacguggcaaugccuuuaacugg

SEQ ID NO: 55393 - RNA, 64 nt, Homo Sapiens
gguaagaauccauacugaagaaaacuccuggaaguguaaaaaauguggcaacacuuuuaauaaa

SEQ ID NO: 55394 - RNA, 64 nt, Homo Sapiens
acagcccuauggaauuugcaaucugugauugccuuguaaaaaggagagugcauauggcacugca

SEQ ID NO: 55395 - RNA, 64 nt, Homo Sapiens
uauagaaaauauaugaaccaaagugauuugaguuuguaaaaauguaaaauaguaugaacaaaau

SEQ ID NO: 55396 - RNA, 64 nt, Homo Sapiens
acaaaaguuugcuuguuuaaaaugacaguugugauguaaaaaguuuaagaaauaugaaugugag

SEQ ID NO: 55397 - RNA, 64 nt, Homo Sapiens
uuacuuuuuuaaagcugaguaguuaagaauucccuguaaaaacaaaacccuguaaauugagccu

SEQ ID NO: 55398 - RNA, 64 nt, Homo Sapiens
aaagcaaguguaauuaauucaaaaguacuguuaauguaaaaaauauauuagagaacugugauuu

SEQ ID NO: 55399 - RNA, 64 nt, Homo Sapiens
ggaaauggugcaugucauugacaaggugguuuauuguaaaaacaacacuuccaaaaacaaggga

SEQ ID NO: 55400 - RNA, 64 nt, Homo Sapiens
cauuguagauaauugaaugugaguuuuccccguuuguaaaaagaugaugugccuguaaaccaag

SEQ ID NO: 55401 - RNA, 64 nt, Homo Sapiens
aacggcuucucugauauuuauaagcagacgaugcuguaaaaacucaccuggucaacuuagcuuu

SEQ ID NO: 55402 - RNA, 64 nt, Homo Sapiens
gccuauuuauauauguugaauauacaauuucaaauguaaaaacauuaaaaguugugcaugggcu

SEQ ID NO: 55403 - RNA, 64 nt, Homo Sapiens
caauuuaaauuuuaauacagauuaaaaaacaacuuguaaaaauggcaauguaaauagaacacua

SEQ ID NO: 55404 - RNA, 64 nt, Homo Sapiens
uaaaauauuuuuuaauuuaauggucaguauauuuuguaaaaaucauguuaauuuauuucauagu

SEQ ID NO: 55405 - RNA, 64 nt, Homo Sapiens
uuucugagcagcauuuugguauuuaaacauuucuuguaaaaagcugagacaguuuguaagaaaa

SEQ ID NO: 55406 - RNA, 64 nt, Homo Sapiens
uuagaggcuuaccccuguaauguguacauuuuuuuguaaaaaguguauauauccaaagauauag

SEQ ID NO: 55407 - RNA, 64 nt, Homo Sapiens
aaaguguaaaauauguauauauuauuuguuaaauuguaaaaaaauuagaggauguauuuauaua

SEQ ID NO: 55408 - RNA, 64 nt, Homo Sapiens
auucuuaguuugugggccuuaaaaagaaaaaagauguaaaaaccgcaagacucccucucaaaag

SEQ ID NO: 55409 - RNA, 64 nt, Homo Sapiens
accugacuuaguaaugcgaauaaccauuuaaaaauguaaaaacgggguauuuauaugaccuuug

SEQ ID NO: 55410 - RNA, 64 nt, Homo Sapiens
uaaauauacuauugcacuaagcaaccaaaauuacuguaaaaaaaauccuuaaaucucuuguaug

SEQ ID NO: 55411 - RNA, 64 nt, Homo Sapiens
gugguuuggccauuaauuugcauauuuuagaaaauguaaaaaugguggccugcugaggcugccc

SEQ ID NO: 55412 - RNA, 64 nt, Homo Sapiens
aaaaaucucaguuauguuuuaacuuuauguacaguguaaaaaaaucccugugaaugccaaagua

SEQ ID NO: 55413 - RNA, 64 nt, Homo Sapiens
uuaaagaauaaaaauacuucugaaaaaauuaaaauguaaaaaaaaaaaauuaaguucugaaaau

SEQ ID NO: 55414 - RNA, 64 nt, Homo Sapiens
uguauuauacaucuguauuuaacagcuucuugcuuguaaaaauaguguaaaaaaaagucuuaac

SEQ ID NO: 55415 - RNA, 64 nt, Homo Sapiens
agucuuaacaacagcuucuuuuauaaacucuaaguguaaaaaaaacuuccuuccugccccaaaa

SEQ ID NO: 55416 - RNA, 64 nt, Homo Sapiens
gauuucuaagaauguuuuucuauaaauuacuaauuguaaaaagucuugcuuuuuaaaacaaguu

SEQ ID NO: 55417 - RNA, 64 nt, Homo Sapiens
uucuccuugaggauagggauagguaagguaaacuuguaaaaaggaugucacagaagucacuuuu

SEQ ID NO: 55418 - RNA, 64 nt, Homo Sapiens
uuguaaagaggaugcugccuuaagaauugcauguuguaaaaaaucuuuuuggaaaauacagacu

SEQ ID NO: 55419 - RNA, 64 nt, Homo Sapiens
guuauuuaucaaaauuaugugagguuccaaaauauguaaaaaugauaauaauaaaaaaagauua

SEQ ID NO: 55420 - RNA, 64 nt, Homo Sapiens
aaguaguucagcaucuaucgaaaagaacaaaaacuguaaaaaggaggacuuauugagguaaauu

SEQ ID NO: 55421 - RNA, 64 nt, Homo Sapiens
uuuaauaauuggguggagaaucccccaccgagcuuguaaaaaacguuugucucagggaaaaucu

SEQ ID NO: 55422 - RNA, 64 nt, Homo Sapiens
guauacacaaaaaucagauuuaguaacuaaagguuguaaaaaauuguaaaacugguuguacaau

SEQ ID NO: 55423 - RNA, 64 nt, Homo Sapiens
uacaauagaugucucacacagaacaauacaaauauguaaaaaaucuuucaccacauauucuugc

SEQ ID NO: 55424 - RNA, 64 nt, Homo Sapiens
ucuugcugguuuauaccuauguucauuuauaugcuguaaaaaaguaguagcuucuucuacaaug

SEQ ID NO: 55425 - RNA, 64 nt, Homo Sapiens
auaugcuguaaaaaaguaguagcuucuucuacaauguaaaaauaaauguacauacaaaaaaaug

SEQ ID NO: 55426 - RNA, 64 nt, Homo Sapiens
aaaauuuaaaguuaaaugauacauauuuuugagauguaaaaaaaugaagcucuaauuauugcag

SEQ ID NO: 55427 - RNA, 64 nt, Homo Sapiens
uuaaaaagcuguuuccaagucacaucuucuuuacuguaaaaauaacauuuucauuaugccccau

SEQ ID NO: 55428 - RNA, 64 nt, Homo Sapiens
gugggaggaggcaaggucugcuaucaggaguuacuguaaaaacaagaacuggaagcucguguuu

SEQ ID NO: 55429 - RNA, 64 nt, Homo Sapiens
gcuuguugcuuggcuuuuaaagaugguguauguuuguaaaaauauucuucugggcucaaaagcu

SEQ ID NO: 55430 - RNA, 64 nt, Homo Sapiens
ucucgggcuuuaauuugcuaaagcugugcacauauguaaaaaaaaaaaaaaaaagauuauuuua

SEQ ID NO: 55431 - RNA, 64 nt, Homo Sapiens
guaagaugauaaagcauuugaaugguacaguagauguaaaaaaaauucaguuuaaaagaacauu

SEQ ID NO: 55432 - RNA, 64 nt, Homo Sapiens
uuuuuucuccuauacuugggcuacauuuuuugauuguaaaaauauuugauggccuuuugaugaa

SEQ ID NO: 55433 - RNA, 64 nt, Homo Sapiens
cacaccuaugcaauauggcuuaucuauauuuauuuguaaaaauccaagcauaguuuaaaauaug

SEQ ID NO: 55434 - RNA, 64 nt, Homo Sapiens
uaaaaaaugaaaguuaugacauuagcuuuaaagguguaaaaaagauguuucacuaauguaacgg

SEQ ID NO: 55435 - RNA, 64 nt, Homo Sapiens
uuuaauaaaaauguuaauuuuggaagugcaguuuuguaaaaaccuuuuucagucaaacaguaaa

SEQ ID NO: 55436 - RNA, 64 nt, Homo Sapiens
aaaaaaaaaaaaaagacaaaaggugauaaaaaacuguaaaaaaacacgacagaguccauguugg

SEQ ID NO: 55437 - RNA, 64 nt, Homo Sapiens
gaaaaagaccucguggagaaaaaaacucuauuuuuguaaaaaggaaggggggugggaggggaag

SEQ ID NO: 55438 - RNA, 64 nt, Homo Sapiens
gugggaaaacauacauuacuagaaacaguaugaauguaaaaaauugaaaggaugcacacugcaa

SEQ ID NO: 55439 - RNA, 64 nt, Homo Sapiens
guggaaaagcauuuagauacauaaacccuuugaguguaaaaaauugaaaguacucacacuggag

SEQ ID NO: 55440 - RNA, 64 nt, Homo Sapiens
gugggaaaguguucguauauaaaaacccuaugaauguaaaaaauugaaagaacucacacuggag

SEQ ID NO: 55441 - RNA, 64 nt, Homo Sapiens
guagaaaauccuuuauugauagaaaccguaucaguguaaaaaauucagagaauucacacuagug

SEQ ID NO: 55442 - RNA, 64 nt, Homo Sapiens
cuuuucuuuguuauucaacaaugaauguaaagauuguaaaaaagucacacuggugacaaacccu

SEQ ID NO: 55443 - RNA, 64 nt, Homo Sapiens
uaauguuguaaauauuuggcaauuuaagacauuguguaaaaagcaaucuguaaaaacaucucca

SEQ ID NO: 55444 - RNA, 64 nt, Homo Sapiens
uuuggcaauuuaagacauuguguaaaaagcaaucuguaaaaacaucuccaggcuuugauuuuug

SEQ ID NO: 55445 - RNA, 64 nt, Homo Sapiens
gaagaaaguggcagguuuucugucgaaacugcauuguaaaaagauguuuacucuaccaauguua

SEQ ID NO: 55446 - RNA, 64 nt, Homo Sapiens
gcaccuggaguuucaaaacaccaguuuuaaucauuguaaaaaaauuguuuuuaaaaauuauauu

SEQ ID NO: 55447 - RNA, 64 nt, Homo Sapiens
uugacaucuuuuuuuuuaaucugaaauauaugcauguaaaaacuagguaggucuucagcauaag

SEQ ID NO: 55448 - RNA, 64 nt, Homo Sapiens
acauuuaauuauaaacaauaauauugaccugcaguguaaaaagcaaauuuacuaaccaguuuuu

SEQ ID NO: 55449 - RNA, 64 nt, Homo Sapiens
aaaaaaauauauauauauaucuggaauaacauuuuguaaaaaaagcccaccaaaaugauccagu

SEQ ID NO: 55450 - RNA, 64 nt, Homo Sapiens
ccagaauugucaaccaauuucuuuaauugaacauuguaaaaaacaggaauaaguacuuuugugu

SEQ ID NO: 55451 - RNA, 64 nt, Homo Sapiens
auaaugcacaguaaauaugugaauuuuuccuagauguaaaaaaaaaaaucuuucauauaaagac

SEQ ID NO: 55452 - RNA, 64 nt, Homo Sapiens
aaaaaaagccaagauuucauuaaccaaacauuuguguaaaaaaauuaucacuaguguggcuaaa

SEQ ID NO: 55453 - RNA, 64 nt, Homo Sapiens
aaaauacuuguugaaaagccauuucauagcaacuuguaaaaaauagauauauauauaaauuuua

SEQ ID NO: 55454 - RNA, 64 nt, Homo Sapiens
gaauaacuguaugcagguuuuugaauuguauagguguaaaaaggguauaaaaacauugcuuuug

SEQ ID NO: 55455 - RNA, 64 nt, Homo Sapiens
ucccuaauugauuauauaguucucuucauuugucuguaaaaauuuacuguaaagcuacuugugu

SEQ ID NO: 55456 - RNA, 64 nt, Homo Sapiens
cugagaugaaucuaauuuuuagauugcccuguauuuuguuaacauguauauauguacaacagug

SEQ ID NO: 55457 - RNA, 64 nt, Homo Sapiens
cguuucugaacagggucugugcuauguguaaagguuuguuaacuguaaaguaauauaaaguuau

SEQ ID NO: 55458 - RNA, 64 nt, Homo Sapiens
uguaaacugauauucagccagcaaugccuaagacuuuguuaagaucauuucuacugcuuuucuu

SEQ ID NO: 55459 - RNA, 64 nt, Homo Sapiens
acacugguuaaguuugacucgucucuaaaacguuuuuguuaauuggacaccaagaggaagaauc

SEQ ID NO: 55460 - RNA, 64 nt, Homo Sapiens
aacugauaaaguuuguaaagugcuauaaauguauuuuguuaaguacagauaaaagcuauugugu

SEQ ID NO: 55461 - RNA, 64 nt, Homo Sapiens
uuuuuuaaaaauguuuuaaggaauaccugggaaguuuguuaaaaucccaaaucuggcuggucgg

SEQ ID NO: 55462 - RNA, 64 nt, Homo Sapiens
uaucucuaggauggugauuuacuagaccauuuaauuuguuaaaucuuuuuaguaucaaaucacu

SEQ ID NO: 55463 - RNA, 64 nt, Homo Sapiens
ugacuaugucgaauauuucuuacugccaucauuauuuguuaaagauauuuugcacuuaauuuug

SEQ ID NO: 55464 - RNA, 64 nt, Homo Sapiens
cguaauuuuaggacuccuauaaaauucuuccuuguuuguuaaugcuauuaaaacucagauucaa

SEQ ID NO: 55465 - RNA, 64 nt, Homo Sapiens
aaggucaaguuuuauucuggugucuuggggaagcuuuguuaaauuuuuguuaauguggguaaau

SEQ ID NO: 55466 - RNA, 64 nt, Homo Sapiens
uuauucuggugucuuggggaagcuuuguuaaauuuuuguuaauguggguaaaucugaguuuaau

SEQ ID NO: 55467 - RNA, 64 nt, Homo Sapiens
aauuacagauuuaaaagagcuuaagaucugguguuuuguuaaugcuucuguuuauuccagaagc

SEQ ID NO: 55468 - RNA, 64 nt, Homo Sapiens
uugagacuuguaaaccuggauauguugaaggguauuuguuaauuuuacuuuucaaagauacuuu

SEQ ID NO: 55469 - RNA, 64 nt, Homo Sapiens
auuuuuaacccuuaaaaaaguggagauguauacauuuguuaacaaugccaugaaagcauuuucu

SEQ ID NO: 55470 - RNA, 64 nt, Homo Sapiens
uguguugccucacacugugugugauuuuguuucuuuuguuaagcagcacuuauguagacugcau

SEQ ID NO: 55471 - RNA, 64 nt, Homo Sapiens
acuagaaugugugacucuguggggacugcauagguuuguuaauugaccuauagcuaaaccuuaa

SEQ ID NO: 55472 - RNA, 64 nt, Homo Sapiens
gccucaggauauuucuuuuacugcuuguguuugcuuuguuaauuuuaaugcguuggaaagaaag

SEQ ID NO: 55473 - RNA, 64 nt, Homo Sapiens
caaauguauaacugcaguuagacagggucuagauuuuguuaaccaauuagucuaacucugcaua

SEQ ID NO: 55474 - RNA, 64 nt, Homo Sapiens
ugucaucagccuucaaccucgcuccuggcucuauuuuguuaagggugucacucuucagggcucu

SEQ ID NO: 55475 - RNA, 64 nt, Homo Sapiens
aacaaaaaaagugauggaaacuuugguucccaacuuuguuaaaaccuuuaaaaaagauguaaga

SEQ ID NO: 55476 - RNA, 64 nt, Homo Sapiens
aaagcaacaaaaauuuucuugaguuggcauaaauuuuguuaaauauguuuguauauagauacag

SEQ ID NO: 55477 - RNA, 64 nt, Homo Sapiens
cugccaauaaaaucauuuucuccaaucacuacauuuuguuaauaguucuuaauuuugaaggacc

SEQ ID NO: 55478 - RNA, 64 nt, Homo Sapiens
auacagacauuguauguuauuaguuguguacuuauuuguuaauaaaaaguguaacauuuuuauu

SEQ ID NO: 55479 - RNA, 64 nt, Homo Sapiens
gauacaaaguuacagcuuggagacuagagagagauuuguuaaaggggaaagcugcagcaaaggg

SEQ ID NO: 55480 - RNA, 64 nt, Homo Sapiens
cuuucccacucucaggggaauuuucccacucucauuuguuaauguguuaaugcuuuguuaaugc

SEQ ID NO: 55481 - RNA, 64 nt, Homo Sapiens
cuuuucccacucucauuuguaccuguguuaaugcuuuguuaaugaauauuuugaauauguaaag

SEQ ID NO: 55482 - RNA, 64 nt, Homo Sapiens
ucuaccuccaacccacaaaaagagauuugcuugauuuguuaacugauuuggggagaguagaagg

SEQ ID NO: 55483 - RNA, 64 nt, Homo Sapiens
gugucuuuuuuuaaaaaguugagaaauaauuguauuuguuaacagcuggcugaguggauuuuaa

SEQ ID NO: 55484 - RNA, 64 nt, Homo Sapiens
aauuucacauuacuuuuacuuaaugcuuuuguguuuuguuaauacuucauaauaugugaaaaac

SEQ ID NO: 55485 - RNA, 64 nt, Homo Sapiens
uuuuuuuuuuuuccaucacucaguggagaaaagcuuuguuaaugaaagauuuugugauagagcu

SEQ ID NO: 55486 - RNA, 64 nt, Homo Sapiens
aauugucaaagacuguauuuagaucucauaaugcuuuguuaaauguuuacaaguaaauaguuug

SEQ ID NO: 55487 - RNA, 64 nt, Homo Sapiens
gacuaccaauuucuuuuauguuaacuagaaugcuuuuguuaaaaguuauuuguucauuauuugu

SEQ ID NO: 55488 - RNA, 64 nt, Homo Sapiens
ccauugaccauuuaguguugaguacuguauguguuuuguuaauucuauaaagguaucuguuaga

SEQ ID NO: 55489 - RNA, 64 nt, Homo Sapiens
uuaaaauuuaauccauucuuaauauuuuaaaacuuuuguuaagaaaaacugccaguuugugcuu

SEQ ID NO: 55490 - RNA, 64 nt, Homo Sapiens
auuuucugaaggucuguuaguuaauuugagauaauuuguuaaaggcaaguaugucauauuacug

SEQ ID NO: 55491 - RNA, 64 nt, Homo Sapiens
acuguaacaugauuugaguggugcuuuuccuugcuuuguuaaccaucacgagagucugcagcac

SEQ ID NO: 55492 - RNA, 64 nt, Homo Sapiens
aagcgggagaggaggagcacuuacucauguuguauuuguuaauggaggaugucaucuuuucaua

SEQ ID NO: 55493 - RNA, 64 nt, Homo Sapiens
aaugaacagucacaccaaaauagacuaugaugcuuuuguuaagaaagguuucauguuuuagaua

SEQ ID NO: 55494 - RNA, 64 nt, Homo Sapiens
cauuguuguaaaguauuugagauguuucuugccuuuuguuaauggggguuccucuguacagcaa

SEQ ID NO: 55495 - RNA, 64 nt, Homo Sapiens
ccuguuccauaggaaggcuguccugcaaauuuaguuuguuaaagcuuucuguuuuguuuuuuuc

SEQ ID NO: 55496 - RNA, 64 nt, Homo Sapiens
guguguguauaguaacacugcgaaugcauguagauuuguuaaauguauguguuuguuaaauauu

SEQ ID NO: 55497 - RNA, 64 nt, Homo Sapiens
auucgaaugcauguagauuuaacacuuguauguguuuguuaaauccauaacauccauaugacug

SEQ ID NO: 55498 - RNA, 64 nt, Homo Sapiens
ccaaacacccagcauagccaacuacugaaaugauuuuguuaauucuguauaaugagcucaauuc

SEQ ID NO: 55499 - RNA, 64 nt, Homo Sapiens
ccuuugcacuuuuuuuuaacuuuuguagauaauuuuuguuaauuuguuuuguuaauuuauguuu

SEQ ID NO: 55500 - RNA, 64 nt, Homo Sapiens
uuuuaacuuuuguagauaauuuuuguuaauuuguuuuguuaauuuauguuuuuccuaauuuuaa

SEQ ID NO: 55501 - RNA, 64 nt, Homo Sapiens
aaauuguaauaccuagguaguugguugaucacaguuuguuaauuguauaaaaaaaaauuaccua

SEQ ID NO: 55502 - RNA, 64 nt, Homo Sapiens
uauacccauuuuauuuauuuagaaaaauaguaucuuuguuaacgacuuacauggucacaguaua

SEQ ID NO: 55503 - RNA, 64 nt, Homo Sapiens
agauuaaagaauuuaugaguuugggguuguauauuuuguuaaaauuucaaccauaguacgaugu

SEQ ID NO: 55504 - RNA, 64 nt, Homo Sapiens
uuuuuggccaauuuauuuuccuguaaaaauguauuuuguuaauuuuauauauauauauauauau

SEQ ID NO: 55505 - RNA, 64 nt, Homo Sapiens
aagaaaaaaaaacacacauauguuuuaaccuguauuuguuaaaaagcuaacugaauuuguucag

SEQ ID NO: 55506 - RNA, 64 nt, Homo Sapiens
gauuuugagucucaaccaacaggaaaagcaugaauuuguuaacauuuucuuuuuuuuuuuuuug

SEQ ID NO: 55507 - RNA, 64 nt, Homo Sapiens
uguuuucuuugugaaacauuugccaccauaccauuuuguuaaaaucucuuuuuuguuauuguua

SEQ ID NO: 55508 - RNA, 64 nt, Homo Sapiens
acugccauaauaucauuauaaaaaauauucugaauuuguuaagcacagcauagguuuuucauau

SEQ ID NO: 55509 - RNA, 64 nt, Homo Sapiens
aaaauuuuucauuguuuuacuucaaaaguauuguuuuguuaaacccaacguuuaguuuuucuug

SEQ ID NO: 55510 - RNA, 64 nt, Homo Sapiens
uuaaacccaacguuuaguuuuucuugugauacauuuuguuaaccuguguaaaaggauuaaauuu

SEQ ID NO: 55511 - RNA, 64 nt, Homo Sapiens
auuaaaaucuccguucuuucaauuuaauuuguuguuuguuaaaagaaagaguuuaagggcuaau

SEQ ID NO: 55512 - RNA, 64 nt, Homo Sapiens
auaucugccaguuauuaaaaucuguaugcugaacuuuguuaaaauagauguaugcacagaccug

SEQ ID NO: 55513 - RNA, 64 nt, Homo Sapiens
auuguuuauaugcuuacaaaagaaauuacuauuuuuuguuaaaguuuauacagaaauucuuugu

SEQ ID NO: 55514 - RNA, 64 nt, Homo Sapiens
gugaccuugacuggcuuuacguugcugaagaugcuuuguuaaauugcacacuucaggcacugua

SEQ ID NO: 55515 - RNA, 64 nt, Homo Sapiens
ccagucagauaauggcauuguaaaggaaauggucuuuguuaauuaaauauuauuaauagcuuau

SEQ ID NO: 55516 - RNA, 64 nt, Homo Sapiens
augucucagauugaccuuaccaaguuggucuuacuuuguuaauuuaucuguuguccccuuccuc

SEQ ID NO: 55517 - RNA, 64 nt, Homo Sapiens
uaagaaguugcugcagauuccuuuggccacuguauuuguuaauuucuugcaauuugaagguacg

SEQ ID NO: 55518 - RNA, 64 nt, Homo Sapiens
uuggaguaacaggcuuauuccacuuuccaugggguuuguuaauauuuugcauugacucauacua

SEQ ID NO: 55519 - RNA, 64 nt, Homo Sapiens
ucuuuaaaaguugcuacagauuugaguucaugauuuuguuaaaaauugcuauggaguacuuugu

SEQ ID NO: 55520 - RNA, 64 nt, Homo Sapiens
auuucacuuugaaggauacauauauacuguuaaauuuguuaaggcuguuucaucagcagccuaa

SEQ ID NO: 55521 - RNA, 64 nt, Homo Sapiens
uaauauuuaaaccugagagaugcauuaaaauauauuuguuaauucacauaaucuguaccaggua

SEQ ID NO: 55522 - RNA, 64 nt, Homo Sapiens
uuuucugauuguuuccuuuaaaccuauuuauuucuuuguuaaaugccuagauugcuuucuucuu

SEQ ID NO: 55523 - RNA, 64 nt, Homo Sapiens
aaauauauagcacaucaccugggacuuggcaaucuuuguuaaaaaaaaauuuccuuucuaaugg

SEQ ID NO: 55524 - RNA, 64 nt, Homo Sapiens
uaaaauuccacauguauuaaaauguacaaaauguuuuguuaauaaaauuuaauaauguuuauaa

SEQ ID NO: 55525 - RNA, 64 nt, Homo Sapiens
aagcauuuuugugagugaccaccuuugcaauauguuuguuaauuuacuucauguuggguucuuu

SEQ ID NO: 55526 - RNA, 64 nt, Homo Sapiens
guaauaucuaaggucaggcaccuaguaacaggguuuuguuaauucuuuucagaaucauugaagc

SEQ ID NO: 55527 - RNA, 64 nt, Homo Sapiens
auuuuuaaaagugcuuucuuugaaacacuggaacuuuguuaagcugccuuuuuuuuuuuaacuu

SEQ ID NO: 55528 - RNA, 64 nt, Homo Sapiens
gcaauguggaguugacuuagcuuggcauuuuagauuuguuaaaacuauuuuuuccauaaauacu

SEQ ID NO: 55529 - RNA, 64 nt, Homo Sapiens
uuccucauuuugaauuauguacuuucauuggauuuuuguuaauucauaauagauaaaaaccuga

SEQ ID NO: 55530 - RNA, 64 nt, Homo Sapiens
cuuauuuuagaaauuauaauauacuuaaauuugguuuguuaauuguuucaaucucugacuaaaa

SEQ ID NO: 55531 - RNA, 64 nt, Homo Sapiens
cuguuagucggguuagaguuggcucuacgcgagguuuguuaauaaaaguuuguuaaaaguuugu

SEQ ID NO: 55532 - RNA, 64 nt, Homo Sapiens
agaguuggcucuacgcgagguuuguuaauaaaaguuuguuaaaaguuuguuuugugcaaguguc

SEQ ID NO: 55533 - RNA, 64 nt, Homo Sapiens
uguuuuuauauuucauauauuauauauauauugcuuuguuaauuguccuguggacuugcaaaua

SEQ ID NO: 55534 - RNA, 64 nt, Homo Sapiens
agccuucucuuguguguuacuaucagaaaagguguuuguuaaaguaaggaaucccuaacccuac

SEQ ID NO: 55535 - RNA, 64 nt, Homo Sapiens
uuauggugucacuuagauugaaccuauuuuaugcuuuguuaaaaugacucuuucaaaugcaaaa

SEQ ID NO: 55536 - RNA, 64 nt, Homo Sapiens
gaacauuuucaauuauaugccuuaugaauaauuguuuguuaauuuuuuaguuaauauaccaaag

SEQ ID NO: 55537 - RNA, 64 nt, Homo Sapiens
aauaagcagauguauguaugcaugguuauacuauuuuguuaacauguacaauuuccugauuuuu

SEQ ID NO: 55538 - RNA, 64 nt, Homo Sapiens
acagaaaaaauuuuaaauuauuucacauuagccauuuguuaaaacacagcaucauaacucagca

SEQ ID NO: 55539 - RNA, 64 nt, Homo Sapiens
auacuuugcccucagaaagauacugauauuuuuauuuguuaauaccuguaauugucuuuuaaaa

SEQ ID NO: 55540 - RNA, 64 nt, Homo Sapiens
gaacucuuaauuauguuuuuaaguaugaaacagauuuguuaacuggcauuuuuacuguuuguga

SEQ ID NO: 55541 - RNA, 64 nt, Homo Sapiens
cuaagauguucaaacuuagaaagaagaguauuuuuuuguuaauacucaauauauuuguaaccuu

SEQ ID NO: 55542 - RNA, 64 nt, Homo Sapiens
caggauuuugccacaauuauaugugaaaauuauuuuuguuaaaauccucauuauguagaaugga

SEQ ID NO: 55543 - RNA, 64 nt, Homo Sapiens
ugcaguuuuacuaaacagaucgaaguauuuggcuuuuguuaauaacuguuuacuucuucacuuu

SEQ ID NO: 55544 - RNA, 64 nt, Homo Sapiens
ugagagauaaacaaugacaaaggcuucagcuugguuuguuaaauacaagguuguagcugugcuc

SEQ ID NO: 55545 - RNA, 64 nt, Homo Sapiens
auuuauaggaaugaggagguaacagcuaacuguuuuuguuaaaggauuaaaggggaagcaugua

SEQ ID NO: 55546 - RNA, 64 nt, Homo Sapiens
guuuccuaaacuauaaaagcagauuuugcuuuuguuuguuaaucauaggcauggccgagcauug

SEQ ID NO: 55547 - RNA, 64 nt, Homo Sapiens
cauuguuuuccuccauccugcaaaagaagaucccuuuguuaagcagcucacuuggaaauaugau

SEQ ID NO: 55548 - RNA, 64 nt, Homo Sapiens
aaaaguucugaguuucuuguuucuacuugucaguuuuguuaaaggugauugaauauaaguaacc

SEQ ID NO: 55549 - RNA, 64 nt, Homo Sapiens
uuuuucuguccgcaacacuggcucccgagcagcuuuuguuaaagcaguagguuuuaaggauucu

SEQ ID NO: 55550 - RNA, 64 nt, Homo Sapiens
aaugccuguuuugaugaguugauuuauaaagauuuuuguuaagcucaggauuuuaaauuacaca

SEQ ID NO: 55551 - RNA, 64 nt, Homo Sapiens
uuauaaugcaaauuagggcuacauuguaaucugcuuuguuaaugaaaaugauaaaacagaauau

SEQ ID NO: 55552 - RNA, 64 nt, Homo Sapiens
cuguccagauuuuucacacaucagugcucuuucauuuguuaaugaaucuuuaaaauaacagaau

SEQ ID NO: 55553 - RNA, 64 nt, Homo Sapiens
ugagaacuugauacugaaucguuuuaauauauucuuuguuaaucuuguggaaagaauguaaaau

SEQ ID NO: 55554 - RNA, 64 nt, Homo Sapiens
auugcacugcaguuauuuaccagaaguuuaaaucuuuguuaaaauauaguguuguguuacaaua

SEQ ID NO: 55555 - RNA, 64 nt, Homo Sapiens
agcaauaaguugaaugauaauagcucacagcacauuuguuaaugauucuugugucaucaaguag

SEQ ID NO: 55556 - RNA, 64 nt, Homo Sapiens
cugcauuuauaauuuugugacugaggaucguuuguuuguuaacguacugugacuuuaacuuuag

SEQ ID NO: 55557 - RNA, 64 nt, Homo Sapiens
uuuuaaguaggugcacuugacaguauugaggucauuuguuaaggugcuauuucaauuaguguag

SEQ ID NO: 55558 - RNA, 64 nt, Homo Sapiens
ugugaaaacucaccaaaaugaauaguuguuucguuacauuuagaugaaaguuaaacuuuacuga

SEQ ID NO: 55559 - RNA, 64 nt, Homo Sapiens
uuugacauuuuggaaauuuuuuuaauuuuacaaguacauuuaacagaucauuuauaaagcagga

SEQ ID NO: 55560 - RNA, 64 nt, Homo Sapiens
auacaguuuccuuugugaaaccaaauaucucaguuacauuuaccuuucucaggaucuauccuag

SEQ ID NO: 55561 - RNA, 64 nt, Homo Sapiens
auguagaauuccagauuacacaagggacauaccuuacauuuagccucccacucagcagagugcc

SEQ ID NO: 55562 - RNA, 64 nt, Homo Sapiens
uuuaaggacaaauauuuccucaauccagggaaccuacauuuauuaauguggcagccaaagagaa

SEQ ID NO: 55563 - RNA, 64 nt, Homo Sapiens
aagaaacguaaugacauaaaguuaguacauuuauuacauuuauuggggguugggguugggagug

SEQ ID NO: 55564 - RNA, 64 nt, Homo Sapiens
acauuuauuaagaaacguaauugggagugguuaguacauuuauucucuacacuggggguugggg

SEQ ID NO: 55565 - RNA, 64 nt, Homo Sapiens
ugcgcggaugaggggagguggcaggagagaauucuacauuuaggggguuaggcugaaaaguguu

SEQ ID NO: 55566 - RNA, 64 nt, Homo Sapiens
cccucaacauguagacuaaugcagccauuggugguacauuuauuuuagccacggauaauugaac

SEQ ID NO: 55567 - RNA, 64 nt, Homo Sapiens
aauggcuuuuguucucaaaugauaagagagcuaauacauuuagcuaauauucuagcucucuuua

SEQ ID NO: 55568 - RNA, 64 nt, Homo Sapiens
aacuaguaugcuacauuugaagcacucugacauguacauuuaaagugacaguuuuaaaaguaaa

SEQ ID NO: 55569 - RNA, 64 nt, Homo Sapiens
auacuucuacauuugagaaggguuuuuuuagaaauacauuuaguaaaguccccaagacauuagu

SEQ ID NO: 55570 - RNA, 64 nt, Homo Sapiens
aauacauuuaguaaaguccccaagacauuagucuuacauuuaaacuuuuuucuuuaaaacaugg

SEQ ID NO: 55571 - RNA, 64 nt, Homo Sapiens
agcggccuuauguacauuucacaguaacacgauguacauuuacauccucuggacauaagacaua

SEQ ID NO: 55572 - RNA, 64 nt, Homo Sapiens
ucccugcccucuuugaccuguuugcauuuuaguguacauuuacguuuuaucucuuugggauaca

SEQ ID NO: 55573 - RNA, 64 nt, Homo Sapiens
auugcuuucuuuuuagcaagagguuauaacaaaauacauuuaacaguauuauuuuaggucauaa

SEQ ID NO: 55574 - RNA, 64 nt, Homo Sapiens
agaauguaugucucagaagaaucaguacuguugauacauuuauuaaauugacccuucguugacu

SEQ ID NO: 55575 - RNA, 64 nt, Homo Sapiens
uugauggcaccuugaaagugaacuucuagaaaucuacauuuaaaaggcaaagcuuuaaaagcag

SEQ ID NO: 55576 - RNA, 64 nt, Homo Sapiens
gacuaaaggaaacccaggaauauuuaccugguguuacauuuaauauuuaauguaacuggucuag

SEQ ID NO: 55577 - RNA, 64 nt, Homo Sapiens
gaaauccacugcacacuguugccuauacacuuuguacauuuaauugauauuugugcugagguga

SEQ ID NO: 55578 - RNA, 64 nt, Homo Sapiens
uauuuuucuuguuaaaauguaguuuuucauuuccuacauuuauuagauuuucauuuucuauuaa

SEQ ID NO: 55579 - RNA, 64 nt, Homo Sapiens
guaaaaauaauaauuuuuauauuuaauuauuaacuacauuuaugaguaacuauuauuauaggua

SEQ ID NO: 55580 - RNA, 64 nt, Homo Sapiens
ccaccguuacaaguauacuuauauuucccuaaaauacauuuaaaacuuaccuaagugacauuug

SEQ ID NO: 55581 - RNA, 64 nt, Homo Sapiens
uacuauaaaaugcaguaacauucuacuugcuuauuacauuuaaauccuuguguaacugaauguu

SEQ ID NO: 55582 - RNA, 64 nt, Homo Sapiens
auguuuauggugagguuuaaaggauaugaaacucuacauuuaaacaaguauuuuauauuugggu

SEQ ID NO: 55583 - RNA, 64 nt, Homo Sapiens
ucauaacgucucuuggucacacauaauacauuuguacauuuaaucuugcauuuaauacauuuau

SEQ ID NO: 55584 - RNA, 64 nt, Homo Sapiens
cauaauacauuuguacauuuaagcuugcauuuaauacauuuauagacauuggugucauuauaug

SEQ ID NO: 55585 - RNA, 64 nt, Homo Sapiens
acccaacaggucaaaauaaaaguugaacuugaguuacauuuaauuuaaauauaaaugcauuuug

SEQ ID NO: 55586 - RNA, 64 nt, Homo Sapiens
ucaaccucugaaaaaagguuuuuccaggaagauuuacauuuagguuuaauauuuuuuuaguuag

SEQ ID NO: 55587 - RNA, 64 nt, Homo Sapiens
uuccgaauguaucauugaauuuuuucauauuuuauacauuuauuugaaaaaugcuuuuuaguac

SEQ ID NO: 55588 - RNA, 64 nt, Homo Sapiens
uuauucaaaguuuucagcuccacauuuccuguuguacauuuaggagaguuccacgguuuguuua

SEQ ID NO: 55589 - RNA, 64 nt, Homo Sapiens
agcaaaagguaaaauuugcaggcugcuucaggauuacauuuaaauaacuguuaaaauguuguau

SEQ ID NO: 55590 - RNA, 64 nt, Homo Sapiens
gcaguuuuugaccaagaaucagaagcccaagggguacauuuauugcuuuaaucugcacucauug

SEQ ID NO: 55591 - RNA, 64 nt, Homo Sapiens
uuuaaauuuguaaauagcuuugaauacauuuauguacauuuauuuaaaacuguuuaaugugaug

SEQ ID NO: 55592 - RNA, 64 nt, Homo Sapiens
uacauuuauuuuuaaauuuguaaugugaugugaauacauuuauguguaauauuuuaaaacuguu

SEQ ID NO: 55593 - RNA, 64 nt, Homo Sapiens
auauuaagauuccuuugacuuaaauuuuauaucuuacauuuaaacuaauuaaaauauauaagcu

SEQ ID NO: 55594 - RNA, 64 nt, Homo Sapiens
uagcauugaaacacuuucaacuccucuagauucauacauuuauauccaguaugcauauuuuuuu

SEQ ID NO: 55595 - RNA, 64 nt, Homo Sapiens
gaguggcucuuucacuggcaauucucaaaugauauacauuuaaagggcagauuuuuuaaaaaga

SEQ ID NO: 55596 - RNA, 64 nt, Homo Sapiens
auuuucuagauacacagucuaugcauuauucauauacauuuauuuuagccuaaagugguuuuca

SEQ ID NO: 55597 - RNA, 64 nt, Homo Sapiens
guuacgguaugaagucuucucuuugaagaaacuauacauuuauugauaugugaaucucuucucc

SEQ ID NO: 55598 - RNA, 64 nt, Homo Sapiens
uauuuccuauguuagcuguuuuggcacuaaagaauacauuuaauucugauuuuaaaacuuacaa

SEQ ID NO: 55599 - RNA, 64 nt, Homo Sapiens
uuuugaucguaguuuuauaugaugcaguaacauuuacauuuaguaaaggcaugucuaucaugug

SEQ ID NO: 55600 - RNA, 64 nt, Homo Sapiens
ugaaaaguaaguaauuuuaaagcauaauuuguucuacauuuauucuuuuuaaaaacuacaaagu

SEQ ID NO: 55601 - RNA, 64 nt, Homo Sapiens
uuaguuuaguuugaaggagaaauuuucugaaaaauacauuuagacauacauggaguauggagga

SEQ ID NO: 55602 - RNA, 64 nt, Homo Sapiens
aggaguacaauaaaacuguuaaugaacaugcaccuacauuuaauaaaaauagcucagauguccu

SEQ ID NO: 55603 - RNA, 64 nt, Homo Sapiens
aaucaugcccagcuucugucauaugaaugagauauacauuuauucaaggaacagcaaugucaac

SEQ ID NO: 55604 - RNA, 64 nt, Homo Sapiens
ugugccccagcacaagaggcacugguguucggucuacauuuaguucuccccacucugauccccu

SEQ ID NO: 55605 - RNA, 64 nt, Homo Sapiens
acacauaaaagccacugcuuuuaacaucccauuguacauuuaacacauaaaugguguuaacauc

SEQ ID NO: 55606 - RNA, 64 nt, Homo Sapiens
cauuuaacacauaaaugguguuaacaucccauuguacauuuaacacauaaauggccauugucuu

SEQ ID NO: 55607 - RNA, 64 nt, Homo Sapiens
auuucauucaguuuuuggagcucaguuaagccaauacauuuaaaguuuugcaugaggaacacug

SEQ ID NO: 55608 - RNA, 64 nt, Homo Sapiens
ucuugcuucuaaaacauauuucauguaaacauuguacauuuauuauuguaauauauacuauuau

SEQ ID NO: 55609 - RNA, 64 nt, Homo Sapiens
auuuuaaugagaaugccucaauuuauuuaguacauacauuuauuuauauagaaaauguaauaca

SEQ ID NO: 55610 - RNA, 64 nt, Homo Sapiens
uuccugaaggaaacucuguaauuguagcugauuuuacauuuaucagugacuuuuuaacuuguaa

SEQ ID NO: 55611 - RNA, 64 nt, Homo Sapiens
caucagguauuuauagugaaagcauuuguaauuguacauuuauuagaaacacauuggcucuguc

SEQ ID NO: 55612 - RNA, 64 nt, Homo Sapiens
uuaauucuuaaguggccaaaaccauugucuuugauacauuuauuaaaacauaacaacaaugacc

SEQ ID NO: 55613 - RNA, 64 nt, Homo Sapiens
acuuaaugguuuugaagcaaauuaguuucuuaaauacauuuacuaaguuaugacaucuguccua

SEQ ID NO: 55614 - RNA, 64 nt, Homo Sapiens
uccugguaagagcagugcuccauuuuccaacgccuacauuuaauaucuggauauauuuugcauu

SEQ ID NO: 55615 - RNA, 64 nt, Homo Sapiens
uuaggacugacaacuucagcuuuguuagaaugaauacauuuauaaaaguugcauccagaagggu

SEQ ID NO: 55616 - RNA, 64 nt, Homo Sapiens
gccuuuuuaaaaagacauuugccugcuagucagauacauuuacauuuaugcaaauuuuuuaaau

SEQ ID NO: 55617 - RNA, 64 nt, Homo Sapiens
uuaaaaagacauuugccugcuagucagauacauuuacauuuaugcaaauuuuuuaaauaggaga

SEQ ID NO: 55618 - RNA, 64 nt, Homo Sapiens
ugaauaauguguaacuauuaaauuagaacugauauacauuuauugcacuuuaaaucuguuuuga

SEQ ID NO: 55619 - RNA, 64 nt, Homo Sapiens
auggaaaggugggaagaauauugcuggugcuucuuacauuuaauuucucugucuuuaguauuuu

SEQ ID NO: 55620 - RNA, 64 nt, Homo Sapiens
cauuuguaaaguuacagcaacaaauguaaaauuuuacauuuaagaauaaauauauaauuuuuua

SEQ ID NO: 55621 - RNA, 64 nt, Homo Sapiens
ugagaaaacacuggauuuaacauguuucuuccuguacauuuauuuucaugucugccauaacaug

SEQ ID NO: 55622 - RNA, 64 nt, Homo Sapiens
cuuggccuaugugcuggccgguucacugugauuguacauuuauaaacuagauuuuauggcuuua

SEQ ID NO: 55623 - RNA, 64 nt, Homo Sapiens
aucuuacaugcaguuauaaauaggcccagagucuuacauuuaaggucaccugccuuaauguagg

SEQ ID NO: 55624 - RNA, 64 nt, Homo Sapiens
uuucuguucuuuuuuuuuuuuuuuuucuauccuguacauuuaguugaacugugcggaauugugg

SEQ ID NO: 55625 - RNA, 64 nt, Homo Sapiens
uaaacugugagccaccuuuucuucuuuauauuguuacauuuaaguguucuugcuuucagcaacu

SEQ ID NO: 55626 - RNA, 64 nt, Homo Sapiens
auggaaaugcagaaagcuguaguuguaacauacauacauuuaaaaguaguaacuuaauauguaa

SEQ ID NO: 55627 - RNA, 64 nt, Homo Sapiens
gcaccccaaugucucucuuugccucaagauacuauacauuuaaaaagggaaugaaacauuuaug

SEQ ID NO: 55628 - RNA, 64 nt, Homo Sapiens
caaaaccccaaacuaagccaucauuauauaaugauacauuuagaaaacccucaaauuggugcuu

SEQ ID NO: 55629 - RNA, 64 nt, Homo Sapiens
aaauugaauggccaaaacauggagaguuuacccauacauuuagcuaacauuuggacuauucauu

SEQ ID NO: 55630 - RNA, 64 nt, Homo Sapiens
aauaaauugugaucaauaauaguaccuuugauuauacauuuauuauugugucucucucugaugu

SEQ ID NO: 55631 - RNA, 64 nt, Homo Sapiens
auuauugugucucucucugauguacuguggauuguacauuuaacuuuggaauggcuuuguaaua

SEQ ID NO: 55632 - RNA, 64 nt, Homo Sapiens
gcuuuuuaacuauccagucaacuuucagcuuuucuacauuuagguaaaaugguuaggauauaac

SEQ ID NO: 55633 - RNA, 64 nt, Homo Sapiens
aaugguuaggauauaacucaugguguggcuaaucuacauuuaucaauaaaauguaaauuaucug

SEQ ID NO: 55634 - RNA, 64 nt, Homo Sapiens
auauauuuuaaaaagcacuuugcaaaauaguuuguacauuuauuuccuaauuuauacaugauuu

SEQ ID NO: 55635 - RNA, 64 nt, Homo Sapiens
caggucaaauuugucuuguuauuugugaguacaguacauuuaaaaaacauccuuaucgguuauu

SEQ ID NO: 55636 - RNA, 64 nt, Homo Sapiens
uucagaauccucaagaggauuguagauucacagauacauuuacuauucucauuaggaaguuaaa

SEQ ID NO: 55637 - RNA, 64 nt, Homo Sapiens
uucugcgccccagagcuaagcauguuuguauaucuacauuuacagaguaacaagaaguaaaaua

SEQ ID NO: 55638 - RNA, 64 nt, Homo Sapiens
uuugcuuaaacucucuaauucccaauuucugaguuacauuuagauaucauauuaauuaucauau

SEQ ID NO: 55639 - RNA, 64 nt, Homo Sapiens
ugaguuacauuuagauaucauauuaauuaucauauacauuuacuucaacauaaaauacuguguu

SEQ ID NO: 55640 - RNA, 64 nt, Homo Sapiens
gaugucauuucaugagucaacuucuugguaaaauuacauuuaaguauacaguccuaguguuugc

SEQ ID NO: 55641 - RNA, 64 nt, Homo Sapiens
aaagcaaaaagugaaaaaaauguuuguggaggauuacauuuaaaauuauaauauaaauuaccau

SEQ ID NO: 55642 - RNA, 63 nt, Homo Sapiens
aaaucucuccacuuucagcugucuuuuggaggacguacguaauaagguuuuaauuuaguaaac

SEQ ID NO: 55643 - RNA, 63 nt, Homo Sapiens
agacuagagagauauuaagugaaagaguauguacguacguauauuugaguguaugcuguagcu

SEQ ID NO: 55644 - RNA, 63 nt, Homo Sapiens
cccauuggcgccgcccuacuggggaagccgguccguacguaggccuugcaucucgccaccucc

SEQ ID NO: 55645 - RNA, 63 nt, Homo Sapiens
cacccacagacacacacagucuacucuagaauacguacguaugugugaacuuuaugguaacuu

SEQ ID NO: 55646 - RNA, 63 nt, Homo Sapiens
ucuccuuuggaagugaggcauugcacagggagacguacguaucagcggccccuugacucuggg

SEQ ID NO: 55647 - RNA, 64 nt, Homo Sapiens
cagcuacuugggaggcugaggugggaggauugcuugaacccaagaggucgaggcugcagugagc

SEQ ID NO: 55648 - RNA, 64 nt, Homo Sapiens
ccauaaucccaacacuuuggcucagcagauugcuugaacccaggaauucaaguccaaucugggc

SEQ ID NO: 55649 - RNA, 64 nt, Homo Sapiens
aacauaagauccucucucuauauuucauuauuggugaacccacauugugcuguguuuugugaua

SEQ ID NO: 55650 - RNA, 64 nt, Homo Sapiens
ucuagauucuuauguggaucuaauaacgaccacuugaacccaguuucacagaauccuuauuuuu

SEQ ID NO: 55651 - RNA, 64 nt, Homo Sapiens
uuuuucuagaagguaaagccuaguuugcugacauugaacccaaauuugauagacugcuguuuuu

SEQ ID NO: 55652 - RNA, 64 nt, Homo Sapiens
auacuaagagggggaggaaaggcuguucugugucugaacccaguugggcuaguccccaagagga

SEQ ID NO: 55653 - RNA, 64 nt, Homo Sapiens
gacauguucuuuuuaaagcuagcagcaccacacaugaacccaaagggauaguuuacacccgggc

SEQ ID NO: 55654 - RNA, 64 nt, Homo Sapiens
agacaccauggaauguccuuaaagccaguugcccugaacccagccuuuucuuguaugccuuggg

SEQ ID NO: 55655 - RNA, 64 nt, Homo Sapiens
cacuuuugcuucuggggcuggcaaaaaccuucucugaacccacacaccaaguucguaguuggua

SEQ ID NO: 55656 - RNA, 64 nt, Homo Sapiens
uaauguucaucucuuuuccacugcccauccucugugaacccauaccucucuagauggagcaggu

SEQ ID NO: 55657 - RNA, 64 nt, Homo Sapiens
aggcagagguugcagugagcacaggagaaucacuugaacccaggcagcuacucgggcagcugag

SEQ ID NO: 55658 - RNA, 64 nt, Homo Sapiens
caucaucucaacuucacaaaagacugacaacgucugaacccacuaacuuuauagugaauagaug

SEQ ID NO: 55659 - RNA, 64 nt, Homo Sapiens
aggcggagcuugcagugagcgcaggagaauggcgugaacccaggcagcuacucugaagacugag

SEQ ID NO: 55660 - RNA, 64 nt, Homo Sapiens
cagagugucaugggugacagguggucugugugacugaacccacaccucccuuccauaauggauc

SEQ ID NO: 55661 - RNA, 64 nt, Homo Sapiens
gcuuccugcuccacucagcuccguccagucaaccugaacccacccaguccagcugucuguggga

SEQ ID NO: 55662 - RNA, 64 nt, Homo Sapiens
cagcuacucugcaggcugaggugggaggauugcuugaacccaggaggucgaggcugcagugagc

SEQ ID NO: 55663 - RNA, 64 nt, Homo Sapiens
uuuucucucacccuggcuuugucaagucuacugcugaacccauugaaggcauucuucaacucag

SEQ ID NO: 55664 - RNA, 64 nt, Homo Sapiens
gaggcuugcccacuuuugcagcucuuuggaauccugaacccauguguggaaaagccugaacugu

SEQ ID NO: 55665 - RNA, 64 nt, Homo Sapiens
ccagccagggcaugaaacaucaaccccccacaugugaacccaucauuccuaaacccuggguagg

SEQ ID NO: 55666 - RNA, 64 nt, Homo Sapiens
ccugagcccaccucccagcccucuccucauucucugaacccacuguggugagaagaauuugcuc

SEQ ID NO: 55667 - RNA, 62 nt, Homo Sapiens
agggcaagggggccaucacugcagucaggcccucagaggaguccugcaggcuuccuaccagu

SEQ ID NO: 55668 - RNA, 62 nt, Homo Sapiens
cacucucgcauacuuugccaaaugaggccugcucagaggaguaggagcugaaagauggugcc

SEQ ID NO: 55669 - RNA, 62 nt, Homo Sapiens
gagacuggcagccagggagcccggggcagagcucagaggagucugggaaggggcgugucccu

SEQ ID NO: 55670 - RNA, 62 nt, Homo Sapiens
ccaagaggcuagccccagggugagcagggcccucagaggaaaggcaguauggcggaggccau

SEQ ID NO: 55671 - RNA, 62 nt, Homo Sapiens
aggggauccugaugccacuuagcagugggauuucagaggaccuuucagaggagcuaagguaa

SEQ ID NO: 55672 - RNA, 62 nt, Homo Sapiens
ugccacuuagcagugggauuucagaggaccuuucagaggagcuaagguaagaugagauggag

SEQ ID NO: 55673 - RNA, 62 nt, Homo Sapiens
agaucagugaucuugggucauugaucccuggcucagaggauagcgguuuccaucauaaacca

SEQ ID NO: 55674 - RNA, 62 nt, Homo Sapiens
cuggcauucgagacuuccuccuguucccugggucagaggauagcgguuuccaucauaaacca

SEQ ID NO: 55675 - RNA, 62 nt, Homo Sapiens
uuccaauccauuugccccgcugccugcuucccucagaggaccgggguucccaaggcacccug

SEQ ID NO: 55676 - RNA, 62 nt, Homo Sapiens
ugggggagcgguggccagcccccagcugggucucagaggagcguucucuccuagccucagcc

SEQ ID NO: 55677 - RNA, 62 nt, Homo Sapiens
aacaggugggacuuugcgaggagaggcagggaucagaggacgcucugggacuccugagaugg

SEQ ID NO: 55678 - RNA, 62 nt, Homo Sapiens
aagauaccagcuuuuucucucaggguucugagucagaggacaccauccaagaauguuguuag

SEQ ID NO: 55679 - RNA, 62 nt, Homo Sapiens
agugaaugugccuuaaaaaucaagacacuaguucagaggaagcacauaauguccagaucuau

SEQ ID NO: 55680 - RNA, 62 nt, Homo Sapiens
ugaggagugagggaacccuggggcucacccucucagaggaagggcacagagaggaagggaag

SEQ ID NO: 55681 - RNA, 62 nt, Homo Sapiens
cgaauucccuguggccugccaugccuucggcaucagaggauggaguggucgaggcuagugga

SEQ ID NO: 55682 - RNA, 62 nt, Homo Sapiens
aauccagugugacagagugcgcugcagcuggaucagaggaaagagugaacuucuuaugggag

SEQ ID NO: 55683 - RNA, 62 nt, Homo Sapiens
uaucuugccaggauaccuacacguuuacuauuucagaggaaaagacaguaacuucuaagguc

SEQ ID NO: 55684 - RNA, 62 nt, Homo Sapiens
acauaggccugcucagccucuagcaccaggacucagaggaugaggucaauuuccugaugcau

SEQ ID NO: 55685 - RNA, 62 nt, Homo Sapiens
aauaccagggcuugugccccgcuauuccucacucagaggaagacuuugauccaggugccaag

SEQ ID NO: 55686 - RNA, 62 nt, Homo Sapiens
cccagggucuggugauggcaacagagucacgaucagaggaaccaggcaacagugugggauaa

SEQ ID NO: 55687 - RNA, 62 nt, Homo Sapiens
aggcaacagugugggauaaaauauacuuuuccucagaggagcuauauauauauauauaaaua

SEQ ID NO: 55688 - RNA, 62 nt, Homo Sapiens
gccuuggugggagaugacugaauccccaugugucagaggaggccaaaucccaucucaauuuu

SEQ ID NO: 55689 - RNA, 62 nt, Homo Sapiens
uguaguacacuacagaaauagcuuuacagcuuucagaggagucuguuuuaucuugcagguaa

SEQ ID NO: 55690 - RNA, 62 nt, Homo Sapiens
aggcugcucuaaagacuguucaggugguggaaucagaggacgcaggagagggauauggagag

SEQ ID NO: 55691 - RNA, 62 nt, Homo Sapiens
cucauuagcuggcuacaugcaccacuggcuacucagaggagggaacagcuggcccaggagcu

SEQ ID NO: 55692 - RNA, 62 nt, Homo Sapiens
agagugacugaggguaaaguuucuagcugaucucagaggacccgaggaugcccagugagagc

SEQ ID NO: 55693 - RNA, 62 nt, Homo Sapiens
ugaagaaaucaagagcaaagggcgagggcaggucagaggaagucuucugcagguccagcccu

SEQ ID NO: 55694 - RNA, 62 nt, Homo Sapiens
ccgagacaauauccuuccucugagagcuugagucagaggaagaacugccuuguaaacaaaaa

SEQ ID NO: 55695 - RNA, 62 nt, Homo Sapiens
gccuggggcuccugcaagucggaauucuucuuucagaggagcgcacugugguugcugugguu

SEQ ID NO: 55696 - RNA, 64 nt, Homo Sapiens
gaauguaguggaaauuuauugauugagacacagaaauccugauuagugauaggccugucuucug

SEQ ID NO: 55697 - RNA, 64 nt, Homo Sapiens
uuuggaagcgucaguggauauauuugaaagugguaauccugaaucucuuuuaaacuauuauaug

SEQ ID NO: 55698 - RNA, 64 nt, Homo Sapiens
ucuaccaagcguuuucauggaugcuaugagagacaauccugaagcugcuguacauauuuuugaa

SEQ ID NO: 55699 - RNA, 64 nt, Homo Sapiens
agcugcuguacauauuuuugaaggaacucaugaaaauccugaguuaauuuggaaugauaauucc

SEQ ID NO: 55700 - RNA, 64 nt, Homo Sapiens
cccauguaaauguccaaaauuguaguucauccuuaauccugacauccuaacauuuugaaguuuc

SEQ ID NO: 55701 - RNA, 64 nt, Homo Sapiens
aaaccacagguuccauagaaaaugauuauaugacaauccugaagcaagcuuucucucauaacgu

SEQ ID NO: 55702 - RNA, 64 nt, Homo Sapiens
caucaacugaucucauuucuagagagccccugacaauccugaggcuucaucaggagcuagagcc

SEQ ID NO: 55703 - RNA, 64 nt, Homo Sapiens
cuuguuaugguuguuuggaccgauaagugugcuuaauccugaggcaaaguagugaauauguuuu

SEQ ID NO: 55704 - RNA, 64 nt, Homo Sapiens
aacaaucacagaccacaugaauggaaaauaagggaauccugagauccucaaaacuguaaaaauc

SEQ ID NO: 55705 - RNA, 64 nt, Homo Sapiens
uuuauuuugccaaaaucaauguuccuccuaaaacaauccugacucucacaauugaguugaagcu

SEQ ID NO: 55706 - RNA, 64 nt, Homo Sapiens
aauggaacagcuguagaaaguuauguacugagagaauccugaagaccuucaugggcccagaaga

SEQ ID NO: 55707 - RNA, 64 nt, Homo Sapiens
caaugugagagacugcagaaucucacaacacaccaauccugauacuuauuuccuauuguguugg

SEQ ID NO: 55708 - RNA, 64 nt, Homo Sapiens
ugaugguaacugccacagcaaccugcuaccuuagagugugaagguuaagcaggcuuuaaauguc

SEQ ID NO: 55709 - RNA, 64 nt, Homo Sapiens
uggcaugcuaauuagcuaauaaucaguuguucuaagugugaauauuuagucaagugacuuuacu

SEQ ID NO: 55710 - RNA, 64 nt, Homo Sapiens
uucuggcauagaguccuggcgaggauuucuccccagugugaaguauuucuacacugauugcacu

SEQ ID NO: 55711 - RNA, 64 nt, Homo Sapiens
cuuuggugugcagugcgcuccucaugucucucccagugugaauuuuuccugcauuugcuguuuu

SEQ ID NO: 55712 - RNA, 64 nt, Homo Sapiens
ccuaaauagaggguaaagugugccucaguguugcagugugaauuaaagacuggggagagcugug

SEQ ID NO: 55713 - RNA, 64 nt, Homo Sapiens
aauggcaucuaggaagguaaggagguggagggacagugugaauaauggggaauguggggaucag

SEQ ID NO: 55714 - RNA, 64 nt, Homo Sapiens
cuaggucagaagcugcuuuugaacgccaccgccuagugugaauguuguuaaauguucagcagga

SEQ ID NO: 55715 - RNA, 64 nt, Homo Sapiens
uaauaucacacaaagcauguauauccuguguuugagugugaaguuuuauuaauacuucccuagg

SEQ ID NO: 55716 - RNA, 64 nt, Homo Sapiens
gccucaacagcugcccuugaggagcacaggcagaagugugaacuugugaauguaauugaucuuu

SEQ ID NO: 55717 - RNA, 64 nt, Homo Sapiens
ucaagcagcuuucucuggaaaaugaaugcuaauuagugugaaccaaaagaguaaguaagagucu

SEQ ID NO: 55718 - RNA, 64 nt, Homo Sapiens
acacucagcccgcccucuggcgauucaggacccaagugugaacagucucuguaccuuacaacag

SEQ ID NO: 55719 - RNA, 64 nt, Homo Sapiens
guaugugagaacuuuuguuugaaaaguaugaaugagugugaaguggcuuucucgguucucagag

SEQ ID NO: 55720 - RNA, 64 nt, Homo Sapiens
cacuggcacaguguguguaaauauguacaucaguagugugaaucgcacauaccaugcggauuuu

SEQ ID NO: 55721 - RNA, 64 nt, Homo Sapiens
aauccuuuugugcuguguuuguuuuuuuuucaguagugugaauuugcaaguaggguccuauuau

SEQ ID NO: 55722 - RNA, 64 nt, Homo Sapiens
cugaggccagggacgucacccaaggcugguggucagugugaagggcuccgugccaacuggucag

SEQ ID NO: 55723 - RNA, 64 nt, Homo Sapiens
agccgagaguucgccccaacccuuccccaggcccagugugaaaaacagacucacaaggggcuuc

SEQ ID NO: 55724 - RNA, 64 nt, Homo Sapiens
uuuuauacagaaaauggaaagagauggacagauaagugugaaugccuggucugaucagugcuau

SEQ ID NO: 55725 - RNA, 64 nt, Homo Sapiens
gcacauuuaggaagguuacacauuggcuuguccgagugugaaauuaaaaaaaaaaaaaaaacuu

SEQ ID NO: 55726 - RNA, 64 nt, Homo Sapiens
cuaaaauaggaguaaagcaugcacuacuuguugaagugugaaauggagacucuggacuuugggu

SEQ ID NO: 55727 - RNA, 64 nt, Homo Sapiens
auguaucuuugcacucuugugcuaguaugucuauagugugaauacauucauaaauuucuugauc

SEQ ID NO: 55728 - RNA, 64 nt, Homo Sapiens
cauaagaacauucauacugaagaggaacccuaugagugugaagaauauggcaaagccuucaaca

SEQ ID NO: 55729 - RNA, 64 nt, Homo Sapiens
gguaagauaguucauacugaagaaaacuucuacaagugugaacaguguggcaaaacuuuuaaug

SEQ ID NO: 55730 - RNA, 64 nt, Homo Sapiens
uuuuuaucuuggggaccagcuaagucucugcaguagugugaaauuccaaaugguuguuuuauca

SEQ ID NO: 55731 - RNA, 64 nt, Homo Sapiens
cccaacuucugagucgcccaucuguugcugugggagugugaacggaucgcugaaggagagggag

SEQ ID NO: 55732 - RNA, 64 nt, Homo Sapiens
caguugugugcaauagacaggggcguauucaugggagcaucagccaguuucuaaaacccacagg

SEQ ID NO: 55733 - RNA, 64 nt, Homo Sapiens
ccgagaugcugacguugcugagcaacgagauggugagcaucagugcaaaugcaccauucagcac

SEQ ID NO: 55734 - RNA, 64 nt, Homo Sapiens
agugacaagucucgggugagcuaaaugagucacugagcaucacuaaaaugaaccugcaagccuu

SEQ ID NO: 55735 - RNA, 64 nt, Homo Sapiens
gggcugauggauuccaaaccuugcacaaacuugugagcaucagaagucuuuucaguuucaucau

SEQ ID NO: 55736 - RNA, 64 nt, Homo Sapiens
agagucaaaggcaucucccuucauuagcugcucugagcaucaagaauuagaagucuuucagugg

SEQ ID NO: 55737 - RNA, 64 nt, Homo Sapiens
cauccccacuagguucuuuuccauugucaauaaggagcaucagccagugaaucuguuucagguu

SEQ ID NO: 55738 - RNA, 64 nt, Homo Sapiens; identical to SEQ ID NO: 24993

SEQ ID NO: 55739 - RNA, 64 nt, Homo Sapiens; identical to SEQ ID NO: 24994

SEQ ID NO: 55740 - RNA, 64 nt, Homo Sapiens; identical to SEQ ID NO: 24995

SEQ ID NO: 55741 - RNA, 64 nt, Homo Sapiens; identical to SEQ ID NO: 24996

SEQ ID NO: 55742 - RNA, 64 nt, Homo Sapiens; identical to SEQ ID NO: 24997

SEQ ID NO: 55743 - RNA, 64 nt, Homo Sapiens; identical to SEQ ID NO: 24998

SEQ ID NO: 55744 - RNA, 64 nt, Homo Sapiens; identical to SEQ ID NO: 24999

SEQ ID NO: 55745 - RNA, 64 nt, Homo Sapiens; identical to SEQ ID NO: 25000

SEQ ID NO: 55746 - RNA, 64 nt, Homo Sapiens; identical to SEQ ID NO: 25001

SEQ ID NO: 55747 - RNA, 64 nt, Homo Sapiens; identical to SEQ ID NO: 25002

SEQ ID NO: 55748 - RNA, 64 nt, Homo Sapiens; identical to SEQ ID NO: 25003

SEQ ID NO: 55749 - RNA, 64 nt, Homo Sapiens; identical to SEQ ID NO: 25004

SEQ ID NO: 55750 - RNA, 64 nt, Homo Sapiens; identical to SEQ ID NO: 25005

SEQ ID NO: 55751 - RNA, 64 nt, Homo Sapiens; identical to SEQ ID NO: 25006

SEQ ID NO: 55752 - RNA, 64 nt, Homo Sapiens; identical to SEQ ID NO: 25007

SEQ ID NO: 55753 - RNA, 64 nt, Homo Sapiens; identical to SEQ ID NO: 25008

SEQ ID NO: 55754 - RNA, 64 nt, Homo Sapiens; identical to SEQ ID NO: 25009

SEQ ID NO: 55755 - RNA, 64 nt, Homo Sapiens; identical to SEQ ID NO: 25010

SEQ ID NO: 55756 - RNA, 64 nt, Homo Sapiens; identical to SEQ ID NO: 25011

SEQ ID NO: 55757 - RNA, 64 nt, Homo Sapiens; identical to SEQ ID NO: 25012

SEQ ID NO: 55758 - RNA, 64 nt, Homo Sapiens; identical to SEQ ID NO: 25013

SEQ ID NO: 55759 - RNA, 64 nt, Homo Sapiens; identical to SEQ ID NO: 25014

SEQ ID NO: 55760 - RNA, 64 nt, Homo Sapiens; identical to SEQ ID NO: 25015

SEQ ID NO: 55761 - RNA, 64 nt, Homo Sapiens; identical to SEQ ID NO: 25016

SEQ ID NO: 55762 - RNA, 64 nt, Homo Sapiens; identical to SEQ ID NO: 25017

SEQ ID NO: 55763 - RNA, 64 nt, Homo Sapiens; identical to SEQ ID NO: 25018

SEQ ID NO: 55764 - RNA, 64 nt, Homo Sapiens; identical to SEQ ID NO: 25019

SEQ ID NO: 55765 - RNA, 64 nt, Homo Sapiens; identical to SEQ ID NO: 25020

SEQ ID NO: 55766 - RNA, 64 nt, Homo Sapiens; identical to SEQ ID NO: 25021

SEQ ID NO: 55767 - RNA, 64 nt, Homo Sapiens; identical to SEQ ID NO: 25022

SEQ ID NO: 55768 - RNA, 64 nt, Homo Sapiens; identical to SEQ ID NO: 25023

SEQ ID NO: 55769 - RNA, 64 nt, Homo Sapiens; identical to SEQ ID NO: 25024

SEQ ID NO: 55770 - RNA, 64 nt, Homo Sapiens; identical to SEQ ID NO: 25025

SEQ ID NO: 55771 - RNA, 64 nt, Homo Sapiens; identical to SEQ ID NO: 25026

SEQ ID NO: 55772 - RNA, 64 nt, Homo Sapiens; identical to SEQ ID NO: 25027

SEQ ID NO: 55773 - RNA, 64 nt, Homo Sapiens; identical to SEQ ID NO: 25028

SEQ ID NO: 55774 - RNA, 64 nt, Homo Sapiens; identical to SEQ ID NO: 25029

SEQ ID NO: 55775 - RNA, 64 nt, Homo Sapiens; identical to SEQ ID NO: 25030

SEQ ID NO: 55776 - RNA, 64 nt, Homo Sapiens; identical to SEQ ID NO: 25031

SEQ ID NO: 55777 - RNA, 64 nt, Homo Sapiens; identical to SEQ ID NO: 25032

SEQ ID NO: 55778 - RNA, 64 nt, Homo Sapiens; identical to SEQ ID NO: 25033

SEQ ID NO: 55779 - RNA, 64 nt, Homo Sapiens; identical to SEQ ID NO: 25034

SEQ ID NO: 55780 - RNA, 64 nt, Homo Sapiens; identical to SEQ ID NO: 25035

SEQ ID NO: 55781 - RNA, 64 nt, Homo Sapiens; identical to SEQ ID NO: 25036

SEQ ID NO: 55782 - RNA, 64 nt, Homo Sapiens; identical to SEQ ID NO: 25037

SEQ ID NO: 55783 - RNA, 64 nt, Homo Sapiens; identical to SEQ ID NO: 25038

SEQ ID NO: 55784 - RNA, 64 nt, Homo Sapiens; identical to SEQ ID NO: 25039

SEQ ID NO: 55785 - RNA, 64 nt, Homo Sapiens; identical to SEQ ID NO: 25040

SEQ ID NO: 55786 - RNA, 64 nt, Homo Sapiens; identical to SEQ ID NO: 25041

SEQ ID NO: 55787 - RNA, 64 nt, Homo Sapiens; identical to SEQ ID NO: 25042

SEQ ID NO: 55788 - RNA, 64 nt, Homo Sapiens; identical to SEQ ID NO: 25043

SEQ ID NO: 55789 - RNA, 64 nt, Homo Sapiens; identical to SEQ ID NO: 25044

SEQ ID NO: 55790 - RNA, 64 nt, Homo Sapiens; identical to SEQ ID NO: 25045

SEQ ID NO: 55791 - RNA, 64 nt, Homo Sapiens; identical to SEQ ID NO: 25046

SEQ ID NO: 55792 - RNA, 64 nt, Homo Sapiens; identical to SEQ ID NO: 25047

SEQ ID NO: 55793 - RNA, 64 nt, Homo Sapiens; identical to SEQ ID NO: 25048

SEQ ID NO: 55794 - RNA, 64 nt, Homo Sapiens; identical to SEQ ID NO: 25049

SEQ ID NO: 55795 - RNA, 64 nt, Homo Sapiens; identical to SEQ ID NO: 25050

SEQ ID NO: 55796 - RNA, 64 nt, Homo Sapiens; identical to SEQ ID NO: 25051

SEQ ID NO: 55797 - RNA, 64 nt, Homo Sapiens; identical to SEQ ID NO: 25052

SEQ ID NO: 55798 - RNA, 64 nt, Homo Sapiens; identical to SEQ ID NO: 25053

SEQ ID NO: 55799 - RNA, 64 nt, Homo Sapiens; identical to SEQ ID NO: 25054

SEQ ID NO: 55800 - RNA, 64 nt, Homo Sapiens; identical to SEQ ID NO: 25055

SEQ ID NO: 55801 - RNA, 64 nt, Homo Sapiens; identical to SEQ ID NO: 25056

SEQ ID NO: 55802 - RNA, 64 nt, Homo Sapiens; identical to SEQ ID NO: 25057

SEQ ID NO: 55803 - RNA, 64 nt, Homo Sapiens; identical to SEQ ID NO: 25058

SEQ ID NO: 55804 - RNA, 64 nt, Homo Sapiens; identical to SEQ ID NO: 25059

SEQ ID NO: 55805 - RNA, 64 nt, Homo Sapiens; identical to SEQ ID NO: 25060

SEQ ID NO: 55806 - RNA, 64 nt, Homo Sapiens; identical to SEQ ID NO: 25061

SEQ ID NO: 55807 - RNA, 64 nt, Homo Sapiens; identical to SEQ ID NO: 25062

SEQ ID NO: 55808 - RNA, 64 nt, Homo Sapiens; identical to SEQ ID NO: 25063

SEQ ID NO: 55809 - RNA, 64 nt, Homo Sapiens; identical to SEQ ID NO: 25064

SEQ ID NO: 55810 - RNA, 64 nt, Homo Sapiens; identical to SEQ ID NO: 25065

SEQ ID NO: 55811 - RNA, 64 nt, Homo Sapiens; identical to SEQ ID NO: 25066

SEQ ID NO: 55812 - RNA, 64 nt, Homo Sapiens; identical to SEQ ID NO: 25067

SEQ ID NO: 55813 - RNA, 64 nt, Homo Sapiens; identical to SEQ ID NO: 25068

SEQ ID NO: 55814 - RNA, 64 nt, Homo Sapiens; identical to SEQ ID NO: 25069

SEQ ID NO: 55815 - RNA, 64 nt, Homo Sapiens; identical to SEQ ID NO: 25070

SEQ ID NO: 55816 - RNA, 64 nt, Homo Sapiens; identical to SEQ ID NO: 25071

SEQ ID NO: 55817 - RNA, 64 nt, Homo Sapiens; identical to SEQ ID NO: 25072

SEQ ID NO: 55818 - RNA, 64 nt, Homo Sapiens; identical to SEQ ID NO: 25073

SEQ ID NO: 55819 - RNA, 64 nt, Homo Sapiens; identical to SEQ ID NO: 25074

SEQ ID NO: 55820 - RNA, 64 nt, Homo Sapiens; identical to SEQ ID NO: 25075

SEQ ID NO: 55821 - RNA, 64 nt, Homo Sapiens; identical to SEQ ID NO: 25076

SEQ ID NO: 55822 - RNA, 64 nt, Homo Sapiens; identical to SEQ ID NO: 25077

SEQ ID NO: 55823 - RNA, 64 nt, Homo Sapiens; identical to SEQ ID NO: 25078

SEQ ID NO: 55824 - RNA, 64 nt, Homo Sapiens; identical to SEQ ID NO: 25079

SEQ ID NO: 55825 - RNA, 64 nt, Homo Sapiens; identical to SEQ ID NO: 25080

SEQ ID NO: 55826 - RNA, 64 nt, Homo Sapiens; identical to SEQ ID NO: 25081

SEQ ID NO: 55827 - RNA, 64 nt, Homo Sapiens; identical to SEQ ID NO: 25082

SEQ ID NO: 55828 - RNA, 64 nt, Homo Sapiens; identical to SEQ ID NO: 25083

SEQ ID NO: 55829 - RNA, 64 nt, Homo Sapiens; identical to SEQ ID NO: 25084

SEQ ID NO: 55830 - RNA, 64 nt, Homo Sapiens; identical to SEQ ID NO: 25085

SEQ ID NO: 55831 - RNA, 64 nt, Homo Sapiens; identical to SEQ ID NO: 25086

SEQ ID NO: 55832 - RNA, 64 nt, Homo Sapiens; identical to SEQ ID NO: 25087

SEQ ID NO: 55833 - RNA, 64 nt, Homo Sapiens; identical to SEQ ID NO: 25088

SEQ ID NO: 55834 - RNA, 64 nt, Homo Sapiens; identical to SEQ ID NO: 25089

SEQ ID NO: 55835 - RNA, 64 nt, Homo Sapiens; identical to SEQ ID NO: 25090

SEQ ID NO: 55836 - RNA, 64 nt, Homo Sapiens; identical to SEQ ID NO: 25091

SEQ ID NO: 55837 - RNA, 64 nt, Homo Sapiens; identical to SEQ ID NO: 25092

SEQ ID NO: 55838 - RNA, 64 nt, Homo Sapiens; identical to SEQ ID NO: 25093

SEQ ID NO: 55839 - RNA, 64 nt, Homo Sapiens; identical to SEQ ID NO: 25094

SEQ ID NO: 55840 - RNA, 64 nt, Homo Sapiens; identical to SEQ ID NO: 25095

SEQ ID NO: 55841 - RNA, 64 nt, Homo Sapiens; identical to SEQ ID NO: 25096

SEQ ID NO: 55842 - RNA, 64 nt, Homo Sapiens; identical to SEQ ID NO: 25097

SEQ ID NO: 55843 - RNA, 64 nt, Homo Sapiens; identical to SEQ ID NO: 25098

SEQ ID NO: 55844 - RNA, 64 nt, Homo Sapiens; identical to SEQ ID NO: 25099

SEQ ID NO: 55845 - RNA, 64 nt, Homo Sapiens; identical to SEQ ID NO: 25100

SEQ ID NO: 55846 - RNA, 64 nt, Homo Sapiens; identical to SEQ ID NO: 25101

SEQ ID NO: 55847 - RNA, 64 nt, Homo Sapiens; identical to SEQ ID NO: 25102

SEQ ID NO: 55848 - RNA, 64 nt, Homo Sapiens; identical to SEQ ID NO: 25103

SEQ ID NO: 55849 - RNA, 64 nt, Homo Sapiens; identical to SEQ ID NO: 25104

SEQ ID NO: 55850 - RNA, 64 nt, Homo Sapiens; identical to SEQ ID NO: 25105

SEQ ID NO: 55851 - RNA, 64 nt, Homo Sapiens; identical to SEQ ID NO: 25106

SEQ ID NO: 55852 - RNA, 64 nt, Homo Sapiens; identical to SEQ ID NO: 25107

SEQ ID NO: 55853 - RNA, 64 nt, Homo Sapiens; identical to SEQ ID NO: 25108

SEQ ID NO: 55854 - RNA, 64 nt, Homo Sapiens; identical to SEQ ID NO: 25109

SEQ ID NO: 55855 - RNA, 64 nt, Homo Sapiens; identical to SEQ ID NO: 25110

SEQ ID NO: 55856 - RNA, 64 nt, Homo Sapiens; identical to SEQ ID NO: 25111

SEQ ID NO: 55857 - RNA, 64 nt, Homo Sapiens; identical to SEQ ID NO: 25112

SEQ ID NO: 55858 - RNA, 64 nt, Homo Sapiens; identical to SEQ ID NO: 25113

SEQ ID NO: 55859 - RNA, 64 nt, Homo Sapiens; identical to SEQ ID NO: 25114

SEQ ID NO: 55860 - RNA, 64 nt, Homo Sapiens; identical to SEQ ID NO: 25115

SEQ ID NO: 55861 - RNA, 64 nt, Homo Sapiens; identical to SEQ ID NO: 25116

SEQ ID NO: 55862 - RNA, 64 nt, Homo Sapiens; identical to SEQ ID NO: 25117

SEQ ID NO: 55863 - RNA, 64 nt, Homo Sapiens; identical to SEQ ID NO: 25118

SEQ ID NO: 55864 - RNA, 64 nt, Homo Sapiens; identical to SEQ ID NO: 25119

SEQ ID NO: 55865 - RNA, 64 nt, Homo Sapiens; identical to SEQ ID NO: 25120

SEQ ID NO: 55866 - RNA, 64 nt, Homo Sapiens; identical to SEQ ID NO: 25121

SEQ ID NO: 55867 - RNA, 64 nt, Homo Sapiens; identical to SEQ ID NO: 25122

SEQ ID NO: 55868 - RNA, 64 nt, Homo Sapiens; identical to SEQ ID NO: 25123

SEQ ID NO: 55869 - RNA, 64 nt, Homo Sapiens; identical to SEQ ID NO: 25124

SEQ ID NO: 55870 - RNA, 64 nt, Homo Sapiens; identical to SEQ ID NO: 25125

SEQ ID NO: 55871 - RNA, 64 nt, Homo Sapiens; identical to SEQ ID NO: 25126

SEQ ID NO: 55872 - RNA, 64 nt, Homo Sapiens; identical to SEQ ID NO: 25127

SEQ ID NO: 55873 - RNA, 64 nt, Homo Sapiens; identical to SEQ ID NO: 25128

SEQ ID NO: 55874 - RNA, 64 nt, Homo Sapiens; identical to SEQ ID NO: 25129

SEQ ID NO: 55875 - RNA, 64 nt, Homo Sapiens; identical to SEQ ID NO: 25130

SEQ ID NO: 55876 - RNA, 64 nt, Homo Sapiens; identical to SEQ ID NO: 25131

SEQ ID NO: 55877 - RNA, 64 nt, Homo Sapiens; identical to SEQ ID NO: 25132

SEQ ID NO: 55878 - RNA, 64 nt, Homo Sapiens; identical to SEQ ID NO: 25133

SEQ ID NO: 55879 - RNA, 64 nt, Homo Sapiens; identical to SEQ ID NO: 25134

SEQ ID NO: 55880 - RNA, 64 nt, Homo Sapiens; identical to SEQ ID NO: 25135

SEQ ID NO: 55881 - RNA, 64 nt, Homo Sapiens; identical to SEQ ID NO: 25136

SEQ ID NO: 55882 - RNA, 64 nt, Homo Sapiens; identical to SEQ ID NO: 25137

SEQ ID NO: 55883 - RNA, 64 nt, Homo Sapiens; identical to SEQ ID NO: 25138

SEQ ID NO: 55884 - RNA, 64 nt, Homo Sapiens; identical to SEQ ID NO: 25139

SEQ ID NO: 55885 - RNA, 64 nt, Homo Sapiens; identical to SEQ ID NO: 25140

SEQ ID NO: 55886 - RNA, 64 nt, Homo Sapiens; identical to SEQ ID NO: 25141

SEQ ID NO: 55887 - RNA, 64 nt, Homo Sapiens; identical to SEQ ID NO: 25142

SEQ ID NO: 55888 - RNA, 64 nt, Homo Sapiens; identical to SEQ ID NO: 25143

SEQ ID NO: 55889 - RNA, 64 nt, Homo Sapiens; identical to SEQ ID NO: 25144

SEQ ID NO: 55890 - RNA, 64 nt, Homo Sapiens; identical to SEQ ID NO: 25145

SEQ ID NO: 55891 - RNA, 64 nt, Homo Sapiens; identical to SEQ ID NO: 25146

SEQ ID NO: 55892 - RNA, 64 nt, Homo Sapiens; identical to SEQ ID NO: 25147

SEQ ID NO: 55893 - RNA, 64 nt, Homo Sapiens; identical to SEQ ID NO: 25148

SEQ ID NO: 55894 - RNA, 64 nt, Homo Sapiens; identical to SEQ ID NO: 25149

SEQ ID NO: 55895 - RNA, 64 nt, Homo Sapiens; identical to SEQ ID NO: 25150

SEQ ID NO: 55896 - RNA, 64 nt, Homo Sapiens; identical to SEQ ID NO: 25151

SEQ ID NO: 55897 - RNA, 64 nt, Homo Sapiens; identical to SEQ ID NO: 25152

SEQ ID NO: 55898 - RNA, 64 nt, Homo Sapiens; identical to SEQ ID NO: 25153

SEQ ID NO: 55899 - RNA, 64 nt, Homo Sapiens; identical to SEQ ID NO: 25154

SEQ ID NO: 55900 - RNA, 64 nt, Homo Sapiens; identical to SEQ ID NO: 25155

SEQ ID NO: 55901 - RNA, 64 nt, Homo Sapiens; identical to SEQ ID NO: 25156

SEQ ID NO: 55902 - RNA, 64 nt, Homo Sapiens; identical to SEQ ID NO: 25157

SEQ ID NO: 55903 - RNA, 64 nt, Homo Sapiens; identical to SEQ ID NO: 25158

SEQ ID NO: 55904 - RNA, 64 nt, Homo Sapiens; identical to SEQ ID NO: 25159

SEQ ID NO: 55905 - RNA, 64 nt, Homo Sapiens; identical to SEQ ID NO: 25160

SEQ ID NO: 55906 - RNA, 64 nt, Homo Sapiens; identical to SEQ ID NO: 25161

SEQ ID NO: 55907 - RNA, 64 nt, Homo Sapiens; identical to SEQ ID NO: 25162

SEQ ID NO: 55908 - RNA, 64 nt, Homo Sapiens; identical to SEQ ID NO: 25163

SEQ ID NO: 55909 - RNA, 64 nt, Homo Sapiens; identical to SEQ ID NO: 25164

SEQ ID NO: 55910 - RNA, 64 nt, Homo Sapiens; identical to SEQ ID NO: 25165

SEQ ID NO: 55911 - RNA, 64 nt, Homo Sapiens; identical to SEQ ID NO: 25166

SEQ ID NO: 55912 - RNA, 64 nt, Homo Sapiens; identical to SEQ ID NO: 25167

SEQ ID NO: 55913 - RNA, 64 nt, Homo Sapiens; identical to SEQ ID NO: 25168

SEQ ID NO: 55914 - RNA, 64 nt, Homo Sapiens; identical to SEQ ID NO: 25169

SEQ ID NO: 55915 - RNA, 64 nt, Homo Sapiens; identical to SEQ ID NO: 25170

SEQ ID NO: 55916 - RNA, 64 nt, Homo Sapiens; identical to SEQ ID NO: 25171

SEQ ID NO: 55917 - RNA, 64 nt, Homo Sapiens; identical to SEQ ID NO: 25172

SEQ ID NO: 55918 - RNA, 64 nt, Homo Sapiens; identical to SEQ ID NO: 25173

SEQ ID NO: 55919 - RNA, 64 nt, Homo Sapiens; identical to SEQ ID NO: 25174

SEQ ID NO: 55920 - RNA, 56 nt, Homo Sapiens
caauucagucuucagauugaacaagaagggaucagaugccacaucguuuuugucgu

SEQ ID NO: 55921 - RNA, 64 nt, Homo Sapiens
guacuuuauaguaauaaaucugaccagcagagggagggaucaggcagcaguguuuagagcacac

SEQ ID NO: 55922 - RNA, 64 nt, Homo Sapiens
aggguccaaagccgacauucgaaucucaacaaccagggaucaggaaggcuuuugagacacaagg

SEQ ID NO: 55923 - RNA, 64 nt, Homo Sapiens
uccugggugugucagaggccgagcuacacacaggagggaucagcagguucugcaggggaaucug

SEQ ID NO: 55924 - RNA, 64 nt, Homo Sapiens
cugcagagcucacagggcccaggacaccaacgccgcauaggacugcccacaugggaccgcccac

SEQ ID NO: 55925 - RNA, 64 nt, Homo Sapiens
cuggcauuuggacacacaucacaugucgauauuugcauaggagucauuuucaguggaauaacau

SEQ ID NO: 55926 - RNA, 64 nt, Homo Sapiens
agaaucuccuuuggaaggugguucuuggaacaacgcauaggaaaagccugaugccaccuccucu

SEQ ID NO: 55927 - RNA, 64 nt, Homo Sapiens
ugaggacaaggaaauuccucgcaaugcagagagggcauaggaucggaugcugucuucgaggaca

SEQ ID NO: 55928 - RNA, 64 nt, Homo Sapiens
uuuuauuuaaaggaaagaauaugcucacaacuaagcauaggaaggugggaaucccuuuugcuuc

SEQ ID NO: 55929 - RNA, 64 nt, Homo Sapiens
uacauucuagaggaaagguugaauuuuauguugagcauaggaaguauuagaacucuuccuuugc

SEQ ID NO: 55930 - RNA, 64 nt, Homo Sapiens
aaugaguaagaacuggcagagaaauguauaaaaaaccugaaaaaauaauguauguguuguuuaa

SEQ ID NO: 55931 - RNA, 64 nt, Homo Sapiens
ccucuuuagcaaaagccuguuguuuuaauuugaaaccugaaaugcuuuuucacuaaaggucagu

SEQ ID NO: 55932 - RNA, 64 nt, Homo Sapiens
ugcuuggcauuugaguagcuacaaacaaaaacaaaccugaaaacaagaaaaauauaaaaguaaa

SEQ ID NO: 55933 - RNA, 64 nt, Homo Sapiens
auaauggauuaauuccucaaaggaagagcagaacaccugaaaaucagcaauuuccugacaacga

SEQ ID NO: 55934 - RNA, 64 nt, Homo Sapiens
augauggauuaauuccuccaaggaagagcagaacaccugaaagccagcaauuuccugacacuga

SEQ ID NO: 55935 - RNA, 64 nt, Homo Sapiens
augauugaaugggaaaaagauucuguaauagaaaaccugaaacguuuauuggaugugauggacg

SEQ ID NO: 55936 - RNA, 64 nt, Homo Sapiens
uaaaacaacaggcuuugccauuuuaauucacaucaccugaaaaggaauacugcuaguuucuuaa

SEQ ID NO: 55937 - RNA, 64 nt, Homo Sapiens
cuuaagccuuuuuuuaaguaagagcucucuaaauaccugaaagaucaacuggguaaagccuucc

SEQ ID NO: 55938 - RNA, 64 nt, Homo Sapiens
caaagugaacuggggugggggauucgagaauugaaccugaaaccaagaaaaucuggaugccugu

SEQ ID NO: 55939 - RNA, 64 nt, Homo Sapiens
gcauuuuggcuccggggcauaaccugcaggcagaaccugaaaggaaaaacuguugcuauuuccu

SEQ ID NO: 55940 - RNA, 64 nt, Homo Sapiens
ggaagacuuggugccaccgcacagcgcauuuucuaccugaaauuacccuuugcacacaggggcu

SEQ ID NO: 55941 - RNA, 64 nt, Homo Sapiens
gauggcauuuguucuuauuagugccuagcacacuaccugaaaacauaauuaaaaauaauguaau

SEQ ID NO: 55942 - RNA, 64 nt, Homo Sapiens
ucuuaggaggaauagcucacugggugacuuggcuaccugaaaaauucuucaaacaguaucuugg

SEQ ID NO: 55943 - RNA, 64 nt, Homo Sapiens
acaacaaaauacaacuccuccuuaauaaaaaguuaccugaaauacacugaaauauuaacuguuu

SEQ ID NO: 55944 - RNA, 64 nt, Homo Sapiens
guaaucacugaaauauuaaccuugaguuuugaacaccugaaauuagaguauaaugaugacccuu

SEQ ID NO: 55945 - RNA, 64 nt, Homo Sapiens
uuccaaaaauuguucuuaagaaccuuuuuaguuaaccugaaagaggaguuuugcuuguugauau

SEQ ID NO: 55946 - RNA, 64 nt, Homo Sapiens
agucuuuagaauacuaaauaaucauuguugaacuaccugaaacagagcaguuggucuuaccaga

SEQ ID NO: 55947 - RNA, 64 nt, Homo Sapiens
aaauuguaacaauucaauugaauuuuaaaaugacaccugaaaagauacaucugauauuuucuau

SEQ ID NO: 55948 - RNA, 64 nt, Homo Sapiens
caucuguauuguugcuccuaccuucaaauaugacaccugaaauaauaagucuguuguccagaau

SEQ ID NO: 55949 - RNA, 64 nt, Homo Sapiens
gccacuuucaugcaguuugugggcaaaccugaaaaccugaaaaucccagcaaacguugacuucu

SEQ ID NO: 55950 - RNA, 64 nt, Homo Sapiens
cugaaaaugccacuuucaugugacuucugggcaaaccugaaaacucuccaagcccagcaaacgu

SEQ ID NO: 55951 - RNA, 64 nt, Homo Sapiens
aauagaauuguaaaggaaaagugguacuguuccaaccugaaaugucuguuauaauuagguuauu

SEQ ID NO: 55952 - RNA, 64 nt, Homo Sapiens
guuguagaucagaauuucaccagggaguaaaauuaccugaaaacguaagaaguuuuaaacagcu

SEQ ID NO: 55953 - RNA, 64 nt, Homo Sapiens
cagaacuucacacgugauucuucaagccacacccaccugaaaucaaaccaaaggagugcugugg

SEQ ID NO: 55954 - RNA, 64 nt, Homo Sapiens
uugaaaucucuuagauguggaaauauuuuuucgaaccugaaaaugcagcugguagaauuucaau

SEQ ID NO: 55955 - RNA, 64 nt, Homo Sapiens
aguggacagggaaggccucugacauuuauccaagaccugaaagaugggcaaaagacgggaagca

SEQ ID NO: 55956 - RNA, 64 nt, Homo Sapiens
ggcuccgcggcaggaggagccggugcucuggaagaccugaaagaagcccagguggccacagggc

SEQ ID NO: 55957 - RNA, 64 nt, Homo Sapiens
uuuuaagagacuuacucaauuucaugacuguacuaccugaaacaaagugagaaaggacaggugu

SEQ ID NO: 55958 - RNA, 64 nt, Homo Sapiens
guucugcaaaauuaauugggcagguuaauuguguaccugaaacuuaacaagcaguuuuuggaag

SEQ ID NO: 55959 - RNA, 64 nt, Homo Sapiens
auccaaggaagccaaaccaugaguaucuuuaccuaccugaaaacucaaaaggaacacugcuuca

SEQ ID NO: 55960 - RNA, 64 nt, Homo Sapiens
auucugaaaagccaggaugugcuggcauaaaauaaccugaaaagcccagaagugccucugcugu

SEQ ID NO: 55961 - RNA, 64 nt, Homo Sapiens
uuguuucacaagauuuauaauauagaugguuuuguuugacuaaagaauaaucucauauaacuag

SEQ ID NO: 55962 - RNA, 64 nt, Homo Sapiens
uaacuauuaauuuuucauagaauuauaaaugucauuugacuaugucaaucuguauauauuguac

SEQ ID NO: 55963 - RNA, 64 nt, Homo Sapiens
gucaguguauaaguaaguuggguuuauggugggcuuugacuaugucauuagguggguacaaaac

SEQ ID NO: 55964 - RNA, 64 nt, Homo Sapiens
acuuucucagaauuaccuaaauguuuuguagaguuuugacuaguaaucaaucaaaauuauauaa

SEQ ID NO: 55965 - RNA, 64 nt, Homo Sapiens
cacuuguaacauauucaacguccuguacuccaguuuugacuacgagaucagauuuuggaggugu

SEQ ID NO: 55966 - RNA, 64 nt, Homo Sapiens
uauggcaaugaacugcagcaugcugggacaauuauuugacuacuuuuuuuuguaauauugucaa

SEQ ID NO: 55967 - RNA, 64 nt, Homo Sapiens
caucucaagcaaguuuaaucagcaaguuucgacguuugacuagcacguuugacuagccaucuca

SEQ ID NO: 55968 - RNA, 64 nt, Homo Sapiens
caucucaagcaaguuucgacuuugauuuucgacguuugacuagcgucuaguuaccuacuuuuuc

SEQ ID NO: 55969 - RNA, 64 nt, Homo Sapiens
uuuuucuauucaauuuguauacuuguuuauggaguuugacuaauuagauuuguauuuguuauaa

SEQ ID NO: 55970 - RNA, 64 nt, Homo Sapiens
uuuuucgauuagauuuguauuuggauuuauagaguuugacuaguacuagaauuuuaaaaucaag

SEQ ID NO: 55971 - RNA, 64 nt, Homo Sapiens
aguuagaacuagauuuaacuuuugauuuuugaaguugggguaguugcuuguagaguuguacugc

SEQ ID NO: 55972 - RNA, 64 nt, Homo Sapiens
acgaucacagacacagacauaaaacgaacucugguugggguacuagugggagaaauuagaaaac

SEQ ID NO: 55973 - RNA, 64 nt, Homo Sapiens
ucuucguuucuuaauauguuuuguuuccuucucuuugggguaugauuugguuuggaagagccuc

SEQ ID NO: 55974 - RNA, 64 nt, Homo Sapiens
aaacacuccucccugcccccuggaauauuggaguuugggguauaaauaggacaggacacagagc

SEQ ID NO: 55975 - RNA, 64 nt, Homo Sapiens
ucaaaacuacuagacaaaaaagugagaggauagauuuagaaaacaucagugaugcucagauaaa

SEQ ID NO: 55976 - RNA, 64 nt, Homo Sapiens
aggaaaauauuauuaaauuuauaucccuaaaauuuuuagaaaucucucaaaaucuuuccaaaug

SEQ ID NO: 55977 - RNA, 64 nt, Homo Sapiens
uucuaccuguauaugguaauuuugucacgucauuuuuagaaauguaaaaaauuuuuaagaauug

SEQ ID NO: 55978 - RNA, 64 nt, Homo Sapiens
uauugguagcagggauguuuuagucaguuuuguauuuagaaaugcacagaaguaacaaauaugg

SEQ ID NO: 55979 - RNA, 64 nt, Homo Sapiens
ggcacacuccuauagucccaacuucaacagccuuuuuagaaauucacuuuuagaucaagaaaac

SEQ ID NO: 55980 - RNA, 64 nt, Homo Sapiens
gcaacuauaucuauauguggauuaauguuucuuguuuagaaaauuucuaacaguauuacugaau

SEQ ID NO: 55981 - RNA, 64 nt, Homo Sapiens
caguucuaaggaaagaguuguuauuaagcuauucuuuagaaauuuuuauagaauaauaugaauu

SEQ ID NO: 55982 - RNA, 64 nt, Homo Sapiens
caggugcuuaaaaaauaugucuuuuuauugguauuuuagaaacuaauucuagugucauguuuua

SEQ ID NO: 55983 - RNA, 64 nt, Homo Sapiens
uuaagaaguuauaguuaaacgacuuuucaggagauuuagaaagccuuaugcacucuuuguguuu

SEQ ID NO: 55984 - RNA, 64 nt, Homo Sapiens
ugucauguugauuuuccuuaugaacccgaagccauuuagaaaaucccugugugucaaaauuaca

SEQ ID NO: 55985 - RNA, 64 nt, Homo Sapiens
augaaagcauacuguugaaacccgcaguguugcauuuagaaaacaguugaacagaaugucaaug

SEQ ID NO: 55986 - RNA, 64 nt, Homo Sapiens
cauucaugcaaaaaaacauuuaaucugcaucuguuuuagaaaagggggaaaugaagcaacuugu

SEQ ID NO: 55987 - RNA, 64 nt, Homo Sapiens
uuuugauacuuucuauuuuuuuggucaaaucauguuuagaaacuuuggaugaguuaagaagucu

SEQ ID NO: 55988 - RNA, 64 nt, Homo Sapiens
uggaagugggugggguuaugaaauuguagauguuuuuagaaaaacuugugaaugaaaaugaauc

SEQ ID NO: 55989 - RNA, 64 nt, Homo Sapiens
aguuaaaauggugcauuauguauauauauuauaauuuagaaauaccauuuuauaauuuuacuau

SEQ ID NO: 55990 - RNA, 64 nt, Homo Sapiens
aauugccaauacuucuacauuugagaaggguuuuuuuagaaauacauuuaguaaaguccccaag

SEQ ID NO: 55991 - RNA, 64 nt, Homo Sapiens
gguugaauaaagcuuauucuuuguccauguguauuuuagaaauaguaacuucuaaagagucugg

SEQ ID NO: 55992 - RNA, 64 nt, Homo Sapiens
agaauaagucccuuuuuguauguguuuuuauacuuuuagaaaauaaaaacuuuagauuaacuca

SEQ ID NO: 55993 - RNA, 64 nt, Homo Sapiens
cugguuugugcugguuuaacgacaucuaagaagguuuagaaauggugagaccaaaacaauaacu

SEQ ID NO: 55994 - RNA, 64 nt, Homo Sapiens
acuuguaacaguagaaaauagaagucauucuuauuuuagaaaaagugacagaagcaguccagua

SEQ ID NO: 55995 - RNA, 64 nt, Homo Sapiens
ugaauugaaguuucaaguuuuguaugcauucacauuuagaaaagagcauaaagcucaaaugaaa

SEQ ID NO: 55996 - RNA, 64 nt, Homo Sapiens
uucacaucuucggagaugagaggcaagcugaaauuuuagaaauaacuugccaauaagaagcaag

SEQ ID NO: 55997 - RNA, 64 nt, Homo Sapiens
gaauuguucacuacaauuagguguuuccuugcccuuuagaaaauuccaucucugcaagcucccu

SEQ ID NO: 55998 - RNA, 64 nt, Homo Sapiens
gaacauuagccacgagccauccucgguaaguauguuuagaaauaggguucacuuccucgugagc

SEQ ID NO: 55999 - RNA, 64 nt, Homo Sapiens
gaaaaugugaagagugacuacuuuuacuagcuacuuuagaaauacugaucuuacgaugcccugc

SEQ ID NO: 56000 - RNA, 64 nt, Homo Sapiens
gcaaauaguuaacuuuucauuguuucuauaguaauuuagaaauuuuuauccugucacauguuuc

SEQ ID NO: 56001 - RNA, 64 nt, Homo Sapiens
gcaaauuuguaagcgugucacccgugcauuuaauuuuagaaaugacaacuaggaugucuugaaa

SEQ ID NO: 56002 - RNA, 64 nt, Homo Sapiens
acagcucauuacaauaaaauaaauaaaagagaaauuuagaaaauuuuacuguaugaaaacagga

SEQ ID NO: 56003 - RNA, 64 nt, Homo Sapiens
ugguaaauaaagcaaguauaugaccuguuugccuuuuagaaaauugacugcuugugucuuuuua

SEQ ID NO: 56004 - RNA, 64 nt, Homo Sapiens
aaaacaacauaguuuucugaguugcuuuuuuuguuuuagaaaaaaaauggacacauaugcucau

SEQ ID NO: 56005 - RNA, 64 nt, Homo Sapiens
aucaucaugauguuuuggaguuauuacuguguauuuuagaaaucauucuuuacaguuuugcauu

SEQ ID NO: 56006 - RNA, 64 nt, Homo Sapiens
aagauuuccugccgcuuuuugacaaucuuguguauuuagaaaaauguauuacuugaaaacauga

SEQ ID NO: 56007 - RNA, 64 nt, Homo Sapiens
uuucucugaccagaguacuaauaaauauagaucauuuagaaaaguggucuucuugccucuugua

SEQ ID NO: 56008 - RNA, 64 nt, Homo Sapiens
ggugugagcuaccucaccuggccaaaacaguuuuuuuagaaaugaaguauauuagacaacaaca

SEQ ID NO: 56009 - RNA, 64 nt, Homo Sapiens
cuucauugccuaaguucauuucaaagaauuuguauuuagaaaagguuuauauuauuagugaaaa

SEQ ID NO: 56010 - RNA, 64 nt, Homo Sapiens
uuuuugcaucuuuuuucaaaguuuaaugugaacuuuuagaaaagugauuaauguugcccuaaua

SEQ ID NO: 56011 - RNA, 64 nt, Homo Sapiens
gcugacuauucugcuuccucaggcaacacuaaaguuuagaaagauaucaucaacguucugucac

SEQ ID NO: 56012 - RNA, 64 nt, Homo Sapiens
uaauugauuuccuacuauauucccagcagacacauuuagaaacuaagcuauguuaaccucagug

SEQ ID NO: 56013 - RNA, 64 nt, Homo Sapiens
aaguuuaaagacuuuaaggacaacaauuauuuauuuuagaaaguaaaugucuuuugguuuauuc

SEQ ID NO: 56014 - RNA, 64 nt, Homo Sapiens
auguagcugucaucauuugguguagcugcuuuucuuuagaaaaucucggaugagagguuggaaa

SEQ ID NO: 56015 - RNA, 64 nt, Homo Sapiens
auuagaaaugacucccuuuccaaaugcuaucuuuuuuagaaacuaaaccaaaaagauuugucua

SEQ ID NO: 56016 - RNA, 64 nt, Homo Sapiens
ugguggcacuuauuaauccuucugauucugcaguuuuagaaacuuugucagcaugcacaaugcc

SEQ ID NO: 56017 - RNA, 64 nt, Homo Sapiens
aggaguccagagacuacgcuguauuuuuuguauauuuagaaauauaaaauuauauaauuuaaau

SEQ ID NO: 56018 - RNA, 64 nt, Homo Sapiens
uagucaggaaaaacauucagauggaagguguugcuuuagaaaggggcuguguuagugaaagcac

SEQ ID NO: 56019 - RNA, 64 nt, Homo Sapiens
gguuguuacauaaaacacccgccugagauuuuauuuuagaaaaaaaaaauccagugucacaugg

SEQ ID NO: 56020 - RNA, 64 nt, Homo Sapiens
uauugaagacauuguauuacuauagaaaaauaacuuuagaaaaaaugcuguugucuuauuauua

SEQ ID NO: 56021 - RNA, 64 nt, Homo Sapiens
agaucuagagaacacgucuugaaaaauacagaguuuuagaaauguacuuaaguuuuagaaauga

SEQ ID NO: 56022 - RNA, 64 nt, Homo Sapiens
agaaaaauacagaguuuuaguuggauacuuaaguuuuagaaauguuuuaguaaggucaguuuga

SEQ ID NO: 56023 - RNA, 64 nt, Homo Sapiens
agaugaugauuucagaggagcucauuuucugguuuuuagaaaguuuugaaauuuaaaucacaaa

SEQ ID NO: 56024 - RNA, 64 nt, Homo Sapiens
aaacuguuugucucugguuuaggaauaccacugauuuagaaacaguauucuaaacauuucagcu

SEQ ID NO: 56025 - RNA, 64 nt, Homo Sapiens
uguaucuucguaacuucauauuaauauaaguuucuuuagaaaacccaaguuuuuaaucguuuuu

SEQ ID NO: 56026 - RNA, 64 nt, Homo Sapiens
uuuuuccuguguauuaaaccuuuccauuuuacguuuuagaaaauuuuauguauuuuaaaauaag

SEQ ID NO: 56027 - RNA, 64 nt, Homo Sapiens
uguccuguauccuuuaauuucaggucucaggauguuuagaaagcuaaaacccccuaccccuuuc

SEQ ID NO: 56028 - RNA, 64 nt, Homo Sapiens
guauuuaaaucuugcaagaauauuuugugcuuucuuuagaaacacaagaguauagauuuuucuc

SEQ ID NO: 56029 - RNA, 64 nt, Homo Sapiens
ucuaaucucauuucacaugaaagaagaaguauauuuuagaaauuuguuaaugagaguaaaagaa

SEQ ID NO: 56030 - RNA, 64 nt, Homo Sapiens
cuuuauucgaaaagaggcuuuuaaaaugugcauguuuagaaacaaaauuucuucauggaaauca

SEQ ID NO: 56031 - RNA, 64 nt, Homo Sapiens
aaaaagagauguacaaaucaauaauaauuacacuuuuagaaacuguaucaucaaagauuuucag

SEQ ID NO: 56032 - RNA, 64 nt, Homo Sapiens
auaaaauauugccuccaacaccucuucagaacccuuuagaaaguauccccacucuuccuuauug

SEQ ID NO: 56033 - RNA, 64 nt, Homo Sapiens
uguugcaucaauauauuaugauuuuuauguuuauuuuagaaaacuugucugauggucugggcuc

SEQ ID NO: 56034 - RNA, 64 nt, Homo Sapiens
auuuuuaauuucagcaaguuccguuaaaacuguuuuuagaaagucuguguauaaaauauuuaug

SEQ ID NO: 56035 - RNA, 64 nt, Homo Sapiens
gguuguaaaucugacuucuucaacaaaaaaggcuuuuagaaaauuccuuauuuggaaaaaccaa

SEQ ID NO: 56036 - RNA, 64 nt, Homo Sapiens
cuuagaagaggggugggugccccgaaauacaaguuuuagaaaauuuuuaaaagaggucuuucuc

SEQ ID NO: 56037 - RNA, 64 nt, Homo Sapiens
auucagccauccuagaaacucuaaccauuucugguuuagaaaacuggugcaauaaaguuccuuu

SEQ ID NO: 56038 - RNA, 64 nt, Homo Sapiens
guuuuaucugaauuuuuaaacaaguauuuguuaauuuagaaaacuuuaaagcguuugcacagau

SEQ ID NO: 56039 - RNA, 64 nt, Homo Sapiens
aagcauucagaagaaaaagaagcaaccucaguaauuuagaaaucauuuugcaaucccuuaauau

SEQ ID NO: 56040 - RNA, 64 nt, Homo Sapiens
aucauauuuauacugcuguccaaucuuuucuauauuuagaaauaauaauguacauauuuaucua

SEQ ID NO: 56041 - RNA, 64 nt, Homo Sapiens
aauaucaaagagaaucauagaugaucauuaaauuuuuagaaauucucggaaguuaaggagaagc

SEQ ID NO: 56042 - RNA, 64 nt, Homo Sapiens
uggaaaugauucuuauguuuuuuuuuuuucuccuuuuagaaaauucuccaaaagguuuugaugu

SEQ ID NO: 56043 - RNA, 64 nt, Homo Sapiens
augucauuucaguauuuuugcuggauaaauccauuuuagaaaugucuuacaaaaaguuuagggc

SEQ ID NO: 56044 - RNA, 64 nt, Homo Sapiens
gagcauuuuuuacaacugccagcacuaacuugauuuuagaaaauugaaaaaacuguaaaauuau

SEQ ID NO: 56045 - RNA, 64 nt, Homo Sapiens
agcuauugggcagaaacagaucuacugaaaacaauuuagaaagagucuccauauacuauuuuuu

SEQ ID NO: 56046 - RNA, 64 nt, Homo Sapiens
auauauaaauauauauuguuacugaauguacugauuuagaaaauaagaaaaaaacaaguuaaaa

SEQ ID NO: 56047 - RNA, 64 nt, Homo Sapiens
cuacuauuguaagaguucuuuuaauaguauuuauuuuagaaaguauuuauuuugaagcucuauu

SEQ ID NO: 56048 - RNA, 64 nt, Homo Sapiens
gaugauugcuuuugucuguuuacugaaaaaugaguuuagaaaggcuagcccacugacauuggaa

SEQ ID NO: 56049 - RNA, 64 nt, Homo Sapiens
aauaugucaugcauucuuucuuaugaauuguauauuuagaaaucuuucuaaauaccauuaaggc

SEQ ID NO: 56050 - RNA, 64 nt, Homo Sapiens
ucauucccuuacaaccccaaucuauacauggauuuuuagaaagucuucauggcuaucuauaguu

SEQ ID NO: 56051 - RNA, 64 nt, Homo Sapiens
ccucuagguuaugaaaacuaucuuagaaggugcuuuuagaaagaaccaggagaacaaccaaagc

SEQ ID NO: 56052 - RNA, 64 nt, Homo Sapiens
cucaaaaugaaaguaauggagaaagacacugaaauuuagaaaauuuugucgauuuaaaauauuu

SEQ ID NO: 56053 - RNA, 64 nt, Homo Sapiens
ccuucaguuuuuacucacuagacaauaauucaaguuuagaaacagguaaucagcuauuugaucu

SEQ ID NO: 56054 - RNA, 64 nt, Homo Sapiens
augcauacuuuuaaaacaaggcuuuuauaaagcauuuagaaaaaugguccuuagaaaagacuuu

SEQ ID NO: 56055 - RNA, 64 nt, Homo Sapiens
agcaaguagugcauacccuuuuaagguuugagguuuuagaaauucauuuuaagaugggggaaaa

SEQ ID NO: 56056 - RNA, 64 nt, Homo Sapiens
auuucaaaaugauauucaauauaaaggaaacacguuuagaaaugauuuaauagauaaagugccu

SEQ ID NO: 56057 - RNA, 64 nt, Homo Sapiens
aauuguuuuucugaaaguauucaugauuugcaacuuuagaaagauaauguacuuucauucccuu

SEQ ID NO: 56058 - RNA, 64 nt, Homo Sapiens
ugauguggaaaaucucugaagucagaucucaauuuuuagaaaacucucugaauauaaugaauau

SEQ ID NO: 56059 - RNA, 64 nt, Homo Sapiens
agguuugagugugccuagugccaauauuuuguaauuuagaaauuuuauucacaaacuucuguuu

SEQ ID NO: 56060 - RNA, 64 nt, Homo Sapiens
cauuaggguguguuuuauguuaagcaaaacauacuuuagaaacaaaugaaaaaggcaauugaaa

SEQ ID NO: 56061 - RNA, 64 nt, Homo Sapiens
uuguuaggccacaaaaacacugcacugugaacauuuuagaaaagguaugucagacugggauuaa

SEQ ID NO: 56062 - RNA, 64 nt, Homo Sapiens
caucccaagaaaaucacaucagcauaaaagaauauuuagaaaaaaguaucaagccaugugcuuu

SEQ ID NO: 56063 - RNA, 64 nt, Homo Sapiens
ugguuucaaguguacauguguaagaaaaacaaguuuuagaaauuauguuacaacaacuauuuuu

SEQ ID NO: 56064 - RNA, 64 nt, Homo Sapiens
aaccaaaaaaaaaaaaagauuugggaauggauaauuuagaaacauuuggaauugguuaaccuua

SEQ ID NO: 56065 - RNA, 64 nt, Homo Sapiens
aauugucuaauuaauuuaugauuuugagauuuuauuuagaaauguuacauucaacuuauuguaa

SEQ ID NO: 56066 - RNA, 64 nt, Homo Sapiens
aaauucuaaaaauuugcaagcugggcuucugacuuuuagaaacaauaacuuagucuuuauuuug

SEQ ID NO: 56067 - RNA, 64 nt, Homo Sapiens
agucuuuggugauauuuauuucccccaaaaugcauuuagaaaacuuuucuaagagaaugaauua

SEQ ID NO: 56068 - RNA, 64 nt, Homo Sapiens
uuagcuuugggaaaaguaaugaaaauauaaugguuuuagaaauccuguguuaaauauugcuaua

SEQ ID NO: 56069 - RNA, 64 nt, Homo Sapiens
uuuauuuucaguuccuuuugcaugccuauuuugauuuagaaaucacuuuaagauaaaugaacaa

SEQ ID NO: 56070 - RNA, 64 nt, Homo Sapiens
auuuagguauuuguaugugaaagagaaacacauauuuagaaacacagcaagggagauuuugaau

SEQ ID NO: 56071 - RNA, 64 nt, Homo Sapiens
ucuuugcuuuagaguuaaauauuccuaucuuaaguuuagaaaaauacaaaaaaccauuccaagg

SEQ ID NO: 56072 - RNA, 64 nt, Homo Sapiens
caagagaggaaucuauuucuuucuccugaaacaauuuagaaaauaguuauccauugacuagaaa

SEQ ID NO: 56073 - RNA, 64 nt, Homo Sapiens
gucugaugauugauugauuacuguccagguacauuuuagaaaaaguguucuucuuccaguuugu

SEQ ID NO: 56074 - RNA, 64 nt, Homo Sapiens
ugaaaaaugucucuuucaguuuguucuguaaauauuuagaaaagugacagcugucaaccucaga

SEQ ID NO: 56075 - RNA, 64 nt, Homo Sapiens
aacgggacugguuuucaaaggccguaggugggcuuuuagaaacugacucugauggaaggaaggu

SEQ ID NO: 56076 - RNA, 64 nt, Homo Sapiens
uguuugaauuccccccgcccacugccgucucgucuuuagaaagccccucucccucagaguuuuc

SEQ ID NO: 56077 - RNA, 64 nt, Homo Sapiens
cuguauaaauuacuggugcagcauuuguuuaaauuuuagaaaacuaauagcuauagucucuuca

SEQ ID NO: 56078 - RNA, 64 nt, Homo Sapiens
cacauuucuaaaaaugucauuauuuuuuuuucuuuuuagaaacaaguccacuggcauuuuagug

SEQ ID NO: 56079 - RNA, 64 nt, Homo Sapiens
uuccgcuuaaaaauacuagcgguuuagaaaaaaauuuagaaauaacaaguucucugauuaaauu

SEQ ID NO: 56080 - RNA, 64 nt, Homo Sapiens
aauuuagaaauauuccgcuuucugauuaaauugguuuagaaaaaguuauauuuuaaacaaguuc

SEQ ID NO: 56081 - RNA, 64 nt, Homo Sapiens
acaggaccagcuuguuacaguaauuggacuguaguuuagaaauuuuucuauuacuuaaauguuu

SEQ ID NO: 56082 - RNA, 64 nt, Homo Sapiens
ucugagaguaacacugcauuuaugaaucuaaucauuuagaaaugaaagaaauuaacugcuuauu

SEQ ID NO: 56083 - RNA, 64 nt, Homo Sapiens
cucuagaagaucuguauuguaaacuguaauauccuuuagaaaugucuuuauuccuuaagaccaa

SEQ ID NO: 56084 - RNA, 64 nt, Homo Sapiens
uucaaaaugguuuuuguggcgaaaaaaacaugaauuuagaaauaaaagagugaggauggauuua

SEQ ID NO: 56085 - RNA, 64 nt, Homo Sapiens
aacaugaauuuagaaauauuagagugaggauggauuuagaaaaaccuugaaagaaguauuaaaa

SEQ ID NO: 56086 - RNA, 64 nt, Homo Sapiens
caccacuguauuuugaccaaauaaugacaacuucuuuagaaauuugaauggcuuggugaggaaa

SEQ ID NO: 56087 - RNA, 64 nt, Homo Sapiens
agugguuucauguuaaaaaacaaacuccuaguccuuuagaaauaacagauucucugcacaaaac

SEQ ID NO: 56088 - RNA, 64 nt, Homo Sapiens
gacagcuuauaaaaauaaagaaaagaaaaaacauuuuagaaacgaggaaaagaggcccaagugc

SEQ ID NO: 56089 - RNA, 64 nt, Homo Sapiens
gaaaacgugaacaaacuuaguuuccugguuccguuuuagaaaaguaaaacccaauacagucuag

SEQ ID NO: 56090 - RNA, 64 nt, Homo Sapiens
cgagcgcauccauguccugagaaaaagucugugguuuagaaaauauguccaugguugcccacag

SEQ ID NO: 56091 - RNA, 64 nt, Homo Sapiens
guguucaaaagauuguguaaaaguucaagcccguuuuagaaagccaacauuuuauguuauaaua

SEQ ID NO: 56092 - RNA, 64 nt, Homo Sapiens
gccgacuucuuccaucuauuuaaagauuuagaacuuuagaaaauagcugauuguauuuuaucuc

SEQ ID NO: 56093 - RNA, 64 nt, Homo Sapiens
uuagcacaugcuuuugaaaauaauuuauuuccacuuuagaaaagacuaguccaaaggccaaagc

SEQ ID NO: 56094 - RNA, 64 nt, Homo Sapiens
aaugcagcuuuaccaugaaccgcugcuaucagauuuuagaaauauuuaaacgaucacaauaggc

SEQ ID NO: 56095 - RNA, 64 nt, Homo Sapiens
auccccauuccagcaguagaagggaacaacacgguuuagaaagaagcuccagcuguuugaagag

SEQ ID NO: 56096 - RNA, 64 nt, Homo Sapiens
ugagacuugccgucuggcauuuuuuuaaaacuauuuuagaaaccuacuaugggcuguaaaccug

SEQ ID NO: 56097 - RNA, 64 nt, Homo Sapiens
uuuuuaagagcuaugugaaaccuuugcugucagauuuagaaaugcccagguaucacugugcugu

SEQ ID NO: 56098 - RNA, 64 nt, Homo Sapiens
ggaaauuuuuuaaagaaaauuuugccuuauacauuuuagaaacuauuuugacucuauuaccugu

SEQ ID NO: 56099 - RNA, 64 nt, Homo Sapiens
uccuguguuuacuuauauuuaaauuacauauuaauuuagaaaauguuacuuaaaauaugauuuu

SEQ ID NO: 56100 - RNA, 64 nt, Homo Sapiens
aacaguuugugaacuuacuuauguuagcuuuagcuuuagaaaauuucuaccauagcaaggccua

SEQ ID NO: 56101 - RNA, 64 nt, Homo Sapiens
uaauuucuaauuccggaaugagaaaaaaaugauauuuagaaaguugguaagaggauuuuuuugg

SEQ ID NO: 56102 - RNA, 64 nt, Homo Sapiens
aguucuccggaugggcuguuuguuuuucaaauuauuuagaaauaaacccuaaugguuucuuguu

SEQ ID NO: 56103 - RNA, 64 nt, Homo Sapiens
auguuuaggggaacaugaggcuagaaaucucuaguuuagaaaggcauguugauuuugucuuagu

SEQ ID NO: 56104 - RNA, 64 nt, Homo Sapiens
aaaucauuguguuuuuuaugaauaauauaagugcuuuagaaauuugucuccaaaaccaugccau

SEQ ID NO: 56105 - RNA, 64 nt, Homo Sapiens
uuaggagauaaauuuauuuuauaugaaacaugucuuuagaaaauaaaauaagggauggucaaau

SEQ ID NO: 56106 - RNA, 64 nt, Homo Sapiens
auaauuuuaguuuauauuaauuguuaauucuuauuuuagaaauuuaaaaauacuuaaauuuggu

SEQ ID NO: 56107 - RNA, 64 nt, Homo Sapiens
caaaugauuaguuaaaaaaacuuuuauagacugauuuagaaaaaaagauuuuaaaaguuuuguu

SEQ ID NO: 56108 - RNA, 64 nt, Homo Sapiens
gccaccaauaucuagcuauggaucguguguuuuguuuagaaaucaguagcuugguuuucuuacu

SEQ ID NO: 56109 - RNA, 64 nt, Homo Sapiens
aauuaaauuaauagaaaagagaacaaacugcagguuuagaaaaaugguuuucauauucaccauu

SEQ ID NO: 56110 - RNA, 64 nt, Homo Sapiens
uaaugucugagaggcacuucugucuucuccuuacuuuagaaacagaaaguauccauaccuauug

SEQ ID NO: 56111 - RNA, 64 nt, Homo Sapiens
uuuuuaaagaaaagcuaagcaagagagccaaauuuuuagaaaucugauggucaaaauagcugaa

SEQ ID NO: 56112 - RNA, 64 nt, Homo Sapiens
auucuaauaacaacguaugucauaaauuuauaacuuuagaaauggaaauggagucucaaagcuu

SEQ ID NO: 56113 - RNA, 64 nt, Homo Sapiens
cccacaaacuucacauaucaaaggaagucccuaauuuagaaacacuggaaacgcaaacucuuuu

SEQ ID NO: 56114 - RNA, 64 nt, Homo Sapiens
caguuuguucccucuuuuauuuuacuguuuucuuuuuagaaacccacuguuaaaauuuaaaaag

SEQ ID NO: 56115 - RNA, 64 nt, Homo Sapiens
augugguguuuuuuuuguuuguuuguuuguuuguuuuagaaaaauugggauuuccccccacccc

SEQ ID NO: 56116 - RNA, 64 nt, Homo Sapiens
caccagcacaagagaauuagagcuucagugagaauuuagaaaaauuauacuaaagugagaugca

SEQ ID NO: 56117 - RNA, 64 nt, Homo Sapiens
uaagcaggauguuggccaccaggugccuuucaaauuuagaaacuaauugacuuuagaaagcuga

SEQ ID NO: 56118 - RNA, 64 nt, Homo Sapiens
accaggugccuuucaaauuuagaaacuaauugacuuuagaaagcugacauugccaaaaaggaua

SEQ ID NO: 56119 - RNA, 64 nt, Homo Sapiens
uaguucagaaucugagcaaaugaaaaaaauuucauuuagaaaccuuauuaauauuauacauacu

SEQ ID NO: 56120 - RNA, 64 nt, Homo Sapiens
auuauuuuucccauuauuucuauuucuuguguauuuuagaaacauuauuuuguucagguaggag

SEQ ID NO: 56121 - RNA, 64 nt, Homo Sapiens
uaaaagcaauuaucuuucagugcauaagugaaaauuuagaaaauacauaaaucugccuuuaugu

SEQ ID NO: 56122 - RNA, 64 nt, Homo Sapiens
auuagggugauaggauauucaaaaauccauuucuuuuagaaaaaaauuuauauuugucacuuua

SEQ ID NO: 56123 - RNA, 64 nt, Homo Sapiens
uuguuauauuuucuggaaugauaagugagaauuauuuagaaaagacaugcuccaaaaaaaaaac

SEQ ID NO: 56124 - RNA, 64 nt, Homo Sapiens
ugaugcaguauagucuuaaggguucugcauacauuuuagaaacaucuuagccguaaguuagguc

SEQ ID NO: 56125 - RNA, 64 nt, Homo Sapiens
ucugaugugaauucaaauuuuguacuauugccauuuuagaaagcacuagagaaagucauuugcu

SEQ ID NO: 56126 - RNA, 64 nt, Homo Sapiens
ccauuacuauucuauaaaccauaucaagugaaaauuuagaaaggaaucacuuauaaaauuuuaa

SEQ ID NO: 56127 - RNA, 64 nt, Homo Sapiens
uugccauucuguuuuccauuuuuaacauauuccauuuagaaauuguguuuucgguucuuguacu

SEQ ID NO: 56128 - RNA, 64 nt, Homo Sapiens
aauguggaaugggcuaaacucucuuuagccuuuauuuagaaagauaaaaguaaauuacccuuaa

SEQ ID NO: 56129 - RNA, 64 nt, Homo Sapiens
uuaguuuuuggauuuuuuuuuaauggaccaaauuuuuagaaaaauugaacaugggaggcauuuu

SEQ ID NO: 56130 - RNA, 64 nt, Homo Sapiens
aauaaaaugcaauguguguggggcagaggccucuuuuagaaaaucucauuucauuuuucuaaag

SEQ ID NO: 56131 - RNA, 64 nt, Homo Sapiens
agacaacgucaugcagcccauugcgagagcugaauuuagaaaccuggaauuaagaccaccuaga

SEQ ID NO: 56132 - RNA, 64 nt, Homo Sapiens
acaggaaacuuguuuuuuuaacgucagccagauauuuagaaaauaaccucaaaaguguuuauau

SEQ ID NO: 56133 - RNA, 64 nt, Homo Sapiens
aaccaaaagagguuguuaauuagcacauauuccuuuuagaaaaauguuucagaaaccucagucu

SEQ ID NO: 56134 - RNA, 64 nt, Homo Sapiens
aaacaccaaaccaaaagaagguaggagugccauuuuuagaaaagacacaacuuuaauuccuguc

SEQ ID NO: 56135 - RNA, 64 nt, Homo Sapiens
guauuuaaguguugucuaaacaguugauuuuuacuuuagaaaagaucaucuucaacuguuuauu

SEQ ID NO: 56136 - RNA, 64 nt, Homo Sapiens
cuuugauucaauuuaaaauuuguacuuauuuucuuuuagaaauaauguauugugucugugcaga

SEQ ID NO: 56137 - RNA, 64 nt, Homo Sapiens
uuacucccccucuaaacacugcugcugccuuaauuuuagaaagcagcuuacuaguuuacccuug

SEQ ID NO: 56138 - RNA, 64 nt, Homo Sapiens
uccuacaggagaaaaguuguaugaauguggaaacuuuagaaauugaaggaauuuuucaguucca

SEQ ID NO: 56139 - RNA, 64 nt, Homo Sapiens
cauaagaagaugaaugguagagcaaccugaaggauuuagaaauuacauauaaaucuuugcaguu

SEQ ID NO: 56140 - RNA, 64 nt, Homo Sapiens
aaacacaacaaaauggcuugauaguaguccagacuuuagaaaccauuguuuuacuggcaguucu

SEQ ID NO: 56141 - RNA, 64 nt, Homo Sapiens
uggguuguuugaagaugaaaaaagcuauuuucauuuuagaaaaaacagauauuuucuccauugg

SEQ ID NO: 56142 - RNA, 64 nt, Homo Sapiens
gcugauuugagaacaaaaggggcuaacaccugacuuuagaaaauaguacacacuguuggcaaaa

SEQ ID NO: 56143 - RNA, 64 nt, Homo Sapiens
aaauugcauugcaaagcucuagaauagagugguauuuagaaaauuuguguuuuuguucuuuuga

SEQ ID NO: 56144 - RNA, 64 nt, Homo Sapiens
caggauuuguuuuguuagggggcccauugagguuuuuagaaaaggacugcagugggcucggaua

SEQ ID NO: 56145 - RNA, 64 nt, Homo Sapiens
uuaaguauuuacuuuuuuaacauuuauuuuauucuuuagaaaacauaauuuaagcagagcuuag

SEQ ID NO: 56146 - RNA, 64 nt, Homo Sapiens
caaauuuaggagcuuguucccauugccaaauggauuuagaaauucccuugugagugccugguag

SEQ ID NO: 56147 - RNA, 64 nt, Homo Sapiens
aaguuuacaaccuuauuccaugcugucuuucagauuuagaaaagaucuaauuucugucucagcu

SEQ ID NO: 56148 - RNA, 64 nt, Homo Sapiens
uuuauaaguauguauuacuuuuguaaucagaauuuuuagaaaguauuuugcugauuuaaaggcu

SEQ ID NO: 56149 - RNA, 64 nt, Homo Sapiens
gcugauguggcuaacaaguuuauuuuaagaauuguuuagaaaugcuguugcuucagguucuuaa

SEQ ID NO: 56150 - RNA, 64 nt, Homo Sapiens
aaacaguauuuauuuuuacuuuugugaccacuauuuuagaaacuuuauuuaauauuuuaauguu

SEQ ID NO: 56151 - RNA, 64 nt, Homo Sapiens
cagaauuguuuuugaaagccuaagaacccagcuuuuuagaaaggauuuucacacuggcauuucu

SEQ ID NO: 56152 - RNA, 64 nt, Homo Sapiens
ucuucuggguaguaauuacauugugguauuaauauuuagaaaaauggaccucagcaguguauuu

SEQ ID NO: 56153 - RNA, 64 nt, Homo Sapiens
auauaauuauuaaagauauucuuuuguggaaagcuuuagaaaugaguuaaaaaacuguaauacc

SEQ ID NO: 56154 - RNA, 64 nt, Homo Sapiens
agccuauaaaauaucaccauaaaauuugcaucuguuuagaaacuguggcuuucaucgcuuugua

SEQ ID NO: 56155 - RNA, 64 nt, Homo Sapiens
aauuaaaaaugugaaaucggauaaccuaaaauaauuuagaaaugacaaaguuagaaaucugccg

SEQ ID NO: 56156 - RNA, 64 nt, Homo Sapiens
gacaucagcucuucucuucugcauuuuauuuuccuuuagaaaugagaugccauuguacuuguag

SEQ ID NO: 56157 - RNA, 64 nt, Homo Sapiens
guaauuuuacuuuuaaggaaacagaguugauauuuuuagaaacacugaaagugaggaugaggau

SEQ ID NO: 56158 - RNA, 64 nt, Homo Sapiens
agaugcauguagagcauucuuaggagaccauuguuuuagaaaacuuugauuuguacauguuagu

SEQ ID NO: 56159 - RNA, 64 nt, Homo Sapiens
uuugggagugaccucuagaaaaaagaaaacuguuuuuagaaauacauaaaaucacuuccaaauc

SEQ ID NO: 56160 - RNA, 64 nt, Homo Sapiens
uucuugguauauucuuguguuaacugcccauuggccugaaaauacucauuguaagccugaaaaa

SEQ ID NO: 56161 - RNA, 64 nt, Homo Sapiens
aacugcccauuggccugaaaauacucauuguaagccugaaaaaaaaaaucuuucccacuguuuu

SEQ ID NO: 56162 - RNA, 64 nt, Homo Sapiens
augaguaagaacuggcagaaaaauguauaaaaaaccugaaaaaauaauguauguguuguuuaag

SEQ ID NO: 56163 - RNA, 64 nt, Homo Sapiens
gcuuggcauuugaguagcuucaaacaaaaacaaaccugaaaacuagaaaaauauaaaaguaaaa

SEQ ID NO: 56164 - RNA, 64 nt, Homo Sapiens
aggccagaauggguaaagacugcucaucccuaauccugaaaaacauagacauuauuggcaaaau

SEQ ID NO: 56165 - RNA, 64 nt, Homo Sapiens
guguccuugaagucccuuccccuuugcccuccgcccugaaaaaguucccuuccuuaacucuccc

SEQ ID NO: 56166 - RNA, 64 nt, Homo Sapiens
auggcauuuguucuuauuaaugccuagcacacuaccugaaaacguaauuaaaaauaauguaaug

SEQ ID NO: 56167 - RNA, 64 nt, Homo Sapiens
cuuaggaggaauagcucacagggugacuuggcuaccugaaaaauucuucaaacaguaucuuggu

SEQ ID NO: 56168 - RNA, 64 nt, Homo Sapiens
auguauaaagaaaugagguuccuaugcauugaugccugaaaaauuauauuuuuuaagggaugug

SEQ ID NO: 56169 - RNA, 64 nt, Homo Sapiens
auaaaugugugacuuucaaaaaacaacacccauaccugaaaagacuggggcaaagacacugaug

SEQ ID NO: 56170 - RNA, 64 nt, Homo Sapiens
uggacugagaauuggccuugacauagugcuuuuuccugaaaagcuuuaucuccuauuccucacc

SEQ ID NO: 56171 - RNA, 64 nt, Homo Sapiens
acaccagugauuguuuauugaaagaguuguugcaccugaaaaagggggugcagugaaugaaacu

SEQ ID NO: 56172 - RNA, 64 nt, Homo Sapiens
gaaugacagacaaucuuauguagcaaagauuaugccugaaaaggaaaauuauucagggcagcua

SEQ ID NO: 56173 - RNA, 64 nt, Homo Sapiens
ucuagauuacacugcaccauucccaaguuaauccccugaaaacuuacucucaacuggagcaaau

SEQ ID NO: 56174 - RNA, 64 nt, Homo Sapiens
uuuuguguucuaauuguuuuugagauauaaagacccugaaaaagcccauuuuagaaccuguuua

SEQ ID NO: 56175 - RNA, 64 nt, Homo Sapiens
ggcagccacugcccaccuccccucuacccaggggccugaaaagaggggcugcccuccugcgcca

SEQ ID NO: 56176 - RNA, 64 nt, Homo Sapiens
aggauuuuccaaucucuacaauuuuccugaaaauccugaaaacccaaaaagagauugcucucag

SEQ ID NO: 56177 - RNA, 64 nt, Homo Sapiens
cugaaaaccaggauuuuccaugcucucagauuuuccugaaaaucgagagcuuccaaaaagagau

SEQ ID NO: 56178 - RNA, 64 nt, Homo Sapiens
cuuucacucugauuacccacucacuacaugaaguccugaaaauaacagagaaacuguuauaucu

SEQ ID NO: 56179 - RNA, 64 nt, Homo Sapiens
uuuuaaugauuuauuugcaaguauugagauuugaccugaaaaacaaugaaacacaugaacacac

SEQ ID NO: 56180 - RNA, 64 nt, Homo Sapiens
gcagaguuugaaagcucccaguagaugagagaagccugaaaaagaacccuccuggggcucuggg

SEQ ID NO: 56181 - RNA, 64 nt, Homo Sapiens
acuaauuugcugcuuucugagagccgaauucgguccugaaaaacuggagaugcaggagcugcgg

SEQ ID NO: 56182 - RNA, 64 nt, Homo Sapiens
cacaugaggaaauaggcugucacuaucacauuguccugaaaacagcaucugcuuuccucuuggc

SEQ ID NO: 56183 - RNA, 64 nt, Homo Sapiens
cuguccauugggugcagucauguagaucugaagcccugaaaagccucaugucugcauccccuuu

SEQ ID NO: 56184 - RNA, 64 nt, Homo Sapiens
agagugccaaaugacaucuucccuccacccugccccugaaaaacaguacacacacauccguuca

SEQ ID NO: 56185 - RNA, 64 nt, Homo Sapiens
gcacacagcguuccacugcgggguuucacgcucaccugaaaacaccuguucccaaccuacuucu

SEQ ID NO: 56186 - RNA, 64 nt, Homo Sapiens
ccacuuucaugcaguuuguuggcaaaccugaaaaccugaaaaugccagcaaacguugacuucug

SEQ ID NO: 56187 - RNA, 64 nt, Homo Sapiens
ugaaaaugccacuuucaugcgacuucugggcaaaccugaaaacccuccaagcccagcaaacguu

SEQ ID NO: 56188 - RNA, 64 nt, Homo Sapiens
ugagggacuggaagugaggccuguguugacccuuccugaaaauccucuagcagcccccgacuuc

SEQ ID NO: 56189 - RNA, 64 nt, Homo Sapiens
aucacuaacuccuuccuuuuccucugcaugccagccugaaaauuccaaaucuagccucugaaug

SEQ ID NO: 56190 - RNA, 64 nt, Homo Sapiens
uccaaggaagccaaaccauuaguaucuuuaccuaccugaaaacacaaaaggaacacugcuucag

SEQ ID NO: 56191 - RNA, 64 nt, Homo Sapiens
uucugaaaagccaggaugugcuggcauaaaauaaccugaaaagaccagaagugccucugcugug

SEQ ID NO: 56192 - RNA, 64 nt, Homo Sapiens
gaacagcaggucugugcaguggaacagugcuggcuguggcuagagaggccauuggcucccagag

SEQ ID NO: 56193 - RNA, 64 nt, Homo Sapiens
uuaugugaggacuagaggugguggagaacacaccuguggcuauccugaugggggacaugccgug

SEQ ID NO: 56194 - RNA, 64 nt, Homo Sapiens
guuuuuauagucaauggcuuguucaucauccagauguggcuacugacauaucuacacuucgcac

SEQ ID NO: 56195 - RNA, 64 nt, Homo Sapiens
acauaucuacacuucgcaccggagugucuggaauuguggcuauccugauuauaggauuuuaacu

SEQ ID NO: 56196 - RNA, 64 nt, Homo Sapiens
ucugucccaucacccugagcuguuguugucugacuguggcuaucuacagcacccagcacugugc

SEQ ID NO: 56197 - RNA, 64 nt, Homo Sapiens
gcacccagcacugugcuguucccuuuccacauacuguggcuacacagaggaggggauccaguag

SEQ ID NO: 56198 - RNA, 64 nt, Homo Sapiens
uaaccaaacauuuguguaaauguuuuaucacuaguguggcuaaauugcaguuagaauaugaaua

SEQ ID NO: 56199 - RNA, 64 nt, Homo Sapiens
uuuauacugauuuugauaucauauuuaaguagccuguggcuauuaaaaaauaagucuguuuguc

SEQ ID NO: 56200 - RNA, 64 nt, Homo Sapiens
cuugcgacuccuggcacacaccuccugggaggauccagccaaaugcugugccccaucccccaag

SEQ ID NO: 56201 - RNA, 64 nt, Homo Sapiens
ugugccccaucccccaagccuguccccccuggguccagccaagcgggucagacaucaauguccc

SEQ ID NO: 56202 - RNA, 64 nt, Homo Sapiens
gauguccugaggccugccccugccacgguccgugccagccaauacugcagaacuaggcucccuc

SEQ ID NO: 56203 - RNA, 64 nt, Homo Sapiens
cucuucagccaggccucugucucugaacaagaguccagccaaccaugaucgagguccccaguag

SEQ ID NO: 56204 - RNA, 64 nt, Homo Sapiens
cucaaacagcgcuacuuacucaggaucaguggcaccagccaacucagcuuugggacaaacccag

SEQ ID NO: 56205 - RNA, 64 nt, Homo Sapiens
caguggcaccagccaacucagcuuugggacaaacccagccaagugaccaggacacuuuagugca

SEQ ID NO: 56206 - RNA, 64 nt, Homo Sapiens
cuccugcggcgccuugcccuccuccgaccccuuuccagccaaaguccccccaccccuucagaga

SEQ ID NO: 56207 - RNA, 64 nt, Homo Sapiens
cugucaucuaaccucaguccugccuacugcaguuccagccaaccugcucuuuccugaguucaaa

SEQ ID NO: 56208 - RNA, 64 nt, Homo Sapiens
agggccuggggaaucuguugggaggauguauccuccagccaaucccagccaaucagggccuuga

SEQ ID NO: 56209 - RNA, 64 nt, Homo Sapiens
agggccuugaggaggauguaugcuggagugucucccagccaaucucuucuggccaaucaaggcu

SEQ ID NO: 56210 - RNA, 64 nt, Homo Sapiens
gcccacagggugcaggacuccacugaugagagauccagccaaagagcugcccccagggguauga

SEQ ID NO: 56211 - RNA, 64 nt, Homo Sapiens
ggaguauuugggagagacuggcugcagauccccgccagccaagaugcaagccacucgggaccug

SEQ ID NO: 56212 - RNA, 64 nt, Homo Sapiens
gcaugcaggcagggugugcuugcgccuucauagcccagccaaggugugagcaaacacacacacg

SEQ ID NO: 56213 - RNA, 64 nt, Homo Sapiens
uagugcccaagcagcuaaacuucucccuacacucccagccaaccgcugugaccaccccccaucc

SEQ ID NO: 56214 - RNA, 64 nt, Homo Sapiens
gccaaggucagcuuggcuggcugccucacagaagccagccaagugcuuaugugugggcacucua

SEQ ID NO: 56215 - RNA, 64 nt, Homo Sapiens
uggugcuccagcgcaccuccugggguguccagcaccagccaagcgagagaccugauggccaggg

SEQ ID NO: 56216 - RNA, 64 nt, Homo Sapiens
ucagaguaggcgcccaaagcuaaugaauggaugcccagccaagcuuuguagcuuaugacuuauu

SEQ ID NO: 56217 - RNA, 64 nt, Homo Sapiens
cugggagugcugucuccacagaccauguucuuauccagccaauauaauguccguguagaaaaag

SEQ ID NO: 56218 - RNA, 64 nt, Homo Sapiens
ugggaaauacauaaaagagacuaaggugacuaugccagccaaccuuccacauuugggggcuauu

SEQ ID NO: 56219 - RNA, 64 nt, Homo Sapiens
caaagaaugcacucugcagggggccccucugaggccagccaagggacaaacugcuguggccagu

SEQ ID NO: 56220 - RNA, 64 nt, Homo Sapiens
ccaaggccacaaggggacccccucaacagcuaccccagccaacacucuggccucccaggcccau

SEQ ID NO: 56221 - RNA, 64 nt, Homo Sapiens
aagcacuuccugggcacggcaaacacaaucagaaccagccaaagcucacccaaggccaaacucc

SEQ ID NO: 56222 - RNA, 64 nt, Homo Sapiens
uuugcauguuuuguagagauucaugccaccauggccagccaacugaguagcugggaccacaggu

SEQ ID NO: 56223 - RNA, 64 nt, Homo Sapiens
ccugucugacaaccucuuggaagucucugcuggcccagccaaacguuagguagagggaguuguc

SEQ ID NO: 56224 - RNA, 64 nt, Homo Sapiens
ccaaagcuccccccgccuuggucagggccucagaccagccaaccuuuguggaauaagccccagc

SEQ ID NO: 56225 - RNA, 64 nt, Homo Sapiens
cagaccagccaaccuuuguggaauaagccccagcccagccaaaccaaacccagaugccugaggc

SEQ ID NO: 56226 - RNA, 64 nt, Homo Sapiens
gcacuuuugugaaaauggggaauauauccuacaaccagccaaauguuuuguuuccccaccuaau

SEQ ID NO: 56227 - RNA, 64 nt, Homo Sapiens
acagacuguagaggauccacggaagugggaagggccagccaaggaaagagaaaguagcaggaaa

SEQ ID NO: 56228 - RNA, 64 nt, Homo Sapiens
uguuuagaaacacucagucuaacagcaccucaguccagccaaaauggccuucauggaggguggu

SEQ ID NO: 56229 - RNA, 64 nt, Homo Sapiens
ugcuucucaacccuagacaaggcagugagaccacccagccaaauaggugggcucuguuuaggag

SEQ ID NO: 56230 - RNA, 64 nt, Homo Sapiens
uccugacagcagggucugccgaggccuccugacaccagccaaaaagagggaucccugcacccag

SEQ ID NO: 56231 - RNA, 64 nt, Homo Sapiens
aaauaaugcuacuuucaaaguagcauuuuuuuaguuaguuuacagguuacauacccaaaaccuu

SEQ ID NO: 56232 - RNA, 64 nt, Homo Sapiens
cggguaaaaggaaugacuguccuugagagaaccauuaguuuaucaaagguuuauguaguuuugu

SEQ ID NO: 56233 - RNA, 64 nt, Homo Sapiens
uacuauguaacuuuuucaggcuuccagguauuuguuaguuuagcccuuaauuguuuuuucaagu

SEQ ID NO: 56234 - RNA, 64 nt, Homo Sapiens
aaaaaauccucccuucccccaauuugaaauagcuuuaguuuaaacauccuuccccuuuuuucua

SEQ ID NO: 56235 - RNA, 64 nt, Homo Sapiens
auccaguuuucgaauuacaucuauuuaaguaaauuuaguuuaaagagccacuagccacaugagg

SEQ ID NO: 56236 - RNA, 64 nt, Homo Sapiens
uguuuauuaguaaacaugaauuaguugacccacuuuaguuuauagccugcuguaucuucccuau

SEQ ID NO: 56237 - RNA, 64 nt, Homo Sapiens
uaacaguguuaguuuuauuuuuguacugcaauuuuuaguuuaaaauauguuggaugcacucguc

SEQ ID NO: 56238 - RNA, 64 nt, Homo Sapiens
gauuuuugaagggauaugacuuccuacuaaggauuuaguuuaccacaacaauucugacuacaau

SEQ ID NO: 56239 - RNA, 64 nt, Homo Sapiens
gaaaugauguguuaaguuuuuauuuccaaaguguuuaguuuauuggcugauggguuguucuugg

SEQ ID NO: 56240 - RNA, 64 nt, Homo Sapiens
uguuucuaaaguuggaccuugcugccaugacuguuuaguuuacagaaacuugaccccggcucau

SEQ ID NO: 56241 - RNA, 64 nt, Homo Sapiens
aaguucagaaguagaaacaauacuuaguuuagcuuuaguuuaguaaacaccgagucuccaaaaa

SEQ ID NO: 56242 - RNA, 64 nt, Homo Sapiens
uuuaguuuaguaaguucagagucuccaaaaauacuuaguuuagcuauccuuucuuaaacaccga

SEQ ID NO: 56243 - RNA, 64 nt, Homo Sapiens
uugcuccgauuugaauuguggagguggaagcaaauuaguuuacauggcauguccucccuaggca

SEQ ID NO: 56244 - RNA, 64 nt, Homo Sapiens
aaauauuguugaauuuaaauaagguaaaucuuuuuuaguuuauauauuugcagacuauacaugu

SEQ ID NO: 56245 - RNA, 64 nt, Homo Sapiens
uauacuuuugguguguuacauagccauguuucuauuaguuuacuuuuaaaucucaaauuuaagu

SEQ ID NO: 56246 - RNA, 64 nt, Homo Sapiens
auauugugagcaauacugaacaucaauaauacccuuaguuuauauacuuauuauuuuaucuuua

SEQ ID NO: 56247 - RNA, 64 nt, Homo Sapiens
guuguguuuuguaaacaccuauguaacucaucuuuuaguuuacacuuccuggggaaauugucuu

SEQ ID NO: 56248 - RNA, 64 nt, Homo Sapiens
guaacuuggcacuuuaguaguguauacacuagcauuaguuuauacaccacuuuugccgcugggg

SEQ ID NO: 56249 - RNA, 64 nt, Homo Sapiens
aauaaacuauaauuuuugaaaacuuccuuuuuuauuaguuuagaaagccccuuauuuuucaaca

SEQ ID NO: 56250 - RNA, 64 nt, Homo Sapiens
acaaaggggauuuuguacacauaacauggguuauuuaguuuaacucuggcaaaaaaaaaaaaaa

SEQ ID NO: 56251 - RNA, 64 nt, Homo Sapiens
acaaacuaaugauugcauuuugccgucuggcauuuuaguuuaauuauuuuagaaaccugagacu

SEQ ID NO: 56252 - RNA, 64 nt, Homo Sapiens
ucgggaacugagauauuguagaaaacagacaauauuaguuuaggaauguuuuuaagagcuaugu

SEQ ID NO: 56253 - RNA, 64 nt, Homo Sapiens
augaaaacaucaaagauuuuuauguuaguuuauguuaguuuauuaucagugggaguucuuggcu

SEQ ID NO: 56254 - RNA, 64 nt, Homo Sapiens
uuaguuuauuaugaaaacauguucuuggcuuauguuaguuuauguaagcacugcaucaguggga

SEQ ID NO: 56255 - RNA, 64 nt, Homo Sapiens
gaugucuuggugaacugugauuugucuaaacauguuaguuuagugaaccuuagucuuuuuuguu

SEQ ID NO: 56256 - RNA, 64 nt, Homo Sapiens
ucaguccuggaugggagagaguauuagcagagcuuuaguuuauccaagcaugguccugaacagu

SEQ ID NO: 56257 - RNA, 64 nt, Homo Sapiens
accuuugaguuagcugauuucuuuauucuguucuuuaguuuauucuuacuagaugcagaggaau

SEQ ID NO: 56258 - RNA, 64 nt, Homo Sapiens
gcagaggaauucaucuacugucuguuauuaacuguuaguuuauucucauacuuacgauguugag

SEQ ID NO: 56259 - RNA, 64 nt, Homo Sapiens
cauuacuaaccuuuaauuuaaucaaucauguacuuuaguuuaauguauaaagauccucuagaaa

SEQ ID NO: 56260 - RNA, 64 nt, Homo Sapiens
uaaaggucccaggaucacuuuuaagggauuuuuauuaguuuaaagguaaauaaagucagcugaa

SEQ ID NO: 56261 - RNA, 64 nt, Homo Sapiens
ccaauuuaacuggcuaccuguuaccucagcugaguuaguuuaggaaguuuacauucguuucuaa

SEQ ID NO: 56262 - RNA, 64 nt, Homo Sapiens
cuaugagauagccaaaguuucaaacacaguuaucuuaguuuaccgguggaguauuucaacacca

SEQ ID NO: 56263 - RNA, 64 nt, Homo Sapiens
gcacauaggagaaccuucagcugcaucuuucuccuuaguuuacagugcaauuuuaucucaggaa

SEQ ID NO: 56264 - RNA, 64 nt, Homo Sapiens
uauguacauuuauugcuauccagugucagaacaguuaguuuaggaaaaguaugcaaacuuuaau

SEQ ID NO: 56265 - RNA, 64 nt, Homo Sapiens
aagccuagaaauaucuuauuuucuaaguuuaccuuuaguuuaccuaaacuuuuguucagauaac

SEQ ID NO: 56266 - RNA, 64 nt, Homo Sapiens
cuucuuuuauauuuuuuggaaaccaaauuuauaguuaguuuagguaaacuuuuuauuaugacca

SEQ ID NO: 56267 - RNA, 64 nt, Homo Sapiens
aagccuagaaauaucuuauuuucuaaguuuaccuuuaguuuaccuaaacuuuuguucagauaau

SEQ ID NO: 56268 - RNA, 64 nt, Homo Sapiens; identical to SEQ ID NO: 56266

SEQ ID NO: 56269 - RNA, 64 nt, Homo Sapiens; identical to SEQ ID NO: 47016

SEQ ID NO: 56270 - RNA, 64 nt, Homo Sapiens; identical to SEQ ID NO: 47017

SEQ ID NO: 56271 - RNA, 64 nt, Homo Sapiens; identical to SEQ ID NO: 47018

SEQ ID NO: 56272 - RNA, 64 nt, Homo Sapiens; identical to SEQ ID NO: 47019

SEQ ID NO: 56273 - RNA, 64 nt, Homo Sapiens; identical to SEQ ID NO: 47020

SEQ ID NO: 56274 - RNA, 64 nt, Homo Sapiens; identical to SEQ ID NO: 47021

SEQ ID NO: 56275 - RNA, 64 nt, Homo Sapiens; identical to SEQ ID NO: 47022

SEQ ID NO: 56276 - RNA, 64 nt, Homo Sapiens; identical to SEQ ID NO: 47023

SEQ ID NO: 56277 - RNA, 64 nt, Homo Sapiens; identical to SEQ ID NO: 47024

SEQ ID NO: 56278 - RNA, 64 nt, Homo Sapiens; identical to SEQ ID NO: 47025

SEQ ID NO: 56279 - RNA, 64 nt, Homo Sapiens; identical to SEQ ID NO: 47026

SEQ ID NO: 56280 - RNA, 64 nt, Homo Sapiens; identical to SEQ ID NO: 47027

SEQ ID NO: 56281 - RNA, 64 nt, Homo Sapiens; identical to SEQ ID NO: 47028

SEQ ID NO: 56282 - RNA, 64 nt, Homo Sapiens; identical to SEQ ID NO: 47029

SEQ ID NO: 56283 - RNA, 64 nt, Homo Sapiens; identical to SEQ ID NO: 47030

SEQ ID NO: 56284 - RNA, 64 nt, Homo Sapiens; identical to SEQ ID NO: 47031

SEQ ID NO: 56285 - RNA, 64 nt, Homo Sapiens; identical to SEQ ID NO: 47032

SEQ ID NO: 56286 - RNA, 64 nt, Homo Sapiens; identical to SEQ ID NO: 47033

SEQ ID NO: 56287 - RNA, 64 nt, Homo Sapiens; identical to SEQ ID NO: 47034

SEQ ID NO: 56288 - RNA, 64 nt, Homo Sapiens; identical to SEQ ID NO: 47035

SEQ ID NO: 56289 - RNA, 64 nt, Homo Sapiens; identical to SEQ ID NO: 47036

SEQ ID NO: 56290 - RNA, 64 nt, Homo Sapiens; identical to SEQ ID NO: 47037

SEQ ID NO: 56291 - RNA, 64 nt, Homo Sapiens; identical to SEQ ID NO: 47038

SEQ ID NO: 56292 - RNA, 64 nt, Homo Sapiens; identical to SEQ ID NO: 47039

SEQ ID NO: 56293 - RNA, 64 nt, Homo Sapiens; identical to SEQ ID NO: 47040

SEQ ID NO: 56294 - RNA, 64 nt, Homo Sapiens; identical to SEQ ID NO: 47041

SEQ ID NO: 56295 - RNA, 64 nt, Homo Sapiens; identical to SEQ ID NO: 47042

SEQ ID NO: 56296 - RNA, 64 nt, Homo Sapiens; identical to SEQ ID NO: 47043

SEQ ID NO: 56297 - RNA, 64 nt, Homo Sapiens; identical to SEQ ID NO: 47044

SEQ ID NO: 56298 - RNA, 64 nt, Homo Sapiens; identical to SEQ ID NO: 47045

SEQ ID NO: 56299 - RNA, 64 nt, Homo Sapiens; identical to SEQ ID NO: 47046

SEQ ID NO: 56300 - RNA, 64 nt, Homo Sapiens; identical to SEQ ID NO: 47047

SEQ ID NO: 56301 - RNA, 64 nt, Homo Sapiens; identical to SEQ ID NO: 47048

SEQ ID NO: 56302 - RNA, 64 nt, Homo Sapiens; identical to SEQ ID NO: 47049

SEQ ID NO: 56303 - RNA, 64 nt, Homo Sapiens; identical to SEQ ID NO: 47050

SEQ ID NO: 56304 - RNA, 64 nt, Homo Sapiens; identical to SEQ ID NO: 47051

SEQ ID NO: 56305 - RNA, 64 nt, Homo Sapiens; identical to SEQ ID NO: 47052

SEQ ID NO: 56306 - RNA, 64 nt, Homo Sapiens; identical to SEQ ID NO: 47053

SEQ ID NO: 56307 - RNA, 64 nt, Homo Sapiens; identical to SEQ ID NO: 47054

SEQ ID NO: 56308 - RNA, 51 nt, Homo Sapiens; identical to SEQ ID NO: 47055

SEQ ID NO: 56309 - RNA, 64 nt, Homo Sapiens; identical to SEQ ID NO: 47056

SEQ ID NO: 56310 - RNA, 64 nt, Homo Sapiens; identical to SEQ ID NO: 47057

SEQ ID NO: 56311 - RNA, 64 nt, Homo Sapiens; identical to SEQ ID NO: 47058

SEQ ID NO: 56312 - RNA, 64 nt, Homo Sapiens; identical to SEQ ID NO: 47059

SEQ ID NO: 56313 - RNA, 64 nt, Homo Sapiens; identical to SEQ ID NO: 47060

SEQ ID NO: 56314 - RNA, 64 nt, Homo Sapiens; identical to SEQ ID NO: 47061

SEQ ID NO: 56315 - RNA, 64 nt, Homo Sapiens; identical to SEQ ID NO: 47062

SEQ ID NO: 56316 - RNA, 64 nt, Homo Sapiens; identical to SEQ ID NO: 47063

SEQ ID NO: 56317 - RNA, 64 nt, Homo Sapiens; identical to SEQ ID NO: 47064

SEQ ID NO: 56318 - RNA, 64 nt, Homo Sapiens; identical to SEQ ID NO: 47065

SEQ ID NO: 56319 - RNA, 64 nt, Homo Sapiens; identical to SEQ ID NO: 47066

SEQ ID NO: 56320 - RNA, 64 nt, Homo Sapiens; identical to SEQ ID NO: 47067

SEQ ID NO: 56321 - RNA, 64 nt, Homo Sapiens; identical to SEQ ID NO: 47068

SEQ ID NO: 56322 - RNA, 64 nt, Homo Sapiens; identical to SEQ ID NO: 47069

SEQ ID NO: 56323 - RNA, 64 nt, Homo Sapiens; identical to SEQ ID NO: 47070

SEQ ID NO: 56324 - RNA, 64 nt, Homo Sapiens; identical to SEQ ID NO: 47071

SEQ ID NO: 56325 - RNA, 64 nt, Homo Sapiens; identical to SEQ ID NO: 47072

SEQ ID NO: 56326 - RNA, 64 nt, Homo Sapiens; identical to SEQ ID NO: 47073

SEQ ID NO: 56327 - RNA, 64 nt, Homo Sapiens; identical to SEQ ID NO: 47074

SEQ ID NO: 56328 - RNA, 64 nt, Homo Sapiens; identical to SEQ ID NO: 47075

SEQ ID NO: 56329 - RNA, 64 nt, Homo Sapiens; identical to SEQ ID NO: 47076

SEQ ID NO: 56330 - RNA, 64 nt, Homo Sapiens; identical to SEQ ID NO: 47077

SEQ ID NO: 56331 - RNA, 64 nt, Homo Sapiens; identical to SEQ ID NO: 47078

SEQ ID NO: 56332 - RNA, 64 nt, Homo Sapiens; identical to SEQ ID NO: 47079

SEQ ID NO: 56333 - RNA, 64 nt, Homo Sapiens; identical to SEQ ID NO: 47080

SEQ ID NO: 56334 - RNA, 64 nt, Homo Sapiens; identical to SEQ ID NO: 47081

SEQ ID NO: 56335 - RNA, 64 nt, Homo Sapiens; identical to SEQ ID NO: 47082

SEQ ID NO: 56336 - RNA, 64 nt, Homo Sapiens; identical to SEQ ID NO: 47083

SEQ ID NO: 56337 - RNA, 64 nt, Homo Sapiens
auagaucaguuggagaaaauacaaaacaauucaaagcucuuaagguauuuaaaccuuucuucuc

SEQ ID NO: 56338 - RNA, 64 nt, Homo Sapiens
ccaacuuaugugaccccugagggguggggcugugagcucuuaauuuguuuuugauucugaaaaa

SEQ ID NO: 56339 - RNA, 64 nt, Homo Sapiens
gugugggucacaguacuguguucuuaguugcuuuagcucuuaaaacauacgaaguguugccuaa

SEQ ID NO: 56340 - RNA, 64 nt, Homo Sapiens
cugaggacuggaugguagaauacuggggucccccagcucuuagcaggaugcaggcuauugcuuc

SEQ ID NO: 56341 - RNA, 64 nt, Homo Sapiens
cagccagaggaccuuccuggcuaugcaggugcacagcucuuaggcaucaagcaaagggucagcc

SEQ ID NO: 56342 - RNA, 64 nt, Homo Sapiens
gguuauccacgaacuucgacacagguguuguccaagcucuuagcgaaaaggagucaggaaaacu

SEQ ID NO: 56343 - RNA, 64 nt, Homo Sapiens
aaacugugcaaucaccccugcuaauauguauaggagcucuuaaauguuggaaaauaguccccau

SEQ ID NO: 56344 - RNA, 64 nt, Homo Sapiens
ccauuuguuuuucuccaaguuaggucucaucuacagcucuuagcuucucaguaaagaggauacu

SEQ ID NO: 56345 - RNA, 64 nt, Homo Sapiens
gagucgucagacugaaaggccagguuguagucccagcucuuaucugccaucuuggacaaagcuu

SEQ ID NO: 56346 - RNA, 64 nt, Homo Sapiens
accccaacucugcccuucucccauccaagagaaaccagcaaaaugauaaagaagcuaaccugcc

SEQ ID NO: 56347 - RNA, 64 nt, Homo Sapiens
aaguagcugggaugacaggcgcacaccaccacgcccagcaaauuuuuuguauuuuuaguagaaa

SEQ ID NO: 56348 - RNA, 64 nt, Homo Sapiens
gauaucuaauauuucagaagacucugauguuuugccagcaaaggcuuguaaugaucgaauaccc

SEQ ID NO: 56349 - RNA, 64 nt, Homo Sapiens
caaaaugcuaagcaaugaaucucccaguccaggcccagcaaaaccugaugagaaauagggaaua

SEQ ID NO: 56350 - RNA, 64 nt, Homo Sapiens
ggauccaacacaggcaauauagaaugacaugaauccagcaaauaugaaggaguacacaaaccag

SEQ ID NO: 56351 - RNA, 64 nt, Homo Sapiens
gaaggaguacacaaaccagauuggagaaaauacuccagcaaaauugcccuuuuuagggaagcug

SEQ ID NO: 56352 - RNA, 64 nt, Homo Sapiens
uguggguacuucuccaccuaccagucaguuuggcccagcaaacacucuaagauaagaggccagg

SEQ ID NO: 56353 - RNA, 64 nt, Homo Sapiens
acuuucaucuuagauuauccagucacucuuuuaaccagcaaagguuagauuucuaucucuugua

SEQ ID NO: 56354 - RNA, 64 nt, Homo Sapiens
gaaagggaggguggagggugaggccaaaucagguccagcaaaagucaguagggacauugcagaa

SEQ ID NO: 56355 - RNA, 64 nt, Homo Sapiens
aaaccacaccagggaggaaaaaugacauucagaaccagcaaacacugaauuucucuuguuguuu

SEQ ID NO: 56356 - RNA, 64 nt, Homo Sapiens
ucuucaucaagaaaaaguggaaccagcugucccuccagcaaaaacagcagcccuaauagcagcc

SEQ ID NO: 56357 - RNA, 64 nt, Homo Sapiens
aauaagccgucaaguaguaagaagaacuuggaugccagcaaagagaauggggcugggcagaucu

SEQ ID NO: 56358 - RNA, 64 nt, Homo Sapiens
cucaguauugagacacugucaagauuaaguuauaccagcaaaagugcaguagugucacuuuuuu

SEQ ID NO: 56359 - RNA, 64 nt, Homo Sapiens
agauggauuugacacacucaccauuuaaucauuuccagcaaaauauauguuuggcugaaauuau

SEQ ID NO: 56360 - RNA, 64 nt, Homo Sapiens
agaaaaaggccgggugacaccggggggcucccagcccgugcacccuggaagggcaggucuggcg

SEQ ID NO: 56361 - RNA, 64 nt, Homo Sapiens
accuucguauccccucucagucgcccggggcugucccgugcauggguuggcuguggggacccca

SEQ ID NO: 56362 - RNA, 64 nt, Homo Sapiens
ucaaaguggauuuuuaaaaaguguuuuagcaauacuccuuaaccaaauaaaccuucggagaacg

SEQ ID NO: 56363 - RNA, 64 nt, Homo Sapiens
gggaccaauuaugaggacugacauccuggccacucuccuuaaaauaaacacugacauuuuucuu

SEQ ID NO: 56364 - RNA, 64 nt, Homo Sapiens
aagaucccuggaaaggaugccaugagcuguuucucuccuuaaagaugaugggcacagagcauca

SEQ ID NO: 56365 - RNA, 64 nt, Homo Sapiens
aauuauauuucaccuuuuagggccaucaauaucucuccuuaaacccuuaggccauaucaacuuu

SEQ ID NO: 56366 - RNA, 64 nt, Homo Sapiens
cuugaaucugaaagagcauuauuccuggucaaagcuccuuaaaguucugggcagcuaaaagcau

SEQ ID NO: 56367 - RNA, 64 nt, Homo Sapiens
cuucaagaaaaaaaaaaaaucucuccccaaugcucuccuuaaccuuuaagucuuacaggaagcc

SEQ ID NO: 56368 - RNA, 64 nt, Homo Sapiens
auuauuauugugaaaauauuauuaacacuggggacuccuuaagaguacaucagaguucucucua

SEQ ID NO: 56369 - RNA, 64 nt, Homo Sapiens
cgauuucuuagccuccauaaucacaugagccaaucuccuuaauaaaugccugcucauagaucug

SEQ ID NO: 56370 - RNA, 64 nt, Homo Sapiens
gcgccaugggugcuuguuggaccccggucucaugcuccuuaaugcacagcugcuuucuucuuac

SEQ ID NO: 56371 - RNA, 64 nt, Homo Sapiens
gauuggaucaaguauuacuaauuucaccccaucccuccuuaagacugacuccaaccauucaaaa

SEQ ID NO: 56372 - RNA, 64 nt, Homo Sapiens
uugagguuaagauauagcuagugucugaacgacacuccuuaaaguaaguuccaaauguaaaaca

SEQ ID NO: 56373 - RNA, 64 nt, Homo Sapiens
gacacuccuuaaaguaaguuccaaauguaaaacacuccuuaaguuccaaauguuuuccgcuaau

SEQ ID NO: 56374 - RNA, 64 nt, Homo Sapiens
gaacuuuugaauuauaaaaauguguucuuuaguucuccuuaaaauucucuuuauaaaugaauuu

SEQ ID NO: 56375 - RNA, 64 nt, Homo Sapiens
uuguuuaucuggagcccacacaagcacacugaugcuccuuaagauccuagggcugccaugguca

SEQ ID NO: 56376 - RNA, 64 nt, Homo Sapiens
aggaccugugacaugcccagauagggaccugugacuccuuaauaggaauaugucacacuccuua

SEQ ID NO: 56377 - RNA, 64 nt, Homo Sapiens
gggaccugugacuccuuaauuggaauaugucacacuccuuaauaaauucuaccaagacacucaa

SEQ ID NO: 56378 - RNA, 64 nt, Homo Sapiens
ugucuuagccucuugacgcuggaugaaucauauucauaugcagaagcaagugacuuucuaagua

SEQ ID NO: 56379 - RNA, 64 nt, Homo Sapiens
gucaaggucacuuaaaggguccaagaacugaaggcauaugcacaagcaagugaacacuguucua

SEQ ID NO: 56380 - RNA, 64 nt, Homo Sapiens
gcauauuaaagagaaagcccauuggaaagaauuucauaugcaaaaaauggugcuuuauauuuag

SEQ ID NO: 56381 - RNA, 64 nt, Homo Sapiens
aaaagaaagaaagaaaaaaacagcaucuuaccuucauaugcaguccuucuaucacccuacauuc

SEQ ID NO: 56382 - RNA, 64 nt, Homo Sapiens
agauuguacaaggcuauucaaaaacaguaagauccauaugcauagaaggcaaaaggugacagua

SEQ ID NO: 56383 - RNA, 64 nt, Homo Sapiens
auguguaauaaaacaaaaagacaacugcuacauacauaugcagacaaagaucuuaaugaguaaa

SEQ ID NO: 56384 - RNA, 64 nt, Homo Sapiens
uauuauucaaccaagcuucuaaucaaauguaaaucauaugcaaaugcaaaaaugaguaugagga

SEQ ID NO: 56385 - RNA, 64 nt, Homo Sapiens
ugcucuaggcugugcaggggaggagagauuaugucauaugcaacaaagcugugauacuaaggag

SEQ ID NO: 56386 - RNA, 64 nt, Homo Sapiens
gugggaggagaucagaccuuaacaguaaaggguacauaugcauaacauaugcaaagcuuuccuu

SEQ ID NO: 56387 - RNA, 64 nt, Homo Sapiens
gcuuuccuuaacaguaaagguucuucuauaucuacauaugcaaauuuaguauuuacguagcuua

SEQ ID NO: 56388 - RNA, 64 nt, Homo Sapiens
uauauuuauugaauuccuaguauggaaagcacaacauaugcaauugcauuugaggauuuuaauu

SEQ ID NO: 56389 - RNA, 64 nt, Homo Sapiens
uauaggaacaaauaaauaaauuguugugugugcacauaugcauauauuuuguguucauucuacu

SEQ ID NO: 56390 - RNA, 64 nt, Homo Sapiens
ucuuuaauaaauggugcugggaaaacuggauauccauaugcagaagaaugaaacuagaccccca

SEQ ID NO: 56391 - RNA, 64 nt, Homo Sapiens
uaaugaaaccagcauuuaguaccagcauaugguucauaugcaaauaauacuuuccccaaaaucu

SEQ ID NO: 56392 - RNA, 64 nt, Homo Sapiens
ccugguuuuguuucauuuugcucuguuuuaaauccauaugcaaauaaaacugcuucucucuuac

SEQ ID NO: 56393 - RNA, 64 nt, Homo Sapiens
uucuugguugugugugcuauggaaaacccaacuacauaugcacugcgcuuugugcacuuggagg

SEQ ID NO: 56394 - RNA, 64 nt, Homo Sapiens
uucuucuggagccucuuagaaggugcucagcccucauaugcauuucaggaaccaucucuguccc

SEQ ID NO: 56395 - RNA, 64 nt, Homo Sapiens
cgcaauagaagggcaccacuuagaugagaucuggcauaugcaccggcagguacacaaaggaccu

SEQ ID NO: 56396 - RNA, 64 nt, Homo Sapiens
uggcagcaacaagagaacccuuuuuauacauguucauaugcauaccucaucuggguuugaccac

SEQ ID NO: 56397 - RNA, 64 nt, Homo Sapiens
aaaauaaaguacauuauuuacccuccuuaauagccauaugcaaugucuguauugaucauggaug

SEQ ID NO: 56398 - RNA, 64 nt, Homo Sapiens
auuuacauuuuuaauuuaguauuucacaaaaaggcauaugcaauaauuuuccucuauccuguac

SEQ ID NO: 56399 - RNA, 64 nt, Homo Sapiens
caaggcaaggaaggguguugcagagagggaacagcauaugcaaaggcguaucaguucauggcau

SEQ ID NO: 56400 - RNA, 64 nt, Homo Sapiens
aaaaaaauuaacaugucacaauguaacggaugaccauaugcacaauuccaugaauuaaaucugu

SEQ ID NO: 56401 - RNA, 64 nt, Homo Sapiens
cauucaguaagugguacugggauaacuagcuagccauaugcagaggauugaaacugaaccacuu

SEQ ID NO: 56402 - RNA, 64 nt, Homo Sapiens
ugcagaggauugaaacugaaccacuuccuuacaccauaugcaaaaaucaacucaagauggauua

SEQ ID NO: 56403 - RNA, 64 nt, Homo Sapiens; identical to SEQ ID NO: 50680

SEQ ID NO: 56404 - RNA, 64 nt, Homo Sapiens; identical to SEQ ID NO: 50681

SEQ ID NO: 56405 - RNA, 64 nt, Homo Sapiens; identical to SEQ ID NO: 50682

SEQ ID NO: 56406 - RNA, 64 nt, Homo Sapiens; identical to SEQ ID NO: 50683

SEQ ID NO: 56407 - RNA, 64 nt, Homo Sapiens; identical to SEQ ID NO: 50684

SEQ ID NO: 56408 - RNA, 64 nt, Homo Sapiens; identical to SEQ ID NO: 50685

SEQ ID NO: 56409 - RNA, 64 nt, Homo Sapiens; identical to SEQ ID NO: 50686

SEQ ID NO: 56410 - RNA, 64 nt, Homo Sapiens; identical to SEQ ID NO: 50687

SEQ ID NO: 56411 - RNA, 64 nt, Homo Sapiens; identical to SEQ ID NO: 50688

SEQ ID NO: 56412 - RNA, 64 nt, Homo Sapiens; identical to SEQ ID NO: 50689

SEQ ID NO: 56413 - RNA, 64 nt, Homo Sapiens; identical to SEQ ID NO: 50690

SEQ ID NO: 56414 - RNA, 64 nt, Homo Sapiens; identical to SEQ ID NO: 50691

SEQ ID NO: 56415 - RNA, 64 nt, Homo Sapiens; identical to SEQ ID NO: 50692

SEQ ID NO: 56416 - RNA, 64 nt, Homo Sapiens; identical to SEQ ID NO: 50693

SEQ ID NO: 56417 - RNA, 61 nt, Homo Sapiens
aaaacuaaccgugaccacuacuccaaacaaaacacaauaugccuaggggcacggaugaacg

SEQ ID NO: 56418 - RNA, 61 nt, Homo Sapiens
uaauguaguuagaaguuucauugucugauggacacaauaugcccuuccgguucuauucaaa

SEQ ID NO: 56419 - RNA, 61 nt, Homo Sapiens
ugauaaugcuuuuccaaagugaaaauaagauacacaauaaucauugcucugugugauuaca

SEQ ID NO: 56420 - RNA, 61 nt, Homo Sapiens
uaauuguauuuuguguuuauacagguauuucacacaauaauuuguucuuaaugcagccacu

SEQ ID NO: 56421 - RNA, 61 nt, Homo Sapiens
aaaucuuaauagauuuaaugcaauuuuacagacacaauaccuucaugaauuucaaaauuca

SEQ ID NO: 56422 - RNA, 61 nt, Homo Sapiens
cuugugcacugaaagcuaacagggagagguuacacaauauuuuacaguuucuuaaacauaa

SEQ ID NO: 56423 - RNA, 61 nt, Homo Sapiens
guuuuuucuuucccauguaucuauuuauaucacacaauauauuuucuguaauguaaauaaa

SEQ ID NO: 56424 - RNA, 61 nt, Homo Sapiens
guauuauagacaaaagaauagagcuuggacuacacaauacacacaguggcuggacuaccga

SEQ ID NO: 56425 - RNA, 61 nt, Homo Sapiens
aggguauuugauacaaucauuaauggaucauacacaauagguuuuuaaaaauuaauaacuu

SEQ ID NO: 56426 - RNA, 61 nt, Homo Sapiens
acaugaucugauacaaccauuaaugaaucauacacaauagguuuuuuaaaauuaauauuaa

SEQ ID NO: 56427 - RNA, 64 nt, Homo Sapiens
aaaugaauggacaaagcucaaggcuguggaagggccaauggagaugcaagaauuucuggaagaa

SEQ ID NO: 56428 - RNA, 64 nt, Homo Sapiens
aaugaagcagaggaaggaaaucccugagguuagcccaauggagauuuaugugugcagacaauuc

SEQ ID NO: 56429 - RNA, 64 nt, Homo Sapiens
uguccuccuguucucuggucccccucucauggcaccaauggaaguaaaacuuggccuccuccag

SEQ ID NO: 56430 - RNA, 64 nt, Homo Sapiens
cagcauuucaaggucaagauagaacuuuuggaacccaauggaauuccacuuauucuugacucug

SEQ ID NO: 56431 - RNA, 64 nt, Homo Sapiens
uaaugaauuucugguuuguauuaaauauguccuuccaauggauaaguucuaaaacauacgcuau

SEQ ID NO: 56432 - RNA, 64 nt, Homo Sapiens
uaguacaagcagcccaagaaacucugaacggggcccaauggaggcaaacuugagcaaauaauug

SEQ ID NO: 56433 - RNA, 64 nt, Homo Sapiens
accaauggggaccuacccaaaccaauauucauccccaauggaaugccaaacacuguugugccau

SEQ ID NO: 56434 - RNA, 64 nt, Homo Sapiens
cuggucacuccucaggaccaugagguagcuuuggccaauggauuccuuuaugagcaugaagcau

SEQ ID NO: 56435 - RNA, 64 nt, Homo Sapiens
uagccauguguuaauauaaaguaggcauggcuucccaauggaaaucucugagaaugacagugga

SEQ ID NO: 56436 - RNA, 64 nt, Homo Sapiens
aaacuaacuuuuagcuaacaauaagggcugugccccaauggaaacugaguucauuuucugagaa

SEQ ID NO: 56437 - RNA, 57 nt, Homo Sapiens
gucuccagacucacgugugacaucuuuccaauggaagaguccugggaucuccaacuu

SEQ ID NO: 56438 - RNA, 64 nt, Homo Sapiens
cacccuggcucucccugaggggaacuuugcucggccaauggaaaugcagccaagauggccauau

SEQ ID NO: 56439 - RNA, 64 nt, Homo Sapiens
cugucccugcguguggccacuccucagcauccuccccacccaccaugguucauuccgacuuuuc

SEQ ID NO: 56440 - RNA, 64 nt, Homo Sapiens
accgccacguggccuucagaggaauccacagguccccacccaagaucccucaauuauaugggga

SEQ ID NO: 56441 - RNA, 64 nt, Homo Sapiens
ggaaggcacugguuaggaaggauguucaaacggucccacccaagccugucaccucugcucaucc

SEQ ID NO: 56442 - RNA, 64 nt, Homo Sapiens
gccaugccuaccaagcucgagcuggcccuugacccccacccacccccacccuugcuggcagggg

SEQ ID NO: 56443 - RNA, 64 nt, Homo Sapiens
aucaaaccccauggagcagccagcguuagaugcccccacccaccuguacucuggagagacugug

SEQ ID NO: 56444 - RNA, 64 nt, Homo Sapiens
cuguaaggcaaaauaaucuaaaaagacuaaccugcccacccacuccuuauauugcugugagauu

SEQ ID NO: 56445 - RNA, 64 nt, Homo Sapiens
cucucuaggccauccccucuucuaccuccugcaacccacccauccuauuagccucccacauuca

SEQ ID NO: 56446 - RNA, 64 nt, Homo Sapiens
uuccuugggcuucuccugagguaaugauuacccccccacccacagcugagucugugaggcccca

SEQ ID NO: 56447 - RNA, 64 nt, Homo Sapiens
cacaacacugggacaauucacacccccacacccacccacccacauccaucgcagggugcucaca

SEQ ID NO: 56448 - RNA, 64 nt, Homo Sapiens
cacacacaacacugggacaacacacacccccacacccacccacccuauuccaucgcagggugcu

SEQ ID NO: 56449 - RNA, 64 nt, Homo Sapiens
acggcugugaugagguggcccaggcacaaacucccccacccagguguuucauccaccggcugca

SEQ ID NO: 56450 - RNA, 64 nt, Homo Sapiens
cccacaggucgauuuggucuguuuuagggcccuccccacccacaauguccagaggccuagggag

SEQ ID NO: 56451 - RNA, 64 nt, Homo Sapiens
cccuugcccgugauggcuccuuggggucugccugcccacccacaugagcccgcgaguauggcag

SEQ ID NO: 56452 - RNA, 64 nt, Homo Sapiens
uauucuuagguuagcggagcuuuuuccucuuuuccccacccaucuccccaauauugcccauuau

SEQ ID NO: 56453 - RNA, 64 nt, Homo Sapiens
uagggcagaggggucaggaucccagcaucucccacccacccagcuggggggcccacuagcagcc

SEQ ID NO: 56454 - RNA, 64 nt, Homo Sapiens
cagcuagggcagaggggucaagcccccagcaucucccacccaccgggcuggggggcccacuagc

SEQ ID NO: 56455 - RNA, 64 nt, Homo Sapiens
gagugguuaaaaaagauaccuuauccuauuccuccccacccacccauguuuuuaaacuaauuua

SEQ ID NO: 56456 - RNA, 64 nt, Homo Sapiens
gguuaaaaaagauaccuuauccuauuccuccccacccacccauguuuuuaaacuaauuuauaua

SEQ ID NO: 56457 - RNA, 64 nt, Homo Sapiens
ccuccaccgcuguuccgcugcagccccgcccugccccacccacccagugccuugcugaagccca

SEQ ID NO: 56458 - RNA, 64 nt, Homo Sapiens
caccgcuguuccgcugcagccccgcccugccccacccacccagugccuugcugaagcccauagc

SEQ ID NO: 56459 - RNA, 64 nt, Homo Sapiens
ccauucacccucaccucuccgugcugccuucccacccacccagugugccuuuucuuuuauuuca

SEQ ID NO: 56460 - RNA, 64 nt, Homo Sapiens
caguccauucacccucaccuuucagugcugccuucccacccaccucuggugccuuuucuuuuau

SEQ ID NO: 56461 - RNA, 64 nt, Homo Sapiens
ccuucgacgcgacgccuacgugacgggcggcguucccacccacagcgcccuccuccuggccuuc

SEQ ID NO: 56462 - RNA, 64 nt, Homo Sapiens
ugcgcccucggcucggucucgccccucuucccuucccacccagccggucccccgucucccggcc

SEQ ID NO: 56463 - RNA, 64 nt, Homo Sapiens
cucugacgagaggcuuuuccggccugccaccagacccacccacgcccagcuggccugagcaggg

SEQ ID NO: 56464 - RNA, 64 nt, Homo Sapiens
acucuggccaaaaauggcuccuggccccaagucucccacccagacacucagagucugggucuca

SEQ ID NO: 56465 - RNA, 64 nt, Homo Sapiens
cccaaagccaccggcaugugcauucaagaguaugcccacccagccgcuaccuguggccuuuuaa

SEQ ID NO: 56466 - RNA, 64 nt, Homo Sapiens
cuaauagaggcagugagacugcaggugggcugggcccacccagggagcugaugccccuucuccc

SEQ ID NO: 56467 - RNA, 64 nt, Homo Sapiens
ccuuccuguucuuccuuccuagaagccccugucgcccacccagcugguccuguggaugggaucc

SEQ ID NO: 56468 - RNA, 50 nt, Homo Sapiens
gaaacaccgcagaccacuagcccacccagcaucagagaccuucucuuccu

SEQ ID NO: 56469 - RNA, 64 nt, Homo Sapiens
cuucuccuucuaccacucuuaaauuuacucccuccccacccagaacccagaugggguggagggg

SEQ ID NO: 56470 - RNA, 64 nt, Homo Sapiens
uggcccccuccccccccgccccucugcuucccuccccacccaccaccucaaggguagggaguug

SEQ ID NO: 56471 - RNA, 64 nt, Homo Sapiens
guucuccuggcaggccugcugugugccaaaaacucccacccaaggucccucaggggauauuuca

SEQ ID NO: 56472 - RNA, 64 nt, Homo Sapiens
acaaccuaugacccccucccccaggacaccaccucccacccacagaccuucccuuuagcuguug

SEQ ID NO: 56473 - RNA, 64 nt, Homo Sapiens
gcuugagaagcccccucucccugguccucuccuacccacccauguccucucagaaccccagccu

SEQ ID NO: 56474 - RNA, 64 nt, Homo Sapiens
caggcuuagaggacagaaaaaugugaagagacgccccacccacccucagccagcccucuccagu

SEQ ID NO: 56475 - RNA, 64 nt, Homo Sapiens
ccccugcagcccugcugcacucaguggacaugaccccacccagcuguccccauaguacaguucu

SEQ ID NO: 56476 - RNA, 64 nt, Homo Sapiens
gggcccugaagcagggccaaccuccccacaccuacccacccagucucccaucuguccccaucuu

SEQ ID NO: 56477 - RNA, 64 nt, Homo Sapiens
agacugaggggcagaggcacagggagacacaggccccacccagcucaguccagcuggaggcugg

SEQ ID NO: 56478 - RNA, 64 nt, Homo Sapiens
ccuucucaguccagcuggaggagcucuguggcuucccacccaaaaacugugaauuggagaaaug

SEQ ID NO: 56479 - RNA, 64 nt, Homo Sapiens
cucucugcagugcccuccucgccugugcagcccgcccacccacaggcucaccccuccugccggc

SEQ ID NO: 56480 - RNA, 64 nt, Homo Sapiens
ugcuggccgccuucuuggugccaaacccccuucccccacccagagacugggcagcugugucugg

SEQ ID NO: 56481 - RNA, 64 nt, Homo Sapiens
augggccugguugggagcagccccuggcccauugcccacccacccaucucacuaugcaauucga

SEQ ID NO: 56482 - RNA, 64 nt, Homo Sapiens
gccugguugggagcagccccuggcccauugcccacccacccaucucacuaugcaauucgaguuc

SEQ ID NO: 56483 - RNA, 64 nt, Homo Sapiens
uuucuuuuuauggccccagguuuccucuccuucccccacccagcuuuggcauucucugaauuua

SEQ ID NO: 56484 - RNA, 64 nt, Homo Sapiens
uuuuuucuuugguugcuuuucaggagagucuccccccacccaccgugggcuuggggcuacgcgc

SEQ ID NO: 56485 - RNA, 64 nt, Homo Sapiens
uccaucacccauccaauaaauuuaccauaguacucccacccacuucccacccauauaucccucc

SEQ ID NO: 56486 - RNA, 64 nt, Homo Sapiens
uaucccuccuuuaccauaguuuuuguugguggcucccacccauagggggagggggaugggggac

SEQ ID NO: 56487 - RNA, 64 nt, Homo Sapiens
acuucucccagucuccccgagucacagugccgaucccacccacccaccguagggugcacagcaa

SEQ ID NO: 56488 - RNA, 64 nt, Homo Sapiens
cucccagucuccccgagucacagugccgaucccacccacccaccguagggugcacagcaaggca

SEQ ID NO: 56489 - RNA, 64 nt, Homo Sapiens
auguccuggcucacuccgcaggcaagcccccccacccacccagggccuuuccuccccacuggag

SEQ ID NO: 56490 - RNA, 64 nt, Homo Sapiens
caggauguccuggcucacucggagggcaagcccccccacccacccagugccuuuccuccccacu

SEQ ID NO: 56491 - RNA, 64 nt, Homo Sapiens
acacuggacuuuucuagagaauugugugcacccacccacccaccuugguguggcuuacuauuuc

SEQ ID NO: 56492 - RNA, 64 nt, Homo Sapiens
caccacacuggacuuuucuauuucauugugugcacccacccaccgccuuugguguggcuuacua

SEQ ID NO: 56493 - RNA, 64 nt, Homo Sapiens
aaaaaaagguagcugugauacaaaccccaggacacccacccacccaaagagccaaagaauaguu

SEQ ID NO: 56494 - RNA, 64 nt, Homo Sapiens
aaagguagcugugauacaaaccccaggacacccacccacccaaagagccaaagaauaguuccug

SEQ ID NO: 56495 - RNA, 64 nt, Homo Sapiens
gguggcccucccaggcugguaucgacauccuagccccacccagacaaggagaacguuugguaca

SEQ ID NO: 56496 - RNA, 64 nt, Homo Sapiens
gagaacguuugguacaaucgcacugauucccucucccacccaagaaaaacuuugcuccaggcau

SEQ ID NO: 56497 - RNA, 64 nt, Homo Sapiens
ccaggcauguggcagggguuggucuccagaaagccccacccaggcagccagugcccugagccag

SEQ ID NO: 56498 - RNA, 64 nt, Homo Sapiens
aacccucagggcaaagccagugcugaucgccuuccccacccacccucuuccccagacgccuggc

SEQ ID NO: 56499 - RNA, 64 nt, Homo Sapiens
uuccuuccucuucccucuucuccauacuaccagccccacccacccagguccugcagcaccuuag

SEQ ID NO: 56500 - RNA, 64 nt, Homo Sapiens
ccaggauguuaggguccccuaccaugggcccugccccacccacuccaccucccaccuagaggag

SEQ ID NO: 56501 - RNA, 64 nt, Homo Sapiens
cagcugccuugggcuggggccugcggaggggaagcccacccacaaugcauggaguauuauuuuu

SEQ ID NO: 56502 - RNA, 64 nt, Homo Sapiens
ugggggguccuggccccugugaugcucccccauccccacccacuucuacauccauccacacccc

SEQ ID NO: 56503 - RNA, 64 nt, Homo Sapiens
caaaggguccugcccacagcgcccuguaccugcucccacccagcccuuggugugcccacccagc

SEQ ID NO: 56504 - RNA, 64 nt, Homo Sapiens
gcccuguaccugcucccacccagcccuuggugugcccacccagccuccucuccagcaccuugcu

SEQ ID NO: 56505 - RNA, 64 nt, Homo Sapiens
ccccaaagccaagaagaucaagucucagcaccggcccacccaaagauucuggcccaacuccauc

SEQ ID NO: 56506 - RNA, 64 nt, Homo Sapiens
accaaaucccugaggauagauggcacccauggcccccacccacggaaggacuugaguuguuuac

SEQ ID NO: 56507 - RNA, 64 nt, Homo Sapiens
cccaagagccugcggggaugcccaucccacacaccccacccagcuguucuaacccugcuaucca

SEQ ID NO: 56508 - RNA, 64 nt, Homo Sapiens
gaggcucuccacuguccacccuaacacauacccucccacccaccuuccagacccccuugguugg

SEQ ID NO: 56509 - RNA, 64 nt, Homo Sapiens
uuaauugugcuuagagcccaccuacccucacccacccacccaguuggccuugcaucugaauagg

SEQ ID NO: 56510 - RNA, 64 nt, Homo Sapiens
caguuuaauugugcuuagaguaggccuacccucacccacccaccuugcuggccuugcaucugaa

SEQ ID NO: 56511 - RNA, 64 nt, Homo Sapiens
caugacucuaaguguguugucccugccccccagccccacccacuaggguggcagcuccccaagg

SEQ ID NO: 56512 - RNA, 64 nt, Homo Sapiens
cccucagguggcacaucuggccacuuggccagugcccacccagcggccuccugcuucuugccua

SEQ ID NO: 56513 - RNA, 64 nt, Homo Sapiens
ccacaggccagccuacucuuccguccccucuccucccacccacgcagcgggccgagugcccucu

SEQ ID NO: 56514 - RNA, 64 nt, Homo Sapiens
cacagccacugccucccccucagaucugucugugcccacccaggcagggcucagggccauguac

SEQ ID NO: 56515 - RNA, 64 nt, Homo Sapiens
ccaucucuuccccaacccuggauaccaguagcuucccacccaguccaaaccugcaccauccauc

SEQ ID NO: 56516 - RNA, 64 nt, Homo Sapiens
auucccucaucuguaggauuugggcugccccaggcccacccagggggcucugaauguauuuugu

SEQ ID NO: 56517 - RNA, 64 nt, Homo Sapiens
agcccccuuuguuacuuaggcuugggugggaaaccccacccaaaugucugcuccuccucuugaa

SEQ ID NO: 56518 - RNA, 64 nt, Homo Sapiens
ugcggcuaagucucuuuuucaacacucugguuuccccacccaacaccccuugguacugccucug

SEQ ID NO: 56519 - RNA, 64 nt, Homo Sapiens
uuccccuuagagugcugugaccacaagaacuccucccacccaacggggcacagaccucucccac

SEQ ID NO: 56520 - RNA, 64 nt, Homo Sapiens
agaacuccucccacccaacugggcacagaccucucccacccacaggcaggaucggcuuccucag

SEQ ID NO: 56521 - RNA, 64 nt, Homo Sapiens
agccugucucaccaguggccugcccucucgcucccccacccagcccacccauugaagucuccuu

SEQ ID NO: 56522 - RNA, 64 nt, Homo Sapiens
caccaguggccugcccucucgcucccccacccagcccacccauugaagucuccuugggccacca

SEQ ID NO: 56523 - RNA, 64 nt, Homo Sapiens
acacugugcaggcccaggcaggcccagccucugccccacccaucaguggaguccagauggcagg

SEQ ID NO: 56524 - RNA, 64 nt, Homo Sapiens
gccaggcucccgaccccauccaccuauccaccaccccacccaccuuugcagggaauaccucguu

SEQ ID NO: 56525 - RNA, 64 nt, Homo Sapiens
ccagaugguacagccuguugugggacaccuaugacccacccaggugcacuuauacaaaccuaga

SEQ ID NO: 56526 - RNA, 64 nt, Homo Sapiens
acauuuuaauaguaaauagacuucgacccccacccccacccaagaauccucugacaaguugacu

SEQ ID NO: 56527 - RNA, 64 nt, Homo Sapiens
cgccgccugcuccccacacggacuccaggcgguccccacccacagaagcagaccuucagcucag

SEQ ID NO: 56528 - RNA, 64 nt, Homo Sapiens
accccgggguggcccuggaggccccugaccccaccccacccacagagcacgagggccccgucag

SEQ ID NO: 56529 - RNA, 64 nt, Homo Sapiens
ugucucauuguggcugccuaaagaccgggacccccccacccacgcgcacaccucccucagcacc

SEQ ID NO: 56530 - RNA, 64 nt, Homo Sapiens
cacccccucccggggcagcacccaacauagcuuccccacccagggcagggcccccacaccagac

SEQ ID NO: 56531 - RNA, 64 nt, Homo Sapiens
auauccccugagaguuauaggaagugcccacugacccacccacccaccuacaccccccgccaca

SEQ ID NO: 56532 - RNA, 64 nt, Homo Sapiens
ccccugagaguuauaggaagugcccacugacccacccacccaccuacaccccccgccacacaca

SEQ ID NO: 56533 - RNA, 64 nt, Homo Sapiens
aagacugcaguauccauaacccccugcccacguccccacccacgggggagacggagagauauaa

SEQ ID NO: 56534 - RNA, 64 nt, Homo Sapiens
ggaccaggccuggagggcacuuccuccacagucccccacccaccuccugcggcucagccuugca

SEQ ID NO: 56535 - RNA, 59 nt, Homo Sapiens
uggagaacagcaagaucuagggcaccagccccacccacuggcuguuucuccguccucuc

SEQ ID NO: 56536 - RNA, 64 nt, Homo Sapiens
aacuucaaaagagcuaaccccuucccacacuccacccacccaccuacauuuccucugugaaauc

SEQ ID NO: 56537 - RNA, 64 nt, Homo Sapiens
ugugagcaaaagcagaaguggaccaccaucagcucccacccacccagcgauuuuuccuuggagg

SEQ ID NO: 56538 - RNA, 64 nt, Homo Sapiens
agcaaaagcagaaguggaccaccaucagcucccacccacccagcgauuuuuccuuggaggucag

SEQ ID NO: 56539 - RNA, 64 nt, Homo Sapiens
agacauucuucaccuccuuggcgcugccaccugccccacccaguuucuggaaaaaguugaugcu

SEQ ID NO: 56540 - RNA, 64 nt, Homo Sapiens
aaccuugcugagccuccuugucuauccuuccucccccacccaccauuguaaaguuuaugucacc

SEQ ID NO: 56541 - RNA, 64 nt, Homo Sapiens
ugccucagcgggucaggccuucagaacacugccacccacccaguuuuauaaucccgcucccucu

SEQ ID NO: 56542 - RNA, 64 nt, Homo Sapiens
ccaguuuuauaaucccgcucccucuccaggcaaccccacccaccagccuaggccugcuccucca

SEQ ID NO: 56543 - RNA, 64 nt, Homo Sapiens
caguggucgagcacugccccgaggcugagaccagcccacccagcucagcccugggccugcagga

SEQ ID NO: 56544 - RNA, 64 nt, Homo Sapiens
cuccagaagcuggaaccauuacccccaccccacccccacccagccugggcucuaucccacaccc

SEQ ID NO: 56545 - RNA, 64 nt, Homo Sapiens
cuuggagcuggaugccuguguagcugcugagucacccacccagccacccuucccugggggcgau

SEQ ID NO: 56546 - RNA, 64 nt, Homo Sapiens
gccuuuccuuggcccucacuacagggucuaugggcccacccagugugggcaggccacugcuggg

SEQ ID NO: 56547 - RNA, 64 nt, Homo Sapiens
cguaccagaaauaaaggcuugaggagaccagucccccacccagcggcagcccggcagaggacgg

SEQ ID NO: 56548 - RNA, 64 nt, Homo Sapiens
agcaggcccccaacccccagccugucagugccggcccacccaccgccugggcacgcggcccucu

SEQ ID NO: 56549 - RNA, 64 nt, Homo Sapiens
guggagaggguggggcgggcugggguuggagggucccacccaccacccugcugugcuugggaac

SEQ ID NO: 56550 - RNA, 64 nt, Homo Sapiens
gaaauguuugaggcuagacggggaggggccaggacccacccacugcuccugggggaugaggucc

SEQ ID NO: 56551 - RNA, 64 nt, Homo Sapiens
caggggaagcggagaccagggugcaggcuccgcccccacccaaggccgggcccagccagaggag

SEQ ID NO: 56552 - RNA, 64 nt, Homo Sapiens
gcuccacaggucugagcagggagcaacucaggcccccacccaagccugcgucagcggaacuuga

SEQ ID NO: 56553 - RNA, 64 nt, Homo Sapiens
agccucaagugacucagccugguuggagaacugccccacccaguaucuucugugccaugguucc

SEQ ID NO: 56554 - RNA, 64 nt, Homo Sapiens
aaucuccaaauaaguacgauaacauagucauagucccacccaacaugaugcaguuaucuugcau

SEQ ID NO: 56555 - RNA, 64 nt, Homo Sapiens
cacaggccccacuugcuaagacccacacccccaucccacccaaccacgcuuaacuccagccccc

SEQ ID NO: 56556 - RNA, 64 nt, Homo Sapiens
cccccaucccacccaaccacgcuuaacuccagcccccacccacaguauggaaagaggggcucac

SEQ ID NO: 56557 - RNA, 62 nt, Homo Sapiens
ucuguagagucccagaaacacuguccuacccacccacccaccugggugcgaacucacaguga

SEQ ID NO: 56558 - RNA, 58 nt, Homo Sapiens
caccucuguagagucccagacuguccuacccacccaccugggugcgaacucacaguga

SEQ ID NO: 56559 - RNA, 64 nt, Homo Sapiens
gcgcagucuccaccucggccagccauccugcauucccacccagcccuguguggcugugccgggc

SEQ ID NO: 56560 - RNA, 64 nt, Homo Sapiens
gcagcaccagccccggccacggguaugagugcgucccacccaacauagcggggcccacaggcag

SEQ ID NO: 56561 - RNA, 64 nt, Homo Sapiens
ucaccacccagaaguggggagagacuuugggccucccacccaguggggcuuggccuggcuucug

SEQ ID NO: 56562 - RNA, 64 nt, Homo Sapiens
gcugcaccagcgaaucugccugggcugcuccugucccacccacccucacugagauccauguaag

SEQ ID NO: 56563 - RNA, 64 nt, Homo Sapiens
gaagccaggggucccagcccgucuaccuccccaucccacccaggcccccagcuccccgcggggg

SEQ ID NO: 56564 - RNA, 64 nt, Homo Sapiens
uuaccguucaucaccacucgggggcaccgggccgcccacccacucccaaaauccgucaguauuc

SEQ ID NO: 56565 - RNA, 64 nt, Homo Sapiens
uguacuucagggccuggguauccagcgagcccuccccacccacccacgguccucaccuggagcu

SEQ ID NO: 56566 - RNA, 64 nt, Homo Sapiens
cuucagggccuggguauccagcgagcccuccccacccacccacgguccucaccuggagcugugg

SEQ ID NO: 56567 - RNA, 64 nt, Homo Sapiens
cuggacuuggccccaugggacucugagucgcucucccacccagcggcccaccuugcggcccugg

SEQ ID NO: 56568 - RNA, 64 nt, Homo Sapiens
ucugggcucccaggcagggaacccccaucccacucccacccauggcugugggcccuccugcucc

SEQ ID NO: 56569 - RNA, 64 nt, Homo Sapiens
cugagaugacaguggcugacgagauacgcacagccccacccacuuuccgagccucagaauccag

SEQ ID NO: 56570 - RNA, 64 nt, Homo Sapiens
accugccuggagaggaacggcuccuguuccugcccccacccaccgacgccagggccugcccggc

SEQ ID NO: 56571 - RNA, 64 nt, Homo Sapiens
ccaggucggcuuguuucucacacacacacaggcacccacccacacuucuagcccuccucccauc

SEQ ID NO: 56572 - RNA, 64 nt, Homo Sapiens
ccauccuacccagggaccccaaagccccuggcaccccacccacucccaaucaccagaaagcacc

SEQ ID NO: 56573 - RNA, 64 nt, Homo Sapiens
gcugagucugugaggccccauaaugauuuacccccccacccacauccuugggcuucuccugagg

SEQ ID NO: 56574 - RNA, 64 nt, Homo Sapiens
cuauuagccucccacauucuucuaccuccugcaacccacccauccucucuaggccauccccucu

SEQ ID NO: 56575 - RNA, 64 nt, Homo Sapiens
gcgcugcacgaccugcucaccaccuaugccguuacccacccacagguguccuacugccagggca

SEQ ID NO: 56576 - RNA, 64 nt, Homo Sapiens
augggcuccaggagggacccucugguccagcugccccacccagcugcccuuaucagcuccaagu

SEQ ID NO: 56577 - RNA, 64 nt, Homo Sapiens
ggcuuggggguaaauccugaggcuuuggugcucccccacccacccauucccgcccuuugcagca

SEQ ID NO: 56578 - RNA, 64 nt, Homo Sapiens
uggggguaaauccugaggcuuuggugcucccccacccacccauucccgcccuuugcagcagccc

SEQ ID NO: 56579 - RNA, 64 nt, Homo Sapiens
aggccccuguagugacccacgcguccagcagacgcccacccaccgcuagccguuguuccugugc

SEQ ID NO: 56580 - RNA, 64 nt, Homo Sapiens
gccguuguuccugugcaaaguagugugcuaugcacccacccagguggccgccucugggcccaag

SEQ ID NO: 56581 - RNA, 64 nt, Homo Sapiens
ucuucauuuggaggaaucaccccaaccucuguuccccacccaguauacugagaaucuaggccac

SEQ ID NO: 56582 - RNA, 64 nt, Homo Sapiens
aaaggaggaccagucaggauuccccugggacuuucccacccagguccugaucaggccucacccc

SEQ ID NO: 56583 - RNA, 64 nt, Homo Sapiens
acccagcaccacuucccagccaggagccccccaggaacagcacagaacagcagggccuggccuc

SEQ ID NO: 56584 - RNA, 64 nt, Homo Sapiens
acuucccagccaggagccccccaggaacagcacagaacagcagggccuggccucugggucuucu

SEQ ID NO: 56585 - RNA, 64 nt, Homo Sapiens
gauuaacucauccugcugcucuguacugaaaagugaacagcaugagucugugcaguugacuugg

SEQ ID NO: 56586 - RNA, 64 nt, Homo Sapiens
ucuccauugcuacaucuccacguaaacagagagugaacagcaccacacuccacgaaaaccgcau

SEQ ID NO: 56587 - RNA, 64 nt, Homo Sapiens
acagcaacgcugcggaucuuaacuggcuagaacggaacagcaucucaucugugcuuucuuuacc

SEQ ID NO: 56588 - RNA, 64 nt, Homo Sapiens
gccaaggcuagcgaggcauauuacuaauucagaggaacagcauaaaauuggaaaagccagccau

SEQ ID NO: 56589 - RNA, 64 nt, Homo Sapiens
uaucaagaagaaaaugugggcuucauggguuuuugaacagcauuccaccaugucacuuugaguc

SEQ ID NO: 56590 - RNA, 64 nt, Homo Sapiens
gucuaacugugcuuacuuagggacguggucaagugaacagcagggcucacuugucccggguuua

SEQ ID NO: 56591 - RNA, 64 nt, Homo Sapiens
uaguagucaaaccaaaaaucuaagauuccaaaaagaacagcauucauugaaauaauauuccauu

SEQ ID NO: 56592 - RNA, 64 nt, Homo Sapiens
caucaaccaacaucuuuuccaaauuagggccacagaacagcaacauuugucugacaguaguaua

SEQ ID NO: 56593 - RNA, 64 nt, Homo Sapiens
acgcugguuuaaaaauaacugacgcggggggcaagaacagcagguguuuaggcacagcagaggg

SEQ ID NO: 56594 - RNA, 64 nt, Homo Sapiens
caagcuucuggccgcauggaagaguuccaugagagaacagcacucgcucagcauggcucacugg

SEQ ID NO: 56595 - RNA, 64 nt, Homo Sapiens
gauggcuggaagggguccagccucguuggaagaggaacagcacuggggagucuuuguggauucu

SEQ ID NO: 56596 - RNA, 64 nt, Homo Sapiens
ucccugaaaccuaguacugccccccaugaggaaggaacagcaauggugucaguauccaggcuuu

SEQ ID NO: 56597 - RNA, 64 nt, Homo Sapiens
uauuaugucaugguaugaacagcccucucauggugaacagcaacacaucuaccuucgaggcagg

SEQ ID NO: 56598 - RNA, 64 nt, Homo Sapiens
ugcauuuuauucgucauuacacuaccccacucaagaacagcagucuacaaagcaaggcccacag

SEQ ID NO: 56599 - RNA, 64 nt, Homo Sapiens
uuugcugacagcgguagaugccugugaggagcuacuacaagaaauagacaucaccccauuucuc

SEQ ID NO: 56600 - RNA, 64 nt, Homo Sapiens
aaaauuuugacauucauauucuccuauuuuacagcuacaagaacuuucuugaaaaucuuauuua

SEQ ID NO: 56601 - RNA, 64 nt, Homo Sapiens
gaaaugggggcuacauaugcccucuccuccccgucuacaagaguugugguuuuccaucugaucc

SEQ ID NO: 56602 - RNA, 64 nt, Homo Sapiens
aauagcuuuuauuuuugauagaccaacugugaaccuacaagacgucuuggacaacugaaguuua

SEQ ID NO: 56603 - RNA, 64 nt, Homo Sapiens
gugccuggccauguuccuacggcucagguccucccuacaagaccuaccacucacccaugccuau

SEQ ID NO: 56604 - RNA, 64 nt, Homo Sapiens
auuuauucauauuguuuugauuacccucguguuacuacaagauggcaauaaauacuaugggauu

SEQ ID NO: 56605 - RNA, 64 nt, Homo Sapiens
ccuccuuuccgcuucuccucucugcuguuccucucuacaagaaccugggaggccaacgccuaaa

SEQ ID NO: 56606 - RNA, 64 nt, Homo Sapiens
ccugguugauacaguucaggaagaagugugugaccuacaagauuucacaguuccucuuuguugg

SEQ ID NO: 56607 - RNA, 64 nt, Homo Sapiens
gaaggauguccccagcccaguccugcuccauccacuacaagaaggugacagucccuggacaacc

SEQ ID NO: 56608 - RNA, 64 nt, Homo Sapiens
ucucaaggcugggucugccacccuuccuuccggucuacaagagcagccaucacccaaugaccgc

SEQ ID NO: 56609 - RNA, 64 nt, Homo Sapiens
ccuauuugacuguaaaaguaucuaccuguuucuucuacaagaucaugagagacuggugggucug

SEQ ID NO: 56610 - RNA, 64 nt, Homo Sapiens
guugacuugauuuugcacagagacagccaaggaccuacaagacaguguucgagguuauaacaag

SEQ ID NO: 56611 - RNA, 64 nt, Homo Sapiens
ugccaugggccuuuucacagaacuccuuguaauucuacaagauagcucauccugcuacagaaug

SEQ ID NO: 56612 - RNA, 64 nt, Homo Sapiens
ucugguuugaauuauuuuuguagguuuuuauuuucuacaagaaugcuggaagaaacuuuggcug

SEQ ID NO: 56613 - RNA, 64 nt, Homo Sapiens
uuuugcaaacagacccucaguucagaaauuagaucuacaagaaguagaaaugaagcagugagug

SEQ ID NO: 56614 - RNA, 64 nt, Homo Sapiens
cagugaccauacuaauuauaaggagccaaacauccuacaagacauuuggcaagcucuaucacca

SEQ ID NO: 56615 - RNA, 64 nt, Homo Sapiens
cccugccccucuguuggaggggccagggaucucucuacaagagcauuuggcaucuccuguccug

SEQ ID NO: 56616 - RNA, 64 nt, Homo Sapiens
ccugucuaguaaauaggaucgacaauccuguuuucuacaagaaucacucagauaaguauacagc

SEQ ID NO: 56617 - RNA, 64 nt, Homo Sapiens
cuuuguagaagaggagaugaccuccugaacugcacuacaagacauucacuuacaccugacugac

SEQ ID NO: 56618 - RNA, 64 nt, Homo Sapiens
cuuacagccauaccacaagguacguccauuuggacuacaagaagagcuuccuuuaaaguuccua

SEQ ID NO: 56619 - RNA, 64 nt, Homo Sapiens
acuugauuucuaguguguuuuguacaguauauaacuacaagauaguacauuuuguagcaguuca

SEQ ID NO: 56620 - RNA, 64 nt, Homo Sapiens
ugccugcccagggaggaacggaggaggacucgcgcuacaagaggccacucccagggacccaggg

SEQ ID NO: 56621 - RNA, 64 nt, Homo Sapiens
acagauuauaccucauauuagcaauuacauuacacuacaagaaaauguauuugcauaggcucuu

SEQ ID NO: 56622 - RNA, 64 nt, Homo Sapiens
aaauucauaaugaauauauuugccuauauucucccuacaagaauauuuuugcuccagaaagaca

SEQ ID NO: 56623 - RNA, 64 nt, Homo Sapiens
uuccccagcccaggguggacuuagaaagcaggggcuacaagagggaauccccgaaggugcugga

SEQ ID NO: 56624 - RNA, 64 nt, Homo Sapiens
caacugaaaaguuggcaguuuggcggaucaaaaccuacaagauuuuauucuaacuugagaucag

SEQ ID NO: 56625 - RNA, 64 nt, Homo Sapiens
aggcaagagacaggccccagaagggugucucaugcuacaagaaguucccuuccccagggccccc

SEQ ID NO: 56626 - RNA, 64 nt, Homo Sapiens
uaaugauaaucccaccaccccgccuaucccaaaccuacaagaacaaaauugcuccuaacuccac

SEQ ID NO: 56627 - RNA, 64 nt, Homo Sapiens
uccaguuuuaacaacaaaagagguggagugguuccuacaagacaagacagcucacugcagacac

SEQ ID NO: 56628 - RNA, 64 nt, Homo Sapiens
uuguguggacauauguuuuccuaugaacauauuucuacaagauuggcuacucugaaugaugcug

SEQ ID NO: 56629 - RNA, 64 nt, Homo Sapiens
acuguaaagcuuaagccauugugguacuagggaacuacaagaauugacaauauuuaaauacuaa

SEQ ID NO: 56630 - RNA, 64 nt, Homo Sapiens
uuuaaauauuuucuguauauuuagaacuuaaauucuacaagaauaacucuuguuuuuuuaaucu

SEQ ID NO: 56631 - RNA, 64 nt, Homo Sapiens
caguccagaugccaacaaggaaaugcguuuauggcuacaagagugccucugcuuucuccuccuc

SEQ ID NO: 56632 - RNA, 64 nt, Homo Sapiens
cacacuucaaaacucccguuagaucagcauucuacuacaagagugaaaggaaaacccuaacaga

SEQ ID NO: 56633 - RNA, 64 nt, Homo Sapiens
guguguuuggccuuuucaguauuagacaaucauucuacaagagcuuuuccucucucugagaugu

SEQ ID NO: 56634 - RNA, 64 nt, Homo Sapiens
guaaacgaucacugaagauuccuuggcuuucaaccuacaagacuuacuauuuaaauaaggagga

SEQ ID NO: 56635 - RNA, 64 nt, Homo Sapiens
cacugcuguggccucauacucuuuuuuccauuuucuacaagaagccuuuuaguauaugaaaauu

SEQ ID NO: 56636 - RNA, 64 nt, Homo Sapiens
uccuuaaaaucucuaauagagccaaugucgaaaccuacaagauuagagguuuaaguuuguugug

SEQ ID NO: 56637 - RNA, 64 nt, Homo Sapiens
aaaguuguggauaacuaggauaaguucacaauugcuacaagaagcuuauaaaaacaagucaucu

SEQ ID NO: 56638 - RNA, 64 nt, Homo Sapiens
caaauaguccucugaauggaaacuaguuaaugagcuacaagaguagaggagcaaagcaguugaa

SEQ ID NO: 56639 - RNA, 64 nt, Homo Sapiens
cccugguugguuuuucguuugaauagcagcaaaucuacaagagagcaaaugccaacauuuugug

SEQ ID NO: 56640 - RNA, 64 nt, Homo Sapiens
aaugacaccacacucugccucuacaccaaguuaccuacaagaaccaaggucuuuggucuucucc

SEQ ID NO: 56641 - RNA, 64 nt, Homo Sapiens
ccacuaggauuuggguucugccuguggcuauuugcuacaagagguuaggaagcccaagaaaaug

SEQ ID NO: 56642 - RNA, 64 nt, Homo Sapiens
uccgggaaaagugaacauaugggcccuuuaaagacuacaagauuugcuagauaaacuggaaaug

SEQ ID NO: 56643 - RNA, 64 nt, Homo Sapiens
uuaauuuuugcaccauuaauuuagcaaaggccaucuacaagagguauaccacuguauuuugcaa

SEQ ID NO: 56644 - RNA, 64 nt, Homo Sapiens
gaucuaugucauauauuaaaaaagagcuugcuuacuacaagaaaaauauugaaauauugaaaau

SEQ ID NO: 56645 - RNA, 64 nt, Homo Sapiens
acuucuauuuccagucgggggaguaacacuaaagcuacaagaaauauguaauaaugauagguaa

SEQ ID NO: 56646 - RNA, 64 nt, Homo Sapiens
gaauguagaugugugauugucugagugagugaaacuacaagagguaaaaaauaaugggugguug

SEQ ID NO: 56647 - RNA, 64 nt, Homo Sapiens
uggagcaacagcuaggaaaucagccuccucuacccuacaagaucccuuccccuguagcagucuu

SEQ ID NO: 56648 - RNA, 64 nt, Homo Sapiens
gcuguaaagugucuucuaaacauuauuucuaaugcuacaagaaucaccuugacgcucuucuuuu

SEQ ID NO: 56649 - RNA, 64 nt, Homo Sapiens
uacuggguuuggauccacaguuugaaaaauauugcuacaagacacuuaaggagaccauccuguu

SEQ ID NO: 56650 - RNA, 64 nt, Homo Sapiens
cuuaugcuucacuccuuuauguuuaaccaugugucuacaagaauaaguuuguuuuggaaaguug

SEQ ID NO: 56651 - RNA, 64 nt, Homo Sapiens
cagaccguuugccuuuucaaguuuccuaguccugcuacaagaugagcuucuuccgugguuuccu

SEQ ID NO: 56652 - RNA, 64 nt, Homo Sapiens
acuaagguaccaauagcucuuucauagacuugugcuacaagaagguuaaaagaccaguuuuauu

SEQ ID NO: 56653 - RNA, 64 nt, Homo Sapiens
cuccugcugcaggcguacaggugugcaccaacaucuacaagaucaggugaacagccuccagacg

SEQ ID NO: 56654 - RNA, 64 nt, Homo Sapiens
acuguauuuauaaaccacucaacagauaagcagccuacaagauaucugugucugcuguauuaua

SEQ ID NO: 56655 - RNA, 64 nt, Homo Sapiens
ugauuacuuuaaugcauuaacauacagguuuuuacuacaagauuugaguuauaugauauuugaa

SEQ ID NO: 56656 - RNA, 64 nt, Homo Sapiens
uaacuuugaagggaaaaaagccuauuuguagggacuacaagaaaccgcucuguggugcaauauc

SEQ ID NO: 56657 - RNA, 64 nt, Homo Sapiens
ccuuaaggauaauauaugaaaauguaugcuagagcuacaagagaguauaauuugcaucuuuacu

SEQ ID NO: 56658 - RNA, 64 nt, Homo Sapiens
ucuguuuguucguucguuugauuugcuggaagcacuacaagacucucuuuuuuccuuucugcug

SEQ ID NO: 56659 - RNA, 64 nt, Homo Sapiens
ccacugucucccaucccaggagguggugaguuggcuacaagagaaagggacaagugaggcaggc

SEQ ID NO: 56660 - RNA, 64 nt, Homo Sapiens
guuuucugucuagcuccauaugguaucagagaaucuacaagaagaacagguucacagaaggaga

SEQ ID NO: 56661 - RNA, 64 nt, Homo Sapiens
cagucagccuucucucccccuuuggggcauuuuucuacaagaaguugccgugaggacaguugaa

SEQ ID NO: 56662 - RNA, 64 nt, Homo Sapiens
aaagacaauuugguugcugacagggauucugugacuacaagaugucaugugcugaguuaaaacu

SEQ ID NO: 56663 - RNA, 64 nt, Homo Sapiens
uguaaacugcauacaguuuggcagcaaccauaugcuacaagaauggcacacaaagugcuuguag

SEQ ID NO: 56664 - RNA, 64 nt, Homo Sapiens
gcuguggcucaacacaugagauuuuugaaauacucuacaagaaaaugcuuuguuuuggggcugu

SEQ ID NO: 56665 - RNA, 64 nt, Homo Sapiens
uuucacaagcaaugcgaguuguaaaauaccagcucuacaagaagcuaggcucugugacggcaua

SEQ ID NO: 56666 - RNA, 64 nt, Homo Sapiens
agaccagccugggcaacaggguaagguccugucucuacaagaucaaaaacuuagccggguaugg

SEQ ID NO: 56667 - RNA, 64 nt, Homo Sapiens
ugggucccugaaucaccgacuggaggagaguuaccuacaagagccuucauccaggagcauccac

SEQ ID NO: 56668 - RNA, 64 nt, Homo Sapiens
uuccuguaaugaggacguucaacauggugaggggcuacaagaaaacgcuuuucuguacagaguc

SEQ ID NO: 56669 - RNA, 64 nt, Homo Sapiens
cugcuaaggcugccucagacacuuacaggccucgcuacaagaacuuuagaccaaaauaugaaag

SEQ ID NO: 56670 - RNA, 64 nt, Homo Sapiens
acccgggucgguaaugucuucugaaccuuucaggcuacaagagaaguauaguaaaaccaaccag

SEQ ID NO: 56671 - RNA, 64 nt, Homo Sapiens
uggaggaauuaagaguucacacauacuuagauaccuacaagacuucucugaacucagggagggc

SEQ ID NO: 56672 - RNA, 64 nt, Homo Sapiens
aacacuugcagguuuagcuuuuucccaggguugacuacaagaaagaaaaccauguuuuugcaag

SEQ ID NO: 56673 - RNA, 64 nt, Homo Sapiens
aacuguggggaccaaaagggagagagccuggggucuacaagaggagacacaucaucaaauguuu

SEQ ID NO: 56674 - RNA, 64 nt, Homo Sapiens
cauuuccagaagauuauuuuuucaaugccuuuuucuacaagagcuauauuggcaaugaagcacu

SEQ ID NO: 56675 - RNA, 64 nt, Homo Sapiens
uacaacucaggagagcuguauaaagauugaacuucuacaagaaguacccaaagaacuauagaug

SEQ ID NO: 56676 - RNA, 64 nt, Homo Sapiens
uuuuucaauuuaaagguuaguauggaaucagcugcuacaagaaugcaaaaaaucuuccaaagac

SEQ ID NO: 56677 - RNA, 64 nt, Homo Sapiens
accagucaggcuuauuucaguaaguuccacaguucuacaagacugcaggaauucuccuuaaggg

SEQ ID NO: 56678 - RNA, 64 nt, Homo Sapiens
aauauuuuuaaaguuacaguucaaucauuagaggcuacaagaauucuaguuaucacuuaagcac

SEQ ID NO: 56679 - RNA, 64 nt, Homo Sapiens
aauauguaaaggagacaugacccuucuuccccuucuacaagaucaacuaauucccuucccuucc

SEQ ID NO: 56680 - RNA, 64 nt, Homo Sapiens
aggaauaagcucuaguucuuaacaaccgacacuccuacaagauuuagaaaaaaguuuacaacau

SEQ ID NO: 56681 - RNA, 64 nt, Homo Sapiens
gaucagcucuuccuguguuuguaauuuaaugcugcuacaagauguuucuguuucuuagauucug

SEQ ID NO: 56682 - RNA, 64 nt, Homo Sapiens
uagagguuuguguguguguacguauguguguguucuacaagaacggaagugugauauguuuaaa

SEQ ID NO: 56683 - RNA, 64 nt, Homo Sapiens
auaagauuuggguugauguauuuuacuauuaguucuacaagaaguagugugguguaauuuuaga

SEQ ID NO: 56684 - RNA, 64 nt, Homo Sapiens
aaccuuuuggguuauuuaauaaauggcacaugcacuacaagaggaaauacugaauagacuugcu

SEQ ID NO: 56685 - RNA, 64 nt, Homo Sapiens
aaaucucaauaaauuauuuuucauaauccguagacuacaagaugccucagccucuauucgcaac

SEQ ID NO: 56686 - RNA, 64 nt, Homo Sapiens
uagaaaacugaagaugucguuugcaguguugaaacuacaagagcggacauaugcaucauugaug

SEQ ID NO: 56687 - RNA, 64 nt, Homo Sapiens
acaucacuuucacaccacuuggggauggaaauaccuacaagagugaaggucaagggcccucccc

SEQ ID NO: 56688 - RNA, 64 nt, Homo Sapiens
gagcggagacugcaccacugcauuccagcccggccuacaagaacaaaacuccaucucaaaauaa

SEQ ID NO: 56689 - RNA, 64 nt, Homo Sapiens
acaccuucucuuucuuaugucuuuuuacuacaaacuacaagacaauuguugaaaccugcuauac

SEQ ID NO: 56690 - RNA, 64 nt, Homo Sapiens
ugccagcaacuugggggaauaagcgaagguuucccuacaagagggaaagaaggcaaaaacggca

SEQ ID NO: 56691 - RNA, 64 nt, Homo Sapiens
aguccugaguccacguucugugggggacgugcuucuacaagaacgggcugugguaccugcagcg

SEQ ID NO: 56692 - RNA, 64 nt, Homo Sapiens
cuuuuaaacuuuuuggacuucuuccugaucuuuucuacaagaagcucuuaacuacugauguugu

SEQ ID NO: 56693 - RNA, 64 nt, Homo Sapiens
uuagaaauauaaaccuugccuuaaaaauucuuaacuacaagagauuaucaaauacagaugacau

SEQ ID NO: 56694 - RNA, 64 nt, Homo Sapiens
ccaaggaggucccaggaaguccacuccaaucacccuacaagaugugaagagcugaguacucagg

SEQ ID NO: 56695 - RNA, 64 nt, Homo Sapiens
uaaaacacacuuccugcugcgaaagacccacaugcuacaagacgggcaaaauaaagugacagau

SEQ ID NO: 56696 - RNA, 64 nt, Homo Sapiens
cugaaauacuccugaagaugguggugcuuauugacuacaagaggaaauucuacaggauuaggau

SEQ ID NO: 56697 - RNA, 64 nt, Homo Sapiens
gagauacaacuccacugcaaguggagguuucuuucuacaagaguuuucugcccaaggccacagc

SEQ ID NO: 56698 - RNA, 64 nt, Homo Sapiens
ugucuaaguaaaagcgcucuauuaaucuaaaacacuacaagagaauuuaacaccaucucucaaa

SEQ ID NO: 56699 - RNA, 64 nt, Homo Sapiens
acugagucacuugcagugggccuacuuacuaucacuacaagaaacagucaggagcacagcaucc

SEQ ID NO: 56700 - RNA, 64 nt, Homo Sapiens
gagggucuugugccuuauaguggcugucaggcgacuacaagacucacauuauguuguagcuggc

SEQ ID NO: 56701 - RNA, 64 nt, Homo Sapiens
auaaguuucuuuuugcaaauaauaauaggaugaucuacaagaaaugcucuucuucaauauuuac

SEQ ID NO: 56702 - RNA, 64 nt, Homo Sapiens
uuuuuacuuauuaaaaaauuuaaguuuuugcaugcuacaagauuaugaaaacuuggggaacugg

SEQ ID NO: 56703 - RNA, 64 nt, Homo Sapiens
accuuagucuuuuuuguuuuaucagacuaucaaacuacaagagauuucaggcaaaucaaauuaa

SEQ ID NO: 56704 - RNA, 64 nt, Homo Sapiens
cucuccaaagagguccagaaaucuacggcaaguacuacaagaggucaucaugaugguguccaac

SEQ ID NO: 56705 - RNA, 64 nt, Homo Sapiens
uuggugaugaauaaaugccauagaguuagagucacuacaagacaauguucucuaagaacugagc

SEQ ID NO: 56706 - RNA, 64 nt, Homo Sapiens
guuugcaguccucuguuaguuuugcauaguugcacuacaagaagaauguaguugugcaaaucua

SEQ ID NO: 56707 - RNA, 64 nt, Homo Sapiens
ucuuuaaaaaaauaaguaaaggagaaauauuuuccuacaagaguacugaauuucaggaaauggg

SEQ ID NO: 56708 - RNA, 64 nt, Homo Sapiens
uucacguuuaacaucacuuugcucuuuaaauagucuacaagacauuuuuuuagccauuugacug

SEQ ID NO: 56709 - RNA, 64 nt, Homo Sapiens
cucaguauucaggaagcuuaauacuguuuuugaucuacaagauccaaauaauuaucccuaucuu

SEQ ID NO: 56710 - RNA, 64 nt, Homo Sapiens
uucuuuaagccaaugaaccccaauuccuggcagucuacaagaagucucuuaaugcuaaugaaga

SEQ ID NO: 56711 - RNA, 64 nt, Homo Sapiens
aucugaacccgagaaucugacccacgugagugugcuacaagaaaugugccagcgaaguuucucu

SEQ ID NO: 56712 - RNA, 64 nt, Homo Sapiens
cuugacaaggcacuguuuuucccaggaggccucacuacaagagcuuaugagucucaccggucaa

SEQ ID NO: 56713 - RNA, 64 nt, Homo Sapiens
ucuggccaguucuuuccaguagccauggggcuggcuacaagaagcaaaacugcccaugcaaaga

SEQ ID NO: 56714 - RNA, 64 nt, Homo Sapiens
ccuuccacacugagguagccgagccucucaagaccuacaagaugggguacuaacaccaccccca

SEQ ID NO: 56715 - RNA, 64 nt, Homo Sapiens
auuaaagauaaaaugauuugcauauuuuaaauuacuacaagauucacauuugacuuuuuuuucu

SEQ ID NO: 56716 - RNA, 64 nt, Homo Sapiens
acuugaauuugccaauucugucggaaggagcagccuacaagauauuauuggaaugacaguguuc

SEQ ID NO: 56717 - RNA, 64 nt, Homo Sapiens
aaaagcagaggccaagaguuaccagagaaccaggcuacaagagaugucaucugcuccuguucac

SEQ ID NO: 56718 - RNA, 64 nt, Homo Sapiens
gaucuuuuuucaagcuguacaaaugcuguacuuacuacaagaaggcccauauugguuuguguuu

SEQ ID NO: 56719 - RNA, 64 nt, Homo Sapiens
gggcaccuccugcccgcagguccuguguaucccccuacaagaaucuacugcccuggcccguuca

SEQ ID NO: 56720 - RNA, 64 nt, Homo Sapiens
uuauaaauguuuuucacaucgauacacacuguaacuacaagaaaguaagaaugauuauaaugaa

SEQ ID NO: 56721 - RNA, 64 nt, Homo Sapiens
gcugcucugaggccuuugagaugaaaaccaagagcuacaagaugugaaaccuguucugguggaa

SEQ ID NO: 56722 - RNA, 64 nt, Homo Sapiens
ccaucugccguuugcaaaagaaugcuuccaggaacuacaagaugaauauuuuacagaauaguaa

SEQ ID NO: 56723 - RNA, 64 nt, Homo Sapiens
ucuguuaaccagaacaccgucauuugaccaagcccuacaagaguuuaccacacuagauguucug

SEQ ID NO: 56724 - RNA, 64 nt, Homo Sapiens
auuugaaucuugggaccuuugagcucuucaucugcuacaagaacggauccauccguccagccaa

SEQ ID NO: 56725 - RNA, 64 nt, Homo Sapiens
uucugugcccaguaugugggcggaugacgcaagacuacaagauccuugcccucaagcugcuagg

SEQ ID NO: 56726 - RNA, 64 nt, Homo Sapiens
cugacagauaccacgaaacaugaagcacguggaacuacaagacccccggggucuuucugagugc

SEQ ID NO: 56727 - RNA, 64 nt, Homo Sapiens
uguugcacacaugguuuucagaugacccagccaucuacaagaucugaauucuacugaaaauauc

SEQ ID NO: 56728 - RNA, 64 nt, Homo Sapiens
caccugauggugaucuuggcacucuccauguucucuacaagaagcuguggugauuggcccugug

SEQ ID NO: 56729 - RNA, 64 nt, Homo Sapiens
aagccaacagaguaaagugguuguacaggaagaucuacaagagcggccacguggauucuuggcu

SEQ ID NO: 56730 - RNA, 64 nt, Homo Sapiens
uauagcuuuaaaaaauacaauaaccacagaaugucuacaagaauaauaagcacaaucaaauuuu

SEQ ID NO: 56731 - RNA, 64 nt, Homo Sapiens
ccgcgucagcggauuauggauucaccuacacuaccuacaagaucaccaccccucagagugcugc

SEQ ID NO: 56732 - RNA, 64 nt, Homo Sapiens
guacgagauuuagucaacuuuaaccaaaaggagccuacaagaaauccuuuauguaagaaugaua

SEQ ID NO: 56733 - RNA, 64 nt, Homo Sapiens
uuuguccacgugguuccugcaagggugcugugcucuacaagacuaucugaucaccaggcugccc

SEQ ID NO: 56734 - RNA, 64 nt, Homo Sapiens
guuuccuuuuacuucaguuauaguuuccauaauucuacaagaauuuuagguccuacuacauugu

SEQ ID NO: 56735 - RNA, 64 nt, Homo Sapiens
gaaaagaucgaaacucuguccacuccagccugggcuacaagauugagccaagaucgugccacug

SEQ ID NO: 56736 - RNA, 64 nt, Homo Sapiens
ucuggcaaggcauaucaugaggcuagugaagcaccuacaagaaacuuauaacucaagguuguaa

SEQ ID NO: 56737 - RNA, 64 nt, Homo Sapiens
acucaagccugggcaauguagcaagauccugucucuacaagaaauuuuuuaaaaaugagccaag

SEQ ID NO: 56738 - RNA, 64 nt, Homo Sapiens
agaccagccugggcaacacggggagacccugucucuacaagaaauuaaaaauuagccaggcaua

SEQ ID NO: 56739 - RNA, 64 nt, Homo Sapiens
cuugccauuggacugagcucuuucucagaagcugcuacaagaugacaccucaugucccugcccu

SEQ ID NO: 56740 - RNA, 64 nt, Homo Sapiens
uuuaaaaacuagccaggcguagcaagacccaucucuacaagaaaaagaccagccugggcaacac

SEQ ID NO: 56741 - RNA, 64 nt, Homo Sapiens
aggagcugccugagugguaccuguaaaugugggacuacaagaagguaugcauuccuuugugucc

SEQ ID NO: 56742 - RNA, 64 nt, Homo Sapiens
aaucaccugguuucccaaccaaauaaggguaauucuacaagaggaaaaggagcaauuaaaucua

SEQ ID NO: 56743 - RNA, 64 nt, Homo Sapiens
aauguacguacuaccuaaaaccguuuacagaaugcuacaagaauuuaaauguuugcaauguuuc

SEQ ID NO: 56744 - RNA, 64 nt, Homo Sapiens
uuuuuaucguuuuugaaggagaucuuuuuaaaaccuacaagagacaucucucuaugccuucuua

SEQ ID NO: 56745 - RNA, 64 nt, Homo Sapiens
ucuuuucaccaggagcaaacccaagucuuaguugcuacaagaaaauccccuggaaguacugggg

SEQ ID NO: 56746 - RNA, 64 nt, Homo Sapiens
aaguuccuucagugguugccucacuugcguuuuccuacaagauguaagacuguuuauaauuaaa

SEQ ID NO: 56747 - RNA, 64 nt, Homo Sapiens
uggcuauaacaucuauaacaaaacgacgauuccucuacaagaggcuguuucucacugcuaacgu

SEQ ID NO: 56748 - RNA, 64 nt, Homo Sapiens
caaccuugacaaauggcuuccaauguuagguuugcuacaagaugguuacuggagcucuagcugc

SEQ ID NO: 56749 - RNA, 64 nt, Homo Sapiens
uuauauuuuaagcuaaguggcuaaaaauguguuucuacaagacuaucuugagaacuucaacauc

SEQ ID NO: 56750 - RNA, 64 nt, Homo Sapiens
agccuguggcaucuuugccuagcugccucacuuccuacaagagcccagagcuguuuauggccuc

SEQ ID NO: 56751 - RNA, 64 nt, Homo Sapiens
uuccuuuaagucaaccaugauuucuccuugauuucuacaagagacaaagaaaugauuuugccuc

SEQ ID NO: 56752 - RNA, 64 nt, Homo Sapiens
gcuugaaucaggaggagauuaacacacugaaccgcuacaagagggcaaagcugauuuuuuuuuu

SEQ ID NO: 56753 - RNA, 64 nt, Homo Sapiens
uucuucgcuaauuuguauuuguauucccuucccccuacaagauuaugagaccccagagggggaa

SEQ ID NO: 56754 - RNA, 64 nt, Homo Sapiens
ucugcauguaagagugagggagggaaggaaggaacuacaagagagucggagaugaugcagcaca

SEQ ID NO: 56755 - RNA, 64 nt, Homo Sapiens
ccugaccacagggugagacaacuacacaagucaucuacaagagcucacuuugugcagugaacaa

SEQ ID NO: 56756 - RNA, 64 nt, Homo Sapiens
agcuuccuuuaaaguuccuauacguccauuuggacuacaagaagcuuacagccauaccacaagg

SEQ ID NO: 56757 - RNA, 64 nt, Homo Sapiens
aaacaggaaagcuagaagagguugcugugucaaccuacaagauagugauucuuggaaguuggua

SEQ ID NO: 56758 - RNA, 64 nt, Homo Sapiens
ugccuaagaccugcccugacaaucagaguagggacuacaagaguguaugguguaugagguucug

SEQ ID NO: 56759 - RNA, 64 nt, Homo Sapiens
cugggaaacccauguuauuucuugaauucagacacuacaagagcagaggauuaagguuuuuuua

SEQ ID NO: 56760 - RNA, 64 nt, Homo Sapiens
agaggaggaggucauggcgauaaagacuuacugccuacaagaggaauuccuauucucugacgaa

SEQ ID NO: 56761 - RNA, 64 nt, Homo Sapiens
ugggaaucagcauaacagggaugaucccagagaccuacaagauggccuaauguuuguuacagaa

SEQ ID NO: 56762 - RNA, 64 nt, Homo Sapiens
aucagccggguugauucuacgauugugcggguuagauagagaucuagaggucaucagccagguu

SEQ ID NO: 56763 - RNA, 64 nt, Homo Sapiens
aucagccugguagauugugugauuguguggguuagauagagauccagaggucaucagccagguu

SEQ ID NO: 56764 - RNA, 57 nt, Homo Sapiens
caagaacuagaaauaaauaaggauggugauagagagguugaagaagaaaugaagaag

SEQ ID NO: 56765 - RNA, 64 nt, Homo Sapiens
aagaucucaagaaccagaaauaaauaaggauggugauagagagcuagaaaauuuuauggcuauc

SEQ ID NO: 56766 - RNA, 64 nt, Homo Sapiens
cuccacucugggaugccagaaacaggguucugcccucccagagcgguggggaaacugaggcagg

SEQ ID NO: 56767 - RNA, 64 nt, Homo Sapiens
cuacagaccuggcuccucggauacuccacucuagcucccagaaugcccuucaucugggaaucau

SEQ ID NO: 56768 - RNA, 64 nt, Homo Sapiens
cuaaauccaguagccucccacuacccucaagauacucccagaucggacacaagacuucugauuu

SEQ ID NO: 56769 - RNA, 64 nt, Homo Sapiens
uggggaacccuucauaggaaccccaagcaggcugcucccagaggaaggguggggcaggcaguac

SEQ ID NO: 56770 - RNA, 64 nt, Homo Sapiens
uggcuccacccuggggccuucuagcuggacacagcucccagaacccauuuggggucacagaugc

SEQ ID NO: 56771 - RNA, 64 nt, Homo Sapiens
aaaaaggagaggcccuggcgcuauggaaucgagucucccagacaagccgagcgugggucccagu

SEQ ID NO: 56772 - RNA, 64 nt, Homo Sapiens
uauguauuuuuuugcgacagggucgugcucuugucucccagacuggacugcaguggcacaauca

SEQ ID NO: 56773 - RNA, 64 nt, Homo Sapiens
caguggcacaaucauagcucacugcagcuuugaccucccagacccaagugauccucccaccuca

SEQ ID NO: 56774 - RNA, 64 nt, Homo Sapiens
ugaugccuucccagagucaaccuccugugacgcccucccagagccaaccucgggugacacccuc

SEQ ID NO: 56775 - RNA, 64 nt, Homo Sapiens
ugacgcccucccagagccaaccucgggugacacccucccagagucaaccucaugugacaccuua

SEQ ID NO: 56776 - RNA, 64 nt, Homo Sapiens
guggaaauguugccuuagaacuucuagacagaaucucccagaguccagccucugucuagacuug

SEQ ID NO: 56777 - RNA, 64 nt, Homo Sapiens
cccaagcacaaggaaggaugugugugaccaguggcucccagauuaacuuuuggaagauaaguga

SEQ ID NO: 56778 - RNA, 64 nt, Homo Sapiens
gggcuuugguguauuuaccuuccuucccuuccugcucccagacagucucacaaguaaacaccag

SEQ ID NO: 56779 - RNA, 64 nt, Homo Sapiens
caguagugcaaucucagcucacugcaaccuccaccucccagacucaagccauccucccaccuca

SEQ ID NO: 56780 - RNA, 64 nt, Homo Sapiens
ugauuguauauaagauaauucauacuggagaaaacucccagaaguggaguuuuccuuauugcac

SEQ ID NO: 56781 - RNA, 64 nt, Homo Sapiens
caauggcgugaucucagcucaccgcaaccucugccucccagauucaagcaauucuccugccuca

SEQ ID NO: 56782 - RNA, 64 nt, Homo Sapiens
cuuuggugccagguuuguggcuggggcacuuaugcucccagagcggguggccuccaccuccugg

SEQ ID NO: 56783 - RNA, 64 nt, Homo Sapiens
cucagaguguggggcugggguaacuucucggcaacucccagacuggaaggucuuugggucauuu

SEQ ID NO: 56784 - RNA, 64 nt, Homo Sapiens
gaacuuggugcucuaaguccggaccacccagggucucccagagucugccaggucuuagaaguca

SEQ ID NO: 56785 - RNA, 64 nt, Homo Sapiens
gcucuacaugacauucaggacccuggugacgcuccucccagauccuugugacacccccucgacu

SEQ ID NO: 56786 - RNA, 64 nt, Homo Sapiens
ggcuacuguauguaauguauuguggggagucugccucccagacuacaugugucagccaugccuc

SEQ ID NO: 56787 - RNA, 64 nt, Homo Sapiens
uuggaccaguugaaagcuccgcaaacaucaccagcucccagauuagcuugcaccaccaaaaaug

SEQ ID NO: 56788 - RNA, 64 nt, Homo Sapiens
aagcccagcugagcagguggggaucucagccagccucccagacugcaccucuucuauugcucuc

SEQ ID NO: 56789 - RNA, 64 nt, Homo Sapiens
ggcuucuucucgcaggucagcuccuuagagaggucucccagauuccccguaaagcagcccugca

SEQ ID NO: 56790 - RNA, 64 nt, Homo Sapiens
guucuugccccucguguccuaggcccaacccagccucccagaccucacuuuccccaucagcaau

SEQ ID NO: 56791 - RNA, 64 nt, Homo Sapiens
cugggggccuuuggggaccagaaggggagaugugcucccagagccucucugcuguaagacccca

SEQ ID NO: 56792 - RNA, 64 nt, Homo Sapiens
uccagcccaucucggagcaugacccucugggaaccucccagaggcagagcaggaccucccuucc

SEQ ID NO: 56793 - RNA, 64 nt, Homo Sapiens
cccagccggccaauggaaacaauauaggucucuucucccagaauggcucugccccagucguuag

SEQ ID NO: 56794 - RNA, 64 nt, Homo Sapiens
cauaucccagaugagugguacagggagugucccccucccagaaggccuucugcugcagcccaag

SEQ ID NO: 56795 - RNA, 64 nt, Homo Sapiens
uuuaagacuuucuccccacuaggggcuagccugacucccagaacgcaaugaggacaccugcagg

SEQ ID NO: 56796 - RNA, 64 nt, Homo Sapiens
auugcuuccaaauucgaagauaagcaaaacuuuccucccagauagagaauuaugggaaaccugg

SEQ ID NO: 56797 - RNA, 64 nt, Homo Sapiens
aggcacggcacaaggaagcaggaucaguggucaccucccagaagugcauuugauuuaggaccuu

SEQ ID NO: 56798 - RNA, 64 nt, Homo Sapiens
cccuuaugcucuugguuuuuucccucucuccucccucccagacacaugccccaccuuugcuucc

SEQ ID NO: 56799 - RNA, 64 nt, Homo Sapiens
cacgaacugaagaaguaucuaucaggcgcgcgcucucccagaaaugcggaacgaccguaccacc

SEQ ID NO: 56800 - RNA, 64 nt, Homo Sapiens
augucaucuuguucuccugcuaucucucacaccucucccagacuuccuguuuuccuuccucugc

SEQ ID NO: 56801 - RNA, 64 nt, Homo Sapiens
cucuuuccuuuccucucuccgugcccuucuccugcucccagauaaccucgcucucccagcacca

SEQ ID NO: 56802 - RNA, 64 nt, Homo Sapiens
ucaccuuggaggagugggcccuggaguccugucccucccagaagcccccagggugggauuucuc

SEQ ID NO: 56803 - RNA, 64 nt, Homo Sapiens
gccugccuccugcacggggcuccacggagcccagcucccagacacgcuacuaagugccuagggu

SEQ ID NO: 56804 - RNA, 64 nt, Homo Sapiens
auggccaagagcagaaacacagccugcauguccacucccagacguaagugccccccacccccau

SEQ ID NO: 56805 - RNA, 64 nt, Homo Sapiens
cugagacccuggcugagaaccugugcuguccugucucccagaucgggcuugugcuuggcaguuc

SEQ ID NO: 56806 - RNA, 64 nt, Homo Sapiens
gcccugcacacacagaaagccaaagcgaucggugcucccagaucccgcagccucuggagagagc

SEQ ID NO: 56807 - RNA, 64 nt, Homo Sapiens
cgaggugaugggggcuggggccccaggcgucagccucccagagggacagcugagcccccugccu

SEQ ID NO: 56808 - RNA, 64 nt, Homo Sapiens
cacacaaguccucaaaaguucagccucucacccacucccagacaguggugugucucgaccccau

SEQ ID NO: 56809 - RNA, 64 nt, Homo Sapiens
ugcuucaccagcaccugccucacucccugcccgucucccagagagggauccaggcucguagagu

SEQ ID NO: 56810 - RNA, 64 nt, Homo Sapiens
ugauccuauccaaagcggccuacagucuccugggcucccagaagaguggcaagcugccauccuc

SEQ ID NO: 56811 - RNA, 64 nt, Homo Sapiens
aacagugccgccaguacauggacuucaccucugccucccagaugucugacuccacccuucaugc

SEQ ID NO: 56812 - RNA, 63 nt, Homo Sapiens
aaagcuucagcguuggccugcuauaaaaaugccccucccagauacugucaaugguuauggguc

SEQ ID NO: 56813 - RNA, 64 nt, Homo Sapiens
gcccuggacagcaggagagggacacucagaccagcucccagaugccaaauaaacggacucagug

SEQ ID NO: 56814 - RNA, 64 nt, Homo Sapiens
ccucaagcccuauucacaggauaugcauuccaggcucccagacauggaggagacugcagucagg

SEQ ID NO: 56815 - RNA, 64 nt, Homo Sapiens
auucucuauuuuuuaaguaacugugcuggccagacucccagaaaccccacauggcccacagcuc

SEQ ID NO: 56816 - RNA, 64 nt, Homo Sapiens
uaaaacuccccaaggugccuucccugacaugaagcucccagagacaaagucugugaaaugaaag

SEQ ID NO: 56817 - RNA, 64 nt, Homo Sapiens
ugcagcugcccaaagucuguugcccgaugugcaccucccagaggcaaggugccugaaauggccg

SEQ ID NO: 56818 - RNA, 64 nt, Homo Sapiens
ugcagcuuccaaaagucccaugcccgaugugcaccucccagaaggaaggugcccgagauggccg

SEQ ID NO: 56819 - RNA, 64 nt, Homo Sapiens
ugucagagguggcugugccaugucagagaugaaacucccagaggagagguacagcugccgaaag

SEQ ID NO: 56820 - RNA, 64 nt, Homo Sapiens
uggagcuccccaaggugucauuccagagguucgacucccagaggaaaagugcccgaggcagccc

SEQ ID NO: 56821 - RNA, 64 nt, Homo Sapiens
cacuacaucuggcuuugggcugucugucccugaacucccagaacccgugcucauugcuaaccac

SEQ ID NO: 56822 - RNA, 64 nt, Homo Sapiens
gcuggguuuauagaugugagccucccaccuuggccucccagaauaacuccugggcucaagcagu

SEQ ID NO: 56823 - RNA, 64 nt, Homo Sapiens
caaauuuaagagggugggacaguccccugcuccucucccagagggcacugcuuggaaauugugu

SEQ ID NO: 56824 - RNA, 64 nt, Homo Sapiens
uauggugcucuguauucuggcauuaugcagcagccucccagaagcucucuucugcuucaaaacc

SEQ ID NO: 56825 - RNA, 64 nt, Homo Sapiens
aacuccugagcucaagugauccacccaccucagccucccagagugcuaggauuacaggccuuuu

SEQ ID NO: 56826 - RNA, 64 nt, Homo Sapiens
cugcagaucauguaaggaagggacugacaagaagcucccagaugcuggggagaaugaagagcua

SEQ ID NO: 56827 - RNA, 64 nt, Homo Sapiens
guguccaucuggggaucuaaggccucugcugaaucucccagagucaaccccagaccaucccucu

SEQ ID NO: 56828 - RNA, 64 nt, Homo Sapiens
ccgcgcugcucuucuaacuuccggaaauuucucccucccagaccaccucucccgcgccccagag

SEQ ID NO: 56829 - RNA, 64 nt, Homo Sapiens
aggagggagagaacacgcugugaaaacacagaagcucccagagaagccuucucagcuuuuaucu

SEQ ID NO: 56830 - RNA, 64 nt, Homo Sapiens
aagcagaaaggcuggaguuauuauucaacucaaucucccagagaacucagaggcuacaguuucu

SEQ ID NO: 56831 - RNA, 64 nt, Homo Sapiens
gugcugaccagggugaaggcacggcgagggacuccucccagacgugccucuugugugccagcug

SEQ ID NO: 56832 - RNA, 64 nt, Homo Sapiens
gagcguugucuggagguuccagggacagggcagccucccagagccgagcaagagcucaagguac

SEQ ID NO: 56833 - RNA, 64 nt, Homo Sapiens
agcucagcguccgcuacucagcccagccaaaacccucccagacgucuccucuccugccugggca

SEQ ID NO: 56834 - RNA, 64 nt, Homo Sapiens
uuccgugccugcuccaacucuccgugaggccccucucccagagccugacacacucuguggccga

SEQ ID NO: 56835 - RNA, 64 nt, Homo Sapiens
agagaguguauguucacccuaucuggcuguaucccauuggcaguggacagauugaggaaauucc

SEQ ID NO: 56836 - RNA, 64 nt, Homo Sapiens
ggugcugggaaucccaaagccaagguucuggcuucauuggcaacccacuaggaacuugaaugug

SEQ ID NO: 56837 - RNA, 64 nt, Homo Sapiens
gugacgggcagcaacgccguuaugcagacgccuccauuggcaaccugcugcccuccaggaugua

SEQ ID NO: 56838 - RNA, 64 nt, Homo Sapiens
cucaccgccaucauuggggagucuccauccucaucauuggcaugacggcugggccugcuucgcc

SEQ ID NO: 56839 - RNA, 64 nt, Homo Sapiens
ggcgccccacuccaucagcacuaaugcuccacuccauuggcacuaacgccccaacuccagcggc

SEQ ID NO: 56840 - RNA, 64 nt, Homo Sapiens
aacgccccgcuccaccggcaccagugccucgcuccauuggcaccaacgcccagcuccaccggua

SEQ ID NO: 56841 - RNA, 64 nt, Homo Sapiens
ggcucccugcuccaucggcacuaacgcccugcuucauuggcacuuugcugcugccuccugagca

SEQ ID NO: 56842 - RNA, 64 nt, Homo Sapiens
uccgcgggacuguguucguacgugcauaguuucgauaucacaucgcggggcuguguucguagcu

SEQ ID NO: 56843 - RNA, 64 nt, Homo Sapiens
aucgcggggcuguguucguagcugcgucguuucgauaucacacccucugugugccgccuuacuu

SEQ ID NO: 56844 - RNA, 64 nt, Homo Sapiens
ucacaguuucugaaaauguagauauaauccauuuauaucacagcaucacaacucaaaggacugu

SEQ ID NO: 56845 - RNA, 64 nt, Homo Sapiens
ucaaaggacugugauauaaugauauaauccauuuauaucacaacaucacagcucaaaggacugu

SEQ ID NO: 56846 - RNA, 64 nt, Homo Sapiens
uaaagaauucaauucuuuacagcaacguuuauggauaucacaaaucuggauagaaauagagaau

SEQ ID NO: 56847 - RNA, 64 nt, Homo Sapiens
agcccuuucuauaugagguuguaguugccaguucauaucacaaugagaugggcuucacaggaau

SEQ ID NO: 56848 - RNA, 64 nt, Homo Sapiens
aauucucaugcuaaaaauacaagaugcagauguuauaucacagcguaaggugcacaguuagcaa

SEQ ID NO: 56849 - RNA, 64 nt, Homo Sapiens
cacccccaaaauauguacaaagacagguagcaaaauaucacauaaugugacaauuacacauugu

SEQ ID NO: 56850 - RNA, 64 nt, Homo Sapiens
uuaaauauucuugaauaaaucuguuauuuuaagaauaucacauuauucaaugcauauaaaacua

SEQ ID NO: 56851 - RNA, 64 nt, Homo Sapiens
ucaacagaaauuuuagcucuuuucuuugcaagauauaucacagcugcuuugggcaguagcugaa

SEQ ID NO: 56852 - RNA, 64 nt, Homo Sapiens
gaacagucaagaaaaacauuauugaggaaaauuaauaucacagcauaaccccacccuuuacauu

SEQ ID NO: 56853 - RNA, 64 nt, Homo Sapiens
uuuguauaacccauaucugugcaauggaauauaaauaucacaaaguuguuuaacuagacugcgu

SEQ ID NO: 56854 - RNA, 64 nt, Homo Sapiens
uuuugcaccaagauaaacuggaaaauugugcaugauaucacauuuggaaaaauacauauuauga

SEQ ID NO: 56855 - RNA, 64 nt, Homo Sapiens
gauuugcuugacuauguugauauguucaagugguauaucacauuaugugguuuucaucuuucau

SEQ ID NO: 56856 - RNA, 64 nt, Homo Sapiens
cauucucaagguaguuauauauuuaaauuuucacauaucacauccagaugugcuuuuguauuaa

SEQ ID NO: 56857 - RNA, 64 nt, Homo Sapiens
ccaaguggauaaaggcaacucuuuuucaguucagauaucacaccauauccucagauuggugcag

SEQ ID NO: 56858 - RNA, 64 nt, Homo Sapiens
ccuacaggguuaccguugugcugcucaccacagagcagcugaggcauuaugccuuggaagaccu

SEQ ID NO: 56859 - RNA, 64 nt, Homo Sapiens
acuucuggacauugcauccuuauucacacauguggcagcugaacgaggugcuguuguggguguc

SEQ ID NO: 56860 - RNA, 64 nt, Homo Sapiens
augccaagcggaggccugcguggccuccugagcagcagcugaccgcccgucucaugcuggacgg

SEQ ID NO: 56861 - RNA, 64 nt, Homo Sapiens
acgccgugcggaggccuacguggcugccugagcagcagcugaccgcccgucucacuguuggcca

SEQ ID NO: 56862 - RNA, 64 nt, Homo Sapiens
gaaccauucuuuaaaggugaguggaggcugauuugcagcugaagugggccagccuugcaccagc

SEQ ID NO: 56863 - RNA, 64 nt, Homo Sapiens
agacagcuaucuaagcucuggacuaccccuuugugcagcugaaucacugcaggguugaccaugc

SEQ ID NO: 56864 - RNA, 64 nt, Homo Sapiens
uuaaauucaaccucugaacugaaaugugucaggggcagcugagcaagacagcaguuguaucccc

SEQ ID NO: 56865 - RNA, 64 nt, Homo Sapiens
accaugagcaacagauuugagguaccagugcauagcagcugaaugccagcccuguaaaagacca

SEQ ID NO: 56866 - RNA, 64 nt, Homo Sapiens
acaccauauuuaacacuauaacccuuuuuuauaagcagcugaaguuuuuuuguucuuguauuua

SEQ ID NO: 56867 - RNA, 64 nt, Homo Sapiens
aucuaggugaaaaaugacuuauacgauuuuaugggcagcugaugcugauucauuaaaauugugc

SEQ ID NO: 56868 - RNA, 64 nt, Homo Sapiens
ugcacgcagacccaucucccggggcuuccuuucugcagcugagaagcaacugaaagggagguga

SEQ ID NO: 56869 - RNA, 64 nt, Homo Sapiens
cuucccacgacagcccugccgauggugccaaagugcagcugacucggcuuggacaggcaccuga

SEQ ID NO: 56870 - RNA, 64 nt, Homo Sapiens
cccuguccaaagagaacuuacucaggcugaggcagcagcugaggcuccuacacacucucugaaa

SEQ ID NO: 56871 - RNA, 64 nt, Homo Sapiens
guacugaaggguuaaggaggcucugcauguugcugcagcugaagagacuaugacucgcgcacag

SEQ ID NO: 56872 - RNA, 64 nt, Homo Sapiens
gagcaaagggugcacugccagcacagcuacaugggcagcugaagccagugccgaagaggagcag

SEQ ID NO: 56873 - RNA, 64 nt, Homo Sapiens
ucugaggaggaggcacugcacagcaguacuaucagcagcugaucaccagugcugaggucuucug

SEQ ID NO: 56874 - RNA, 64 nt, Homo Sapiens
aagaugggccggggcaagcaagggaaugggccgagcagcugacagcauggagauggauaagacc

SEQ ID NO: 56875 - RNA, 64 nt, Homo Sapiens
gagcagcaggagguaagacugacgcccagaagaagcagcugaagugggcgucacagagcuuuca

SEQ ID NO: 56876 - RNA, 64 nt, Homo Sapiens
ucgcagcaguagcaaacuuuucacaugcuaaugugcagcugagugcacuuuauuuaaaaagaau

SEQ ID NO: 56877 - RNA, 64 nt, Homo Sapiens
gauguccuagaaguucuuugauccagaggugggugcagcugaaaguaaacagaauggauugcca

SEQ ID NO: 56878 - RNA, 64 nt, Homo Sapiens
cucaugaugugggcgcucaauucuccuuccugcugcagcugaagugagcaaguacagcggcguc

SEQ ID NO: 56879 - RNA, 64 nt, Homo Sapiens
gaguugcugacgcugcccgugaugagacugcugugcagcugagccccagguccagucugccgcu

SEQ ID NO: 56880 - RNA, 64 nt, Homo Sapiens
guggacguuaggccaggccuuaucugaaaggccagcagcugaugcuguacuaacccagucuuuc

SEQ ID NO: 56881 - RNA, 64 nt, Homo Sapiens
uccuuuucaggagauggggaauaauuuccuucaggcagcugaaauucaccaagaacagcgggua

SEQ ID NO: 56882 - RNA, 60 nt, Homo Sapiens
uauuuccucuuuauuuucccucauugaaagaugcaaaacagcucucuauuguguacagaa

SEQ ID NO: 56883 - RNA, 60 nt, Homo Sapiens
gcucucuauuguguacagaaaggguaaauaaugcaaaauaccugguaguaaaauaaaugc

SEQ ID NO: 56884 - RNA, 60 nt, Homo Sapiens
auuauuacauggugguggugguuuuauuauaugcaaaaucucugucuauuaugagauacu

SEQ ID NO: 56885 - RNA, 60 nt, Homo Sapiens
acaguaauguguguuuuguucagcauuauuaugcaaaaauucacuaguugagaugguuug

SEQ ID NO: 56886 - RNA, 60 nt, Homo Sapiens
aaauauuggcaaacaauacacagaugcaaaaugcaaaauauagaaggauuuuauucucaa

SEQ ID NO: 56887 - RNA, 60 nt, Homo Sapiens
caaaauaaaauauuggcaaauucucaacagaugcaaaaugacauuuuuagaaggauuuua

SEQ ID NO: 56888 - RNA, 60 nt, Homo Sapiens
ccuauuuuaaaaucacugugcaugcaaggcaugcaaaaaggguuuguauguagcaccuuu

SEQ ID NO: 56889 - RNA, 60 nt, Homo Sapiens
aauucaguuuauaagauaaaaauuauuuugaugcaaaagaacuuuuuuuuucuuaaagcc

SEQ ID NO: 56890 - RNA, 60 nt, Homo Sapiens
caucagcaucacccgggaacuuuuuuagaaaugcaaaaucucuacugcuuuggauccugg

SEQ ID NO: 56891 - RNA, 60 nt, Homo Sapiens
ccugggucaaaaaaaagaaaaaaaaaagaaaugcaaaacuuuaggcccugccccagauuu

SEQ ID NO: 56892 - RNA, 50 nt, Homo Sapiens
uccaacggaucaauagauaaaugcaaaaauggauaaaauaauuuuuguua

SEQ ID NO: 56893 - RNA, 60 nt, Homo Sapiens
cccuaauauauucuuauauguagagcaauaaugcaaaagcuguucuauaugcaaacauga

SEQ ID NO: 56894 - RNA, 60 nt, Homo Sapiens
uuguaauguaguaucaaaguuuuuuagguaaugcaaaauuuuacaaaucauuuguggaau

SEQ ID NO: 56895 - RNA, 60 nt, Homo Sapiens
uuuucaucaagaagguagcuugagccugaaaugcaaaacccauggaggaauucugaagcc

SEQ ID NO: 56896 - RNA, 60 nt, Homo Sapiens
uguuaucagaaauaggagaguggaugauagaugcaaaauaauaccuguccacaacaaacu

SEQ ID NO: 56897 - RNA, 60 nt, Homo Sapiens
auauacuuguauaugucacagagaaaaaaaaugcaaaauuuauaauagaguuacauuaac

SEQ ID NO: 56898 - RNA, 60 nt, Homo Sapiens
caacuuaaacuuuucuuugcaucaagguauaugcaaaacauuggugccgugcaucaccaa

SEQ ID NO: 56899 - RNA, 60 nt, Homo Sapiens
uuuucaacaaaauaguguuuuucuuuuuaaaugcaaaaccgccuuggauuuuacauauuu

SEQ ID NO: 56900 - RNA, 60 nt, Homo Sapiens
ccaaucuggcuucuagucucagcauacacgaugcaaaauaggagcaaagauuuucaaaca

SEQ ID NO: 56901 - RNA, 60 nt, Homo Sapiens
aaugagcuguaaccccuucagucacuguagaugcaaaacgguauugagugccuauucauu

SEQ ID NO: 56902 - RNA, 60 nt, Homo Sapiens
aaguauguauugagugccuauuuaucauucaugcaaaaaagguaauguaaaaucauuuca

SEQ ID NO: 56903 - RNA, 60 nt, Homo Sapiens
caaccacauacaacacaaagagaaaaagaaaugcaaaaaucucugcgugcagggacaaag

SEQ ID NO: 56904 - RNA, 60 nt, Homo Sapiens
gagugagaggucucucuuccugauuuagauaugcaaaagcugguauguucaguaggaacu

SEQ ID NO: 56905 - RNA, 60 nt, Homo Sapiens
aggcaugugugaaacauacucauagauguuaugcaaaaaaaagucuauggccagguaugc

SEQ ID NO: 56906 - RNA, 60 nt, Homo Sapiens
uuguaagcuuuaacuauaucucucuuuaaaaugcaaaauaaugucuuaagauucaaaguc

SEQ ID NO: 56907 - RNA, 60 nt, Homo Sapiens
aauucuaaauguuuaaaugcuuuucuaaaaaugcaaaacuaugauguuuaguugcuuuau

SEQ ID NO: 56908 - RNA, 60 nt, Homo Sapiens
aauguagaaaagauacucagucuuaauccuaugcaaaaaaaaaaaucaaguaauuguuuu

SEQ ID NO: 56909 - RNA, 60 nt, Homo Sapiens
agcaggccauaacuuuauuuucucaagugaaugcaaaaggaucuaaucaaaacugggagu

SEQ ID NO: 56910 - RNA, 60 nt, Homo Sapiens
aaaugcuuaaccaacacuacuaggauuaggaugcaaaaauuaaauucauagaguggauau

SEQ ID NO: 56911 - RNA, 60 nt, Homo Sapiens
ccccuuucacccaagugaugucacaguucgaugcaaaaucaaugauccagaaugaucgug

SEQ ID NO: 56912 - RNA, 60 nt, Homo Sapiens
acucaaaguguuucuuaagggugaguuggcaugcaaaaaauuacauugauuacagugugu

SEQ ID NO: 56913 - RNA, 60 nt, Homo Sapiens
auucugauuacuuuagccuuaucaguagcaaugcaaaaauucauuuuuaaauaauucaaa

SEQ ID NO: 56914 - RNA, 60 nt, Homo Sapiens
uguauuuuccuguggcccauagcuccacaaaugcaaaagaucuccaacacauuguuucug

SEQ ID NO: 56915 - RNA, 60 nt, Homo Sapiens
gcuagcuugauuuuaaaaaaauguuuguauaugcaaaacucuuguauauuagcaauuaua

SEQ ID NO: 56916 - RNA, 60 nt, Homo Sapiens
aaaagaaaagaaaaccacccgauuuuuuuuaugcaaaaagcuuccacacauuaauggcau

SEQ ID NO: 56917 - RNA, 60 nt, Homo Sapiens
uguagaaagaguuuaaaaccaguauuuuuaaugcaaaaaaacuuuccucagauuuucaaa

SEQ ID NO: 56918 - RNA, 60 nt, Homo Sapiens
uugucuauauauauuuguguuuaaaaugguaugcaaaauuauauuuccaaaaaugaaccu

SEQ ID NO: 56919 - RNA, 60 nt, Homo Sapiens
auucuuauggcggaguuuuuuuaaaaaaaaaugcaaaaaaauguaagugucgauguuuuu

SEQ ID NO: 56920 - RNA, 60 nt, Homo Sapiens
gcagcugaaauaauaccuuaguuugcagacaugcaaaacugugugugugugugugugugu

SEQ ID NO: 56921 - RNA, 60 nt, Homo Sapiens
aauggcacaggugaugccaggagacuguguaugcaaaaugaguccgguaggaugucaggu

SEQ ID NO: 56922 - RNA, 60 nt, Homo Sapiens
acaucuguacucgucaaucaacaaaaccugaugcaaaaaacagaaaaggggugauguagg

SEQ ID NO: 56923 - RNA, 60 nt, Homo Sapiens
acuaaagcuggcacucccccagccguucucaugcaaaauaccugugucagaauacuccuu

SEQ ID NO: 56924 - RNA, 60 nt, Homo Sapiens
acuacaagaagaauguaguugugcaaaucuaugcaaaacugaugguggccugcuauuucc

SEQ ID NO: 56925 - RNA, 60 nt, Homo Sapiens
cagcugugugauauucugcugugcaaauccaugcaaaacugacugugguagugaaaaguc

SEQ ID NO: 56926 - RNA, 60 nt, Homo Sapiens
gacaucuuuaacauaguccuuuuaugugcuaugcaaaauaaguaaacaggaaaccuacuu

SEQ ID NO: 56927 - RNA, 60 nt, Homo Sapiens
aaccaaguccuccgaaggcaaugagagcaaaugcaaaaauucauuccaaaaagaacaaua

SEQ ID NO: 56928 - RNA, 60 nt, Homo Sapiens
augguguuuucagggaacacagaaaugcggaugcaaaacaacuuuugacagaggcccauc

SEQ ID NO: 56929 - RNA, 60 nt, Homo Sapiens
guuugcagaacacugauuugaaagcuuccuaugcaaaaugagaagggguucaaauauauu

SEQ ID NO: 56930 - RNA, 60 nt, Homo Sapiens
guuaaaaaaaaaaaaaaacaagacccauuuaugcaaaaauaaacugguuaccuguaucaa

SEQ ID NO: 56931 - RNA, 60 nt, Homo Sapiens
gguuuugugucauuaacugaaugucauaugaugcaaaaaauaaguugauuuacugaugau

SEQ ID NO: 56932 - RNA, 60 nt, Homo Sapiens
uguaguuaaauuugaccucaaauguagacaaugcaaaauucuuuuaagaaucauguguuc

SEQ ID NO: 56933 - RNA, 54 nt, Homo Sapiens
ucacaaaggcuccauguuaccuugaugcaaaacaacuacugucuuacagauuga

SEQ ID NO: 56934 - RNA, 60 nt, Homo Sapiens
uuaauuugucuuuauuuuuuuuaaauuuuaaugcaaaauuaagaggaauaugguauaauu

SEQ ID NO: 56935 - RNA, 60 nt, Homo Sapiens
gucuuuuccuagcuuccuggaguuccacugaugcaaaaggacuuguggaaagcuucaagg

SEQ ID NO: 56936 - RNA, 60 nt, Homo Sapiens
gaaaaaaaaaaaaggugacaaagguaggaaaugcaaaaaaaauauauauauauaugucaa

SEQ ID NO: 56937 - RNA, 60 nt, Homo Sapiens
gaaaacacacacaaccaauacauauuucuuaugcaaaaaggagccucuggacuaaaugga

SEQ ID NO: 56938 - RNA, 60 nt, Homo Sapiens
uuuuuugaagugaauucuuuugaaaaaaaaaugcaaaacuagaaaacuuuauucauuuua

SEQ ID NO: 56939 - RNA, 60 nt, Homo Sapiens
aacaucugcauaauuucacuuaaaauuauuaugcaaaaaugaauguuuuuucaaaaaaug

SEQ ID NO: 56940 - RNA, 60 nt, Homo Sapiens
uugguguggcugcaaauuucauacuaccucaugcaaaauauauuucuuauucagugcuga

SEQ ID NO: 56941 - RNA, 60 nt, Homo Sapiens
ggauuuauuuucuuaaguuugagcacuagaaugcaaaagagagagaaggccuagagguua

SEQ ID NO: 56942 - RNA, 64 nt, Homo Sapiens
cccuugccuauguguggcagagaugcaccaugcaugcucacaguuguauucagagcaccucucc

SEQ ID NO: 56943 - RNA, 64 nt, Homo Sapiens
caguaugugugaagaucccucagccaagaugcucugcucacaguuguaauaggccauggcacac

SEQ ID NO: 56944 - RNA, 64 nt, Homo Sapiens
gccaggcccauuuccugcuuuuguguaaggaaggugcucacauaggaaguuuuuauuugguuag

SEQ ID NO: 56945 - RNA, 64 nt, Homo Sapiens
augaggcagcugaggccuggggaugugaacaaccugcucacaguccucauuuacuggauuugac

SEQ ID NO: 56946 - RNA, 64 nt, Homo Sapiens
uuucccugcugaccuucuucgauacagauuccuuugcucacaugcuuuccuugaacuuauucgu

SEQ ID NO: 56947 - RNA, 64 nt, Homo Sapiens
aacaugcgcuguaaugaaucuagccccaacucugugcucacagaauguuguuagccuauaacuu

SEQ ID NO: 56948 - RNA, 64 nt, Homo Sapiens
gaauuaugggaugccuuaagugcuguuacuagguugcucacagccuaaccuggcguguuguuua

SEQ ID NO: 56949 - RNA, 64 nt, Homo Sapiens
cugacaacccagugaggcagauacacuuucuuacugcucacaucuuacaggugaguacucauaa

SEQ ID NO: 56950 - RNA, 64 nt, Homo Sapiens
uaacaaagagaggaaaugugcauauuggauuacaugcucacauuuuaugaccaagggcuugaaa

SEQ ID NO: 56951 - RNA, 64 nt, Homo Sapiens
ugcagagacugacaauugugggcauuaugucuguugcucacagaucucccuaggaugccaaagu

SEQ ID NO: 56952 - RNA, 64 nt, Homo Sapiens
gguggaguggaaaaagauauggugaaggcagaacugcucacaccagcuccagaagcacguccuc

SEQ ID NO: 56953 - RNA, 64 nt, Homo Sapiens
guaaauucuguuaauaaacaaggaguucauccguugcucacaucuuucauuggugcccucugaa

SEQ ID NO: 56954 - RNA, 64 nt, Homo Sapiens
cucaagggaagagauugcccaggcacuaccacucugcucacauguuccccccuuggcaaugugg

SEQ ID NO: 56955 - RNA, 64 nt, Homo Sapiens
uucugacauccuggauaguguggggagguaauggugcucacaguagguuaauuggagacaccau

SEQ ID NO: 56956 - RNA, 64 nt, Homo Sapiens
ccaggaaaauguggagacaguucuucuccuccacugcucacaggaggcccgugguaauucuccc

SEQ ID NO: 56957 - RNA, 64 nt, Homo Sapiens
uuuaguacuggaauugcacuugggguugacaaggugcucacaccaugagaauggaggcaggaau

SEQ ID NO: 56958 - RNA, 64 nt, Homo Sapiens
caguaucagucuuguccugggagccggguccugcugcucacaagcccagagcugccagggagcu

SEQ ID NO: 56959 - RNA, 64 nt, Homo Sapiens
auuccaaauauuuguucccaaguagcuacugaacugcucacaccauuggaagauuuuguauuuu

SEQ ID NO: 56960 - RNA, 64 nt, Homo Sapiens
uacaagugcaaacaauguggcaaaacuuaauuuaugcucacaccuuacugcacagaaaagaauu

SEQ ID NO: 56961 - RNA, 64 nt, Homo Sapiens
caaauauaaagaauguggaaaagccguuaauaucugcucacaucuuacucagcaucagaaagua

SEQ ID NO: 56962 - RNA, 64 nt, Homo Sapiens
cgccuacaugugugaacaauauggcaaaacuuaaugcucacacuuuauugcuaggaaagcauuu

SEQ ID NO: 56963 - RNA, 64 nt, Homo Sapiens
caaauauaaagacugugaaaaagccaucauuaucugcucacauuuuacucaacacagagaguuc

SEQ ID NO: 56964 - RNA, 64 nt, Homo Sapiens
uaccagugugaacaacguggccaagcuucgacaaugcucacacccuauugcacaggaaagcauu

SEQ ID NO: 56965 - RNA, 64 nt, Homo Sapiens
caaauauuggcaaaguaaaaaauccauuaacaccugcucacaucuuacucaaaauuguagaguu

SEQ ID NO: 56966 - RNA, 64 nt, Homo Sapiens
uuacucaacaucagagaguuaagccauuaauacaugcucacauccaaauauaaagacugugaaa

SEQ ID NO: 56967 - RNA, 64 nt, Homo Sapiens
uucacaggaaagcauuuauaaaacuuuuaacuaaugcucacacccaugugugaacagugugaca

SEQ ID NO: 56968 - RNA, 59 nt, Homo Sapiens
aaguaaaccucuucccguggcaauaaacagccuccuauaucaauaacauuuuaaaggac

SEQ ID NO: 56969 - RNA, 59 nt, Homo Sapiens
uuaaaauacuguauucgcaucgugugcuugccuccuaaugguagaguaacaccuuuaua

SEQ ID NO: 56970 - RNA, 59 nt, Homo Sapiens
ucauuauuucaagaggaacccaaaguccagccuccuacauagaugcugccccacgaagg

SEQ ID NO: 56971 - RNA, 59 nt, Homo Sapiens
uccccagcucaagcaauccucccaccucagccuccuaaguaccugguacuacaggcgcg

SEQ ID NO: 56972 - RNA, 59 nt, Homo Sapiens
cugcuucuccacaggugcggccuggcccggccuccuaaaggccacacccuccccacgca

SEQ ID NO: 56973 - RNA, 59 nt, Homo Sapiens
ccgccuuccacgcuaggauguaagaggucgccuccuauuguacauuuggggaaagccuu

SEQ ID NO: 56974 - RNA, 59 nt, Homo Sapiens
cuggguggagggaguggcaagucaggcgugccuccuacaagcuuccuaaccucuuaagc

SEQ ID NO: 56975 - RNA, 59 nt, Homo Sapiens
agauugugggaaauggucauuugcugagcgccuccuaguugccaggcacuggagggcgc

SEQ ID NO: 56976 - RNA, 64 nt, Homo Sapiens
agucuucuuuccuucugacagaccaggucaucuggcuuccgagaucaucagagaagauaagucu

SEQ ID NO: 56977 - RNA, 64 nt, Homo Sapiens
ccgucguccucccagacaaaugaaaccacgcugcgcuuccgaugcccccgcuugccguguaaug

SEQ ID NO: 56978 - RNA, 64 nt, Homo Sapiens
ccuagccggggcccgagggaagcggagauccccggcuuccgacguccuugggcaccgucgccuc

SEQ ID NO: 56979 - RNA, 64 nt, Homo Sapiens
aucucaggagaauagcuuuuacucugguaggaaugcuuccgagacaccacaaggcagccugaac

SEQ ID NO: 56980 - RNA, 64 nt, Homo Sapiens
acgcuguaggguaugggaagaaacccucgggaaugcuuccgagccgccgggaggcguugggcag

SEQ ID NO: 56981 - RNA, 64 nt, Homo Sapiens
ccagcaguacgagaugcucagguggagaucggccgcuuccgagagcagagaucgaagccgugga

SEQ ID NO: 56982 - RNA, 64 nt, Homo Sapiens
auuaaaucuaagucauuugauuuccauuuaguuugcuuccgaugaauucuucucuauuguaagg

SEQ ID NO: 56983 - RNA, 64 nt, Homo Sapiens
agacgugguugcucuccacggggaagggccgcuggcuuccgaacuucuggccuguggcagggcc

SEQ ID NO: 56984 - RNA, 64 nt, Homo Sapiens
gcaguaagaagcgugucugggucuggagaagggugcuuccgagagugugcagguggcccuuccc

SEQ ID NO: 56985 - RNA, 60 nt, Homo Sapiens
agaaagcacaugaguccuaaugccccagcagcuuccgauuggaaaaugcaaauuguuuuu

SEQ ID NO: 56986 - RNA, 64 nt, Homo Sapiens
gggauuucacuugggaaaugaaguacuuuaguuggcuuccgaguuccagacuauauguccagau

SEQ ID NO: 56987 - RNA, 64 nt, Homo Sapiens
agcuaguguuaauccagagaaccccccgcaaugugcuuccgagauucagacugcuucauuggga

SEQ ID NO: 56988 - RNA, 64 nt, Homo Sapiens
caacucccuccuuuagugaaggagccguguuagagcuuccgagaauagcuccacuggagagaag

SEQ ID NO: 56989 - RNA, 64 nt, Homo Sapiens
uguuuuauugagggcuacuauguuggacuuagaggcuuccgaacuuuucacaucaaaaugaugc

SEQ ID NO: 56990 - RNA, 64 nt, Homo Sapiens
gauccuugaaggaaccuggucagucuccgguucagcuuccgacaccagaguggaacccaguaag

SEQ ID NO: 56991 - RNA, 64 nt, Homo Sapiens
auuugaaaauaggauccaaaucuuuucugaagaugcuuccgaagugaaacaaacaauaugcacu

SEQ ID NO: 56992 - RNA, 64 nt, Homo Sapiens
ugccccaacugaauguguucugucacucagcuuugcuuccgacaccucuguuuccucuuccccu

SEQ ID NO: 56993 - RNA, 64 nt, Homo Sapiens
gcagaaauagucccauguaucuaucugcgcagacgcuuccgaggccugccacuugcuaaccaug

SEQ ID NO: 56994 - RNA, 64 nt, Homo Sapiens
aaaagaagaaagcaauaucucccacccugugucugcuuccgaaucaggaggugucgcacugccu

SEQ ID NO: 56995 - RNA, 64 nt, Homo Sapiens
aucaggagaggguagcugccugcauaggagccucgcuuccgauuauucccuucccaauauuauu

SEQ ID NO: 56996 - RNA, 64 nt, Homo Sapiens
cuaaguaccacucauggagaguaugugcugagaugcuuccgaccuuucaggugacgcaggaaca

SEQ ID NO: 56997 - RNA, 64 nt, Homo Sapiens
agcuguacagacucuuucagagguuuaacgugcugcuuccgaugugccaccugcaguaguggau

SEQ ID NO: 56998 - RNA, 64 nt, Homo Sapiens
cagcuggcucugacaagaugguccauuuguuccugcuuccgagauccccagggcagccuggauc

SEQ ID NO: 56999 - RNA, 64 nt, Homo Sapiens
cgagagguuaagguggcuucuguggccacgaagcgcuuccgagcugugcccagucccgggaauu

SEQ ID NO: 57000 - RNA, 64 nt, Homo Sapiens
gucucccucgacccucugucuggagucacugggggcuuccgagguuuggggcugccccuuuguc

SEQ ID NO: 57001 - RNA, 64 nt, Homo Sapiens
agagcccaguuaauucuccgcaccucgguugugugcuuccgaaugggcucacucccgugguggu

SEQ ID NO: 57002 - RNA, 64 nt, Homo Sapiens
ucaccgacgaugagggcgcaccugcuguccuggagcuuccgaucucuguucggggacccuguga

SEQ ID NO: 57003 - RNA, 64 nt, Homo Sapiens
ccuaaggcaauagugcacaacuuagguuauuuuugcuuccgaauuugaaugaaaaacuuaaugc

SEQ ID NO: 57004 - RNA, 64 nt, Homo Sapiens
caugucuaugcucuacccccaggguagcaucucagcuuccgaacccugggcuguuuccuuaguc

SEQ ID NO: 57005 - RNA, 64 nt, Homo Sapiens
uaccuaggggagcugcugcugccugcucauucuagcuuccgauuccauucccagccccugcguu

SEQ ID NO: 57006 - RNA, 64 nt, Homo Sapiens
ucagaugagaucaggcgcgucccgacccugcuuagcuuccgagaccauccaaguacuaaccagg

SEQ ID NO: 57007 - RNA, 64 nt, Homo Sapiens
uuaacuuuaggcuuuugggcauaugcuagucugagcuuccgaaaagauacauauauguuucccu

SEQ ID NO: 57008 - RNA, 64 nt, Homo Sapiens
cucaaucaacuugcugauauuuuaguaguuaacagcuuccgagccuaucaugcaauuuggaguc

SEQ ID NO: 57009 - RNA, 64 nt, Homo Sapiens
accuaguaagcaaccaagagacccucccuucauggcuuccgaucagauggcaagggucuuugca

SEQ ID NO: 57010 - RNA, 64 nt, Homo Sapiens
uuuuacguuugcagcacaacaccauugcccggaggcuuccgaaucuagcaaagcagcauauuaa

SEQ ID NO: 57011 - RNA, 64 nt, Homo Sapiens
cugaucccuaaguugagaccugucuuccuguaacgcuuccgaauaagagguccggucgaaaaga

SEQ ID NO: 57012 - RNA, 50 nt, Homo Sapiens
ccccgcgcuuccagcccugagcuuccgaugcggggagagcagagccucgg

SEQ ID NO: 57013 - RNA, 64 nt, Homo Sapiens
agccacucucccuggggccucuggggugagagcagcuuccgauaggaccugcccagauuucugc

SEQ ID NO: 57014 - RNA, 64 nt, Homo Sapiens
cucccucugaaccacugaaacucggcacuccugggcuuccgauguagucacagagaugugugug

SEQ ID NO: 57015 - RNA, 64 nt, Homo Sapiens
gucccguuccuuuaccauaggauucuccacaguggcuuccgacucaggcuccaauggaccaaau

SEQ ID NO: 57016 - RNA, 64 nt, Homo Sapiens
ggcggcuaccggggccgcggcggggaccguggaggcuuccgagggggccggggugguggggaca

SEQ ID NO: 57017 - RNA, 64 nt, Homo Sapiens
guucuucaagugggccaacauucaggugugcucggcuuccgagacacagcuucaccaggggcuu

SEQ ID NO: 57018 - RNA, 64 nt, Homo Sapiens
caggaaccagcacugucucuccuggccaagcccagcuuccgaaguuccuguggcucccuccaaa

SEQ ID NO: 57019 - RNA, 64 nt, Homo Sapiens
ccccugaaagacacugcuccagagaaacuaccccgcuuccgaagcucuccccucccuuugaaug

SEQ ID NO: 57020 - RNA, 64 nt, Homo Sapiens
cuggggucagggcaggaaggaacuucacucugcugcuuccgagaaccucggccgugacauucgg

SEQ ID NO: 57021 - RNA, 64 nt, Homo Sapiens
cccugagagcggacaucucccaagaggcugaggggcuuccgagccaugucucccguuggggagg

SEQ ID NO: 57022 - RNA, 64 nt, Homo Sapiens
uaagaauuuuauggucaucuucaccuucaagaaagcuuccgaggccgugucuugugaacuccca

SEQ ID NO: 57023 - RNA, 64 nt, Homo Sapiens
uacagggcugggaccaggucccucaccuccuggggcuuccgagccccagcccuaagggugugaa

SEQ ID NO: 57024 - RNA, 64 nt, Homo Sapiens
gcccucuguugaaauugucaggucagggaagugggcuuccgaguggcccugagguggcagcagg

SEQ ID NO: 57025 - RNA, 64 nt, Homo Sapiens
ugggaugagaggaaggaaaccaccuugauaaggugcuuccgagcgaaacagaagcggcucaguu

SEQ ID NO: 57026 - RNA, 64 nt, Homo Sapiens
ugggaugagaggaagggaaacaccuugauaaggugcuuccgagcgaaacagaagcggcucaguu

SEQ ID NO: 57027 - RNA, 64 nt, Homo Sapiens
ccucuguuuccucuuccccuugucacucagcuuugcuuccgacaugcccugacugaauguguuc

SEQ ID NO: 57028 - RNA, 64 nt, Homo Sapiens
cuggcugucagagugaaaugacuuuccauguggugcuuccgaccagugagcaguuauggacagc

SEQ ID NO: 57029 - RNA, 64 nt, Homo Sapiens
gcacuaccgggggcucugagcuccagcacaugcggcuuccgagggauccuugccuccaacgugc

SEQ ID NO: 57030 - RNA, 64 nt, Homo Sapiens
acuggccucugcugccaggccacugccugucucugcuuccgacuuugucuucuuucucccuuuc

SEQ ID NO: 57031 - RNA, 64 nt, Homo Sapiens
uggcggacugcccaggggcccuccagcccugagugcuuccgagcgcccaugcuuagagcccagg

SEQ ID NO: 57032 - RNA, 64 nt, Homo Sapiens
caaguuuguggagaguacagacugcguuggcugggcuuccgagagcuucggccugccuaagucu

SEQ ID NO: 57033 - RNA, 63 nt, Homo Sapiens
uaccucaaguugcuuggcagcacaacuaucuuugcaaaaaaaaguaaagaaaaaguaaaugau

SEQ ID NO: 57034 - RNA, 63 nt, Homo Sapiens
gaauaaucaaagugauuuuucagaauuaugugugcaaaaaauuaaugugcauucauauauucu

SEQ ID NO: 57035 - RNA, 63 nt, Homo Sapiens
aaaaaaaaaaaaaucucagaaaaauagaaaauugcaaaaaaaauugaugagcuuaaaaaaaua

SEQ ID NO: 57036 - RNA, 63 nt, Homo Sapiens
gaagugagucagagcccauuaaaaccuaucuuggcaaaaaaaguuagaaaaaaacaacaaagc

SEQ ID NO: 57037 - RNA, 63 nt, Homo Sapiens
ucaaauuuuuuucagcagugcaaauacaaacaagcaaaaaaccucauuugaaguuggcaaaaa

SEQ ID NO: 57038 - RNA, 63 nt, Homo Sapiens
aaauuacauuaugcccuugaugcuaaguaaggggcaaaaaaaaaaugggcugcugucauuuua

SEQ ID NO: 57039 - RNA, 63 nt, Homo Sapiens
gcaucgauccccagccugguaacugggaaauaagcaaaaaacuuguuuucgagcaggacuaac

SEQ ID NO: 57040 - RNA, 63 nt, Homo Sapiens
acaguguugaaauuggaaagucuuccuguaguggcaaaaaagauguuauaacaccaucuggag

SEQ ID NO: 57041 - RNA, 63 nt, Homo Sapiens
uuugaugggauuuuaaauucuuuaugcuuaagagcaaaaaaguuauguaugcuauuuguugua

SEQ ID NO: 57042 - RNA, 63 nt, Homo Sapiens
auuguagcuuuaaaauaacaugcaacugauuuugcaaaaaaaaccuggcuuguuuugucucuu

SEQ ID NO: 57043 - RNA, 63 nt, Homo Sapiens
gcacaauaauuuaacugaaaaccuagaaauuaagcaaaaaauaaugauaaacacgcaaaaaaa

SEQ ID NO: 57044 - RNA, 63 nt, Homo Sapiens
ccuagaaauuaagcaaaaaaacaugauaaacacgcaaaaaaaaugcccacuuuaccuacggag

SEQ ID NO: 57045 - RNA, 63 nt, Homo Sapiens
gcacaucaacugcgaaguuaagcacuuuuaauagcaaaaaaaggacauuuuagcauguuaaau

SEQ ID NO: 57046 - RNA, 63 nt, Homo Sapiens
ccacaugaauaaagcaauaaaccacagugccuugcaaaaaacauuccaaguuuucuaguccau

SEQ ID NO: 57047 - RNA, 63 nt, Homo Sapiens
ugauauguacuauagugauucuguuuuugaggugcaaaaaacauacauauauaccaguuggua

SEQ ID NO: 57048 - RNA, 63 nt, Homo Sapiens
ggagaugcuuauagaugauaguuguacauaugugcaaaaaaaaauccacuugcaaugguaaga

SEQ ID NO: 57049 - RNA, 63 nt, Homo Sapiens
augauauuuuaggaauaacggacuuuuaaagaagcaaaaaaaaagacugaauuuccuugcuua

SEQ ID NO: 57050 - RNA, 63 nt, Homo Sapiens
cauguuuaauuuguauuuguaaaaaaacaaaaagcaaaaaaauucccaaaacccagauaacaa

SEQ ID NO: 57051 - RNA, 63 nt, Homo Sapiens
gcccaaagauuacauguugguguucaaaguguagcaaaaaaugauguauauuuauaaaucuau

SEQ ID NO: 57052 - RNA, 63 nt, Homo Sapiens
ccaagccauguaaaagaucuacuuuuucuaagggcaaaaaaaaaaaaaaaaaaaaaagaacac

SEQ ID NO: 57053 - RNA, 63 nt, Homo Sapiens
uuaccuggucauuuugugaucacaagagucuaugcaaaaaaaaaaauuucuuuaccccagauu

SEQ ID NO: 57054 - RNA, 63 nt, Homo Sapiens
acuacagaucuggauggcuauucagauaacauggcaaaaaaugauagcagaagaucauuaaaa

SEQ ID NO: 57055 - RNA, 63 nt, Homo Sapiens
cauuuggacagauccugucauuguuuaagcugagcaaaaaaccacacaaaaguuguguaagag

SEQ ID NO: 57056 - RNA, 63 nt, Homo Sapiens
ccugacauaguaaaguuugcuuucauaacugcagcaaaaaaggucaacuugccaagucacugc

SEQ ID NO: 57057 - RNA, 63 nt, Homo Sapiens
cuauuaaccuauauaaccauugaauuuugaaaagcaaaaaauaguaauagacaucaccagcaa

SEQ ID NO: 57058 - RNA, 63 nt, Homo Sapiens
caaaaauuagcuggguauggaaacacugucucugcaaaaaauaccagccuggacaacauagug

SEQ ID NO: 57059 - RNA, 63 nt, Homo Sapiens
acuuggauauaugguugaagaaucaaaacaaaagcaaaaaaaaaaagcaaaaaaagaaaagag

SEQ ID NO: 57060 - RNA, 63 nt, Homo Sapiens
guugaagaaucaaaacaaaagcaaaaaaaaaaagcaaaaaaagaaaagagaaaaaaagaaaaa

SEQ ID NO: 57061 - RNA, 63 nt, Homo Sapiens
auuuuuucaaagaaaaauuuuuaaugggccaaugcaaaaaaucucauuauuuaucuauguuua

SEQ ID NO: 57062 - RNA, 63 nt, Homo Sapiens
aaccuuugcuuuuuuuuuuuaacaaaagacaaagcaaaaaauaaauucucaugcuaaaaauac

SEQ ID NO: 57063 - RNA, 63 nt, Homo Sapiens
aaaagucaaaccaaacuuccccccccgccccccgcaaaaaaguuagucaauucugaaccacca

SEQ ID NO: 57064 - RNA, 63 nt, Homo Sapiens
auucacgcuuggugugaauauuaacuuuugcuggcaaaaaaaaaaagagguuucuuugauguu

SEQ ID NO: 57065 - RNA, 63 nt, Homo Sapiens
gaaaugugaacugaacaggagaaaaaaagaaaagcaaaaaacuccuguaacccuugagauuaa

SEQ ID NO: 57066 - RNA, 63 nt, Homo Sapiens
uucaggcuaaugauuaccucuuauucucuacaugcaaaaaauuaaauauuuuguguucaaaua

SEQ ID NO: 57067 - RNA, 63 nt, Homo Sapiens
agauggaacuucaggucuuaagugcaaaucaaagcaaaaaacaaacaaaacuuacauggaaaa

SEQ ID NO: 57068 - RNA, 63 nt, Homo Sapiens
ccuaggcaacagagcgagacucugucuccccccgcaaaaaaaaaaaagaaagaaagaaagaga

SEQ ID NO: 57069 - RNA, 63 nt, Homo Sapiens
uacacauaacauggguuauuuaguuuaacucuggcaaaaaaaaaaaaaaaaauuuuguauguu

SEQ ID NO: 57070 - RNA, 63 nt, Homo Sapiens
aacucaaaguguuucuuaagggugaguuggcaugcaaaaaauuacauugauuacaguguguuu

SEQ ID NO: 57071 - RNA, 63 nt, Homo Sapiens
cugucguuaaaacugaggauuugcaauauuuuugcaaaaaaauccuacaaaaauaaacugaac

SEQ ID NO: 57072 - RNA, 63 nt, Homo Sapiens
acuaagauguacgggucuugaaaaagcaaaacugcaaaaaaguucacagcuaugacaaaaccg

SEQ ID NO: 57073 - RNA, 63 nt, Homo Sapiens
aacuuuucauguagcguaucacauaacuuuuuugcaaaaaauauaaaaagaaauaaacuucaa

SEQ ID NO: 57074 - RNA, 63 nt, Homo Sapiens
gaaugaaaauauguggacugucauuuuguugcagcaaaaaaguguuaauaaaaugcucuauuu

SEQ ID NO: 57075 - RNA, 63 nt, Homo Sapiens
ucuuauggcggaguuuuuuguuuaaaaaaaaaugcaaaaaaaugauguaagugucgauguuuu

SEQ ID NO: 57076 - RNA, 63 nt, Homo Sapiens
ggugggugggaugaaacauguaggucugggagggcaaaaaagaaauuaauuugcuucuguuuu

SEQ ID NO: 57077 - RNA, 63 nt, Homo Sapiens
uauauauauaccuauauuuaucucccugccaaggcaaaaaauaugcaaaaaaugauaugaguu

SEQ ID NO: 57078 - RNA, 63 nt, Homo Sapiens
auaugaguuucucccugccauauuuuuaugauugcaaaaaauguguuuuuauuuuauuuugcu

SEQ ID NO: 57079 - RNA, 63 nt, Homo Sapiens
auucuuuugaauuguuacaucaugcuggaaccugcaaaaaauacuuuuucuaaugaggagaga

SEQ ID NO: 57080 - RNA, 63 nt, Homo Sapiens
guuaauagauuuuuucagacuugucaagccugugcaaaaaaauuaaaauggaugccuugaaua

SEQ ID NO: 57081 - RNA, 63 nt, Homo Sapiens
uuucaaaauagaaaaguuauuagugguuuaucagcaaaaaaguccaauuuuaauuuaguaaau

SEQ ID NO: 57082 - RNA, 63 nt, Homo Sapiens
ccccagcuauugucuguuguguucagcugagaugcaaaaaagaaauuaagcaaaaaagaaaaa

SEQ ID NO: 57083 - RNA, 63 nt, Homo Sapiens
uuguguucagcugagaugcaaaaaagaaauuaagcaaaaaagaaaaagaugaagacuuuucau

SEQ ID NO: 57084 - RNA, 63 nt, Homo Sapiens
aaauucuauugaaaaaggaaaaucagcaauucagcaaaaaauaaauaaaaaauaaaaauguaa

SEQ ID NO: 57085 - RNA, 63 nt, Homo Sapiens
gugaccgaccccuuggccaaaaaaaaacaaaaagcaaaaaacaaaaaccuacccuguucuggu

SEQ ID NO: 57086 - RNA, 63 nt, Homo Sapiens
cuaugacagagcaaugcuuuuaaugaauuuaaggcaaaaaagguggagagggagaugugugag

SEQ ID NO: 57087 - RNA, 63 nt, Homo Sapiens
auaaacguggauuuuaaaaaaucaaucaauggugcaaaaaaaaacuuaaagcaaaauaguauu

SEQ ID NO: 57088 - RNA, 63 nt, Homo Sapiens
guaauggcaaaguuugccaacaguuuggauucugcaaaaaaggcaaggaaccagggaugaaau

SEQ ID NO: 57089 - RNA, 63 nt, Homo Sapiens
aaaauaacucuccugaacaucagcuauaauuuugcaaaaaagguuguauuuuacagaugcaaa

SEQ ID NO: 57090 - RNA, 62 nt, Homo Sapiens
aaguuguuaaauaaaguuauaauacagcugugaagggcuaaaguuagaguugauuacauaag

SEQ ID NO: 57091 - RNA, 62 nt, Homo Sapiens
uuagguuugaaaauacuauuuaauaagggcagaagggcuauauaugauuuggcuauuauuuc

SEQ ID NO: 57092 - RNA, 62 nt, Homo Sapiens
auccagaucaacacccuuucuuccauacagaaaagggcuaaccauaccacagcuggaaucuc

SEQ ID NO: 57093 - RNA, 62 nt, Homo Sapiens
aaaauuauauuuagaauuuuuaaacauguacaaagggcuacauuuuaauuuuaaaauagcuu

SEQ ID NO: 57094 - RNA, 62 nt, Homo Sapiens
ccccauucucuuggggucagggaggggcugggaagggcuacugaaggccccauucucccaca

SEQ ID NO: 57095 - RNA, 62 nt, Homo Sapiens
aacauuuuuauaugauuauaaaagaauucuucaagggcuaauuaccuaaccagcuuguauug

SEQ ID NO: 57096 - RNA, 62 nt, Homo Sapiens
uuacuacauauuuuccaucuguaguuucucagaagggcuauggauuaguuugaacugucaaa

SEQ ID NO: 57097 - RNA, 62 nt, Homo Sapiens
ggaggaacacuaugguuaacccucucuugauuaagggcuacuuaaugcacagugcauuaugu

SEQ ID NO: 57098 - RNA, 62 nt, Homo Sapiens
gcaagggggugucaucugaggcaccagagugaaagggcuaugcuuucucccccgacacugcu

SEQ ID NO: 57099 - RNA, 62 nt, Homo Sapiens
uucuggaagucuccccaggcuccucagggucaaagggcuacucaucacgacugauccccacc

SEQ ID NO: 57100 - RNA, 62 nt, Homo Sapiens
cucuggcaucuccagguguugacagauaggccaagggcuacuacugugugggagccuggacu

SEQ ID NO: 57101 - RNA, 62 nt, Homo Sapiens
ggcacugccaggggaagggaaucuauauacugaagggcuaguuuccaucugggagaggcaga

SEQ ID NO: 57102 - RNA, 62 nt, Homo Sapiens
auuuaugucauuuuauagcacagaaacagaucaagggcuauagaagaagcuggcauuguuua

SEQ ID NO: 57103 - RNA, 62 nt, Homo Sapiens
uugguauugaaagcaugcugagauccuauuuaaagggcuaauaugagaagcuuuauuaagaa

SEQ ID NO: 57104 - RNA, 62 nt, Homo Sapiens
cagggggcaaauugagccccugaggagggcagaagggcuagggagagccaugaggagagggc

SEQ ID NO: 57105 - RNA, 62 nt, Homo Sapiens
gaugaggguugguggggcucggaccugugaauaagggcuaauagaggagccgcccacuucca

SEQ ID NO: 57106 - RNA, 62 nt, Homo Sapiens
uuucuuuucuuucuuuuguucccuuuacuacaaagggcuauugcucuugccuucccagcaug

SEQ ID NO: 57107 - RNA, 62 nt, Homo Sapiens
caucuguuugcuccaguuuucugguuuuucuaaagggcuauuccacaucaguucaacauccu

SEQ ID NO: 57108 - RNA, 62 nt, Homo Sapiens
ccaccgcagcagccucccucgcugggguggagaagggcuagcccaauggggguggggaaguu

SEQ ID NO: 57109 - RNA, 62 nt, Homo Sapiens
gcaaauauaaaauuaaauguuaugcauugauuaagggcuagacuuaaaaauguuuuuguugu

SEQ ID NO: 57110 - RNA, 62 nt, Homo Sapiens
augaguuccagucugaauacagguagauauuaaagggcuaauaaaaaaugagaaaccggucg

SEQ ID NO: 57111 - RNA, 62 nt, Homo Sapiens
ggagaaaauuuucgcaaccuacucaucugacaaagggcuaauaaccagaaucuacaaugaac

SEQ ID NO: 57112 - RNA, 62 nt, Homo Sapiens
uugaguagauauuuuaaacaccuaacaaaguaaagggcuaaaagccauucagauagcaguaa

SEQ ID NO: 57113 - RNA, 62 nt, Homo Sapiens
auuuucuuaagcuaaaauacagacauguuucaaagggcuaaaguuggagaugaguagauagg

SEQ ID NO: 57114 - RNA, 62 nt, Homo Sapiens
cgcuguguccucucugcccagccuggcuuaccaagggcuaccucagugggagaugagguugg

SEQ ID NO: 57115 - RNA, 62 nt, Homo Sapiens
caacucaaaauagucugauuuaguugcuaauaaagggcuacaacaacagauaccuucuauuu

SEQ ID NO: 57116 - RNA, 62 nt, Homo Sapiens
uuuguucuuuguuagucucuuauacuuaaggaaagggcuaucagccaacuccugaguuuugc

SEQ ID NO: 57117 - RNA, 62 nt, Homo Sapiens
cuugaaugucacucgcccagauaguacucacaaagggcuagcgaacauugcuggacguccuc

SEQ ID NO: 57118 - RNA, 62 nt, Homo Sapiens
auucaagcacuuuuauucgucaacauuaaaucaagggcuacaagaagccguauuuguacgca

SEQ ID NO: 57119 - RNA, 62 nt, Homo Sapiens
uggcugagcggaagggugagaucuuuggucugaagggcuauguuuccuuagccucuucggug

SEQ ID NO: 57120 - RNA, 62 nt, Homo Sapiens
cagggaauccccaagguuagccugcuuaggggaagggcuagggguaccuggaauguaggauc

SEQ ID NO: 57121 - RNA, 62 nt, Homo Sapiens
cugacugauagcauuucagaaugugucuuuugaagggcuaugauaccaguuauuaaauagug

SEQ ID NO: 57122 - RNA, 62 nt, Homo Sapiens
guggccuucagaaaccauucaacucuuggcuaaagggcuaguucuauguaauucagaagcag

SEQ ID NO: 57123 - RNA, 62 nt, Homo Sapiens
gagcuguuugcaauaaaaagcacaguuugaugaagggcuagaaagacuaacuugaaagcagg

SEQ ID NO: 57124 - RNA, 62 nt, Homo Sapiens
ggucacagaucgucagugccguucaaaguaaaaagggcuacacaugaaugcuuauuuagguu

SEQ ID NO: 57125 - RNA, 62 nt, Homo Sapiens
uugggauuugaagacaaaaugauaaaaguuugaagggcuagacaaauauucuggagaaccug

SEQ ID NO: 57126 - RNA, 62 nt, Homo Sapiens
ucuguagacagaaguucaguaaagccuauuuaaagggcuauuuuaggaccucuuuuauuaaa

SEQ ID NO: 57127 - RNA, 62 nt, Homo Sapiens
accuggucuacagcccccagugcgauggcuacaagggcuacgcgcugaaggcuuacuucaga

SEQ ID NO: 57128 - RNA, 62 nt, Homo Sapiens
uuucagagcugcagggacagggugagcagcugaagggcuaggagggaagccggcccccgcuc

SEQ ID NO: 57129 - RNA, 62 nt, Homo Sapiens
uuauucagaauuucuaaaaauuuaaguucuguaagggcuaauauauucucuuccuaugguuu

SEQ ID NO: 57130 - RNA, 62 nt, Homo Sapiens
aggcaaaaucuguacugagguagaucauuugaaagggcuagauuauaaaauuaagccuuaga

SEQ ID NO: 57131 - RNA, 62 nt, Homo Sapiens
gaugacaucucauuuauuuuagugugagagauaagggcuaauacaacugucuccauuuuuca

SEQ ID NO: 57132 - RNA, 62 nt, Homo Sapiens
cgaaaucuugacucagggguacacauuaacuaaagggcuauucucaggcauuuuuuuuuuuu

SEQ ID NO: 57133 - RNA, 62 nt, Homo Sapiens
auuacaggcaugagccacugccucggccuuccaagggcuagggggcucaagcauuucuccua

SEQ ID NO: 57134 - RNA, 62 nt, Homo Sapiens
uucgguuuucugcagccauugcuuuauugccaaagggcuagucccaaaccucugcagcaucu

SEQ ID NO: 57135 - RNA, 62 nt, Homo Sapiens
gccaauacuagggucaaaaaauauaaauagcaaagggcuauuuuuaaagaaaaguuuuaauu

SEQ ID NO: 57136 - RNA, 62 nt, Homo Sapiens
cuaacugugugaccuuaggugaccaguucauuaagggcuaauagauuuccauuuuucaauua

SEQ ID NO: 57137 - RNA, 62 nt, Homo Sapiens
gacacauacaugucacauuuagcugugcucagaagggcuaucaucauccuacaacucacauu

SEQ ID NO: 57138 - RNA, 62 nt, Homo Sapiens
gguuccacugaaccucaugggacuuuuaaaagaagggcuauuuaaggaauucacuugguagu

SEQ ID NO: 57139 - RNA, 62 nt, Homo Sapiens
agugucccuuuuaaaaauagugugugcuaacuaagggcuauucauucugccauuuuuaacuu

SEQ ID NO: 57140 - RNA, 62 nt, Homo Sapiens
gguuagcccugaucugaauauaaaagugagaaaagggcuacagugcauuucuugguaacuua

SEQ ID NO: 57141 - RNA, 62 nt, Homo Sapiens
caugggcgccaagaugguggagcuuguagcacaagggcuacaugggcauugucuuuucagag

SEQ ID NO: 57142 - RNA, 62 nt, Homo Sapiens
gaacuaugcagguggcuagucgagaugccaagaagggcuaugaaggcaccaugacugcccau

SEQ ID NO: 57143 - RNA, 62 nt, Homo Sapiens
cucacaccuccuuagcuguaagaccaguauuuaagggcuaauuuauagaccaugcuaaugcu

SEQ ID NO: 57144 - RNA, 62 nt, Homo Sapiens
ggcaaaaggggugggagguguucucacagauuaagggcuaagggccuauaugagaaaccauc

SEQ ID NO: 57145 - RNA, 62 nt, Homo Sapiens
auuuccugaacuggauguccacacauuacuauaagggcuauugggauuugugacaagauagu

SEQ ID NO: 57146 - RNA, 62 nt, Homo Sapiens
uuugguaccaguguuuugucuagcccaggccuaagggcuauggggaaagaccuuugagagcc

SEQ ID NO: 57147 - RNA, 62 nt, Homo Sapiens
gcagcuuuacaugcaauuuaaucugggaagggaagggcuacuuaucauauugguauucacua

SEQ ID NO: 57148 - RNA, 62 nt, Homo Sapiens
aaaaaaugauugaccagccuccugaauuuuaaaagggcuagagcaaguuuaaucuuuggaug

SEQ ID NO: 57149 - RNA, 62 nt, Homo Sapiens
aggugagggccuucauuaauuggagaugauugaagggcuaggugaagacaguugcuggugag

SEQ ID NO: 57150 - RNA, 62 nt, Homo Sapiens
guuacccacgccauuuuacgucuccuucacugaagggcuagaguuuuaacuuuuaauuuuuu

SEQ ID NO: 57151 - RNA, 62 nt, Homo Sapiens
augcuuguaacucuggaaagaggccuacacccaagggcuaggaauuuuauuuuuccuuuucu

SEQ ID NO: 57152 - RNA, 62 nt, Homo Sapiens
gacauagaaaguucauggaacucauguuuuuaaagggcuauguaaauauaugaacauuagaa

SEQ ID NO: 57153 - RNA, 62 nt, Homo Sapiens
uaaaaaaauaguuaugaaaucuuaaaccauucaagggcuaaucuucauaaaacacuuauagc

SEQ ID NO: 57154 - RNA, 62 nt, Homo Sapiens
uucaagcaugacuguuaauguuauuuuaaaacaagggcuagcucuuguucucucccagcaau

SEQ ID NO: 57155 - RNA, 51 nt, Homo Sapiens
gacugacagaaauaacuaccgaagggcuagcagcaguucaauacccacuag

SEQ ID NO: 57156 - RNA, 62 nt, Homo Sapiens
aaaaggugauaugucuccugccucucggacaaaagggcuaggauuccuuccuuguuaucaag

SEQ ID NO: 57157 - RNA, 62 nt, Homo Sapiens
accuuggacaaaaguuuuugaaggucaauaaaaagggcuaaagagagaaucaugaagaaaag

SEQ ID NO: 57158 - RNA, 62 nt, Homo Sapiens
ggauuauaguaauagcuugacaaaagcgcuauaagggcuaaagcuuguuggaaugcagucua

SEQ ID NO: 57159 - RNA, 62 nt, Homo Sapiens
acgaugcauauacugaagggauacuuccaugaaagggcuaauacauauauauuuauguagau

SEQ ID NO: 57160 - RNA, 62 nt, Homo Sapiens
ucaguaguauagaccagugauaagaaacuuugaagggcuauuuaucggcuucccaaguuuac

SEQ ID NO: 57161 - RNA, 62 nt, Homo Sapiens
gagaagaggaagauaagguuacucggucuguuaagggcuaagguuauuuccaaauagaaugg

SEQ ID NO: 57162 - RNA, 62 nt, Homo Sapiens
gaugucaaauggaagagacugaaaaaggcauuaagggcuagaagcauaacagcuugucuucc

SEQ ID NO: 57163 - RNA, 62 nt, Homo Sapiens
ggugcauucuccccaccccacccccauuauauaagggcuauuuuagaugcuuuuaaccuccc

SEQ ID NO: 57164 - RNA, 62 nt, Homo Sapiens
gaagaagagggucuugagaaauccuuagcauaaagggcuacuggugagauugagaucugagc

SEQ ID NO: 57165 - RNA, 62 nt, Homo Sapiens
gcuccuggaagaguggacggccccuuuccuagaagggcuacuguaggcugguuuucuuccca

SEQ ID NO: 57166 - RNA, 62 nt, Homo Sapiens
aauuuaauuuguuguuuguuuugaaagaguuuaagggcuaaugggccugcugcuuuuauauu

SEQ ID NO: 57167 - RNA, 62 nt, Homo Sapiens
gaauagugaguuuauucugguccacuagucccaagggcuaaguuugaaauagugacauauca

SEQ ID NO: 57168 - RNA, 62 nt, Homo Sapiens
aagauguacaacagaacaugccacuagcuuuuaagggcuaccagaaucuaccugagaccaug

SEQ ID NO: 57169 - RNA, 62 nt, Homo Sapiens
ucugaguaccuuuuaguauuaugucuaacaacaagggcuaccggagucuagaacauccuuaa

SEQ ID NO: 57170 - RNA, 62 nt, Homo Sapiens
ugaaugaauaagaggauguggcacugagcgccaagggcuaccuuggaacgcaccgaggagcg

SEQ ID NO: 57171 - RNA, 62 nt, Homo Sapiens
aggcauagccugggcauaucaccucauugguaaagggcuagagccuuucuuuuuuauggcac

SEQ ID NO: 57172 - RNA, 62 nt, Homo Sapiens
uuguuaaaguagccuucuucagaugcuuuucuaagggcuaguuaccaacuuuauuucugugu

SEQ ID NO: 57173 - RNA, 62 nt, Homo Sapiens
gagaaauggcacaaaaacaggcagucaucuuuaagggcuaugccuaggcaaacuacuaacau

SEQ ID NO: 57174 - RNA, 62 nt, Homo Sapiens
gauggguagugggcugagaagaggggacuaggaagggcuauuccaggcucagcccugcuccu

SEQ ID NO: 57175 - RNA, 62 nt, Homo Sapiens
cuaauaaaggaauguauauacuuuauaagugcaagggcuaccuuccuuuuugaggaagguuu

SEQ ID NO: 57176 - RNA, 62 nt, Homo Sapiens
gucaggagcugauuuuuaauagauacugaacuaagggcuaauaauucccaaauuucauuugu

SEQ ID NO: 57177 - RNA, 62 nt, Homo Sapiens
uguguguauguguacccaagcacacaugugugaagggcuauagccaaaguauuuuuacuagc

SEQ ID NO: 57178 - RNA, 62 nt, Homo Sapiens
gcauacuaaaucgacaaccaauuuagauagauaagggcuacaugucuauguagucauacuga

SEQ ID NO: 57179 - RNA, 62 nt, Homo Sapiens
uuauuccccuuuuacuuggguuugaguuccacaagggcuaauuugccucugauucuuguaag

SEQ ID NO: 57180 - RNA, 62 nt, Homo Sapiens
uucaaugcuagugauuucuuucucacgugacuaagggcuauagguugcucaugaaguuaauc

SEQ ID NO: 57181 - RNA, 62 nt, Homo Sapiens
ugagcucuucaccugcauccugcgggcaugggaagggcuagccgagcguggauugucacagc

SEQ ID NO: 57182 - RNA, 62 nt, Homo Sapiens
gagaccacacagggguagccgcuggcagugggaagggcuaguugggugcugcuggccuccaa

SEQ ID NO: 57183 - RNA, 62 nt, Homo Sapiens
gacaucggaggggaccugccugcugucccaggaagggcuagggccuagguuugaacagcaga

SEQ ID NO: 57184 - RNA, 62 nt, Homo Sapiens
ucuuccaaccccaacuggcuugggggcaggacaagggcuaggcuugaugguggccaggcuug

SEQ ID NO: 57185 - RNA, 62 nt, Homo Sapiens
ugaaggaaaucauagaaaguuugcugaaagcaaagggcuaagcuuaugaaggaaugccuccu

SEQ ID NO: 57186 - RNA, 62 nt, Homo Sapiens
cagggacuggagaagccaaggggagagucuaaaagggcuagagcauuuuuaaaaauagacac

SEQ ID NO: 57187 - RNA, 62 nt, Homo Sapiens
cuaugaacagaucagcgcauucucuaggccaaaagggcuagccagguggcaagaucaauuua

SEQ ID NO: 57188 - RNA, 62 nt, Homo Sapiens
caguaacuuggguggaggcaaaacacuaauaaaagggcuaaaaaggaaaaugaugcuuuucu

SEQ ID NO: 57189 - RNA, 62 nt, Homo Sapiens
ccacgcugcuguuccaggagagauaccugcagaagggcuacacucugauccagcuggcgcgc

SEQ ID NO: 57190 - RNA, 62 nt, Homo Sapiens
uuugggaacauuugacuuccggugccgauguaaagggcuacauauauauggcaggcuucccu

SEQ ID NO: 57191 - RNA, 62 nt, Homo Sapiens
cccguguuuaauagaugaacaaauguucauuuaagggcuaccggcuguugaugauggguuaa

SEQ ID NO: 57192 - RNA, 62 nt, Homo Sapiens
ugggagagucagcuaucuugcgccuuuauggaaagggcuaugguguguuuaagcuuaggaau

SEQ ID NO: 57193 - RNA, 62 nt, Homo Sapiens
uccaccauaccaguguuuagaagcaaaacaugaagggcuagcgccaccaggauaguuagcag

SEQ ID NO: 57194 - RNA, 62 nt, Homo Sapiens
uguagguuuguaguagccaccgguaauaagccaagggcuaggcucuuguuugaguuuauggc

SEQ ID NO: 57195 - RNA, 62 nt, Homo Sapiens
ucagagggaauaugcacuggcgaguuuaaaguaagggcuaugauauuugauggucccaaagu

SEQ ID NO: 57196 - RNA, 62 nt, Homo Sapiens
auugaccgucuugacuggcuagauguuggcagaagggcuaaucaccccagccucacauugcc

SEQ ID NO: 57197 - RNA, 62 nt, Homo Sapiens
aguagaaacuuucuauaacccauaaagaauguaagggcuauaggaaagacacagauuucggu

SEQ ID NO: 57198 - RNA, 62 nt, Homo Sapiens
ccucuuccccaguccccucacacucuaggcccaagggcuaguagaacucuggagcuacaggc

SEQ ID NO: 57199 - RNA, 62 nt, Homo Sapiens
aaucuguuuauaaagagcauuuggauggcuuaaagggcuauagauauuucuuucaaucugua

SEQ ID NO: 57200 - RNA, 62 nt, Homo Sapiens
auguuaaaagguuaaacuuauggcuauuuuuaaagggcuauucauuuaaucugaguuuuccc

SEQ ID NO: 57201 - RNA, 62 nt, Homo Sapiens
ugagacauugggaaauggaacggugccaaagcaagggcuaguaaauagcagagugagccagg

SEQ ID NO: 57202 - RNA, 62 nt, Homo Sapiens
aaagaauguaaucugauaugucagucuuuaacaagggcuagaaagcaagaaggcuuaguagc

SEQ ID NO: 57203 - RNA, 62 nt, Homo Sapiens
gcuaagugagcuuuaucuaauauguggggaaaaagggcuauuuuuuguagaaccuuccagaa

SEQ ID NO: 57204 - RNA, 62 nt, Homo Sapiens
guagcucugaaauaacaagauugguugugcccaagggcuacagcagucuuugccucuuucug

SEQ ID NO: 57205 - RNA, 62 nt, Homo Sapiens
uuauauaagcaaacacuacuuuuauccaguuaaagggcuaaaaauuuugaaauuucgguaua

SEQ ID NO: 57206 - RNA, 62 nt, Homo Sapiens
guuaguacuacuuaccagauggucuaauuucaaagggcuagaaugcuaugauuucacgugca

SEQ ID NO: 57207 - RNA, 62 nt, Homo Sapiens
uuucacgcugaaacaugcuagugauaucuagaaagggcuaauuaggucucauccuuuaaugc

SEQ ID NO: 57208 - RNA, 62 nt, Homo Sapiens
ucaugacuguaauucauuaugacugcuccaggaagggcuaauggggccaauauauuauugcc

SEQ ID NO: 57209 - RNA, 62 nt, Homo Sapiens
uucauuaaagcagcaaauuccuucucgccuuuaagggcuaugguuguagugugacccguggc

SEQ ID NO: 57210 - RNA, 62 nt, Homo Sapiens
agaaacaguguuauguugggcucagaaaaucaaagggcuaguuuuuuuuuuuaaggugagga

SEQ ID NO: 57211 - RNA, 62 nt, Homo Sapiens
uuuaauuuucuuuuuacuuguugucaaggcccaagggcuaauaaaaggcccuggcaauuaaa

SEQ ID NO: 57212 - RNA, 62 nt, Homo Sapiens
cauuucccuuauuugguucagcuuuuagcaaaaagggcuacaguucacccugcagaguauua

SEQ ID NO: 57213 - RNA, 62 nt, Homo Sapiens
cauaauuuaaucuuugccauccuuagauagagaagggcuauagaucacauacguuaucaaaa

SEQ ID NO: 57214 - RNA, 62 nt, Homo Sapiens
ggagggcuagaacuggagaggcuagaaccaagaagggcuagaaccuggaggggcuagaaccu

SEQ ID NO: 57215 - RNA, 62 nt, Homo Sapiens
ggagggcuagaaccuggagagcuagaaccuagaagggcuagaaccuggagggcuggaaucug

SEQ ID NO: 57216 - RNA, 62 nt, Homo Sapiens
ggagggcuagaaccuggagggcuagaaccuagaagggcuagaaccuggagggcuggaaucug

SEQ ID NO: 57217 - RNA, 62 nt, Homo Sapiens
ggagggcuagaaccuggagggcuagaaccuagaagggcuagaaccuggagggcuagaaccug

SEQ ID NO: 57218 - RNA, 62 nt, Homo Sapiens
ggagggcuagaaccuggcagguuagaaccuagaagggcuagaaccuggagagccagaaccug

SEQ ID NO: 57219 - RNA, 62 nt, Homo Sapiens
ggagagccagaaccuggagggcuagaaccuggaagggcuagaaccuguagagcuagaacaug

SEQ ID NO: 57220 - RNA, 62 nt, Homo Sapiens
cuggggcucugaccacacuggcauaggguggaaagggcuaccgcugggcugcuuggggcuug

SEQ ID NO: 57221 - RNA, 62 nt, Homo Sapiens
ggaagaacaaaagggauacaugugugacgacaaagggcuacuugggacaaaaauaggaaugg

SEQ ID NO: 57222 - RNA, 62 nt, Homo Sapiens
gauuugggaagcuguguguagagguuacagaaaagggcuacagagucugacacagcuuucau

SEQ ID NO: 57223 - RNA, 62 nt, Homo Sapiens
aguucaguuuguugggauggaagcaugaaggaaagggcuagagaaguaugaaaucucgaaug

SEQ ID NO: 57224 - RNA, 62 nt, Homo Sapiens
ggaaauuuaagauuguuaacccuguuuuucagaagggcuacuguuaauugcacauaaacaug

SEQ ID NO: 57225 - RNA, 62 nt, Homo Sapiens
guaaauuaaauaaagauuccuuuaaggcagacaagggcuaagauuuccuuagcaguaauaau

SEQ ID NO: 57226 - RNA, 62 nt, Homo Sapiens
uuaaaaucuuugcaaauugaauaauuacagaaaagggcuacauuuaaaauuuguauuuguuu

SEQ ID NO: 57227 - RNA, 62 nt, Homo Sapiens
ggaaacaucucaggccaacauaggcaaaugaaaagggcuauuaaaauauuuuuacaccuuug

SEQ ID NO: 57228 - RNA, 62 nt, Homo Sapiens
gcugccugauauuucccuccccuggggacagcaagggcuaucccuuuccaaaggccauggag

SEQ ID NO: 57229 - RNA, 62 nt, Homo Sapiens
uucguuagguagaaccagagcagugcucagucaagggcuaaugauugcccacccccaaggua

SEQ ID NO: 57230 - RNA, 62 nt, Homo Sapiens
caugcaugugucaguggcuuucuugaugggccaagggcuaaaaguucauucccagggcccca

SEQ ID NO: 57231 - RNA, 62 nt, Homo Sapiens
ccuccauuucagagagcuucuuacugggucuaaagggcuauguaccaugcauuucucguucu

SEQ ID NO: 57232 - RNA, 62 nt, Homo Sapiens
uuccacauauagagcuccagcuuucuguccagaagggcuacuccacauggaccacgaauauu

SEQ ID NO: 57233 - RNA, 62 nt, Homo Sapiens
uuuuucuagcaugcuugauuuaggagagaauaaagggcuauauaauaauaaauccagauuuc

SEQ ID NO: 57234 - RNA, 62 nt, Homo Sapiens
uggggagaaugacuuucccuuuuuugccccauaagggcuagcauaagcugagguagaacuua

SEQ ID NO: 57235 - RNA, 62 nt, Homo Sapiens
acagcacccccaacccuggcacccagggugggaagggcuacaccuuagccugcccuccuuuc

SEQ ID NO: 57236 - RNA, 62 nt, Homo Sapiens
ccucagcaucuaggcuuuuuagaaaacauuucaagggcuauaugcuagaaaauucacaggga

SEQ ID NO: 57237 - RNA, 62 nt, Homo Sapiens
gagagauuuuuacaagucagaugccacaaaauaagggcuauauuucauagcauuuugauaaa

SEQ ID NO: 57238 - RNA, 62 nt, Homo Sapiens
aucccugaggagccaggccguuccuuagucucaagggcuagccuaguuucccugaaggaaca

SEQ ID NO: 57239 - RNA, 62 nt, Homo Sapiens
uuucuauucacgucaaacuuacuaccaugcagaagggcuaucucuagugcugguauuuguug

SEQ ID NO: 57240 - RNA, 62 nt, Homo Sapiens
aaugaacuugcuuguguguauuugauggcucuaagggcuauaaauuacaaacaaaacacauc

SEQ ID NO: 57241 - RNA, 62 nt, Homo Sapiens
gccauaccuugagaccaagccggugcccaccuaagggcuaaggccucuugcuggugcacaug

SEQ ID NO: 57242 - RNA, 62 nt, Homo Sapiens
uguuuugaagcucaugggaaaauugugaucaaaagggcuaugggaagggcagaccccgccaa

SEQ ID NO: 57243 - RNA, 62 nt, Homo Sapiens
auauucaguuaaucauaugguuccuagcuuacaagggcuagaucuaagauuauucccaugag

SEQ ID NO: 57244 - RNA, 62 nt, Homo Sapiens
cuucuucagugaagcagccuuacuauucauagaagggcuagaauaggagaaaaugaaaggua

SEQ ID NO: 57245 - RNA, 62 nt, Homo Sapiens
gcagcaggaauggugcccaccucggcgaauugaagggcuaagagucccagauagcuaggcca

SEQ ID NO: 57246 - RNA, 62 nt, Homo Sapiens
cuuucuuucacgugcaaaacugugugccucauaagggcuauuugcucugcuguccuggaccc

SEQ ID NO: 57247 - RNA, 62 nt, Homo Sapiens
gcuggucccagaggccuggcgccccagcucagaagggcuauauggcuucugcugaccgcugg

SEQ ID NO: 57248 - RNA, 62 nt, Homo Sapiens
aauuacaaacaaaacacaucuuugauggcuccaagggcuauaaaugaacuugcuugugugua

SEQ ID NO: 57249 - RNA, 62 nt, Homo Sapiens
auuuguucuccuucucuuccuucuguucuuaaaagggcuagaaaccuaaggaaauuauucau

SEQ ID NO: 57250 - RNA, 62 nt, Homo Sapiens
cgugauaguccuugcaaguacaggaaucacugaagggcuaaccuuuuucacagaacuggugu

SEQ ID NO: 57251 - RNA, 62 nt, Homo Sapiens
guauugauuacacuuaacagaaggcugaacagaagggcuaguaccaggagcuuauuauagga

SEQ ID NO: 57252 - RNA, 62 nt, Homo Sapiens
aauuacaaacaaaacacaucuuugauggcucuaagggcuauaaaugaacuugcuugugugua

SEQ ID NO: 57253 - RNA, 62 nt, Homo Sapiens
gucuccagggccgggucuugaccagugcagacaagggcuacaugagagccuugggggucucc

SEQ ID NO: 57254 - RNA, 62 nt, Homo Sapiens
ccaguguguguucauuguaaacacuuuugggaaagggcuaaacaugugaggccuggagauag

SEQ ID NO: 57255 - RNA, 62 nt, Homo Sapiens
uaccagggcuuaaauguuguuaagcuuugggcaagggcuauucagaaugauccaggggagau

SEQ ID NO: 57256 - RNA, 62 nt, Homo Sapiens
uccccagucuggccuuggccuccagccuggagaagggcuaacaucagcucauugucaaggcc

SEQ ID NO: 57257 - RNA, 62 nt, Homo Sapiens
ggagaaaauuuucgcaaccuacucaucugacaaagggcuaauauccagaaucuacaaugaac

SEQ ID NO: 57258 - RNA, 62 nt, Homo Sapiens
auacacccaacauuauaacaaaggacuguagcaagggcuaugggaguucugaagcagaaacc

SEQ ID NO: 57259 - RNA, 62 nt, Homo Sapiens
cacugaagggacacagagguccaguccuucugaagggcuaggaucggguucuggcagggaga

SEQ ID NO: 57260 - RNA, 62 nt, Homo Sapiens
acuguaaugguggaauguggcaguuggugggaaagggcuaaucugaaaagcuucauaagggg

SEQ ID NO: 57261 - RNA, 62 nt, Homo Sapiens
agccauguguuaauuguuaaauaaauucuccaaagggcuaaaaguaaauuacuuauaaauuu

SEQ ID NO: 57262 - RNA, 62 nt, Homo Sapiens
gguguguauuuuagggauuaugagcuucuuucaagggcuaaggcugcagagauauuuccucc

SEQ ID NO: 57263 - RNA, 62 nt, Homo Sapiens
ggcugcaauaaggugccaugaaaucaaaaucaaagggcuagaacucuccaaggucuugcccc

SEQ ID NO: 57264 - RNA, 62 nt, Homo Sapiens
ucccugaacccaggugggaccuggcuguagagaagggcuacauccuguuugcccugagccgc

SEQ ID NO: 57265 - RNA, 62 nt, Homo Sapiens
ucaaccgaccuuucggguuuccuuccagcuccaagggcuacaacagauagaccggccucgcc

SEQ ID NO: 57266 - RNA, 62 nt, Homo Sapiens
auuauuucaagagaaucccaaaguacuugaauaagggcuauuguaaaauuuaaaagaaauau

SEQ ID NO: 57267 - RNA, 62 nt, Homo Sapiens
gacggagaaggcagacaucaugcaacaugcucaagggcuauucauuuuaagcugaaacauac

SEQ ID NO: 57268 - RNA, 62 nt, Homo Sapiens
acccugcauccauguguguccguggguaccguaagggcuacugggggaagaaccuguaagca

SEQ ID NO: 57269 - RNA, 62 nt, Homo Sapiens
ugaagaaaguuucaguauugaucauguuguuuaagggcuaggaauugacaaaauaucugaua

SEQ ID NO: 57270 - RNA, 62 nt, Homo Sapiens
ggacaaaaugucucuuagaccuguucuggcugaagggcuaucucuggcaccucugagauccc

SEQ ID NO: 57271 - RNA, 62 nt, Homo Sapiens
augagggugggucacuacagauguuggggagcaagggcuaggaucacuuuuuaaaaaaucac

SEQ ID NO: 57272 - RNA, 62 nt, Homo Sapiens
aauaaaauagccaaaaaaugaaacaagcuuccaagggcuagagauauggugucuuuuucuug

SEQ ID NO: 57273 - RNA, 62 nt, Homo Sapiens
ccacccagagacugugcccggccacagugccuaagggcuagggacaugcccaugccaccuau

SEQ ID NO: 57274 - RNA, 62 nt, Homo Sapiens
ggauuuaaucuggguaaaaucagccuucugagaagggcuaagaaacaguucaauuaacugua

SEQ ID NO: 57275 - RNA, 62 nt, Homo Sapiens
cugaccuggccucuugccuaaaccacaaggcuaagggcuauagacaaugguuuccuuaggaa

SEQ ID NO: 57276 - RNA, 62 nt, Homo Sapiens
aauuuugagcaacaaaauuuauuuagguggauaagggcuagauauauguagaaccauacaga

SEQ ID NO: 57277 - RNA, 64 nt, Homo Sapiens
cuaaguuguuaaauaaaguuauaauacagcugugaagggcuaaaguuagaguugauuacauaag

SEQ ID NO: 57278 - RNA, 64 nt, Homo Sapiens
auuuagguuugaaaauacuauuuaauaagggcagaagggcuauauaugauuuggcuauuauuuc

SEQ ID NO: 57279 - RNA, 64 nt, Homo Sapiens
ccauccagaucaacacccuuucuuccauacagaaaagggcuaaccauaccacagcuggaaucuc

SEQ ID NO: 57280 - RNA, 64 nt, Homo Sapiens
uaaaaauuauauuuagaauuuuuaaacauguacaaagggcuacauuuuaauuuuaaaauagcuu

SEQ ID NO: 57281 - RNA, 64 nt, Homo Sapiens
gcccccauucucuuggggucagggaggggcugggaagggcuacugaaggccccauucucccaca

SEQ ID NO: 57282 - RNA, 64 nt, Homo Sapiens
aaaacauuuuuauaugauuauaaaagaauucuucaagggcuaauuaccuaaccagcuuguauug

SEQ ID NO: 57283 - RNA, 64 nt, Homo Sapiens
auuuacuacauauuuuccaucuguaguuucucagaagggcuauggauuaguuugaacugucaaa

SEQ ID NO: 57284 - RNA, 64 nt, Homo Sapiens
agggaggaacacuaugguuaacccucucuugauuaagggcuacuuaaugcacagugcauuaugu

SEQ ID NO: 57285 - RNA, 64 nt, Homo Sapiens
gcaagggggugucaucugagcugcaccagagugaaagggcuauggccuuucucccccgacacug

SEQ ID NO: 57286 - RNA, 64 nt, Homo Sapiens
uucuggaagucuccccaggcccuccucagggucaaagggcuacuuucaucacgacugaucccca

SEQ ID NO: 57287 - RNA, 64 nt, Homo Sapiens
cucuggcaucuccagguguucugacagauaggccaagggcuacuugacugugugggagccugga

SEQ ID NO: 57288 - RNA, 64 nt, Homo Sapiens
ggcacugccaggggaagggagaaucuauauacugaagggcuagucuuuccaucugggagaggca

SEQ ID NO: 57289 - RNA, 64 nt, Homo Sapiens
auuuaugucauuuuauagcauacagaaacagaucaagggcuauacugaagaagcuggcauuguu

SEQ ID NO: 57290 - RNA, 64 nt, Homo Sapiens
uugguauugaaagcaugcugaaagauccuauuuaaagggcuaaucaaugagaagcuuuauuaag

SEQ ID NO: 57291 - RNA, 64 nt, Homo Sapiens
cagggggcaaauugagccccgcugaggagggcagaagggcuaggaagagagccaugaggagagg

SEQ ID NO: 57292 - RNA, 64 nt, Homo Sapiens
gaugaggguugguggggcuccaggaccugugaauaagggcuaauggagaggagccgcccacuuc

SEQ ID NO: 57293 - RNA, 64 nt, Homo Sapiens
uuucuuuucuuucuuuuguuugcccuuuacuacaaagggcuauuuggcucuugccuucccagca

SEQ ID NO: 57294 - RNA, 64 nt, Homo Sapiens
caucuguuugcuccaguuuucucugguuuuucuaaagggcuauugcccacaucaguucaacauc

SEQ ID NO: 57295 - RNA, 64 nt, Homo Sapiens
ccaccgcagcagccucccucuugcugggguggagaagggcuagcgaccaauggggguggggaag

SEQ ID NO: 57296 - RNA, 64 nt, Homo Sapiens
gcaaauauaaaauuaaauguguuaugcauugauuaagggcuagaugcuuaaaaauguuuuuguu

SEQ ID NO: 57297 - RNA, 64 nt, Homo Sapiens
agaugaguuccagucugaauacagguagauauuaaagggcuaauaaaaaaugagaaaccggucg

SEQ ID NO: 57298 - RNA, 64 nt, Homo Sapiens
ugggagaaaauuuucgcaaccuacucaucugacaaagggcuaauaaccagaaucuacaaugaac

SEQ ID NO: 57299 - RNA, 64 nt, Homo Sapiens
auuugaguagauauuuuaaacaccuaacaaaguaaagggcuaaaagccauucagauagcaguaa

SEQ ID NO: 57300 - RNA, 64 nt, Homo Sapiens
aaauuuucuuaagcuaaaauacagacauguuucaaagggcuaaaguuggagaugaguagauagg

SEQ ID NO: 57301 - RNA, 64 nt, Homo Sapiens
accgcuguguccucucugcccagccuggcuuaccaagggcuaccucagugggagaugagguugg

SEQ ID NO: 57302 - RNA, 64 nt, Homo Sapiens
caacucaaaauagucugauuuuuaguugcuaauaaagggcuacaguacaacagauaccuucuau

SEQ ID NO: 57303 - RNA, 64 nt, Homo Sapiens
uuuguucuuuguuagucucugcuauacuuaaggaaagggcuaucugagccaacuccugaguuuu

SEQ ID NO: 57304 - RNA, 64 nt, Homo Sapiens
cuugaaugucacucgcccagucauaguacucacaaagggcuagcucgaacauugcuggacgucc

SEQ ID NO: 57305 - RNA, 64 nt, Homo Sapiens
auucaagcacuuuuauucgucacaacauuaaaucaagggcuacagcagaagccguauuuguacg

SEQ ID NO: 57306 - RNA, 64 nt, Homo Sapiens
uggcugagcggaagggugagugaucuuuggucugaagggcuaugcuuuuccuuagccucuucgg

SEQ ID NO: 57307 - RNA, 64 nt, Homo Sapiens
uccagggaauccccaagguuagccugcuuaggggaagggcuagggguaccuggaauguaggauc

SEQ ID NO: 57308 - RNA, 64 nt, Homo Sapiens
cccugacugauagcauuucagaaugugucuuuugaagggcuaugauaccaguuauuaaauagug

SEQ ID NO: 57309 - RNA, 64 nt, Homo Sapiens
guggccuucagaaaccauucagaacucuuggcuaaagggcuaguguucuauguaauucagaagc

SEQ ID NO: 57310 - RNA, 64 nt, Homo Sapiens
gagcuguuugcaauaaaaagggcacaguuugaugaagggcuagauaaagacuaacuugaaagca

SEQ ID NO: 57311 - RNA, 64 nt, Homo Sapiens
ggucacagaucgucagugccuuguucaaaguaaaaagggcuacauacaugaaugcuuauuuagg

SEQ ID NO: 57312 - RNA, 64 nt, Homo Sapiens
uugggauuugaagacaaaauuggauaaaaguuugaagggcuagauccaaauauucuggagaacc

SEQ ID NO: 57313 - RNA, 64 nt, Homo Sapiens
ucuguagacagaaguucaguaaaaagccuauuuaaagggcuauuguuuaggaccucuuuuauua

SEQ ID NO: 57314 - RNA, 64 nt, Homo Sapiens
accuggucuacagcccccaggaugcgauggcuacaagggcuacgcacgcugaaggcuuacuuca

SEQ ID NO: 57315 - RNA, 64 nt, Homo Sapiens
uuuuucagagcugcagggacagggugagcagcugaagggcuaggagggaagccggcccccgcuc

SEQ ID NO: 57316 - RNA, 64 nt, Homo Sapiens
ccuuauucagaauuucuaaaaauuuaaguucuguaagggcuaauauauucucuuccuaugguuu

SEQ ID NO: 57317 - RNA, 64 nt, Homo Sapiens
aaaggcaaaaucuguacugagguagaucauuugaaagggcuagauuauaaaauuaagccuuaga

SEQ ID NO: 57318 - RNA, 64 nt, Homo Sapiens
gaugacaucucauuuauuuucaagugugagagauaagggcuaaugaacaacugucuccauuuuu

SEQ ID NO: 57319 - RNA, 64 nt, Homo Sapiens
cgaaaucuugacucagggguuuacacauuaacuaaagggcuauugccucaggcauuuuuuuuuu

SEQ ID NO: 57320 - RNA, 64 nt, Homo Sapiens
auuacaggcaugagccacuguaccucggccuuccaagggcuaggcugggcucaagcauuucucc

SEQ ID NO: 57321 - RNA, 64 nt, Homo Sapiens
uucgguuuucugcagccauucugcuuuauugccaaagggcuaguuucccaaaccucugcagcau

SEQ ID NO: 57322 - RNA, 64 nt, Homo Sapiens
gccaauacuagggucaaaaauuauauaaauagcaaagggcuauuaauuuaaagaaaaguuuuaa

SEQ ID NO: 57323 - RNA, 64 nt, Homo Sapiens
uacuaacugugugaccuuaggugaccaguucauuaagggcuaauagauuuccauuuuucaauua

SEQ ID NO: 57324 - RNA, 64 nt, Homo Sapiens
uagacacauacaugucacauuuagcugugcucagaagggcuaucaucauccuacaacucacauu

SEQ ID NO: 57325 - RNA, 64 nt, Homo Sapiens
uggguuccacugaaccucaugggacuuuuaaaagaagggcuauuuaaggaauucacuugguagu

SEQ ID NO: 57326 - RNA, 64 nt, Homo Sapiens
caagugucccuuuuaaaaauagugugugcuaacuaagggcuauucauucugccauuuuuaacuu

SEQ ID NO: 57327 - RNA, 64 nt, Homo Sapiens
aggguuagcccugaucugaauauaaaagugagaaaagggcuacagugcauuucuugguaacuua

SEQ ID NO: 57328 - RNA, 64 nt, Homo Sapiens
caugggcgccaagaugguggagagcuuguagcacaagggcuacagcugggcauugucuuuucag

SEQ ID NO: 57329 - RNA, 64 nt, Homo Sapiens
gaacuaugcagguggcuaguaucgagaugccaagaagggcuauggcaaggcaccaugacugccc

SEQ ID NO: 57330 - RNA, 64 nt, Homo Sapiens
cucacaccuccuuagcuguacuagaccaguauuuaagggcuaauuuuuauagaccaugcuaaug

SEQ ID NO: 57331 - RNA, 64 nt, Homo Sapiens
ggcaaaaggggugggaggugucuucucacagauuaagggcuaaguuggccuauaugagaaacca

SEQ ID NO: 57332 - RNA, 64 nt, Homo Sapiens
auuuccugaacuggauguccguacacauuacuauaagggcuauuaagggauuugugacaagaua

SEQ ID NO: 57333 - RNA, 64 nt, Homo Sapiens
uuugguaccaguguuuugucccuagcccaggccuaagggcuaugcugggaaagaccuuugagag

SEQ ID NO: 57334 - RNA, 64 nt, Homo Sapiens
gcagcuuuacaugcaauuuauaaucugggaagggaagggcuacuuauaucauauugguauucac

SEQ ID NO: 57335 - RNA, 64 nt, Homo Sapiens
aaaaaaugauugaccagccuugccugaauuuuaaaagggcuagaaagcaaguuuaaucuuugga

SEQ ID NO: 57336 - RNA, 64 nt, Homo Sapiens
aggugagggccuucauuaauaguggagaugauugaagggcuagggaugaagacaguugcuggug

SEQ ID NO: 57337 - RNA, 64 nt, Homo Sapiens
uuguuacccacgccauuuuacgucuccuucacugaagggcuagaguuuuaacuuuuaauuuuuu

SEQ ID NO: 57338 - RNA, 64 nt, Homo Sapiens
ugaugcuuguaacucuggaaagaggccuacacccaagggcuaggaauuuuauuuuuccuuuucu

SEQ ID NO: 57339 - RNA, 64 nt, Homo Sapiens
augacauagaaaguucauggaacucauguuuuuaaagggcuauguaaauauaugaacauuagaa

SEQ ID NO: 57340 - RNA, 64 nt, Homo Sapiens
uaaaaaaauaguuaugaaaugccuuaaaccauucaagggcuaauugcuucauaaaacacuuaua

SEQ ID NO: 57341 - RNA, 64 nt, Homo Sapiens
uucaagcaugacuguuaaugauuuauuuuaaaacaagggcuagcugucuuguucucucccagca

SEQ ID NO: 57342 - RNA, 51 nt, Homo Sapiens; identical to SEQ ID NO: 57155

SEQ ID NO: 57343 - RNA, 64 nt, Homo Sapiens
aaaaggugauaugucuccugagccucucggacaaaagggcuaggagauuccuuccuuguuauca

SEQ ID NO: 57344 - RNA, 64 nt, Homo Sapiens
accuuggacaaaaguuuuugagaaggucaauaaaaagggcuaaagagagagaaucaugaagaaa

SEQ ID NO: 57345 - RNA, 64 nt, Homo Sapiens
ggauuauaguaauagcuugauacaaaagcgcuauaagggcuaaaaagcuuguuggaaugcaguc

SEQ ID NO: 57346 - RNA, 64 nt, Homo Sapiens
acgaugcauauacugaagggauauacuuccaugaaagggcuaauauacauauauauuuauguag

SEQ ID NO: 57347 - RNA, 64 nt, Homo Sapiens
ucaguaguauagaccagugaacuaagaaacuuugaagggcuauuuuuaucggcuucccaaguuu

SEQ ID NO: 57348 - RNA, 64 nt, Homo Sapiens
gagaagaggaagauaagguuggacucggucuguuaagggcuaaguuguuauuuccaaauagaau

SEQ ID NO: 57349 - RNA, 64 nt, Homo Sapiens
gaugucaaauggaagagacuccgaaaaaggcauuaagggcuagaucagcauaacagcuugucuu

SEQ ID NO: 57350 - RNA, 64 nt, Homo Sapiens
cuggugcauucuccccaccccacccccauuauauaagggcuauuuuagaugcuuuuaaccuccc

SEQ ID NO: 57351 - RNA, 64 nt, Homo Sapiens
uugaagaagagggucuugagaaauccuuagcauaaagggcuacuggugagauugagaucugagc

SEQ ID NO: 57352 - RNA, 64 nt, Homo Sapiens
gcuccuggaagaguggacggcaccccuuuccuagaagggcuacuggguaggcugguuuucuucc

SEQ ID NO: 57353 - RNA, 64 nt, Homo Sapiens
aauuuaauuuguuguuuguuuuuugaaagaguuuaagggcuaauuggggccugcugcuuuuaua

SEQ ID NO: 57354 - RNA, 64 nt, Homo Sapiens
gaauagugaguuuauucuggcauccacuagucccaagggcuaagaguuugaaauagugacauau

SEQ ID NO: 57355 - RNA, 64 nt, Homo Sapiens
aagauguacaacagaacaugugccacuagcuuuuaagggcuacccaagaaucuaccugagacca

SEQ ID NO: 57356 - RNA, 64 nt, Homo Sapiens
ucugaguaccuuuuaguauuaaaugucuaacaacaagggcuaccuuggagucuagaacauccuu

SEQ ID NO: 57357 - RNA, 64 nt, Homo Sapiens
caugaaugaauaagaggauguggcacugagcgccaagggcuaccuuggaacgcaccgaggagcg

SEQ ID NO: 57358 - RNA, 64 nt, Homo Sapiens
acaggcauagccugggcauaucaccucauugguaaagggcuagagccuuucuuuuuuauggcac

SEQ ID NO: 57359 - RNA, 64 nt, Homo Sapiens
uuuuguuaaaguagccuucuucagaugcuuuucuaagggcuaguuaccaacuuuauuucugugu

SEQ ID NO: 57360 - RNA, 64 nt, Homo Sapiens
uugagaaauggcacaaaaacaggcagucaucuuuaagggcuaugccuaggcaaacuacuaacau

SEQ ID NO: 57361 - RNA, 64 nt, Homo Sapiens
uggauggguagugggcugagaagaggggacuaggaagggcuauuccaggcucagcccugcuccu

SEQ ID NO: 57362 - RNA, 64 nt, Homo Sapiens
cuaauaaaggaauguauauauucuuuauaagugcaagggcuaccauuuccuuuuugaggaaggu

SEQ ID NO: 57363 - RNA, 64 nt, Homo Sapiens
gucaggagcugauuuuuaauguagauacugaacuaagggcuaauagaauucccaaauuucauuu

SEQ ID NO: 57364 - RNA, 64 nt, Homo Sapiens
ccuguguguauguguacccaagcacacaugugugaagggcuauagccaaaguauuuuuacuagc

SEQ ID NO: 57365 - RNA, 64 nt, Homo Sapiens
gcauacuaaaucgacaaccagaauuuagauagauaagggcuacaaaugucuauguagucauacu

SEQ ID NO: 57366 - RNA, 64 nt, Homo Sapiens
uuauuccccuuuuacuugggaguuugaguuccacaagggcuaaugauugccucugauucuugua

SEQ ID NO: 57367 - RNA, 64 nt, Homo Sapiens
uucaaugcuagugauuucuuucucucacgugacuaagggcuauauggguugcucaugaaguuaa

SEQ ID NO: 57368 - RNA, 64 nt, Homo Sapiens
ugagcucuucaccugcauccgcugcgggcaugggaagggcuagcggcgagcguggauugucaca

SEQ ID NO: 57369 - RNA, 64 nt, Homo Sapiens
gagaccacacagggguagccaagcuggcagugggaagggcuaguucugggugcugcuggccucc

SEQ ID NO: 57370 - RNA, 64 nt, Homo Sapiens
gacaucggaggggaccugccgaugcugucccaggaagggcuagggagccuagguuugaacagca

SEQ ID NO: 57371 - RNA, 64 nt, Homo Sapiens
uaucuuccaaccccaacuggcuugggggcaggacaagggcuaggcuugaugguggccaggcuug

SEQ ID NO: 57372 - RNA, 64 nt, Homo Sapiens
auugaaggaaaucauagaaaguuugcugaaagcaaagggcuaagcuuaugaaggaaugccuccu

SEQ ID NO: 57373 - RNA, 64 nt, Homo Sapiens
ggcagggacuggagaagccaaggggagagucuaaaagggcuagagcauuuuuaaaaauagacac

SEQ ID NO: 57374 - RNA, 64 nt, Homo Sapiens
cacuaugaacagaucagcgcauucucuaggccaaaagggcuagccagguggcaagaucaauuua

SEQ ID NO: 57375 - RNA, 64 nt, Homo Sapiens
ugcaguaacuuggguggaggcaaaacacuaauaaaagggcuaaaaaggaaaaugaugcuuuucu

SEQ ID NO: 57376 - RNA, 64 nt, Homo Sapiens
ccacgcugcuguuccaggaggcagauaccugcagaagggcuacagucucugauccagcuggcgc

SEQ ID NO: 57377 - RNA, 64 nt, Homo Sapiens
uuugggaacauuugacuucccuggugccgauguaaagggcuacauguauauauggcaggcuucc

SEQ ID NO: 57378 - RNA, 64 nt, Homo Sapiens
cccguguuuaauagaugaacaaaaauguucauuuaagggcuaccagggcuguugaugauggguu

SEQ ID NO: 57379 - RNA, 64 nt, Homo Sapiens
ugggagagucagcuaucuugaucgccuuuauggaaagggcuaugguguguguuuaagcuuagga

SEQ ID NO: 57380 - RNA, 64 nt, Homo Sapiens
ccuccaccauaccaguguuuagaagcaaaacaugaagggcuagcgccaccaggauaguuagcag

SEQ ID NO: 57381 - RNA, 64 nt, Homo Sapiens
ucuguagguuuguaguagccaccgguaauaagccaagggcuaggcucuuguuugaguuuauggc

SEQ ID NO: 57382 - RNA, 64 nt, Homo Sapiens
cuucagagggaauaugcacuggcgaguuuaaaguaagggcuaugauauuugauggucccaaagu

SEQ ID NO: 57383 - RNA, 64 nt, Homo Sapiens
auugaccgucuugacuggcuccagauguuggcagaagggcuaauuccaccccagccucacauug

SEQ ID NO: 57384 - RNA, 64 nt, Homo Sapiens
aguagaaacuuucuauaaccgucauaaagaauguaagggcuauagaggaaagacacagauuucg

SEQ ID NO: 57385 - RNA, 64 nt, Homo Sapiens
ccucuuccccaguccccucagccacucuaggcccaagggcuaguccagaacucuggagcuacag

SEQ ID NO: 57386 - RNA, 64 nt, Homo Sapiens
aaucuguuuauaaagagcauuauuggauggcuuaaagggcuauaaugauauuucuuucaaucug

SEQ ID NO: 57387 - RNA, 64 nt, Homo Sapiens
acauguuaaaagguuaaacuuauggcuauuuuuaaagggcuauucauuuaaucugaguuuuccc

SEQ ID NO: 57388 - RNA, 64 nt, Homo Sapiens
ugagacauugggaaauggaaggcggugccaaagcaagggcuaguacaaauagcagagugagcca

SEQ ID NO: 57389 - RNA, 64 nt, Homo Sapiens
aaagaauguaaucugauauggcucagucuuuaacaagggcuagaccaagcaagaaggcuuagua

SEQ ID NO: 57390 - RNA, 64 nt, Homo Sapiens
gcuaagugagcuuuaucuaaaauauguggggaaaaagggcuauugcuuuuguagaaccuuccag

SEQ ID NO: 57391 - RNA, 64 nt, Homo Sapiens
guagcucugaaauaacaagauguugguugugcccaagggcuacacagcagucuuugccucuuuc

SEQ ID NO: 57392 - RNA, 64 nt, Homo Sapiens
uuauauaagcaaacacuacuuauuuauccaguuaaagggcuaaagaaauuuugaaauuucggua

SEQ ID NO: 57393 - RNA, 64 nt, Homo Sapiens
guuaguacuacuuaccagaucaggucuaauuucaaagggcuagagaaugcuaugauuucacgug

SEQ ID NO: 57394 - RNA, 64 nt, Homo Sapiens
acuuucacgcugaaacaugcuagugauaucuagaaagggcuaauuaggucucauccuuuaaugc

SEQ ID NO: 57395 - RNA, 64 nt, Homo Sapiens
ugucaugacuguaauucauuaugacugcuccaggaagggcuaauggggccaauauauuauugcc

SEQ ID NO: 57396 - RNA, 64 nt, Homo Sapiens
aguucauuaaagcagcaaauuccuucucgccuuuaagggcuaugguuguagugugacccguggc

SEQ ID NO: 57397 - RNA, 64 nt, Homo Sapiens
agaaacaguguuauguuggggacucagaaaaucaaagggcuaguuuuuuuuuuuuuaaggugag

SEQ ID NO: 57398 - RNA, 64 nt, Homo Sapiens
uuuaauuuucuuuuuacuugaauugucaaggcccaagggcuaauacaaaaggcccuggcaauua

SEQ ID NO: 57399 - RNA, 64 nt, Homo Sapiens
aacauuucccuuauuugguucagcuuuuagcaaaaagggcuacaguucacccugcagaguauua

SEQ ID NO: 57400 - RNA, 64 nt, Homo Sapiens
cacauaauuuaaucuuugccauccuuagauagagaagggcuauagaucacauacguuaucaaaa

SEQ ID NO: 57401 - RNA, 64 nt, Homo Sapiens
cuggagggcuagaacuggagaggcuagaaccaagaagggcuagaaccuggaggggcuagaaccu

SEQ ID NO: 57402 - RNA, 64 nt, Homo Sapiens
cuggagggcuagaaccuggagagcuagaaccuagaagggcuagaaccuggagggcuggaaucug

SEQ ID NO: 57403 - RNA, 64 nt, Homo Sapiens
cuggagggcuagaaccuggagggcuagaaccuagaagggcuagaaccuggagggcuggaaucug

SEQ ID NO: 57404 - RNA, 64 nt, Homo Sapiens
cuggagggcuagaaccuggagggcuagaaccuagaagggcuagaaccuggagggcuagaaccug

SEQ ID NO: 57405 - RNA, 64 nt, Homo Sapiens
cuggagggcuagaaccuggcagguuagaaccuagaagggcuagaaccuggagagccagaaccug

SEQ ID NO: 57406 - RNA, 64 nt, Homo Sapiens
cuggagagccagaaccuggagggcuagaaccuggaagggcuagaaccuguagagcuagaacaug

SEQ ID NO: 57407 - RNA, 64 nt, Homo Sapiens
cuggggcucugaccacacuguggcauaggguggaaagggcuaccgggcugggcugcuuggggcu

SEQ ID NO: 57408 - RNA, 64 nt, Homo Sapiens
ggaagaacaaaagggauacaggugugugacgacaaagggcuacugaugggacaaaaauaggaau

SEQ ID NO: 57409 - RNA, 64 nt, Homo Sapiens
gauuugggaagcuguguguaaugagguuacagaaaagggcuacacugagucugacacagcuuuc

SEQ ID NO: 57410 - RNA, 64 nt, Homo Sapiens
cuaguucaguuuguugggauggaagcaugaaggaaagggcuagagaaguaugaaaucucgaaug

SEQ ID NO: 57411 - RNA, 64 nt, Homo Sapiens
ggggaaauuuaagauuguuaacccuguuuuucagaagggcuacuguuaauugcacauaaacaug

SEQ ID NO: 57412 - RNA, 64 nt, Homo Sapiens
caguaaauuaaauaaagauuccuuuaaggcagacaagggcuaagauuuccuuagcaguaauaau

SEQ ID NO: 57413 - RNA, 64 nt, Homo Sapiens
acuuaaaaucuuugcaaauugaauaauuacagaaaagggcuacauuuaaaauuuguauuuguuu

SEQ ID NO: 57414 - RNA, 64 nt, Homo Sapiens
agggaaacaucucaggccaacauaggcaaaugaaaagggcuauuaaaauauuuuuacaccuuug

SEQ ID NO: 57415 - RNA, 64 nt, Homo Sapiens
gagcugccugauauuucccuccccuggggacagcaagggcuaucccuuuccaaaggccauggag

SEQ ID NO: 57416 - RNA, 64 nt, Homo Sapiens
gauucguuagguagaaccagagcagugcucagucaagggcuaaugauugcccacccccaaggua

SEQ ID NO: 57417 - RNA, 64 nt, Homo Sapiens
caugcaugugucaguggcuucaucuugaugggccaagggcuaaaccaguucauucccagggccc

SEQ ID NO: 57418 - RNA, 64 nt, Homo Sapiens
ccuccauuucagagagcuuccuuuacugggucuaaagggcuaugcuuaccaugcauuucucguu

SEQ ID NO: 57419 - RNA, 64 nt, Homo Sapiens
uuccacauauagagcuccaguucuuucuguccagaagggcuacuaaccacauggaccacgaaua

SEQ ID NO: 57420 - RNA, 64 nt, Homo Sapiens
guuuuuucuagcaugcuugauuuaggagagaauaaagggcuauauaauaauaaauccagauuuc

SEQ ID NO: 57421 - RNA, 64 nt, Homo Sapiens
cuuggggagaaugacuuucccuuuuuugccccauaagggcuagcauaagcugagguagaacuua

SEQ ID NO: 57422 - RNA, 64 nt, Homo Sapiens
uuacagcacccccaacccuggcacccagggugggaagggcuacaccuuagccugcccuccuuuc

SEQ ID NO: 57423 - RNA, 64 nt, Homo Sapiens
ccucagcaucuaggcuuuuugaagaaaacauuucaagggcuauaauugcuagaaaauucacagg

SEQ ID NO: 57424 - RNA, 64 nt, Homo Sapiens
gagagauuuuuacaagucagaaaugccacaaaauaagggcuauagauuucauagcauuuugaua

SEQ ID NO: 57425 - RNA, 64 nt, Homo Sapiens
aucccugaggagccaggccgcauuccuuagucucaagggcuagccccuaguuucccugaaggaa

SEQ ID NO: 57426 - RNA, 64 nt, Homo Sapiens
uuucuauucacgucaaacuuugacuaccaugcagaagggcuaucuuucuagugcugguauuugu

SEQ ID NO: 57427 - RNA, 64 nt, Homo Sapiens
caaaugaacuugcuuguguguauuugauggcucuaagggcuauaaauuacaaacaaaacacauc

SEQ ID NO: 57428 - RNA, 64 nt, Homo Sapiens
augccauaccuugagaccaagccggugcccaccuaagggcuaaggccucuugcuggugcacaug

SEQ ID NO: 57429 - RNA, 64 nt, Homo Sapiens
ucuguuuugaagcucaugggaaaauugugaucaaaagggcuaugggaagggcagaccccgccaa

SEQ ID NO: 57430 - RNA, 64 nt, Homo Sapiens
gaauauucaguuaaucauaugguuccuagcuuacaagggcuagaucuaagauuauucccaugag

SEQ ID NO: 57431 - RNA, 64 nt, Homo Sapiens
uucuucuucagugaagcagccuuacuauucauagaagggcuagaauaggagaaaaugaaaggua

SEQ ID NO: 57432 - RNA, 64 nt, Homo Sapiens
cugcagcaggaauggugcccaccucggcgaauugaagggcuaagagucccagauagcuaggcca

SEQ ID NO: 57433 - RNA, 64 nt, Homo Sapiens
cuuucuuucacgugcaaaacccugugugccucauaagggcuauuuuugcucugcuguccuggac

SEQ ID NO: 57434 - RNA, 64 nt, Homo Sapiens
gcuggucccagaggccuggcgggccccagcucagaagggcuauaucuggcuucugcugaccgcu

SEQ ID NO: 57435 - RNA, 64 nt, Homo Sapiens
aauuacaaacaaaacacaucuauuugauggcuccaagggcuauacaaaugaacuugcuugugug

SEQ ID NO: 57436 - RNA, 64 nt, Homo Sapiens
auuuguucuccuucucuuccauuucuguucuuaaaagggcuagaauaaccuaaggaaauuauuc

SEQ ID NO: 57437 - RNA, 64 nt, Homo Sapiens
cgugauaguccuugcaaguagucaggaaucacugaagggcuaacuucuuuuucacagaacuggu

SEQ ID NO: 57438 - RNA, 64 nt, Homo Sapiens
guauugauuacacuuaacaggaaaggcugaacagaagggcuagucaaccaggagcuuauuauag

SEQ ID NO: 57439 - RNA, 64 nt, Homo Sapiens
aauuacaaacaaaacacaucuauuugauggcucuaagggcuauacaaaugaacuugcuugugug

SEQ ID NO: 57440 - RNA, 64 nt, Homo Sapiens
gucuccagggccgggucuugccaccagugcagacaagggcuacaucugagagccuugggggucu

SEQ ID NO: 57441 - RNA, 64 nt, Homo Sapiens
ucccaguguguguucauuguaaacacuuuugggaaagggcuaaacaugugaggccuggagauag

SEQ ID NO: 57442 - RNA, 64 nt, Homo Sapiens
uaccagggcuuaaauguuguauuaagcuuugggcaagggcuauuaacagaaugauccaggggag

SEQ ID NO: 57443 - RNA, 64 nt, Homo Sapiens
ccuccccagucuggccuuggccuccagccuggagaagggcuaacaucagcucauugucaaggcc

SEQ ID NO: 57444 - RNA, 64 nt, Homo Sapiens
ugggagaaaauuuucgcaaccuacucaucugacaaagggcuaauauccagaaucuacaaugaac

SEQ ID NO: 57445 - RNA, 64 nt, Homo Sapiens
uaauacacccaacauuauaacaaaggacuguagcaagggcuaugggaguucugaagcagaaacc

SEQ ID NO: 57446 - RNA, 64 nt, Homo Sapiens
cccacugaagggacacagagguccaguccuucugaagggcuaggaucggguucuggcagggaga

SEQ ID NO: 57447 - RNA, 64 nt, Homo Sapiens
acuguaaugguggaauguggggcaguuggugggaaagggcuaaugacugaaaagcuucauaagg

SEQ ID NO: 57448 - RNA, 64 nt, Homo Sapiens
guagccauguguuaauuguuaaauaaauucuccaaagggcuaaaaguaaauuacuuauaaauuu

SEQ ID NO: 57449 - RNA, 64 nt, Homo Sapiens
augguguguauuuuagggauuaugagcuucuuucaagggcuaaggcugcagagauauuuccucc

SEQ ID NO: 57450 - RNA, 64 nt, Homo Sapiens
gaggcugcaauaaggugccaugaaaucaaaaucaaagggcuagaacucuccaaggucuugcccc

SEQ ID NO: 57451 - RNA, 64 nt, Homo Sapiens
ucccugaacccaggugggacgccuggcuguagagaagggcuacacguccuguuugcccugagcc

SEQ ID NO: 57452 - RNA, 64 nt, Homo Sapiens
ucaaccgaccuuucggguuuccccuuccagcuccaagggcuacaguacagauagaccggccucg

SEQ ID NO: 57453 - RNA, 64 nt, Homo Sapiens
ugauuauuucaagagaaucccaaaguacuugaauaagggcuauuguaaaauuuaaaagaaauau

SEQ ID NO: 57454 - RNA, 64 nt, Homo Sapiens
gugacggagaaggcagacaucaugcaacaugcucaagggcuauucauuuuaagcugaaacauac

SEQ ID NO: 57455 - RNA, 64 nt, Homo Sapiens
caacccugcauccauguguguccguggguaccguaagggcuacugggggaagaaccuguaagca

SEQ ID NO: 57456 - RNA, 64 nt, Homo Sapiens
ugaagaaaguuucaguauuguaaucauguuguuuaagggcuaggguaauugacaaaauaucuga

SEQ ID NO: 57457 - RNA, 64 nt, Homo Sapiens
auggacaaaaugucucuuagaccuguucuggcugaagggcuaucucuggcaccucugagauccc

SEQ ID NO: 57458 - RNA, 64 nt, Homo Sapiens
ucaugagggugggucacuacagauguuggggagcaagggcuaggaucacuuuuuaaaaaaucac

SEQ ID NO: 57459 - RNA, 64 nt, Homo Sapiens
aauaaaauagccaaaaaaugugaaacaagcuuccaagggcuagaaugauauggugucuuuuucu

SEQ ID NO: 57460 - RNA, 64 nt, Homo Sapiens
ccacccagagacugugcccgaugccacagugccuaagggcuaggcugacaugcccaugccaccu

SEQ ID NO: 57461 - RNA, 64 nt, Homo Sapiens
uuggauuuaaucuggguaaaaucagccuucugagaagggcuaagaaacaguucaauuaacugua

SEQ ID NO: 57462 - RNA, 64 nt, Homo Sapiens
accugaccuggccucuugccuaaaccacaaggcuaagggcuauagacaaugguuuccuuaggaa

SEQ ID NO: 57463 - RNA, 64 nt, Homo Sapiens
aauuuugagcaacaaaauuugaauuuagguggauaagggcuagacauauauguagaaccauaca

SEQ ID NO: 57464 - RNA, 64 nt, Homo Sapiens
uaagauuuuacaaaucuuuucuucauuauuuuuaggaauaaaugcuuuaaguugacuuuuuuua

SEQ ID NO: 57465 - RNA, 64 nt, Homo Sapiens
ugaaaagcuaaauuaaaauaugaaggaccucaauggaauaaauuguacucucccuauuaauauu

SEQ ID NO: 57466 - RNA, 64 nt, Homo Sapiens
uaugauacccacuuggacuuuuaacaaaaguaaaggaauaaauuugcauauaggcuuggaaagu

SEQ ID NO: 57467 - RNA, 64 nt, Homo Sapiens
ucagccuuuugaccaccuggugccagcuauauaaggaauaaaguugauucauaucaacauuaga

SEQ ID NO: 57468 - RNA, 64 nt, Homo Sapiens
cauucuacagggagaaagagauagccaauacauaggaauaaauauauacaagguaucauguagu

SEQ ID NO: 57469 - RNA, 64 nt, Homo Sapiens
gggaaacaagacuuuuccugcaauagccugggaaggaauaaaaggauagaguguuuggguuuuu

SEQ ID NO: 57470 - RNA, 64 nt, Homo Sapiens
uuuucccagcaaaauaaaucauauggcgagucagggaauaaaaagucaaaagaaacaaauagaa

SEQ ID NO: 57471 - RNA, 64 nt, Homo Sapiens
ugccuuuuuuucacaguaguccuuggcucugcacggaauaaaugauacccucaaaucuaauugg

SEQ ID NO: 57472 - RNA, 64 nt, Homo Sapiens
uucacugucuguugcuucaguaaaaggaccucggggaauaaaacauuucucucuuauaugccag

SEQ ID NO: 57473 - RNA, 64 nt, Homo Sapiens
uguuuucgaugagguuccauguuuuguuuucuugggaauaaauuaauauauuguuuuccacuuc

SEQ ID NO: 57474 - RNA, 64 nt, Homo Sapiens
aaucaacggggaaaacaucuucuccaaaaaacuuggaauaaauccaaggaccaguuuuuaccca

SEQ ID NO: 57475 - RNA, 64 nt, Homo Sapiens
caacacaaaauaaacuagaaggccagaggauaauggaauaaaagaucauugcaauuacuuaucc

SEQ ID NO: 57476 - RNA, 64 nt, Homo Sapiens
gguaccuugucugauuuaauaauauauuuuauaaggaauaaaauuuuuuacagcaacaauauga

SEQ ID NO: 57477 - RNA, 64 nt, Homo Sapiens
gagagagcaguguggaaaccgggcaggaaagagaggaauaaaggucuuaugccguugguauaca

SEQ ID NO: 57478 - RNA, 64 nt, Homo Sapiens
uuuuaugaauggacuuuucaaaauucauguaaguggaauaaaaguuguuaagaacacguguauu

SEQ ID NO: 57479 - RNA, 64 nt, Homo Sapiens
ggaucauugguuccagucacguuuguccuggcggggaauaaaagagaaaacugccuacauacug

SEQ ID NO: 57480 - RNA, 64 nt, Homo Sapiens
cagagggagaggacccucagcucaauacugccagggaauaaaacgaugggucccugugccaggc

SEQ ID NO: 57481 - RNA, 64 nt, Homo Sapiens
aaaguuuucacacuguguacggauacuugggaggggaauaaauugcuaaagagauauacauucu

SEQ ID NO: 57482 - RNA, 64 nt, Homo Sapiens
aacccccuaaccacaaaauaugaacaacuuugcaggaauaaagcuaaauuuuuauuaaugcacu

SEQ ID NO: 57483 - RNA, 64 nt, Homo Sapiens
gaauuuaucauugaacccaaauaugauauuauuuggaauaaacauuaacuugugaacuccuugg

SEQ ID NO: 57484 - RNA, 64 nt, Homo Sapiens
uuuuaaaaauuaagagauauuuuuuauuuuuaagggaauaaaaaaucuucuauucaaaaucuuu

SEQ ID NO: 57485 - RNA, 64 nt, Homo Sapiens
uuguuugacucuggagaggagagaaaaaguucaaggaauaaagagauuagaaaauaagacuucu

SEQ ID NO: 57486 - RNA, 64 nt, Homo Sapiens
gugucccaccuguuuacuugcaccauaacaguagggaauaaacucucgugaagggcaaauguaa

SEQ ID NO: 57487 - RNA, 64 nt, Homo Sapiens
ugucugcucacaagagauaaagauacccucucauggaauaaacaccuugcuuagaauucauaua

SEQ ID NO: 57488 - RNA, 64 nt, Homo Sapiens
agagugaaaggggcuauuauuaggugggacaaaaggaauaaaugaagacugcccagaaaaaacu

SEQ ID NO: 57489 - RNA, 64 nt, Homo Sapiens
aauagaguaacaaguggcagaacagaugacauguggaauaaagucagguuuguuuuuccaaagu

SEQ ID NO: 57490 - RNA, 64 nt, Homo Sapiens
ggaagcugggucucuuuguuccccuacccaacugggaauaaacucuccccgagagcaggccugu

SEQ ID NO: 57491 - RNA, 64 nt, Homo Sapiens
auagauuaaaaguauacaaugguucaaauugaguggaauaaaguuuaaaagacuuauuaugugg

SEQ ID NO: 57492 - RNA, 64 nt, Homo Sapiens
uaugaacaaaaaagcugcaauagagaaguuaacaggaauaaauauaauaaaauucucuuucagc

SEQ ID NO: 57493 - RNA, 64 nt, Homo Sapiens
uggaagguacuuuaauuuuugaagaaacuucagcaagcuagaacuuaauuuuuguacuuuugca

SEQ ID NO: 57494 - RNA, 64 nt, Homo Sapiens
acccaagcuucugccuucugcuauuuuacuuguaaagcuagagcugagcuuuugccugccugug

SEQ ID NO: 57495 - RNA, 64 nt, Homo Sapiens
agaacauuccaaacuaguaacauuucgcuacuaaaagcuagaaaggaugaacugugaaagguuc

SEQ ID NO: 57496 - RNA, 64 nt, Homo Sapiens
cauugcaugggaagaguacagagguggcagaaugaagcuagagugggaaggacuaaagacugag

SEQ ID NO: 57497 - RNA, 64 nt, Homo Sapiens
ugcucuucaacuagugaaugaaagaaacuucagaaagcuagaauugcuuaucaaucaaaagacu

SEQ ID NO: 57498 - RNA, 64 nt, Homo Sapiens
cucaacaacaauauucucaagagucuucuacuggaagcuagaaagaaauaggaauuuaagucca

SEQ ID NO: 57499 - RNA, 64 nt, Homo Sapiens
uuucaagcuucacuuuugugcaguagaaacaaaaguaggcuacagucugugccauguugaugua

SEQ ID NO: 57500 - RNA, 64 nt, Homo Sapiens
ucaguccgaauuaauucccccucccuaggugccuguaggcuaugguacuucuuccucauuguuu

SEQ ID NO: 57501 - RNA, 64 nt, Homo Sapiens
acauuugaacagggcaaaaugaacuaacugccauguaggcuaagaaagaaaugcuaaccugugg

SEQ ID NO: 57502 - RNA, 64 nt, Homo Sapiens
cacuccucugagagggcagaacacacauauccaaguaggcuacccaccacuggguagggauuuc

SEQ ID NO: 57503 - RNA, 64 nt, Homo Sapiens
gugcccucaucagagucaucagcaaacuguccaaguaggcuaggcuccagauuuaugaggaaag

SEQ ID NO: 57504 - RNA, 64 nt, Homo Sapiens
ugaauguucauucuuucuuuuugcucauacugcuguaggcuauaauuccccccuguuuuuccau

SEQ ID NO: 57505 - RNA, 64 nt, Homo Sapiens
uccccccaccccagcuggucgacagucccccgagguaggcuacacucagcccguuuugaggaca

SEQ ID NO: 57506 - RNA, 64 nt, Homo Sapiens
ggguuucuucuaugacacuuagucugggaguaggguaggcuagggaguuaaaccucuggcauga

SEQ ID NO: 57507 - RNA, 64 nt, Homo Sapiens
gcuuagugccugaguauuuauccuagaguuucagguaggcuaaugaauacagcacuagacuuca

SEQ ID NO: 57508 - RNA, 64 nt, Homo Sapiens
gaggugaccaggccuggcagcaugugucauaagaguaggcuacaugguuacccuugccuccacc

SEQ ID NO: 57509 - RNA, 64 nt, Homo Sapiens
aaggaaggacccuccugucaaccugguuguauguguaggcuaaggaacccuuccauccuuugac

SEQ ID NO: 57510 - RNA, 64 nt, Homo Sapiens
aaacaaaaaaagguugcuguaacaauuuugagaaguaggcuauacccguugucacuaaucacac

SEQ ID NO: 57511 - RNA, 64 nt, Homo Sapiens
uuuuuaaacauuccacaagagacuguuuucuuuaguaggcuaaccaaaaccuucacaagaaguc

SEQ ID NO: 57512 - RNA, 64 nt, Homo Sapiens
aaaguguuagccuuuuuuccccagacuuguuggcguaggcuacagagaagccuucaagcucuga

SEQ ID NO: 57513 - RNA, 64 nt, Homo Sapiens
gacaccuugguguguuuguuaucuuuaucuguggguaggcuagcugacccaucuccuugaguca

SEQ ID NO: 57514 - RNA, 64 nt, Homo Sapiens
ccuaaccaagccuuggcaccgccagauccuuucuguaggcuaauuccucuugcccaacggcaua

SEQ ID NO: 57515 - RNA, 64 nt, Homo Sapiens
gagauagaaaagaccuuuaagacaauaaaagauuguaggcuaucucuguaaucaugcaauagcu

SEQ ID NO: 57516 - RNA, 64 nt, Homo Sapiens
ggccccagcauggagggaagcccugugggccacgguaggcuagaagggaauucgagcugggcau

SEQ ID NO: 57517 - RNA, 64 nt, Homo Sapiens
agugcugcccuuuaucagcacccugggucauaguguaggcuagaguuaaggcacuggcagacuu

SEQ ID NO: 57518 - RNA, 64 nt, Homo Sapiens
uuguauuguguguugcuaaagaauucuacuuuuaguaggcuaaucaacaaugaaaggguuagaa

SEQ ID NO: 57519 - RNA, 64 nt, Homo Sapiens
gcguaggugccucagggacuuuuggauuuggaaaguaggcuaagcuagugggugucuccaacuc

SEQ ID NO: 57520 - RNA, 64 nt, Homo Sapiens
ugauccuggauaguuucucuuuuuuuuguucccuguaggcuacuuggaaauaaacauuauuuuc

SEQ ID NO: 57521 - RNA, 64 nt, Homo Sapiens
agaagacaagagggccgggcacaaacucugagaaguaggcuaagaggacugcuuccacuuagaa

SEQ ID NO: 57522 - RNA, 64 nt, Homo Sapiens
uuggggaggcucaaaccauuccauagaaaaguaaguaggcuaaguuuguugaaaaaucacaaac

SEQ ID NO: 57523 - RNA, 64 nt, Homo Sapiens
auuuaguguucaaguaucagcuuaacuauuuuguguaggcuacacacagcuugcuuuuguuucu

SEQ ID NO: 57524 - RNA, 64 nt, Homo Sapiens
ucaaugcauaaguuguauaggcuaaauguugcuuguaggcuacauuaaacucaaauguaauagu

SEQ ID NO: 57525 - RNA, 64 nt, Homo Sapiens
caaggccaagaccaucuuuuguaccguugguacaguaggcuaaagguacgguguuccauauuaa

SEQ ID NO: 57526 - RNA, 64 nt, Homo Sapiens
aauauuuugguuaaaaucauguccugcugaugugguaggcuagcuccccgccugcaccagugcc

SEQ ID NO: 57527 - RNA, 64 nt, Homo Sapiens
cuuaucuguggcuuugggauacauaaagaccacuguaggcuaucaaaaggaauuauacaaagga

SEQ ID NO: 57528 - RNA, 64 nt, Homo Sapiens
uaucacgggucacuugaaauucuuucagcuaucaguaggcuaaugucaaaauuguuuaaaaauu

SEQ ID NO: 57529 - RNA, 64 nt, Homo Sapiens
ugugauuuuuuuauauaaguuaaagagacaaauaguaggcuaaaaacauuuuaaaaucaacuuu

SEQ ID NO: 57530 - RNA, 64 nt, Homo Sapiens
aaagugcuacuugagagugggggagaauggcaugguaggcuacuuuucagggccuugacaagua

SEQ ID NO: 57531 - RNA, 64 nt, Homo Sapiens
uaaguccucuagugaauguaggcuggcuuucagaguaggcuauuccugagagcugcaugugucc

SEQ ID NO: 57532 - RNA, 64 nt, Homo Sapiens
guaauucagauguuaaugccacuugaagaaguugguaggcuagcaaagaggaugagacaugaac

SEQ ID NO: 57533 - RNA, 64 nt, Homo Sapiens
cuaagcaaauaaugcagcguuagcacuuuaugauguaggcuaaaguuaauuucccaucuaugaa

SEQ ID NO: 57534 - RNA, 64 nt, Homo Sapiens
augcccgggcuggugcccacaucugucuugggcuguaggcuagaccucagcugcuguccgccug

SEQ ID NO: 57535 - RNA, 64 nt, Homo Sapiens
auaacacaguauuuacaugucagauuacuguacuguaggcuaaaucucccuuaucauuuguauc

SEQ ID NO: 57536 - RNA, 64 nt, Homo Sapiens
agugaaaucauaguaacauaaauuaguauaugauguaggcuaaaaagcugcauguaaaagggga

SEQ ID NO: 57537 - RNA, 64 nt, Homo Sapiens
gugauuguaagaacucuguauauaccagaguguaguaggcuaggcagaauugaagaaagaguau

SEQ ID NO: 57538 - RNA, 64 nt, Homo Sapiens
aguaaauaauuuucuccccaugguacacucuaguguaggcuauucauaccacacugaaaugaac

SEQ ID NO: 57539 - RNA, 64 nt, Homo Sapiens
ugggaugggcagcuaagcagcgcuguggcuggagguaggcuagugauuuaucuagcuguccagc

SEQ ID NO: 57540 - RNA, 64 nt, Homo Sapiens
guugauugucugcacuugccuugcccaauagccaguaggcuacagcuuuugccccacacccuua

SEQ ID NO: 57541 - RNA, 64 nt, Homo Sapiens
uguuaaucucuuucaugugcaaucuuugcuucuuguaggcuaucgccccauuccagcggagacu

SEQ ID NO: 57542 - RNA, 64 nt, Homo Sapiens
agaucuuuuuccucagaauuguuuucuuuucacuguaggcuauuacaggauacuucaggaucaa

SEQ ID NO: 57543 - RNA, 64 nt, Homo Sapiens
ccaagcaaaucauccccauuaaaaagcuuuuccuguaggcuaguaggauuucuaaauagaugaa

SEQ ID NO: 57544 - RNA, 64 nt, Homo Sapiens
caggcucuuugagagccaugggcugcacccggccguaggcuaguguaacucgcaucccauugca

SEQ ID NO: 57545 - RNA, 64 nt, Homo Sapiens
acccaaagcaaacauccuuaauaagagaccaaaaguaggcuaucccuuaguacucagauaauaa

SEQ ID NO: 57546 - RNA, 64 nt, Homo Sapiens
aacauaccauggccuauuggaugaaucauuugccguaggcuaaaucagacuguaggguuuguga

SEQ ID NO: 57547 - RNA, 64 nt, Homo Sapiens
aggcuuccaggcugagagccgagagguggauccuguaggcuaaagaggcaccucugagggagca

SEQ ID NO: 57548 - RNA, 64 nt, Homo Sapiens
agcugugacaguacacuccagguugcuauuuaggguaggcuaaccucacuuaccaagaaugguu

SEQ ID NO: 57549 - RNA, 64 nt, Homo Sapiens
gcagaccacccacuucugcuauguugcugcagaaguaggcuaagacucuucccagggaaaauuc

SEQ ID NO: 57550 - RNA, 64 nt, Homo Sapiens
uuuucaguguauauccacucguuguuugagaaauguaggcuauucaauaucugcuccuuuucga

SEQ ID NO: 57551 - RNA, 64 nt, Homo Sapiens
ugguuuucugccauacuuuucuccauuggcccagguaggcuaauugguaguuguucauuucagc

SEQ ID NO: 57552 - RNA, 64 nt, Homo Sapiens
acgggagguaagggugguaugggccgagggccggguaggcuagcauguuggggcggcaagcggu

SEQ ID NO: 57553 - RNA, 64 nt, Homo Sapiens
gaccaagauguccaaaauuaagauaccacuugcuguaggcuacggaauuauccuuuaauuuuac

SEQ ID NO: 57554 - RNA, 64 nt, Homo Sapiens
aaaaggggggaggauaacuuucacaggguaauugguaggcuaaauaggaguuacagaaaacugu

SEQ ID NO: 57555 - RNA, 64 nt, Homo Sapiens
agugguaauggggacaagaugcggcccuggugcuguaggcuacauccugauaccuauaaguuca

SEQ ID NO: 57556 - RNA, 64 nt, Homo Sapiens
aaacgggcuucguguuagauaauuuugcuaaacaguaggcuacuguaaguguucugagcauauu

SEQ ID NO: 57557 - RNA, 64 nt, Homo Sapiens
auuauuuuucuaguuaguaguugucgaccuacagguaggcuaguagaggcugugauuucuguau

SEQ ID NO: 57558 - RNA, 64 nt, Homo Sapiens
cucugcuuacuuaagucucugggcauagcucacuguaggcuagcaauauggugucugucauuca

SEQ ID NO: 57559 - RNA, 64 nt, Homo Sapiens
agggaagauugucaauauuuacuaacaauaaagaguaggcuauauaucauccuuuggcauccca

SEQ ID NO: 57560 - RNA, 64 nt, Homo Sapiens
ccaugauaguguuaaaaaacucugcuaaugcagaguaggcuacuacuauuucuuauuucaaaug

SEQ ID NO: 57561 - RNA, 64 nt, Homo Sapiens
accuuccacuuaaaagcaugccagaucuaacaaaguaggcuaagcaacccaucuacaaaugugc

SEQ ID NO: 57562 - RNA, 64 nt, Homo Sapiens
aguugaaggaaggauaauaauuuaggguuuaacaguaggcuaauggaauuugucuaauaacaau

SEQ ID NO: 57563 - RNA, 64 nt, Homo Sapiens
acuauauauuguagacuauguauuauucuaacauguaggcuaauuuacaugacuuguuaucgcc

SEQ ID NO: 57564 - RNA, 64 nt, Homo Sapiens
uauuuuauuaaaauuuuuuuuguauaguaauaggguaggcuauuugcccguuuuaugcuugaug

SEQ ID NO: 57565 - RNA, 64 nt, Homo Sapiens
cuuggcugucccugccacaguuccagaguuaucaguaggcuagauagaaggugaccucuccuca

SEQ ID NO: 57566 - RNA, 64 nt, Homo Sapiens
accugagagagagacccaaacuuuacucugggagguaggcuaugcccauccaaauaaaucucca

SEQ ID NO: 57567 - RNA, 64 nt, Homo Sapiens
agcacauucagcuuuggaaacuauauuauuuaauguaggcuagcuuguuuucaaauuuuaaaag

SEQ ID NO: 57568 - RNA, 64 nt, Homo Sapiens
accugucuuggugggccgggcccucuugugccccguaggcuaggucuuagggcaacuccuugcc

SEQ ID NO: 57569 - RNA, 64 nt, Homo Sapiens
aagggacaccugccugcaaaacauaagacagcccguaggcuaccacgcccuaguuaagcagcug

SEQ ID NO: 57570 - RNA, 64 nt, Homo Sapiens
ggaagggacucaaagcagcaaugccccucauaguguaggcuaaggugaguuuggugcaugcaaa

SEQ ID NO: 57571 - RNA, 64 nt, Homo Sapiens
aaugaaaaguauuugccaaauuuaaauucuagauguaggcuaacagagaccauaccuaauauug

SEQ ID NO: 57572 - RNA, 64 nt, Homo Sapiens
uuauuuuaccagcuauuuauugagugucuuuuauguaggcuaaaugaacauaggucucuggccu

SEQ ID NO: 57573 - RNA, 64 nt, Homo Sapiens
ugggccccagaugguuaagugcuaaauuuguaggguaggcuaucaggaagugcaggcuggaaac

SEQ ID NO: 57574 - RNA, 64 nt, Homo Sapiens
cacaccacauuuccucaaagcuaaucugaauucuguaggcuaaaaauauucauguagcaaaucu

SEQ ID NO: 57575 - RNA, 64 nt, Homo Sapiens
gaguaaugaauuagccugaccacagguggucacuguaggcuaauggaaaauacccaagggaggg

SEQ ID NO: 57576 - RNA, 64 nt, Homo Sapiens
acuuccggccuagucugccagcuuuugcuggcacguaggcuaccacucuccgggcaccggcugg

SEQ ID NO: 57577 - RNA, 64 nt, Homo Sapiens
aauacacccuuuuuaaauuacaacucuuuuugcuguaggcuaggaaaaauccuuucgauuuagc

SEQ ID NO: 57578 - RNA, 63 nt, Homo Sapiens
uaugugcaaaauaauucuggcuaacuguaaaauguauucaauuuuaggauuuuuuuuuuuugu

SEQ ID NO: 57579 - RNA, 63 nt, Homo Sapiens
uuucauuguaaacguuauugugccaaauguacuguauucaaaaggaugugaauguguauuguu

SEQ ID NO: 57580 - RNA, 63 nt, Homo Sapiens
ccuaacuugagcagaucugauuauucuuggauaguauucaagugguaucuugacuauuaaacu

SEQ ID NO: 57581 - RNA, 63 nt, Homo Sapiens
uuagccauaguaacuuuuugucacaauaacuaaguauucaauuauauauaaagagugaaacau

SEQ ID NO: 57582 - RNA, 63 nt, Homo Sapiens
cugguuuauuaucuuaaucuuggcugacuucuuguauucaacuugugguuuuagaaucuucug

SEQ ID NO: 57583 - RNA, 63 nt, Homo Sapiens
uuaaugaaacugaagguuuacugccccacuuuuguauucaaaaguacacuguucacguuuagc

SEQ ID NO: 57584 - RNA, 63 nt, Homo Sapiens
acaguguucagauuuguccuguguguguuuacaguauucaauuuauugcaguuauagaauugg

SEQ ID NO: 57585 - RNA, 63 nt, Homo Sapiens
uuuuagcuuagugccauuaugucauuuugauuuguauucaaguacucuucaaguaucuuugua

SEQ ID NO: 57586 - RNA, 63 nt, Homo Sapiens
caaguguguuaauuaauaaauggcacauaguauguauucaaaacuaguagcuagcagagagcc

SEQ ID NO: 57587 - RNA, 63 nt, Homo Sapiens
cuuacuagacgaacaaucuuaucagaucacucuguauucaaagcagaauaaaagggugaggac

SEQ ID NO: 57588 - RNA, 64 nt, Homo Sapiens
ucuaguuucaaguaucucacuucuauaacuaucaacuaucaaauucaagaugauuuaauugagc

SEQ ID NO: 57589 - RNA, 64 nt, Homo Sapiens
aucaaauucuaguuucaaguauugagcuucuauaacuaucaacuuuccacuucaagaugauuua

SEQ ID NO: 57590 - RNA, 64 nt, Homo Sapiens
gcagagugaggaagacccccggagucuugguugugacuccaagaagggacuucguugguuuuuu

SEQ ID NO: 57591 - RNA, 64 nt, Homo Sapiens
gcagagcagggaagagcccaagaguguuggucaugacuccaagaaagggacuuuguuggcuuuu

SEQ ID NO: 57592 - RNA, 64 nt, Homo Sapiens
gauuaagugaaagcuuuugggccucaauuuuccuuuaccugaagacuaccaacuuagucaucaa

SEQ ID NO: 57593 - RNA, 64 nt, Homo Sapiens
ugccguagggugagcuuagacagacuggcuuuuguuaccugacagguaaagauggaaggcuggg

SEQ ID NO: 57594 - RNA, 64 nt, Homo Sapiens
aauuaaggacugcaccugguuuucuaaaguuauguuaccugagaaacuuguauuagaauuguuu

SEQ ID NO: 57595 - RNA, 64 nt, Homo Sapiens
aaucaaggagugcaccugauuuucuaaaguuauguuaccugaaaacuuguauuagaauuguuuu

SEQ ID NO: 57596 - RNA, 64 nt, Homo Sapiens
cuuguuuaacauguauuagauuucucagcuacuauuaccugaaaucauuaugugcaucaauauu

SEQ ID NO: 57597 - RNA, 64 nt, Homo Sapiens
uuugugauuagaacagaacacacuccaucaaaauuuaccugaucugucugaaacaaacacagag

SEQ ID NO: 57598 - RNA, 64 nt, Homo Sapiens
ugaaggaucuucaaagcaggaugaagaccuagacuuaccugaaggccuagacucagcugaagga

SEQ ID NO: 57599 - RNA, 64 nt, Homo Sapiens
ugaaggaucuucaaagcaggaugaagaccuagacuuaccugaaggaucuucaaagcagaaugaa

SEQ ID NO: 57600 - RNA, 64 nt, Homo Sapiens
ugaaggaucuucaaagcagaaugaagaccuaggcuuaccugaaggaucuucaaagcaggaugaa

SEQ ID NO: 57601 - RNA, 64 nt, Homo Sapiens
ugaaggaucuucaaagcaggaugaagaccuagacuuaccugaaggaucuucacaggaggauaaa

SEQ ID NO: 57602 - RNA, 64 nt, Homo Sapiens
ugaaggaucuucacaggaggauaaagacguagaauuaccugaaggaucuucacaggaggaugaa

SEQ ID NO: 57603 - RNA, 63 nt, Homo Sapiens
ugcgggacaaccucuacuaggcgauggcucugcucugucuacauuuauuuguacccacacgug

SEQ ID NO: 57604 - RNA, 64 nt, Homo Sapiens
uguguguguguguguguguguuugugugugugugucugucuauuuuguauccuggaccacaagu

SEQ ID NO: 57605 - RNA, 64 nt, Homo Sapiens
cuggccgagucuccgacugugccgagucucugggucugucuacagccuggcucugucuacacug

SEQ ID NO: 57606 - RNA, 64 nt, Homo Sapiens
cuggccgagucucugggucucugcccagccuggcucugucuacaguggggccagcgucgccggg

SEQ ID NO: 57607 - RNA, 64 nt, Homo Sapiens
uuaagcuuucuuuauaucagaguaaauuucagggucugucuaucaaauggaauuucaggagcac

SEQ ID NO: 57608 - RNA, 64 nt, Homo Sapiens
gguuuaugggcuauuacuuuacauagugcugguuucugucuauacuguaguccuugucuccuug

SEQ ID NO: 57609 - RNA, 64 nt, Homo Sapiens
ucaucuuugcuuccuguuacuuuuagggcagaagucugucuaauucccaccaauuagucaacuc

SEQ ID NO: 57610 - RNA, 64 nt, Homo Sapiens
ucuagagcccauguucuuuagagucaaaugcaagucugucuaaacuauuaaguucuaguauuug

SEQ ID NO: 57611 - RNA, 64 nt, Homo Sapiens
aacacagaggagaauuuauuguugcuaccgagugucugucuaagagucuacuaggcauagcacc

SEQ ID NO: 57612 - RNA, 64 nt, Homo Sapiens
uugaauuggguaagggucucaaccucaaaagacgucugucuacagaggacaaagcagcggauac

SEQ ID NO: 57613 - RNA, 64 nt, Homo Sapiens
caguucccuugagaacuuccgagauguuuguaccucugucuaaaguauuuggaagucugaauug

SEQ ID NO: 57614 - RNA, 64 nt, Homo Sapiens
uacaaaggucagaaaucuuaguguuuucuccagaucugucuagacuaguuagcuaguagcaacc

SEQ ID NO: 57615 - RNA, 63 nt, Homo Sapiens
uacucuuaaguguaaauaauauaaaauguuucaagcgcuuaacucccccucauucacaaagua

SEQ ID NO: 57616 - RNA, 63 nt, Homo Sapiens
acauucccaauucagugagauuaugguuugaccagcgcuuaucugacaguaaauaucagaauu

SEQ ID NO: 57617 - RNA, 63 nt, Homo Sapiens
cugaaguauuagauuaaagcgauauucacuuucagcgcuuauauguuuuuauaaaagcaaaag

SEQ ID NO: 57618 - RNA, 63 nt, Homo Sapiens
uaauuaaaugggggcucuuacugacuuuaaauuagcgcuuauaaaauaaaaauguuuaguuca

SEQ ID NO: 57619 - RNA, 63 nt, Homo Sapiens
uuccuagcgaagugccguaacacuucaaagagcagcgcuuaaaagaguauaaagcagcuguca

SEQ ID NO: 57620 - RNA, 63 nt, Homo Sapiens
aacauguuccuguuccucggccuccaaucccccagcgcuuagagcagucugaaggauucccca

SEQ ID NO: 57621 - RNA, 50 nt, Homo Sapiens
augcacagcagaggcgaugaagcgcuuacucuuugauccuucuccugaag

SEQ ID NO: 57622 - RNA, 63 nt, Homo Sapiens
cuaugugaaguacuguguugcagaaguggcaaaagcgcuuauuuuuaaaaaugcaaaauauuu

SEQ ID NO: 57623 - RNA, 63 nt, Homo Sapiens
augcccccacgugugaacauauuuggagcugguagcgcuuacgccaaguucccaucacgucag

SEQ ID NO: 57624 - RNA, 63 nt, Homo Sapiens
ccuuacccaggaaauauccucgguaccaagaguagcgcuuagcuggugagggucagaagggga

SEQ ID NO: 57625 - RNA, 63 nt, Homo Sapiens
uuguuccucuguuaucaugccuuugggguuuagagcgcuuaaguggaggcaagaaagcauuuc

SEQ ID NO: 57626 - RNA, 63 nt, Homo Sapiens
guauauuuaaauacuaccauugaagcacuauuaagcgcuuaacagaguaaaagucuaccccuc

SEQ ID NO: 57627 - RNA, 63 nt, Homo Sapiens
aaaacaaauuggacagcuacggucccaaugcucagcgcuuaaauucauuuguggcaauuaagu

SEQ ID NO: 57628 - RNA, 63 nt, Homo Sapiens
gcacgcugucaucauggacaguugguuggacacagcgcuuagugcuaaaaugccagguaaagg

SEQ ID NO: 57629 - RNA, 63 nt, Homo Sapiens
uccaagacuauuuuuuauugcuuuagguauaucagcgcuuaaacacuuaagccuagaauuucu

SEQ ID NO: 57630 - RNA, 63 nt, Homo Sapiens
ccuuuuucuauuuuagucggaucccuucucgugagcgcuuagauugagcauuguauuucucgc

SEQ ID NO: 57631 - RNA, 63 nt, Homo Sapiens
gacacgcgggccuuugguggugcugcuguaguuagcgcuuaguugcacugcucgagacacaag

SEQ ID NO: 57632 - RNA, 63 nt, Homo Sapiens
uauguuuuucuugaauagguauugauaaauggaagcgcuuaccagcccagcuuugccagcccu

SEQ ID NO: 57633 - RNA, 63 nt, Homo Sapiens
aaauccggaaaaaugggguuuuucuuauuuuagagcgcuuaaagcuggcuugcacuuucuuau

SEQ ID NO: 57634 - RNA, 66 nt, Homo Sapiens
aaugagauggcaugugaaagcacuuugaaaauuguaaagcgcuauguaaauguaagguauuauaga

SEQ ID NO: 57635 - RNA, 66 nt, Homo Sapiens
aauggugcuguguuuugguuguggucugaagcuuugaagcgcuacuuagcaucuccuuucuuccau

SEQ ID NO: 57636 - RNA, 66 nt, Homo Sapiens
gggccgccagugccuucuucuguggacagcucucagaagcgcuaccuugguggacgccgacccugu

SEQ ID NO: 57637 - RNA, 66 nt, Homo Sapiens
cagcuagucuaaccacuaggacaggaaacauaaucaaagcgcuaguucacccccuccacacacaaa

SEQ ID NO: 57638 - RNA, 66 nt, Homo Sapiens
aauguagagaaugaauugaauuuuuuuuuuuuuuuuaagcgcuacuugauauuaauuuugccuuuu

SEQ ID NO: 57639 - RNA, 66 nt, Homo Sapiens
gugauucaugaaugaauuucguuugaguagauugccaagcgcuacuugcacagaaauuuggguaau

SEQ ID NO: 57640 - RNA, 66 nt, Homo Sapiens
uaaaaauauuaacugacgaaagaacucguuaaagcaaagcgcuaagauuucaaucucuuuguguuc

SEQ ID NO: 57641 - RNA, 66 nt, Homo Sapiens
aaaacacuuauuacccuucugcagcaaaggcauuaaaagcgcuaagcauauauuaauaaaugcaag

SEQ ID NO: 57642 - RNA, 66 nt, Homo Sapiens
ggaagcagccaagucgguuaggaacggugaaguacuaagcgcuagaaccaucucccaugaagaaag

SEQ ID NO: 57643 - RNA, 66 nt, Homo Sapiens
gucauaaaggacucagcaaccagccagggacagauaaagcgcuauggaaaggggcuuccaaguucu

SEQ ID NO: 57644 - RNA, 66 nt, Homo Sapiens
aaauaaauguuuacaauuuuauaugaaagauggaauaagcgcuagagcuuccaacuguauauuuuu

SEQ ID NO: 57645 - RNA, 66 nt, Homo Sapiens
guacaccagcuccaaguaaacuaguuaccuggguaaaagcgcuaacgacccaaaggcucuucuaag

SEQ ID NO: 57646 - RNA, 66 nt, Homo Sapiens
agggcuaaaggauuauaguaggaaugcagucuacaaaagcgcuauauccacuaaagaaagcuuguu

SEQ ID NO: 57647 - RNA, 66 nt, Homo Sapiens
cuaaaguguguaaguuuuucuucaaagauaaguauuaagcgcuaccaccuagcaucagcaauagau

SEQ ID NO: 57648 - RNA, 66 nt, Homo Sapiens
gagggccugcggagccucaagaagccagaccgcaagaagcgcuacaccguggugggcaaccccuac

SEQ ID NO: 57649 - RNA, 66 nt, Homo Sapiens
uucuauuugaucugauaucagauuuauuuguuuaaaaagcgcuaauuaauuucugcaaauguaauu

SEQ ID NO: 57650 - RNA, 66 nt, Homo Sapiens
uuuuuuugcucuugauuuaaaaaaaaguuuuguugaaagcgcuauugaauauugcaaucuauauag

SEQ ID NO: 57651 - RNA, 66 nt, Homo Sapiens
guccacaccgcuucauugaugaggacaggagacuccaagcgcuaguauugcacgcugcacuuaaug

SEQ ID NO: 57652 - RNA, 66 nt, Homo Sapiens
augccuuuugccucugcauaggaaaagaggagagccaagcgcuagccaacagaaagaugucaacaa

SEQ ID NO: 57653 - RNA, 66 nt, Homo Sapiens
acacguauuuccuugacaaauaccugauguguauucaagcgcuauaucuuuuuuguuuugucuuuc

SEQ ID NO: 57654 - RNA, 66 nt, Homo Sapiens
uguucaggcuuuuaaaaaaauaccacugugagaauaaagcgcuagcaagauacaucacuuacugau

SEQ ID NO: 57655 - RNA, 66 nt, Homo Sapiens
cuggacuccgaguucuauaaaaaccucaccuccaucaagcgcuaugauggggacaucacugaccug

SEQ ID NO: 57656 - RNA, 66 nt, Homo Sapiens
ccuggcuucaagagauccacccaccucagccucccaaagcgcuaggauuacaaguaugagacuuug

SEQ ID NO: 57657 - RNA, 66 nt, Homo Sapiens
uguuuuauaaagaacgugauuuccagugaucucuggaagcgcuaaagcuaaaauuucuguucuuga

SEQ ID NO: 57658 - RNA, 66 nt, Homo Sapiens
uauuguaagaacuguuaauaaaaguugucaaguaaaaagcgcuauaucuaaaaagacuuuaugaac

SEQ ID NO: 57659 - RNA, 66 nt, Homo Sapiens
agacugcccaugaccugaaggcuccagguggcuuuaaagcgcuauguuuaccaacuaucccggugu

SEQ ID NO: 57660 - RNA, 66 nt, Homo Sapiens
caggaaaacgugcuuuucggcaaagcccugaaccccaagcgcuaccagcagacucuggaggccugu

SEQ ID NO: 57661 - RNA, 66 nt, Homo Sapiens
cuguaauuguagcuuuccacuuaggcaguucccaacaagcgcuagccuguggccucaggaaucaac

SEQ ID NO: 57662 - RNA, 66 nt, Homo Sapiens
gucccuuuucaauucccuucugguucaugaugcauaaagcgcuaggcccuagaacuccagaaacag

SEQ ID NO: 57663 - RNA, 66 nt, Homo Sapiens
ccuagucuuaagcaaucuuccugcuuuggccucccaaagcgcuaggauuccaggugugagcuacug

SEQ ID NO: 57664 - RNA, 66 nt, Homo Sapiens
gcugggaguggggagggcguggagacagucuacggaaagcgcuagcagacccccgagagggugcag

SEQ ID NO: 57665 - RNA, 66 nt, Homo Sapiens
caaaauuguguccacauaauccacgcucaucuugcaaagcgcuauuucaggcacaucauuggaaua

SEQ ID NO: 57666 - RNA, 66 nt, Homo Sapiens
cagccggagagacagccaggcaccucggccccagcaaagcgcuaagcccacccagcgcgcagucuc

SEQ ID NO: 57667 - RNA, 66 nt, Homo Sapiens
caugugacugugcccauuccugcauggaccuuucccaagcgcuagcacaggugcaaaauccaucag

SEQ ID NO: 57668 - RNA, 66 nt, Homo Sapiens
ccugggcucaugcaauccuccugccuuggccucccaaagcgcuaggauuagaggugugagccgcug

SEQ ID NO: 57669 - RNA, 63 nt, Homo Sapiens
aagugcgccugugugcgcgggugugggagcacacuuugcaaagccacagcguuucugguuuug

SEQ ID NO: 57670 - RNA, 63 nt, Homo Sapiens
caggcaccgaggcagggcuggaggaguaaguggcuuugcaauaaaaugggugcuggagucuaa

SEQ ID NO: 57671 - RNA, 63 nt, Homo Sapiens
gcuuugcuaaugugcugauccgcacuaacucaucuuugcaaaaggaacugcucccucggcgug

SEQ ID NO: 57672 - RNA, 63 nt, Homo Sapiens
ccuggccuccauucucuugggggagucuuggcacuuugcaaacauccuggccaccaugggcac

SEQ ID NO: 57673 - RNA, 63 nt, Homo Sapiens
ucuacgcucuccuuccucgccagcacgccuuagcuuugcaagccugcaugcauucaggcuucu

SEQ ID NO: 57674 - RNA, 63 nt, Homo Sapiens
aaugaguuguuguuuccuuaucacuccuggucccuuugcaagugaacccugcagcucacccau

SEQ ID NO: 57675 - RNA, 63 nt, Homo Sapiens
ccuuuaccucaaguugcuuggcagcacaacuaucuuugcaaaaaaaaguaaagaaaaaguaaa

SEQ ID NO: 57676 - RNA, 63 nt, Homo Sapiens
acaacuuuuuuucccaaacaguguuaaaagccacuuugcaacacuugacuucaucuuaaugua

SEQ ID NO: 57677 - RNA, 63 nt, Homo Sapiens
cuuccugaguaauuaaauggaccaacaaugagccuuugcaaaauuuucaagcggaaauuuuaa

SEQ ID NO: 57678 - RNA, 63 nt, Homo Sapiens
uaaaaagaacauugguuuagauaaauacuuauacuuugcaaagucaaaaauggcuugauuuuu

SEQ ID NO: 57679 - RNA, 63 nt, Homo Sapiens
cuuuuugauugcugcagaaauguccuaugcacucuuugcaagagcacacaacaaaugucagau

SEQ ID NO: 57680 - RNA, 63 nt, Homo Sapiens
uuuuaaauuacuuuguggacuguguuuucaaaacuuugcaaauucaucuguuacacagaaaau

SEQ ID NO: 57681 - RNA, 63 nt, Homo Sapiens
cugccucaccugccuccucaccuugcauagcaccuuugcaagccugcggcgauuugggugcca

SEQ ID NO: 57682 - RNA, 63 nt, Homo Sapiens
ucauguucucuccaaccagggcuggcaucacugcuuugcaaaguggggccugagguagaagaa

SEQ ID NO: 57683 - RNA, 63 nt, Homo Sapiens
uaucucuuggaaaauaagacaauaguauuucuccuuugcaauagcaguuauaacagaugugaa

SEQ ID NO: 57684 - RNA, 63 nt, Homo Sapiens
ucauuuucugaggugcuuggcucugauucagggcuuugcaagggguuagaagcugacuguaaa

SEQ ID NO: 57685 - RNA, 63 nt, Homo Sapiens
gaucaguucuuagcaaugauguuuuuuuuucugcuuugcaaggcgcuagaaucuuuuauuuua

SEQ ID NO: 57686 - RNA, 63 nt, Homo Sapiens
ugacacacagcugcuguaccagugaaaacgaggcuuugcaagcuuguaccuacuauauaacau

SEQ ID NO: 57687 - RNA, 63 nt, Homo Sapiens
aaaacggugccagguaccacaacaguaacagaacuuugcaauuuucugggguuuuguuuuuua

SEQ ID NO: 57688 - RNA, 63 nt, Homo Sapiens
caccagucaaacccaccaaauugcuuuauuccccuuugcaagaugggcacugccauaguucug

SEQ ID NO: 57689 - RNA, 63 nt, Homo Sapiens
uacuguguaaauagguuacaccccaguugaaaucuuugcaaaggucgguucuauucagcgaac

SEQ ID NO: 57690 - RNA, 63 nt, Homo Sapiens
gcagugccauccuacagguggcuggagcagcugcuuugcaaccugaucaccuugaguucugag

SEQ ID NO: 57691 - RNA, 63 nt, Homo Sapiens
ggccuaacggagcccacccaggcacagccaccacuuugcaagugggaggaggggagaagggga

SEQ ID NO: 57692 - RNA, 63 nt, Homo Sapiens
augcacaagcagagaucaugguauaauaaaucccuuugcaacuccacucagcccugacaaccc

SEQ ID NO: 57693 - RNA, 63 nt, Homo Sapiens
cuccugauugaacugaugcacagaaucuuuuuacuuugcaauagauuuguacuaaccagaccu

SEQ ID NO: 57694 - RNA, 63 nt, Homo Sapiens
aauaagugauaaugaaaaccacugaguuauauacuuugcaaggguaaauuacaucugaauaaa

SEQ ID NO: 57695 - RNA, 63 nt, Homo Sapiens
agggccuagaaacucacccgugcauauguugaccuuugcaaaaugaccuggugacauggcaag

SEQ ID NO: 57696 - RNA, 63 nt, Homo Sapiens
ucacuuguguuaaaggcucugaacguguugaggcuuugcaauuggugcucuguggauugaguu

SEQ ID NO: 57697 - RNA, 63 nt, Homo Sapiens
aacugucacuuucgucuccauguuucuacaggucuuugcaacaagaaaugaacguguaaguaa

SEQ ID NO: 57698 - RNA, 63 nt, Homo Sapiens
uuuauuacacaaagaacuuggaaaccaagugcgcuuugcaauaauauuugacuugaaaagaaa

SEQ ID NO: 57699 - RNA, 63 nt, Homo Sapiens
ugcuugguuguguugagguuugcuuuccugggccuuugcaagaucccugacuggccaaacccu

SEQ ID NO: 57700 - RNA, 63 nt, Homo Sapiens
ucugccuuggguucagcccaacugaugucacaacuuugcaagccggguacaauaacacacugu

SEQ ID NO: 57701 - RNA, 63 nt, Homo Sapiens
acuacugggcuucccaagaaaugcugcugcugccuuugcaaggccgacaucccaccgaaucug

SEQ ID NO: 57702 - RNA, 63 nt, Homo Sapiens
cauucaauuucagucugcugcuaaagguuucuccuuugcaaccauagaaaguuuucuauagcu

SEQ ID NO: 57703 - RNA, 63 nt, Homo Sapiens
aauaagcacucuaauuuuuauuuccaugguguacuuugcaagaaacaauuuucccccgagggu

SEQ ID NO: 57704 - RNA, 63 nt, Homo Sapiens
uuaugcugggauuguuuuuacaauauuuaaugucuuugcaacuacuguuuauauuuuuaaaag

SEQ ID NO: 57705 - RNA, 63 nt, Homo Sapiens
auuaaaacuacccuaaguaauccucaacaauaacuuugcaauaauaauauaaggaaggugagc

SEQ ID NO: 57706 - RNA, 63 nt, Homo Sapiens
uucccucauguaaggaagguggaagaccuucaccuuugcaaacaugcuuugguauuuucuugg

SEQ ID NO: 57707 - RNA, 63 nt, Homo Sapiens
uaugggcuuuuuuguuuuugucucguccugucucuuugcaaagaaauucuuuaacuucuuauu

SEQ ID NO: 57708 - RNA, 63 nt, Homo Sapiens
guuuucugcauguuuguucacgcuaaauaaaaucuuugcaauuaagugccaagcacagaaagc

SEQ ID NO: 57709 - RNA, 63 nt, Homo Sapiens
uccguaauuaggaaccuguuauacccuuuugaacuuugcaacuaauuuacauuaguuuuuuuc

SEQ ID NO: 57710 - RNA, 63 nt, Homo Sapiens
ggaaacauccuguuuuauggggggucucauuagcuuugcaacaugcucugagacaagaagggu

SEQ ID NO: 57711 - RNA, 63 nt, Homo Sapiens
gucauuuaucuuucacucccgagcuucuaccaccuuugcaauuucugucugucaccuggucau

SEQ ID NO: 57712 - RNA, 63 nt, Homo Sapiens
gucacuuaucuuucacucccgagcuucuaccaccuuugcaauuucugucugucaccuggucac

SEQ ID NO: 57713 - RNA, 63 nt, Homo Sapiens
acuaguugauacucagugaaaaaauucaaguagcuuugcaaauaacaagugaagaucaacaga

SEQ ID NO: 57714 - RNA, 63 nt, Homo Sapiens
aacaacuuuacuagugacuugucuuuaacucaucuuugcaaucguaacgcuuagucucacagu

SEQ ID NO: 57715 - RNA, 63 nt, Homo Sapiens
auuuaagaaugcgcuuuaucuagcucaugguaacuuugcaacgccuuagauuaaaaugacagu

SEQ ID NO: 57716 - RNA, 63 nt, Homo Sapiens
gagaaaaauaauuacacuuucaaagagaauucccuuugcaauuuuauguuuggaucaccacug

SEQ ID NO: 57717 - RNA, 63 nt, Homo Sapiens
guaggaagcacugaaaauaguguucccagagcacuuugcaacucccuggguaagagggacgac

SEQ ID NO: 57718 - RNA, 63 nt, Homo Sapiens
auuuauuggggccuuuuauucuuucccaaagugcuuugcaaacauuaaguuuuagccacuagc

SEQ ID NO: 57719 - RNA, 63 nt, Homo Sapiens
cuuugagaggucuguguacagugacagguauaucuuugcaaagaaucuuuuugaaaaugguuc

SEQ ID NO: 57720 - RNA, 63 nt, Homo Sapiens
gacauuccuguacuaagguggcacagagcuguccuuugcaacauucucauaaaauugggcaca

SEQ ID NO: 57721 - RNA, 63 nt, Homo Sapiens
ucaguuauuggauauguaucuuuguguacauaucuuugcaaaaauggauaaguacaaaacuug

SEQ ID NO: 57722 - RNA, 63 nt, Homo Sapiens
gcccacccacugugucuuccacguaagggagaccuuugcaaagggcauccaaauggguaggca

SEQ ID NO: 57723 - RNA, 63 nt, Homo Sapiens
ugaaguccgcaugaaacacugcaccaggcagggcuuugcaaagugcaagguauccccagucca

SEQ ID NO: 57724 - RNA, 63 nt, Homo Sapiens
gaguuuuagaagauuagaccauuaggaacguaucuuugcaaacugcccauucacccaugaaga

SEQ ID NO: 57725 - RNA, 63 nt, Homo Sapiens
aucccucuccaccccuuccccccaaaagguuuucuuugcaagugcuuuuggaacuaagagcua

SEQ ID NO: 57726 - RNA, 63 nt, Homo Sapiens
ggauccagagcuauagguacagugugaucucagcuuugcaaacacauuuucuacauagauagu

SEQ ID NO: 57727 - RNA, 63 nt, Homo Sapiens
cugaaauaauagcacaauuucaaagaagagacucuuugcaaaguugauaacauuucaaacccu

SEQ ID NO: 57728 - RNA, 63 nt, Homo Sapiens
cauuuuuauugcuuuucuuaaaauaagggauagcuuugcaaccacuauuguuuuaauggaaag

SEQ ID NO: 57729 - RNA, 63 nt, Homo Sapiens
cuuuucucccacccucuuuuccaagcuguuucgcuuugcaauauauuacugguaaugaguugc

SEQ ID NO: 57730 - RNA, 63 nt, Homo Sapiens
uccacuuuauaaaauagcucaggcauacuguuacuuugcaauagcucccaguucuguuaggac

SEQ ID NO: 57731 - RNA, 63 nt, Homo Sapiens
ugaagagagguucguacuucuuuccauugcaagcuuugcaaagugcaaaauauagcuaaccac

SEQ ID NO: 57732 - RNA, 63 nt, Homo Sapiens
auuaguucuuuuacgaagucccucguccccuuucuuugcaaauuaaugcuuauuagaaaaugu

SEQ ID NO: 57733 - RNA, 63 nt, Homo Sapiens
uuuuccagcccagauacucuucauguaaaccagcuuugcaaaagaaauugggacaaaacaccu

SEQ ID NO: 57734 - RNA, 63 nt, Homo Sapiens
uguguaacauuuucuguuuuccaggagugcuuucuuugcaacuugcuaucaugucagugaacg

SEQ ID NO: 57735 - RNA, 63 nt, Homo Sapiens
uugcaagauuuguagaccaguucuaaggaaagccuuugcaaucaagauagcugaguaggaugg

SEQ ID NO: 57736 - RNA, 63 nt, Homo Sapiens
uauuuauuacuugugcacuuuguuuauacacaacuuugcaaauugaugccgaacauuaggaau

SEQ ID NO: 57737 - RNA, 63 nt, Homo Sapiens
aucauaauacaucaauauuuacacacaaaaaaacuuugcaaccuuuuacaauguguuuauugg

SEQ ID NO: 57738 - RNA, 63 nt, Homo Sapiens
cugcaguuuuuaugguaaaaauuacaacacugccuuugcaacauguaauuuugucuuuggaaa

SEQ ID NO: 57739 - RNA, 63 nt, Homo Sapiens
ggaugguuguuugcaguuagaagcgucauauaccuuugcaaaauuuaaaaauuaucuugacau

SEQ ID NO: 57740 - RNA, 63 nt, Homo Sapiens
cgaaagaauagacugugaaacaugggacagagacuuugcaaucacauauauauauuaaaauug

SEQ ID NO: 57741 - RNA, 63 nt, Homo Sapiens
gauuuugcaaaaaaaaauuggcuuguuuugucucuuugcaacuucuauuacugccuuugccug

SEQ ID NO: 57742 - RNA, 63 nt, Homo Sapiens
ggaaaucaagcugggagaauccuaacucaacugcuuugcaagggaauggaaaagcucugucuc

SEQ ID NO: 57743 - RNA, 63 nt, Homo Sapiens
gaggggcauuacugucaccugacaguuuguucucuuugcaagagcucuucauguuacacuaau

SEQ ID NO: 57744 - RNA, 63 nt, Homo Sapiens
uguauauuacuaacauaguuaacuuucuagacucuuugcaaaacuaaagagauuucuuuuaaa

SEQ ID NO: 57745 - RNA, 63 nt, Homo Sapiens
cuggauuccaauggaccuuuauaacuugacaugcuuugcaaauuggguggcauauguuuugcc

SEQ ID NO: 57746 - RNA, 63 nt, Homo Sapiens
caggcugugaccaacacauguauggugacuucccuuugcaaacuaugucaucagucaucucuu

SEQ ID NO: 57747 - RNA, 63 nt, Homo Sapiens
gccuugggggcacuggcuggagccuuuuucuuccuuugcaaagcuguggguccuuggaccuuu

SEQ ID NO: 57748 - RNA, 63 nt, Homo Sapiens
auacacaaaugcuucucuguaaugugcaauaugcuuugcaacuguagaugauauuuuauguuu

SEQ ID NO: 57749 - RNA, 63 nt, Homo Sapiens
cagagagauugaacuuugaggaggaagcagaaucuuugcaagaaagucagaccuguuucuugu

SEQ ID NO: 57750 - RNA, 63 nt, Homo Sapiens
cuuagccuaccacacuaccagucauucccaucgcuuugcaaucacaagccacaggaugagaag

SEQ ID NO: 57751 - RNA, 63 nt, Homo Sapiens
aggggaugucaauccuuugcauuugaaugaagacuuugcaaaacacaccaaguuuggaaauac

SEQ ID NO: 57752 - RNA, 63 nt, Homo Sapiens
auauuuauaggaauauauucacuacuuuguauacuuugcaaauuugucucucuggcuuuaccc

SEQ ID NO: 57753 - RNA, 63 nt, Homo Sapiens
cuagaugaaagguguccaugguuagaauuugaucuuugcaaacuguauauaauuguuauuuuu

SEQ ID NO: 57754 - RNA, 63 nt, Homo Sapiens
ccaauucacaggguuugugguucuggaugaaaucuuugcaaaggguuucccuggcacucaaac

SEQ ID NO: 57755 - RNA, 63 nt, Homo Sapiens
ggaccaucagauguuugggcaaaacugaaagcucuuugcaaccacacaccuucccugagcuua

SEQ ID NO: 57756 - RNA, 63 nt, Homo Sapiens
cuggaaauguauaaacuaaaguaagcugauuggcuuugcaaacauguucauuuguuuuucaga

SEQ ID NO: 57757 - RNA, 63 nt, Homo Sapiens
uagccucugucaaaagucaaaagacuauaaaugcuuugcaaaaaugguuucacguuugcuuaa

SEQ ID NO: 57758 - RNA, 63 nt, Homo Sapiens
guagaaauuaaaagauacuguauaauuuuaugccuuugcaaagauucguucuuguauuugaau

SEQ ID NO: 57759 - RNA, 63 nt, Homo Sapiens
uuuauuauugacuauaauaauuaguuuaauuagcuuugcaaacugauggcaucaagguaaaua

SEQ ID NO: 57760 - RNA, 63 nt, Homo Sapiens
auaauuuaaguugcuaucagcugauauuaguagcuuugcaacccugauagaguaaauaaauuu

SEQ ID NO: 57761 - RNA, 63 nt, Homo Sapiens
cguccaacaaauucuguacaugcugcuuuacaucuuugcaacaaaccucuuaacuagcagcau

SEQ ID NO: 57762 - RNA, 63 nt, Homo Sapiens
uaagcacuguaaacuucugcaacaagcaugcagcuuugcaaacccauuaaggggaagaaugaa

SEQ ID NO: 57763 - RNA, 63 nt, Homo Sapiens
ugcuugacucaccucagacucucaccugccaaucuuugcaauugccguacaggguagcaccuc

SEQ ID NO: 57764 - RNA, 63 nt, Homo Sapiens
aauacuuuuuaaaaaauaauuguguccagcauucuuugcaauaaucucagccacaugcaacac

SEQ ID NO: 57765 - RNA, 63 nt, Homo Sapiens
uuauuuagcacauuuugacaaguaagcagaguucuuugcaagcaucuaggucuugguuagaga

SEQ ID NO: 57766 - RNA, 63 nt, Homo Sapiens
ucauccagugcaaguuugauugcauugucugaacuuugcaacucuuaauuuugcaaaggagga

SEQ ID NO: 57767 - RNA, 63 nt, Homo Sapiens
cuccaaccagccaggaccagcagccucacagaucuuugcaacaucuugcugagaauguggaug

SEQ ID NO: 57768 - RNA, 63 nt, Homo Sapiens
ccuggugguauuuuauuuugguaaauauuuacucuuugcaaacucgaaugggguagaaacauu

SEQ ID NO: 57769 - RNA, 63 nt, Homo Sapiens
ggcucagugacuggaagaggucccucuucucuccuuugcaaauuaauaauagcaacccuuguc

SEQ ID NO: 57770 - RNA, 63 nt, Homo Sapiens
cuuuuuggaaaagagcugggcacaagguuggagcuuugcaauuugaaaggaauaaaaccuaca

SEQ ID NO: 57771 - RNA, 63 nt, Homo Sapiens
aucagccagccaacaaugucuacuuaugcaucucuuugcaagauaagauguacuugacuaguu

SEQ ID NO: 57772 - RNA, 63 nt, Homo Sapiens
guaccuuaagacaaaauaauagcaguuagaauucuuugcaaaugcaaggacaaagguaauagc

SEQ ID NO: 57773 - RNA, 63 nt, Homo Sapiens
gacaaagggaugaauuccuuguugauuaagagacuuugcaaacuuuuacucucuaacuguuga

SEQ ID NO: 57774 - RNA, 63 nt, Homo Sapiens
cacccucaaaagcugcaccaggccauccuuaugcuuugcaaaguggagugugcggccuaacaa

SEQ ID NO: 57775 - RNA, 63 nt, Homo Sapiens
cuaugaauauuucagggucaucuauucuugguucuuugcaauuucucuccaccuuguuuuucu

SEQ ID NO: 57776 - RNA, 63 nt, Homo Sapiens
auuuaaugaggauacacugugcuuaggaagaaacuuugcaaacagcuguaacuaguuguaagu

SEQ ID NO: 57777 - RNA, 63 nt, Homo Sapiens
uguaacuuuguagcuaucuuugaaaucacuugacuuugcaauggugcuaagcugauagauuua

SEQ ID NO: 57778 - RNA, 63 nt, Homo Sapiens
ugcacugugcccaugcugcccucccaucacccccuuugcaauauauuuuuauauuuuauuauu

SEQ ID NO: 57779 - RNA, 63 nt, Homo Sapiens
uuacggugcaauugcuucuguuugcuaaugcugcuuugcaaauaaaacuugcugccgaccacc

SEQ ID NO: 57780 - RNA, 63 nt, Homo Sapiens
cccccauuccccaaagcaaucaaaccgucaugacuuugcaauuuggcacauccuagcuuguua

SEQ ID NO: 57781 - RNA, 63 nt, Homo Sapiens
gucccauauuucaccuguucaguguauacuguacuuugcaaucaucuuuccuuuuuucacauu

SEQ ID NO: 57782 - RNA, 63 nt, Homo Sapiens
ugucaaacagguugguguggguucauuggcauucuuugcaauacugcuuaauugcugauacca

SEQ ID NO: 57783 - RNA, 63 nt, Homo Sapiens
auuuaguggauuaaccaguccagacgcacugaucuuugcaaaggagacuuaauuucaaaucug

SEQ ID NO: 57784 - RNA, 63 nt, Homo Sapiens
caaugcuauuugccuuaguucauucguuguuuacuuugcaaaauuugugacuuuuaaguacua

SEQ ID NO: 57785 - RNA, 63 nt, Homo Sapiens
uagagaaaaguuacuuuaaaaauagcuauaacgcuuugcaauuucaguaacaguucugccucu

SEQ ID NO: 57786 - RNA, 63 nt, Homo Sapiens
uugcaaaggcugugugugaaaugaguaaacaaucuuugcaaguccuaaguaaguuuuauguca

SEQ ID NO: 57787 - RNA, 63 nt, Homo Sapiens
cagacaucacccguguucaaguuuaaaaguacacuuugcaacuauuuuucagaaauagaaauu

SEQ ID NO: 57788 - RNA, 63 nt, Homo Sapiens
gagaugacaaagaaauccaaguaaaugccuugucuuugcaaauguuuuuauauuaaaucauaa

SEQ ID NO: 57789 - RNA, 63 nt, Homo Sapiens
aaugcauuuuuuacaaaugguugcuuuauugcacuuugcaaauauaugucaucuuauugcguu

SEQ ID NO: 57790 - RNA, 63 nt, Homo Sapiens
cugccuguuggcauauugaauuuugggagcugccuuugcaaacaaauguuuacagacaaauaa

SEQ ID NO: 57791 - RNA, 63 nt, Homo Sapiens
gagaauuuagaugagagaugacuggauauuaaacuuugcaaaauuuuacuuauguggcaaaga

SEQ ID NO: 57792 - RNA, 63 nt, Homo Sapiens
guuauuucauacagauguuucauuuuugucaaucuuugcaacaaaccgcauguucuaagugug

SEQ ID NO: 57793 - RNA, 63 nt, Homo Sapiens
aacuauguauauuguaaauaguaaaucugacuucuuugcaaguaaggcuuuuagaaaaugguu

SEQ ID NO: 57794 - RNA, 63 nt, Homo Sapiens
uuuguaccauaaccguuuaugcucaccugaaggcuuugcaaaaaauuuccaagauuauuugug

SEQ ID NO: 57795 - RNA, 51 nt, Homo Sapiens
gcauugauuaaugucugcaaucuuugcaagcggaaagagaaaucuucauaa

SEQ ID NO: 57796 - RNA, 63 nt, Homo Sapiens
gacuguaagcagauuacaauaacauaugucugucuuugcaaagaauuuauaucuuuaugcaaa

SEQ ID NO: 57797 - RNA, 63 nt, Homo Sapiens
ugagacuuucuaaaucaaacugacugagggcagcuuugcaaaacacauaaaaggcuucacuuu

SEQ ID NO: 57798 - RNA, 63 nt, Homo Sapiens
aguaauuaacacuaguaacauuuggguaaaacucuuugcaagcgaaucauuaaauacaccugc

SEQ ID NO: 57799 - RNA, 63 nt, Homo Sapiens
uaauaguuuuugcuuucuguuuugcuguuguugcuuugcaaagcuuuccccucauagccugua

SEQ ID NO: 57800 - RNA, 63 nt, Homo Sapiens
gugacuuaaguuuuugcuguuuucguuuucccgcuuugcaauuuccuccuuuugccaaaaaug

SEQ ID NO: 57801 - RNA, 63 nt, Homo Sapiens
cuacaguuuugugaaucuuugugcuucaacauucuuugcaagaugauacgguauuuaggcauu

SEQ ID NO: 57802 - RNA, 63 nt, Homo Sapiens
acagucccuuacuggaauucuaacuguaauuugcuuugcaaucaaacugcuuuuagggcagcc

SEQ ID NO: 57803 - RNA, 63 nt, Homo Sapiens
ggaagcucccccccccccaacagugugucgagucuuugcaaagaaaccuuuagaugugguuca

SEQ ID NO: 57804 - RNA, 63 nt, Homo Sapiens
aacaagcuaugggaauuuggcuucauacucuuucuuugcaacagcaguguucugggugauaau

SEQ ID NO: 57805 - RNA, 63 nt, Homo Sapiens
uaucacacauaggcccacacacagacucaccaacuuugcaauagaaauacuggugccugcaga

SEQ ID NO: 57806 - RNA, 63 nt, Homo Sapiens
auagugccauuuagagaugaaaaccagcuuuaacuuugcaaagugaacauguacauggucugc

SEQ ID NO: 57807 - RNA, 63 nt, Homo Sapiens
agucagaauuacuaaucauaaaaaaauauguugcuuugcaacgggggcucacaacaguaucuc

SEQ ID NO: 57808 - RNA, 63 nt, Homo Sapiens
acuaaggcguauuauaggaacuaucuaucuaugcuuugcaaagaaauaacuaguucaaaccaa

SEQ ID NO: 57809 - RNA, 63 nt, Homo Sapiens
uguauguuacaauagauagucacuguugugcuccuuugcaaaauuuuaaggcuaacuucuuuu

SEQ ID NO: 57810 - RNA, 63 nt, Homo Sapiens
ggacugucuuuuacuuuaugcugaagugguuaacuuugcaacuauguucuuuccaaguuaaua

SEQ ID NO: 57811 - RNA, 63 nt, Homo Sapiens
gucccuuuauauuuaaauuuaguugucuugcggcuuugcaaguaauuuggguuuuuguacuga

SEQ ID NO: 57812 - RNA, 63 nt, Homo Sapiens
caaauaaagauaacccuuauguucauauuuauacuuugcaaucaacuuguauuuccaaaccug

SEQ ID NO: 57813 - RNA, 63 nt, Homo Sapiens
cgagaagaguggcaugcuuccucacucuucugucuuugcaaacuaaacacggcgaggucaccu

SEQ ID NO: 57814 - RNA, 63 nt, Homo Sapiens
acauuaugcuuuugcacacacacaaaugcaaaccuuugcaaacuacaugucuacacaugacua

SEQ ID NO: 57815 - RNA, 63 nt, Homo Sapiens
ggaaucuccucacugaaaauuacaguaugguaacuuugcaaauggugguuguuucuuccaaga

SEQ ID NO: 57816 - RNA, 63 nt, Homo Sapiens
gguuuugugcaacuucugagccucaguuuucuccuuugcaaauuaauaauuacauaccuuuau

SEQ ID NO: 57817 - RNA, 63 nt, Homo Sapiens
ugagugccaagaaccaacuugguaagguugaggcuuugcaaguuaacugcugggguuauagga

SEQ ID NO: 57818 - RNA, 63 nt, Homo Sapiens
uugugaagugguauaagaaaugacuuugaaccacuuugcaauuguagauucccaacaauaaaa

SEQ ID NO: 57819 - RNA, 63 nt, Homo Sapiens
auauuuugaauugcaacauuaugcuaaguauaacuuugcaagucaugauauugccuaacugcu

SEQ ID NO: 57820 - RNA, 63 nt, Homo Sapiens
gggguggucucugauagguagcauuuuccagcacuuugcaaggaauguuuuguagcucuaggg

SEQ ID NO: 57821 - RNA, 63 nt, Homo Sapiens
uucaaagucuguauuuuuaaagcauggcuuuggcuuugcaaaauaaaaaauguguuuuguaca

SEQ ID NO: 57822 - RNA, 63 nt, Homo Sapiens
uuuauauuaaagcauugguaugagcccuuccuccuuugcaaaaaugcagggcguauauuuugu

SEQ ID NO: 57823 - RNA, 63 nt, Homo Sapiens
ccgaggaaucaagccagauguggggaaagggggcuuugcaaaguagguagacugcugcucuaa

SEQ ID NO: 57824 - RNA, 63 nt, Homo Sapiens
aggggcuaucaaauuaccuauaauuguuaaucacuuugcaaauagcagauagaaguuauugua

SEQ ID NO: 57825 - RNA, 63 nt, Homo Sapiens
uuuaccgacagccgucuuuuuguacuauguccacuuugcaauaaaggaucagccaugugccuc

SEQ ID NO: 57826 - RNA, 63 nt, Homo Sapiens
uuuuuuuuaggaugagccucaauugagaaaagacuuugcaauuacuugaggcuuuuuuguuuu

SEQ ID NO: 57827 - RNA, 63 nt, Homo Sapiens
caugaagcuuaggaggccugaaauucauuuuggcuuugcaaguauagaaugacauguaaugcu

SEQ ID NO: 57828 - RNA, 63 nt, Homo Sapiens
ucuacuuuaguauacucauuugaagucauuugccuuugcaaucuuuuuguagauucucggucu

SEQ ID NO: 57829 - RNA, 63 nt, Homo Sapiens
ucaaaacagaugcagugaacugaaugagcagcacuuugcaacuacaugguagcaucugugacu

SEQ ID NO: 57830 - RNA, 63 nt, Homo Sapiens
auaauaaauguuauuuaagaauggagaagacuucuuugcaacauaaaugugagaacuguucuc

SEQ ID NO: 57831 - RNA, 63 nt, Homo Sapiens
aacuguggagaaugggugguaguguuugcuggucuuugcaacaagaagcugcuagaguuaucc

SEQ ID NO: 57832 - RNA, 63 nt, Homo Sapiens
acguggcaaguaucugauuuguagcagcuuugacuuugcaauacuaucuaccauauuuuaagu

SEQ ID NO: 57833 - RNA, 63 nt, Homo Sapiens
gcacgaagcagcacgggugucaugaaauaaaagcuuugcaaaggguggauuccaugccgcaga

SEQ ID NO: 57834 - RNA, 63 nt, Homo Sapiens
cuaucuaaccagaauacauaauuugauucuuuucuuugcaaugccaucuuuguauuuuuuuaa

SEQ ID NO: 57835 - RNA, 63 nt, Homo Sapiens
ugucccgugggcuguguuucuuguuguuuuucucuuugcaaagacauagcuaggaaagcgaau

SEQ ID NO: 57836 - RNA, 63 nt, Homo Sapiens
ugcauuguugugccgagaacaccgagcacugaacuuugcaaagaccuucgucuuugagaagac

SEQ ID NO: 57837 - RNA, 63 nt, Homo Sapiens
aguguuuugugcuuacaucuuucggggggaagccuuugcaagaaaauugcauacaaggcuuug

SEQ ID NO: 57838 - RNA, 63 nt, Homo Sapiens
gggcgccuugcagccuccauaauauacauuugacuuugcaaacgucuagacauguuuucugaa

SEQ ID NO: 57839 - RNA, 63 nt, Homo Sapiens
uagggaguguuuuuucccacgcuuuuccaguaacuuugcaaaagcauuaauuguucacuggca

SEQ ID NO: 57840 - RNA, 63 nt, Homo Sapiens
agcagugcuucccaaagugugcucugucaccugcuuugcaaucggcuuccauuagcgcauguu

SEQ ID NO: 57841 - RNA, 63 nt, Homo Sapiens
caccugggagcaucugagucugcuccuaaguggcuuugcaacugggccuaaguucuguuuccu

SEQ ID NO: 57842 - RNA, 63 nt, Homo Sapiens
guuuuaaugacacagaaaacuuugcugcaucaccuuugcaacuuugccaaagcucagaguuca

SEQ ID NO: 57843 - RNA, 63 nt, Homo Sapiens
gucugugcauuuauuucuuaggggagcccggagcuuugcaagcugggggcuuccgcagcuuca

SEQ ID NO: 57844 - RNA, 63 nt, Homo Sapiens
gucuuucucucaaugaagagucuucagcagcaucuuugcaaauucacaggcccaaaggacucu

SEQ ID NO: 57845 - RNA, 63 nt, Homo Sapiens
uauguggcagccaugagggccaggugucucccacuuugcaaccuaucagcccaguggaaagca

SEQ ID NO: 57846 - RNA, 63 nt, Homo Sapiens
acuagauugugaaaagcuaauuuauccauaugccuuugcaauauuugacuuuguccauuaaca

SEQ ID NO: 57847 - RNA, 63 nt, Homo Sapiens
guucaccuauaauccuauuuaacauucugcagucuuugcaauagcaguuuuaaggauuugggc

SEQ ID NO: 57848 - RNA, 63 nt, Homo Sapiens
uuacagaugcaccccaacauccccugaccucaccuuugcaaaggcccacuugaggcuggcacu

SEQ ID NO: 57849 - RNA, 63 nt, Homo Sapiens
ccacuaguuggcauccuuuugaacuuuugucuccuuugcaaacagugguccuaaaauacgagg

SEQ ID NO: 57850 - RNA, 63 nt, Homo Sapiens
uugguuucaaaucccaguuaugacaucuguuaacuuugcaaacucacaaaaauuauuugaaau

SEQ ID NO: 57851 - RNA, 63 nt, Homo Sapiens
aaaaagucauugggaaacuuaaagucuauucuacuuugcaagaggagaaauguguuuuaugaa

SEQ ID NO: 57852 - RNA, 63 nt, Homo Sapiens
uaauaaacugcaaaugugcaguucaguuugucucuuugcaacuccuguaauacggucuggugu

SEQ ID NO: 57853 - RNA, 63 nt, Homo Sapiens
aagcaaagucacugucuucaguaccuaaaaggacuuugcaacccuaaugaccaaagacccagg

SEQ ID NO: 57854 - RNA, 63 nt, Homo Sapiens
uauuuuauauauauugacaauuuuuguguauaucuuugcaaucugaggaguguaaugcuuauu

SEQ ID NO: 57855 - RNA, 63 nt, Homo Sapiens
cuuacaagagagcacaaguuuauuuaauuaccacuuugcaagccuugugaguuauagucugcu

SEQ ID NO: 57856 - RNA, 63 nt, Homo Sapiens
aaugacucuuccugagccugucacuugccggcccuuugcaauggggacagagguggcccuggu

SEQ ID NO: 57857 - RNA, 63 nt, Homo Sapiens
uuuuaauauauuaaaacaagguagcucaaagggcuuugcaaaaacaguggguagacuaaggca

SEQ ID NO: 57858 - RNA, 63 nt, Homo Sapiens
ccgaggaggguggaucacuuuguaaucccagcacuuugcaaggcagucgugguggcucaugcc

SEQ ID NO: 57859 - RNA, 63 nt, Homo Sapiens
uuggauuaaauuccaccuauauaaacacaaagccuuugcaaaaguuuccaucuuaagauuuuu

SEQ ID NO: 57860 - RNA, 63 nt, Homo Sapiens
agaaguggucuccagcaaccuaggaacugcuggcuuugcaaauaacaaacaaaaauaggagua

SEQ ID NO: 57861 - RNA, 63 nt, Homo Sapiens
acuuacucccuucuggauauuuuugccacauuucuuugcaaaaggagauauauauaucuuuag

SEQ ID NO: 57862 - RNA, 63 nt, Homo Sapiens
cacugcuugugggaauguaaaguacuguagccacuuugcaaaacaguuugacagcuccucaaa

SEQ ID NO: 57863 - RNA, 63 nt, Homo Sapiens
ugaugacgaguugucuugaauaaaucauguguucuuugcaaugggcauuggugcugugaugag

SEQ ID NO: 57864 - RNA, 63 nt, Homo Sapiens
gggcccaagacugggugagagucuuggcagagccuuugcaacaccuuaaguggacaggacugg

SEQ ID NO: 57865 - RNA, 63 nt, Homo Sapiens
gugaaagcgagacauuauauuagccauaguauucuuugcaaaugcgcaguaggggaugagggu

SEQ ID NO: 57866 - RNA, 63 nt, Homo Sapiens
auuaaaaaauuuuuuuugcuuugcuguacaguccuuugcaaauuaauucaaccacaugguugu

SEQ ID NO: 57867 - RNA, 63 nt, Homo Sapiens
ucauuuuucauuugugggguuucaccacaguaacuuugcaacauuuuagugauauuuuucaac

SEQ ID NO: 57868 - RNA, 63 nt, Homo Sapiens
cuuuacaaaagaaaaaaggcucuggaacugacccuuugcaagucagaacacagggcucgagcc

SEQ ID NO: 57869 - RNA, 63 nt, Homo Sapiens
ggguggaaguuuuuuucuucucacugccuuaaucuuugcaacacaguguuuuucagauuccuu

SEQ ID NO: 57870 - RNA, 63 nt, Homo Sapiens
agggagauacuauagaaaggagaacacugccuacuuugcaagccagugaccugccuuuugagg

SEQ ID NO: 57871 - RNA, 63 nt, Homo Sapiens
uuuugaaggcagaaagcaaaauuauguuugccacuuugcaaaggagcucacuguggugucugu

SEQ ID NO: 57872 - RNA, 63 nt, Homo Sapiens
aacuuuauuaucaacagaaauuuuagcucuuuucuuugcaagauauaucacagcugcuuuggg

SEQ ID NO: 57873 - RNA, 63 nt, Homo Sapiens
cagucauguaauauacagaacuauaagcagagacuuugcaaaacuaaauaaagggcugcaugc

SEQ ID NO: 57874 - RNA, 63 nt, Homo Sapiens
uugcaaaugauaagcauuuuugugagugaccaccuuugcaauauguuuguuaauuuacuucau

SEQ ID NO: 57875 - RNA, 63 nt, Homo Sapiens
gaaggaaaugaaguccugaaauaaagugaugggcuuugcaaauccaggguagaggcccuaaca

SEQ ID NO: 57876 - RNA, 63 nt, Homo Sapiens
acaacaagcaaggagguagacaauauugucuaccuuugcaaaugaggaaacagaggcuuagag

SEQ ID NO: 57877 - RNA, 63 nt, Homo Sapiens
uacaaagccagugccaaaacccagccaugggcucuuugcaaccucccagcugcgcucauucca

SEQ ID NO: 57878 - RNA, 63 nt, Homo Sapiens
accaagauucgccaaucucauacaagccauuuacuuugcaagugagauagcuuccccaccagc

SEQ ID NO: 57879 - RNA, 63 nt, Homo Sapiens
uggggguugaauaggaguuaaccccugcgcucucuuugcaacugucucucuucucagaguggu

SEQ ID NO: 57880 - RNA, 63 nt, Homo Sapiens
gcucaagccacugcuguugcauuacacccaucccuuugcaaaaucccuauggagccugucacc

SEQ ID NO: 57881 - RNA, 63 nt, Homo Sapiens
cacaaaaagucuacauuuauuuaauaugauggucuuugcaaaaaggaacaaaacaacacaaaa

SEQ ID NO: 57882 - RNA, 63 nt, Homo Sapiens
ggcagacacagcugucugguucaggccaagccccuuugcaaugcaagcccuuucugguguuau

SEQ ID NO: 57883 - RNA, 63 nt, Homo Sapiens
ucaugaacacacccgagaaaucuuaaauagacacuuugcaauauuuaagaaccuaaugcuguu

SEQ ID NO: 57884 - RNA, 63 nt, Homo Sapiens
ggaaaagucuguuuuguguuuuuaaagccacuccuuugcaacaguaaagggugugauuuuacu

SEQ ID NO: 57885 - RNA, 63 nt, Homo Sapiens
uuuuuacacuuuaaauuaguugaguuaucuucccuuugcaaaaagagcugaaaauguagaaau

SEQ ID NO: 57886 - RNA, 63 nt, Homo Sapiens
ucccagcaacaauaaugauuaacucuccccuuucuuugcaacucuguuacacuaauuugaaua

SEQ ID NO: 57887 - RNA, 63 nt, Homo Sapiens
gccuugauuaaaccagaaaagucaaagauagcucuuugcaaguacguagggacuucaugucau

SEQ ID NO: 57888 - RNA, 63 nt, Homo Sapiens
gucuuggaggaguauaggaccaucuaaguggugcuuugcaaauuggacuauggcccagucccc

SEQ ID NO: 57889 - RNA, 63 nt, Homo Sapiens
aaaggaaaaacacaaauugcucuggagcuccaccuuugcaaagcccgccuaggacaggagcug

SEQ ID NO: 57890 - RNA, 63 nt, Homo Sapiens
gccgugcaagaugaaugcagaaacacccacucacuuugcaauaaguauuguguuuugcuuugg

SEQ ID NO: 57891 - RNA, 63 nt, Homo Sapiens
ucugaaaguucuggcuuguagaccccuccccuccuuugcaaagguaugggauagaggggucag

SEQ ID NO: 57892 - RNA, 63 nt, Homo Sapiens
guccgggaggcaccguccggcggcgagcucuggcuuugcaagggccccuccuucugggggcuu

SEQ ID NO: 57893 - RNA, 63 nt, Homo Sapiens
ugaaguaaauguaugguagaaauuaagacguuucuuugcaaaacaaggaaaucacacauaugc

SEQ ID NO: 57894 - RNA, 63 nt, Homo Sapiens
gguuacaauuagaacuccugaccccagauucaacuuugcaaacaacaggggaaaaaaaugggg

SEQ ID NO: 57895 - RNA, 63 nt, Homo Sapiens
guuuaauggccaccuguucucuccugugaaaggcuuugcaaagucacauuaaguuugcaugac

SEQ ID NO: 57896 - RNA, 63 nt, Homo Sapiens
uucuggcuaacguuaaaugcugcuauacaacugcuuugcaacaguugcugguauauuuaaauc

SEQ ID NO: 57897 - RNA, 63 nt, Homo Sapiens
gggaccaggaugauacagucaucugagguuaugcuuugcaaaaggcugacgguauggaauaug

SEQ ID NO: 57898 - RNA, 63 nt, Homo Sapiens
gcacccuuaauucaggcacuguccauuagcuuccuuugcaaaggcuacuuauggccggucaca

SEQ ID NO: 57899 - RNA, 63 nt, Homo Sapiens
uuauuguucugcucauuguguuugugacaaacucuuugcaauauggcuuaauuuucuuugugu

SEQ ID NO: 57900 - RNA, 63 nt, Homo Sapiens
aacaaacguuuuuccaaagaauucacagugcuccuuugcaauuuauagauuucauguugaaau

SEQ ID NO: 57901 - RNA, 63 nt, Homo Sapiens
ggacuaaauuuugucaauuucauguaauuuacccuuugcaauaaaaaugauucauuaaauaua

SEQ ID NO: 57902 - RNA, 63 nt, Homo Sapiens
uauguguguuauucguuugucugguuuuacuaccuuugcaaaaacaaaauaccccaaagauau

SEQ ID NO: 57903 - RNA, 63 nt, Homo Sapiens
gacuuccuucaacaaauauuuauuaaauauccacuuugcaacagcacugaaauggcuguaagg

SEQ ID NO: 57904 - RNA, 63 nt, Homo Sapiens
auaauugugggucaggaauccuacaaaauacuccuuugcaauguugggcuccagaggacuuac

SEQ ID NO: 57905 - RNA, 63 nt, Homo Sapiens
gcugccgagcuuucgugcacaaacacugcugaccuuugcaaagcccaguucccccgccccagg

SEQ ID NO: 57906 - RNA, 63 nt, Homo Sapiens
ggauuucuccuggggaauuugggugugacuuuccuuugcaaauugggugaggucuacaaaauu

SEQ ID NO: 57907 - RNA, 63 nt, Homo Sapiens
aucaaccuggcaaaaaugcagaagagugcccugcuuugcaaacugguuuuggggaaaugugga

SEQ ID NO: 57908 - RNA, 63 nt, Homo Sapiens
ucauauuuuugugggaauggagcaagauuuccucuuugcaaaaccacacauacccucuaagcc

SEQ ID NO: 57909 - RNA, 63 nt, Homo Sapiens
augauuggugcuuauuuuuuagauaaaauuguucuuugcaagauaacucuuuucaauccuuuu

SEQ ID NO: 57910 - RNA, 63 nt, Homo Sapiens
acauuuauuuauuaauucaugcuucagcaacugcuuugcaaugcuuguaacucauaccugucu

SEQ ID NO: 57911 - RNA, 63 nt, Homo Sapiens
ucuguaauuucacucaacgauuacauuuuuuuccuuugcaaauagaaguacugugcucaaauu

SEQ ID NO: 57912 - RNA, 63 nt, Homo Sapiens
uguaguuaagauauacuuuacauugcuucauuucuuugcaaaagcccugacugguugugcaac

SEQ ID NO: 57913 - RNA, 63 nt, Homo Sapiens
uuccugugaaaacaucaguucucuucauaacugcuuugcaaguaauaauuaagaacgcucuuc

SEQ ID NO: 57914 - RNA, 63 nt, Homo Sapiens
ccccuccacaaaagcaaaucuugaauuguuuuucuuugcaaaaguauaagcuguaacagaauu

SEQ ID NO: 57915 - RNA, 63 nt, Homo Sapiens
cuucaggaaacagaguugugucauguugaagugcuuugcaagguugucgguuuguuuuuucau

SEQ ID NO: 57916 - RNA, 63 nt, Homo Sapiens
ccagccucccagugcucauuuacauucaccaggcuuugcaaacacuccccaaucuggaugcau

SEQ ID NO: 57917 - RNA, 63 nt, Homo Sapiens
uuagaaaccuugacucugauggaauuauuuagucuuugcaauacuuuccaucccaccccccuu

SEQ ID NO: 57918 - RNA, 63 nt, Homo Sapiens
auagcuuaaagagcagaguagaaacggaagaggcuuugcaaaaggcuagauaacuaacaacac

SEQ ID NO: 57919 - RNA, 63 nt, Homo Sapiens
uuugcccucccauucccaucuaucccccaaguccuuugcaauuucuucccugcccuacauagg

SEQ ID NO: 57920 - RNA, 63 nt, Homo Sapiens
ugauguaaaaaauacaaacauucuaauuaaaggcuuugcaacacaugccuugucuguuuuuau

SEQ ID NO: 57921 - RNA, 63 nt, Homo Sapiens
uugugacuggggaggggcuccguauaaucucaccuuugcaagcguuuauuuacugauguaugc

SEQ ID NO: 57922 - RNA, 63 nt, Homo Sapiens
uaguuacuugugcuuuuuuuuuuuuuuuuggaucuuugcaagggcaaaacuacaaguaacgag

SEQ ID NO: 57923 - RNA, 63 nt, Homo Sapiens
cuacccauuuacaaauaagaggacagauaacugcuuugcaaauucaagagccuccccuggguu

SEQ ID NO: 57924 - RNA, 63 nt, Homo Sapiens
ccuuuccucaauagcuuccuuugcuccaauaagcuuugcaaucaaggccaaagaaaaugaucu

SEQ ID NO: 57925 - RNA, 63 nt, Homo Sapiens
auaacagacaaaaauacacacacguguguuuuucuuugcaauacuugaaauauugccacugug

SEQ ID NO: 57926 - RNA, 63 nt, Homo Sapiens
agccacccuaggccccagcugcuugccccucagcuuugcaaagugaccugccuggcuuccuua

SEQ ID NO: 57927 - RNA, 63 nt, Homo Sapiens
uugccaccaguagauaccggucuuccagaagaccuuugcaaguauagaacauaauuuuaugag

SEQ ID NO: 57928 - RNA, 63 nt, Homo Sapiens
ccugcauccccagcacugguauuccaugcuugccuuugcaauagacaggcaugaggagugccu

SEQ ID NO: 57929 - RNA, 63 nt, Homo Sapiens
auccccguacuccugccccugcggacaggcgggcuuugcaaugguccacgagguggggugcag

SEQ ID NO: 57930 - RNA, 63 nt, Homo Sapiens
cagugguacagacauggaguuuccuucuucauucuuugcaaaagguucuaggagccagauuca

SEQ ID NO: 57931 - RNA, 63 nt, Homo Sapiens
aaacagcuucuccacacauggagaucauaacuucuuugcaagaaaugauggcaugacaaucca

SEQ ID NO: 57932 - RNA, 63 nt, Homo Sapiens
uauacuugaguucacuccuguugacaaguagcccuuugcaauuuaggauagauauuugucauc

SEQ ID NO: 57933 - RNA, 63 nt, Homo Sapiens
ggcuggggcccucggcguggggcagcguggcagcuuugcaaggcugcaugcgccaccauuuuu

SEQ ID NO: 57934 - RNA, 63 nt, Homo Sapiens
gcuuuugacuaaucgucuguaccuaucaaagggcuuugcaagacucccuacucuccaccgaua

SEQ ID NO: 57935 - RNA, 63 nt, Homo Sapiens
gggccgccuccccgcguagccggagaaacugcacuuugcaaugcugacccaccgccaccuccg

SEQ ID NO: 57936 - RNA, 63 nt, Homo Sapiens
auuuucauuuguuuguuuucuagcaucuuguggcuuugcaaccauaacagacuaggccagaca

SEQ ID NO: 57937 - RNA, 63 nt, Homo Sapiens
acuuuugccacauuguauacuuauaaugggaaacuuugcaaggacauuuuugggaagcaaugc

SEQ ID NO: 57938 - RNA, 63 nt, Homo Sapiens
auagguuccagugauagaguuauaauuuugcuccuuugcaaacaaaugguaucuaauuaauaa

SEQ ID NO: 57939 - RNA, 63 nt, Homo Sapiens
auaucuaaaguuauauuucagauguaauguuuucuuugcaaaguauuguaaauuauauuugug

SEQ ID NO: 57940 - RNA, 63 nt, Homo Sapiens
uugauugcaugugguuaauguugcauuagagcacuuugcaauugcauaauucauuaauguuuu

SEQ ID NO: 57941 - RNA, 63 nt, Homo Sapiens
gaacuagaagguagguuuaagccaucaccaggccuuugcaaauggccuaaaugguguucccuu

SEQ ID NO: 57942 - RNA, 63 nt, Homo Sapiens
cagagacccgccuuaagagacuggaucgcacaccuuugcaacagauguguucugauucucuga

SEQ ID NO: 57943 - RNA, 63 nt, Homo Sapiens
aaagguucuguauaaaaccacugcuuucaaguucuuugcaauucacugccacccccagcgugg

SEQ ID NO: 57944 - RNA, 63 nt, Homo Sapiens
uggcugaggagaaagcacaccuggaggcaguugcuuugcaagaagagcuggggcacaagggga

SEQ ID NO: 57945 - RNA, 63 nt, Homo Sapiens
uuuuuauuguuaauguagcagaguauuacuucccuuugcaaugcaaaaugaugauauucucuu

SEQ ID NO: 57946 - RNA, 63 nt, Homo Sapiens
uauuuuaauuacaaacacuucuccaacaaagaccuuugcaauaauagcuuagauauaaaaggu

SEQ ID NO: 57947 - RNA, 63 nt, Homo Sapiens
gcgauggcagccacuagauacacucaggcagcccuuugcaauccauuaccugcaaagaaaggg

SEQ ID NO: 57948 - RNA, 63 nt, Homo Sapiens
ccuuuauugagcuccuccacagagcuucuaguucuuugcaaucucaugugccaaagccagggc

SEQ ID NO: 57949 - RNA, 63 nt, Homo Sapiens
uauauauuuauauaacuuugauuauuuuaaaagcuuugcaacccuuucacugacauuuuaauc

SEQ ID NO: 57950 - RNA, 63 nt, Homo Sapiens
gcugaagucccuugugaacccugcaauaaacugcuuugcaaauucaucuggaagugucugugu

SEQ ID NO: 57951 - RNA, 63 nt, Homo Sapiens
gcugaagugccuugugaacccugcaauaaacugcuuugcaaauucaucugaaagugucugugu

SEQ ID NO: 57952 - RNA, 63 nt, Homo Sapiens
aacagaaccagaguaacuccucgccuguugcugcuuugcaaugaauuuccuuuaccuuucugg

SEQ ID NO: 57953 - RNA, 63 nt, Homo Sapiens
auccaaguuucugccucuuuuaaauguacuugacuuugcaaggcaaguaguuuuacagccauu

SEQ ID NO: 57954 - RNA, 63 nt, Homo Sapiens
cacaacguccccucaagccccuucucucaaucccuuugcaacgcucacugguuuuggccaccc

SEQ ID NO: 57955 - RNA, 63 nt, Homo Sapiens
ccaugagucccccacacccaccccauccucggucuuugcaaagaagggcccgagcuuaguuuc

SEQ ID NO: 57956 - RNA, 63 nt, Homo Sapiens
auucagucugcuuuuggauuuucauauauuuaacuuugcaaaaagauuuacuuuguacauguu

SEQ ID NO: 57957 - RNA, 63 nt, Homo Sapiens
aauguacuuggaaauuaauguauguuuacaucucuuugcaaauuccuguacauagagauauau

SEQ ID NO: 57958 - RNA, 63 nt, Homo Sapiens
cucaagguucucggaaauuucucuaaguuuuaucuuugcaauaugccaugaccuuccgcacau

SEQ ID NO: 57959 - RNA, 63 nt, Homo Sapiens
caguguuuuucuuacuggaggucuccacugugccuuugcaaauauauuuaaugcauuaaaccu

SEQ ID NO: 57960 - RNA, 63 nt, Homo Sapiens
gcuguuugcuuuucaugucuauuuggagaugagcuuugcaaaggaagaauugagaauugauag

SEQ ID NO: 57961 - RNA, 63 nt, Homo Sapiens
auaaucauuguucucacccuggacuucucagaacuuugcaaacccaaaguuuggacaguagau

SEQ ID NO: 57962 - RNA, 63 nt, Homo Sapiens
aucagugauuuccacauucauaucaggauuuaucuuugcaaaaaaaauggaguuugcaauuaa

SEQ ID NO: 57963 - RNA, 63 nt, Homo Sapiens
acccgggagcuggcggggaacacuguguuacugcuuugcaaagaccucuuccacuccuucucu

SEQ ID NO: 57964 - RNA, 63 nt, Homo Sapiens
uuaaaaaaaaggggggagggccuugccacuuaccuuugcaaaguguucgaugcacucuuuccu

SEQ ID NO: 57965 - RNA, 63 nt, Homo Sapiens
aaagcuaaaauuucuguucuugaaacacuucagcuuugcaacuaaaauauuacagauuaauaa

SEQ ID NO: 57966 - RNA, 63 nt, Homo Sapiens
guaaagggagacuuuuuuaaauaacaguugagucuuugcaaguaaaaagauuuagagauuauu

SEQ ID NO: 57967 - RNA, 63 nt, Homo Sapiens
caaugcucagaauugaaaauuacuacuuaaaaucuuugcaaauugaauaauuacagaaaaggg

SEQ ID NO: 57968 - RNA, 63 nt, Homo Sapiens
acuugcugggacagugugggugggagaccagggcuuugcaauucguggcauccuuuaggauaa

SEQ ID NO: 57969 - RNA, 63 nt, Homo Sapiens
cuuuggcccuuguguaacauugcaaaccuguggcuuugcaaaauguacccaggucacaagggg

SEQ ID NO: 57970 - RNA, 63 nt, Homo Sapiens
uuuuuuuauggugcuuaaaguaaagagcccauccuuugcaagucauccauguuguuacuuagg

SEQ ID NO: 57971 - RNA, 63 nt, Homo Sapiens
acaguguguccaguuaccacuaaacaacuuucacuuugcaaaguguuaaaucguaacaagcaa

SEQ ID NO: 57972 - RNA, 63 nt, Homo Sapiens
ccucacaggauuccugugggacacuaucaaugucuuugcaaaugaaagaugcuccaagaacca

SEQ ID NO: 57973 - RNA, 63 nt, Homo Sapiens
gagaugggcccaaggaauucggcguccugagcacuuugcaagacagcucagcaccagcacccg

SEQ ID NO: 57974 - RNA, 63 nt, Homo Sapiens
aagauaaucuauuuacuguaaaaauaaauuggacuuugcaaaagcuuuuagaaggaaaagaaa

SEQ ID NO: 57975 - RNA, 63 nt, Homo Sapiens
guccccucuguaguugguuuccuuccugugucccuuugcaagcuuccaggcgaucuaaggugu

SEQ ID NO: 57976 - RNA, 63 nt, Homo Sapiens
cuguguaaaugcuccagcacucaauaaagugggcuuugcaagcuaccuccuucccugccuccu

SEQ ID NO: 57977 - RNA, 63 nt, Homo Sapiens
ccacuuccuugcuucucaagcugacaauucucacuuugcaauaaauaguccaguguuuccuuc

SEQ ID NO: 57978 - RNA, 63 nt, Homo Sapiens
ccucccacgccguggaagcuuuguucuuucgcucuuugcaauaaaucuugcuacugcccacuc

SEQ ID NO: 57979 - RNA, 63 nt, Homo Sapiens
ggaauaaagcccccuaguugccuuuggccccaccuuugcaaaguuccagagggcugacccucu

SEQ ID NO: 57980 - RNA, 63 nt, Homo Sapiens
uuuaguggcucuuuagagagaaacucuuucucccuuugcaaaaaugggcuagaaugaaaagga

SEQ ID NO: 57981 - RNA, 63 nt, Homo Sapiens
guuuacguguccugguucacacccaggacuuuucuuugcaagcgaaccuguuugaagcccaag

SEQ ID NO: 57982 - RNA, 63 nt, Homo Sapiens
agacagacuguccccaagagcuugcugugcuggcuuugcaacauggaacuaaugcggaggcug

SEQ ID NO: 57983 - RNA, 63 nt, Homo Sapiens
gaccuacugacuacuggaucagccagucccugacuuugcaacacuucugcuguggagagaucu

SEQ ID NO: 57984 - RNA, 63 nt, Homo Sapiens
guguuaagugcauucuuuuguacaccagaauugcuuugcaaauucaauucuugaaaaugugga

SEQ ID NO: 57985 - RNA, 63 nt, Homo Sapiens
aguuugaauacugugaauuccaaacucaaauaucuuugcaaacgaugaaagucagaaggcugu

SEQ ID NO: 57986 - RNA, 63 nt, Homo Sapiens; identical to SEQ ID NO: 57984

SEQ ID NO: 57987 - RNA, 63 nt, Homo Sapiens
agaaugcaagcguuaacuuucgauauaaccuugcuuugcaaacuaagaaagcuuauuuauuag

SEQ ID NO: 57988 - RNA, 63 nt, Homo Sapiens
uccugcuccauauugguggagccugaaucugggcuuugcaagcaaguugaacuuucagucccu

SEQ ID NO: 57989 - RNA, 63 nt, Homo Sapiens
auacagcuugugaggaagugagccagcaguggccuuugcaauuguggaucuugagcucugcuc

SEQ ID NO: 57990 - RNA, 63 nt, Homo Sapiens
cagacucaguagcguuuuagucguuuuauguuucuuugcaacggccucagaaguuuggccgga

SEQ ID NO: 57991 - RNA, 63 nt, Homo Sapiens
cacacgguuagccgugcaugcacuuuguggccccuuugcaaggggcagaggguacuggaagug

SEQ ID NO: 57992 - RNA, 63 nt, Homo Sapiens
accacaguucuaccccugggauguuuugagggucuuugcaagaaucauuaauacaaagaauuu

SEQ ID NO: 57993 - RNA, 63 nt, Homo Sapiens
gcaaauauuauccagcaagcagucuacccuguccuuugcaauugcucuucuccacgucuuucc

SEQ ID NO: 57994 - RNA, 63 nt, Homo Sapiens
aaggaauuuagguuucugcaacugaucgaugaucuuugcaaucuuuuuuuuguuuucaauauc

SEQ ID NO: 57995 - RNA, 63 nt, Homo Sapiens
aaggaauuuagguuucugcaacugaucaaucaucuuugcaauuauauuuucauuuuaaauauc

SEQ ID NO: 57996 - RNA, 63 nt, Homo Sapiens
aaggaauuuagguuucugcaacugaucaauaaucuuugcaaucauauuuuuguuuucaauauc

SEQ ID NO: 57997 - RNA, 63 nt, Homo Sapiens
acucugugcacaccuuagaguuccuggccuucucuuugcaaggggagcugagaaucugguuuu

SEQ ID NO: 57998 - RNA, 63 nt, Homo Sapiens
uucuauaaaaucugccauaguuggauuaugcagcuuugcaaaaauuuuuacuagauuuugcac

SEQ ID NO: 57999 - RNA, 63 nt, Homo Sapiens
ugccauuuucuacagcuugcugaguugucauuccuuugcaacauuaaaauacaugcugaacuc

SEQ ID NO: 58000 - RNA, 63 nt, Homo Sapiens
uggcuuuaagaaucacugaaacuguauuaccugcuuugcaaggauucugcaggacaggaaaua

SEQ ID NO: 58001 - RNA, 63 nt, Homo Sapiens
aggaaagugaagcucaagggauuauaaauaacucuuugcaaaucaagacuccaucucaaaaaa

SEQ ID NO: 58002 - RNA, 63 nt, Homo Sapiens
ggggucuugggagcaggccucgugcaucugcuccuuugcaaguugggucuaugugugugugac

SEQ ID NO: 58003 - RNA, 63 nt, Homo Sapiens
auccuacuggucaaauaaccaaagaaaggcugccuuugcaaaaagagagagagagaaagaaag

SEQ ID NO: 58004 - RNA, 63 nt, Homo Sapiens
auugaagcccacgcucugagcuugaaacugagccuuugcaagcaaaugaaaaagccgauuuac

SEQ ID NO: 58005 - RNA, 63 nt, Homo Sapiens
acauucuacaaccugaugguuuccugggguggacuuugcaaacaguaaaucgaccuuuaagaa

SEQ ID NO: 58006 - RNA, 63 nt, Homo Sapiens
uauugaaggaauugcugccgggcccugaggagucuuugcaauguuccuagugagcagggcucu

SEQ ID NO: 58007 - RNA, 63 nt, Homo Sapiens
uauccugggagacccuaaaacaacuguaggugccuuugcaacccuuccagauuagaaaaauuu

SEQ ID NO: 58008 - RNA, 63 nt, Homo Sapiens
cuccccaaccaaguccaccgaggaguaugugggcuuugcaaccuccugucuacuaggaugaca

SEQ ID NO: 58009 - RNA, 63 nt, Homo Sapiens
cagacacacuuccucuugagggcccagggacaucuuugcaagcacacagcgggguccugucca

SEQ ID NO: 58010 - RNA, 63 nt, Homo Sapiens
aaaauuuaauaaauucauaaaaaagacucauaucuuugcaaacaaaagaagggcagauacugg

SEQ ID NO: 58011 - RNA, 63 nt, Homo Sapiens
uguggaauuuucuuuaugaaaaaugauuuuagccuuugcaaauguuaaccaugugaaacacau

SEQ ID NO: 58012 - RNA, 63 nt, Homo Sapiens
cccagcccagucuuucuccccggcauucacaaacuuugcaagcgugguccagggccuucucca

SEQ ID NO: 58013 - RNA, 63 nt, Homo Sapiens
uaguuguucuccuuguugcaauaauuaauaacucuuugcaaaaugucuccuuugagacagagg

SEQ ID NO: 58014 - RNA, 63 nt, Homo Sapiens
gacuaccuauagccugugaaaaauuguggccaucuuugcaaauacauuuaauucaaggaucaa

SEQ ID NO: 58015 - RNA, 63 nt, Homo Sapiens
uaauuuggaaauaagucaauaaaaaauaaucuccuuugcaaugaguuaauuucccguguugga

SEQ ID NO: 58016 - RNA, 63 nt, Homo Sapiens
gauggagacagguuagguggccaggucccaggacuuugcaagaauugauggaccagccucuuu

SEQ ID NO: 58017 - RNA, 63 nt, Homo Sapiens
agaugacauuucagaaaaucuacauaccaauggcuuugcaagaauuauuuaaauggaacuuau

SEQ ID NO: 58018 - RNA, 63 nt, Homo Sapiens
gagaucaucguucuaguggcgaccucacuagcccuuugcaaugacgaauugaggcagggaaua

SEQ ID NO: 58019 - RNA, 63 nt, Homo Sapiens
agcauuuauauuuucuuuuuuaugaaugguggucuuugcaaagauacaaauauuuacaauuuu

SEQ ID NO: 58020 - RNA, 63 nt, Homo Sapiens
ugauagaaaagaucugaccacaggucuuggcgccuuugcaaagcucuauaccaggccugagug

SEQ ID NO: 58021 - RNA, 63 nt, Homo Sapiens
aggaaccuguggacuaggggugcagggacuucccuuugcaagggguaacagaccgcuggaaaa

SEQ ID NO: 58022 - RNA, 63 nt, Homo Sapiens
agaaauguagaaaagcauuccauaauuucucuucuuugcaaauacaugaaaggaugcacagag

SEQ ID NO: 58023 - RNA, 63 nt, Homo Sapiens
gugaguuuccugcuauauuaacaucaucuuagacuuugcaagcagagagucguggaaucaaau

SEQ ID NO: 58024 - RNA, 63 nt, Homo Sapiens
guggguugcuugggggugggaugggaagaggcucuuugcaaacgaggguccccagagaagacu

SEQ ID NO: 58025 - RNA, 63 nt, Homo Sapiens
uaaaacaacugacguuacucaagaauuagaaaacuuugcaagauuugacuuguuuaaaaauca

SEQ ID NO: 58026 - RNA, 63 nt, Homo Sapiens
uguuaagguucaagacagauaauagccuguggccuuugcaauuggggcucccguggccuguag

SEQ ID NO: 58027 - RNA, 63 nt, Homo Sapiens
caacacucgaaccaaaagaucuggacaauguuucuuugcaaagcugaaggaagaaagcagcag

SEQ ID NO: 58028 - RNA, 63 nt, Homo Sapiens
caguacgacagccucagagcccccggcucagaucuuugcaaauggguaccaggcuucugccac

SEQ ID NO: 58029 - RNA, 63 nt, Homo Sapiens
ccauguuugcacgguggggggcucugggcacuucuuugcaaagcauuguaagaguuccacaga

SEQ ID NO: 58030 - RNA, 63 nt, Homo Sapiens
uaccuagucucagguaguucuuaaaccucuuuccuuugcaaaucauguggaacugugugugag

SEQ ID NO: 58031 - RNA, 63 nt, Homo Sapiens
auaaugaauguagcagagccuacuggagaaaaacuuugcaaguguaagacauacaauaauuua

SEQ ID NO: 58032 - RNA, 63 nt, Homo Sapiens
ugcugauuuuauacaugauucuuccaaccagaacuuugcaauggaaaaggcuacuauuuauaa

SEQ ID NO: 58033 - RNA, 63 nt, Homo Sapiens
cgguggggaagccgcugaauccaccugcuucuccuuugcaaccgacagcaaacagcuuucucc

SEQ ID NO: 58034 - RNA, 57 nt, Homo Sapiens
auuucauuacagauaggugaucuucagcuuugcaaacuggaugaacuagauugcuug

SEQ ID NO: 58035 - RNA, 63 nt, Homo Sapiens
aagucaacaugcauauuacauuuucauccuuugcuuugcaagcacugguggcuugcaguuugc

SEQ ID NO: 58036 - RNA, 63 nt, Homo Sapiens
acucuuugagucccaggagaagccuggcacccucuuugcaaauuggccuuugcucuuucaaug

SEQ ID NO: 58037 - RNA, 63 nt, Homo Sapiens
aggcagguuucgggccugaagcagaucagagggcuuugcaaaagacagcauagagccaucuuc

SEQ ID NO: 58038 - RNA, 63 nt, Homo Sapiens
uuuuugucaaaacaaaugcuguacuccaauuuucuuugcaaggccuuauucuugccucuauag

SEQ ID NO: 58039 - RNA, 63 nt, Homo Sapiens
ucucuuggagaauaaguggacuccaagcuaacucuuugcaaauguaaacacauguccaucuug

SEQ ID NO: 58040 - RNA, 63 nt, Homo Sapiens
aucuugaauguuguguauauauuuuaaaaagcacuuugcaaaauaguuuguacauuuauuucc

SEQ ID NO: 58041 - RNA, 63 nt, Homo Sapiens
agcagcaauuucccaauuuauugaaagugaucgcuuugcaaggaugucuaagcuaaucccguc

SEQ ID NO: 58042 - RNA, 63 nt, Homo Sapiens
caaguucagccugagaugcuggcuguacucagccuuugcaauuuuuguagauguagcuuagga

SEQ ID NO: 58043 - RNA, 63 nt, Homo Sapiens
ccuggucuacagauggaagcugcagguuggugacuuugcaaaugcacuuccuacagaugaacu

SEQ ID NO: 58044 - RNA, 63 nt, Homo Sapiens
uugacuguaugcagguuuauuauuaagugaaugcuuugcaaguuaaguuuguuucaacuaaaa

SEQ ID NO: 58045 - RNA, 63 nt, Homo Sapiens
auccggagccagcucccagggaugaaggggcagcuuugcaagggcagcuacuccugccccaga

SEQ ID NO: 58046 - RNA, 63 nt, Homo Sapiens
aguugaaaaaauaaaaaaaauguugcuaugcugcuuugcaaaagcaagugcuacaaucacgau

SEQ ID NO: 58047 - RNA, 63 nt, Homo Sapiens
accuuuuugaugauuaagguaggcaacagugcccuuugcaauuucaggugacuagagaauuuc

SEQ ID NO: 58048 - RNA, 63 nt, Homo Sapiens
uaguguugcaucugauuuucauguugugggaaucuuugcaagugaaagcaucacuucuuuuuu

SEQ ID NO: 58049 - RNA, 63 nt, Homo Sapiens
ccacugcacuccagccugagugacagagugagacuuugcaaccaaaaaauaaaauaauaauaa

SEQ ID NO: 58050 - RNA, 63 nt, Homo Sapiens
auuggcaaauagcaucaauuuguuauccgagaccuuugcaaaccaugauugcuaucuuauuuu

SEQ ID NO: 58051 - RNA, 63 nt, Homo Sapiens
gcacuugcuugcggaacucucggauucucgacucuuugcaacauaucaccuuucccagauucu

SEQ ID NO: 58052 - RNA, 63 nt, Homo Sapiens
caaaauucagaagggacucugcacaaaaucauucuuugcaacugaugcacugggaauuuauua

SEQ ID NO: 58053 - RNA, 61 nt, Homo Sapiens
uuaccaaaaggguccauuauuucauaagaguuacuuugcaaaaaaaaaaauguggguuuuu

SEQ ID NO: 58054 - RNA, 63 nt, Homo Sapiens
agcucaggaccuggagauguacggugugaacuacuuugcaauccggguguguugaaaccucuc

SEQ ID NO: 58055 - RNA, 63 nt, Homo Sapiens
aguuuuaaguuugauuuuuuuuauuucaaaaugcuuugcaauuaaaugaauuacuguucagaa

SEQ ID NO: 58056 - RNA, 63 nt, Homo Sapiens
ccucagaacagacaaaucaugaaugagcuggaacuuugcaagaauauucauauuauaaauguc

SEQ ID NO: 58057 - RNA, 63 nt, Homo Sapiens
auugugucugguuaauuucuguauucucugcaacuuugcaauguuuggcuugaagaaggagcu

SEQ ID NO: 58058 - RNA, 63 nt, Homo Sapiens
gguaggagaucuggggaggcccacccuguggcccuuugcaaugguaguguuguuuucucgugu

SEQ ID NO: 58059 - RNA, 63 nt, Homo Sapiens
ccugcugcaguccccagucuuccagaaugcccccuuugcaaggcaucuguucuugcaccacca

SEQ ID NO: 58060 - RNA, 63 nt, Homo Sapiens
ccaggagcggcauugcccccccuguucauauugcuuugcaauuucucuggcucaggggaaagu

SEQ ID NO: 58061 - RNA, 63 nt, Homo Sapiens
aggaggagaucugggcugggcagcagaaugucccuuugcaaugaaucacuggccccuugaaga

SEQ ID NO: 58062 - RNA, 63 nt, Homo Sapiens
ugggcacuuggcaucaggguuuaacuuuuucuucuuugcaaaggagccaagggagcaggguca

SEQ ID NO: 58063 - RNA, 63 nt, Homo Sapiens
gcaccccuugucuuaaaaucagcccgggcaguccuuugcaaagagugcggacccguggcuggc

SEQ ID NO: 58064 - RNA, 63 nt, Homo Sapiens
acaaauaaauauggaagucacgucauaaucuaccuuugcaaagccauacaugaacuuuuauuu

SEQ ID NO: 58065 - RNA, 55 nt, Homo Sapiens
uguucaaggaaacggucuagcccuucuuugcaaaacacaacugccuaguuuacca

SEQ ID NO: 58066 - RNA, 63 nt, Homo Sapiens
ugucugaacuuuauuuacucauuagucaagguucuuugcaaggcaggugauuaacuuaaauau

SEQ ID NO: 58067 - RNA, 63 nt, Homo Sapiens
uauguggaaucccccaaagucucugguuuaauucuuugcaauuauaauaaccuggcugugagg

SEQ ID NO: 58068 - RNA, 63 nt, Homo Sapiens
aaguguagacuaugacaaaaaauacacuaauaccuuugcaaucugaaugagaauuugaccauu

SEQ ID NO: 58069 - RNA, 63 nt, Homo Sapiens
uuaauauaauuuugaucacaauuuacaaaugaucuuugcaaauaguggucagacggcauuagu

SEQ ID NO: 58070 - RNA, 63 nt, Homo Sapiens
uuccccucuaucagucacugacaguuaauaaaccuuugcaaacguuccccaguuguuugcacc

SEQ ID NO: 58071 - RNA, 63 nt, Homo Sapiens
uuccccuguaucagucacugacaguuaauaaaccuuugcaaacguuccccaguuguuuguucc

SEQ ID NO: 58072 - RNA, 63 nt, Homo Sapiens
gguagccucccacugcaucccauccugaauauccuuugcaacuccccaagagugcuuauuuaa

SEQ ID NO: 58073 - RNA, 63 nt, Homo Sapiens
uuccccucuaucagucacugacaguuaacaaaccuuugcaaacauuccccaguuguuuguucc

SEQ ID NO: 58074 - RNA, 63 nt, Homo Sapiens
uuccccuguagcagucacugacaguuaauaaaccuuugcaaacguuccccaguuguuugcucg

SEQ ID NO: 58075 - RNA, 63 nt, Homo Sapiens
gggauguaaguuuguguaaauuaaugguuuauucuuugcaaauaaaacgcuuuccccgucugu

SEQ ID NO: 58076 - RNA, 63 nt, Homo Sapiens
uauugcugucugaaaaaguguuuuuacauauagcuuugcaaccuuguacuuuacaaucaugcc

SEQ ID NO: 58077 - RNA, 63 nt, Homo Sapiens
ucaguggccuaaauucucugccuuuuuaacuugcuuugcaagccuacucugaaaauaaguuau

SEQ ID NO: 58078 - RNA, 63 nt, Homo Sapiens
aguacagcaauuguaguaacugacacauccucucuuugcaagcugcugacugggcacacucau

SEQ ID NO: 58079 - RNA, 63 nt, Homo Sapiens
aaauuuguauuuuauauuguuuuaucuaucugucuuugcaagcagucuucagguuaaagauac

SEQ ID NO: 58080 - RNA, 63 nt, Homo Sapiens
gcuuaacccaugagcuccaugugccuuuuggaucuuugcaacacugaagauuuggaagaagcu

SEQ ID NO: 58081 - RNA, 63 nt, Homo Sapiens
uuguuuuuuguuauugauauuaaacaguguaaucuuugcaagcguauauugaagauuauucug

SEQ ID NO: 58082 - RNA, 63 nt, Homo Sapiens
aaguguccaacaaggaauucacaccucugccuccuuugcaacaacaacauuuacacaguuggu

SEQ ID NO: 58083 - RNA, 63 nt, Homo Sapiens
uacauuuuuucuaaccucagauaagugcagugucuuugcaaugccaacauaagggagaucuug

SEQ ID NO: 58084 - RNA, 63 nt, Homo Sapiens
uuucuuuucugauuuauuuaagugcugacuugucuuugcaauauaauaauacacauuucugug

SEQ ID NO: 58085 - RNA, 63 nt, Homo Sapiens
ccuuagaguacuuuuuuccuguuaguccauauacuuugcaacuaucaagaauacaccuaugaa

SEQ ID NO: 58086 - RNA, 63 nt, Homo Sapiens
guuccccaguuguuugcuccccaguuaauaaaccuuugcaaacuuccccucuaucagucacug

SEQ ID NO: 58087 - RNA, 63 nt, Homo Sapiens
guuccccaguuguuugcuccacaguuaauacaccuuugcaaacauuccccguaucagucacug

SEQ ID NO: 58088 - RNA, 63 nt, Homo Sapiens
guuccccaguuguuugcucgacaguaaauaaaccuuugcaaacuuccccuguagcagucacug

SEQ ID NO: 58089 - RNA, 63 nt, Homo Sapiens
guuccccaguuguuugcaucacaguuaauaaaccuuugcaaacuuccguuguaucagucacug

SEQ ID NO: 58090 - RNA, 63 nt, Homo Sapiens; identical to SEQ ID NO: 58087

SEQ ID NO: 58091 - RNA, 63 nt, Homo Sapiens
ucuaguagaagauuuccacacccaauaucuagucuuugcaaauuuaagaucaaugaaccuuuc

SEQ ID NO: 58092 - RNA, 63 nt, Homo Sapiens
auccacauaaaauucuguaauggacugaaauaucuuugcaaguggguguguaauuugaaguuu

SEQ ID NO: 58093 - RNA, 63 nt, Homo Sapiens
gacuauuugauuaacacauuaguauuuauuucucuuugcaaguugguaguggauuuugaauua

SEQ ID NO: 58094 - RNA, 63 nt, Homo Sapiens
uauuuuuccugccuuucaguugauugcucaccacuuugcaaagacguuuuuuaacucauguag

SEQ ID NO: 58095 - RNA, 63 nt, Homo Sapiens
auccaaauauuguuaagggaggugcugcuaauucuuugcaaaaauaauuaacacuuaagguug

SEQ ID NO: 58096 - RNA, 63 nt, Homo Sapiens
ugucauaaauucucuucuuugcuguaguucuaucuuugcaaugaucaucucuacaacuaagau

SEQ ID NO: 58097 - RNA, 63 nt, Homo Sapiens
uucguaauaauuuagugaugaauguaagccuaacuuugcaaaacauacaccagcaacaguaua

SEQ ID NO: 58098 - RNA, 63 nt, Homo Sapiens
ggcauuacucgccauugauuuaaggaaacucggcuuugcaacaacuuccuggggccaagaaac

SEQ ID NO: 58099 - RNA, 63 nt, Homo Sapiens
cucccagcgcuggccgccuggccacugagggcccuuugcaaaaaucacggguguagagauggc

SEQ ID NO: 58100 - RNA, 63 nt, Homo Sapiens
uuuuucugagaauccugugaaggaacgcugucucuuugcaaaguaaggaggacuaagggaaaa

SEQ ID NO: 58101 - RNA, 63 nt, Homo Sapiens
cauugaaauguuaaaauggcuuacacuugcagacuuugcaaaucuuaagacuaacaaauccuu

SEQ ID NO: 58102 - RNA, 63 nt, Homo Sapiens
caauccugcuuucucaaguacuauucuaacauugcgcuuuauaagggaugauauuucuaccac

SEQ ID NO: 58103 - RNA, 63 nt, Homo Sapiens
auaaagcccaggaacuucuagaauaacccagaugcgcuuuaauuuuuuuuaauauguuuugau

SEQ ID NO: 58104 - RNA, 63 nt, Homo Sapiens
gccuuaauauaucuauggcagacauuuaagaaugcgcuuuaucuagcucaugguaacuuugca

SEQ ID NO: 58105 - RNA, 63 nt, Homo Sapiens
uacgguaguuaggaugcucaguugcuaaacacugcgcuuuauuuucuuaaccaguuguggugu

SEQ ID NO: 58106 - RNA, 63 nt, Homo Sapiens
ucaugggauaaaaauaaucgauguauguuacgggcgcuuuaaccaucagcugccucucgaaug

SEQ ID NO: 58107 - RNA, 63 nt, Homo Sapiens
ucggagcgcaaugccaucuaagccgccggcgcugcgcuuuauuggguucaccuggguggcugg

SEQ ID NO: 58108 - RNA, 63 nt, Homo Sapiens
uuaauuaccaaaacucuccuagucucuguaccagcgcuuuaugcuguuucccuuaaugauaca

SEQ ID NO: 58109 - RNA, 63 nt, Homo Sapiens
uagaaguggcagaacacuggauuuguguguguggcgcuuuagggugcuggacuguauggcuga

SEQ ID NO: 58110 - RNA, 63 nt, Homo Sapiens
agauuagccugagaaauaaugaaaacacuuugagcgcuuuaagaucccuccccuugcacuugu

SEQ ID NO: 58111 - RNA, 63 nt, Homo Sapiens
aaagugacuguuuggcuuauaaacacauugaaugcgcuuuauugcccaugggauauguggugu

SEQ ID NO: 58112 - RNA, 63 nt, Homo Sapiens
ggaauaacaaguugucccuagcaaaaccgcugagcgcuuuauaauuuugugguguauuuuugu

SEQ ID NO: 58113 - RNA, 63 nt, Homo Sapiens
gaaaaugguuagacugaaaaacuuuuuaaauaagcgcuuuaauacucaguuuuauaaggugau

SEQ ID NO: 58114 - RNA, 63 nt, Homo Sapiens
cagacaucaguuccauggugaucacauggggaagcgcuuuauaguacauugucaugugacugg

SEQ ID NO: 58115 - RNA, 63 nt, Homo Sapiens
aagcauuguuuuaguccaggcaggcugcagaaugcgcuuuagacucucaccucacaggcacau

SEQ ID NO: 58116 - RNA, 63 nt, Homo Sapiens
auuaguuaaucuuuugcagggccacagacuugagcgcuuuauuucauugcaugagucaagucg

SEQ ID NO: 58117 - RNA, 63 nt, Homo Sapiens
aaauuuuuaaacuucuaagugaaaguagucugagcgcuuuauaaaauucauauuauugugugu

SEQ ID NO: 58118 - RNA, 63 nt, Homo Sapiens
ugugggagaagagaggagagcugccacuguucugcgcuuuaauuaccccagcacacacacucc

SEQ ID NO: 58119 - RNA, 63 nt, Homo Sapiens
uucaugaugacaacacugccucgcguuucaauagcgcuuuauacuuuuuuaaguguuuucuau

SEQ ID NO: 58120 - RNA, 63 nt, Homo Sapiens
cauauuucuuuaaaaugcaaagugguuuacaaugcgcuuuagauuuuugcuauuguaaauauu

SEQ ID NO: 58121 - RNA, 63 nt, Homo Sapiens
auuugagugauucaauaguugccaauugugagggcgcuuuagccuguagcuaucuucaccugc

SEQ ID NO: 58122 - RNA, 63 nt, Homo Sapiens
uugagcgcauggcaagucacuaaguccccggcggcgcuuuaguagggccgaggugggcuucag

SEQ ID NO: 58123 - RNA, 63 nt, Homo Sapiens
aaaagauugaacuuaaaugccccccucccaacagcgcuuuaaaagcgaccucucuugagguag

SEQ ID NO: 58124 - RNA, 63 nt, Homo Sapiens
uuuuuaauagacaaaucacauucuuuuucacaagcgcuuuauucuugccgccaucucuuaguu

SEQ ID NO: 58125 - RNA, 63 nt, Homo Sapiens
auauuauucacagaugcauuucuucaacacuaugcgcuuuaucaccuuggauuuaauuuaaag

SEQ ID NO: 58126 - RNA, 63 nt, Homo Sapiens
uccgugugcuuucaguuuuuauugaauauuaaggcgcuuuacuuccaauccaacuugaaguca

SEQ ID NO: 58127 - RNA, 63 nt, Homo Sapiens
cucugccucagaaagcucugcgcuuuccagaaagcgcuuuacccugcaggguuuugcuaaccu

SEQ ID NO: 58128 - RNA, 63 nt, Homo Sapiens
gcuucucuuuggcauauccaucacuuaaaggaggcgcuuuauaucuugagaaccuucacccuu

SEQ ID NO: 58129 - RNA, 63 nt, Homo Sapiens
uuucauucucccccucucucccuccugugucuugcgcuuuauguuuucuuccguuugauaauu

SEQ ID NO: 58130 - RNA, 63 nt, Homo Sapiens
cuccuagagaagccaugugauucccagagccaggcgcuuuacaccuaaaguaguuugacuuuc

SEQ ID NO: 58131 - RNA, 63 nt, Homo Sapiens
ugcuuguguguguagcuucuuguagcuuagaaagcgcuuuaugcccaugaugucauuucaggc

SEQ ID NO: 58132 - RNA, 64 nt, Homo Sapiens
gcaaucacaauacauuuguagcucccgaguguccuaaagggagugcacuucuuugaagcuggug

SEQ ID NO: 58133 - RNA, 64 nt, Homo Sapiens
auacuuuagcuugugaagaagauaaugaauuuuuuaaagggaacuuucuaugcaauguucagga

SEQ ID NO: 58134 - RNA, 64 nt, Homo Sapiens
auuaucaguaauuucauagcuaauugcaguuuauuaaagggaucugaauuucuauauuaguggu

SEQ ID NO: 58135 - RNA, 64 nt, Homo Sapiens
aaugacauguuuucuauuuuugaagaaaggucacuaaagggagaugguaaaccagguaauugaa

SEQ ID NO: 58136 - RNA, 64 nt, Homo Sapiens
guaguuuuguaaucaagauuuuauguaacauuuguaaagggaaaauuagcacuuuugugguucu

SEQ ID NO: 58137 - RNA, 64 nt, Homo Sapiens
uugaaguugucaauuccucuuauucuuaaauaucuaaagggaaaggaaaccaacuuuaauuuca

SEQ ID NO: 58138 - RNA, 64 nt, Homo Sapiens
gugaaccugugaaagucauuauuuacauuugcuuuaaagggacaguuuuaccguucaacuucaa

SEQ ID NO: 58139 - RNA, 64 nt, Homo Sapiens
aaaacacuguuaucauuuuugaguuuugggaaguuaaagggaaguacaggugauuaacuuggau

SEQ ID NO: 58140 - RNA, 64 nt, Homo Sapiens
uugagcugcuuuuuuugaaaucuaguaauauauuuaaagggaaaauauacaacaccaaaaaaua

SEQ ID NO: 58141 - RNA, 63 nt, Homo Sapiens
aagggggaaagucucuuacuuuuccuugaauguacauaggaacuagagccuucuugcuuucau

SEQ ID NO: 58142 - RNA, 63 nt, Homo Sapiens
guaaugccagucccaggggaaggugcucuccacacauaggauguuuuaaauuauaucuguccc

SEQ ID NO: 58143 - RNA, 63 nt, Homo Sapiens
gguauuuuucuugauccaaaagaugcuguuaaaacauaggaaguucauucacuauuguauaga

SEQ ID NO: 58144 - RNA, 63 nt, Homo Sapiens
aauacaaguaaggaugugaguaacuuacaguuaacauaggaaaauagccguguuuacuuguau

SEQ ID NO: 58145 - RNA, 63 nt, Homo Sapiens
acgccgcauaggacugcccacaugggaccgcccacauaggaccgcccacauaggaccgcccac

SEQ ID NO: 58146 - RNA, 63 nt, Homo Sapiens
ugcccacaugggaccgcccacauaggaccgcccacauaggaccgcccacaugggaccgcccac

SEQ ID NO: 58147 - RNA, 63 nt, Homo Sapiens
cuuugccaaaaagcauacaagcaaccuggucauacauaggaugacaaaauucuuucugguugu

SEQ ID NO: 58148 - RNA, 63 nt, Homo Sapiens
uuuaaacaauaaagcaauaagaacaaauacaauacauaggaaguuaaaagcacaaaggaauga

SEQ ID NO: 58149 - RNA, 63 nt, Homo Sapiens
uugcacuuuuuuuuuuuuuuaacucugaagaauacauaggacuuauuuguuuucuuuccuaac

SEQ ID NO: 58150 - RNA, 63 nt, Homo Sapiens
gacugaaagacuguaauuuucaggagagcaagcacauaggacaauuuuuagcuaauaucuagc

SEQ ID NO: 58151 - RNA, 63 nt, Homo Sapiens
aauaacaguuuuguugacuuaaaaauaugagauacauaggaugugaaaaaaaauguuugcagu

SEQ ID NO: 58152 - RNA, 63 nt, Homo Sapiens
auauacugggguagauuauugccugccccuuauacauaggaauaugcugcauaauugcgcaua

SEQ ID NO: 58153 - RNA, 63 nt, Homo Sapiens
ucacuguguuuucauuugaugagugacuuucuaacauaggaauggucuguggcagacauugcc

SEQ ID NO: 58154 - RNA, 63 nt, Homo Sapiens
ucacuguguuuucauuugauacaaugcuguguaacauaggaaucuuacauaacagugcagagc

SEQ ID NO: 58155 - RNA, 63 nt, Homo Sapiens
uauguuuggggagaggguugcaguucccaaagaacauaggacuuaaccuuaaacucauguaag

SEQ ID NO: 58156 - RNA, 63 nt, Homo Sapiens
cauuauucagaauguagucuuuaccagugugauacauaggaauuuaaccacuaauuuugaaaa

SEQ ID NO: 58157 - RNA, 63 nt, Homo Sapiens
uuagaaaauacuaauaacuuuaauuaaaugcuaacauaggaagccaacuaguauauaaaguac

SEQ ID NO: 58158 - RNA, 63 nt, Homo Sapiens
cuggacuggguugccggauguuuccucuuagccacauaggacuuucgaauugagucaagccca

SEQ ID NO: 58159 - RNA, 63 nt, Homo Sapiens
gaaauauguaacccagaacaaucaccuaaguuuacauaggaauaagaagguggggucuuggau

SEQ ID NO: 58160 - RNA, 63 nt, Homo Sapiens
caaaguuuucagucacagaucacgccuuaaaagacauaggagaauucauacuggagagaaacc

SEQ ID NO: 58161 - RNA, 63 nt, Homo Sapiens
caaggucuucagucaagcuucauccuaugcaaaacauaggagaauucaugcaggagagaaaug

SEQ ID NO: 58162 - RNA, 63 nt, Homo Sapiens
auuuauacaggagagaaacccauccuaugcaaaacauaggagacaaggucuucagucaagcuu

SEQ ID NO: 58163 - RNA, 63 nt, Homo Sapiens
auuuauacuggagagaaagcucacaccuuaaagacauaggagaacaaaguuuccauuuggaaa

SEQ ID NO: 58164 - RNA, 63 nt, Homo Sapiens
auucauacaggagagaaacccauccuaugcaaaacauaggaggcaaggucuucagucaagcuu

SEQ ID NO: 58165 - RNA, 63 nt, Homo Sapiens
auucacacuggagaaaagccuccagcuucaaauacauaggagaacaaaguuuucauucacaaa

SEQ ID NO: 58166 - RNA, 64 nt, Homo Sapiens
agcuccccuccacagcugcagcugauccauaggacuaccgcaggcccggacucaccaacuugcc

SEQ ID NO: 58167 - RNA, 64 nt, Homo Sapiens
gcagcugggcccacagcccccccugccccucccccuaccgcaugcccuuccugacccggauugg

SEQ ID NO: 58168 - RNA, 64 nt, Homo Sapiens
guagagagccuaaagagaguuuucuaaucaugcucuaccgcauuuauuguuugaagguuuaucu

SEQ ID NO: 58169 - RNA, 64 nt, Homo Sapiens
accaacggcccuuuucagggaccucuacaguacacuaccgcaaauggcuucggcggcugagcuu

SEQ ID NO: 58170 - RNA, 64 nt, Homo Sapiens
gcggggacugacccuccgugccgagggcugcaugcuaccgcacuaagucaauacaugggcuccc

SEQ ID NO: 58171 - RNA, 64 nt, Homo Sapiens
uggaaccaugcgagugauacuauacucucugugccuaccgcauugaggauguaauuccaucaua

SEQ ID NO: 58172 - RNA, 64 nt, Homo Sapiens
aaaaaauuuuuuuguucucuugcauuuuuuucaacuaccgcaaagcuauacagauuuuuuugua

SEQ ID NO: 58173 - RNA, 64 nt, Homo Sapiens
ccgccgagguuagcacuuucauuacaggugugagcuaccgcacccagccucccaaagugcugag

SEQ ID NO: 58174 - RNA, 64 nt, Homo Sapiens
aggugggcguacggacugcugccaggcgggagaacuaccgcagcgucuccaccuugauggagag

SEQ ID NO: 58175 - RNA, 56 nt, Homo Sapiens
gccugaugcaguccuccugaccguuccuaccgcagguccagggccugggcccgcgg

SEQ ID NO: 58176 - RNA, 64 nt, Homo Sapiens
ccagggugcacgucuccccagguccugggaguggcuaccgcagguaguuucuggagagcacguu

SEQ ID NO: 58177 - RNA, 64 nt, Homo Sapiens
agagcgucauguccuuggcagaggcagggaagcucuaccgcaaggaccuggagauugugcucug

SEQ ID NO: 58178 - RNA, 64 nt, Homo Sapiens
ccagagucacacugcgcgucugugcaucucuggccuaccgcaguggccccggcugucugcacau

SEQ ID NO: 58179 - RNA, 64 nt, Homo Sapiens
ccacccugaaacagccacagugccaagaacacagcuaccgcacaucccagccccugaagcucua

SEQ ID NO: 58180 - RNA, 64 nt, Homo Sapiens
ccuccuccgaggacccuuuguguaucuccuccagcuaccgcagagcccacaaacccaggcaucu

SEQ ID NO: 58181 - RNA, 64 nt, Homo Sapiens
ccucucucuccaggaaugucaccgucucccucuucuaccgcaaugacuccgcccaccugccccu

SEQ ID NO: 58182 - RNA, 64 nt, Homo Sapiens
gagagcuaaguaaguaaaguuuuauaacuguuagguuucuuaaugaucauauuuugcaguuuua

SEQ ID NO: 58183 - RNA, 64 nt, Homo Sapiens
uaacauccuuauacuuucuauuuuaaguauaucuguuucuuaaguaaacaacuuagauauuuuc

SEQ ID NO: 58184 - RNA, 64 nt, Homo Sapiens
cuaagauucaauauuacguuugauaauugcaacuguuucuuaucagaaggaauuaagaguacac

SEQ ID NO: 58185 - RNA, 64 nt, Homo Sapiens
uuuuuugcaauuauuagcuggcuaacuuuuaaugguuucuuaaaauuuuuaaagauuauuuagu

SEQ ID NO: 58186 - RNA, 64 nt, Homo Sapiens
gcuuggcaacacgacuugaaauaaauaaaacuuuguuucuuaggagaaaaugauucuguaauuc

SEQ ID NO: 58187 - RNA, 64 nt, Homo Sapiens
aguauacaccuagaguuuuaauuaccuuuauaauguuucuuaaaagugaaacuuagauacaauu

SEQ ID NO: 58188 - RNA, 64 nt, Homo Sapiens
auggucauauagcuaguuaucuuguaaaaccaauguuucuuaguucauacuuacaacugcaauu

SEQ ID NO: 58189 - RNA, 64 nt, Homo Sapiens
cugcaauuucacuuucauuuagaaaagaauaaauguuucuuaauugaacaacuauuuuaucugu

SEQ ID NO: 58190 - RNA, 64 nt, Homo Sapiens
caacuagaaacagcuccaguguuuuuaagagaauguuucuuaaaaccaauaggaaacuuaagcg

SEQ ID NO: 58191 - RNA, 64 nt, Homo Sapiens
gccagagaaacugagguaacugucauuagaaaagguuucuuaaaauacucacaaagcuguuauu

SEQ ID NO: 58192 - RNA, 64 nt, Homo Sapiens
uuuucccuggugccucucacuucguuggugaccaguuucuuaaacugaaagcuuuaauguuaca

SEQ ID NO: 58193 - RNA, 64 nt, Homo Sapiens
uacuauuuuucuuuccaagucauuuuuguuuuugguuucuuauucaaagaugauaauuuagugg

SEQ ID NO: 58194 - RNA, 64 nt, Homo Sapiens
cugcagucuaugcacaacacgaucuugaugcaggguuucuuaacugucaggggaaggagggaaa

SEQ ID NO: 58195 - RNA, 64 nt, Homo Sapiens
acuuucucuuugcauaauaaaacacauuauguagguuucuuaucugccuuuucugaccucauau

SEQ ID NO: 58196 - RNA, 64 nt, Homo Sapiens
agaccacaaauaguuaucuuuuaauuacagaagaguuucuuaacuuacuuuuguaaguuuuuau

SEQ ID NO: 58197 - RNA, 64 nt, Homo Sapiens
cuauauauuucuuaauaaaauaauucucaaauuuguuucuuaugaaucaucucucaaaucuagu

SEQ ID NO: 58198 - RNA, 64 nt, Homo Sapiens
uccccaacauccuaggcacagcuuucauaacccaguuucuuagguguaagaaacuguuuuuauc

SEQ ID NO: 58199 - RNA, 64 nt, Homo Sapiens
uucuuuucuagccaaucaucucugaagaguugcuguuucuuacugacaauaaaaaauguucucu

SEQ ID NO: 58200 - RNA, 64 nt, Homo Sapiens
auuguaggaaaauuaucuaguucuuuagaugaauguuucuuaggaugugcuauguaccagauaa

SEQ ID NO: 58201 - RNA, 64 nt, Homo Sapiens
caaaucccuuggaacuaugguuuaaaauguucagguuucuuaucaaauaauuauaucugacuga

SEQ ID NO: 58202 - RNA, 64 nt, Homo Sapiens
cuuacaacaugauuguuuauguacagggauucagguuucuuauuugcuuccuaaucuuuuuguu

SEQ ID NO: 58203 - RNA, 64 nt, Homo Sapiens
auucauucuuguuucacaaaaauuuggauuucauguuucuuaaugauauugugaaaauaagugc

SEQ ID NO: 58204 - RNA, 64 nt, Homo Sapiens
auuuuugcuuuugcuuauuuaguaauuuguaaaaguuucuuaaauauuaacuuucuuuuaugua

SEQ ID NO: 58205 - RNA, 64 nt, Homo Sapiens
uauguaaauacuugcaucacuugacuaugacacaguuucuuauuuugcugaacugucuugacca

SEQ ID NO: 58206 - RNA, 64 nt, Homo Sapiens
ggaaaugaugacuccugacacugucacucagugaguuucuuacuugaucuuuagucuucauuuu

SEQ ID NO: 58207 - RNA, 64 nt, Homo Sapiens
ccaauauuccuuuacaaauuuguaucauuuuuuuguuucuuaaucaauugguacagacauuuug

SEQ ID NO: 58208 - RNA, 64 nt, Homo Sapiens
aaguaugugccuggugugaaaugaucuauggccuguuucuuacacaggaagcccccugaaccuc

SEQ ID NO: 58209 - RNA, 64 nt, Homo Sapiens
agcaagagagugcacccguuuagcccuggacccuguuucuuacugugugacuuggcuagaguug

SEQ ID NO: 58210 - RNA, 64 nt, Homo Sapiens
uucuuucagaguuugggccuaauaguuaacaauaguuucuuauuugauauauuacuuuguuaau

SEQ ID NO: 58211 - RNA, 64 nt, Homo Sapiens
uaggaguuugagugaauuauauuggugaugacacguuucuuaagagaagagccuuuacuaucuu

SEQ ID NO: 58212 - RNA, 64 nt, Homo Sapiens
gaaugccucauaaauuaaugauucugaagcuuauguuucuuauucucuguuugcuuuugaacgu

SEQ ID NO: 58213 - RNA, 64 nt, Homo Sapiens
gaauccugcucuaaaauacacaaggagcuuucuuguuucuuauuaggccucagaaagaagucag

SEQ ID NO: 58214 - RNA, 64 nt, Homo Sapiens
uuaucucuuaagaccauaugcccccuguuuuaauguuucuuacaucuuguuuuuacucauuucu

SEQ ID NO: 58215 - RNA, 64 nt, Homo Sapiens
uuagucucuuuuaaguuacaaaaagccaauugauguuucuuauucuuuuuaaauuuuaaauauu

SEQ ID NO: 58216 - RNA, 64 nt, Homo Sapiens
ccauccuuuuccugagcacagccuggauuuuuauuucugccaugaaacccagcucccaugacuc

SEQ ID NO: 58217 - RNA, 64 nt, Homo Sapiens
ucagccuguggcuuguggccugugaccugugaccuucugccagaauugucaugccucugaggcc

SEQ ID NO: 58218 - RNA, 64 nt, Homo Sapiens
cuacaauagcagugaagacuuacuuugaaauagguucugccagucucuacgcucauugcagaaa

SEQ ID NO: 58219 - RNA, 64 nt, Homo Sapiens
augucgaaaucagacccugaucccuacgugauccuucugccaaacauccaugaagaagguaaaa

SEQ ID NO: 58220 - RNA, 64 nt, Homo Sapiens
uuucagggucuaagauugguaauuuccauguauuuucugccauuuuuuuuuuuuuuuuuuuuca

SEQ ID NO: 58221 - RNA, 64 nt, Homo Sapiens
uccaccacccauucaguuugggaacugguauccauucugccaauguaguggggucaggaaugua

SEQ ID NO: 58222 - RNA, 64 nt, Homo Sapiens
uugaaacccccauucuguuucaauaauggaaugguucugccaucauucuaggggcuuauagcuc

SEQ ID NO: 58223 - RNA, 64 nt, Homo Sapiens
gauggaaaaaauacagguauguaaaacgucucuguucugccagaggaagagcccagaucugaau

SEQ ID NO: 58224 - RNA, 64 nt, Homo Sapiens
aucaaaguuccagcuaccuguacuccauugugguuucugccacucaggccauuucugugaaccc

SEQ ID NO: 58225 - RNA, 64 nt, Homo Sapiens
gcagugcagccccaggaugccucgcagacgugccuucugccaugauugugaaguucuagccacg

SEQ ID NO: 58226 - RNA, 64 nt, Homo Sapiens
augugaucucugcacacgcuagcucuccuucgccuucugccaugcuggaaguagccugaggccc

SEQ ID NO: 58227 - RNA, 64 nt, Homo Sapiens
ggaacugguuaaaaacacugucccccaaccuaacuucugccaugugccuugcuuuucuuccucu

SEQ ID NO: 58228 - RNA, 64 nt, Homo Sapiens
gucuugucugaaggcagacuuucuucugagguuuuucugccaguuucuccaaaggcuuggaguu

SEQ ID NO: 58229 - RNA, 64 nt, Homo Sapiens
aaacaaaguuuuggaugagcgaacaauucuuucuuucugccaaguuuagguuuaagauguaagu

SEQ ID NO: 58230 - RNA, 64 nt, Homo Sapiens
uuuacuggguucuaaaugcuuaaaggucaucaucuucugccaccgccaaacagccaugcaucua

SEQ ID NO: 58231 - RNA, 64 nt, Homo Sapiens
auaaaccuguucuuccuuuuucucuauuuuacuuuucugccaaauaaagacaaauuuugcauau

SEQ ID NO: 58232 - RNA, 64 nt, Homo Sapiens
guaaaacaauacaucaacaauggguuuauuuucauucugccaaacuugaacaaagacauuuaua

SEQ ID NO: 58233 - RNA, 64 nt, Homo Sapiens
agaagagagcccuugguaaccaguuuugcucuucuucugccacuccucccugcuugcaucucgu

SEQ ID NO: 58234 - RNA, 64 nt, Homo Sapiens
gagaggaaggaugucugcagaacuuuguucuguuuucugccacaaaaaugugaauaguucagag

SEQ ID NO: 58235 - RNA, 64 nt, Homo Sapiens
ggcugguagacaagaacugugaagaaauggugauuucugccagggaaaguagcauuccuucgcc

SEQ ID NO: 58236 - RNA, 64 nt, Homo Sapiens
ggauuuuggaaaguagcauuaaaucucuaggagauucugccaaaaaauuaggaagcagaaaaac

SEQ ID NO: 58237 - RNA, 64 nt, Homo Sapiens
ccucgagcauccaagcaugaagagaccagcaagguucugccaggcuucacuuaucccacccuac

SEQ ID NO: 58238 - RNA, 64 nt, Homo Sapiens
ccccaagcaucugagcaugaagagaccagcaagguucugccaggcuucauuuaucccauccuuc

SEQ ID NO: 58239 - RNA, 64 nt, Homo Sapiens
gauugggggugguuuuugucuagaaaauacugcuuucugccaucgguuaaguuucagugccagc

SEQ ID NO: 58240 - RNA, 64 nt, Homo Sapiens
guguuggaggugguggagcguagagagcagcugcuucugccaggucuggaaaaugcucuugcug

SEQ ID NO: 58241 - RNA, 64 nt, Homo Sapiens
guagaacacagacagggcuuaggacuggggcacuuucugccacacugcucccaaaaccgcugga

SEQ ID NO: 58242 - RNA, 64 nt, Homo Sapiens
accaggaggauuucaagaaaucuuccccacuggguucugccaccuucacggcaagaccccccuc

SEQ ID NO: 58243 - RNA, 64 nt, Homo Sapiens
uagaugcuccauuagcaguucucuuggaggauuuuucugccaugauucugccuggccccauguc

SEQ ID NO: 58244 - RNA, 64 nt, Homo Sapiens
aagccaccccuuagcacuccucuccagcuccccuuucugccagggugggcucugggcuugacgg

SEQ ID NO: 58245 - RNA, 64 nt, Homo Sapiens
cccuccccuuuuaauuuauuucccugacccugccuucugccaugaccccagggccacuagucuc

SEQ ID NO: 58246 - RNA, 64 nt, Homo Sapiens
gggcccugaaacuguaccaguucugaagaccguuuucugccacacccccacccccagcugacca

SEQ ID NO: 58247 - RNA, 64 nt, Homo Sapiens
uguauuuuccuauuucccugccaucaucugcuauuucugccacuucucuuagacuccuugucug

SEQ ID NO: 58248 - RNA, 64 nt, Homo Sapiens
cauccagagcccauucuggaguuuuguuuuuuccuucugccagaugcuuuguguccugucuucc

SEQ ID NO: 58249 - RNA, 64 nt, Homo Sapiens
ugggaaaaugggcaagcagagugcacagcccucguucugccagcuggagccaagaagcacagag

SEQ ID NO: 58250 - RNA, 64 nt, Homo Sapiens
ucucaggggcagaagacauggguuccaguucugguucugccacacacccaccggccuugaauuu

SEQ ID NO: 58251 - RNA, 64 nt, Homo Sapiens
agggugugcugugggggucacuucucacgcagaguucugccaggggcugggcuuuugcuguccu

SEQ ID NO: 58252 - RNA, 64 nt, Homo Sapiens
aaauccuggccaugggacccugggcuuuucuggcuucugccauggguuaagcggcaggcaggau

SEQ ID NO: 58253 - RNA, 64 nt, Homo Sapiens
gaugcuuuuccuaaacccuuuuccuacacuuuauuucugccauuguaguugccuaaauuuaaga

SEQ ID NO: 58254 - RNA, 64 nt, Homo Sapiens
ugguuuauuucauauacacuuauaaucauuuuuauucugccauaacacuuacaauauacuggcu

SEQ ID NO: 58255 - RNA, 64 nt, Homo Sapiens
cuuauaaauguuagauaugugggaaaggccuuuauucugccaagucauuucgaagacaugaaaa

SEQ ID NO: 58256 - RNA, 64 nt, Homo Sapiens
cuuauaaauguaagauaugugggaaaggcuuuuauucugccaagucauuucaaauaccugaaaa

SEQ ID NO: 58257 - RNA, 64 nt, Homo Sapiens
gugaacuugaagaagguugucagcugcagccacuuucugccagcaucugcagccacuuucugcc

SEQ ID NO: 58258 - RNA, 64 nt, Homo Sapiens
cugcagccacuuucugccagcaucugcagccacuuucugccagcaucugcagccagcaagcugg

SEQ ID NO: 58259 - RNA, 64 nt, Homo Sapiens
aaaucgaacaagugcaauuaccgucucuccuggcuucugccagacgaagagaagcacgcugucc

SEQ ID NO: 58260 - RNA, 64 nt, Homo Sapiens
auuggccuuucccagaugcucuggaaucuuccaguucugccagacuggacgccucuccccuggu

SEQ ID NO: 58261 - RNA, 64 nt, Homo Sapiens
gcuucagccaguccccccgucacaauccauguuuuucugccaugauaaauguccaugaaaccuu

SEQ ID NO: 58262 - RNA, 64 nt, Homo Sapiens
uucuucaccacuuuauaucaaugcuagaauacaguucugccaagcaagcucuaccuuccguaaa

SEQ ID NO: 58263 - RNA, 64 nt, Homo Sapiens
cugcugagucuguucugguagcuuugccaugugcuucugccaccgagcuuacguaguucuaccg

SEQ ID NO: 58264 - RNA, 64 nt, Homo Sapiens
uguccuaauggugaugcagucuuugagcucccacuucugccagaagccugcccagcccccuggu

SEQ ID NO: 58265 - RNA, 64 nt, Homo Sapiens
cgacgauccaaaugccgugugucaccaaccccgcuucugccacuggcggcuucccuucuuggcu

SEQ ID NO: 58266 - RNA, 64 nt, Homo Sapiens
ugccauucuuggaaacugucccauugcuucguauuucugccaacguagcucugccugccuguca

SEQ ID NO: 58267 - RNA, 64 nt, Homo Sapiens
cccguggacuacacagcuccugagcuugaucuuuuucugccaugaaguuuaaagauucuaugcc

SEQ ID NO: 58268 - RNA, 64 nt, Homo Sapiens
uaaauuaagcucuugcuaacuugaaaaaucccuguucugccagcgaagcuuccuccuccucucc

SEQ ID NO: 58269 - RNA, 64 nt, Homo Sapiens
ccuuguaagaaagcauuccuugguuuacagugguggcugacaccguaaguuugugguuuguuuc

SEQ ID NO: 58270 - RNA, 64 nt, Homo Sapiens
gagugaagguguuugaaauggugguggccgcuguggcugacacuggugcggggccagcugcuau

SEQ ID NO: 58271 - RNA, 64 nt, Homo Sapiens
ugggguaugccgggcacugguugcuagcucagguggcugacacacacagcccugagagauggug

SEQ ID NO: 58272 - RNA, 64 nt, Homo Sapiens
cgcguucaaagcacuuuugucgcucccuuguguuggcugacacgaaggcuaaaaauaacuggug

SEQ ID NO: 58273 - RNA, 64 nt, Homo Sapiens
ucacugagugauaagcauggcagcccuucucuguggcugacaggggggcaggguuagcagaugg

SEQ ID NO: 58274 - RNA, 64 nt, Homo Sapiens
uucuuguagaucuagcuccucagaguuggaggaaggcugacagagaaggucuccucugugcucc

SEQ ID NO: 58275 - RNA, 64 nt, Homo Sapiens
cucuggaggcugccuguggucuccuuccggcuguggcugacaguggcucuggccaggguugcuu

SEQ ID NO: 58276 - RNA, 64 nt, Homo Sapiens
cuccuggaagaagcuaugcugcugacauauuuacggcugacaaaaaguaaagagucuauuuaug

SEQ ID NO: 58277 - RNA, 64 nt, Homo Sapiens
uuuacggcugacaaacuccuaagagucuauuuauggcugacauacaaacagaaaaaaaaaagua

SEQ ID NO: 58278 - RNA, 64 nt, Homo Sapiens
uauauacaccuaauacccacaaaacaucucauguaccccauaaaacacauugcaugccuauauc

SEQ ID NO: 58279 - RNA, 64 nt, Homo Sapiens
acaugaugugauuauuacacuugaggagauggacaccccauauuuuuguaacacaaauaaaugc

SEQ ID NO: 58280 - RNA, 64 nt, Homo Sapiens
auguacuuagccacaggcagaauagcuuucgaugaccccauagcacuuuguuucuucgccuuga

SEQ ID NO: 58281 - RNA, 64 nt, Homo Sapiens
gaacaucauccuagagagugugauguucacuauaaccccauaccuacauucccuaaugauacag

SEQ ID NO: 58282 - RNA, 64 nt, Homo Sapiens
uacugaauuagaaacucuaggauucuggauccauaccccauaccuugggcuaguuagagaucca

SEQ ID NO: 58283 - RNA, 64 nt, Homo Sapiens
aaucugggaaaugggcuagguuaugguugaggauaccccauaugaguuugucaggcagagaugu

SEQ ID NO: 58284 - RNA, 64 nt, Homo Sapiens
cuggcccaaggcagcgaggcuucuacagucccacaccccauagccgccugggcuggggcuuacu

SEQ ID NO: 58285 - RNA, 64 nt, Homo Sapiens
ggacugcguuguaugcuuuccauccacucaccuuaccccauagcaucuugcggcccagaaacca

SEQ ID NO: 58286 - RNA, 59 nt, Homo Sapiens
caacuaaaauagacguggagugucaucacuacagauaugaggacaaggcuggaggcauu

SEQ ID NO: 58287 - RNA, 59 nt, Homo Sapiens
gauucagugggucugcguagcugugaaaauacagauacuuuguggaucaccugaggauc

SEQ ID NO: 58288 - RNA, 59 nt, Homo Sapiens
uuuucaaaaauucaucauucaguauuaauuacagauaacgaacaaauaguaaaauccaa

SEQ ID NO: 58289 - RNA, 59 nt, Homo Sapiens
uauaaaacccucuauaaauaaccugagauuacagauacuaacagagugaggccuuuuua

SEQ ID NO: 58290 - RNA, 59 nt, Homo Sapiens
ccaagcccacuggaauuauccuuuaauuuuacagauaccacuugcuguaggcuguggac

SEQ ID NO: 58291 - RNA, 59 nt, Homo Sapiens
uggauuauggaucugaauagagaaaugcuuacagauaaucauuagcccacauaccagua

SEQ ID NO: 58292 - RNA, 59 nt, Homo Sapiens
uugcaaggcuuuuaucccugaaaaucauuuacagauaaccacaauuugcugugguauau

SEQ ID NO: 58293 - RNA, 59 nt, Homo Sapiens
uaaaauuuaagauuuuucuaauaaaagaguacagauaaugggacaguugagagagaugg

SEQ ID NO: 58294 - RNA, 59 nt, Homo Sapiens
gauuaaggaauacagacuaugcuaauuuguacagauagguuccauuccugaauaugcag

SEQ ID NO: 58295 - RNA, 59 nt, Homo Sapiens
cugaugguuauugccuuauugaagaaaaguacagauaggaauuuuacugaguaggcaca

SEQ ID NO: 58296 - RNA, 59 nt, Homo Sapiens
uuaagacuauuuaaauuucuuuacuuguuuacagauaguauuugaaauuucuggcugcc

SEQ ID NO: 58297 - RNA, 59 nt, Homo Sapiens
uggguuucaagcacaagaaucagaaagcuuacagauaaacugaaguaucugugugcuuc

SEQ ID NO: 58298 - RNA, 59 nt, Homo Sapiens
acuuguuuuaauuuuagagaaacuuugaguacagauacugugagcuuacauugaaaaca

SEQ ID NO: 58299 - RNA, 59 nt, Homo Sapiens
uuucuagaugacauaaaauuuacauuuaauacagauaaguguucuucaguguaauguga

SEQ ID NO: 58300 - RNA, 59 nt, Homo Sapiens
uauauuuaaaaauauuuuuuuaaauucuuuacagauaauauuauacuuguuacccuuca

SEQ ID NO: 58301 - RNA, 59 nt, Homo Sapiens
ggcaauuucuuggccauggauguagaaccuacagauaaggugagccaacugcauuagga

SEQ ID NO: 58302 - RNA, 59 nt, Homo Sapiens
acaacugaggcucagggagauucccaucuuacagauaaauccauacaacgaaucuauua

SEQ ID NO: 58303 - RNA, 59 nt, Homo Sapiens
uacagaaaguagggaggaagugguuuagauacagauauuuauauuugaccaaaauauuc

SEQ ID NO: 58304 - RNA, 59 nt, Homo Sapiens
cauuagcccacauaccaguaagaaaugcuuacagauaauuggauuauggaucugaauag

SEQ ID NO: 58305 - RNA, 59 nt, Homo Sapiens
acuugcuguaggcuacggaccuuuaauuuuacagauaccccaagcccauuggaauuauc

SEQ ID NO: 58306 - RNA, 59 nt, Homo Sapiens
guuauguaggaccuuuggacccaggguccuacagauagauauggugugcccagauuuua

SEQ ID NO: 58307 - RNA, 59 nt, Homo Sapiens
cagauguuacuggucugugaggaaauaaguacagauacugacaggaagcuuuuauaaac

SEQ ID NO: 58308 - RNA, 59 nt, Homo Sapiens
uuuuacuccugauagguagaugcagcucuuacagauauuuacuugguaaagugcagugg

SEQ ID NO: 58309 - RNA, 59 nt, Homo Sapiens
uuuacucacguaccuguuacacuuuagcauacagauagaucauagaucacguuacaagc

SEQ ID NO: 58310 - RNA, 59 nt, Homo Sapiens
uauauaugacgcgucacagaauauauauauacagauauaauacagauaucuauaucuau

SEQ ID NO: 58311 - RNA, 59 nt, Homo Sapiens
uauaucuauauauauauauacuaucuauauacagauaucaaaacacaaaaaaagaaaau

SEQ ID NO: 58312 - RNA, 64 nt, Homo Sapiens
gcccugaagccuccguggaacauucuggaucugacccucccagucucaucuccugacccuccca

SEQ ID NO: 58313 - RNA, 64 nt, Homo Sapiens
uucuggaucugacccucccagucucaucuccugacccucccacucccaucuccuuaccucugga

SEQ ID NO: 58314 - RNA, 64 nt, Homo Sapiens
cccgcguucaguauggguugagggucacagaccucccucccaucugggugccugaguuuugacu

SEQ ID NO: 58315 - RNA, 64 nt, Homo Sapiens
accucugaaaaaaguauaguaucgaguacccguucccucccagaggugggaguaacugcuggua

SEQ ID NO: 58316 - RNA, 64 nt, Homo Sapiens
gggugggacagggcuucuccugcgggggcgaggccccucccaguaagggcguggcucugggugg

SEQ ID NO: 58317 - RNA, 64 nt, Homo Sapiens
aggacagggacuucgcagaggcaagcgaccgaggcccucccaaagaggcccgcccugcccgggc

SEQ ID NO: 58318 - RNA, 64 nt, Homo Sapiens
cagccaggcagcgaguccugccccgcccgcagcucccucccacaccccgccuggccaagaugac

SEQ ID NO: 58319 - RNA, 64 nt, Homo Sapiens
guugcguuaguuuuuaaucaucaggacuaucucacccucccacuccuguuuuuaaaacucagaa

SEQ ID NO: 58320 - RNA, 64 nt, Homo Sapiens
ccucgccagggcucccuucucuuccucucugcuucccucccaggcaggcaggcuugcucugucc

SEQ ID NO: 58321 - RNA, 64 nt, Homo Sapiens
cgcagcaccaagggcuugcuugcccucugcagaccccucccagcuggagggggacuggacccag

SEQ ID NO: 58322 - RNA, 64 nt, Homo Sapiens
acuuucacucccucuccaagggccaagaaugaggcccucccaacugcguccuuaccacugaucu

SEQ ID NO: 58323 - RNA, 64 nt, Homo Sapiens
ugguacuaaaauuucaguguuacgugcaaggaaucccucccaucagcagguggaugcucaagau

SEQ ID NO: 58324 - RNA, 64 nt, Homo Sapiens
gaccgaccccuggcccaagcucccagggaccuaccccucccaggcugcugcccagcucuacccc

SEQ ID NO: 58325 - RNA, 64 nt, Homo Sapiens
gaccuaccccucccagggaccugcccagcucuaccccucccaggguuggccacuggccaugcug

SEQ ID NO: 58326 - RNA, 64 nt, Homo Sapiens
ccucccuaccuuggacaggaacugaccccugacccccucccagcagcacacucagugcagcaag

SEQ ID NO: 58327 - RNA, 64 nt, Homo Sapiens
ccacccccagauagagggaacccugcauguggagcccucccaccgggaaaggacaggugccgag

SEQ ID NO: 58328 - RNA, 64 nt, Homo Sapiens
gggaaggggcgugucccuccucuuccuguagugccccucccauggcccagcagcuuggcugagc

SEQ ID NO: 58329 - RNA, 64 nt, Homo Sapiens
agggaucuucucccuccccucacccgcugcccagcccucccagcuggugucacucugccucuaa

SEQ ID NO: 58330 - RNA, 64 nt, Homo Sapiens
ggagguuguggaauuucuuucuucuccccuucuucccucccaaaagcuuagcuauguauaaagu

SEQ ID NO: 58331 - RNA, 64 nt, Homo Sapiens
uaguggguuuuggaggagggaguggaguaagaugcccucccacuuuuaucaguuuaguaguagu

SEQ ID NO: 58332 - RNA, 64 nt, Homo Sapiens
aaauuaugaucugacuggaaaacaauccuguauccccucccaaagaaucaugggcuuuuuuuuu

SEQ ID NO: 58333 - RNA, 64 nt, Homo Sapiens
cugcuuuccaacuccaagcucccuccacaaguuucccucccaggccccccacaccccagugugg

SEQ ID NO: 58334 - RNA, 64 nt, Homo Sapiens
ucucuguugcuucucuucugguguugcuucuccucccucccauucucucugcaacucccugcgg

SEQ ID NO: 58335 - RNA, 64 nt, Homo Sapiens
ucaccuggugggccugggcucagcaaacagcccucccucccaguauuucaucaaggacagggaa

SEQ ID NO: 58336 - RNA, 64 nt, Homo Sapiens
ucccucccaguauuucaucaaggacagggaauaucccucccacacacaggccagcugcucaccc

SEQ ID NO: 58337 - RNA, 64 nt, Homo Sapiens
guuugacaccugucuacccagagccagugacugucccucccagcagccuccaaaggguccaaag

SEQ ID NO: 58338 - RNA, 64 nt, Homo Sapiens
ugacuucucugggcugaggcuggucguccuggagcccucccaguaccucgggcugcaagagcug

SEQ ID NO: 58339 - RNA, 64 nt, Homo Sapiens
cacccagucccucugugggagcccgggugccaggcccucccaacaccacaccacccuccaggcc

SEQ ID NO: 58340 - RNA, 64 nt, Homo Sapiens
guugaugccuucccagagucaaccuccugugacgcccucccagagccaaccucgggugacaccc

SEQ ID NO: 58341 - RNA, 64 nt, Homo Sapiens
ugugacgcccucccagagccaaccucgggugacacccucccagagucaaccucaugugacaccu

SEQ ID NO: 58342 - RNA, 64 nt, Homo Sapiens
cccauacugguacugcuguacuccacagccucaccccucccaccugcccuauacgccgccuuca

SEQ ID NO: 58343 - RNA, 64 nt, Homo Sapiens
aacuucaacuccuccauggaggaguaccacucuccccucccacaugcugaggaguugacgacag

SEQ ID NO: 58344 - RNA, 64 nt, Homo Sapiens
auacucccgucacuccuccccacugccgccccuccccucccacucucgucuccuuccccucgcc

SEQ ID NO: 58345 - RNA, 64 nt, Homo Sapiens
agggcaugcaggcccucagcccgggcugugccagcccucccagccccaggcccaucugagggac

SEQ ID NO: 58346 - RNA, 64 nt, Homo Sapiens
uuggcuuuuuccuuugucgccuccccagcaccugcccucccagucucccaccccggccccaggc

SEQ ID NO: 58347 - RNA, 64 nt, Homo Sapiens
uaaaaaaguagcacugauguguuuuguaaucugccccucccagcccuccguggaggcugccagg

SEQ ID NO: 58348 - RNA, 64 nt, Homo Sapiens
uuccucccaccucaccugucgcugaaccccaccucccucccaccguguguagggggguuucagg

SEQ ID NO: 58349 - RNA, 64 nt, Homo Sapiens
uggagccuguuacccguuagucuggggcucuuggcccucccaccaccccacgggaggaguggca

SEQ ID NO: 58350 - RNA, 64 nt, Homo Sapiens
gaggugaagcgaagccacucuuaccucucccuuccccucccaccugcccccugcguaggcaccc

SEQ ID NO: 58351 - RNA, 64 nt, Homo Sapiens
uuuacuccuuggucugucucgcuuuaucugucgccccucccagcgcugagagccuccccuggcu

SEQ ID NO: 58352 - RNA, 64 nt, Homo Sapiens
uucccauucauagaaucauauuugacaauaaugccccucccaacaugaaaaauggacagcugcu

SEQ ID NO: 58353 - RNA, 64 nt, Homo Sapiens
cucaucccugcuucuuuggguauaagcuuguccucccucccacacccuaaucgcuuacaccuaa

SEQ ID NO: 58354 - RNA, 64 nt, Homo Sapiens
guccacuggcuccaggcucccucuaaagccuccucccucccagcccucccccgguugcccccca

SEQ ID NO: 58355 - RNA, 64 nt, Homo Sapiens
gggcugcccaccaagcccugcccccaccagcucccccucccauacuuuggucagucccuguggu

SEQ ID NO: 58356 - RNA, 64 nt, Homo Sapiens
uccucagacccagcaaaagcauuuuauggcuccucccucccauguuuuaaaauuguucuccagc

SEQ ID NO: 58357 - RNA, 64 nt, Homo Sapiens
agccagggcggagacugucuaggguucuuguugucccucccauucuggcagcccuguugucugg

SEQ ID NO: 58358 - RNA, 64 nt, Homo Sapiens
uuccguccagcccggggcagucugacugucggugcccucccaggaacggggaaggccuccgucu

SEQ ID NO: 58359 - RNA, 64 nt, Homo Sapiens
agaacaacaggaaaccaaggucugaccuaggguucccucccagucuucacaucacucuggccuc

SEQ ID NO: 58360 - RNA, 64 nt, Homo Sapiens
acguggagagcuucaauugucuaacgugcucgcgcccucccagccaggucuucucuucugccaa

SEQ ID NO: 58361 - RNA, 64 nt, Homo Sapiens
gcucucugcccugcgcguucgagaccguguugcccccucccacagcauucgaguuaccugguga

SEQ ID NO: 58362 - RNA, 64 nt, Homo Sapiens
gaaguuugugcuuaaaaaacuccguucucccuuccccucccacugugccuaggggguguggggu

SEQ ID NO: 58363 - RNA, 64 nt, Homo Sapiens
gccaacccccaccccguuucccaguauccuccagcccucccaaucucugaggucaggucugagg

SEQ ID NO: 58364 - RNA, 64 nt, Homo Sapiens
gccuugugggugugagcagcacccauccaccguccccucccagggagcaagggcagggacaggg

SEQ ID NO: 58365 - RNA, 64 nt, Homo Sapiens
aggcugagcugaaagaggccaaacaggcccuccucccucccagcuccaccccgcaagcaccauc

SEQ ID NO: 58366 - RNA, 64 nt, Homo Sapiens
ugugugaaauuccagagcuuugggggagaauccacccucccaucaucugcuucccccaaggccu

SEQ ID NO: 58367 - RNA, 64 nt, Homo Sapiens
ccauccagcuucccuccccuuccuccaaaacccucccucccaccuccccacacccauugaguca

SEQ ID NO: 58368 - RNA, 64 nt, Homo Sapiens
uucuuguuucaucccugcuucuggacuugggguacccucccaauugccacauccuaucuggucc

SEQ ID NO: 58369 - RNA, 64 nt, Homo Sapiens
ggguuuaguccguggacauuucagagggagaucccccucccauuuaacuguccucacaggcccu

SEQ ID NO: 58370 - RNA, 64 nt, Homo Sapiens
gcaagcauuccccuuuaagagcuuccacugcacccccucccaagggacacagcgguaggaaugg

SEQ ID NO: 58371 - RNA, 64 nt, Homo Sapiens
ucuuucuugaggguugguccuguccccaccuccacccucccacccccuggaagaggaagggccc

SEQ ID NO: 58372 - RNA, 64 nt, Homo Sapiens
acuggcccccaugauucaauuaccucccccgggucccucccacaacacaugggaauucugagag

SEQ ID NO: 58373 - RNA, 64 nt, Homo Sapiens
cuggccccccugauucgaugaccucccccugggucccucccacaacaugugggaauuccagaag

SEQ ID NO: 58374 - RNA, 64 nt, Homo Sapiens
acccagccgccgccguugagcccucccaccacuccccucccaagagggagcugaggagcccuua

SEQ ID NO: 58375 - RNA, 64 nt, Homo Sapiens
acuccccucccaagacccagcugaggagcccuuacccucccacccugggaguccagggagggag

SEQ ID NO: 58376 - RNA, 64 nt, Homo Sapiens
gagaggcugaaggaauggaauuccugccuuuauucccucccaggauucacaguuuaauagagac

SEQ ID NO: 58377 - RNA, 64 nt, Homo Sapiens
caccagacacagggcacgguuggacacugggccacccucccagggcagcaucagugggacaaga

SEQ ID NO: 58378 - RNA, 64 nt, Homo Sapiens
gauugugauacauacuaaagccuauuuuaacaagcccucccaguagugacagugggcccagcca

SEQ ID NO: 58379 - RNA, 64 nt, Homo Sapiens
uguaggagauuagugaggcacucuccucaaagcucccucccaucucuccaggauccucaugugc

SEQ ID NO: 58380 - RNA, 64 nt, Homo Sapiens
cccuccagacugggucucagagccgugccacccacccucccacacagccggccacagggagaac

SEQ ID NO: 58381 - RNA, 64 nt, Homo Sapiens
aacaugacgcagcucaauaagggugagggucacucccucccagaagccccgucuggacgagccu

SEQ ID NO: 58382 - RNA, 64 nt, Homo Sapiens
uggccugggcacccuccugggagcaggccuuccucccucccacccccaauguccuguugguagg

SEQ ID NO: 58383 - RNA, 64 nt, Homo Sapiens
gcugcccacccuaccugcccugccugccugcugccccucccagccugccaagaaaacgguaggg

SEQ ID NO: 58384 - RNA, 64 nt, Homo Sapiens
gccugcucgugccuucauucugcagcggcauggucccucccauucuggcuccaccugcagccuc

SEQ ID NO: 58385 - RNA, 64 nt, Homo Sapiens
ccucugugggcccuugucggccagcccuuagcuccccucccaggucccaaaugccaccggaacc

SEQ ID NO: 58386 - RNA, 64 nt, Homo Sapiens
gaggcugugcacagacugucgaggugacugcagacccucccaggucaccccgggaccgugggcc

SEQ ID NO: 58387 - RNA, 64 nt, Homo Sapiens
caucagagcccacucaggacaggcaggaccugggcccucccacccauguggggccugggugggc

SEQ ID NO: 58388 - RNA, 64 nt, Homo Sapiens
ccgucucagcccugugcuccucccuugucaccuucccucccaccccucccccuucauaaaggcc

SEQ ID NO: 58389 - RNA, 64 nt, Homo Sapiens
gcuugaggcucccuauacuugcugcucuugcucucccucccaggaggcucagcccuagggaaag

SEQ ID NO: 58390 - RNA, 64 nt, Homo Sapiens
aguccagccaggggcugccuuggguccugcccugcccucccagguccgcaggccuccaggagua

SEQ ID NO: 58391 - RNA, 64 nt, Homo Sapiens
ucccaccugauaugcagugcgguuggagucccuacccucccacccuuuacuuuacuuuguccca

SEQ ID NO: 58392 - RNA, 64 nt, Homo Sapiens
cugggguuggggaggagcagucagcugggccacccccucccaccguuucccagcugcuuccugc

SEQ ID NO: 58393 - RNA, 64 nt, Homo Sapiens
gcaucuguagugccuugugggguauccaggaacacccucccagcaggggaugggaacccugucc

SEQ ID NO: 58394 - RNA, 64 nt, Homo Sapiens
ccucccuccuggccucgaccccuaagggcuucgccccucccaggggccuguaacuaagucgggu

SEQ ID NO: 58395 - RNA, 64 nt, Homo Sapiens
gacaggcagggagggcuuggggcugcaccuccuacccucccaccagaacgcaccccacugggag

SEQ ID NO: 58396 - RNA, 64 nt, Homo Sapiens
ccaggggcaccuaugagauggccaugcucaaccccccucccagacaggcccucccugucuccag

SEQ ID NO: 58397 - RNA, 64 nt, Homo Sapiens
uacggucccugcuuagccagcuucuguguguccgcccucccagcuccagcccugcaggccgucu

SEQ ID NO: 58398 - RNA, 64 nt, Homo Sapiens
agcuggcccaguguaaaaaugucccaaguguagccccucccaccgcagagccuguuucuaacgu

SEQ ID NO: 58399 - RNA, 64 nt, Homo Sapiens
uaacagagaaaagggagcccagacuagaggcuggcccucccagaucaaaguuugggcugaugua

SEQ ID NO: 58400 - RNA, 64 nt, Homo Sapiens
caaagcuucuaaaacuggggcauccagcagccuccccucccaaggaauacugagcugauggugu

SEQ ID NO: 58401 - RNA, 64 nt, Homo Sapiens
agucaccuccacugcacaacaccucauggcuguccccucccaccuccccgauccaaguuccuag

SEQ ID NO: 58402 - RNA, 64 nt, Homo Sapiens
agccauguccauccagcccucuuggagacacccccccucccaaaccgucucacccccgagcccc

SEQ ID NO: 58403 - RNA, 64 nt, Homo Sapiens
caacuccccaccuccagccgccucaacccugaaccccucccauuuccucuucuccccguacuga

SEQ ID NO: 58404 - RNA, 64 nt, Homo Sapiens
ggagcagcuccagagccauuucuguccagccccucccucccacuaccccucccccauuauucuu

SEQ ID NO: 58405 - RNA, 64 nt, Homo Sapiens
acuaucuugggagggagaagccaagagccugggucccucccacugcuaaagaguccggggggaa

SEQ ID NO: 58406 - RNA, 64 nt, Homo Sapiens
ugagacuggucuuugggagguucccaccaucagccccucccacucccagacucucuucuagggc

SEQ ID NO: 58407 - RNA, 64 nt, Homo Sapiens
ucuugggcagggcucuuuucuaagcugucccagccccucccauuuuccaaaggcugggaaaaac

SEQ ID NO: 58408 - RNA, 64 nt, Homo Sapiens
uaggcugcacuggggccgaacucuacccaucccucccucccaaugaaggagaagcccagccagc

SEQ ID NO: 58409 - RNA, 64 nt, Homo Sapiens
aacaaaugaauccagcguggaguugugcugcccucccucccacaagagcagaugggacugucaa

SEQ ID NO: 58410 - RNA, 64 nt, Homo Sapiens
ccucaaaccuccucuucugacgugccuuuugcaccccucccauuaggacaaucaguccccuccc

SEQ ID NO: 58411 - RNA, 64 nt, Homo Sapiens
gccuuuugcaccccucccauuaggacaaucaguccccucccaucugggaguccccuuuucuuuu

SEQ ID NO: 58412 - RNA, 64 nt, Homo Sapiens
ucuucucuuuccccuccaaccaguucaaucucaucccucccagcagcuccccuuccaccccccg

SEQ ID NO: 58413 - RNA, 64 nt, Homo Sapiens
cugcucugccccugcccguccccacccagucuugcccucccauccucucaucuauucccccgcu

SEQ ID NO: 58414 - RNA, 64 nt, Homo Sapiens
uggccacagcccugccuccgcccucaccuacaugcccucccagccccucccaucucuggacgag

SEQ ID NO: 58415 - RNA, 64 nt, Homo Sapiens
ccugccuccgcccucaccuacaugcccucccagccccucccaucucuggacgaggccuccuucc

SEQ ID NO: 58416 - RNA, 64 nt, Homo Sapiens
guacuuacugugcugagagcuuuccucgcagaggcccucccaacgaacagcucucucagaagca

SEQ ID NO: 58417 - RNA, 64 nt, Homo Sapiens
acuguacucucucuccuaccugccucccugcagucccucccauggaugacucaggccucccaga

SEQ ID NO: 58418 - RNA, 64 nt, Homo Sapiens
aguggccuuggcaaugucugugccaccuccugagcccucccagcauguccucacaugcucaugc

SEQ ID NO: 58419 - RNA, 64 nt, Homo Sapiens
uuccccuaagcacacagggguuaaagcugugugucccucccaguggcuguggcagugacaguga

SEQ ID NO: 58420 - RNA, 64 nt, Homo Sapiens
cuuccugccuccugccccaaugucggugaucacacccucccaucagagagaacgugugugugug

SEQ ID NO: 58421 - RNA, 64 nt, Homo Sapiens
ggcuggcccaggaccgugggcaggcgcagugccccccucccaugcucccuucagcucugggagg

SEQ ID NO: 58422 - RNA, 64 nt, Homo Sapiens
cccccaaucuaccuggugauuauuuauuacccuccccucccacacugcccucagcccccgaccu

SEQ ID NO: 58423 - RNA, 64 nt, Homo Sapiens
cguccuggggaugcucagggcacggaagaccuggcccucccagccaucucaggcacuucugcau

SEQ ID NO: 58424 - RNA, 64 nt, Homo Sapiens
ccguuaccuaacuguacguccaaaugcacagucccccucccacuuauauauauauauauauaca

SEQ ID NO: 58425 - RNA, 64 nt, Homo Sapiens
caugaauccuuacucagcuaccaggccaggacagcccucccagcaaggcuucucuccaagugug

SEQ ID NO: 58426 - RNA, 64 nt, Homo Sapiens
caccugcacccuagcuucguggggcugggcaggacccucccacagcuccugguggggaauggcu

SEQ ID NO: 58427 - RNA, 64 nt, Homo Sapiens
cuuaguguucccucccucaaugggucuugcugugcccucccaggauccugaggacagaaaaagc

SEQ ID NO: 58428 - RNA, 64 nt, Homo Sapiens
cccugccuuggcaccgucacgggacacgcggcuucccucccaguccuugggugcaggcagggcu

SEQ ID NO: 58429 - RNA, 64 nt, Homo Sapiens
auugccuuccacauauguaagucucugggcggcgcccucccagcucccugccucuguuucccca

SEQ ID NO: 58430 - RNA, 64 nt, Homo Sapiens
acaaucaacucaagguacgcccacugcaaggccucccucccaccgcggccccugccuggccacc

SEQ ID NO: 58431 - RNA, 64 nt, Homo Sapiens
aacccgcccagccucccgcggggccacacacuuccccucccaacacacacacacaccugccauc

SEQ ID NO: 58432 - RNA, 64 nt, Homo Sapiens
gggacuugaggggggccccagggguucucaggaccccucccaccaccucccagugcuuccacgu

SEQ ID NO: 58433 - RNA, 64 nt, Homo Sapiens
ccucuucugagcacagauguucccccaucucgcucccucccaggacucugaccccagcauucuc

SEQ ID NO: 58434 - RNA, 64 nt, Homo Sapiens
ccggaaugccacccacaucuuccauuuccauguccccucccagagcugguggacccagggaaca

SEQ ID NO: 58435 - RNA, 64 nt, Homo Sapiens
ccgcaguauuucagggacagccugcccucguguucccucccagcgcuggggaggggcacaggac

SEQ ID NO: 58436 - RNA, 50 nt, Homo Sapiens
uccccucuguacauaggucacccucccaucuggugggagaccacgccuga

SEQ ID NO: 58437 - RNA, 64 nt, Homo Sapiens
uucuaggcgaauaguccccaagcaucuuccaucccccucccaccccugcauccccacacuucac

SEQ ID NO: 58438 - RNA, 64 nt, Homo Sapiens
ccuguggggaaacuguucccucugcauggccacccccucccagcggauucccccucaccccacc

SEQ ID NO: 58439 - RNA, 64 nt, Homo Sapiens
ccguuccacuccucccugcccgugccucccgcagcccucccaugcuugccccugaccccccugc

SEQ ID NO: 58440 - RNA, 64 nt, Homo Sapiens
ucccuuccuggccuggccggcucccccucgagaccccucccaugaguugggagaagcccagccc

SEQ ID NO: 58441 - RNA, 64 nt, Homo Sapiens
cccccuugcccaggccucccggcuccagggggugcccucccagacccgaugggauggcuugggg

SEQ ID NO: 58442 - RNA, 64 nt, Homo Sapiens
cccuccccgggcagcagagagcccaccccgccugcccucccaccgcaaacagcacaaggcguga

SEQ ID NO: 58443 - RNA, 64 nt, Homo Sapiens
uccccccauuccucaaauccuccucuacucccaccccucccaugccagugccucccucccuccu

SEQ ID NO: 58444 - RNA, 64 nt, Homo Sapiens
ccacuucugccuguuuuaaaccccagccccucagcccucccagccuuccucuuuccccacagcc

SEQ ID NO: 58445 - RNA, 64 nt, Homo Sapiens
cagccugcacuggagucugaggccugggaccccccccucccacccccuaacccauguuucucau

SEQ ID NO: 58446 - RNA, 64 nt, Homo Sapiens
ccuggcaagcugggggcccaucgccguggggagucccucccaccacccucgccgcaggcagcug

SEQ ID NO: 58447 - RNA, 64 nt, Homo Sapiens
gccuggaauggcccagaccccagccuccccuccucccucccauccucacccaggccaaggccca

SEQ ID NO: 58448 - RNA, 64 nt, Homo Sapiens
uuugcccccacaagccuggucaucagccaggcagcccucccagugcccaagggccaccaacccc

SEQ ID NO: 58449 - RNA, 64 nt, Homo Sapiens
cuccuuaccuuggucuuuucaauguugauaccuucccucccagguuauuuuuaguucaguuuaa

SEQ ID NO: 58450 - RNA, 64 nt, Homo Sapiens
uuuaguuccucaucacaaaaaauuuuuuuuucuccccucccaaagguggaauauuucauggaca

SEQ ID NO: 58451 - RNA, 64 nt, Homo Sapiens
guccaccaagggcuccugcucugggacugguauccccucccaggccggacagugccucacucac

SEQ ID NO: 58452 - RNA, 64 nt, Homo Sapiens
ucccuguguauaaauauuuaaucguguggcccuccccucccaccggcggggggcgcagcaacgc

SEQ ID NO: 58453 - RNA, 64 nt, Homo Sapiens
gccuggcagccauccagaggcucgugcugcccuucccucccacaaggcagagcccaaucagggu

SEQ ID NO: 58454 - RNA, 64 nt, Homo Sapiens
agcuggccgcccagcaggagcaggccaaucccuucccucccagagcucugcaggaugaggaaga

SEQ ID NO: 58455 - RNA, 64 nt, Homo Sapiens
auggccccaccugcucuuucaccugcucuuuccucccucccagucccugccgaggugugacccc

SEQ ID NO: 58456 - RNA, 64 nt, Homo Sapiens
cggcccagucugcacggcccaucugcuucaccuucccucccagccacgugccaguggccacagc

SEQ ID NO: 58457 - RNA, 64 nt, Homo Sapiens
cuguucccugggggccagccagggcccuuugugccccucccagcacaggccugaugcagguguc

SEQ ID NO: 58458 - RNA, 64 nt, Homo Sapiens
gcuggccaugugagcaccccaugaagggaccgcccccucccaaggauggucccuuugggugcag

SEQ ID NO: 58459 - RNA, 64 nt, Homo Sapiens
uaaccgucuguccuagccccucccuaaucccuggcccucccagcugucugggacuucaguggac

SEQ ID NO: 58460 - RNA, 64 nt, Homo Sapiens
gaagggacuacucucuucaccuuggaaaggggcucccucccagagcacccuuggccugaguaaa

SEQ ID NO: 58461 - RNA, 64 nt, Homo Sapiens
augggccagagcuucagcccuucagggaaugugucccucccaccgugccagggggcucagcugc

SEQ ID NO: 58462 - RNA, 64 nt, Homo Sapiens
caaacuccugaccucaagagauccacucgccuugcccucccaaagugcugggauuacaggcuug

SEQ ID NO: 58463 - RNA, 64 nt, Homo Sapiens
aagucaaaacuauagccauauccaaaucuuuucccccucccaagaguucucagugucuacaugu

SEQ ID NO: 58464 - RNA, 64 nt, Homo Sapiens
cccccaccaacucucgcguguuggagagaaggggcccucccagcacaaaguugcauuccucccc

SEQ ID NO: 58465 - RNA, 64 nt, Homo Sapiens
guggccugagggcugucgagugagcugccccagccccucccagcccuugcccagccugggggag

SEQ ID NO: 58466 - RNA, 64 nt, Homo Sapiens
gcugugcguuccugagggccgacagccagcuccgcccucccaagggagggaaggcggagcugag

SEQ ID NO: 58467 - RNA, 64 nt, Homo Sapiens
ccgucccagcauucgcacuuccgccagggcccaccccucccaccccccccugcuucaggaacac

SEQ ID NO: 58468 - RNA, 64 nt, Homo Sapiens
uguuauucaugcuauaaagaguaaacguuugaugaauuagaagagaugcucuuuuccaagcuau

SEQ ID NO: 58469 - RNA, 64 nt, Homo Sapiens
ucuguuacuguuuaauuucaauucuucuggugagaauuagaaaugaaauauuuuuuauucauug

SEQ ID NO: 58470 - RNA, 64 nt, Homo Sapiens
cgaggagacagaaacugaaucccacaccuggugcaauuagaagcauaauuagaagcagaagaac

SEQ ID NO: 58471 - RNA, 64 nt, Homo Sapiens
aacugaaucccacaccuggugcaauuagaagcauaauuagaagcagaagaacaaaaugccacgu

SEQ ID NO: 58472 - RNA, 64 nt, Homo Sapiens
augaggcaaaagaacuaagacuuuuuucaaacuaaauuagaaaggagugucauuauuugacugu

SEQ ID NO: 58473 - RNA, 64 nt, Homo Sapiens
uagcucauuacucuaccaccaagaaccuaaaaggaauuagaauacagcagaauuggccucagug

SEQ ID NO: 58474 - RNA, 64 nt, Homo Sapiens
guuaacauuuaagugcuuaucucaaagcagaaauaauuagaaauauuagaagucauuucuaguc

SEQ ID NO: 58475 - RNA, 64 nt, Homo Sapiens
cauuucuaguccucaaagcauuucaggucagcaaaauuagaaguuaaauacgaauguuaaaaca

SEQ ID NO: 58476 - RNA, 64 nt, Homo Sapiens
ggcaccaugguaucauauauuaaaacaauaaugcaauuagaauuugggagaagcaaauauaggu

SEQ ID NO: 58477 - RNA, 64 nt, Homo Sapiens
aacauuuaugugagguaauuauugcucaacagacaauuagaaaaaaguccacacuugaagccua

SEQ ID NO: 58478 - RNA, 64 nt, Homo Sapiens
gcuaaaaugcuaaucuuuacuaaauagugagcuaaauuagaauuucuaacucuuauauugugcu

SEQ ID NO: 58479 - RNA, 64 nt, Homo Sapiens
uuuuaaaggauuguuauuuacuacuuuggauuguaauuagaacaaugcacaucugucuuccaag

SEQ ID NO: 58480 - RNA, 64 nt, Homo Sapiens
uuaaacccuacccuuuaacuuauuauuauuguuuaauuagaauaccuugcauaguguagucauc

SEQ ID NO: 58481 - RNA, 64 nt, Homo Sapiens
auuuacauuuaaaaaaaauggaaaaaaggcccacaauuagaaaaaaauccucaagcaauaacaa

SEQ ID NO: 58482 - RNA, 64 nt, Homo Sapiens
aaguaugaauauuaauaaaaacuauaugaagguaaauuagaaauauccuuuugaaaaaguuaag

SEQ ID NO: 58483 - RNA, 64 nt, Homo Sapiens
uuucagaaugccaaaugaagccauuuuuguuuaaaauuagaacuugagaaauuuuucagaaagu

SEQ ID NO: 58484 - RNA, 64 nt, Homo Sapiens
accuggagccgccgcucaaaaggaggugccuccgaauuagaaaucagaauaaguaaaagguuug

SEQ ID NO: 58485 - RNA, 64 nt, Homo Sapiens
gacaaucucucuauaugcagagcccuuucaugauaauuagaaugguauggacaaaccaaugaaa

SEQ ID NO: 58486 - RNA, 64 nt, Homo Sapiens
caagugcaaaacagguguucuuaucuaaaacgucaauuagaaaauuaucugcgguuguuaaucu

SEQ ID NO: 58487 - RNA, 64 nt, Homo Sapiens
aacuggaauaagcucuaucauauucugaaacaagaauuagaaugacuugagaacgggcaaauaa

SEQ ID NO: 58488 - RNA, 64 nt, Homo Sapiens
uuaaaugggguguucacagugacuuggauacaccaauuagaaauuaaauaagcaaauauauaua

SEQ ID NO: 58489 - RNA, 64 nt, Homo Sapiens
uagcuucagaccaaauucaaauugaauuugaauaaauuagaaauacugugcauacauaaccuuc

SEQ ID NO: 58490 - RNA, 64 nt, Homo Sapiens
uucaugucaggcacaaggguuuagugaaacacaaaauuagaaugaagaaauauauuuauaaagc

SEQ ID NO: 58491 - RNA, 64 nt, Homo Sapiens
cuuuauuacuuacaaacucaguuuuucauguucuaauuagaauacucagagauguuaauaucau

SEQ ID NO: 58492 - RNA, 64 nt, Homo Sapiens
aagcagucuuaaagggucuuuugcagaugguacaaauuagaacaauuagaauauaguauuuuga

SEQ ID NO: 58493 - RNA, 64 nt, Homo Sapiens
uaaagggucuuuugcagaugguacaaauuagaacaauuagaauauaguauuuugaguucuagua

SEQ ID NO: 58494 - RNA, 64 nt, Homo Sapiens
cacaugcacgccgggauuccucugcugccauuugaauuagaagaaaauaauuuauaugcaugca

SEQ ID NO: 58495 - RNA, 64 nt, Homo Sapiens
aucaucucaauuuuuucaaaugaaaggauucucuaauuagaaauuuauaugucagagcuguuau

SEQ ID NO: 58496 - RNA, 64 nt, Homo Sapiens
ucuaggggaugaauagugguccccauaccuacugaauuagaaacauccagauucuggauccaua

SEQ ID NO: 58497 - RNA, 64 nt, Homo Sapiens
guaugaaagagguauaacacguucaauucauuuuaauuagaaaaagggaguccucagaguugca

SEQ ID NO: 58498 - RNA, 64 nt, Homo Sapiens
agaucuaaccuggcuuguuuagggccauaccacuaauuagaaaaucugugcuagaaccuguguc

SEQ ID NO: 58499 - RNA, 64 nt, Homo Sapiens
cuaaaauuuagaguauaaauugucuuauauuucaaauuagaaaaguucaaaugaaguuuaauug

SEQ ID NO: 58500 - RNA, 64 nt, Homo Sapiens
aauaagugauucaaaaugaaguuaauauaacauaaauuagaaaacauaauuuuaaauuuucuau

SEQ ID NO: 58501 - RNA, 64 nt, Homo Sapiens
gggcccaaagccagugagauuggucaauuugauaaauuagaauuucagaauauauuugccacca

SEQ ID NO: 58502 - RNA, 64 nt, Homo Sapiens
cacuuuacuaaauauaaguacaguaaugaugcauaauuagaaaaugagguauucuagguaaaau

SEQ ID NO: 58503 - RNA, 64 nt, Homo Sapiens
uaacuuuuguaacuucacuugauaguuuuuaagcaauuagaauggaguuagggaaagaacauau

SEQ ID NO: 58504 - RNA, 64 nt, Homo Sapiens
cuguauccauuaaaguaacuuuuuuaacuaugagaauuagaaaauaagggacaacagggguuaa

SEQ ID NO: 58505 - RNA, 64 nt, Homo Sapiens
uuuccaaacaaaucuuucuacgcuuaaaugaucaaauuagaaaaaccaauuccuauaauuaaua

SEQ ID NO: 58506 - RNA, 64 nt, Homo Sapiens
uuucuugugcuugcuucggcagcauauauacugaaauuagaaaaagaaaacuuuucuuuuuuau

SEQ ID NO: 58507 - RNA, 64 nt, Homo Sapiens
uuuaaaauggaaauaacaaagcaacuguuagaaaaauuagaaaauauucccaacucacaggcaa

SEQ ID NO: 58508 - RNA, 64 nt, Homo Sapiens
guaugaaauuaagaguuucaguaucaguuuuaaaaauuagaauuaauuuuaugacaucuauuau

SEQ ID NO: 58509 - RNA, 64 nt, Homo Sapiens
agguuuuuauuaguaccauaguaccauuuauacaaauuagaaaauguuauuuaacagcugaauu

SEQ ID NO: 58510 - RNA, 64 nt, Homo Sapiens
uauugcugagagaaauauggaacuuacauuguucaauuagaauaguguucugcaaaaauauuua

SEQ ID NO: 58511 - RNA, 64 nt, Homo Sapiens
aaacuugaaaaucagcuuuggccaucuaccugagaauuagaaagucugauuuuuggaauuagaa

SEQ ID NO: 58512 - RNA, 64 nt, Homo Sapiens
caucuaccugagaauuagaaagucugauuuuuggaauuagaaaucaugauuguaggcugggcac

SEQ ID NO: 58513 - RNA, 64 nt, Homo Sapiens
guuaacauuuaucuuuagguuccuccuuuuacagaauuagaaaacuacuuuacuaaauuaauac

SEQ ID NO: 58514 - RNA, 64 nt, Homo Sapiens
auauaugcuuacauuuuucaccaauucaaaaauaaauuagaaaagcugauucacagcuuauuau

SEQ ID NO: 58515 - RNA, 64 nt, Homo Sapiens
uugaaagaaaguguuaaaacugaaggccucacuuaauuagaaacgugauaaauauauggacaaa

SEQ ID NO: 58516 - RNA, 64 nt, Homo Sapiens
aacuugucaaacuugucaagaaugagaaaagccaaauuagaaaauccuauguccuaguuuccuu

SEQ ID NO: 58517 - RNA, 64 nt, Homo Sapiens
cccuauaugccucacucauaagcgauugccuggcccucccuaaggcuuguguugcagacacugg

SEQ ID NO: 58518 - RNA, 64 nt, Homo Sapiens
ccuguuugugugugauccuuggagcaggucaggcccucccuaggcaaguuggggacggagaugg

SEQ ID NO: 58519 - RNA, 64 nt, Homo Sapiens
aagcacugccucuacugggcucaccucaugucucccucccuacauuggauuuuugcaauugguu

SEQ ID NO: 58520 - RNA, 64 nt, Homo Sapiens
uugagaauccaccuacaggagcagucugggacacccucccuacuggagaauagucucauaccuu

SEQ ID NO: 58521 - RNA, 64 nt, Homo Sapiens
cucccugagagggccaagcagagaguacuggaaaccucccuaccaaaaagacagagacccgccc

SEQ ID NO: 58522 - RNA, 64 nt, Homo Sapiens
cugucugucccagauaaaggcgcuguucucccauccucccuaccccauccucuccaccaaaucg

SEQ ID NO: 58523 - RNA, 64 nt, Homo Sapiens
ccgccccugccagccaccaaggccucgagggugaccucccuacccccuagcacauggggacccc

SEQ ID NO: 58524 - RNA, 64 nt, Homo Sapiens
gggcuaucggccucuugggacugugugugugugaccucccuaccucuuuaccuccagggaucag

SEQ ID NO: 58525 - RNA, 64 nt, Homo Sapiens
ggauuggcuguccccucuauaggaaauccuuagcccucccuagaccgcucaggcuuuaucaguc

SEQ ID NO: 58526 - RNA, 64 nt, Homo Sapiens
uguugggauuauaggugugagccucccgccuuggccucccuaaggaacuccuggccacaagugu

SEQ ID NO: 58527 - RNA, 64 nt, Homo Sapiens
ccuuccagccugggacacacaccgccuggcccucccucccuagcaucuguccucacccuguggg

SEQ ID NO: 58528 - RNA, 64 nt, Homo Sapiens
cucggaaaucagugcgauguccgcuccugcuuccccucccuaccgcccagugccagcuccagug

SEQ ID NO: 58529 - RNA, 64 nt, Homo Sapiens
ucugaaaucaacucucuucggcauucuuccgcacccucccuagcucuugcucucgaccggcccu

SEQ ID NO: 58530 - RNA, 64 nt, Homo Sapiens
ucuuccccaucucacucuuaagauuacccccaguccucccuagcgggcaaagaguaaagauuaa

SEQ ID NO: 58531 - RNA, 64 nt, Homo Sapiens
gggcgugaggacacaaggaggccucugggccacgccucccuaccagaugcaggaacuccuggac

SEQ ID NO: 58532 - RNA, 64 nt, Homo Sapiens
agccauccuugcacucuccagcgacacucucgcaccucccuaggggaagcuucccucccccugg

SEQ ID NO: 58533 - RNA, 64 nt, Homo Sapiens
cacuccccgccguacaguucuccagaaucccaggcgaugacaagucugaacccacgaaaauacc

SEQ ID NO: 58534 - RNA, 64 nt, Homo Sapiens
guguuguuguguuugaaguaaaacuaguuguuaucgaugacaauuuuuaccauaguuuucucag

SEQ ID NO: 58535 - RNA, 64 nt, Homo Sapiens
gguccccagaggugcuccauggaaugccuggggauucacccaguauggacgagggcucuccaag

SEQ ID NO: 58536 - RNA, 64 nt, Homo Sapiens
uuucuucuucagaaggccuuccaacuccagugaauucacccauuagacccaaccccuagcuggg

SEQ ID NO: 58537 - RNA, 64 nt, Homo Sapiens
uaaucaagggugaagguaaacugauaaaucuauauucacccaaauucuagaaaguuauuuucaa

SEQ ID NO: 58538 - RNA, 64 nt, Homo Sapiens
ucagccucccaaagugcugggugaccgcaagcgauucacccaccgucaggcuagucucgaacuc

SEQ ID NO: 58539 - RNA, 64 nt, Homo Sapiens
uauuggcuuuacguaacaauauuguuccuguccauucacccagccaaauuguguuaaagaggaa

SEQ ID NO: 58540 - RNA, 64 nt, Homo Sapiens
gauaacucuguccuuccauuugcucacuucucucuucacccaucuuuuuuaaaaacaaauaaau

SEQ ID NO: 58541 - RNA, 64 nt, Homo Sapiens
auuguuaacacacuugugaugugucagccacagauucacccaggaggucacagaaugacagcaa

SEQ ID NO: 58542 - RNA, 63 nt, Homo Sapiens
ucuucauaaaacauuugaaaauaaaagaucauucuucacccauauguucuuuggauucuggca

SEQ ID NO: 58543 - RNA, 64 nt, Homo Sapiens
gaaagacuuccuggguuugacccuucuuuauagaagagugaaggcauccaacuucaugccaguu

SEQ ID NO: 58544 - RNA, 64 nt, Homo Sapiens
agaguaaugguguggaagugaauaaagggacuuaagagugaacaccuauauauucucugaaugc

SEQ ID NO: 58545 - RNA, 64 nt, Homo Sapiens
cugagaaaugucauaaaauacaauccagguucugagagugaaugcauugggcacuuuaaguuga

SEQ ID NO: 58546 - RNA, 64 nt, Homo Sapiens
ugugaagcaauuaaucgaauguuucagaaggagcagagugaauuaguagcacaaguaagugacu

SEQ ID NO: 58547 - RNA, 64 nt, Homo Sapiens
acuugcuuauauugacaacaaaucaucucgcuaaagagugaauguaggccaggcgcgguggcuc

SEQ ID NO: 58548 - RNA, 64 nt, Homo Sapiens
acuccgucucaaaaaaaaaaaaaaaaaaaaaaaaagagugaauguaauagucuugcagaaaaug

SEQ ID NO: 58549 - RNA, 64 nt, Homo Sapiens
uuagaggacaaauaaggugacagguacuaagagaagagugaauuaagugaaaaucuucccuuug

SEQ ID NO: 58550 - RNA, 64 nt, Homo Sapiens
agagaucgugccauugcacuccagccugggaacaagagugaaacucucaaaagcagaaacaaaa

SEQ ID NO: 58551 - RNA, 64 nt, Homo Sapiens
aaaaauugcaaaucuacagcaaaaguaaaacaguagagugaacaccauguaacccucaccuggu

SEQ ID NO: 58552 - RNA, 64 nt, Homo Sapiens
gcugagaugccaccaccacaccagccugggugacagagugaaacucguaucuccaaacaaacaa

SEQ ID NO: 58553 - RNA, 64 nt, Homo Sapiens
gaagaaaaagauauguaaggucuuuuagcuccuuagagugaagcaaaagcaagacuucaaccuc

SEQ ID NO: 58554 - RNA, 64 nt, Homo Sapiens
ucuacagauaauuaguggauuguguuguuuguugagagugaagguuucuuggcaucuggugccu

SEQ ID NO: 58555 - RNA, 64 nt, Homo Sapiens
cucuacuacaugugacuggcccacacacaguuacagagugaacagguaggauaucuuggcuuug

SEQ ID NO: 58556 - RNA, 64 nt, Homo Sapiens
aggugugacuugaacuagauaaggaagaagucuaagagugaaguuugcagggaagccccacuug

SEQ ID NO: 58557 - RNA, 64 nt, Homo Sapiens
gaacacgcauacaggcucuagucaagaaugaauuagagugaaggaaagcugugugacaccuggc

SEQ ID NO: 58558 - RNA, 64 nt, Homo Sapiens
acagaguuauauuuccucacaaacuucuuugugaagagugaaauguguuucuguaccucugggu

SEQ ID NO: 58559 - RNA, 59 nt, Homo Sapiens
uuggauaccuguaucucuaaguguugcucagagugaagagugaagagcauuugguacac

SEQ ID NO: 58560 - RNA, 64 nt, Homo Sapiens
ggauaccuguaucucuaaguguugcucagagugaagagugaagagcauuugguacacacuugac

SEQ ID NO: 58561 - RNA, 64 nt, Homo Sapiens
guguuucuguaccucuggguaaacuucuuugugaagagugaaauacagaguuauauuuccucac

SEQ ID NO: 58562 - RNA, 64 nt, Homo Sapiens
aaagcugugugacaccuggcgucaagaaugaauuagagugaagggaacaggcauacaggcucua

SEQ ID NO: 58563 - RNA, 64 nt, Homo Sapiens
acguuuuuguaccucucauuaaacuucuuuacgaagagugaaaugcagaguuguauuuccucac

SEQ ID NO: 58564 - RNA, 64 nt, Homo Sapiens
aaagcugugugacaccuggcgucaagaaugaauuagagugaaggaaacaggcauacaggcucua

SEQ ID NO: 58565 - RNA, 64 nt, Homo Sapiens
agacuuugugcagcaggaaaguaucgaaaagaugagagugaaggcuucugcccugccugacgau

SEQ ID NO: 58566 - RNA, 64 nt, Homo Sapiens
uccaccucaaaaaaaaaaaacagccugggcgacaagagugaaacaagaucauacuacugcacuc

SEQ ID NO: 58567 - RNA, 64 nt, Homo Sapiens
cacaugcuacaaugaggcagagagugaaaacacuagagugaaaacauucauaaacacagagugu

SEQ ID NO: 58568 - RNA, 64 nt, Homo Sapiens
cacuagagugaaaacacauguaaacacagaguguagagugaaaauagcucaggcuauucauuca

SEQ ID NO: 58569 - RNA, 64 nt, Homo Sapiens
gaccagcaugggggcagguuaucuguuggccugaagagugaaaccuguaccaggccaaagguga

SEQ ID NO: 58570 - RNA, 64 nt, Homo Sapiens
ugagggcgugagugagggcaggaguguuuauggcagagugaaguucugugcccaccacaagagg

SEQ ID NO: 58571 - RNA, 64 nt, Homo Sapiens
ugcagaaccagggguuuauauugcagggaguguauuuucugaauucuaagucagaacaagcagu

SEQ ID NO: 58572 - RNA, 64 nt, Homo Sapiens
uggagcaccucggccugggacccucaguguaggguuuucugacucuuaggcaacuuccuagggu

SEQ ID NO: 58573 - RNA, 64 nt, Homo Sapiens
aacuuucuucucuuccccuuccccacccgaauucuuuucugaaguugcuggcauuugggucaag

SEQ ID NO: 58574 - RNA, 64 nt, Homo Sapiens
caaauuuggaggaaacaacugaaguugugcaauauuuucugauaauugcuuuuuuuauucuugu

SEQ ID NO: 58575 - RNA, 51 nt, Homo Sapiens
augaugaagcuaacacuugaauuuucugaagucuagcuuaacaucuuuggu

SEQ ID NO: 58576 - RNA, 64 nt, Homo Sapiens
ccuuuuugaaucgagguuuuuuuguuuuguuuuguuuucugaaaaaaucauacaacuuugugcu

SEQ ID NO: 58577 - RNA, 64 nt, Homo Sapiens
uuuuuuuuaacaucucuuucccauucugaauuuuuuuucugaaucgcaagcuuugagugggaca

SEQ ID NO: 58578 - RNA, 64 nt, Homo Sapiens
cuuggauuaauucaugguauuuuuuuuuuaauuauuuucugagaaccucaucgggauugucuuu

SEQ ID NO: 58579 - RNA, 64 nt, Homo Sapiens
uagacauacagagauauacaaauauauuauauauuuuucugagauuuuugauaucucaaucugc

SEQ ID NO: 58580 - RNA, 64 nt, Homo Sapiens
aagaagugaguugugucaauuauuguagauacaauuuucugauuaaaucuggaaaaauaaaagg

SEQ ID NO: 58581 - RNA, 64 nt, Homo Sapiens
cuauauauaguaggaggggguaugugucucaggcuuuucugaaguugcaagacuuaaagaaaua

SEQ ID NO: 58582 - RNA, 64 nt, Homo Sapiens
auuuaagacauccaaucaauaaugaaggaaauuuuuuucugaauguagguuugagugaggggca

SEQ ID NO: 58583 - RNA, 64 nt, Homo Sapiens
ucuauaauccuucagcagaacaggguccuagaauuuuucugauuaaaauaagcaaguuaagcuu

SEQ ID NO: 58584 - RNA, 64 nt, Homo Sapiens
cccacaucugccaucauuucucccgucuuguguuuuuucugaaccuuuuuuccccucuuccccu

SEQ ID NO: 58585 - RNA, 64 nt, Homo Sapiens
acuuccaaagauuaaucaaaaaugagcauuaauguuuucugaacucaugguuaccccauuuguu

SEQ ID NO: 58586 - RNA, 64 nt, Homo Sapiens
ugaaaacauauuaauuaaacauguaaaaacauuuuuuucugagaacaugaaugaacaggaaaag

SEQ ID NO: 58587 - RNA, 64 nt, Homo Sapiens
auuuuaguacagaauuaguacaaagcuuguuaucuuuucugaccguauaauuuuacacaguacu

SEQ ID NO: 58588 - RNA, 64 nt, Homo Sapiens
aacucuugacucuugcuccuugacuuaaaggcaguuuucugaagaauguuuuguuccuuugucc

SEQ ID NO: 58589 - RNA, 64 nt, Homo Sapiens
gguaauaaugucuaaaucuuucaccauuuagcaauuuucugaauuaugaauuuuacauuuuucc

SEQ ID NO: 58590 - RNA, 64 nt, Homo Sapiens
ucugaggaacaaugccuuaauuuuuguggcuggguuuucugaaguuuuuuauugcucuggugga

SEQ ID NO: 58591 - RNA, 64 nt, Homo Sapiens
acugcuuuacauagaccucuacaaguagggaauguuuucugaagcagaaguuaaaauggacagc

SEQ ID NO: 58592 - RNA, 64 nt, Homo Sapiens
uuuaccugaugucauuguuucuuauaauaaaaccuuuucugauugaaaacuuccaguguugcaa

SEQ ID NO: 58593 - RNA, 64 nt, Homo Sapiens
caauuccacaagcaaaagcucuaauuuaaccagauuuucugacauugaaggcuuauuuucccca

SEQ ID NO: 58594 - RNA, 64 nt, Homo Sapiens
gaaagcaucucacauugguuuucuuucuuguaucuuuucugaaacuccuugcuguaaggcagcu

SEQ ID NO: 58595 - RNA, 64 nt, Homo Sapiens
gcuguuucaaucuaaaauagcugaaauguacuuuuuuucugaauuaaauccugaugcugaccau

SEQ ID NO: 58596 - RNA, 64 nt, Homo Sapiens
uuuuuaaagucuaacaaaucguauuaguuuuugcuuuucugagcuaaugacauuuuuauuuugu

SEQ ID NO: 58597 - RNA, 64 nt, Homo Sapiens
ccuuaugcucuuuuaaagcccuuuguagaauauuuuuucugaaugcaauaguugauuuugaugc

SEQ ID NO: 58598 - RNA, 64 nt, Homo Sapiens
ugaugcauauuuuaagacucaagaggggcaaguguuuucugaaauuuuggguuuuuuuuuuuuu

SEQ ID NO: 58599 - RNA, 64 nt, Homo Sapiens
uguaaugagcagggggauugaucuguagcugggauuuucugacuauccacuuauccaucuuaag

SEQ ID NO: 58600 - RNA, 64 nt, Homo Sapiens
acuuauuccugaugaucaauuuuuccgccuguguuuuucugagauauuugggauucuugcuuau

SEQ ID NO: 58601 - RNA, 64 nt, Homo Sapiens
gguauccauuuuguaggcuuuuuuaaguauauacuuuucugaaauuauccugacgucuuggguc

SEQ ID NO: 58602 - RNA, 64 nt, Homo Sapiens
cuuuuguuuuauaaaagcucuagauaaaacuuucuuuucugaucaugaaucaaguaucuguggu

SEQ ID NO: 58603 - RNA, 64 nt, Homo Sapiens
uacuacuuaaugauuuuggugcaggaaccugagauuuucugauuuauauuucaugauauuucac

SEQ ID NO: 58604 - RNA, 64 nt, Homo Sapiens
uccuauuuuauaaugauacaauugcaguagcuaauuuucugauuauauuuuuuaccauaugaaa

SEQ ID NO: 58605 - RNA, 64 nt, Homo Sapiens
acauacugaucuuucauaauuguuuagcaccccguuuucugaguugggaucugagacuuuucuu

SEQ ID NO: 58606 - RNA, 64 nt, Homo Sapiens
ucugaauucaauuacaauuucuuuuacuucacaauuuucugaaguaauauuucuccaucauggc

SEQ ID NO: 58607 - RNA, 64 nt, Homo Sapiens
aggauaccaaagugcgauaauugagauuuuuuuuuuuucugaaacaugcuuauguuuauaaguu

SEQ ID NO: 58608 - RNA, 64 nt, Homo Sapiens
gcuacccauaaaaucacuuuucagugcaguacauuuuucugaaacaagacagaacuuugucacu

SEQ ID NO: 58609 - RNA, 64 nt, Homo Sapiens
uaccauuuuuucaagaauguaauugguuuuuguguuuucugaaugcuuggggauuauuuuaaau

SEQ ID NO: 58610 - RNA, 64 nt, Homo Sapiens
cugcaaucauuccuuugacauauuacaaagcacauuuucugaauauacuuuauguuaacagggu

SEQ ID NO: 58611 - RNA, 64 nt, Homo Sapiens
gcagaaaacguucagauuuuaugguacacuagaauuuucugaaaaagaaauaucuaagcuguac

SEQ ID NO: 58612 - RNA, 64 nt, Homo Sapiens
auuuuaacacacagaagugcaacuuucugcuuuauuuucugaauuucacauuacuuuuacuuaa

SEQ ID NO: 58613 - RNA, 64 nt, Homo Sapiens
gcucucaaacacuaaaguccuuaauggcaaggucuuuucugauagcuucauggauaguauugau

SEQ ID NO: 58614 - RNA, 64 nt, Homo Sapiens
uuagcucagggccugacuguauuuuucauccaucuuuucugaagugucuuugggcaguauguag

SEQ ID NO: 58615 - RNA, 64 nt, Homo Sapiens
cuacuuugauuugggguuuugauuaauucuuuauuuuucugaaaaaaaguuuaaauaaugucug

SEQ ID NO: 58616 - RNA, 64 nt, Homo Sapiens
aaaggauauuaguuacccaagagauccaauuuguuuuucugaugaauaguguucaguaaaauga

SEQ ID NO: 58617 - RNA, 64 nt, Homo Sapiens
cccuuuaacuucuagguuuuguucaagaaguucauuuucugaguaaaagguauuuucauauaug

SEQ ID NO: 58618 - RNA, 64 nt, Homo Sapiens
cugacuugcucuagggugcuaucuuucuaaaucauuuucugaagugccccugacucuuacauuu

SEQ ID NO: 58619 - RNA, 64 nt, Homo Sapiens
auuuuuuugaagauuaauuuggaaacaaagaauauuuucugaaguacuaaacucuaccaagaau

SEQ ID NO: 58620 - RNA, 64 nt, Homo Sapiens
caguuuuguuuggaccaaaauugaauuuauuggcuuuucugaucaaaauuggggauucuuaaag

SEQ ID NO: 58621 - RNA, 64 nt, Homo Sapiens
gaggaagccugauuaaagaaauugugcgcuaaacuuuucugauagaagugagugaguugggugu

SEQ ID NO: 58622 - RNA, 64 nt, Homo Sapiens
uaagcuuuuaaaauaauucaauggauauacauuuuuuucugaagauuaagauuuuaauuauuca

SEQ ID NO: 58623 - RNA, 64 nt, Homo Sapiens
auuuuucuuaauuguuauuuuuuauaaucauuauuuuucugaaccauucuucuggccucagaag

SEQ ID NO: 58624 - RNA, 64 nt, Homo Sapiens
caguuagcugcugaacaguaugaugauuuggggauuuucugaaucauuuguacuuagauacugg

SEQ ID NO: 58625 - RNA, 64 nt, Homo Sapiens
caugcuguccuugaagcagcuauuugaagauguguuuucugaggaaaacaggcuacaacuguuu

SEQ ID NO: 58626 - RNA, 64 nt, Homo Sapiens
gcaguauagggaacaugaauggaccagggauugcuuuucugaaguuguuacaugaauaauuugu

SEQ ID NO: 58627 - RNA, 64 nt, Homo Sapiens
ccagaucaaacuguuaccuuaauauguggccuccuuuucugaaguugaguaaaaugagaaaguu

SEQ ID NO: 58628 - RNA, 64 nt, Homo Sapiens
cuguaaagaauauauccagugugcauauuuuuacuuuucugauaacgucuucucugccuuguua

SEQ ID NO: 58629 - RNA, 64 nt, Homo Sapiens
gagagaguccaggagggauguuguggaugacuucuuuucugaugauuggaauguuuuuccccga

SEQ ID NO: 58630 - RNA, 64 nt, Homo Sapiens
ccuuaaacuuuuuuagcaugauuauaaauuuuaguuuucugaacuuaaguauaaccauguaaga

SEQ ID NO: 58631 - RNA, 64 nt, Homo Sapiens
uuacuauuuuaagggccagaauuacuuauuuuaauuuucugacuuuuaaguauuuuaaguauau

SEQ ID NO: 58632 - RNA, 64 nt, Homo Sapiens
cagaaacaggacugcucaaaugauccuauuuguauuuucugaugcuaucagacucuaauguuuu

SEQ ID NO: 58633 - RNA, 64 nt, Homo Sapiens
cugcgacugaaacaaacagguucauagagaugaauuuucugagaaacauauaucuacauguugu

SEQ ID NO: 58634 - RNA, 64 nt, Homo Sapiens
cagcccucauuguuuuaggaaucucucucagguuuuuucugaccuaaaccagcaggaagucguc

SEQ ID NO: 58635 - RNA, 64 nt, Homo Sapiens
cugggcuguaagcaccaucacuugcuuuuuuuuuuuuucugauuucacaagugugguguuuucc

SEQ ID NO: 58636 - RNA, 64 nt, Homo Sapiens
aaggcccuuuccuuuggaacaagacagccuucacuuuucugaguucuugaagcauuucaaagcc

SEQ ID NO: 58637 - RNA, 64 nt, Homo Sapiens
agcuuuacgcucaucaccuaaacuuguacuuuauuuuucugauagaaaugguuuccucuggauc

SEQ ID NO: 58638 - RNA, 64 nt, Homo Sapiens
guuuccuuuauagagugucuuuucuuuguuaaauuuuucugauucuuucuucuuaaccuauuua

SEQ ID NO: 58639 - RNA, 64 nt, Homo Sapiens
gaaagugcauaugaaauccuuuugcuuuucaggguuuucugagggugugacauuccaggggucg

SEQ ID NO: 58640 - RNA, 64 nt, Homo Sapiens
cuuagaguaacagugcuuuuccugacugaaaaccuuuucugagaaggaccaggagccuccauau

SEQ ID NO: 58641 - RNA, 64 nt, Homo Sapiens
uggaguuucacucuuguugcgucuuuuuuuuuuuuuuucugagaaugugccuuaccuccagaga

SEQ ID NO: 58642 - RNA, 64 nt, Homo Sapiens
uuguuuucuuuggcguaucuaaccccuucuuuuguuuucugagaccugguaacccacgcucuug

SEQ ID NO: 58643 - RNA, 64 nt, Homo Sapiens
agggauguaaccacauccacucagaggacacuacuuuucugaaagcucuggggugacuaaugau

SEQ ID NO: 58644 - RNA, 64 nt, Homo Sapiens
uuuggcauccuacauaauaccccccuucuugacuuuuucugauaauuagcugauauucaugguu

SEQ ID NO: 58645 - RNA, 64 nt, Homo Sapiens
uuuguauaagcacuccuugaagaauaucuaagcuuuuucugagaugggcuuuuaaaauuauaau

SEQ ID NO: 58646 - RNA, 64 nt, Homo Sapiens
aacauuuuuuuccaauuucuacucaagaaaguuuuuuucugaaugugcuacaggaaacaagcac

SEQ ID NO: 58647 - RNA, 64 nt, Homo Sapiens
uuaauauaaagaguaucaaaaugagagagcuuucuuuucugagguaaaagaaaaaaauguucaa

SEQ ID NO: 58648 - RNA, 64 nt, Homo Sapiens
aaacuuuugcaauaaaaaaauuacauuuaaaaaguuuucugaaaagauucaggugguuuauuaa

SEQ ID NO: 58649 - RNA, 64 nt, Homo Sapiens
uuuacuccuacgguaaaucaugcagacuucacauuuuucugaccauaacucauguggacuucaa

SEQ ID NO: 58650 - RNA, 64 nt, Homo Sapiens
uaauuacuuuagcugcacuagacaauugauauguuuuucugauauacuguccgguggacaaaau

SEQ ID NO: 58651 - RNA, 64 nt, Homo Sapiens
uuaauguacucuuggagcccacuauaccacuauuuuuucugagaagaagcaaaucccuguggag

SEQ ID NO: 58652 - RNA, 64 nt, Homo Sapiens
uauuuaauaagagguauagacugcauaugaagcauuuucugauauagcaccuuagcuaauuaau

SEQ ID NO: 58653 - RNA, 64 nt, Homo Sapiens
uuuaaauugacaagcaaugugauuuguacaaauuuuuucugaaauccauggauuauuuuuauau

SEQ ID NO: 58654 - RNA, 64 nt, Homo Sapiens
ucuugggcacaucuguggccaucgcuggguccauuuuucugacugugaaguaaggagagacguc

SEQ ID NO: 58655 - RNA, 64 nt, Homo Sapiens
cagaaauagugugagccacauaugugacuuuaaauuuucugacagucacauuucaaaaaguaaa

SEQ ID NO: 58656 - RNA, 64 nt, Homo Sapiens
uuuucccagauuuacaagccacuggagaccccuuuuuucugauacaaugcacgauucucugcgc

SEQ ID NO: 58657 - RNA, 64 nt, Homo Sapiens
aauucuuaucucuagcuugguuuccacaugagguuuuucugagaagggcuugggacaagaaguc

SEQ ID NO: 58658 - RNA, 64 nt, Homo Sapiens
uuuaaaagucaaguuuaauuucaaaaaaccuuuuuuuucugagauuacuuuugggguaauauuu

SEQ ID NO: 58659 - RNA, 64 nt, Homo Sapiens
caucuauuugaaaacauuacacaucuauguaaaauuuucugauucguucauacaaaauggucuu

SEQ ID NO: 58660 - RNA, 64 nt, Homo Sapiens
uauuuucuuaagugccaauguugaagccauauuauuuucugauuauucauauuuauuuguccac

SEQ ID NO: 58661 - RNA, 64 nt, Homo Sapiens
uggaaguauccuuucaaaaauuuugaucuucuuguuuucugacuuauucuggaaaaaccuauug

SEQ ID NO: 58662 - RNA, 64 nt, Homo Sapiens
agugaacaauucuguuaaaauaugauaaagacaauuuucugaaaauuaaguagaguagcuucuu

SEQ ID NO: 58663 - RNA, 64 nt, Homo Sapiens
ucuaaaaggaacugaccaucaggucaucauuugauuuucugaaauugcaaauuaagggaaauuu

SEQ ID NO: 58664 - RNA, 64 nt, Homo Sapiens
uacaaagcuugauuaccauaaaugggauguuuuauuuucugauguuaauaaauauuuguuuaau

SEQ ID NO: 58665 - RNA, 64 nt, Homo Sapiens
uguuuuaaaauagaaguacauauaacauauauuuuuuucugaaacuuuugaguaagaguauugc

SEQ ID NO: 58666 - RNA, 64 nt, Homo Sapiens
gcuuuuuuuuuuuuuggugguuauuugugagaaauuuucugagggauaucaggcauuaguugcc

SEQ ID NO: 58667 - RNA, 64 nt, Homo Sapiens
cagcuuuaagucauucaagagaaccucaggcuguuuuucugacagugaugauaugauauacaga

SEQ ID NO: 58668 - RNA, 64 nt, Homo Sapiens
guguuccuaauuugguauuacauguauucuauuuuuuucugaaugauagcaugaaaagugucaa

SEQ ID NO: 58669 - RNA, 64 nt, Homo Sapiens
gccuuaggcacaggugguuuugaaaucuggggcuuuuucugauuuauuuuucugacuuguuggg

SEQ ID NO: 58670 - RNA, 64 nt, Homo Sapiens
gugguuuugaaaucuggggcuuuuucugauuuauuuuucugacuuguugggggagagaauauuc

SEQ ID NO: 58671 - RNA, 64 nt, Homo Sapiens
cuuucugaaucuggacaaagucgacuuaacagauuuuucugaugagcauguuuuaugaauccuc

SEQ ID NO: 58672 - RNA, 64 nt, Homo Sapiens
uuacuuaaucucuuccccuauccuucuaaauuaauuuucugaaguuggaguguagucuuuuccc

SEQ ID NO: 58673 - RNA, 64 nt, Homo Sapiens
aauaaaugcuauggcuuaucacaguuacaauguguuuucugaaaguaaagauuauuuuaccuug

SEQ ID NO: 58674 - RNA, 64 nt, Homo Sapiens
cuggaugaauuuuauaaaaugaauuuuguaauuuuuuucugagaaaaaaaaguucuuaaauaca

SEQ ID NO: 58675 - RNA, 64 nt, Homo Sapiens
uguaaagaucuuuugccuucaaauuuggcuuauuuuuucugauuuaugaggguuugaaagaaag

SEQ ID NO: 58676 - RNA, 64 nt, Homo Sapiens
uaaucaggguagcauuaaaauggagaaaagaaaguuuucugaaaaaaugcaguaaauauaagcc

SEQ ID NO: 58677 - RNA, 64 nt, Homo Sapiens
auuaagugaaaagcaaguucucagcauuuucauuuuuucugaaucuaagagggaaaacugcauc

SEQ ID NO: 58678 - RNA, 64 nt, Homo Sapiens
cagacguuucuuuuaguaagaguucucaucuuuguuuucugaaaaaugcagucauuugcacgug

SEQ ID NO: 58679 - RNA, 64 nt, Homo Sapiens
ggacugugcuguuuccuccgcccccacucccguguuuucugaccuccugccugaguuuggggua

SEQ ID NO: 58680 - RNA, 64 nt, Homo Sapiens
ccugccugaguuugggguauuuauagacuauuaauuuucugacugagccaauagugguugggga

SEQ ID NO: 58681 - RNA, 64 nt, Homo Sapiens
ggauugaagaguucuaagcauaaaauaaguggcauuuucugacuucuuccuccuccuccuuccc

SEQ ID NO: 58682 - RNA, 64 nt, Homo Sapiens
uuuaucucaaaaugccgaacgagaaaacuguccauuuucugagacccccagaaaggaaacugac

SEQ ID NO: 58683 - RNA, 64 nt, Homo Sapiens
ugucaacuccuuggggugcugaucucgaguguuauuuucugauugugguguugagaguugcacu

SEQ ID NO: 58684 - RNA, 64 nt, Homo Sapiens
cccugcucuugguucuccucuagauugaaguuuguuuucugaugcuguucuuaccagauuaaaa

SEQ ID NO: 58685 - RNA, 64 nt, Homo Sapiens
ugguuuuaauaaaauaauaaaauuuccccuaaucuuuucugaaucuucugaaaccaaauguaac

SEQ ID NO: 58686 - RNA, 64 nt, Homo Sapiens
uaucguccagugacuuucaggaauugcccauuguuuuucugauauguuuguacaagauugucau

SEQ ID NO: 58687 - RNA, 64 nt, Homo Sapiens
agaauguacgaggugugccauaaaugccuucguguuuucugagcgugcauaauugaguuuucua

SEQ ID NO: 58688 - RNA, 64 nt, Homo Sapiens
accucccuuacugaagcauuguucaaggacauauuuuucugaauaggauguuagaaaugucuua

SEQ ID NO: 58689 - RNA, 64 nt, Homo Sapiens
aucagccccuaauaggacaacaguugauuauauauuuucugaauuuauccuguuaucacaccaa

SEQ ID NO: 58690 - RNA, 64 nt, Homo Sapiens
guauaguguauaaaugugguauauucuaaaauauuuuucugacauaagcuauucacgacucaaa

SEQ ID NO: 58691 - RNA, 64 nt, Homo Sapiens
uuacugguuuucuuuucccuccagauggaaauuguuuucugaugugaugccagucagagccagg

SEQ ID NO: 58692 - RNA, 64 nt, Homo Sapiens
uucauuauguggacuggauggugguaaauggucuuuuucugacuuuuguagaaagcacagauaa

SEQ ID NO: 58693 - RNA, 64 nt, Homo Sapiens; identical to SEQ ID NO: 53190

SEQ ID NO: 58694 - RNA, 64 nt, Homo Sapiens; identical to SEQ ID NO: 53191

SEQ ID NO: 58695 - RNA, 64 nt, Homo Sapiens; identical to SEQ ID NO: 53192

SEQ ID NO: 58696 - RNA, 64 nt, Homo Sapiens; identical to SEQ ID NO: 53193

SEQ ID NO: 58697 - RNA, 64 nt, Homo Sapiens; identical to SEQ ID NO: 53194

SEQ ID NO: 58698 - RNA, 64 nt, Homo Sapiens; identical to SEQ ID NO: 53195

SEQ ID NO: 58699 - RNA, 64 nt, Homo Sapiens; identical to SEQ ID NO: 53196

SEQ ID NO: 58700 - RNA, 64 nt, Homo Sapiens; identical to SEQ ID NO: 53197

SEQ ID NO: 58701 - RNA, 64 nt, Homo Sapiens; identical to SEQ ID NO: 53198

SEQ ID NO: 58702 - RNA, 64 nt, Homo Sapiens; identical to SEQ ID NO: 53199

SEQ ID NO: 58703 - RNA, 64 nt, Homo Sapiens; identical to SEQ ID NO: 53200

SEQ ID NO: 58704 - RNA, 64 nt, Homo Sapiens; identical to SEQ ID NO: 53201

SEQ ID NO: 58705 - RNA, 64 nt, Homo Sapiens; identical to SEQ ID NO: 53202

SEQ ID NO: 58706 - RNA, 64 nt, Homo Sapiens; identical to SEQ ID NO: 53203

SEQ ID NO: 58707 - RNA, 64 nt, Homo Sapiens; identical to SEQ ID NO: 53204

SEQ ID NO: 58708 - RNA, 64 nt, Homo Sapiens; identical to SEQ ID NO: 53205

SEQ ID NO: 58709 - RNA, 64 nt, Homo Sapiens; identical to SEQ ID NO: 53206

SEQ ID NO: 58710 - RNA, 64 nt, Homo Sapiens; identical to SEQ ID NO: 53207

SEQ ID NO: 58711 - RNA, 64 nt, Homo Sapiens; identical to SEQ ID NO: 53208

SEQ ID NO: 58712 - RNA, 64 nt, Homo Sapiens; identical to SEQ ID NO: 53209

SEQ ID NO: 58713 - RNA, 64 nt, Homo Sapiens; identical to SEQ ID NO: 53210

SEQ ID NO: 58714 - RNA, 64 nt, Homo Sapiens; identical to SEQ ID NO: 53211

SEQ ID NO: 58715 - RNA, 64 nt, Homo Sapiens; identical to SEQ ID NO: 53212

SEQ ID NO: 58716 - RNA, 64 nt, Homo Sapiens; identical to SEQ ID NO: 53213

SEQ ID NO: 58717 - RNA, 64 nt, Homo Sapiens; identical to SEQ ID NO: 53214

SEQ ID NO: 58718 - RNA, 64 nt, Homo Sapiens; identical to SEQ ID NO: 53215

SEQ ID NO: 58719 - RNA, 64 nt, Homo Sapiens; identical to SEQ ID NO: 53216

SEQ ID NO: 58720 - RNA, 64 nt, Homo Sapiens; identical to SEQ ID NO: 53217

SEQ ID NO: 58721 - RNA, 64 nt, Homo Sapiens; identical to SEQ ID NO: 53218

SEQ ID NO: 58722 - RNA, 64 nt, Homo Sapiens; identical to SEQ ID NO: 53219

SEQ ID NO: 58723 - RNA, 64 nt, Homo Sapiens; identical to SEQ ID NO: 53220

SEQ ID NO: 58724 - RNA, 64 nt, Homo Sapiens; identical to SEQ ID NO: 53221

SEQ ID NO: 58725 - RNA, 64 nt, Homo Sapiens; identical to SEQ ID NO: 53222

SEQ ID NO: 58726 - RNA, 64 nt, Homo Sapiens; identical to SEQ ID NO: 53223

SEQ ID NO: 58727 - RNA, 64 nt, Homo Sapiens; identical to SEQ ID NO: 53224

SEQ ID NO: 58728 - RNA, 64 nt, Homo Sapiens; identical to SEQ ID NO: 53225

SEQ ID NO: 58729 - RNA, 64 nt, Homo Sapiens; identical to SEQ ID NO: 53226

SEQ ID NO: 58730 - RNA, 64 nt, Homo Sapiens; identical to SEQ ID NO: 53227

SEQ ID NO: 58731 - RNA, 64 nt, Homo Sapiens; identical to SEQ ID NO: 53228

SEQ ID NO: 58732 - RNA, 64 nt, Homo Sapiens; identical to SEQ ID NO: 53229

SEQ ID NO: 58733 - RNA, 64 nt, Homo Sapiens; identical to SEQ ID NO: 53230

SEQ ID NO: 58734 - RNA, 64 nt, Homo Sapiens
auauccuucauucagggcauuuccccaacaucaacaucaacaugaccauuuuucaaguuaucuu

SEQ ID NO: 58735 - RNA, 64 nt, Homo Sapiens
aacaugauauccuucauucauaucuuuuccccaacaucaacaucgccacuaccauuuuucaagu

SEQ ID NO: 58736 - RNA, 64 nt, Homo Sapiens
uguacaacgccuccaaggccaggagcaaaaccuacaucaacaugcgggaggugucccagcgcuu

SEQ ID NO: 58737 - RNA, 64 nt, Homo Sapiens
uuuucaaacacuaugacacagaccaguccggcaccaucaacagcuacgagaugcgaaaugcagu

SEQ ID NO: 58738 - RNA, 64 nt, Homo Sapiens
uguuuuauuaccgaagacaauugguugcuguuaccaucaacaucccugaaacguauauguacuu

SEQ ID NO: 58739 - RNA, 64 nt, Homo Sapiens
agcuaaauauagcugauauaaagauacagcuacucaucaacaucuaugauuuuuaaaacauuuu

SEQ ID NO: 58740 - RNA, 60 nt, Homo Sapiens
uguaaagcaauaugauuuguuacuauaauuaaccuguauaaaagauacauuuuauggugg

SEQ ID NO: 58741 - RNA, 60 nt, Homo Sapiens
cugagacaaggcaagucccuuccacuuaugaaccuguaaaaucaaaaguaaacuaguuac

SEQ ID NO: 58742 - RNA, 60 nt, Homo Sapiens
uacagauucuuccuguaaacuucuuucugcaaccuguacuuguaaauagcacuaaacguu

SEQ ID NO: 58743 - RNA, 60 nt, Homo Sapiens
aauaugaaagauuuuuauaucuuucaucuaaaccuguaaacagcacuaaagcaugagcua

SEQ ID NO: 58744 - RNA, 60 nt, Homo Sapiens
ccuugaaguucuuugaccuccucaauucacaaccuguagcugacuuuagccacccacaag

SEQ ID NO: 58745 - RNA, 60 nt, Homo Sapiens
acaguuuucuuaaucaaaaguggucuagguaaccuguaaagaaaggauuaaaaauuuaag

SEQ ID NO: 58746 - RNA, 64 nt, Homo Sapiens
aaacuaauguuuacuuucugcucuacauuuugugaggugagagaaguaggagggcguuggccau

SEQ ID NO: 58747 - RNA, 64 nt, Homo Sapiens
auagcuuaaauacauugaaaucuagcuaaugcucaggugagaucuuucuaaacugauuagaacu

SEQ ID NO: 58748 - RNA, 64 nt, Homo Sapiens
acacacacauaugcauaucuugacauugcucuguaggugagagaggaccaugacgcccauguuu

SEQ ID NO: 58749 - RNA, 64 nt, Homo Sapiens
gaucugagggcaggcgggcagcugcagggaggagaggugagaaaggaagcgucuucuagagaca

SEQ ID NO: 58750 - RNA, 64 nt, Homo Sapiens
acuaucacaggaagaaauaaaaacagauuuuugaaggugagaugauaaacuugcaaaacucaca

SEQ ID NO: 58751 - RNA, 64 nt, Homo Sapiens
uuggaaacuuaauccccaaagcaacagcuuugagaggugagaccuuuaaggguuacuaggcaga

SEQ ID NO: 58752 - RNA, 64 nt, Homo Sapiens
ugcuggcagcaauacugcuccgcccuguggcuggaggugagauaauucugagauaggagaaaac

SEQ ID NO: 58753 - RNA, 64 nt, Homo Sapiens
gaaaguggaucucagcugggcaggagccacugugaggugagaauuggugcauuggaaaaggagu

SEQ ID NO: 58754 - RNA, 64 nt, Homo Sapiens
agaccagugggaguaaaccgaguguuaagugucaaggugagaaagccucacauucucucaagac

SEQ ID NO: 58755 - RNA, 64 nt, Homo Sapiens
gaucaaaauucagauggaaugugggauggguaauaggugagaguagaaacccuucccuccagga

SEQ ID NO: 58756 - RNA, 64 nt, Homo Sapiens
caguccaagugggguucccuguugccaguuagagaggugagaauguuuggacucuaacucaccg

SEQ ID NO: 58757 - RNA, 64 nt, Homo Sapiens
acaggccucauccaccaggcaauagacaggagagaggugagaacuauuuuuagaaggaggaaaa

SEQ ID NO: 58758 - RNA, 64 nt, Homo Sapiens
cauaaguguaacucccauccuugccuugcgccuuaggugagaaguauuuggguaggaggaagcc

SEQ ID NO: 58759 - RNA, 64 nt, Homo Sapiens
aggaagugaggccauagaugggacccauggucccaggugagagaaagaauauucccuuggguuu

SEQ ID NO: 58760 - RNA, 64 nt, Homo Sapiens
ucuuuuacuggacugucugaucaggguggagggaaggugagagguuugcauccacuucaggagc

SEQ ID NO: 58761 - RNA, 64 nt, Homo Sapiens
ggggcgggugaugagaccugggguuuagaaccccaggugagaccucaaaucacugcauucauuc

SEQ ID NO: 58762 - RNA, 64 nt, Homo Sapiens
aggcugauuaucuggguaaucuuuuacgggugggaggugagauugauagugcaauaaucaguga

SEQ ID NO: 58763 - RNA, 64 nt, Homo Sapiens
acaacucuuaauugggccuagugaaaaugggggcaggugagaaguccauuuugagaaucagcau

SEQ ID NO: 58764 - RNA, 64 nt, Homo Sapiens
accaaaggggugaccagcccuguauccaggagaggaacugcauacgugaagaaguaucucugaa

SEQ ID NO: 58765 - RNA, 64 nt, Homo Sapiens
cagacucuuuucugagacuaguuuucuuaggcgggaacugcaaaggguuuuuguuuguuuguuu

SEQ ID NO: 58766 - RNA, 64 nt, Homo Sapiens
cuugcuuaugauugacuuggauuaaaaugccugugaacugcaaaccuuugugacucaagguuga

SEQ ID NO: 58767 - RNA, 64 nt, Homo Sapiens
aguuuuuuuaaugccacuuuaucugcaucaguuagaacugcagaugcuaugcauuuugaaaaua

SEQ ID NO: 58768 - RNA, 64 nt, Homo Sapiens
acccaccacuggaagcaggauggagcugacuacggaacugcacacucagugggcuguuucugcu

SEQ ID NO: 58769 - RNA, 64 nt, Homo Sapiens
auggauauguauugggcagcagacuguguuucgugaacugcagugauguauacaucuuauagau

SEQ ID NO: 58770 - RNA, 64 nt, Homo Sapiens
gcccuuguguaauuuucguugggaggggggcuaggaacugcacagaguggagcauguguguguu

SEQ ID NO: 58771 - RNA, 64 nt, Homo Sapiens
cuucucauucugucggaaauggcuucucgcacaugaacugcaucccccuuucuuauugcaagac

SEQ ID NO: 58772 - RNA, 64 nt, Homo Sapiens
agaacuugcagaaugcgugguguuaaucuacagagaacugcagcccuuauucagaauugagcag

SEQ ID NO: 58773 - RNA, 64 nt, Homo Sapiens
ugagcugggccuugggagaagaauuuggccuucagaacugcaauaucacugagccugcgaucua

SEQ ID NO: 58774 - RNA, 64 nt, Homo Sapiens
cuuauagaaauacaaguaagaaaguauauauccagaacugcauccuuucagguguuuucaacug

SEQ ID NO: 58775 - RNA, 64 nt, Homo Sapiens
gaacaaucugacaaaugugaucagaauugccugagaacugcaauuauucuccuucagagcaaca

SEQ ID NO: 58776 - RNA, 64 nt, Homo Sapiens
gaauuuuuuuuuaagccacuuaauuguggccaaagcuauucagcugugauaauaguaucucaca

SEQ ID NO: 58777 - RNA, 64 nt, Homo Sapiens
ugaccaugaccauuguugguugaauauuccaguugcuauucagaaauugucauaugucucaagu

SEQ ID NO: 58778 - RNA, 64 nt, Homo Sapiens
aggcugaggcaccagaauugugccuguaaucccagcuauucagguagucagguguggcggugcg

SEQ ID NO: 58779 - RNA, 64 nt, Homo Sapiens
uaaggcagaacuaggagucuugauauccacaaaugcuauucagaaccucguuacucucaccucg

SEQ ID NO: 58780 - RNA, 64 nt, Homo Sapiens
uuaauuauggauuuugugaaaaacaauagaacauguuaaugaguaauuuauauuaguucgaugu

SEQ ID NO: 58781 - RNA, 64 nt, Homo Sapiens
aaguggacacgaagugauuuuuguaaccugagcaguuaaugaaugugccaacauuuucuaggaa

SEQ ID NO: 58782 - RNA, 64 nt, Homo Sapiens
aaacaaacuagauuugguaucaaagaaugaacaaguuaaugaacaaaaaaauucucauuauuug

SEQ ID NO: 58783 - RNA, 54 nt, Homo Sapiens
auaaaaagaagugacaucucguauguuaaugaagauauuucaggaggagaauga

SEQ ID NO: 58784 - RNA, 64 nt, Homo Sapiens
uccuuuuccuauucuguauccuuaccuuggucauguuaaugacuuuggaguuauucaguuaaug

SEQ ID NO: 58785 - RNA, 64 nt, Homo Sapiens
accuuggucauguuaaugacuuuggaguuauucaguuaaugacccuuuaauucucacaaccaac

SEQ ID NO: 58786 - RNA, 64 nt, Homo Sapiens
aaaauuggucuuuggggcccauccccagugugagguuaaugagcauccuuaaguugucaaucug

SEQ ID NO: 58787 - RNA, 64 nt, Homo Sapiens
auuuaauuuuuaaauacaggcucuugaggguguuguuaaugaagaguucgcagcacugagggca

SEQ ID NO: 58788 - RNA, 64 nt, Homo Sapiens
uaagaacacauucuaacaagcucuacuccuuccuguuaaugaauuacugguuuuaaaccuugug

SEQ ID NO: 58789 - RNA, 64 nt, Homo Sapiens; identical to SEQ ID NO: 58788

SEQ ID NO: 58790 - RNA, 64 nt, Homo Sapiens
uguuuuuaaauuuuggguuuuuuuuuuuguuguuguuaaugagcagaaagagagacauaaugac

SEQ ID NO: 58791 - RNA, 64 nt, Homo Sapiens
aaugaauaaugaauuuacucaaaauaaaacauagguuaaugagauaccuguguuugugaaaaaa

SEQ ID NO: 58792 - RNA, 64 nt, Homo Sapiens
gucugcccauguccugccuggaaaguuguauacuguuaaugacuuccauugaagaagagaguuu

SEQ ID NO: 58793 - RNA, 64 nt, Homo Sapiens
accauuaauaggcaaucauuaaugguuaaugaugguuaaugauaaucuuauuaccauuaguauu

SEQ ID NO: 58794 - RNA, 64 nt, Homo Sapiens
guuaaugauaaccauuaauacauuaguauuaaugguuaaugaugaauguguaaaaucuuauuac

SEQ ID NO: 58795 - RNA, 64 nt, Homo Sapiens
accugagaaugugccucucaguaucuuaaaauugguuaaugaaaaaucugaauuucuaaaaccc

SEQ ID NO: 58796 - RNA, 64 nt, Homo Sapiens
aauaaguugaaugauaauagcucacagcacauuuguuaaugauucuugugucaucaaguaguag

SEQ ID NO: 58797 - RNA, 64 nt, Homo Sapiens
cagcuacuauacagaaaaaguaguguacauaccaauuaguuauuuauuuaaguaaugcuagggg

SEQ ID NO: 58798 - RNA, 64 nt, Homo Sapiens
aaagcaaauauguucaucacacagugcacucaucauuaguuaacaguaguguuuacaagaucca

SEQ ID NO: 58799 - RNA, 64 nt, Homo Sapiens
ugaaucuuuucuuaagaaaucccaaaaagccaauauuaguuaaaauucuguuguuuaauuuggu

SEQ ID NO: 58800 - RNA, 64 nt, Homo Sapiens
auauaaauauuuaccauauaaucuuggaauaaguauuaguuaauguuaccaaaaucuguauuaa

SEQ ID NO: 58801 - RNA, 64 nt, Homo Sapiens
gguaaaacuaccaccuggccgaaugucaggacuuuaucagcaggugcaguuuaggaacuauuag

SEQ ID NO: 58802 - RNA, 64 nt, Homo Sapiens
cuuucaagaauauuagauaaacacaaccaaaccauaucagcaucaaguugagauuugugggggg

SEQ ID NO: 58803 - RNA, 64 nt, Homo Sapiens
uggggcaaagccauucaacaguuguccauauugcuaucagcauugccaccucagccuggacuuu

SEQ ID NO: 58804 - RNA, 64 nt, Homo Sapiens
caagaacaaauuguggaucaugguauaugcaggcuaucagcagaaggaucagacaauaaaauga

SEQ ID NO: 58805 - RNA, 64 nt, Homo Sapiens
aaugaguuagugcaaaccauuuaguaaaaauaacuaucagcagaguuguuccagauuaaaaaua

SEQ ID NO: 58806 - RNA, 57 nt, Homo Sapiens
accuggauaccaccaucuaagcuccuguaucagcaguccucaucaucacucaucugc

SEQ ID NO: 58807 - RNA, 64 nt, Homo Sapiens
auagccaagaucccaucccuccauguacucuggguaucagcaacuguccucaucagucuccaua

SEQ ID NO: 58808 - RNA, 57 nt, Homo Sapiens
accuggauagaaucaucuaagcuccuguaucagcacuccucaucaucacucaucugc

SEQ ID NO: 58809 - RNA, 64 nt, Homo Sapiens
auagccaagaucccaucucuccauauacuuuggguaucagcaucuguccucaucagucuccaua

SEQ ID NO: 58810 - RNA, 64 nt, Homo Sapiens
acuuccuaaucaaaauuaagaagcaaaaccacaauaucagcaacuugguagaaaucagguuaca

SEQ ID NO: 58811 - RNA, 64 nt, Homo Sapiens
auuuguuuagcucuaaggcaauuugacaguugaguaucagcauaaaaucuuucacuucaagaua

SEQ ID NO: 58812 - RNA, 65 nt, Homo Sapiens
cagggaagauacauacauauaugagguacaguuuuugaauguacugguaaugccuaauguggucu

SEQ ID NO: 58813 - RNA, 65 nt, Homo Sapiens
uuaaaaacuuguauaguugucuagauuucugcaccugaauguauguuugaugcuuugauuugaaa

SEQ ID NO: 58814 - RNA, 65 nt, Homo Sapiens
aaaagggcuuauucuuccucagucuguugaaggccugaauguaacaauguggguggaccccgucc

SEQ ID NO: 58815 - RNA, 65 nt, Homo Sapiens
uaaccugagcccucuccauuuucccaugaaaagggugaauguauacccaccucaggccucacacu

SEQ ID NO: 58816 - RNA, 65 nt, Homo Sapiens
cccuggcgacaguugagacccuccuggugugaagaugaauguaaagugaagaugaaugaauguaa

SEQ ID NO: 58817 - RNA, 65 nt, Homo Sapiens
uccuggugugaagaugaaugcgaugugaagaugaaugaauguaacaccacggcagagagcagcgc

SEQ ID NO: 58818 - RNA, 65 nt, Homo Sapiens
uguuuaagauauguuuggugaccaaaacguaugugugaauguaguuauaaugcuuuugaaaaauu

SEQ ID NO: 58819 - RNA, 65 nt, Homo Sapiens
ucagauuuagauucuuccuggggauuacacagcuaugaauguauuugcuucuaaaaccucccaaa

SEQ ID NO: 58820 - RNA, 65 nt, Homo Sapiens
uggaaaaccccuaaaaauccaaugaccaggcucuaugaauguacaggcucuaugaauguacaugg

SEQ ID NO: 58821 - RNA, 65 nt, Homo Sapiens
uggaaugaccaggcucuauggcugaccaggcucuaugaauguacacgcaacaaggacuccucgcu

SEQ ID NO: 58822 - RNA, 65 nt, Homo Sapiens
cuuacauagcacuugauacguguuaaaugaacauaugaauguaauuuauauauuccuagaauuua

SEQ ID NO: 58823 - RNA, 65 nt, Homo Sapiens
uuagcagcucaauuuguacuacuucagccaaucugugaauguaaaaacuacacuguugccuugcu

SEQ ID NO: 58824 - RNA, 65 nt, Homo Sapiens
caggagaggaacugcauaacgugaagaaguaucucugaauguaucgagcgcaucaccugaauguc

SEQ ID NO: 58825 - RNA, 65 nt, Homo Sapiens
guacacuuucaauccuccccaccacgucccccgcaugaauguacuagccaugcacccgcccagcc

SEQ ID NO: 58826 - RNA, 65 nt, Homo Sapiens
auuugauccucauuguguucccagguguccugauuugaauguacuggauaucuuuguccauauac

SEQ ID NO: 58827 - RNA, 65 nt, Homo Sapiens
aacuuacugugggcauuuacuaugcgguuuggaaaugaauguagauuugcugucuuuuuacacug

SEQ ID NO: 58828 - RNA, 65 nt, Homo Sapiens
gaaggaaucauuggugaacuuuccaagguuauuucugaauguaacaauuuccuuaaaaaugacuu

SEQ ID NO: 58829 - RNA, 65 nt, Homo Sapiens
uagaauagauuaauaaauuggcuauguuguuccaaugaauguacagcacuuccauuaacuuuuga

SEQ ID NO: 58830 - RNA, 65 nt, Homo Sapiens
aagaugaauauauuccuuacguucaaccaagauuuugaauguaauaaaacuuuauaaucgucauu

SEQ ID NO: 58831 - RNA, 65 nt, Homo Sapiens
uauuuucuaaacacuuuacugcacacugcccacaaugaauguaacuggcaaauaagaauguuuga

SEQ ID NO: 58832 - RNA, 65 nt, Homo Sapiens
guugaaaagucugguuuacuaauagauacauguuuugaauguaaaucuaucagaaauuguaagag

SEQ ID NO: 58833 - RNA, 65 nt, Homo Sapiens
aucaguaguguuuacaagauacuaagaauacaguuugaauguauauccuaguaagugccacuucc

SEQ ID NO: 58834 - RNA, 65 nt, Homo Sapiens
aauacauuaaauuuuuaaaaguauucuacuggaaaugaauguaaugaugugauagugccgugaau

SEQ ID NO: 58835 - RNA, 65 nt, Homo Sapiens
cuacuggaaaugaauguaaugaugugauagugccgugaauguauugccaguucaaaagaauagua

SEQ ID NO: 58836 - RNA, 65 nt, Homo Sapiens
gauuuagaaaauauauauaaaaacaaguuaaaaacugaauguacuucuucuguuugugaagaaaa

SEQ ID NO: 58837 - RNA, 65 nt, Homo Sapiens
agaaguguacugaagggacuaccacuuauaugaauugaauguaucaaaaaacacacauucagcca

SEQ ID NO: 58838 - RNA, 65 nt, Homo Sapiens
gaacacuuaaaucuaacagaggauuuucagaguagugaauguaaggaaagcuuaauggaucucuc

SEQ ID NO: 58839 - RNA, 65 nt, Homo Sapiens
cagcaucaaagaauucacacaggagagaaagcacaugaauguaaugaauguggaaaagcuuucag

SEQ ID NO: 58840 - RNA, 65 nt, Homo Sapiens
cagcaucacaaaaugcauaggaaagagaaaucguaugaauguaaugaguaugagggcaguuucag

SEQ ID NO: 58841 - RNA, 65 nt, Homo Sapiens
uucaacaucagagcauucauaccaaagagaacucaugaauguaaugaagaugggaagauauuuau

SEQ ID NO: 58842 - RNA, 65 nt, Homo Sapiens
ugcuuauauugacaacaaaucaucucgcuaaagagugaauguaggccaggcgcgguggcucaugc

SEQ ID NO: 58843 - RNA, 65 nt, Homo Sapiens
ccgucucaaaaaaaaaaaaaaaaaaaaaaaaagagugaauguaauagucuugcagaaaaugaaug

SEQ ID NO: 58844 - RNA, 65 nt, Homo Sapiens
acaccuugacauuucuuuuucccugauuguuuauaugaauguagacuuuacaauuucaaauguua

SEQ ID NO: 58845 - RNA, 65 nt, Homo Sapiens
cgggaggacaagggcuuccaucuuggagaaacauaugaauguauuagcaagccauuuaauccggu

SEQ ID NO: 58846 - RNA, 65 nt, Homo Sapiens
ggggggaucgaaaagaagguuuaagucuccuuuacugaauguaagauuugggauacuaaaguagu

SEQ ID NO: 58847 - RNA, 65 nt, Homo Sapiens
uugguugcugauguuuauaaaauuggucuuaauguugaauguauuaggaccuagcuguuguaaag

SEQ ID NO: 58848 - RNA, 65 nt, Homo Sapiens
agcucugugaaucagaccaguguuauuuugagucaugaauguacaaucauuuggguuugagggug

SEQ ID NO: 58849 - RNA, 65 nt, Homo Sapiens
cuuucaguacgagacaaaguggaccugacccacacugaauguagugcguucuggcuaacacuguu

SEQ ID NO: 58850 - RNA, 65 nt, Homo Sapiens
gcagguaaauugucgggggagagaguuagcauguaugaauguaaggaugagggaagcgaagcaag

SEQ ID NO: 58851 - RNA, 65 nt, Homo Sapiens
uaagugcccacauuugauggaggguggaaauaauuugaauguauuugauuuauaaguuuuuuuuu

SEQ ID NO: 58852 - RNA, 65 nt, Homo Sapiens
aaaucuguugucauguuaguaaaugauuugaaaacugaauguaauacuugaguagauuuuuuuuu

SEQ ID NO: 58853 - RNA, 65 nt, Homo Sapiens
ugacauagaguaaacaucuuaguaauauauuaaagugaauguaaauggugguuaaaauuacauua

SEQ ID NO: 58854 - RNA, 65 nt, Homo Sapiens
gcuucuaaccccaguagaguagaacuaaauugcacugaauguauaguuaacucugucuugaauuc

SEQ ID NO: 58855 - RNA, 65 nt, Homo Sapiens
aauaauuuuuugucauuugucuuuauguccagcuaugaauguagauuuugugucccgacagcccu

SEQ ID NO: 58856 - RNA, 65 nt, Homo Sapiens
gaacaccagugaauuuacacugcaaagaaaaacuaugaauguauggaauuuuuuaaaaagaagua

SEQ ID NO: 58857 - RNA, 65 nt, Homo Sapiens
uaauacucuuguaggagaaaaagcaacuguauaaaugaauguagagugacuuucugcaauauuuc

SEQ ID NO: 58858 - RNA, 65 nt, Homo Sapiens
cgacauuaugggcuuauuuauuaaaauaaaaauucugaauguacauguuacucugguucuuuguu

SEQ ID NO: 58859 - RNA, 65 nt, Homo Sapiens
ugcacugucacuuugcucugccacacuugagaggaugaauguauggagucaaugugcaguguagc

SEQ ID NO: 58860 - RNA, 65 nt, Homo Sapiens
cauaaaggaauccaaagcuuucuuuuaacaugucuugaauguacaugguuuauuuugaugaaagu

SEQ ID NO: 58861 - RNA, 65 nt, Homo Sapiens
auggucccauuucaauuucccuuaggagaaaaugcugaauguaaguacagagcuauguaaaggga

SEQ ID NO: 58862 - RNA, 65 nt, Homo Sapiens
auaaguacccaugauuucuaauaaugccuuccaucugaauguaaauuuuuuuuaauacauaucca

SEQ ID NO: 58863 - RNA, 65 nt, Homo Sapiens
guaaauaaguaacuuugacuaguugcacgaaggcaugaauguauuuuggcuacgcagggaugggc

SEQ ID NO: 58864 - RNA, 65 nt, Homo Sapiens
uuuuacugugaagcuaucugaaccuauuaguauugugaauguagauauaauuuguuaacacuaga

SEQ ID NO: 58865 - RNA, 65 nt, Homo Sapiens
cagggauaugcguauaguuuuuguaguuuaaugauugaauguagacugccauuuuaccagcauua

SEQ ID NO: 58866 - RNA, 65 nt, Homo Sapiens
ucauuagggcuugcagacaaugucaccuaaauugcugaauguacucauuauaauaugauaucuga

SEQ ID NO: 58867 - RNA, 65 nt, Homo Sapiens
acuuugcaguaaguaucauguaaauaugcaaauguugaauguaauauagauuguguccucauuga

SEQ ID NO: 58868 - RNA, 65 nt, Homo Sapiens
uuaaccacaguguccuaaacucuauuuuuuucuagugaauguauugggaaaggaguuugaaugug

SEQ ID NO: 58869 - RNA, 65 nt, Homo Sapiens
auguauguucaaguauucagcucugugguacacauugaauguacuaaugaaguagaggugacucu

SEQ ID NO: 58870 - RNA, 65 nt, Homo Sapiens
ccugcggcucagccuugcacacccacugccccgugugaauguagcuuccaccucauggauugcca

SEQ ID NO: 58871 - RNA, 65 nt, Homo Sapiens
gacaucuacauuuuuuaaaacugaaucuuaaucgaugaauguaaacucgggggugcuggggccag

SEQ ID NO: 58872 - RNA, 65 nt, Homo Sapiens
auucugaauagaugaaagcauaaaaugugagaaacugaauguauuauucaggaagaauacugagu

SEQ ID NO: 58873 - RNA, 65 nt, Homo Sapiens
aggaagaauacugagugccuucauuuaacuaaaguugaauguaaaagucaauuugcacuucuuua

SEQ ID NO: 58874 - RNA, 65 nt, Homo Sapiens
cagaucuuaacaauuccaauagaagagaagacauaugaauguaaggaaugugggaaaaucuuggc

SEQ ID NO: 58875 - RNA, 65 nt, Homo Sapiens
auucagcugugaucucacaagugugaaaaaucuuaugaauguaaaauguguggagauucuucuuu

SEQ ID NO: 58876 - RNA, 65 nt, Homo Sapiens
uuucauaaaaggacacacacuggagagaaacccugugaauguaagaaauguagaaaagcauucca

SEQ ID NO: 58877 - RNA, 65 nt, Homo Sapiens
auacaugaaaggaugcacagaggagagaagcucugugaauguaagcauugugggaaagcauucau

SEQ ID NO: 58878 - RNA, 65 nt, Homo Sapiens
auacaugcaagaacacacaauggagagaaacccuaugaauguaaagaaugcagaaaagcauucag

SEQ ID NO: 58879 - RNA, 65 nt, Homo Sapiens
augcauggaaggacucacacuggagaaaaacccuaugaauguaagcaguaugggaaagcguucag

SEQ ID NO: 58880 - RNA, 65 nt, Homo Sapiens
guucagaccugacaagauucuuugaauacagauaaugaauguaaacaauuaacuguuuauaauaa

SEQ ID NO: 58881 - RNA, 65 nt, Homo Sapiens
auuuaugaaaggacacacacuggagagaaacccuaugaauguaagaaauguggaaaagcguucca

SEQ ID NO: 58882 - RNA, 65 nt, Homo Sapiens
gaauacaugcaaaacacacacuggagagaaaccuaugaauguaaggaaugcaaacaagcauucaa

SEQ ID NO: 58883 - RNA, 65 nt, Homo Sapiens
auacaugaaaggacucauacgagagagaauccguaugaauguaaggauugugggaaagcauucag

SEQ ID NO: 58884 - RNA, 65 nt, Homo Sapiens
auagacauguaaagacacaccagaaggaaacccuaugaauguaagcaauguggcaaaagcuuuca

SEQ ID NO: 58885 - RNA, 65 nt, Homo Sapiens
augcauggaagcacucacacuuggcagaaacucuaugaauguaagcaguaugggaaagccuucag

SEQ ID NO: 58886 - RNA, 65 nt, Homo Sapiens
cuucagaucggcuaggauucuuugaauacaaauaaugaauguaaacaauuaacuguuuauaauaa

SEQ ID NO: 58887 - RNA, 65 nt, Homo Sapiens
cagcaaagccauucuuaagagucgugagguccuucugaauguaaaacuggagcccaggagaagcu

SEQ ID NO: 58888 - RNA, 65 nt, Homo Sapiens
cauaauuaacuuaauuggagaugcauuaggucacuugaauguauaagcaagcaccuaugguaggc

SEQ ID NO: 58889 - RNA, 59 nt, Homo Sapiens
augcgaaaucauacagcugagaaacccuaugaauguaaggaauguggaaaagccuucag

SEQ ID NO: 58890 - RNA, 65 nt, Homo Sapiens
cuucaugugagaagucacacaggggagaaacccuaugaauguaauaaaugugggaaagccuuuuc

SEQ ID NO: 58891 - RNA, 65 nt, Homo Sapiens
auacauaugagaagucauacuggugagaaacccuuugaauguaaugaaugugggaaagcauucuc

SEQ ID NO: 58892 - RNA, 65 nt, Homo Sapiens
gaaucugggaauaccuuucuuggagagaaacuguaugaauguagaaaacacaucagaaaucucac

SEQ ID NO: 58893 - RNA, 65 nt, Homo Sapiens
aauguggaagcaacuuuguauggggagaaacccuaugaauguaaacugaagacaugaaaacucac

SEQ ID NO: 58894 - RNA, 65 nt, Homo Sapiens
gaauguggaaaacccuucaguggagagaaacccuaugaauguaaaauacaugaacgaauucauac

SEQ ID NO: 58895 - RNA, 65 nt, Homo Sapiens
cagugugguaaagccuucaguggagagaaaccuuaugaauguaaaauacaugaaagaacccacac

SEQ ID NO: 58896 - RNA, 65 nt, Homo Sapiens
aaaugugggaaaacauacauugcaaagaaacaguaugaauguaaaagacaugaaaggaugcacac

SEQ ID NO: 58897 - RNA, 65 nt, Homo Sapiens
cugugugggaaaacuuacuuugcacagaaacacuaugaauguaaaaaacaugagaggaaucacac

SEQ ID NO: 58898 - RNA, 65 nt, Homo Sapiens
aaaugugggaaaguguucguuggagaaaaacccuaugaauguaaagcacaugaaagaacucacac

SEQ ID NO: 58899 - RNA, 65 nt, Homo Sapiens
caauguggaaaaaccuacauuguacagaaacgcuaugaauguaaagcacaugaaaggaaucacac

SEQ ID NO: 58900 - RNA, 65 nt, Homo Sapiens
cacauaguaaagccuuaauuuggagauaaacccuaugaauguaaacagauagaaauaauucucau

SEQ ID NO: 58901 - RNA, 65 nt, Homo Sapiens
aaauguagaaaagcauugaguggagagaagucauaugaauguaagguacaugaaaggauucacuc

SEQ ID NO: 58902 - RNA, 65 nt, Homo Sapiens
ccauguggugaaggcuuaagaagaaauaaacucuaugaauguaaaaaaaaauaaaaaaaaagaaa

SEQ ID NO: 58903 - RNA, 65 nt, Homo Sapiens
gaauguggaaaagcauugagcgcaaagaagcuaugugaauguaagggacaugaaagaacucauac

SEQ ID NO: 58904 - RNA, 65 nt, Homo Sapiens
gaaugcaggaaagcauucucuggagagaagccguaugaauguaagcaacaugaaaggauucacac

SEQ ID NO: 58905 - RNA, 65 nt, Homo Sapiens
uaaugugggaaagcauuugggggagagaagccauaugaauguaaaaaucaugagacaacucauau

SEQ ID NO: 58906 - RNA, 65 nt, Homo Sapiens
caaugugggaaagcauuugaugcagagaaaccccaugaauguaagagacgugaaaccacucacag

SEQ ID NO: 58907 - RNA, 65 nt, Homo Sapiens
caguguucuaaagccuucccuggggagaaacuguaugaauguaagagacaugaaagaacacguac

SEQ ID NO: 58908 - RNA, 65 nt, Homo Sapiens
caguguucuaaagccuuucauggagagaaacuauaugaauguaagaugcaugaaagaacucacuc

SEQ ID NO: 58909 - RNA, 65 nt, Homo Sapiens
aaguucuucagcacuugagcaaauuuagauuguagugaauguaggaacauaauuuauucuaggua

SEQ ID NO: 58910 - RNA, 65 nt, Homo Sapiens
aaaaucuuuagccuuaucuggagagaauaauguaaugaauguagguaucuucagcaaauuccuau

SEQ ID NO: 58911 - RNA, 65 nt, Homo Sapiens
aaagcuuuuaucuauuacacaucauguugacuuugugaauguagaagaauagcauauagagaaua

SEQ ID NO: 58912 - RNA, 65 nt, Homo Sapiens
gaaugugagaaggccucuucuggugagaaacccuaugaauguaaucaacaucaaagaauuccuac

SEQ ID NO: 58913 - RNA, 65 nt, Homo Sapiens
gauuguaaaaaagcuuuucuuggugacaaacccuaugaauguaaaaaacaucagacaauucacac

SEQ ID NO: 58914 - RNA, 65 nt, Homo Sapiens
gaauguguaaagaccuuuaccagugugaaacccuaugaauguaagcaacaucaaagaauucauac

SEQ ID NO: 58915 - RNA, 65 nt, Homo Sapiens
gaaugugggaaugccuucauuggggagaaacccuaugaauguaauagacaucagagaauucacag

SEQ ID NO: 58916 - RNA, 65 nt, Homo Sapiens
cugagcccccuuuucuggacaccaacuguguccugugaauguaucgcuacugugagcuguucccg

SEQ ID NO: 58917 - RNA, 65 nt, Homo Sapiens
ucagugucggggcugagccccuugagcugcuucagugaauguacagugcccggcacgagcugaac

SEQ ID NO: 58918 - RNA, 65 nt, Homo Sapiens
gccagagucguaauugaaaucuaggaagucucgcuugaauguaugcgauacauauuuucacuacg

SEQ ID NO: 58919 - RNA, 65 nt, Homo Sapiens
uuuaaagguagaguuaacagaauauacugguggacugaauguagguugagagaggaagcgagaag

SEQ ID NO: 58920 - RNA, 65 nt, Homo Sapiens
ccgcccccuccggggcugagccugggucugaagacugaauguaacaggggccgcuggcacuccug

SEQ ID NO: 58921 - RNA, 65 nt, Homo Sapiens
aguguuguuuuuguaucaauauguuugugcagugaugaauguauuuauuucucagacuuggggcg

SEQ ID NO: 58922 - RNA, 65 nt, Homo Sapiens
auaccuaguuuacuugccagugagggaauguguggugaauguaaauucuaacaacuguggagauu

SEQ ID NO: 58923 - RNA, 65 nt, Homo Sapiens
uauaacuauuuauuucuggacugggauguaaacucugaauguauuuuuuugguguuccaaugaau

SEQ ID NO: 58924 - RNA, 65 nt, Homo Sapiens
ugggaggggucgggggcacguuuguucagacuaaaugaauguaucgcacagaaugagcuucgagc

SEQ ID NO: 58925 - RNA, 65 nt, Homo Sapiens
gacccgugggcacuuuuccuagcccccacccgcuuugaauguagacaucugccuuucuuuccccc

SEQ ID NO: 58926 - RNA, 64 nt, Homo Sapiens
aauaacuuuauuauaugaguacuguuaguugguugucagugaacuuguauauugucagugaaga

SEQ ID NO: 58927 - RNA, 64 nt, Homo Sapiens
aacuguuaguugguugucagcacacuuguauauugucagugaagcugaaggcucgaaggcacug

SEQ ID NO: 58928 - RNA, 64 nt, Homo Sapiens
ucucagacggggcccucccgucgagaagcugguagucagugagugagaacaagagaacaagaac

SEQ ID NO: 58929 - RNA, 64 nt, Homo Sapiens
acccauuuuccuuguuuucagugcugcgguaucagucagugaucugaggaaauccuguagggga

SEQ ID NO: 58930 - RNA, 64 nt, Homo Sapiens
aauauccuaaaguaucacauaguuaaauuuuucagucagugaagaccgggagggaaugucagug

SEQ ID NO: 58931 - RNA, 64 nt, Homo Sapiens
uaaauuuuucagucagugaagaccgggagggaaugucagugaauuggcuugaauguucuguggc

SEQ ID NO: 58932 - RNA, 64 nt, Homo Sapiens
cccacagguuucuguggacagcgauacagcaggagucagugaaaucaacuggggagcucacuug

SEQ ID NO: 58933 - RNA, 64 nt, Homo Sapiens
uauuugcaauguggaguuuccgccccgaucucacgucagugagggucuccugucucucaagugu

SEQ ID NO: 58934 - RNA, 64 nt, Homo Sapiens
gagaacacagagagggacaaagugcugguuacuagucagugacaaaggucuguugaugcaugcc

SEQ ID NO: 58935 - RNA, 64 nt, Homo Sapiens
augaaaacucagacaaagcagcugcccaggcaaagucagugaacgcaccaagguaagagguggg

SEQ ID NO: 58936 - RNA, 64 nt, Homo Sapiens
guucauguuaaguuagagugaggguguagguagugucagugaguggcucuugugccugcuguag

SEQ ID NO: 58937 - RNA, 64 nt, Homo Sapiens
cuuuuaggaagucugagaugauaaauauuucaaggucagugaagucuaucaaucauucuccccu

SEQ ID NO: 58938 - RNA, 64 nt, Homo Sapiens
gaguuaaguggcuucuccgugccuccagccgguggucagugaggucaagcgaggcaugcaugag

SEQ ID NO: 58939 - RNA, 64 nt, Homo Sapiens
ucucagcccugaugacacccagaggacccugggugucagugagacgaccuccagugagcuugga

SEQ ID NO: 58940 - RNA, 63 nt, Homo Sapiens
cagccagggacgccaggacauagcugcuccuggucaguggaggucagccggguaucaaaagcc

SEQ ID NO: 58941 - RNA, 63 nt, Homo Sapiens
auuuccaagaagcugaaucuuugggacugauucucaguggagggcuuagaucauacaaaaauc

SEQ ID NO: 58942 - RNA, 63 nt, Homo Sapiens
caaauaacugauguuuuaaccagaguaaugaccucaguggauuugcuuuaacccucacauuuu

SEQ ID NO: 58943 - RNA, 63 nt, Homo Sapiens
ccagagcuagcgucccuacugccucccgacuccucaguggaggaggagcugcggucccucugg

SEQ ID NO: 58944 - RNA, 63 nt, Homo Sapiens
gggguccaggucggguguggacuguccucacugucaguggagccccagaagcuagauggguac

SEQ ID NO: 58945 - RNA, 63 nt, Homo Sapiens
aaccuugucacauguagcugagucugggaugacucaguggaucaguggaugcguggaagguuu

SEQ ID NO: 58946 - RNA, 63 nt, Homo Sapiens
cacauguagcugagucugggaugacucaguggaucaguggaugcguggaagguuuugguguuu

SEQ ID NO: 58947 - RNA, 63 nt, Homo Sapiens
gauacccagaggucccccaggucaucacuuggcucaguggaagcccucuuuccccaaauccua

SEQ ID NO: 58948 - RNA, 63 nt, Homo Sapiens
aaguggauacauaagauuaacuaucacagugacucaguggaauuuuuuguuugcuuuuguaca

SEQ ID NO: 58949 - RNA, 63 nt, Homo Sapiens
auuugcuuauauguaaaaguuguuuuuguggagucaguggauauauuucuaaugaagugcuag

SEQ ID NO: 58950 - RNA, 63 nt, Homo Sapiens
augaucuaaaagccaacuuuuucucaguuuuacucaguggaaagauaaacuaaguuuuaaugu

SEQ ID NO: 58951 - RNA, 63 nt, Homo Sapiens
ggugacacacugagugaaagggacugggccagcucaguggaccguguggaacaggaacagcug

SEQ ID NO: 58952 - RNA, 63 nt, Homo Sapiens
ggaaaagaugccuucuggaucuuaagccaguugucaguggagguccucagggcugcaaauguc

SEQ ID NO: 58953 - RNA, 63 nt, Homo Sapiens
caaaccuuguagccuaagccauuugucuuuuucucaguggagggaguguauggaccuggcccc

SEQ ID NO: 58954 - RNA, 63 nt, Homo Sapiens
acccaggauccugaucugcccugcacugagcacucaguggauaaacacuccuccagcccagac

SEQ ID NO: 58955 - RNA, 63 nt, Homo Sapiens
cuaaacaucgacuucgguucacuucacggauguucaguggauaucggucacaugccagguccc

SEQ ID NO: 58956 - RNA, 63 nt, Homo Sapiens
agucuagugcagacccgugaucaccuuagugcuucaguggauucacugguuagauuaaaaaga

SEQ ID NO: 58957 - RNA, 63 nt, Homo Sapiens
gguuuauucauucauuaaacuacuuuggaagcgucaguggauauauuugaaagugguaauccu

SEQ ID NO: 58958 - RNA, 63 nt, Homo Sapiens
acaaguuucuuguuauccugaaacuuucuaugcucaguggaaaguaucugccagccacagcau

SEQ ID NO: 58959 - RNA, 63 nt, Homo Sapiens
ccauuuuccuuuccuugugguugaaaaccacagucaguggagagauguuuggaaaccacaguc

SEQ ID NO: 58960 - RNA, 63 nt, Homo Sapiens
cacagucaguggagagauguuuggaaaccacagucaguggagccugggugguacccaggcuuu

SEQ ID NO: 58961 - RNA, 63 nt, Homo Sapiens
aucaauuacggagauacagagccuugaggucuuucaguggaaaggugguucauguucauucuc

SEQ ID NO: 58962 - RNA, 63 nt, Homo Sapiens
caggacugggggucuggcuugggcagggauugcucaguggaagcagccugggggucugggcug

SEQ ID NO: 58963 - RNA, 63 nt, Homo Sapiens
guucgggaugcagggggcacuaaauaacccccgucaguggagugcuguaggcaagcuugcaca

SEQ ID NO: 58964 - RNA, 63 nt, Homo Sapiens
agaugaagccaaaggacagacagugcugcugcuucaguggaagcucauucccuuacccccggc

SEQ ID NO: 58965 - RNA, 63 nt, Homo Sapiens
gucugcucuagaugagcugguugaagaagaugaucaguggacagugccuucuucagggccugg

SEQ ID NO: 58966 - RNA, 63 nt, Homo Sapiens
cagauagaaaauauaaagucuuaagcccagacuucaguggacccccagaaucagcucuggauu

SEQ ID NO: 58967 - RNA, 63 nt, Homo Sapiens
uuucuuaauuuuucuaaagaauucuuaagaguuucaguggaauuaguuuacaaucuaagaguu

SEQ ID NO: 58968 - RNA, 63 nt, Homo Sapiens
uuuaaaacuugguacuacuaaguuaaaucuguaucaguggacuaauuuguaguuuuauuaugc

SEQ ID NO: 58969 - RNA, 63 nt, Homo Sapiens
caucccccuguuagagaccccagaacucaagguucaguggacaucaucaauccgucugggugc

SEQ ID NO: 58970 - RNA, 63 nt, Homo Sapiens
uuugugggccuccagcuucugacagaaagagggucaguggacugguccuuuauucauuucugg

SEQ ID NO: 58971 - RNA, 63 nt, Homo Sapiens
agaugucucaaaaauccuuaccuuuauaauauuucaguggaauuagaagugguuuguagacuu

SEQ ID NO: 58972 - RNA, 63 nt, Homo Sapiens
guuaaaccuucccccacucaguccucccuuuguucaguggacgcauuuuuaaugauguugugu

SEQ ID NO: 58973 - RNA, 63 nt, Homo Sapiens
ccuugcccccaaaugucgacuuugggggauuuuucaguggaacaccugaaaccucagcgugaa

SEQ ID NO: 58974 - RNA, 63 nt, Homo Sapiens
acaccauucucccccccucacccccccaccaccucaguggaacacagugggcaagaggacacc

SEQ ID NO: 58975 - RNA, 63 nt, Homo Sapiens
gcccugaaaggaggcucacuagcccuuuccaagucaguggagaaccucaaacacuggccugug

SEQ ID NO: 58976 - RNA, 63 nt, Homo Sapiens
auugaaaacaacaacaacaaugaaguaauaguuucaguggauggaugcguaauauaauucugg

SEQ ID NO: 58977 - RNA, 63 nt, Homo Sapiens
uuuuuauucuucuuuagucuuuuuuuuuaaucaucaguggaaacugcugauauuauggaagua

SEQ ID NO: 58978 - RNA, 63 nt, Homo Sapiens
ugcuugguguggggaucuggagcacaugcagccucaguggagacuaggaggacccaccagugg

SEQ ID NO: 58979 - RNA, 63 nt, Homo Sapiens
ugcacagaaaaucuucuggcguuuuguaaaauuucaguggaaaaauagguuccauguguaagu

SEQ ID NO: 58980 - RNA, 63 nt, Homo Sapiens
auuuauuuuaaaaaaaaaacauauuaauacauuucaguggauaucaguuuccaaguuuauauc

SEQ ID NO: 58981 - RNA, 63 nt, Homo Sapiens
aauuguuugcccaaauauucuugucauuuggagucaguggaaaauccagcacaccaagcacca

SEQ ID NO: 58982 - RNA, 63 nt, Homo Sapiens
guacuguuaauaucuggaaaguaucuugagauaucaguggaaagcuaaacagucuaaauuaac

SEQ ID NO: 58983 - RNA, 63 nt, Homo Sapiens
agggggcuggucccggcuccacccccuccaagcucaguggacacugggucugaaaggaaggag

SEQ ID NO: 58984 - RNA, 63 nt, Homo Sapiens
ccucagugggcccgaacucgccagccccagcuuucaguggagaaagcgguccucugaaauggu

SEQ ID NO: 58985 - RNA, 63 nt, Homo Sapiens
gcccuuagcaguggccuggcacaaaacaaaugcucaguggauggaagcugccuauuauuauug

SEQ ID NO: 58986 - RNA, 63 nt, Homo Sapiens
ucaaggcaauaguacauaauaguggaagaaaauucaguggaagguuauugcuauugucauuug

SEQ ID NO: 58987 - RNA, 63 nt, Homo Sapiens
aucaaccugggagaccaccccggccgcggcgccucaguggacaggugggaggaaaagaaaacu

SEQ ID NO: 58988 - RNA, 63 nt, Homo Sapiens
caucacaugucgauauuugcauaggagucauuuucaguggaauaacauuuuuaaugugugguu

SEQ ID NO: 58989 - RNA, 63 nt, Homo Sapiens
ggaauguugcaugagucggaucccaguccauugucaguggagggugagggugaccccaucugc

SEQ ID NO: 58990 - RNA, 63 nt, Homo Sapiens
uguaauaaacuauaaauaaacauuccagacuucucaguggauuucuagcucucugauuccaua

SEQ ID NO: 58991 - RNA, 63 nt, Homo Sapiens
agggcagguugaaucaagguacugguuuuaaaaucaguggaaauuuauaguuucucuauaaaa

SEQ ID NO: 58992 - RNA, 63 nt, Homo Sapiens
agugggucccuggucuccuaagaacugccauuaucaguggaguguucuggcccuuccccaucu

SEQ ID NO: 58993 - RNA, 63 nt, Homo Sapiens
guucuauagaauuaaugaugauuaaaguuuuacucaguggauaaggcuucuggaaccaaacug

SEQ ID NO: 58994 - RNA, 63 nt, Homo Sapiens
ucuaaaccuugugaugacuaaaaugagacuuuuucaguggaacuguaugaguugcauuuguaa

SEQ ID NO: 58995 - RNA, 63 nt, Homo Sapiens
acuccaguuguaaugcauaucaaacucuuauucucaguggaaagauuuaugugaggucaaaac

SEQ ID NO: 58996 - RNA, 63 nt, Homo Sapiens
guuccauguggauccauacuaaguauucuucagucaguggauuuuagcaaggggagguaggag

SEQ ID NO: 58997 - RNA, 63 nt, Homo Sapiens
uuaacuaacuguaaggcguggaauaggaguugcucaguggauugguucuauguuguggacuac

SEQ ID NO: 58998 - RNA, 63 nt, Homo Sapiens
accucuugaaggugucgaauguauguuuauacaucaguggaacccauuuuucuagccuagcaa

SEQ ID NO: 58999 - RNA, 63 nt, Homo Sapiens
auaaguugcagacugccuuuaaaauagauuuuaucaguggagaaauggugauaguuuuuucuu

SEQ ID NO: 59000 - RNA, 63 nt, Homo Sapiens
aucuaagcccaggacaugagugucuguccagacucaguggaucugaagaaaaaaggaaaaaaa

SEQ ID NO: 59001 - RNA, 63 nt, Homo Sapiens
cuacugaaguuguguggagggauggaaagugggucaguggagaagggauucagaaaaugacac

SEQ ID NO: 59002 - RNA, 63 nt, Homo Sapiens
caagaggacugggugcugggcugcagaggccggucaguggagccccuagcacgugugaacuca

SEQ ID NO: 59003 - RNA, 63 nt, Homo Sapiens
agguauuggagccucuguggccuuaaauguggcucaguggagggagacccagcauagccaggc

SEQ ID NO: 59004 - RNA, 63 nt, Homo Sapiens
agugccccugugggggagccuguaaaugcgggcucaguggaccacuggugacugggcucaugc

SEQ ID NO: 59005 - RNA, 63 nt, Homo Sapiens
gcagugagacuaugagccaagcaaagagaagucucaguggagcaugaggagggagcaguccag

SEQ ID NO: 59006 - RNA, 63 nt, Homo Sapiens
aaaguucuaaacugccucugcaaugacuuguagucaguggaagaguaucacuuuccccugauc

SEQ ID NO: 59007 - RNA, 63 nt, Homo Sapiens
auaaaaaucaaaaggcugccucuauuacaauccucaguggaauagauggcuaucuuucuuggc

SEQ ID NO: 59008 - RNA, 63 nt, Homo Sapiens
uuguuaccaaacuuguaaaagcauuccauguauucaguggaggcagaauguauaauauuuuuu

SEQ ID NO: 59009 - RNA, 63 nt, Homo Sapiens
aggaguuuguuuccugaguguggagugaggcugucaguggauccgugcuuugucggccagcgu

SEQ ID NO: 59010 - RNA, 63 nt, Homo Sapiens
aacuccucacucccugaucaauggaaguccaggucaguggagucucuccuugauugaucaccc

SEQ ID NO: 59011 - RNA, 63 nt, Homo Sapiens
cccuggagugggcaggcaggccagggcugcgcaucaguggacacauugcugccaggaagagcu

SEQ ID NO: 59012 - RNA, 63 nt, Homo Sapiens
cuggcuuagggaacagggagccaggagggguucucaguggagcugcuccauguucauucggag

SEQ ID NO: 59013 - RNA, 63 nt, Homo Sapiens
ucaauauauaguuagcuuuaacugcauuuuuaaucaguggaacacaaaagcaaaauuuuuaaa

SEQ ID NO: 59014 - RNA, 63 nt, Homo Sapiens
cauucuaagggcaagacauuaacuucacauugcucaguggacuagguuuuccuggacaccgcc

SEQ ID NO: 59015 - RNA, 63 nt, Homo Sapiens
uuuucaguuucccacccugccuucucugcagaaucaguggagaggaaggauuguuccuuagag

SEQ ID NO: 59016 - RNA, 63 nt, Homo Sapiens
ucuauagaugguuuugaaaaaaccuaauuaugcucaguggacuguaaacggacuuguuaaccu

SEQ ID NO: 59017 - RNA, 63 nt, Homo Sapiens
uucccaucuauuacgccucaaugacauggauguucaguggaaccuucugauugccuaauaaau

SEQ ID NO: 59018 - RNA, 63 nt, Homo Sapiens
aaacauuaaaauguaccacuuaauaucacaguaucaguggacuaauuaaaccuugcauuaaaa

SEQ ID NO: 59019 - RNA, 63 nt, Homo Sapiens
aacauuguggcauggcagcacagaaauccuauuucaguggaccacuacuguugacaguuuccg

SEQ ID NO: 59020 - RNA, 63 nt, Homo Sapiens
aaagaauuaaaccaaggcuuagccuuaagcagcucaguggaaggaugagcugcugcggaccac

SEQ ID NO: 59021 - RNA, 63 nt, Homo Sapiens
gauguguggcugggcccucucccaccugccuguucaguggaggccagggcagcagcccagaac

SEQ ID NO: 59022 - RNA, 63 nt, Homo Sapiens
cuuccuacugcaaaggacagugaauccagcaacucaguggauccaagcugggcucagaggucg

SEQ ID NO: 59023 - RNA, 63 nt, Homo Sapiens
uaucugauggguuagagugccuuugagaagaaaucaguggauacuggauuugcuccugucaau

SEQ ID NO: 59024 - RNA, 63 nt, Homo Sapiens
ccugggauggagcccaucucuccaguuccucccucaguggaggagaucccugugccuggggaa

SEQ ID NO: 59025 - RNA, 63 nt, Homo Sapiens
acaguauacuuuuguguguggcugagguuauucucaguggauuuaacccaggaaacagaccca

SEQ ID NO: 59026 - RNA, 63 nt, Homo Sapiens
agaaucaaacugguacauugugagagauucuauucaguggaucgucuggucaccagauaugga

SEQ ID NO: 59027 - RNA, 63 nt, Homo Sapiens
augggaauaaagcauuucuacuagguuguauuuucaguggacacagauauuuacugaaggaau

SEQ ID NO: 59028 - RNA, 63 nt, Homo Sapiens
auaaaccagcugagaagaacccuauauugagcuucaguggagaguaaguaaagaaaauauaau

SEQ ID NO: 59029 - RNA, 63 nt, Homo Sapiens
gugguugggugcaccuguaguucuguuuauuggucaguggaaaugaaaaaaaaaaaaaaaaaa

SEQ ID NO: 59030 - RNA, 63 nt, Homo Sapiens
gauuaaauaaaacuuaaaucucacucuaggaguucaguggagagguuagagccagccacacuu

SEQ ID NO: 59031 - RNA, 63 nt, Homo Sapiens
agaaguuuuuguucuuuuuuuuuuuuccaucacucaguggagaaaagcuuuguuaaugaaaga

SEQ ID NO: 59032 - RNA, 63 nt, Homo Sapiens
cccaagagagacuuguuugggccuuuuguggugucaguggaauggauagguaacuuggguggg

SEQ ID NO: 59033 - RNA, 63 nt, Homo Sapiens
agagauaacuuugaaauuucauaaguuugauauucaguggauacaaauagaacaugaauucua

SEQ ID NO: 59034 - RNA, 63 nt, Homo Sapiens
guaagagcauaaucaaacaggaauuuucuuuucucaguggauaauacaacagagaaaacagag

SEQ ID NO: 59035 - RNA, 63 nt, Homo Sapiens
aauaccccacacaaguucacuugauuaauugcaucaguggaaggggacauagcuucucucuua

SEQ ID NO: 59036 - RNA, 63 nt, Homo Sapiens
uaaaauucauuuuccacuggaacucuaugacauucaguggagugguggaaaguuaaccucuua

SEQ ID NO: 59037 - RNA, 63 nt, Homo Sapiens
acauuggaagugcuguagacuucuuuauguggcucaguggagagagggaaagaauguugcacc

SEQ ID NO: 59038 - RNA, 63 nt, Homo Sapiens
cucuccucacugcucacagcaagggguucuguaucaguggauuucauuuuguagcugcugaga

SEQ ID NO: 59039 - RNA, 63 nt, Homo Sapiens
aaucaaagugauucugggggaagcuaugcucuuucaguggauaauaaaauugguaacucuauu

SEQ ID NO: 59040 - RNA, 63 nt, Homo Sapiens
ggcauaauauuaauagcgccaccuucuguugggucaguggagaugggugaggaacagcacaga

SEQ ID NO: 59041 - RNA, 63 nt, Homo Sapiens
aaucaugaaugacaaugagauaacauacagaugucaguggagacaaaguuguggguuccuccu

SEQ ID NO: 59042 - RNA, 63 nt, Homo Sapiens
ccagcagaaccacaggagagugcccugccugucucaguggaaguguauuauuguuuuaaggau

SEQ ID NO: 59043 - RNA, 63 nt, Homo Sapiens
cacucgauuggagucaguugaauauuuguacccucaguggagcccuucuggucuuuucuucca

SEQ ID NO: 59044 - RNA, 63 nt, Homo Sapiens
gacuggcaguaacaagggcuuuuacuguucuguucaguggaaccuucuuggucaaauuguaau

SEQ ID NO: 59045 - RNA, 63 nt, Homo Sapiens
gucugcucacugccaggcuccucuccccuuuguucaguggagcuggcuuuucucccagccccu

SEQ ID NO: 59046 - RNA, 63 nt, Homo Sapiens
ccugucaaaucgcauaaaaggauuuuuuuguucucaguggaacaguauacuuuguaaggagca

SEQ ID NO: 59047 - RNA, 63 nt, Homo Sapiens
cugggccaccauggcagaccaacaauagcauugucaguggaggaugcccuauuccuaaauaau

SEQ ID NO: 59048 - RNA, 63 nt, Homo Sapiens
cuuauuaauauccaagacuuggauuucucccucucaguggagcggagcgcucucuugauucug

SEQ ID NO: 59049 - RNA, 63 nt, Homo Sapiens
cgcacacggccccggcgcgccaggaucgggcacucaguggagcgggggacggugcccccagcc

SEQ ID NO: 59050 - RNA, 63 nt, Homo Sapiens
auuauauagguugugcaaauguauauaucugcuucaguggagaaaaaaaaaagcucauauuuu

SEQ ID NO: 59051 - RNA, 63 nt, Homo Sapiens
uuaggaaacgcucccacuccugggcucuuaucuucaguggagcgguggggggagggguugggu

SEQ ID NO: 59052 - RNA, 63 nt, Homo Sapiens
uugacagcucccuaaagauuauuucugugguguucaguggaggcgcaccuagccucuuugauc

SEQ ID NO: 59053 - RNA, 63 nt, Homo Sapiens
aguggaauuggcaaacuagaauuuaguuuguacucaguggacagugcuguugaagauuugagg

SEQ ID NO: 59054 - RNA, 63 nt, Homo Sapiens
gacaccagcuucaccuucuuaacaaggugcagcucaguggaagaugaugacaaccagaagaca

SEQ ID NO: 59055 - RNA, 63 nt, Homo Sapiens
gagaggagacuguuugaugugguacaggggcagucaguggagggcgagugguuucggaaaaaa

SEQ ID NO: 59056 - RNA, 63 nt, Homo Sapiens
gugugcauuuuuuuauucuaauauuccuucuagucaguggaaauuuguauucccauacaaacu

SEQ ID NO: 59057 - RNA, 63 nt, Homo Sapiens
ccccuccuccauccacccugaggacccuggggcucaguggaggcagggcccugccccccuccc

SEQ ID NO: 59058 - RNA, 63 nt, Homo Sapiens
gggcugcuagugaguuacauuaauuacugcaaaucaguggaauucucaagagacaagauaagc

SEQ ID NO: 59059 - RNA, 63 nt, Homo Sapiens
ucuaauauauauaucauugagggugacuaaucuucaguggaccaaaucucuacccuuccccaa

SEQ ID NO: 59060 - RNA, 63 nt, Homo Sapiens
cucaaugguaggagacauccagacuuguauauuucaguggaaauacaaaaccacuucagagac

SEQ ID NO: 59061 - RNA, 63 nt, Homo Sapiens
aaagacucaagacacagaagaugaugagggagcucaguggaauuguaccgccuguacuuuuuu

SEQ ID NO: 59062 - RNA, 63 nt, Homo Sapiens
ucagugccuccagccaaaugccuagcacagagcucaguggauuugauucuuccauucagauac

SEQ ID NO: 59063 - RNA, 63 nt, Homo Sapiens
uaaaugaucauagaaggugcgauuaaaaaaaaaucaguggaaaagaaugcaugaucucagagu

SEQ ID NO: 59064 - RNA, 63 nt, Homo Sapiens
ugaccccacccagcccccugauaguacaguucuucaguggacaauuucugguuuucugucccc

SEQ ID NO: 59065 - RNA, 63 nt, Homo Sapiens
cagucauguuagguaggaggguggccacuucccucaguggaguaggcccaaggcuuggauaag

SEQ ID NO: 59066 - RNA, 63 nt, Homo Sapiens
cuggcagggucccuccagcaugggggaaaggauucaguggagggcccccagagcccgucagcg

SEQ ID NO: 59067 - RNA, 63 nt, Homo Sapiens
caaagaugaauccaaguucaaccuaccaggugcucaguggaaucaagaaauaugugaauaccc

SEQ ID NO: 59068 - RNA, 63 nt, Homo Sapiens
aaucaauauauaacuuagugcaagaaagaauuuucaguggaaauuguccaccuagucagagcc

SEQ ID NO: 59069 - RNA, 63 nt, Homo Sapiens
acaaaugaaaaugaauagcuuucaguaaugucuucaguggaacaaauaaaccauuggacagau

SEQ ID NO: 59070 - RNA, 63 nt, Homo Sapiens
uguuuggaacucugaaggauaugaaguauggguucaguggaaaguuuugguuguuuuaaacuc

SEQ ID NO: 59071 - RNA, 63 nt, Homo Sapiens
ucagaggacggggagauagauacaagguaaguuucaguggagcggcgugggggacaagaagga

SEQ ID NO: 59072 - RNA, 63 nt, Homo Sapiens
ggggcgucugagcuccccaggcaugaccaaaccucaguggaggggccucugcuucaggccccg

SEQ ID NO: 59073 - RNA, 63 nt, Homo Sapiens
acagcuaccugcauuguagaaccuuuucuuaucucaguggaaccuucuauaaccuaaauauac

SEQ ID NO: 59074 - RNA, 63 nt, Homo Sapiens
ucagccuggacacccggcagcuucuggaguuugucaguggaggcagaggggauccggccaggc

SEQ ID NO: 59075 - RNA, 63 nt, Homo Sapiens
cucagggaguguuuuccugugaggccucccccaucaguggaccagagggagaagcccgaugcc

SEQ ID NO: 59076 - RNA, 63 nt, Homo Sapiens
aaaugauuagcccuaaaugaaacuguaauaauuucaguggaaacucaaucuguuuuuaccuuu

SEQ ID NO: 59077 - RNA, 63 nt, Homo Sapiens
cagcuucuucggagaagugaaauauaacauuacucaguggacggagaaaucuguuuuguuaca

SEQ ID NO: 59078 - RNA, 63 nt, Homo Sapiens
ccugcgguucaguucaggcugagauuuucuccuucaguggacugucugugucccccugccgaa

SEQ ID NO: 59079 - RNA, 63 nt, Homo Sapiens
cuuaugggucuccagaaacucugccagccagccucaguggagaagcuuccucuaccaccagcu

SEQ ID NO: 59080 - RNA, 63 nt, Homo Sapiens
gauacauacaguggaguucuauaaacucauaccucaguggacuuaaccaaaauuguguuaguc

SEQ ID NO: 59081 - RNA, 63 nt, Homo Sapiens
auccuguuccgccuccugccaccuggaccucccucaguggaugucuucccucccccgacccca

SEQ ID NO: 59082 - RNA, 63 nt, Homo Sapiens
ggccuaacucuaaugucgcccggucgggaagcuucaguggagauccugucugccacgugcuga

SEQ ID NO: 59083 - RNA, 63 nt, Homo Sapiens
gaaugucuuuuuauuuuaaaccucuuuuagaagucaguggauuauauauagagguauauuuag

SEQ ID NO: 59084 - RNA, 63 nt, Homo Sapiens
uguuuuccccaccaaguggcuaagaccagaauaucaguggauucacauuuucuguucagggau

SEQ ID NO: 59085 - RNA, 63 nt, Homo Sapiens
ugcuuggaauucuggcagguuccccgggguguuucaguggacaggaggcccccgugccguggc

SEQ ID NO: 59086 - RNA, 63 nt, Homo Sapiens
cuacuacaucuaggacgccuccggugagcagggucaguggaagccccaacgggaaaggaaacg

SEQ ID NO: 59087 - RNA, 63 nt, Homo Sapiens
aucucuuguuuguguugaacugaaggcuaagucucaguggacauggaaaagacuuuuggguga

SEQ ID NO: 59088 - RNA, 63 nt, Homo Sapiens
uacuuaaaggaauaauaaaugcauaauaugaggucaguggacgccauuuucuguuauaaucau

SEQ ID NO: 59089 - RNA, 63 nt, Homo Sapiens
cgaagcauuguuucugagugugugaggauguuuucaguggacucagugaagaucugcccucag

SEQ ID NO: 59090 - RNA, 63 nt, Homo Sapiens
ggguggggccuggugggaggggagcacugccuuucaguggaccccaguccacagaggccccca

SEQ ID NO: 59091 - RNA, 63 nt, Homo Sapiens
ugucccacaagaauucacagggaacgcaagcugucaguggaaccacugaggacugguaccucg

SEQ ID NO: 59092 - RNA, 63 nt, Homo Sapiens
aaacauuuuucaauaaauaauagaaguguauuuucaguggaagacugucuugcauuauaaaau

SEQ ID NO: 59093 - RNA, 63 nt, Homo Sapiens
ggucaucuggguucuaaagguucaaaagcacuuucaguggauugccauaaguaaucagcaauc

SEQ ID NO: 59094 - RNA, 63 nt, Homo Sapiens
caaauuuuugccauuaaaaagcauuauggaguuucaguggaacaaaaguaguagcucucugua

SEQ ID NO: 59095 - RNA, 63 nt, Homo Sapiens
agaguagagcucaaaacugggagagccaaguagucaguggaaggcaagaauucuuaugcuuau

SEQ ID NO: 59096 - RNA, 63 nt, Homo Sapiens
uguucccugaguccgaggcuuuguacuccacagucaguggaacuuuggaaaagaaugcaauag

SEQ ID NO: 59097 - RNA, 63 nt, Homo Sapiens
gcagaacacugcagucagauccuguuacuugcuucaguggaccgaaaucuguauucuguuugc

SEQ ID NO: 59098 - RNA, 63 nt, Homo Sapiens
cgguuugcauucuuuuggaacucaaugugccgaucaguggagucaguaucgagccugaccacc

SEQ ID NO: 59099 - RNA, 63 nt, Homo Sapiens
auauucuuuccuguuucccaauuccuugucucuucaguggaaguauuuuuuauaaccaccauc

SEQ ID NO: 59100 - RNA, 63 nt, Homo Sapiens
ggcagugccacucaggucucuuuaugugggccuucaguggaugaacaugaacaugaguaccua

SEQ ID NO: 59101 - RNA, 63 nt, Homo Sapiens
gagcacgaggauguucucaggcggucacuccucucaguggaaaauuaacaaacccaaagugaa

SEQ ID NO: 59102 - RNA, 63 nt, Homo Sapiens
uauccggggcaauuguagcggcucucugcucugucaguggagccucacugaugguuuuuuacu

SEQ ID NO: 59103 - RNA, 63 nt, Homo Sapiens
gaaacaaggguuuaaacuugucuucauauagaaucaguggaugugagaaacuuugaaaaugga

SEQ ID NO: 59104 - RNA, 63 nt, Homo Sapiens
aaaugagcagauaaguagauagaaacucuuaguucaguggaggagaugugcacucuggacuca

SEQ ID NO: 59105 - RNA, 63 nt, Homo Sapiens
uggcuccuccccgcacugagaaguggagcguuuucaguggaguuguggacaccauggaggggg

SEQ ID NO: 59106 - RNA, 63 nt, Homo Sapiens
cccaucccuggguuccccugggacgguuuguuuucaguggaaugggcccucgacaggacagca

SEQ ID NO: 59107 - RNA, 63 nt, Homo Sapiens
gauuuuuauuaaaaagaagcugcuuauuuauuuucaguggaaguaauaguucaguaauuuaaa

SEQ ID NO: 59108 - RNA, 63 nt, Homo Sapiens
uccuccgaaguuuuucaggggguaaaaguaacaucaguggaggguauuauuuuaaauaaauuu

SEQ ID NO: 59109 - RNA, 63 nt, Homo Sapiens
aaaacauugacuguuaccauugaaugagauggaucaguggauauuaagaugagguuacaaauu

SEQ ID NO: 59110 - RNA, 63 nt, Homo Sapiens
cucuuguuuugguuauuuuguguagcaguuuaaucaguggauaacugagccuguuuccucuua

SEQ ID NO: 59111 - RNA, 63 nt, Homo Sapiens
auuuuacuaacauaaauauuuucuauguguguuucaguggaugacaaucgagcagcagaagaa

SEQ ID NO: 59112 - RNA, 63 nt, Homo Sapiens
ugcuucuuccauagacagaagcuuagucuguuuucaguggaauuaauugaugaacugggaaaa

SEQ ID NO: 59113 - RNA, 63 nt, Homo Sapiens
gucugagaaaauauuuuuuucuaaagaaggcagucaguggaucuuaaaaugacaaucuguuuu

SEQ ID NO: 59114 - RNA, 63 nt, Homo Sapiens
ccagaagaaguuuuuccuugauugugcuauguuucaguggaagaaauucuuugaaguagaugu

SEQ ID NO: 59115 - RNA, 63 nt, Homo Sapiens
aagaggcacauugcauagaagccauuggggaguucaguggaaguucuguaagaugugcaugua

SEQ ID NO: 59116 - RNA, 63 nt, Homo Sapiens
acacucaagacuuuugacugccauuuuguuuguucaguggagacucccuggccaacagaaucc

SEQ ID NO: 59117 - RNA, 63 nt, Homo Sapiens
aaaaucuaaaaauucugguuuuaaauaugagaaucaguggaaaauaaggguauaauuuuguag

SEQ ID NO: 59118 - RNA, 63 nt, Homo Sapiens
auaauagggaaauauccauuuaaaacagguauaucaguggaaacacagaguuauuuuaaguga

SEQ ID NO: 59119 - RNA, 63 nt, Homo Sapiens
ccccuuccugguugcuaccacucaggcugccacucaguggacuccaccccagggacacggcag

SEQ ID NO: 59120 - RNA, 63 nt, Homo Sapiens
aagcugcaaugcaguauugaaggcguggcuucuucaguggaccuagugcaucuuuuguaucuc

SEQ ID NO: 59121 - RNA, 63 nt, Homo Sapiens
gcuucaaaagcagaguuuuggaucuuuaccaggucaguggauuaacaugcaaguuuguacuuu

SEQ ID NO: 59122 - RNA, 63 nt, Homo Sapiens
agggguucaaugaauuacggagccugaucccugucaguggaaaacacaagaaaaacagagaaa

SEQ ID NO: 59123 - RNA, 63 nt, Homo Sapiens
cuuaagaugcaguaauuaugccuucuauauacaucaguggaaagauaaaaauugugccuuuag

SEQ ID NO: 59124 - RNA, 63 nt, Homo Sapiens
ccugaaguuguacuuguguagaaucaccgcauuucaguggacuccagugcccagaauauacua

SEQ ID NO: 59125 - RNA, 63 nt, Homo Sapiens
cuggccaagcacagaggcugguaaaugaagggcucaguggagugaggaggggcugcccacucu

SEQ ID NO: 59126 - RNA, 63 nt, Homo Sapiens
gagcggcaaacugggacaugguguaagugcaaaucaguggaagaagugaagagaacgucauga

SEQ ID NO: 59127 - RNA, 63 nt, Homo Sapiens
ucauucucuugaguaauaaauucugugaaccuaucaguggauuacgcuguagauggaacaugu

SEQ ID NO: 59128 - RNA, 63 nt, Homo Sapiens
agugagcagccgacucugagggcuuucuccagcucaguggagcggcucaggcuagcguaaaca

SEQ ID NO: 59129 - RNA, 63 nt, Homo Sapiens
aauguauuauuuccaugaucaugguauuguauaucaguggagacaacuuuuccagugcauuac

SEQ ID NO: 59130 - RNA, 63 nt, Homo Sapiens
aaaauuuccccuuuuuuucagaauauaaauuugucaguggaaugcuuauacauuauauuuaua

SEQ ID NO: 59131 - RNA, 63 nt, Homo Sapiens
ccaaagucaagaccagcaccugagccucgggacucaguggacagacugcaucccuccugggcc

SEQ ID NO: 59132 - RNA, 63 nt, Homo Sapiens
caggagcuaacucagaccccgcugacggccugcucaguggagcauccgcguggugggcuggca

SEQ ID NO: 59133 - RNA, 63 nt, Homo Sapiens
uguguuauucuuucuauaaugaucaguuuacuuucaguggauucagaauuguguagcaggaua

SEQ ID NO: 59134 - RNA, 63 nt, Homo Sapiens
aagaccuucccuuccuugaucccuggaccagacucaguggacauuugugcaauugcucgcccu

SEQ ID NO: 59135 - RNA, 63 nt, Homo Sapiens
cugcccucucugagucucaguuuuuccauuuguucaguggagagaauuaaccauugauaccuc

SEQ ID NO: 59136 - RNA, 62 nt, Homo Sapiens
acauccugggccuggaauagugaugaagagcaucaguggaaaacccaccccacacgccaugg

SEQ ID NO: 59137 - RNA, 63 nt, Homo Sapiens
caugacugacggccccuugugcaagcucauucuucaguggauccuucaguggaguggugacac

SEQ ID NO: 59138 - RNA, 63 nt, Homo Sapiens
ccccuugugcaagcucauucuucaguggauccuucaguggaguggugacacgugccagcgguc

SEQ ID NO: 59139 - RNA, 63 nt, Homo Sapiens
gugacuuccauuauggcuggacaggcggugagcucaguggauugcaguggugugcuggugauu

SEQ ID NO: 59140 - RNA, 63 nt, Homo Sapiens
uaaucccauccucucacccauccauuuccucacucaguggagauuugccaaaugaauaaacga

SEQ ID NO: 59141 - RNA, 63 nt, Homo Sapiens
aauuuagaggaaaucaaacaagcaucacuuuccucaguggaaaaacuuaugaaacuucuuaua

SEQ ID NO: 59142 - RNA, 63 nt, Homo Sapiens
gauauuucuugaaaauaacgaccuugucuuguaucaguggaagaaguaaguugcuuagaaagg

SEQ ID NO: 59143 - RNA, 63 nt, Homo Sapiens
aacaugugauuucaggguugccgcagugucaccucaguggaccagccugggggaaggagcuua

SEQ ID NO: 59144 - RNA, 63 nt, Homo Sapiens
uugccucacucugauccuggccccauaauguccucaguggaaggugaugggggccggugcugu

SEQ ID NO: 59145 - RNA, 63 nt, Homo Sapiens
gaagcuuauaaucuaauuuuaggaggaccaaauucaguggauggcaacuggaacauugauugu

SEQ ID NO: 59146 - RNA, 63 nt, Homo Sapiens
guuuaagacgccaagggcauugcagaaucccucucaguggacaguaugcacucagcugaccac

SEQ ID NO: 59147 - RNA, 63 nt, Homo Sapiens
guaugagcgucaaguccugcgaaguccugcguuucaguggagcccacugagggacugggcugg

SEQ ID NO: 59148 - RNA, 63 nt, Homo Sapiens
gaggaagcuuuagauagagagcacuccugguuuucaguggacaccaagcccagaaguaccuuu

SEQ ID NO: 59149 - RNA, 63 nt, Homo Sapiens
aauaguucucuagcuaaggaucucuuccaggagucaguggaagagaaaugggaaucuuuuuuu

SEQ ID NO: 59150 - RNA, 63 nt, Homo Sapiens
aagcagaugagaaacucuuggguggaugaaaugucaguggaagggugucaaugaauuuugcuu

SEQ ID NO: 59151 - RNA, 63 nt, Homo Sapiens
ugccccuccuaagcagagaacugcccagccuucucaguggacuugaacucuuucaacucugcg

SEQ ID NO: 59152 - RNA, 63 nt, Homo Sapiens
gcauuguccugugaaauauuaaguaacauuaacucaguggaagagcauaaggguuauuugagc

SEQ ID NO: 59153 - RNA, 63 nt, Homo Sapiens
cuuuuguuuguguguguguggaaaaaggaaaauucaguggagggcucugaacuuuguguauuu

SEQ ID NO: 59154 - RNA, 63 nt, Homo Sapiens
uccagcgagauauuagaaauagcuuucuuuauaucaguggaaauucagggucugucuaucuua

SEQ ID NO: 59155 - RNA, 63 nt, Homo Sapiens
cucgggguuuggacuuaauguacuuacuuguuaucaguggauuaaaaaauuagcacaucccuu

SEQ ID NO: 59156 - RNA, 63 nt, Homo Sapiens
aggucagaagcucauguucucagaugcugguccucaguggauugcuguugguagugcuuucca

SEQ ID NO: 59157 - RNA, 63 nt, Homo Sapiens
ggccugagguagaggggagugguauguguuuucucaguggaagcagcacaugagugggugaca

SEQ ID NO: 59158 - RNA, 63 nt, Homo Sapiens
uguccuaggugcuagguggaccgagcaaaagacucaguggaugaacuggugcagugccugaca

SEQ ID NO: 59159 - RNA, 63 nt, Homo Sapiens
auuucaaauauuuagcaacaaaaguuuauuccuucaguggaagauuuauaauaaugauaggug

SEQ ID NO: 59160 - RNA, 63 nt, Homo Sapiens
guuagaacuacuacucacaguuaccacuuggggucaguggaacaaaaugcauauaugguuuug

SEQ ID NO: 59161 - RNA, 63 nt, Homo Sapiens
ugcuuucauuguuuuuucauaaucuuuucuccuucaguggaguacugauugcaugaaauuuga

SEQ ID NO: 59162 - RNA, 52 nt, Homo Sapiens
agucucuuccagacucauagcaucaguggauaccauguggcugagaaaagaa

SEQ ID NO: 59163 - RNA, 63 nt, Homo Sapiens
uagcugcucugagcaucaagaauuagaagucuuucaguggaauuguacaagagucccuuugaa

SEQ ID NO: 59164 - RNA, 63 nt, Homo Sapiens
ugacugccgugugugcuuagacccguaguuuccucaguggauagcacucaauuuauuccguag

SEQ ID NO: 59165 - RNA, 63 nt, Homo Sapiens
aaagguguugauuuuuguauaugaaguuaagccucaguggagucucauuuguuaguuuuuagu

SEQ ID NO: 59166 - RNA, 63 nt, Homo Sapiens
aaggcagggguuaaaucaggauaaaaacagacaucaguggaaucgaaaaccaauaguuaguua

SEQ ID NO: 59167 - RNA, 63 nt, Homo Sapiens
guuuuaauguagaaccucaaacaggauggaacaucaguggauggcaggagguugggaauucuu

SEQ ID NO: 59168 - RNA, 63 nt, Homo Sapiens
cugcucugugguccgaagucaaggaaaucugugucaguggaugacuauuauagaauggaacuc

SEQ ID NO: 59169 - RNA, 63 nt, Homo Sapiens
uuaagaggggugagaaaacaccacuuuaauuucucaguggaagaggauucuuugaacuuauuu

SEQ ID NO: 59170 - RNA, 63 nt, Homo Sapiens
acuuaaccacugcugucccuccccuucagguccucaguggauugagaaagguaaguccauuuu

SEQ ID NO: 59171 - RNA, 63 nt, Homo Sapiens
guuuccuagcaaucauuuuggaucacuggacuuucaguggacuaccuaaaacaggggacagcu

SEQ ID NO: 59172 - RNA, 63 nt, Homo Sapiens
uauuaaaugacuccaccugcgcaguccuuguguucaguggaugaauaccugugggcucuugua

SEQ ID NO: 59173 - RNA, 63 nt, Homo Sapiens
gaaauaacugaaguauaacaugcaagaaaaugaucaguggaauugguauuuucaauuuucauu

SEQ ID NO: 59174 - RNA, 63 nt, Homo Sapiens
guagaugcuuuguauaucuuucauuuugcccugucaguggaugcuuuuuauuucccuuguuuc

SEQ ID NO: 59175 - RNA, 63 nt, Homo Sapiens
gguuuucgcuuaaaggaaaauuuggaauuuuuuucaguggaguugcaauuuuuaaaaaacaag

SEQ ID NO: 59176 - RNA, 63 nt, Homo Sapiens
gagaaugcuucccauagaaaccuuggaacugaaucaguggaaaucgguuaaugggucaguucu

SEQ ID NO: 59177 - RNA, 63 nt, Homo Sapiens
aaauauucgacaggccauaaucuguagauaacgucaguggaguguacaaacuggccaagugcu

SEQ ID NO: 59178 - RNA, 63 nt, Homo Sapiens
uguggcugggaacauugcaucccaaagagcuucucaguggaggaggcuggggaaggcaugagg

SEQ ID NO: 59179 - RNA, 63 nt, Homo Sapiens
uucauaacuugugggcuuuuuuuuuuuuuaacuucaguggaauuuacuuuagauauucauuca

SEQ ID NO: 59180 - RNA, 63 nt, Homo Sapiens
uucagccucucaguuuuaauauagcuuuauuuuucaguggagaucauuguuuaggaugagaca

SEQ ID NO: 59181 - RNA, 63 nt, Homo Sapiens
auuaauguuuacaguggaauugugaauaaguuuucaguggacuaucuuaucccuugacaaaaa

SEQ ID NO: 59182 - RNA, 63 nt, Homo Sapiens
cauacugcauucugugcuacacaagccuuagccucaguggagcugugguucucuugguacuuu

SEQ ID NO: 59183 - RNA, 63 nt, Homo Sapiens
cucugcugugcugcacauugagcccuuucucagucaguggaguaucaaguugggccaucuguc

SEQ ID NO: 59184 - RNA, 63 nt, Homo Sapiens
aggcccaggcaggcccagccucugccccacccaucaguggaguccagauggcaggcuacaguu

SEQ ID NO: 59185 - RNA, 63 nt, Homo Sapiens
agaugguuuagguguacagcaaauuuaaaauagucaguggauugugucuuacuacuucauguc

SEQ ID NO: 59186 - RNA, 63 nt, Homo Sapiens
uuugcuuaguaucauguccauguuuccuucaccucaguggagcuucugaguuuuauacugcuc

SEQ ID NO: 59187 - RNA, 63 nt, Homo Sapiens
gcacuggguucuacugcugugggguaaacuaacucaguggaauagggcugguuacuuugggcu

SEQ ID NO: 59188 - RNA, 63 nt, Homo Sapiens
uauuuuaaaugcauuuaucuuuuuugacacuauucaguggaauguguaagcuagcuaauucuu

SEQ ID NO: 59189 - RNA, 63 nt, Homo Sapiens
cauccacacaaacccacggcucccaguugacagucaguggaaugcucgucuccuuagcgucca

SEQ ID NO: 59190 - RNA, 63 nt, Homo Sapiens
uacagacucccugggguuggcaggggcuccaucucaguggaccaggaagcaagaggggaagcg

SEQ ID NO: 59191 - RNA, 63 nt, Homo Sapiens
acuuuucauuguaauuucgcuuagacccuuuuaucaguggagcuccaguuuucuuaccuagcu

SEQ ID NO: 59192 - RNA, 63 nt, Homo Sapiens
agggccaacuuaguuccuacuguucugugcccuucaguggauggaacgugagugucugaucau

SEQ ID NO: 59193 - RNA, 63 nt, Homo Sapiens
gaaacacaaacaauaguaauucucaggccaucaucaguggagccauguuaauguaaucugaug

SEQ ID NO: 59194 - RNA, 63 nt, Homo Sapiens
guuuuaacaauccauucacaagccuccuguaccucaguggaucuucagaacugcccuugcugc

SEQ ID NO: 59195 - RNA, 63 nt, Homo Sapiens
ucuggacauauuuauggacuaaugagagauauuucaguggacaauagaaaccaaguaagaaua

SEQ ID NO: 59196 - RNA, 63 nt, Homo Sapiens
caaaucaaaagccacuaacaaacuguguguaugucaguggaauuaaauaugacauugaauucg

SEQ ID NO: 59197 - RNA, 63 nt, Homo Sapiens
aguuauguuuuauacucuacauccaaccuccugucaguggagcuaauacaauauuaaguccaa

SEQ ID NO: 59198 - RNA, 63 nt, Homo Sapiens
gaguuugaucugcagcacccccagaggacauucucaguggaaacauucagagagaacaugggu

SEQ ID NO: 59199 - RNA, 63 nt, Homo Sapiens
gagccaggggcuggagguggggggacagcacagucaguggagacagaggcugggguccuccug

SEQ ID NO: 59200 - RNA, 63 nt, Homo Sapiens
ugggccugcagcagacucaaugcucguggccacucaguggagcuggcccgguggggacacagu

SEQ ID NO: 59201 - RNA, 63 nt, Homo Sapiens
ccaaagcaaaagcucccgacccacucacuuaucucaguggacuucuggucuuccaagacuuug

SEQ ID NO: 59202 - RNA, 63 nt, Homo Sapiens
caagggugggccuugugagggucaaagagagggucaguggaaagaggcaauuggggguuucag

SEQ ID NO: 59203 - RNA, 63 nt, Homo Sapiens
ggugcccacagcagguacccacuggcccccuccucaguggagaccccaaggagcugcagcuga

SEQ ID NO: 59204 - RNA, 63 nt, Homo Sapiens
cugagaggacuuuucuuuguggcuuccuaaaauucaguggaaaauuaauuguuuggggaugag

SEQ ID NO: 59205 - RNA, 63 nt, Homo Sapiens
ucaguccccaacggcuggcaagacucaggguccucaguggacauggugugggugacaucagaa

SEQ ID NO: 59206 - RNA, 63 nt, Homo Sapiens
gcaaauuuuuaaguaauuuaugaaaaaccuagaucaguggaucuccucucuggcugcccauua

SEQ ID NO: 59207 - RNA, 63 nt, Homo Sapiens
cccuuaacugauuguuauaugcuacaagggauuucaguggacugcagagugcgaacgucuugc

SEQ ID NO: 59208 - RNA, 63 nt, Homo Sapiens
cugcccgcaaagcaagagcaucauuccuauucuucaguggaugccagccuucccugccccaac

SEQ ID NO: 59209 - RNA, 63 nt, Homo Sapiens
uuuguggugggugcugugaagaguaaacauuacucaguggaaagcuaaguucagaagguacuu

SEQ ID NO: 59210 - RNA, 63 nt, Homo Sapiens
cccugcacccaccccugcccaggcagucuuugcucaguggaucacacacauggaaggugaugg

SEQ ID NO: 59211 - RNA, 63 nt, Homo Sapiens
guggccuggaggccuauuaagcacgacacaguaucaguggaauugauccauaaaccucccugu

SEQ ID NO: 59212 - RNA, 63 nt, Homo Sapiens
ucacugugcuagcaauaguuggcuucuccccugucaguggaaaccccacuucugcccggcccu

SEQ ID NO: 59213 - RNA, 63 nt, Homo Sapiens
gaagcugcugacugugauuaaugcagaucacugucaguggaggcaggccgccaggaauggacc

SEQ ID NO: 59214 - RNA, 63 nt, Homo Sapiens
aagacgucccuccuccaucaggccucuggggaaucaguggaugaucuaggaccucagccaugu

SEQ ID NO: 59215 - RNA, 63 nt, Homo Sapiens
acaaaggagggccucacugucagugaaaagcuuucaguggaggcucuuucuuugcagaccgaa

SEQ ID NO: 59216 - RNA, 63 nt, Homo Sapiens; identical to SEQ ID NO: 59214

SEQ ID NO: 59217 - RNA, 63 nt, Homo Sapiens
caauaaucaucucuauugcugaacuuacucuauucaguggaaauauauguuaaaccaaucaag

SEQ ID NO: 59218 - RNA, 63 nt, Homo Sapiens
augacgggggaucugaggcuccaucccccuuauucaguggaagcaacugcugagaccucuucu

SEQ ID NO: 59219 - RNA, 63 nt, Homo Sapiens
gcaguuuuuuuacuauuccagcuauuuuuuuugucaguggaauuugugcuauuuggaagcaaa

SEQ ID NO: 59220 - RNA, 63 nt, Homo Sapiens
uauucaccuuaagcgauuucaauuuguaaaugaucaguggauaaaaucacagaaaauugucag

SEQ ID NO: 59221 - RNA, 63 nt, Homo Sapiens
cggaguccuagcauccccuugggagcagcagcgucaguggacccagugcugagaaaagccccc

SEQ ID NO: 59222 - RNA, 63 nt, Homo Sapiens
agaacaaagcccauucauccauuggauucacugucaguggagauacuaccucucguggcaacc

SEQ ID NO: 59223 - RNA, 63 nt, Homo Sapiens
cugaaccuugaggagggaaagcuugccuucuauucaguggacaaucaggagaagcuucuguau

SEQ ID NO: 59224 - RNA, 63 nt, Homo Sapiens
guaaaguucccuucuugggacuuauuccuggagucaguggauacaaguagugcagaagguuca

SEQ ID NO: 59225 - RNA, 63 nt, Homo Sapiens
aggcagcgacuccuuggacagaggccugggcccucaguggacugccugcucccacagccuggg

SEQ ID NO: 59226 - RNA, 63 nt, Homo Sapiens
aggcugcugacccucagcagggccagacaaggcucaguggaucuggucugaguuucaaucugc

SEQ ID NO: 59227 - RNA, 63 nt, Homo Sapiens
agccacauuacaagcugccauccccuccccguuucaguggacccuguggccaggugcuuuucc

SEQ ID NO: 59228 - RNA, 63 nt, Homo Sapiens
uaccugacucuguguuguaauuucaggggagcaucaguggaggaggcagugggggcagcagca

SEQ ID NO: 59229 - RNA, 53 nt, Homo Sapiens
uucggacccaaaagaggugacugucaguggaggggucucugcagccaacugag

SEQ ID NO: 59230 - RNA, 63 nt, Homo Sapiens
gggguguccugggcugaauuuccugggcacuucucaguggaacucucuagccuccugguucgg

SEQ ID NO: 59231 - RNA, 63 nt, Homo Sapiens
uccugagcuuggccagaagggggccaugaggccucaguggacuuuccacccccucccuggccu

SEQ ID NO: 59232 - RNA, 63 nt, Homo Sapiens
aucuuuuuuagcugagggggacaagaggagaagucaguggacacauggaaguuacucgugacc

SEQ ID NO: 59233 - RNA, 63 nt, Homo Sapiens
cugcacugguuugucgaucuaguucaguucaacucaguggauguucucugaaugcuuacuggg

SEQ ID NO: 59234 - RNA, 63 nt, Homo Sapiens
ugugauucuuaacauuauagcacaaguauuaucucaguggauuauccggaauaacaucugaaa

SEQ ID NO: 59235 - RNA, 63 nt, Homo Sapiens
gaucaaagaacucugacugcagaacugccgcucucaguggacagggcaucuguuacccugaga

SEQ ID NO: 59236 - RNA, 63 nt, Homo Sapiens
ccugagaccuuagaaaccagaagagccauacagucaguggaaggcgggggggcccuggccucu

SEQ ID NO: 59237 - RNA, 63 nt, Homo Sapiens
gcuuucaagcagugcuuguuuucccuggaccguucaguggacacaccaucugugggucauccu

SEQ ID NO: 59238 - RNA, 63 nt, Homo Sapiens
auaauaauaguggaggguugugauacaggcaauucaguggacuaacaaacaaaaaacugccuu

SEQ ID NO: 59239 - RNA, 63 nt, Homo Sapiens
gccuuggacugaacgugggcagucacacggggcucaguggacggacacccccagcucugucag

SEQ ID NO: 59240 - RNA, 63 nt, Homo Sapiens
guagcuucuuaaaaaaaaaauaauacuuccuuuucaguggacuuuuucuucucagaaaaacca

SEQ ID NO: 59241 - RNA, 63 nt, Homo Sapiens
ccuauagcuuccugaagcugacugcaguuugaaucaguggaugugaccauucagcuauaacca

SEQ ID NO: 59242 - RNA, 63 nt, Homo Sapiens
ucuugguuugaugauaaccugcugaucaaaugaucaguggaauugccuguuuccuaguaaugg

SEQ ID NO: 59243 - RNA, 63 nt, Homo Sapiens
gauauuuauguauuauuuuuguuauauccuggcucaguggagucauguaucuguaguccauga

SEQ ID NO: 59244 - RNA, 63 nt, Homo Sapiens
augaugccuccuccgggaagcccacggugcuucucaguggacacacacaggcaguggccaggc

SEQ ID NO: 59245 - RNA, 63 nt, Homo Sapiens
uauauuuaggucccagaacaaggaagucacuuuucaguggauccaaagaaucuacuccuuaaa

SEQ ID NO: 59246 - RNA, 63 nt, Homo Sapiens
aucacaucagggagugauuaguccuggggaaauucaguggaggcacaagccugaagcacucuu

SEQ ID NO: 59247 - RNA, 63 nt, Homo Sapiens
gugggaauuaacucucccaagaaaggcauucauucaguggacauaauauauuuauuaauauuu

SEQ ID NO: 59248 - RNA, 53 nt, Homo Sapiens
aaauggagacucagaagaggauaucaguggagauacuuuuauuauuuggauga

SEQ ID NO: 59249 - RNA, 63 nt, Homo Sapiens
cucugcccuucuuuuucuuacuguaggagauacucaguggagcagguaauaccacuaucaggc

SEQ ID NO: 59250 - RNA, 63 nt, Homo Sapiens
aggaaugcaauugugaauucaaggcugguaugaucaguggaucucaucucgcccagagugcuc

SEQ ID NO: 59251 - RNA, 63 nt, Homo Sapiens
agagcaaagccacagacgaugacuuguccauucucaguggaugcuccaggcugugccuacaca

SEQ ID NO: 59252 - RNA, 63 nt, Homo Sapiens
gcuggagcugcagccugcucgccaucuggaggcucaguggaguggggaguugggguucucaua

SEQ ID NO: 59253 - RNA, 63 nt, Homo Sapiens
caauaugcuuuggguggacggucuccuacauguucaguggaggccaccaggagcauccaugag

SEQ ID NO: 59254 - RNA, 63 nt, Homo Sapiens
cugaaucacgagaauguggagggguggggggugucaguggaaaggcauaaggcugagcugaga

SEQ ID NO: 59255 - RNA, 63 nt, Homo Sapiens
guagguggugguuuuaggucuugucacccucacucaguggaacugccucugggagcuuuggcg

SEQ ID NO: 59256 - RNA, 63 nt, Homo Sapiens
agugucuaggaaaaaacaaaaacuccaaacccuucaguggaugaggacaaggucgcagaaagg

SEQ ID NO: 59257 - RNA, 63 nt, Homo Sapiens
cugaagggagaggaguaacagccagaccccccaucaguggacaaggggagaguccccuacucc

SEQ ID NO: 59258 - RNA, 63 nt, Homo Sapiens
aaguuccugcuggcguuucuaguccugagucccucaguggagcuguccuccucuuucugugag

SEQ ID NO: 59259 - RNA, 63 nt, Homo Sapiens
ugacggcuacuguggagaugggcagaugaggccucaguggaagcgacuggagcaagguuugcu

SEQ ID NO: 59260 - RNA, 63 nt, Homo Sapiens
cucagaccagcucccagaugcaaauaaacggacucaguggacaaacccagugagacagaccgc

SEQ ID NO: 59261 - RNA, 63 nt, Homo Sapiens
gcagcugucaggccugaaggggggcuguggccgucaguggaauaggaggaagggagggcagag

SEQ ID NO: 59262 - RNA, 63 nt, Homo Sapiens
uagaccugccaggagcacuuucucacucugccuucaguggagcgcucauguggguguccccuc

SEQ ID NO: 59263 - RNA, 63 nt, Homo Sapiens
cccguuccccccaucccuggugucacccggaccucaguggaaguugagggaagaccacccucc

SEQ ID NO: 59264 - RNA, 63 nt, Homo Sapiens
ucuccuggggccuucgaugggcuuuucuucuugucaguggagggagcagcuccccacucagcc

SEQ ID NO: 59265 - RNA, 63 nt, Homo Sapiens
aagaugcccagggcccagaagccaucagaauuaucaguggagaagcaccuuuugacucuuccc

SEQ ID NO: 59266 - RNA, 63 nt, Homo Sapiens
cuggagacaacaccucagaccaucugaaccccaucaguggacgaaaauggggcuguuaauaua

SEQ ID NO: 59267 - RNA, 63 nt, Homo Sapiens
agagauguuauguaauaugcugagguggcgaccucaguggagaaauguaaagacugaauugaa

SEQ ID NO: 59268 - RNA, 63 nt, Homo Sapiens
ccccagggcacauaagagcaaaggcuccaauggucaguggaugacucugcaaaagugaccccc

SEQ ID NO: 59269 - RNA, 63 nt, Homo Sapiens
aaccacagcagcagccagggccacaccgugcccucaguggacuuggggagcuguccggugcua

SEQ ID NO: 59270 - RNA, 63 nt, Homo Sapiens
acgugucucuuuaaagcugcaagcaacuuuaugucaguggaaagagauaagcugcaaggggcg

SEQ ID NO: 59271 - RNA, 63 nt, Homo Sapiens
acugaaauacagcgguuguguugguguugugagucaguggaacuauauauauacagugccuuu

SEQ ID NO: 59272 - RNA, 61 nt, Homo Sapiens
uaaagcucaaagcaaacaacuggaacagauacgucaguggacauaacagaagagacuagag

SEQ ID NO: 59273 - RNA, 63 nt, Homo Sapiens
cacaaaauauaguaauuucauuuuuaccuuucuucaguggacugaauuguauggaaggaaauu

SEQ ID NO: 59274 - RNA, 63 nt, Homo Sapiens
agcuucccagggcugcccccgacaggcuggcucucaguggaggccagagaucuggaaucgggg

SEQ ID NO: 59275 - RNA, 63 nt, Homo Sapiens
aaaaaaacauuuaaaaauguugaaacuuaaagaucaguggaaaaagaaauaaaugaguauuac

SEQ ID NO: 59276 - RNA, 63 nt, Homo Sapiens
caagugggaaaacaugguccgccucugugugccucaguggagaaggccucgaggagucaauuu

SEQ ID NO: 59277 - RNA, 63 nt, Homo Sapiens
gucuguaggaaacuugcagcgucucuggggcacucaguggauucugggaaguuuuucagugac

SEQ ID NO: 59278 - RNA, 63 nt, Homo Sapiens
ccuaaucccuggcccucccagcugucugggacuucaguggacccccagccccugcccccacuc

SEQ ID NO: 59279 - RNA, 63 nt, Homo Sapiens
ccgcuggcgucaaguucagcuccacgugugccaucaguggauccgauccguccagccauggcu

SEQ ID NO: 59280 - RNA, 63 nt, Homo Sapiens
gugcugucuaugcacaggugacugcagcgacaaucaguggaugcaggcuuaguaacgccgugg

SEQ ID NO: 59281 - RNA, 63 nt, Homo Sapiens
gcaggggucuggcacaggugcugcuugcggcuuucaguggaggccuugcaugcaccuugcuac

SEQ ID NO: 59282 - RNA, 56 nt, Homo Sapiens
gaugcacguugauacuauuuagucauucaguggaaaauguuggccacgauccauga

SEQ ID NO: 59283 - RNA, 63 nt, Homo Sapiens
ugccuggguggggagcaggucuccucugucuugucaguggaggucggccugagagcugugccg

SEQ ID NO: 59284 - RNA, 63 nt, Homo Sapiens
uggggagguuagagagaugggaaaugcucagccucaguggagagcccccggccaggcccugag

SEQ ID NO: 59285 - RNA, 63 nt, Homo Sapiens
uuccugcacccccagccuggcuccugggcgacgucaguggaccccaacucagggacauccccu

SEQ ID NO: 59286 - RNA, 63 nt, Homo Sapiens
aaacauuauuucauuuuuuuccucucaguaaugucaguggaaguuagggaaaagauucuugga

SEQ ID NO: 59287 - RNA, 63 nt, Homo Sapiens
cuucuuccuuguccccguguuucuugagagcacucaguggaugacuauggagaagagccugca

SEQ ID NO: 59288 - RNA, 63 nt, Homo Sapiens
auccuuuuacacgcacaaaagcaauagauucauucaguggacaaguuccuuguuuaacuacac

SEQ ID NO: 59289 - RNA, 63 nt, Homo Sapiens
gguuauauuucaaccacaccuaaauuaacaaauucaguggacauuuguucuggguuaacagua

SEQ ID NO: 59290 - RNA, 63 nt, Homo Sapiens
ccuaggucuugggagcucuuggaggugucuguaucaguggauuucccauccccugugggaaau

SEQ ID NO: 59291 - RNA, 55 nt, Homo Sapiens
gugcccggaaaaaugauuaaagcauucaguggaaguauaucuauuuuuguauuuu

SEQ ID NO: 59292 - RNA, 63 nt, Homo Sapiens
uuuuuucuuuuucccuucucuucuuaggaaccaucaguggacaugaauguuucuacaaugcau

SEQ ID NO: 59293 - RNA, 63 nt, Homo Sapiens
augauguucagauggugaaauacaauuaauaacucaguggaaaguucagcagaauaaacucuu

SEQ ID NO: 59294 - RNA, 63 nt, Homo Sapiens
ccauguuaugucgacuauuaccauuuuaucccuucaguggaaaugaugaggucaugucacaga

SEQ ID NO: 59295 - RNA, 63 nt, Homo Sapiens
cuguguugccaauggacaaaauaugaccggguaucaguggaaguggcuucucucccuccaggu

SEQ ID NO: 59296 - RNA, 63 nt, Homo Sapiens
ucaaucagaagguauucugaauuuaaugaugcuucaguggaaacuagcaaugccacgauuuag

SEQ ID NO: 59297 - RNA, 63 nt, Homo Sapiens
cucuuuuuuccuaauuauaaacacaugaugcauucaguggacagaaauguuaauugcauuuuu

SEQ ID NO: 59298 - RNA, 63 nt, Homo Sapiens
ugucaaguacaggugagcacgugaacccagugaucaguggaaugugcugaaagaaacauugau

SEQ ID NO: 59299 - RNA, 63 nt, Homo Sapiens
aacaaaguacacuugauaaaaagggguuauuggucaguggaagcuuuuaugugucuuucuaca

SEQ ID NO: 59300 - RNA, 63 nt, Homo Sapiens
uuaucuucauuaaauuuagcuuuccuuaggaauucaguggaacuggugucggaauuguuguau

SEQ ID NO: 59301 - RNA, 63 nt, Homo Sapiens
guucagcagaauaaacucuuuacaauuaauaacucaguggaaaaugauguucagauggugaaa

SEQ ID NO: 59302 - RNA, 63 nt, Homo Sapiens
ucaaaagcagaauuuuuaaaacugcauuuuuaaucaguggaacucaauguauaguuagcuuua

SEQ ID NO: 59303 - RNA, 63 nt, Homo Sapiens; identical to SEQ ID NO: 59302

SEQ ID NO: 59304 - RNA, 64 nt, Homo Sapiens
ccagccagggacgccaggacauagcugcuccuggucaguggaggucagccggguaucaaaagcc

SEQ ID NO: 59305 - RNA, 64 nt, Homo Sapiens
uauuuccaagaagcugaaucuuugggacugauucucaguggagggcuuagaucauacaaaaauc

SEQ ID NO: 59306 - RNA, 64 nt, Homo Sapiens
acaaauaacugauguuuuaaccagaguaaugaccucaguggauuugcuuuaacccucacauuuu

SEQ ID NO: 59307 - RNA, 64 nt, Homo Sapiens
gccagagcuagcgucccuacugccucccgacuccucaguggaggaggagcugcggucccucugg

SEQ ID NO: 59308 - RNA, 64 nt, Homo Sapiens
ugggguccaggucggguguggacuguccucacugucaguggagccccagaagcuagauggguac

SEQ ID NO: 59309 - RNA, 64 nt, Homo Sapiens
caaccuugucacauguagcugagucugggaugacucaguggaucaguggaugcguggaagguuu

SEQ ID NO: 59310 - RNA, 64 nt, Homo Sapiens
ucacauguagcugagucugggaugacucaguggaucaguggaugcguggaagguuuugguguuu

SEQ ID NO: 59311 - RNA, 64 nt, Homo Sapiens
agauacccagaggucccccaggucaucacuuggcucaguggaagcccucuuuccccaaauccua

SEQ ID NO: 59312 - RNA, 64 nt, Homo Sapiens
uaaguggauacauaagauuaacuaucacagugacucaguggaauuuuuuguuugcuuuuguaca

SEQ ID NO: 59313 - RNA, 64 nt, Homo Sapiens
aauuugcuuauauguaaaaguuguuuuuguggagucaguggauauauuucuaaugaagugcuag

SEQ ID NO: 59314 - RNA, 64 nt, Homo Sapiens
uaugaucuaaaagccaacuuuuucucaguuuuacucaguggaaagauaaacuaaguuuuaaugu

SEQ ID NO: 59315 - RNA, 64 nt, Homo Sapiens
uggugacacacugagugaaagggacugggccagcucaguggaccguguggaacaggaacagcug

SEQ ID NO: 59316 - RNA, 64 nt, Homo Sapiens
uggaaaagaugccuucuggaucuuaagccaguugucaguggagguccucagggcugcaaauguc

SEQ ID NO: 59317 - RNA, 64 nt, Homo Sapiens
ccaaaccuuguagccuaagccauuugucuuuuucucaguggagggaguguauggaccuggcccc

SEQ ID NO: 59318 - RNA, 64 nt, Homo Sapiens
cacccaggauccugaucugcccugcacugagcacucaguggauaaacacuccuccagcccagac

SEQ ID NO: 59319 - RNA, 64 nt, Homo Sapiens
acuaaacaucgacuucgguucacuucacggauguucaguggauaucggucacaugccagguccc

SEQ ID NO: 59320 - RNA, 64 nt, Homo Sapiens
gagucuagugcagacccgugaucaccuuagugcuucaguggauucacugguuagauuaaaaaga

SEQ ID NO: 59321 - RNA, 64 nt, Homo Sapiens
agguuuauucauucauuaaacuacuuuggaagcgucaguggauauauuugaaagugguaauccu

SEQ ID NO: 59322 - RNA, 64 nt, Homo Sapiens
aacaaguuucuuguuauccugaaacuuucuaugcucaguggaaaguaucugccagccacagcau

SEQ ID NO: 59323 - RNA, 64 nt, Homo Sapiens
uccauuuuccuuuccuugugguugaaaaccacagucaguggagagauguuuggaaaccacaguc

SEQ ID NO: 59324 - RNA, 64 nt, Homo Sapiens
ccacagucaguggagagauguuuggaaaccacagucaguggagccugggugguacccaggcuuu

SEQ ID NO: 59325 - RNA, 64 nt, Homo Sapiens
aaucaauuacggagauacagagccuugaggucuuucaguggaaaggugguucauguucauucuc

SEQ ID NO: 59326 - RNA, 64 nt, Homo Sapiens
caggacugggggucuggcuuggggcagggauugcucaguggaagccagccugggggucugggcu

SEQ ID NO: 59327 - RNA, 64 nt, Homo Sapiens
guucgggaugcagggggcacauaaauaacccccgucaguggaguagcuguaggcaagcuugcac

SEQ ID NO: 59328 - RNA, 64 nt, Homo Sapiens
agaugaagccaaaggacagaccagugcugcugcuucaguggaaggcucauucccuuacccccgg

SEQ ID NO: 59329 - RNA, 64 nt, Homo Sapiens
gucugcucuagaugagcuggguugaagaagaugaucaguggacaggugccuucuucagggccug

SEQ ID NO: 59330 - RNA, 64 nt, Homo Sapiens
cagauagaaaauauaaagucuuuaagcccagacuucaguggaccgcccagaaucagcucuggau

SEQ ID NO: 59331 - RNA, 64 nt, Homo Sapiens
uuucuuaauuuuucuaaagauauucuuaagaguuucaguggaauuuaguuuacaaucuaagagu

SEQ ID NO: 59332 - RNA, 64 nt, Homo Sapiens
uuuaaaacuugguacuacuacaguuaaaucuguaucaguggacucaauuuguaguuuuauuaug

SEQ ID NO: 59333 - RNA, 64 nt, Homo Sapiens
caucccccuguuagagacccccagaacucaagguucaguggacacucaucaauccgucugggug

SEQ ID NO: 59334 - RNA, 64 nt, Homo Sapiens
uuugugggccuccagcuucuggacagaaagagggucaguggacuggguccuuuauucauuucug

SEQ ID NO: 59335 - RNA, 64 nt, Homo Sapiens
agaugucucaaaaauccuuauccuuuauaauauuucaguggaaucuagaagugguuuguagacu

SEQ ID NO: 59336 - RNA, 64 nt, Homo Sapiens
guuaaaccuucccccacucauguccucccuuuguucaguggacgccauuuuuaaugauguugug

SEQ ID NO: 59337 - RNA, 64 nt, Homo Sapiens
ccuugcccccaaaugucgacauuugggggauuuuucaguggaacgaccugaaaccucagcguga

SEQ ID NO: 59338 - RNA, 64 nt, Homo Sapiens
acaccauucucccccccucaccccccccaccaccucaguggaacgacagugggcaagaggacac

SEQ ID NO: 59339 - RNA, 64 nt, Homo Sapiens
gcccugaaaggaggcucacugagcccuuuccaagucaguggagauaccucaaacacuggccugu

SEQ ID NO: 59340 - RNA, 64 nt, Homo Sapiens
auugaaaacaacaacaacaagugaaguaauaguuucaguggaugagaugcguaauauaauucug

SEQ ID NO: 59341 - RNA, 64 nt, Homo Sapiens
uuuuuauucuucuuuagucuauuuuuuuuaaucaucaguggaaagcugcugauauuauggaagu

SEQ ID NO: 59342 - RNA, 64 nt, Homo Sapiens
ugcuugguguggggaucugggagcacaugcagccucaguggagaccuaggaggacccaccagug

SEQ ID NO: 59343 - RNA, 64 nt, Homo Sapiens
ugcacagaaaaucuucuggcuguuuuguaaaauuucaguggaaaaaauagguuccauguguaag

SEQ ID NO: 59344 - RNA, 64 nt, Homo Sapiens
auuuauuuuaaaaaaaaaaccauauuaauacauuucaguggauaaucaguuuccaaguuuauau

SEQ ID NO: 59345 - RNA, 64 nt, Homo Sapiens
caauuguuugcccaaauauucuugucauuuggagucaguggaaaauccagcacaccaagcacca

SEQ ID NO: 59346 - RNA, 64 nt, Homo Sapiens
aguacuguuaauaucuggaaaguaucuugagauaucaguggaaagcuaaacagucuaaauuaac

SEQ ID NO: 59347 - RNA, 64 nt, Homo Sapiens
uagggggcuggucccggcuccacccccuccaagcucaguggacacugggucugaaaggaaggag

SEQ ID NO: 59348 - RNA, 64 nt, Homo Sapiens
cccucagugggcccgaacucgccagccccagcuuucaguggagaaagcgguccucugaaauggu

SEQ ID NO: 59349 - RNA, 64 nt, Homo Sapiens
agcccuuagcaguggccuggcacaaaacaaaugcucaguggauggaagcugccuauuauuauug

SEQ ID NO: 59350 - RNA, 64 nt, Homo Sapiens
uucaaggcaauaguacauaauaguggaagaaaauucaguggaagguuauugcuauugucauuug

SEQ ID NO: 59351 - RNA, 64 nt, Homo Sapiens
aaucaaccugggagaccaccccggccgcggcgccucaguggacaggugggaggaaaagaaaacu

SEQ ID NO: 59352 - RNA, 64 nt, Homo Sapiens
acaucacaugucgauauuugcauaggagucauuuucaguggaauaacauuuuuaaugugugguu

SEQ ID NO: 59353 - RNA, 64 nt, Homo Sapiens
aggaauguugcaugagucggaucccaguccauugucaguggagggugagggugaccccaucugc

SEQ ID NO: 59354 - RNA, 64 nt, Homo Sapiens
uguaauaaacuauaaauaaaacauuccagacuucucaguggauuaucuagcucucugauuccau

SEQ ID NO: 59355 - RNA, 64 nt, Homo Sapiens
agggcagguugaaucaagguaacugguuuuaaaaucaguggaaacuuuauaguuucucuauaaa

SEQ ID NO: 59356 - RNA, 64 nt, Homo Sapiens
agugggucccuggucuccuauagaacugccauuaucaguggaguuguucuggcccuuccccauc

SEQ ID NO: 59357 - RNA, 64 nt, Homo Sapiens
guucuauagaauuaaugauggauuaaaguuuuacucaguggauacaggcuucuggaaccaaacu

SEQ ID NO: 59358 - RNA, 64 nt, Homo Sapiens
ucuaaaccuugugaugacuaaaaaugagacuuuuucaguggaacguguaugaguugcauuugua

SEQ ID NO: 59359 - RNA, 64 nt, Homo Sapiens
acuccaguuguaaugcauauccaaacucuuauucucaguggaaaggauuuaugugaggucaaaa

SEQ ID NO: 59360 - RNA, 64 nt, Homo Sapiens
gguuccauguggauccauacuaaguauucuucagucaguggauuuuagcaaggggagguaggag

SEQ ID NO: 59361 - RNA, 64 nt, Homo Sapiens
guuaacuaacuguaaggcguggaauaggaguugcucaguggauugguucuauguuguggacuac

SEQ ID NO: 59362 - RNA, 64 nt, Homo Sapiens
caccucuugaaggugucgaauguauguuuauacaucaguggaacccauuuuucuagccuagcaa

SEQ ID NO: 59363 - RNA, 64 nt, Homo Sapiens
gauaaguugcagacugccuuuaaaauagauuuuaucaguggagaaauggugauaguuuuuucuu

SEQ ID NO: 59364 - RNA, 64 nt, Homo Sapiens
caucuaagcccaggacaugagugucuguccagacucaguggaucugaagaaaaaaggaaaaaaa

SEQ ID NO: 59365 - RNA, 64 nt, Homo Sapiens
ccuacugaaguuguguggagggauggaaagugggucaguggagaagggauucagaaaaugacac

SEQ ID NO: 59366 - RNA, 64 nt, Homo Sapiens
gcaagaggacugggugcugggcugcagaggccggucaguggagccccuagcacgugugaacuca

SEQ ID NO: 59367 - RNA, 64 nt, Homo Sapiens
cagguauuggagccucuguggccuuaaauguggcucaguggagggagacccagcauagccaggc

SEQ ID NO: 59368 - RNA, 64 nt, Homo Sapiens
cagugccccugugggggagccuguaaaugcgggcucaguggaccacuggugacugggcucaugc

SEQ ID NO: 59369 - RNA, 64 nt, Homo Sapiens
agcagugagacuaugagccaagcaaagagaagucucaguggagcaugaggagggagcaguccag

SEQ ID NO: 59370 - RNA, 64 nt, Homo Sapiens
aaaaguucuaaacugccucugcaaugacuuguagucaguggaagaguaucacuuuccccugauc

SEQ ID NO: 59371 - RNA, 64 nt, Homo Sapiens
uauaaaaaucaaaaggcugccucuauuacaauccucaguggaauagauggcuaucuuucuuggc

SEQ ID NO: 59372 - RNA, 64 nt, Homo Sapiens
auuguuaccaaacuuguaaaagcauuccauguauucaguggaggcagaauguauaauauuuuuu

SEQ ID NO: 59373 - RNA, 64 nt, Homo Sapiens
caggaguuuguuuccugaguguggagugaggcugucaguggauccgugcuuugucggccagcgu

SEQ ID NO: 59374 - RNA, 64 nt, Homo Sapiens
uaacuccucacucccugaucaauggaaguccaggucaguggagucucuccuugauugaucaccc

SEQ ID NO: 59375 - RNA, 64 nt, Homo Sapiens
gcccuggagugggcaggcaggccagggcugcgcaucaguggacacauugcugccaggaagagcu

SEQ ID NO: 59376 - RNA, 64 nt, Homo Sapiens
cuggcuuagggaacagggaggccaggagggguucucaguggagcaugcuccauguucauucgga

SEQ ID NO: 59377 - RNA, 64 nt, Homo Sapiens
ucaauauauaguuagcuuuaaacugcauuuuuaaucaguggaaccacaaaagcaaaauuuuuaa

SEQ ID NO: 59378 - RNA, 64 nt, Homo Sapiens
cauucuaagggcaagacauucaacuucacauugcucaguggacugagguuuuccuggacaccgc

SEQ ID NO: 59379 - RNA, 64 nt, Homo Sapiens
uuuucaguuucccacccugcgcuucucugcagaaucaguggagauggaaggauuguuccuuaga

SEQ ID NO: 59380 - RNA, 64 nt, Homo Sapiens
ucuauagaugguuuugaaaauaaccuaauuaugcucaguggacuuguaaacggacuuguuaacc

SEQ ID NO: 59381 - RNA, 64 nt, Homo Sapiens
uucccaucuauuacgccucauaugacauggauguucaguggaacacuucugauugccuaauaaa

SEQ ID NO: 59382 - RNA, 64 nt, Homo Sapiens
aaacauuaaaauguaccacuauaauaucacaguaucaguggacuaaauuaaaccuugcauuaaa

SEQ ID NO: 59383 - RNA, 64 nt, Homo Sapiens
aacauuguggcauggcagcagcagaaauccuauuucaguggaccuacuacuguugacaguuucc

SEQ ID NO: 59384 - RNA, 64 nt, Homo Sapiens
uaaagaauuaaaccaaggcuuagccuuaagcagcucaguggaaggaugagcugcugcggaccac

SEQ ID NO: 59385 - RNA, 64 nt, Homo Sapiens
agauguguggcugggcccucucccaccugccuguucaguggaggccagggcagcagcccagaac

SEQ ID NO: 59386 - RNA, 64 nt, Homo Sapiens
ucuuccuacugcaaaggacagugaauccagcaacucaguggauccaagcugggcucagaggucg

SEQ ID NO: 59387 - RNA, 64 nt, Homo Sapiens
cuaucugauggguuagagugccuuugagaagaaaucaguggauacuggauuugcuccugucaau

SEQ ID NO: 59388 - RNA, 64 nt, Homo Sapiens
gccugggauggagcccaucucuccaguuccucccucaguggaggagaucccugugccuggggaa

SEQ ID NO: 59389 - RNA, 64 nt, Homo Sapiens
acaguauacuuuugugugugagcugagguuauucucaguggauuauaacccaggaaacagaccc

SEQ ID NO: 59390 - RNA, 64 nt, Homo Sapiens
agaaucaaacugguacauugaugagagauucuauucaguggaucagucuggucaccagauaugg

SEQ ID NO: 59391 - RNA, 64 nt, Homo Sapiens
augggaauaaagcauuucuaucuagguuguauuuucaguggacaacagauauuuacugaaggaa

SEQ ID NO: 59392 - RNA, 64 nt, Homo Sapiens
auaaaccagcugagaagaacuccuauauugagcuucaguggagauguaaguaaagaaaauauaa

SEQ ID NO: 59393 - RNA, 64 nt, Homo Sapiens
cgugguugggugcaccuguaguucuguuuauuggucaguggaaaugaaaaaaaaaaaaaaaaaa

SEQ ID NO: 59394 - RNA, 64 nt, Homo Sapiens
agauuaaauaaaacuuaaaucucacucuaggaguucaguggagagguuagagccagccacacuu

SEQ ID NO: 59395 - RNA, 64 nt, Homo Sapiens
cagaaguuuuuguucuuuuuuuuuuuuccaucacucaguggagaaaagcuuuguuaaugaaaga

SEQ ID NO: 59396 - RNA, 64 nt, Homo Sapiens
ucccaagagagacuuguuugggccuuuuguggugucaguggaauggauagguaacuuggguggg

SEQ ID NO: 59397 - RNA, 64 nt, Homo Sapiens
cagagauaacuuugaaauuucauaaguuugauauucaguggauacaaauagaacaugaauucua

SEQ ID NO: 59398 - RNA, 64 nt, Homo Sapiens
uguaagagcauaaucaaacaggaauuuucuuuucucaguggauaauacaacagagaaaacagag

SEQ ID NO: 59399 - RNA, 64 nt, Homo Sapiens
uaauaccccacacaaguucacuugauuaauugcaucaguggaaggggacauagcuucucucuua

SEQ ID NO: 59400 - RNA, 64 nt, Homo Sapiens
auaaaauucauuuuccacuggaacucuaugacauucaguggagugguggaaaguuaaccucuua

SEQ ID NO: 59401 - RNA, 64 nt, Homo Sapiens
uacauuggaagugcuguagacuucuuuauguggcucaguggagagagggaaagaauguugcacc

SEQ ID NO: 59402 - RNA, 64 nt, Homo Sapiens
ucucuccucacugcucacagcaagggguucuguaucaguggauuucauuuuguagcugcugaga

SEQ ID NO: 59403 - RNA, 64 nt, Homo Sapiens
aaaucaaagugauucugggggaagcuaugcucuuucaguggauaauaaaauugguaacucuauu

SEQ ID NO: 59404 - RNA, 64 nt, Homo Sapiens
aggcauaauauuaauagcgccaccuucuguugggucaguggagaugggugaggaacagcacaga

SEQ ID NO: 59405 - RNA, 64 nt, Homo Sapiens
gaaucaugaaugacaaugagauaacauacagaugucaguggagacaaaguuguggguuccuccu

SEQ ID NO: 59406 - RNA, 64 nt, Homo Sapiens
gccagcagaaccacaggagagugcccugccugucucaguggaaguguauuauuguuuuaaggau

SEQ ID NO: 59407 - RNA, 64 nt, Homo Sapiens
acacucgauuggagucaguugaauauuuguacccucaguggagcccuucuggucuuuucuucca

SEQ ID NO: 59408 - RNA, 64 nt, Homo Sapiens
ggacuggcaguaacaagggcuuuuacuguucuguucaguggaaccuucuuggucaaauuguaau

SEQ ID NO: 59409 - RNA, 64 nt, Homo Sapiens
ggucugcucacugccaggcuccucuccccuuuguucaguggagcuggcuuuucucccagccccu

SEQ ID NO: 59410 - RNA, 64 nt, Homo Sapiens
ccugucaaaucgcauaaaagagauuuuuuuguucucaguggaacaaguauacuuuguaaggagc

SEQ ID NO: 59411 - RNA, 64 nt, Homo Sapiens
cugggccaccauggcagaccuaacaauagcauugucaguggagggaugcccuauuccuaaauaa

SEQ ID NO: 59412 - RNA, 64 nt, Homo Sapiens
cuuauuaauauccaagacuugggauuucucccucucaguggagcgggagcgcucucuugauucu

SEQ ID NO: 59413 - RNA, 64 nt, Homo Sapiens
cgcacacggccccggcgcgcccaggaucgggcacucaguggagcggggggacggugcccccagc

SEQ ID NO: 59414 - RNA, 64 nt, Homo Sapiens
auuauauagguugugcaaauuguauauaucugcuucaguggagaaaaaaaaaaagcucauauuu

SEQ ID NO: 59415 - RNA, 64 nt, Homo Sapiens
uuaggaaacgcucccacuccuugggcucuuaucuucaguggagcggguggggggagggguuggg

SEQ ID NO: 59416 - RNA, 64 nt, Homo Sapiens
uugacagcucccuaaagauucauuucugugguguucaguggaggucgcaccuagccucuuugau

SEQ ID NO: 59417 - RNA, 64 nt, Homo Sapiens
aaguggaauuggcaaacuagaauuuaguuuguacucaguggacagugcuguugaagauuugagg

SEQ ID NO: 59418 - RNA, 64 nt, Homo Sapiens
agacaccagcuucaccuucuuaacaaggugcagcucaguggaagaugaugacaaccagaagaca

SEQ ID NO: 59419 - RNA, 64 nt, Homo Sapiens
ggagaggagacuguuugaugugguacaggggcagucaguggagggcgagugguuucggaaaaaa

SEQ ID NO: 59420 - RNA, 64 nt, Homo Sapiens
agugugcauuuuuuuauucuaauauuccuucuagucaguggaaauuuguauucccauacaaacu

SEQ ID NO: 59421 - RNA, 64 nt, Homo Sapiens
accccuccuccauccacccugaggacccuggggcucaguggaggcagggcccugccccccuccc

SEQ ID NO: 59422 - RNA, 64 nt, Homo Sapiens
ugggcugcuagugaguuacauuaauuacugcaaaucaguggaauucucaagagacaagauaagc

SEQ ID NO: 59423 - RNA, 64 nt, Homo Sapiens
uucuaauauauauaucauugagggugacuaaucuucaguggaccaaaucucuacccuuccccaa

SEQ ID NO: 59424 - RNA, 64 nt, Homo Sapiens
ccucaaugguaggagacauccagacuuguauauuucaguggaaauacaaaaccacuucagagac

SEQ ID NO: 59425 - RNA, 64 nt, Homo Sapiens
caaagacucaagacacagaagaugaugagggagcucaguggaauuguaccgccuguacuuuuuu

SEQ ID NO: 59426 - RNA, 64 nt, Homo Sapiens
gucagugccuccagccaaaugccuagcacagagcucaguggauuugauucuuccauucagauac

SEQ ID NO: 59427 - RNA, 64 nt, Homo Sapiens
uaaaugaucauagaaggugcugauuaaaaaaaaaucaguggaaaaagaaugcaugaucucagag

SEQ ID NO: 59428 - RNA, 64 nt, Homo Sapiens
ugaccccacccagcccccugcauaguacaguucuucaguggacacauuucugguuuucuguccc

SEQ ID NO: 59429 - RNA, 64 nt, Homo Sapiens
cagucauguuagguaggagggguggccacuucccucaguggagugaggcccaaggcuuggauaa

SEQ ID NO: 59430 - RNA, 64 nt, Homo Sapiens
cuggcagggucccuccagcagugggggaaaggauucaguggaggcgcccccagagcccgucagc

SEQ ID NO: 59431 - RNA, 64 nt, Homo Sapiens
caaagaugaauccaaguucacaccuaccaggugcucaguggaauucaagaaauaugugaauacc

SEQ ID NO: 59432 - RNA, 64 nt, Homo Sapiens
aaucaauauauaacuuagugccaagaaagaauuuucaguggaaaauuguccaccuagucagagc

SEQ ID NO: 59433 - RNA, 64 nt, Homo Sapiens
acaaaugaaaaugaauagcuuuucaguaaugucuucaguggaacgaaauaaaccauuggacaga

SEQ ID NO: 59434 - RNA, 64 nt, Homo Sapiens
uguuuggaacucugaaggaucaugaaguauggguucaguggaaauguuuugguuguuuuaaacu

SEQ ID NO: 59435 - RNA, 64 nt, Homo Sapiens
ucagaggacggggagauagaauacaagguaaguuucaguggagcaggcgugggggacaagaagg

SEQ ID NO: 59436 - RNA, 64 nt, Homo Sapiens
cggggcgucugagcuccccaggcaugaccaaaccucaguggaggggccucugcuucaggccccg

SEQ ID NO: 59437 - RNA, 64 nt, Homo Sapiens
gacagcuaccugcauuguagaaccuuuucuuaucucaguggaaccuucuauaaccuaaauauac

SEQ ID NO: 59438 - RNA, 64 nt, Homo Sapiens
uucagccuggacacccggcagcuucuggaguuugucaguggaggcagaggggauccggccaggc

SEQ ID NO: 59439 - RNA, 64 nt, Homo Sapiens
gcucagggaguguuuuccugugaggccucccccaucaguggaccagagggagaagcccgaugcc

SEQ ID NO: 59440 - RNA, 64 nt, Homo Sapiens
caaaugauuagcccuaaaugaaacuguaauaauuucaguggaaacucaaucuguuuuuaccuuu

SEQ ID NO: 59441 - RNA, 64 nt, Homo Sapiens
gcagcuucuucggagaagugaaauauaacauuacucaguggacggagaaaucuguuuuguuaca

SEQ ID NO: 59442 - RNA, 64 nt, Homo Sapiens
uccugcgguucaguucaggcugagauuuucuccuucaguggacugucugugucccccugccgaa

SEQ ID NO: 59443 - RNA, 64 nt, Homo Sapiens
gcuuaugggucuccagaaacucugccagccagccucaguggagaagcuuccucuaccaccagcu

SEQ ID NO: 59444 - RNA, 64 nt, Homo Sapiens
ggauacauacaguggaguucuauaaacucauaccucaguggacuuaaccaaaauuguguuaguc

SEQ ID NO: 59445 - RNA, 64 nt, Homo Sapiens
uauccuguuccgccuccugccaccuggaccucccucaguggaugucuucccucccccgacccca

SEQ ID NO: 59446 - RNA, 64 nt, Homo Sapiens
ggccuaacucuaaugucgccacggucgggaagcuucaguggagaauccugucugccacgugcug

SEQ ID NO: 59447 - RNA, 64 nt, Homo Sapiens
gaaugucuuuuuauuuuaaagccucuuuuagaagucaguggauuaauauauagagguauauuua

SEQ ID NO: 59448 - RNA, 64 nt, Homo Sapiens
uguuuuccccaccaaguggcuuaagaccagaauaucaguggauugcacauuuucuguucaggga

SEQ ID NO: 59449 - RNA, 64 nt, Homo Sapiens
uugcuuggaauucuggcagguuccccgggguguuucaguggacaggaggcccccgugccguggc

SEQ ID NO: 59450 - RNA, 64 nt, Homo Sapiens
ucuacuacaucuaggacgccuccggugagcagggucaguggaagccccaacgggaaaggaaacg

SEQ ID NO: 59451 - RNA, 64 nt, Homo Sapiens
uaucucuuguuuguguugaacugaaggcuaagucucaguggacauggaaaagacuuuuggguga

SEQ ID NO: 59452 - RNA, 64 nt, Homo Sapiens
guacuuaaaggaauaauaaaugcauaauaugaggucaguggacgccauuuucuguuauaaucau

SEQ ID NO: 59453 - RNA, 64 nt, Homo Sapiens
gcgaagcauuguuucugagugugugaggauguuuucaguggacucagugaagaucugcccucag

SEQ ID NO: 59454 - RNA, 64 nt, Homo Sapiens
ggguggggccuggugggaggaggagcacugccuuucaguggaccaccaguccacagaggccccc

SEQ ID NO: 59455 - RNA, 64 nt, Homo Sapiens
ugucccacaagaauucacaggggaacgcaagcugucaguggaacucacugaggacugguaccuc

SEQ ID NO: 59456 - RNA, 64 nt, Homo Sapiens
aaacauuuuucaauaaauaauuagaaguguauuuucaguggaaguacugucuugcauuauaaaa

SEQ ID NO: 59457 - RNA, 64 nt, Homo Sapiens
ggucaucuggguucuaaaggcuucaaaagcacuuucaguggauuagccauaaguaaucagcaau

SEQ ID NO: 59458 - RNA, 64 nt, Homo Sapiens
caaauuuuugccauuaaaaaagcauuauggaguuucaguggaacaaaaaguaguagcucucugu

SEQ ID NO: 59459 - RNA, 64 nt, Homo Sapiens
agaguagagcucaaaacuggugagagccaaguagucaguggaagggcaagaauucuuaugcuua

SEQ ID NO: 59460 - RNA, 64 nt, Homo Sapiens
uguucccugaguccgaggcuguuguacuccacagucaguggaacuuuuggaaaagaaugcaaua

SEQ ID NO: 59461 - RNA, 64 nt, Homo Sapiens
agcagaacacugcagucagauccuguuacuugcuucaguggaccgaaaucuguauucuguuugc

SEQ ID NO: 59462 - RNA, 64 nt, Homo Sapiens
gcgguuugcauucuuuuggaacucaaugugccgaucaguggagucaguaucgagccugaccacc

SEQ ID NO: 59463 - RNA, 64 nt, Homo Sapiens
auauucuuuccuguuucccacauuccuugucucuucaguggaagguauuuuuuauaaccaccau

SEQ ID NO: 59464 - RNA, 64 nt, Homo Sapiens
ggcagugccacucaggucucauuuaugugggccuucaguggauguaacaugaacaugaguaccu

SEQ ID NO: 59465 - RNA, 64 nt, Homo Sapiens
gagcacgaggauguucucagagcggucacuccucucaguggaaacauuaacaaacccaaaguga

SEQ ID NO: 59466 - RNA, 64 nt, Homo Sapiens
uauccggggcaauuguagcgugcucucugcucugucaguggagcucucacugaugguuuuuuac

SEQ ID NO: 59467 - RNA, 64 nt, Homo Sapiens
gaaacaaggguuuaaacuugaucuucauauagaaucaguggaugaugagaaacuuugaaaaugg

SEQ ID NO: 59468 - RNA, 64 nt, Homo Sapiens
aaaugagcagauaaguagauaagaaacucuuaguucaguggaggaagaugugcacucuggacuc

SEQ ID NO: 59469 - RNA, 64 nt, Homo Sapiens
uggcuccuccccgcacugaggaaguggagcguuuucaguggaguauguggacaccauggagggg

SEQ ID NO: 59470 - RNA, 64 nt, Homo Sapiens
cccaucccuggguuccccugaggacgguuuguuuucaguggaauggggcccucgacaggacagc

SEQ ID NO: 59471 - RNA, 64 nt, Homo Sapiens
gauuuuuauuaaaaagaagcaugcuuauuuauuuucaguggaagauaauaguucaguaauuuaa

SEQ ID NO: 59472 - RNA, 64 nt, Homo Sapiens
cuccuccgaaguuuuucaggggguaaaaguaacaucaguggaggguauuauuuuaaauaaauuu

SEQ ID NO: 59473 - RNA, 64 nt, Homo Sapiens
gaaaacauugacuguuaccauugaaugagauggaucaguggauauuaagaugagguuacaaauu

SEQ ID NO: 59474 - RNA, 64 nt, Homo Sapiens
ccucuuguuuugguuauuuuguguagcaguuuaaucaguggauaacugagccuguuuccucuua

SEQ ID NO: 59475 - RNA, 64 nt, Homo Sapiens
cauuuuacuaacauaaauauuuucuauguguguuucaguggaugacaaucgagcagcagaagaa

SEQ ID NO: 59476 - RNA, 64 nt, Homo Sapiens
gugcuucuuccauagacagaagcuuagucuguuuucaguggaauuaauugaugaacugggaaaa

SEQ ID NO: 59477 - RNA, 64 nt, Homo Sapiens
agucugagaaaauauuuuuuucuaaagaaggcagucaguggaucuuaaaaugacaaucuguuuu

SEQ ID NO: 59478 - RNA, 64 nt, Homo Sapiens
uccagaagaaguuuuuccuugauugugcuauguuucaguggaagaaauucuuugaaguagaugu

SEQ ID NO: 59479 - RNA, 64 nt, Homo Sapiens
aaagaggcacauugcauagaagccauuggggaguucaguggaaguucuguaagaugugcaugua

SEQ ID NO: 59480 - RNA, 64 nt, Homo Sapiens
gacacucaagacuuuugacugccauuuuguuuguucaguggagacucccuggccaacagaaucc

SEQ ID NO: 59481 - RNA, 64 nt, Homo Sapiens
aaaaaucuaaaaauucugguuuuaaauaugagaaucaguggaaaauaaggguauaauuuuguag

SEQ ID NO: 59482 - RNA, 64 nt, Homo Sapiens
aauaauagggaaauauccauuuaaaacagguauaucaguggaaacacagaguuauuuuaaguga

SEQ ID NO: 59483 - RNA, 64 nt, Homo Sapiens
accccuuccugguugcuaccacucaggcugccacucaguggacuccaccccagggacacggcag

SEQ ID NO: 59484 - RNA, 64 nt, Homo Sapiens
aagcugcaaugcaguauugacaggcguggcuucuucaguggaccguagugcaucuuuuguaucu

SEQ ID NO: 59485 - RNA, 64 nt, Homo Sapiens
gcuucaaaagcagaguuuugugaucuuuaccaggucaguggauuaaacaugcaaguuuguacuu

SEQ ID NO: 59486 - RNA, 64 nt, Homo Sapiens
agggguucaaugaauuacggaagccugaucccugucaguggaaauacacaagaaaaacagagaa

SEQ ID NO: 59487 - RNA, 64 nt, Homo Sapiens
cuuaagaugcaguaauuauggccuucuauauacaucaguggaaaugauaaaaauugugccuuua

SEQ ID NO: 59488 - RNA, 64 nt, Homo Sapiens
ccugaaguuguacuuguguaagaaucaccgcauuucaguggacucccagugcccagaauauacu

SEQ ID NO: 59489 - RNA, 64 nt, Homo Sapiens
cuggccaagcacagaggcuguguaaaugaagggcucaguggaguagaggaggggcugcccacuc

SEQ ID NO: 59490 - RNA, 64 nt, Homo Sapiens
gagcggcaaacugggacaugaguguaagugcaaaucaguggaagcaagugaagagaacgucaug

SEQ ID NO: 59491 - RNA, 64 nt, Homo Sapiens
ucauucucuugaguaauaaauuucugugaaccuaucaguggauuuacgcuguagauggaacaug

SEQ ID NO: 59492 - RNA, 64 nt, Homo Sapiens
agugagcagccgacucugagaggcuuucuccagcucaguggagcgggcucaggcuagcguaaac

SEQ ID NO: 59493 - RNA, 64 nt, Homo Sapiens
aauguauuauuuccaugauccaugguauuguauaucaguggagaccaacuuuuccagugcauua

SEQ ID NO: 59494 - RNA, 64 nt, Homo Sapiens
aaaauuuccccuuuuuuucaagaauauaaauuugucaguggaauggcuuauacauuauauuuau

SEQ ID NO: 59495 - RNA, 64 nt, Homo Sapiens
ccaaagucaagaccagcacccugagccucgggacucaguggacaggacugcaucccuccugggc

SEQ ID NO: 59496 - RNA, 64 nt, Homo Sapiens
caggagcuaacucagaccccagcugacggccugcucaguggagcuauccgcguggugggcuggc

SEQ ID NO: 59497 - RNA, 64 nt, Homo Sapiens
auguguuauucuuucuauaaugaucaguuuacuuucaguggauucagaauuguguagcaggaua

SEQ ID NO: 59498 - RNA, 64 nt, Homo Sapiens
uaagaccuucccuuccuugaucccuggaccagacucaguggacauuugugcaauugcucgcccu

SEQ ID NO: 59499 - RNA, 64 nt, Homo Sapiens
ccugcccucucugagucucaguuuuuccauuuguucaguggagagaauuaaccauugauaccuc

SEQ ID NO: 59500 - RNA, 62 nt, Homo Sapiens; identical to SEQ ID NO: 59136

SEQ ID NO: 59501 - RNA, 64 nt, Homo Sapiens
ccaugacugacggccccuugugcaagcucauucuucaguggauccuucaguggaguggugacac

SEQ ID NO: 59502 - RNA, 64 nt, Homo Sapiens
gccccuugugcaagcucauucuucaguggauccuucaguggaguggugacacgugccagcgguc

SEQ ID NO: 59503 - RNA, 64 nt, Homo Sapiens
agugacuuccauuauggcuggacaggcggugagcucaguggauugcaguggugugcuggugauu

SEQ ID NO: 59504 - RNA, 64 nt, Homo Sapiens
cuaaucccauccucucacccauccauuuccucacucaguggagauuugccaaaugaauaaacga

SEQ ID NO: 59505 - RNA, 64 nt, Homo Sapiens
aaauuuagaggaaaucaaacaagcaucacuuuccucaguggaaaaacuuaugaaacuucuuaua

SEQ ID NO: 59506 - RNA, 64 nt, Homo Sapiens
cgauauuucuugaaaauaacgaccuugucuuguaucaguggaagaaguaaguugcuuagaaagg

SEQ ID NO: 59507 - RNA, 64 nt, Homo Sapiens
gaacaugugauuucaggguugccgcagugucaccucaguggaccagccugggggaaggagcuua

SEQ ID NO: 59508 - RNA, 64 nt, Homo Sapiens
cuugccucacucugauccuggccccauaauguccucaguggaaggugaugggggccggugcugu

SEQ ID NO: 59509 - RNA, 64 nt, Homo Sapiens
ggaagcuuauaaucuaauuuuaggaggaccaaauucaguggauggcaacuggaacauugauugu

SEQ ID NO: 59510 - RNA, 64 nt, Homo Sapiens
uguuuaagacgccaagggcauugcagaaucccucucaguggacaguaugcacucagcugaccac

SEQ ID NO: 59511 - RNA, 64 nt, Homo Sapiens
guaugagcgucaaguccugcggaaguccugcguuucaguggagcuccacugagggacugggcug

SEQ ID NO: 59512 - RNA, 64 nt, Homo Sapiens
gaggaagcuuuagauagagaugcacuccugguuuucaguggacagccaagcccagaaguaccuu

SEQ ID NO: 59513 - RNA, 64 nt, Homo Sapiens
aauaguucucuagcuaaggauucucuuccaggagucaguggaagaagaaaugggaaucuuuuuu

SEQ ID NO: 59514 - RNA, 64 nt, Homo Sapiens
aagcagaugagaaacucuugugguggaugaaaugucaguggaaguggugucaaugaauuuugcu

SEQ ID NO: 59515 - RNA, 64 nt, Homo Sapiens
ugccccuccuaagcagagaagcugcccagccuucucaguggacucugaacucuuucaacucugc

SEQ ID NO: 59516 - RNA, 64 nt, Homo Sapiens
gcauuguccugugaaauauucaaguaacauuaacucaguggaaggagcauaaggguuauuugag

SEQ ID NO: 59517 - RNA, 64 nt, Homo Sapiens
cuuuuguuugugugugugugugaaaaaggaaaauucaguggaggggcucugaacuuuguguauu

SEQ ID NO: 59518 - RNA, 64 nt, Homo Sapiens
uccagcgagauauuagaaauaagcuuucuuuauaucaguggaaauuucagggucugucuaucuu

SEQ ID NO: 59519 - RNA, 64 nt, Homo Sapiens
cucgggguuuggacuuaauguuacuuacuuguuaucaguggauuaaaaaaauuagcacaucccu

SEQ ID NO: 59520 - RNA, 64 nt, Homo Sapiens
aggucagaagcucauguucuacagaugcugguccucaguggauuggcuguugguagugcuuucc

SEQ ID NO: 59521 - RNA, 64 nt, Homo Sapiens
aggccugagguagaggggagugguauguguuuucucaguggaagcagcacaugagugggugaca

SEQ ID NO: 59522 - RNA, 64 nt, Homo Sapiens
cuguccuaggugcuagguggaccgagcaaaagacucaguggaugaacuggugcagugccugaca

SEQ ID NO: 59523 - RNA, 64 nt, Homo Sapiens
aauuucaaauauuuagcaacaaaaguuuauuccuucaguggaagauuuauaauaaugauaggug

SEQ ID NO: 59524 - RNA, 64 nt, Homo Sapiens
uguuagaacuacuacucacaguuaccacuuggggucaguggaacaaaaugcauauaugguuuug

SEQ ID NO: 59525 - RNA, 64 nt, Homo Sapiens
gugcuuucauuguuuuuucauaaucuuuucuccuucaguggaguacugauugcaugaaauuuga

SEQ ID NO: 59526 - RNA, 52 nt, Homo Sapiens; identical to SEQ ID NO: 59162

SEQ ID NO: 59527 - RNA, 64 nt, Homo Sapiens
uuagcugcucugagcaucaagaauuagaagucuuucaguggaauuguacaagagucccuuugaa

SEQ ID NO: 59528 - RNA, 64 nt, Homo Sapiens
gugacugccgugugugcuuagacccguaguuuccucaguggauagcacucaauuuauuccguag

SEQ ID NO: 59529 - RNA, 64 nt, Homo Sapiens
caaagguguugauuuuuguauaugaaguuaagccucaguggagucucauuuguuaguuuuuagu

SEQ ID NO: 59530 - RNA, 64 nt, Homo Sapiens
gaaggcagggguuaaaucaggauaaaaacagacaucaguggaaucgaaaaccaauaguuaguua

SEQ ID NO: 59531 - RNA, 64 nt, Homo Sapiens
uguuuuaauguagaaccucaaacaggauggaacaucaguggauggcaggagguugggaauucuu

SEQ ID NO: 59532 - RNA, 64 nt, Homo Sapiens
cugcucugugguccgaaguccaaggaaaucugugucaguggauggacuauuauagaauggaacu

SEQ ID NO: 59533 - RNA, 64 nt, Homo Sapiens
uuaagaggggugagaaaacauccacuuuaauuucucaguggaaguaggauucuuugaacuuauu

SEQ ID NO: 59534 - RNA, 64 nt, Homo Sapiens
acuuaaccacugcugucccuuccccuucagguccucaguggauuugagaaagguaaguccauuu

SEQ ID NO: 59535 - RNA, 64 nt, Homo Sapiens
aguuuccuagcaaucauuuuggaucacuggacuuucaguggacuaccuaaaacaggggacagcu

SEQ ID NO: 59536 - RNA, 64 nt, Homo Sapiens
auauuaaaugacuccaccugcgcaguccuuguguucaguggaugaauaccugugggcucuugua

SEQ ID NO: 59537 - RNA, 64 nt, Homo Sapiens
gaaauaacugaaguauaacauugcaagaaaaugaucaguggaaucugguauuuucaauuuucau

SEQ ID NO: 59538 - RNA, 64 nt, Homo Sapiens
guagaugcuuuguauaucuucucauuuugcccugucaguggauggcuuuuuauuucccuuguuu

SEQ ID NO: 59539 - RNA, 64 nt, Homo Sapiens
gguuuucgcuuaaaggaaaaguuuggaauuuuuuucaguggagucugcaauuuuuaaaaaacaa

SEQ ID NO: 59540 - RNA, 64 nt, Homo Sapiens
gagaaugcuucccauagaaauccuuggaacugaaucaguggaaauucgguuaaugggucaguuc

SEQ ID NO: 59541 - RNA, 64 nt, Homo Sapiens
aaauauucgacaggccauaauucuguagauaacgucaguggaguuguacaaacuggccaagugc

SEQ ID NO: 59542 - RNA, 64 nt, Homo Sapiens
auguggcugggaacauugcaucccaaagagcuucucaguggaggaggcuggggaaggcaugagg

SEQ ID NO: 59543 - RNA, 64 nt, Homo Sapiens
auucauaacuugugggcuuuuuuuuuuuuuaacuucaguggaauuuacuuuagauauucauuca

SEQ ID NO: 59544 - RNA, 64 nt, Homo Sapiens
guucagccucucaguuuuaauauagcuuuauuuuucaguggagaucauuguuuaggaugagaca

SEQ ID NO: 59545 - RNA, 64 nt, Homo Sapiens
uauuaauguuuacaguggaauugugaauaaguuuucaguggacuaucuuaucccuugacaaaaa

SEQ ID NO: 59546 - RNA, 64 nt, Homo Sapiens
acauacugcauucugugcuacacaagccuuagccucaguggagcugugguucucuugguacuuu

SEQ ID NO: 59547 - RNA, 64 nt, Homo Sapiens
ccucugcugugcugcacauugagcccuuucucagucaguggaguaucaaguugggccaucuguc

SEQ ID NO: 59548 - RNA, 64 nt, Homo Sapiens
caggcccaggcaggcccagccucugccccacccaucaguggaguccagauggcaggcuacaguu

SEQ ID NO: 59549 - RNA, 64 nt, Homo Sapiens
aagaugguuuagguguacagcaaauuuaaaauagucaguggauugugucuuacuacuucauguc

SEQ ID NO: 59550 - RNA, 64 nt, Homo Sapiens
cuuugcuuaguaucauguccauguuuccuucaccucaguggagcuucugaguuuuauacugcuc

SEQ ID NO: 59551 - RNA, 64 nt, Homo Sapiens
agcacuggguucuacugcugugggguaaacuaacucaguggaauagggcugguuacuuugggcu

SEQ ID NO: 59552 - RNA, 64 nt, Homo Sapiens
uuauuuuaaaugcauuuaucuuuuuugacacuauucaguggaauguguaagcuagcuaauucuu

SEQ ID NO: 59553 - RNA, 64 nt, Homo Sapiens
ucauccacacaaacccacggcucccaguugacagucaguggaaugcucgucuccuuagcgucca

SEQ ID NO: 59554 - RNA, 64 nt, Homo Sapiens
cuacagacucccugggguuggcaggggcuccaucucaguggaccaggaagcaagaggggaagcg

SEQ ID NO: 59555 - RNA, 64 nt, Homo Sapiens
gacuuuucauuguaauuucgcuuagacccuuuuaucaguggagcuccaguuuucuuaccuagcu

SEQ ID NO: 59556 - RNA, 64 nt, Homo Sapiens
cagggccaacuuaguuccuacuguucugugcccuucaguggauggaacgugagugucugaucau

SEQ ID NO: 59557 - RNA, 64 nt, Homo Sapiens
ugaaacacaaacaauaguaauucucaggccaucaucaguggagccauguuaauguaaucugaug

SEQ ID NO: 59558 - RNA, 64 nt, Homo Sapiens
aguuuuaacaauccauucacaagccuccuguaccucaguggaucuucagaacugcccuugcugc

SEQ ID NO: 59559 - RNA, 64 nt, Homo Sapiens
ucuggacauauuuauggacuaaaugagagauauuucaguggacauauagaaaccaaguaagaau

SEQ ID NO: 59560 - RNA, 64 nt, Homo Sapiens
caaaucaaaagccacuaacagaacuguguguaugucaguggaauauaaauaugacauugaauuc

SEQ ID NO: 59561 - RNA, 64 nt, Homo Sapiens
aguuauguuuuauacucuacaauccaaccuccugucaguggagcauaauacaauauuaagucca

SEQ ID NO: 59562 - RNA, 64 nt, Homo Sapiens
gaguuugaucugcagcacccuccagaggacauucucaguggaaaccauucagagagaacauggg

SEQ ID NO: 59563 - RNA, 64 nt, Homo Sapiens
gagccaggggcuggaggugggggggacagcacagucaguggagaacagaggcugggguccuccu

SEQ ID NO: 59564 - RNA, 64 nt, Homo Sapiens
ugggccugcagcagacucaauugcucguggccacucaguggagcguggcccgguggggacacag

SEQ ID NO: 59565 - RNA, 64 nt, Homo Sapiens
ccaaagcaaaagcucccgacgccacucacuuaucucaguggacuaucuggucuuccaagacuuu

SEQ ID NO: 59566 - RNA, 64 nt, Homo Sapiens
caagggugggccuugugaggggucaaagagagggucaguggaaaggaggcaauuggggguuuca

SEQ ID NO: 59567 - RNA, 64 nt, Homo Sapiens
aggugcccacagcagguacccacuggcccccuccucaguggagaccccaaggagcugcagcuga

SEQ ID NO: 59568 - RNA, 64 nt, Homo Sapiens
ucugagaggacuuuucuuuguggcuuccuaaaauucaguggaaaauuaauuguuuggggaugag

SEQ ID NO: 59569 - RNA, 64 nt, Homo Sapiens
cucaguccccaacggcuggcaagacucaggguccucaguggacauggugugggugacaucagaa

SEQ ID NO: 59570 - RNA, 64 nt, Homo Sapiens
ugcaaauuuuuaaguaauuuaugaaaaaccuagaucaguggaucuccucucuggcugcccauua

SEQ ID NO: 59571 - RNA, 64 nt, Homo Sapiens
gcccuuaacugauuguuauaugcuacaagggauuucaguggacugcagagugcgaacgucuugc

SEQ ID NO: 59572 - RNA, 64 nt, Homo Sapiens
ccugcccgcaaagcaagagcaucauuccuauucuucaguggaugccagccuucccugccccaac

SEQ ID NO: 59573 - RNA, 64 nt, Homo Sapiens
uuuuguggugggugcugugaagaguaaacauuacucaguggaaagcuaaguucagaagguacuu

SEQ ID NO: 59574 - RNA, 64 nt, Homo Sapiens
ccccugcacccaccccugcccaggcagucuuugcucaguggaucacacacauggaaggugaugg

SEQ ID NO: 59575 - RNA, 64 nt, Homo Sapiens
uguggccuggaggccuauuaagcacgacacaguaucaguggaauugauccauaaaccucccugu

SEQ ID NO: 59576 - RNA, 64 nt, Homo Sapiens
gucacugugcuagcaauaguuggcuucuccccugucaguggaaaccccacuucugcccggcccu

SEQ ID NO: 59577 - RNA, 64 nt, Homo Sapiens
gaagcugcugacugugauuacaugcagaucacugucaguggaggccaggccgccaggaauggac

SEQ ID NO: 59578 - RNA, 64 nt, Homo Sapiens
aagacgucccuccuccaucauggccucuggggaaucaguggaugcaucuaggaccucagccaug

SEQ ID NO: 59579 - RNA, 64 nt, Homo Sapiens
acaaaggagggccucacuguacagugaaaagcuuucaguggaggccucuuucuuugcagaccga

SEQ ID NO: 59580 - RNA, 64 nt, Homo Sapiens; identical to SEQ ID NO: 59578

SEQ ID NO: 59581 - RNA, 64 nt, Homo Sapiens
caauaaucaucucuauugcuggaacuuacucuauucaguggaaaauauauguuaaaccaaucaa

SEQ ID NO: 59582 - RNA, 64 nt, Homo Sapiens
augacgggggaucugaggcuuccaucccccuuauucaguggaagccaacugcugagaccucuuc

SEQ ID NO: 59583 - RNA, 64 nt, Homo Sapiens
gcaguuuuuuuacuauuccaagcuauuuuuuuugucaguggaaucuugugcuauuuggaagcaa

SEQ ID NO: 59584 - RNA, 64 nt, Homo Sapiens
uuauucaccuuaagcgauuucaauuuguaaaugaucaguggauaaaaucacagaaaauugucag

SEQ ID NO: 59585 - RNA, 64 nt, Homo Sapiens
gcggaguccuagcauccccuugggagcagcagcgucaguggacccagugcugagaaaagccccc

SEQ ID NO: 59586 - RNA, 64 nt, Homo Sapiens
gagaacaaagcccauucauccauuggauucacugucaguggagauacuaccucucguggcaacc

SEQ ID NO: 59587 - RNA, 64 nt, Homo Sapiens
gcugaaccuugaggagggaaagcuugccuucuauucaguggacaaucaggagaagcuucuguau

SEQ ID NO: 59588 - RNA, 64 nt, Homo Sapiens
gguaaaguucccuucuugggacuuauuccuggagucaguggauacaaguagugcagaagguuca

SEQ ID NO: 59589 - RNA, 64 nt, Homo Sapiens
gaggcagcgacuccuuggacagaggccugggcccucaguggacugccugcucccacagccuggg

SEQ ID NO: 59590 - RNA, 64 nt, Homo Sapiens
caggcugcugacccucagcagggccagacaaggcucaguggaucuggucugaguuucaaucugc

SEQ ID NO: 59591 - RNA, 64 nt, Homo Sapiens
aagccacauuacaagcugccauccccuccccguuucaguggacccuguggccaggugcuuuucc

SEQ ID NO: 59592 - RNA, 64 nt, Homo Sapiens
cuaccugacucuguguuguaauuucaggggagcaucaguggaggaggcagugggggcagcagca

SEQ ID NO: 59593 - RNA, 53 nt, Homo Sapiens; identical to SEQ ID NO: 59229

SEQ ID NO: 59594 - RNA, 64 nt, Homo Sapiens
ggggguguccugggcugaauuuccugggcacuucucaguggaacucucuagccuccugguucgg

SEQ ID NO: 59595 - RNA, 64 nt, Homo Sapiens
uuccugagcuuggccagaagggggccaugaggccucaguggacuuuccacccccucccuggccu

SEQ ID NO: 59596 - RNA, 64 nt, Homo Sapiens
uaucuuuuuuagcugagggggacaagaggagaagucaguggacacauggaaguuacucgugacc

SEQ ID NO: 59597 - RNA, 64 nt, Homo Sapiens
gcugcacugguuugucgaucuaguucaguucaacucaguggauguucucugaaugcuuacuggg

SEQ ID NO: 59598 - RNA, 64 nt, Homo Sapiens
gugugauucuuaacauuauagcacaaguauuaucucaguggauuauccggaauaacaucugaaa

SEQ ID NO: 59599 - RNA, 64 nt, Homo Sapiens
ugaucaaagaacucugacugcagaacugccgcucucaguggacagggcaucuguuacccugaga

SEQ ID NO: 59600 - RNA, 64 nt, Homo Sapiens
uccugagaccuuagaaaccagaagagccauacagucaguggaaggcgggggggcccuggccucu

SEQ ID NO: 59601 - RNA, 64 nt, Homo Sapiens
gcuuucaagcagugcuuguuuuucccuggaccguucaguggacaacaccaucugugggucaucc

SEQ ID NO: 59602 - RNA, 64 nt, Homo Sapiens
auaauaauaguggaggguuguugauacaggcaauucaguggacuaaacaaacaaaaaacugccu

SEQ ID NO: 59603 - RNA, 64 nt, Homo Sapiens
gccuuggacugaacgugggcgagucacacggggcucaguggacgggacacccccagcucuguca

SEQ ID NO: 59604 - RNA, 64 nt, Homo Sapiens
guagcuucuuaaaaaaaaaaauaauacuuccuuuucaguggacucuuuucuucucagaaaaacc

SEQ ID NO: 59605 - RNA, 64 nt, Homo Sapiens
ccuauagcuuccugaagcugaacugcaguuugaaucaguggaugaugaccauucagcuauaacc

SEQ ID NO: 59606 - RNA, 64 nt, Homo Sapiens
ucuugguuugaugauaaccuggcugaucaaaugaucaguggaauuugccuguuuccuaguaaug

SEQ ID NO: 59607 - RNA, 64 nt, Homo Sapiens
gauauuuauguauuauuuuuaguuauauccuggcucaguggaguucauguaucuguaguccaug

SEQ ID NO: 59608 - RNA, 64 nt, Homo Sapiens
augaugccuccuccgggaagccccacggugcuucucaguggacaacacacaggcaguggccagg

SEQ ID NO: 59609 - RNA, 64 nt, Homo Sapiens
cuauauuuaggucccagaacaaggaagucacuuuucaguggauccaaagaaucuacuccuuaaa

SEQ ID NO: 59610 - RNA, 64 nt, Homo Sapiens
aaucacaucagggagugauuaguccuggggaaauucaguggaggcacaagccugaagcacucuu

SEQ ID NO: 59611 - RNA, 64 nt, Homo Sapiens
gugggaauuaacucucccaaugaaaggcauucauucaguggacaguaauauauuuauuaauauu

SEQ ID NO: 59612 - RNA, 53 nt, Homo Sapiens; identical to SEQ ID NO: 59248

SEQ ID NO: 59613 - RNA, 64 nt, Homo Sapiens
cucugcccuucuuuuucuuaccuguaggagauacucaguggagcuagguaauaccacuaucagg

SEQ ID NO: 59614 - RNA, 64 nt, Homo Sapiens
aggaaugcaauugugaauuccaaggcugguaugaucaguggaucuucaucucgcccagagugcu

SEQ ID NO: 59615 - RNA, 64 nt, Homo Sapiens
aagagcaaagccacagacgaugacuuguccauucucaguggaugcuccaggcugugccuacaca

SEQ ID NO: 59616 - RNA, 64 nt, Homo Sapiens
ugcuggagcugcagccugcucgccaucuggaggcucaguggaguggggaguugggguucucaua

SEQ ID NO: 59617 - RNA, 64 nt, Homo Sapiens
ccaauaugcuuuggguggacggucuccuacauguucaguggaggccaccaggagcauccaugag

SEQ ID NO: 59618 - RNA, 64 nt, Homo Sapiens
ucugaaucacgagaauguggagggguggggggugucaguggaaaggcauaaggcugagcugaga

SEQ ID NO: 59619 - RNA, 64 nt, Homo Sapiens
gguagguggugguuuuaggucuugucacccucacucaguggaacugccucugggagcuuuggcg

SEQ ID NO: 59620 - RNA, 64 nt, Homo Sapiens
aagugucuaggaaaaaacaaaaacuccaaacccuucaguggaugaggacaaggucgcagaaagg

SEQ ID NO: 59621 - RNA, 64 nt, Homo Sapiens
gcugaagggagaggaguaacagccagaccccccaucaguggacaaggggagaguccccuacucc

SEQ ID NO: 59622 - RNA, 64 nt, Homo Sapiens
aaguuccugcuggcguuucugaguccugagucccucaguggagcguguccuccucuuucuguga

SEQ ID NO: 59623 - RNA, 64 nt, Homo Sapiens
ugacggcuacuguggagauguggcagaugaggccucaguggaagccgacuggagcaagguuugc

SEQ ID NO: 59624 - RNA, 64 nt, Homo Sapiens
cucagaccagcucccagaugccaaauaaacggacucaguggacaaaacccagugagacagaccg

SEQ ID NO: 59625 - RNA, 64 nt, Homo Sapiens
gcagcugucaggccugaagggggggcuguggccgucaguggaaucaggaggaagggagggcaga

SEQ ID NO: 59626 - RNA, 64 nt, Homo Sapiens
uagaccugccaggagcacuucucucacucugccuucaguggagcggcucauguggguguccccu

SEQ ID NO: 59627 - RNA, 64 nt, Homo Sapiens
cccguuccccccaucccuggcugucacccggaccucaguggaagcuugagggaagaccacccuc

SEQ ID NO: 59628 - RNA, 64 nt, Homo Sapiens
cucuccuggggccuucgaugggcuuuucuucuugucaguggagggagcagcuccccacucagcc

SEQ ID NO: 59629 - RNA, 64 nt, Homo Sapiens
gaagaugcccagggcccagaagccaucagaauuaucaguggagaagcaccuuuugacucuuccc

SEQ ID NO: 59630 - RNA, 64 nt, Homo Sapiens
acuggagacaacaccucagaccaucugaaccccaucaguggacgaaaauggggcuguuaauaua

SEQ ID NO: 59631 - RNA, 64 nt, Homo Sapiens
gagagauguuauguaauaugcugagguggcgaccucaguggagaaauguaaagacugaauugaa

SEQ ID NO: 59632 - RNA, 64 nt, Homo Sapiens
gccccagggcacauaagagcaaaggcuccaauggucaguggaugacucugcaaaagugaccccc

SEQ ID NO: 59633 - RNA, 64 nt, Homo Sapiens
aaccacagcagcagccagggaccacaccgugcccucaguggacuguggggagcuguccggugcu

SEQ ID NO: 59634 - RNA, 64 nt, Homo Sapiens
acgugucucuuuaaagcugcgaagcaacuuuaugucaguggaaaggagauaagcugcaaggggc

SEQ ID NO: 59635 - RNA, 64 nt, Homo Sapiens
acugaaauacagcgguuguguuugguguugugagucaguggaacauauauauauacagugccuu

SEQ ID NO: 59636 - RNA, 62 nt, Homo Sapiens
uaaagcucaaagcaaacaacguggaacagauacgucaguggaccauaacagaagagacuaga

SEQ ID NO: 59637 - RNA, 64 nt, Homo Sapiens
ucacaaaauauaguaauuucauuuuuaccuuucuucaguggacugaauuguauggaaggaaauu

SEQ ID NO: 59638 - RNA, 64 nt, Homo Sapiens
uagcuucccagggcugcccccgacaggcuggcucucaguggaggccagagaucuggaaucgggg

SEQ ID NO: 59639 - RNA, 64 nt, Homo Sapiens
aaaaaaacauuuaaaaaugucugaaacuuaaagaucaguggaaagaagaaauaaaugaguauua

SEQ ID NO: 59640 - RNA, 64 nt, Homo Sapiens
caagugggaaaacaugguccugccucugugugccucaguggagacaggccucgaggagucaauu

SEQ ID NO: 59641 - RNA, 64 nt, Homo Sapiens
gucuguaggaaacuugcagccgucucuggggcacucaguggauuacugggaaguuuuucaguga

SEQ ID NO: 59642 - RNA, 64 nt, Homo Sapiens
cccuaaucccuggcccucccagcugucugggacuucaguggacccccagccccugcccccacuc

SEQ ID NO: 59643 - RNA, 64 nt, Homo Sapiens
gccgcuggcgucaaguucagcuccacgugugccaucaguggauccgauccguccagccauggcu

SEQ ID NO: 59644 - RNA, 64 nt, Homo Sapiens
gugcugucuaugcacagguggacugcagcgacaaucaguggauggcaggcuuaguaacgccgug

SEQ ID NO: 59645 - RNA, 64 nt, Homo Sapiens
gcaggggucuggcacaggugccugcuugcggcuuucaguggaggaccuugcaugcaccuugcua

SEQ ID NO: 59646 - RNA, 56 nt, Homo Sapiens; identical to SEQ ID NO: 59282

SEQ ID NO: 59647 - RNA, 64 nt, Homo Sapiens
ugccuggguggggagcaggugcuccucugucuugucaguggagggucggccugagagcugugcc

SEQ ID NO: 59648 - RNA, 64 nt, Homo Sapiens
uggggagguuagagagauggggaaaugcucagccucaguggagaugcccccggccaggcccuga

SEQ ID NO: 59649 - RNA, 64 nt, Homo Sapiens
uuccugcacccccagccuggucuccugggcgacgucaguggaccaccaacucagggacaucccc

SEQ ID NO: 59650 - RNA, 64 nt, Homo Sapiens
caaacauuauuucauuuuuuuccucucaguaaugucaguggaaguuagggaaaagauucuugga

SEQ ID NO: 59651 - RNA, 64 nt, Homo Sapiens
ucuucuuccuuguccccguguuucuugagagcacucaguggaugacuauggagaagagccugca

SEQ ID NO: 59652 - RNA, 64 nt, Homo Sapiens
uauccuuuuacacgcacaaaagcaauagauucauucaguggacaaguuccuuguuuaacuacac

SEQ ID NO: 59653 - RNA, 64 nt, Homo Sapiens
ugguuauauuucaaccacaccuaaauuaacaaauucaguggacauuuguucuggguuaacagua

SEQ ID NO: 59654 - RNA, 64 nt, Homo Sapiens
cccuaggucuugggagcucuuggaggugucuguaucaguggauuucccauccccugugggaaau

SEQ ID NO: 59655 - RNA, 55 nt, Homo Sapiens; identical to SEQ ID NO: 59291

SEQ ID NO: 59656 - RNA, 64 nt, Homo Sapiens
uuuuuuucuuuuucccuucucuucuuaggaaccaucaguggacaugaauguuucuacaaugcau

SEQ ID NO: 59657 - RNA, 64 nt, Homo Sapiens
augauguucagauggugaaauuacaauuaauaacucaguggaaagguucagcagaauaaacucu

SEQ ID NO: 59658 - RNA, 64 nt, Homo Sapiens
ccauguuaugucgacuauuaaccauuuuaucccuucaguggaaauugaugaggucaugucacag

SEQ ID NO: 59659 - RNA, 64 nt, Homo Sapiens
cuguguugccaauggacaaauauaugaccggguaucaguggaaguuggcuucucucccuccagg

SEQ ID NO: 59660 - RNA, 64 nt, Homo Sapiens
ucaaucagaagguauucugagauuuaaugaugcuucaguggaaagcuagcaaugccacgauuua

SEQ ID NO: 59661 - RNA, 64 nt, Homo Sapiens
cucuuuuuuccuaauuauaauacacaugaugcauucaguggacaugaaauguuaauugcauuuu

SEQ ID NO: 59662 - RNA, 64 nt, Homo Sapiens
ugucaaguacaggugagcacugugaacccagugaucaguggaauugugcugaaagaaacauuga

SEQ ID NO: 59663 - RNA, 64 nt, Homo Sapiens
aacaaaguacacuugauaaaaaagggguuauuggucaguggaaggcuuuuaugugucuuucuac

SEQ ID NO: 59664 - RNA, 64 nt, Homo Sapiens
uuaucuucauuaaauuuagcuuuuccuuaggaauucaguggaacauggugucggaauuguugua

SEQ ID NO: 59665 - RNA, 64 nt, Homo Sapiens
gguucagcagaauaaacucuuuacaauuaauaacucaguggaaaaugauguucagauggugaaa

SEQ ID NO: 59666 - RNA, 64 nt, Homo Sapiens
cucaaaagcagaauuuuuaaaacugcauuuuuaaucaguggaacucaauguauaguuagcuuua

SEQ ID NO: 59667 - RNA, 64 nt, Homo Sapiens; identical to SEQ ID NO: 59666

SEQ ID NO: 59668 - RNA, 64 nt, Homo Sapiens
uagaaaugugcaggagcggacaugucacauauugaaauagcaaaacaugcuggccucagagauu

SEQ ID NO: 59669 - RNA, 64 nt, Homo Sapiens
gcaacuuguggaucugugugaguuuauggauuuaaaauagcaaaggcugcagacagaggaagaa

SEQ ID NO: 59670 - RNA, 64 nt, Homo Sapiens
uccuaaugcuugcugcugauaacuuauggggccaaaauagcaugauguguagugcuacacaccu

SEQ ID NO: 59671 - RNA, 64 nt, Homo Sapiens
ccucaauugugaaaaaauuuaacaaaacaguccuaaauagcagcuaauuccuguuuuuauuauu

SEQ ID NO: 59672 - RNA, 64 nt, Homo Sapiens
uuuaaaaguuuucuauuucacauaaacuaguagaaaauagcaguuuauuagcaugucauuugua

SEQ ID NO: 59673 - RNA, 64 nt, Homo Sapiens
uacagcaaaaccucagugaugacuuggugaaaggaaauagcaguuguaugagacaaaaguugag

SEQ ID NO: 59674 - RNA, 64 nt, Homo Sapiens
cuagcauaacuuuuuacauuuaauuuuucauaugaaauagcaauuaguuacugcuguguuacau

SEQ ID NO: 59675 - RNA, 64 nt, Homo Sapiens
uguuuuaaaugucuagguucuguauuuuuuucuuaaauagcaagaaaauacagauugcuaguau

SEQ ID NO: 59676 - RNA, 64 nt, Homo Sapiens
ugaccaaauauaucagcaucuaauugaaaugaccaaauagcauucuuagacuucuguauuauga

SEQ ID NO: 59677 - RNA, 64 nt, Homo Sapiens
uguaugguauuuuauuuaaaggagauaaacagccaaauagcaaauaggucacugaaugauaaga

SEQ ID NO: 59678 - RNA, 64 nt, Homo Sapiens
cagcucacaucuguuuuagaugugacaguuauauaaauagcaugugccucacucauuacuccug

SEQ ID NO: 59679 - RNA, 64 nt, Homo Sapiens
cuaaauuugaguaaauacaacugcuuagaacuauaaauagcauuaaucagaauauuucaucuaa

SEQ ID NO: 59680 - RNA, 64 nt, Homo Sapiens
gauucagaauuuuuuuuaauuucaagguguuuuuaaauagcaguaucucaaacaaaagacuugc

SEQ ID NO: 59681 - RNA, 64 nt, Homo Sapiens
uagaaguuuuggauaugaaacugcugugccccuaaaauagcauuaccaagugcuggaaucuaau

SEQ ID NO: 59682 - RNA, 64 nt, Homo Sapiens
accagaaauuauagaaaucuguguuuuccuguaaaaauagcacuauaguaucacuugaacaauu

SEQ ID NO: 59683 - RNA, 64 nt, Homo Sapiens
aaacagauuuugggcaggacauuccaugcacuggaaauagcaugaacaaaugcaugaaaauugc

SEQ ID NO: 59684 - RNA, 64 nt, Homo Sapiens
ccuggauuggucucaaaaacauaaugcucagugaaaauagcaaguuguagaaaguuauauacaa

SEQ ID NO: 59685 - RNA, 64 nt, Homo Sapiens
gacuuuggcaugaaauguuaagcauccgacaucuaaauagcaauauuuugaauacuggaaacuc

SEQ ID NO: 59686 - RNA, 64 nt, Homo Sapiens
cagagguuugagugaacccucuuucaaagacaauaaauagcacagaauuguccgugcuucugug

SEQ ID NO: 59687 - RNA, 64 nt, Homo Sapiens
ccuaguguuuuaauuaccugugugcagcuauuuuaaauagcauuuuacuugaauaauauguaug

SEQ ID NO: 59688 - RNA, 64 nt, Homo Sapiens
uagaaaaauucuacuuuaauuuccauuaaaaagcaaauagcauugacacauuuaaagcuuuuca

SEQ ID NO: 59689 - RNA, 64 nt, Homo Sapiens
ucugcugcuguuauuuauaugcaauucuucugguaaauagcaauagaauaaaacauauuucaau

SEQ ID NO: 59690 - RNA, 64 nt, Homo Sapiens
uuaauuucaguaguacaguauggaauaguuaaauaaauagcaaaucacugaauucagaaucuca

SEQ ID NO: 59691 - RNA, 64 nt, Homo Sapiens
ugaauaagaggugauggaccaguuuacugcuuagaaauagcaagaggcacugcaguaaaacuug

SEQ ID NO: 59692 - RNA, 64 nt, Homo Sapiens
auugaagauacaucucuguuucaaauuucaaaagaaauagcauguggguaccuuugaaagaauc

SEQ ID NO: 59693 - RNA, 64 nt, Homo Sapiens
gacaauaaacaaaguacuacaucgguggccaggaaaauagcaguaagggaauuuaggauccacc

SEQ ID NO: 59694 - RNA, 64 nt, Homo Sapiens
uuagugaaugcaauucaguaguaaguaaaauuucaaauagcauuaguagugggguggguggcga

SEQ ID NO: 59695 - RNA, 64 nt, Homo Sapiens
acagacugaggcgguccugaaaauaauuuuuuuaaaauagcauuuaguauuuaagaaaauguug

SEQ ID NO: 59696 - RNA, 64 nt, Homo Sapiens
gaagccucuauuguuccccagauaauguucccucaaauagcacggggaagcaacugccuuucaa

SEQ ID NO: 59697 - RNA, 64 nt, Homo Sapiens
uauuaaucauuggagaagggggaagaggaaaugaaaauagcacaaaaauuaaaauuggaacgaa

SEQ ID NO: 59698 - RNA, 64 nt, Homo Sapiens
cuaacuugaagccacauccuacagauggcagcccaaauagcacaugggcaauuggcaccaucuu

SEQ ID NO: 59699 - RNA, 64 nt, Homo Sapiens
aaaaacuuugccucugaugcucagccccacccccaaauagcacacaagcuuguuaaccccaccu

SEQ ID NO: 59700 - RNA, 64 nt, Homo Sapiens
aucuuuuguuuuuaaaaaaugcaauuaaaacuagaaauagcacucuugguuucuuuugaugaaa

SEQ ID NO: 59701 - RNA, 64 nt, Homo Sapiens
uggagauagguaggucauuaugauugcagagccaaaauagcaaaacaaacauauuaaguguguu

SEQ ID NO: 59702 - RNA, 64 nt, Homo Sapiens
uuccuugaauuaugcaaugcaacauuuuacauguaaauagcacuggucauauacugauguauau

SEQ ID NO: 59703 - RNA, 64 nt, Homo Sapiens
uuucaauggagauagggcuagaaauacuuuugccaaauagcauucuuauucacuuuaugccggu

SEQ ID NO: 59704 - RNA, 64 nt, Homo Sapiens
ucacauuuuuccacaguauauaaaauuacuuuguaaauagcaguaauuuguucuuaccaaaaaa

SEQ ID NO: 59705 - RNA, 64 nt, Homo Sapiens
caacaaaaugucuuuauugaugauuuaaacaaauaaauagcauguuuuguuaaggcaugacaga

SEQ ID NO: 59706 - RNA, 64 nt, Homo Sapiens
gacccagccugaaagauacaggggaucauguuaaaaauagcaguauuauuuuucgucucaaugg

SEQ ID NO: 59707 - RNA, 64 nt, Homo Sapiens
aggaauggggggcgggccagggugggaagagaagaaauagcagagccuauuuuggugagguuuu

SEQ ID NO: 59708 - RNA, 64 nt, Homo Sapiens
guuugauguucagugcauacuuauuaacuuaaaaaaauagcaaauuuauuguaaagugcucccu

SEQ ID NO: 59709 - RNA, 64 nt, Homo Sapiens
aucucuugauuugcuuuuguaaucagcaauaauaaaauagcagguagauggaugacaguugcuc

SEQ ID NO: 59710 - RNA, 64 nt, Homo Sapiens
uucuugcuggaagaauaucucugccuucuuaccuuaaauuaaaaagagcacuaagauaacaccu

SEQ ID NO: 59711 - RNA, 64 nt, Homo Sapiens
aaggcauuugaaugaauguuugacucagguuuguuaaauuaaccuucaguaacugcaguaccaa

SEQ ID NO: 59712 - RNA, 64 nt, Homo Sapiens
auaaacuauucaucauauaauaguaagcugcaucuaaauuaaaacuuggacauaauuaauauua

SEQ ID NO: 59713 - RNA, 64 nt, Homo Sapiens
uuuuucagaaauaucgaaggacuccccaaauuucuaaauuaaucugaaaguuuaaguuuuagac

SEQ ID NO: 59714 - RNA, 64 nt, Homo Sapiens
aguaacugaaccaaaggaaaaagaagcucuuugcuaaauuaaggucuuuuauaaauuuaguaaa

SEQ ID NO: 59715 - RNA, 64 nt, Homo Sapiens
ugauguugagauuauuauauacuguauuuucuucuaaauuaacccuaauguuuaaaaacucacu

SEQ ID NO: 59716 - RNA, 64 nt, Homo Sapiens
ugaaauauauaugaugaaaagaauugagaaguucuaaauuaagacauuucaguuaagcucauaa

SEQ ID NO: 59717 - RNA, 64 nt, Homo Sapiens
gcucuucauguuaauauggcagaguuuuguaaacuaaauuaaaacuuacugauauauuggacuu

SEQ ID NO: 59718 - RNA, 64 nt, Homo Sapiens
uaaaguuuugccccaugauaaaauaaguaacauauaaauuaauacauaaguuaauauuggaagu

SEQ ID NO: 59719 - RNA, 64 nt, Homo Sapiens
uaaaauggcuauuccucuuuuuacuuggaaauaauaaauuaacauuauauuuuaaacauaaauu

SEQ ID NO: 59720 - RNA, 64 nt, Homo Sapiens
auuucuaacuugguucaucacauuauaagauaaauaaauuaaauuaaugaaaaugugacuuaga

SEQ ID NO: 59721 - RNA, 64 nt, Homo Sapiens
uaacuugguucaucacauuauaagauaaauaaauuaaauuaaugaaaaugugacuuagaguagg

SEQ ID NO: 59722 - RNA, 64 nt, Homo Sapiens
aaucugccagaucugugaaugauagagauuaugcuaaauuaaugcugauucuuugugugugugg

SEQ ID NO: 59723 - RNA, 64 nt, Homo Sapiens
uuucuuaucagaauaucuggcuggcccuguaauuuaaauuaaaauaaaauuuuggagaaacagc

SEQ ID NO: 59724 - RNA, 64 nt, Homo Sapiens
auucauuuuauucuuauuaaggaaauacuuugcauaaauuaaucagccccagagugcuuuaaaa

SEQ ID NO: 59725 - RNA, 64 nt, Homo Sapiens
uuacuuuuuuucugauguuuccuacaacuaaaaauaaauuaauaaauuuauauaaauucuauuu

SEQ ID NO: 59726 - RNA, 64 nt, Homo Sapiens
uagccugccucuauuuguuguugcaguaaaauguuaaauuaaugccucggggauuuuuuccauu

SEQ ID NO: 59727 - RNA, 64 nt, Homo Sapiens
uuuuuuuuuuuacuuggauguccuuuuucauuguuaaauuaaaauggcauaaacccuuugaagu

SEQ ID NO: 59728 - RNA, 64 nt, Homo Sapiens
ugaaaaguugaaauuuaugagcuuugaagauugcuaaauuaaauaauuuauagcuccaaaaaca

SEQ ID NO: 59729 - RNA, 64 nt, Homo Sapiens
uguuguuuaccuuucacugauuucuuauaugguauaaauuaaaguucaggcauuuauggggaga

SEQ ID NO: 59730 - RNA, 64 nt, Homo Sapiens
aauuuuaaguauaauguuuugccuuugguacaacuaaauuaaaacucuugguggucacauauug

SEQ ID NO: 59731 - RNA, 64 nt, Homo Sapiens
guuaugauaaauuuuauauuuuuaaaauaauuuuuaaauuaacagcaaauucaauaaacucaaa

SEQ ID NO: 59732 - RNA, 64 nt, Homo Sapiens
ugcuuagcuguuuguuuugaaauuguuuuauuuuuaaauuaauuauuauauucaucuacuuaga

SEQ ID NO: 59733 - RNA, 64 nt, Homo Sapiens
ugcaaguaauguuuugaggaaaaauucauuuuccuaaauuaaugucauguuuugaagauuguuu

SEQ ID NO: 59734 - RNA, 64 nt, Homo Sapiens
uuuuauaaauauuucauauuaaacuuacuagauauaaauuaaaaggaaugggggugauauagau

SEQ ID NO: 59735 - RNA, 64 nt, Homo Sapiens
uguacaaaaagaacucuuuaaauuaaaugugacauaaauuaauuuuuugagguuaugcacacua

SEQ ID NO: 59736 - RNA, 64 nt, Homo Sapiens
gugacauaaauuaauuuguagagguuaugcacacuaaauuaaauuggaauaauaccucaguuuu

SEQ ID NO: 59737 - RNA, 64 nt, Homo Sapiens
guuacaagguagguuggcucgcaaggcuuuaaauuaaauuaauacagaaaugauggaguaaaca

SEQ ID NO: 59738 - RNA, 64 nt, Homo Sapiens
uaauaguuacaagguagguuaaacagcaaggcuuuaaauuaaauuuuggcagaaaugauggagu

SEQ ID NO: 59739 - RNA, 64 nt, Homo Sapiens
cauaguuaucuaguaguaggcauucauauauuuauaaauuaaaauggcuuggaaaagagguacc

SEQ ID NO: 59740 - RNA, 64 nt, Homo Sapiens
acaguaaauguguauaaauaaaauugaucaacuuuaaauuaagcauuucuuuaauaaguuuuua

SEQ ID NO: 59741 - RNA, 64 nt, Homo Sapiens
uuuguaaacccaaguaaguuaaauuaggcucacuuaaauuaauuaucuucgaauuccauggaca

SEQ ID NO: 59742 - RNA, 64 nt, Homo Sapiens
aaagccuacauuaguucaauuuaacuaaugacaauaaauuaaacaguuuaguacaggagugaca

SEQ ID NO: 59743 - RNA, 64 nt, Homo Sapiens
ucugccuuuucugaccucauuccucauaagcuucuaaauuaaucaauacuaaaauauuuucucu

SEQ ID NO: 59744 - RNA, 64 nt, Homo Sapiens
aaucuaaauuuuaaccuacuaauuuaccuuuuaauaaauuaaaauuuucaggcaugguaacaga

SEQ ID NO: 59745 - RNA, 64 nt, Homo Sapiens
ggacacuaaaguccuaucauuucauuguuuuaaauaaauuaagguguaaacuuuugagucuggu

SEQ ID NO: 59746 - RNA, 64 nt, Homo Sapiens
uaugaucauagaaacaucuauuuucaaaacaauauaaauuaagcuuuuccccuugauuccuguu

SEQ ID NO: 59747 - RNA, 64 nt, Homo Sapiens
uagacucguuuaaaaacaaguauauuaaauggguuaaauuaagcuuuuacagaacaugcuuaau

SEQ ID NO: 59748 - RNA, 64 nt, Homo Sapiens
uaaaaauuaaauaaacguauuaaguuuaacauauuaaauuaauuuaacauuuagacuaacauua

SEQ ID NO: 59749 - RNA, 64 nt, Homo Sapiens
aaauuaauuuaacauuuagacuaacauuaacauuuaaauuaauauguuaagugaauauacuuaa

SEQ ID NO: 59750 - RNA, 64 nt, Homo Sapiens
aaaguaaagcuacucagagcagaauugcuaggauuaaauuaaggacggggcaugcaauagcuua

SEQ ID NO: 59751 - RNA, 64 nt, Homo Sapiens
uaaauuuaagggaagcucuauucaauauauauuauaaauuaauauguuuuuuguaaagcuauca

SEQ ID NO: 59752 - RNA, 64 nt, Homo Sapiens
ucucaaaauucuuuaagucaauauuuaucauauguaaauuaaacaugaauacauucucaucuua

SEQ ID NO: 59753 - RNA, 64 nt, Homo Sapiens
uucaguaggaaacugaacucagcacucagaauuuuaaauuaaaucaaugaucuucaaguauuug

SEQ ID NO: 59754 - RNA, 64 nt, Homo Sapiens
ugcaguguuuggauuguauauauggugcuaaaaauaaauuaauuuacuuuauaaaccuuaucug

SEQ ID NO: 59755 - RNA, 64 nt, Homo Sapiens
ccauacauguuaauauucuacauucuugcuuccuuaaauuaauauguuuguguguauauaugug

SEQ ID NO: 59756 - RNA, 64 nt, Homo Sapiens
uccucucaauuuugcugugaaccugaaauggcuuuaaauuaauacucuuauuuuuuauuuaauu

SEQ ID NO: 59757 - RNA, 64 nt, Homo Sapiens
uuaauacucuuauuuuuuauuuaauuuaauuacauaaauuaaaccuuaccaugaccaaauugug

SEQ ID NO: 59758 - RNA, 64 nt, Homo Sapiens
uuguuuuuaguagaugacauuugagauccaguuauaaauuaaccuucaauugcuauuaaacaag

SEQ ID NO: 59759 - RNA, 64 nt, Homo Sapiens
uacagucauucauuauuuguccacaggacuaauguaaauuaauaaauggaaaauguacucuaga

SEQ ID NO: 59760 - RNA, 64 nt, Homo Sapiens
aggcuacaucacccaaaguagauguuagaaaaccuaaauuaaugaaccauauuuuuaaaauccu

SEQ ID NO: 59761 - RNA, 64 nt, Homo Sapiens
caaccucuuugggagaaguaugaaugcgugugucuaaauuaaaagaaaaaaauauuuaaacguu

SEQ ID NO: 59762 - RNA, 64 nt, Homo Sapiens
uaggaauacagcuuuuugaaaaagcuauaaaguuuaaauuaacuaaaaauaugcauuuucuuac

SEQ ID NO: 59763 - RNA, 64 nt, Homo Sapiens
acugugaccaaauuucuguauuacgauuuuauguuaaauuaaacuaauauggcagguuauaaug

SEQ ID NO: 59764 - RNA, 64 nt, Homo Sapiens
gaauaguuauuuuacaguucuucccucaauucuguaaauuaaaauauuuugacauuuaaaauac

SEQ ID NO: 59765 - RNA, 64 nt, Homo Sapiens
agagauuuggcuaguuguguaugacauuaucuuuuaaauuaaaauuucuauauguugcguugug

SEQ ID NO: 59766 - RNA, 64 nt, Homo Sapiens
ucaacuauuuguauuucaauuaaauuuuguugaauaaauuaagcuuguacacugauauauuggg

SEQ ID NO: 59767 - RNA, 64 nt, Homo Sapiens
auuaaauaaaacuaauaugacacaauuuuagaaauaaauuaaaagguaauaugcuccaccuaca

SEQ ID NO: 59768 - RNA, 64 nt, Homo Sapiens
gaauaugaaaccaaaggaagaauuuccauguagauaaauuaagaauagggaaaaacaucuaccu

SEQ ID NO: 59769 - RNA, 64 nt, Homo Sapiens
uucaaagacugucaaguggaaagcuaucauuuccuaaauuaaggaacuuaggucaaaguuaaau

SEQ ID NO: 59770 - RNA, 64 nt, Homo Sapiens
gaaacaucaauuucuauuuucugaccucuaagccuaaauuaagauauuguauauguaaugauga

SEQ ID NO: 59771 - RNA, 64 nt, Homo Sapiens
uuaucauuaauaauauaaaacacuuauuugagauuaaauuaaauuuuucaugagccccucuuug

SEQ ID NO: 59772 - RNA, 64 nt, Homo Sapiens
agaagaaauauauuuauaaagaaaagagacguaguaaauuaaaucgaacauauuuauugguacu

SEQ ID NO: 59773 - RNA, 64 nt, Homo Sapiens
uuaaauuuuaauuggcuggcguaccuauaaucccuaaauuaaaaaaaaaagucacuaacuuugu

SEQ ID NO: 59774 - RNA, 64 nt, Homo Sapiens
gaaccuagccaauaagauagauuauuuuuuucuuuaaauuaaaauuuuagaugacauucuacaa

SEQ ID NO: 59775 - RNA, 64 nt, Homo Sapiens
uuuucacacuguguacugugacuugggaggggaauaaauuaaagaagagauauacauucuggau

SEQ ID NO: 59776 - RNA, 64 nt, Homo Sapiens
uccaaccugggcgacagagcaagacuccaucucauaaauuaaaaggaaaguaugauaguguuau

SEQ ID NO: 59777 - RNA, 64 nt, Homo Sapiens
ucucuggguggaugaucuucuaguacuguauuuuuaaauuaaggaguuuuaguuauaaugaaau

SEQ ID NO: 59778 - RNA, 64 nt, Homo Sapiens
cauuuuuaaaguuuucaaaaagccaucggaauguuaaauuaauguaaagggaacagcuaaucua

SEQ ID NO: 59779 - RNA, 64 nt, Homo Sapiens
auuuauuuuucagaccauuuuugaacaucacuccuaaauuaauaaaguauuccucuguugcuuu

SEQ ID NO: 59780 - RNA, 64 nt, Homo Sapiens
aauguuuagugaaacauuugugaaaaaagaagacuaaauuaagaccugagcugaaauaaaguga

SEQ ID NO: 59781 - RNA, 64 nt, Homo Sapiens
aaucugaaaaguggaggaagaguacaaauagaccuaaauuaagcucauuuuuaggcuuugauuu

SEQ ID NO: 59782 - RNA, 64 nt, Homo Sapiens
ucaagguaagaaacauuguauuccuaguguuacuuaaauuaagaaaauaaaagauauugagguc

SEQ ID NO: 59783 - RNA, 64 nt, Homo Sapiens
aggaaaauaaaagauauugaaaaaaacuuuuuuuuaaauuaaaaaaaucuuuguaucuggggaa

SEQ ID NO: 59784 - RNA, 64 nt, Homo Sapiens
aauuuuuuaaaagucauauuaaaaaaaaaacuacuaaauuaaauccuuauugauuuuuuuccaa

SEQ ID NO: 59785 - RNA, 64 nt, Homo Sapiens
cuuuuauuucuuccccuaucuugguuuuacuggguaaauuaauaaagccaucccuauggggaaa

SEQ ID NO: 59786 - RNA, 64 nt, Homo Sapiens
aaaaugacuuggcuuuugguagugaauuauuuucuaaauuaaaauacuucaguaaauuauucuu

SEQ ID NO: 59787 - RNA, 64 nt, Homo Sapiens
uucuggauuuaauuaguaguugguucaaucuuaguaaauuaacaccucccccccucucauuuuc

SEQ ID NO: 59788 - RNA, 64 nt, Homo Sapiens
agcuaauguuguauuguuuuauuaaaaguaguuuuaaauuaauggauuuaauggaauuguaauu

SEQ ID NO: 59789 - RNA, 64 nt, Homo Sapiens
cuggggaaguaacguuugcggaugcacaccgaccuaaauuaaaugaaggguauguacuggaaac

SEQ ID NO: 59790 - RNA, 64 nt, Homo Sapiens
ggauuucuuauugaccuauauucaugaaagcauauaaauuaaaauauuuaaaauuagauaugau

SEQ ID NO: 59791 - RNA, 64 nt, Homo Sapiens
ugguuuugugaauacuggcaaaagcaauuguuuuuaaauuaacaauggagagaaugauaagaug

SEQ ID NO: 59792 - RNA, 64 nt, Homo Sapiens
uaugucagucuaaucucuuguuugccaagguuccuaaauuaauucacuuaaccaugaugcaaau

SEQ ID NO: 59793 - RNA, 64 nt, Homo Sapiens
auguucuauauagccuuugcuaaagagcaacuaauaaauuaaaccuauucuuucugugugugug

SEQ ID NO: 59794 - RNA, 64 nt, Homo Sapiens
gugugccaggccgggugcggaguuacugcuaaauuaaauuaaauucuucugggcgcagggagua

SEQ ID NO: 59795 - RNA, 64 nt, Homo Sapiens
uaaaugugugccaggccggggaguaaguuacugcuaaauuaaaucuaccucuucugggcgcagg

SEQ ID NO: 59796 - RNA, 64 nt, Homo Sapiens
cuuuuuccuaguggugucauuuuugaaugccucauaaauuaaugauucugaagcuuauguuucu

SEQ ID NO: 59797 - RNA, 64 nt, Homo Sapiens
cccuaucacugacacaucagcauguuuucugcuuuaaauuaaaauuuuaugacaguaucgaggc

SEQ ID NO: 59798 - RNA, 64 nt, Homo Sapiens
cucagaauaaaccugugaccuuacuuuuguauaauaaauuaaaauuaauauuaaauuaaaaccu

SEQ ID NO: 59799 - RNA, 64 nt, Homo Sapiens
ccuuuacuuuuguauaauaaucuacuauuaauauuaaauuaaaacacacguaagaaaguguuuu

SEQ ID NO: 59800 - RNA, 64 nt, Homo Sapiens
agaagccauuaaaauuuuacuaaaauugugcauguaaauuaauugucagcauuccaugucucaa

SEQ ID NO: 59801 - RNA, 64 nt, Homo Sapiens
augucucaagauuuucuuaauuuaguucgcuguuuaaauuaauucauguccuguaaaguucuga

SEQ ID NO: 59802 - RNA, 64 nt, Homo Sapiens
guaauaccucaaaacugcucuaacauuucuauacuaaauuaacacauaccacaucaaaauacag

SEQ ID NO: 59803 - RNA, 64 nt, Homo Sapiens
cacaauuugguaccuaggguacauccaucuugaguaaauuaagcauuuuucauaacuuuguagu

SEQ ID NO: 59804 - RNA, 64 nt, Homo Sapiens
uuuucugguuucugugggaauuuaaaauuguaaauaaauuaaacuguccaauuuguguaauuug

SEQ ID NO: 59805 - RNA, 64 nt, Homo Sapiens
auguugcagcucauaaagaaaaugaagacugaauuaaauuaaaagaaaguuuuggaaaagaaac

SEQ ID NO: 59806 - RNA, 64 nt, Homo Sapiens
acaauggcucuuuagagaguuaucugaguguaaguaaauuaauguucucauuuagauuuaucuc

SEQ ID NO: 59807 - RNA, 64 nt, Homo Sapiens
guuaccuacaauauuuacuagagauuuaugaaauuaaauuaagagauaauguaagaaaauacau

SEQ ID NO: 59808 - RNA, 64 nt, Homo Sapiens
caggguuuuuuuguuuuauuuguuugcuuauuuuuaaauuaacuguuuugagcuuugaauacuu

SEQ ID NO: 59809 - RNA, 64 nt, Homo Sapiens
guauuuuuuagucaauguguuccaugauuuugcuuaaauuaauacuuuuaaguaauggaacuuu

SEQ ID NO: 59810 - RNA, 64 nt, Homo Sapiens
uuucauugaacauguuagccuaggauacguacaguaaauuaacaaugauagcagcagaugccua

SEQ ID NO: 59811 - RNA, 64 nt, Homo Sapiens
uucucaaggaggaaaauuggucuaggaagccuucuaaauuaaacucugggaaauauaguaauga

SEQ ID NO: 59812 - RNA, 64 nt, Homo Sapiens
cuccuccuuuuacagaauuauuuaacuacuuuacuaaauuaauacagauuuccauuuuuuguau

SEQ ID NO: 59813 - RNA, 64 nt, Homo Sapiens
uguaaaacuccauucauaguauaaauauuaggcauaaauuaaaaccuaugaaugaaauucuuuu

SEQ ID NO: 59814 - RNA, 64 nt, Homo Sapiens
caucauuuacuugagguucaaaaauaauucauuuuaaauuaaguaguuuuaaucagcuuaaaag

SEQ ID NO: 59815 - RNA, 64 nt, Homo Sapiens
ggugcagaaauaauacauuaaaagauuuucacuuuaaauuaauuaguaauauugagcgcucacc

SEQ ID NO: 59816 - RNA, 64 nt, Homo Sapiens
ggucagacggcauuaguuuuucccuuaguuaagcuaaauuaaagggacuccauccuguuaugau

SEQ ID NO: 59817 - RNA, 64 nt, Homo Sapiens
uuaaaugcaauauaugucuugcuuauuaggauaauaaauuaauauccucaauagauugcauguu

SEQ ID NO: 59818 - RNA, 64 nt, Homo Sapiens
guauaccuaaacagagauaguauuguauccaugguaaauuaauugcaaugccuuugaaaaggga

SEQ ID NO: 59819 - RNA, 64 nt, Homo Sapiens
uuucucuaggaacuaaccuaccccaacucugcccuucucccauccaagagaaaccagcaaaaug

SEQ ID NO: 59820 - RNA, 64 nt, Homo Sapiens
aagggcagugagcaagagaaaugucuaaagcugcuucucccaacaccguccaaagucuccacug

SEQ ID NO: 59821 - RNA, 64 nt, Homo Sapiens
guuguaaauaacuuuuaaugcuucuugucuuuuuuucucccacuaggucuguaaugugaaacaa

SEQ ID NO: 59822 - RNA, 64 nt, Homo Sapiens
agccaucugguucuccucuucucccuccuguggauucucccaucgccacguucccuuuccuccu

SEQ ID NO: 59823 - RNA, 64 nt, Homo Sapiens
auguacucacugugggcagauauaccacucaccuuucucccagcguacucagaaaagaacuguu

SEQ ID NO: 59824 - RNA, 64 nt, Homo Sapiens
gauuaugacugggacauucugugcgggucacaguuucucccaauuuggucuuaauguagcuacu

SEQ ID NO: 59825 - RNA, 64 nt, Homo Sapiens
aagcuuugauuuuuaccguuucuaggcuacaauuuucucccaggccaggggaaagaugagcuuu

SEQ ID NO: 59826 - RNA, 64 nt, Homo Sapiens
ccugcccccacuuccuguuuccucccccucccccuucucccacccccuccgauccuuccuccca

SEQ ID NO: 59827 - RNA, 64 nt, Homo Sapiens
uuucucuccacccacauaaaagguuuuuucaaauuucucccauuaguuuuuuagcuuuauaaag

SEQ ID NO: 59828 - RNA, 64 nt, Homo Sapiens
gaauaacuuggagguugacuuuuauugcuuugauuucucccaaacugugcuaaagaaaugauau

SEQ ID NO: 59829 - RNA, 64 nt, Homo Sapiens
auguacuuaucuuaccucgggagcgucagugauauucucccagaauuggaaauaaaaaugguuu

SEQ ID NO: 59830 - RNA, 64 nt, Homo Sapiens
cccaacuuuauuugcaaugguuuaaaggagauucuucucccacccaacuuuaugauuugaaagc

SEQ ID NO: 59831 - RNA, 64 nt, Homo Sapiens
cacuccuaccagcaagcagcaccaucccgcaggcuucucccaccugauggcuguucucccaccg

SEQ ID NO: 59832 - RNA, 64 nt, Homo Sapiens
caccaucccgcaggcuucucccaccugauggcuguucucccaccgggucugggcucuggaagga

SEQ ID NO: 59833 - RNA, 64 nt, Homo Sapiens
uggcugggggugaauccgaaugacagugcagacguucucccauccaccaugucugagcuugggg

SEQ ID NO: 59834 - RNA, 64 nt, Homo Sapiens
ucuugcuagcuauugcaaauccaagauuguccuuuucucccauuaagaucaauuucucccaagg

SEQ ID NO: 59835 - RNA, 64 nt, Homo Sapiens
gccaagauuguccuuuucucuucugaagaucaauuucucccaagaaagagauagcuucucuucu

SEQ ID NO: 59836 - RNA, 64 nt, Homo Sapiens
ucaucaccccaccaccgucaggauuuugcuggaauucucccaugagcugcugguucucccaggu

SEQ ID NO: 59837 - RNA, 64 nt, Homo Sapiens
uggauuuugcuggaauucucaguggagcugcugguucucccagggagauccacucuguccgugg

SEQ ID NO: 59838 - RNA, 64 nt, Homo Sapiens
ugcuugaaggaaaaauaaaguuaguacuuuugucuucucccaugcugucaaacucaaugaucau

SEQ ID NO: 59839 - RNA, 64 nt, Homo Sapiens
uuaagugguucuguaccacacugugaccaugcucuucucccaauuugcauggcuuggacccuau

SEQ ID NO: 59840 - RNA, 64 nt, Homo Sapiens
cugcagugggagagcuuugcggagaaauaccugauucucccaaucccuggcagccccccaugug

SEQ ID NO: 59841 - RNA, 64 nt, Homo Sapiens
cgaaaccaaaugcgccccuuccgcccgcucucuuuucucccaaggccucacugcgccagccucc

SEQ ID NO: 59842 - RNA, 64 nt, Homo Sapiens
guccagagccaggaccccuucuacucccagccccuucucccagggcccugguaucuccccaucc

SEQ ID NO: 59843 - RNA, 64 nt, Homo Sapiens
uuugccgccugugcugccauccugcagagagccuuucucccagccccgcaccagcauuuuggaa

SEQ ID NO: 59844 - RNA, 64 nt, Homo Sapiens
gccacccucccuucauuacccccacuccauacccuucucccaacuuuuugaugucccuguaggg

SEQ ID NO: 59845 - RNA, 64 nt, Homo Sapiens
uccuguuccauucaucugcccaaacccuuucucuuucucccaggcagggcucugcagguccaua

SEQ ID NO: 59846 - RNA, 64 nt, Homo Sapiens
uagccuggagcuccaugguggcuucaugccucccuucucccagcucagguggcccugagggcuc

SEQ ID NO: 59847 - RNA, 64 nt, Homo Sapiens
uuuauagagauuuucuauugcugggaagguguguuucucccacaauuuguuugugaauauucac

SEQ ID NO: 59848 - RNA, 64 nt, Homo Sapiens
augguaggaccccuggccaguuuugugguuuugguucucccacuuguuugcuaccuccugcuau

SEQ ID NO: 59849 - RNA, 64 nt, Homo Sapiens
uccugaucuagcacuccucaucuccuugccuugcuucucccauuuccaacuccugaugcccucu

SEQ ID NO: 59850 - RNA, 64 nt, Homo Sapiens
uacccaacaaauaaccuguuugaacucucuuauauucucccacuagccugaagcaaugaccuca

SEQ ID NO: 59851 - RNA, 64 nt, Homo Sapiens
cucucugcuguguguggaugaaugauggaauuacuucucccauguugccauuuuugagguguac

SEQ ID NO: 59852 - RNA, 64 nt, Homo Sapiens
ucccuacccacguuugagcucucccacauucuuauucucccacaccccacuuuuucucuugguu

SEQ ID NO: 59853 - RNA, 64 nt, Homo Sapiens
uucuuauucucccacaucccacuuuuucucuugguucucccacaaacuccacucucccagcccc

SEQ ID NO: 59854 - RNA, 64 nt, Homo Sapiens
caucacguuugucacugccguuuauuacauugacuucucccaagaugaaucuuccuuccaaaug

SEQ ID NO: 59855 - RNA, 64 nt, Homo Sapiens
ggugaucgucuuugaaguucagcaaagcugcuuguucucccauggauuccugucccaagcuacc

SEQ ID NO: 59856 - RNA, 64 nt, Homo Sapiens
uucuaccaacuccaccuccacccccucauuccccuucucccaaaguacuacugcuguugcauga

SEQ ID NO: 59857 - RNA, 64 nt, Homo Sapiens
cucacugcaaccucugccuccuggguucaagcaauucucccaccucagccucccaaguagcugg

SEQ ID NO: 59858 - RNA, 64 nt, Homo Sapiens
gaaaugaugaaagugaccagacuuacauagguauuucucccacauuauaauuucaaaaugcauc

SEQ ID NO: 59859 - RNA, 64 nt, Homo Sapiens
aaaucuuuguacagcuuuaauaugaagagaagauuucucccaggccuguagguauaaaccucug

SEQ ID NO: 59860 - RNA, 64 nt, Homo Sapiens
cucugucuucaauaaaaacucggagucccccuucuucucccagaccgaccgcaucacugucuuc

SEQ ID NO: 59861 - RNA, 64 nt, Homo Sapiens
cugaguccguagccccgcccgggcuagggggagguucucccagccgcgggugccgcccucgcgc

SEQ ID NO: 59862 - RNA, 64 nt, Homo Sapiens
ccugccccgucaccaucucaggccaccugcccccuucucccacacugcuaggugggccagcccc

SEQ ID NO: 59863 - RNA, 64 nt, Homo Sapiens
gaaggaauugacuucgacugugaccuguggggauuucucccagcucuagacaacccugcaaagg

SEQ ID NO: 59864 - RNA, 64 nt, Homo Sapiens
cugcaguacuggggaagggcugggauggcucuccuucucccaagcccuaagugacgguccuaag

SEQ ID NO: 59865 - RNA, 64 nt, Homo Sapiens
uuaaggggcucuccucccuccugaaguguccccuuucucccaucgaugggggauacccaccuuu

SEQ ID NO: 59866 - RNA, 64 nt, Homo Sapiens
cagcuucccagacccucaugcaguugguuguaaauucucccaggagcuguuuuacugucuacuu

SEQ ID NO: 59867 - RNA, 64 nt, Homo Sapiens
gguuggggggcuccuucccuucagaacuugaaguuucucccacugccuccucuccaguggucuc

SEQ ID NO: 59868 - RNA, 64 nt, Homo Sapiens
uaacccuuuaucagguauacagcuugcaacuauuuucucccauuucugaguugucucuucauuc

SEQ ID NO: 59869 - RNA, 64 nt, Homo Sapiens
aaaaaaccuugcccggaccaacgucuugaagcuuuucucccacccauuuuuguauaugggauaa

SEQ ID NO: 59870 - RNA, 64 nt, Homo Sapiens
accacugauuguagggaugccguuccccccucccuucucccaugggcaucaucuuauuuauuua

SEQ ID NO: 59871 - RNA, 64 nt, Homo Sapiens
agagagcugggcuugaguggaguuuauuguagauuucucccaaggggaucacuuagcuucucac

SEQ ID NO: 59872 - RNA, 64 nt, Homo Sapiens
cccagccucauuucuuaaaugucuuccaguuccuuucucccauuacuggccugaccugggccuu

SEQ ID NO: 59873 - RNA, 64 nt, Homo Sapiens
uuuggucucagggggacccccccagagucccuccuucucccagggcucccccacuuugcauguu

SEQ ID NO: 59874 - RNA, 64 nt, Homo Sapiens
ccgucagcguccaacguggaaaaggcguuaccucuucucccagcgcuggccgccuggccacuga

SEQ ID NO: 59875 - RNA, 64 nt, Homo Sapiens
uuaguuaccacagccugcccagagagaaacuaucuucucccaacauuuacuaacauccacuggu

SEQ ID NO: 59876 - RNA, 64 nt, Homo Sapiens; identical to SEQ ID NO: 24669

SEQ ID NO: 59877 - RNA, 64 nt, Homo Sapiens; identical to SEQ ID NO: 24670

SEQ ID NO: 59878 - RNA, 64 nt, Homo Sapiens; identical to SEQ ID NO: 24671

SEQ ID NO: 59879 - RNA, 64 nt, Homo Sapiens; identical to SEQ ID NO: 24672

SEQ ID NO: 59880 - RNA, 64 nt, Homo Sapiens; identical to SEQ ID NO: 24673

SEQ ID NO: 59881 - RNA, 64 nt, Homo Sapiens; identical to SEQ ID NO: 24674

SEQ ID NO: 59882 - RNA, 64 nt, Homo Sapiens; identical to SEQ ID NO: 24675

SEQ ID NO: 59883 - RNA, 64 nt, Homo Sapiens; identical to SEQ ID NO: 24676

SEQ ID NO: 59884 - RNA, 64 nt, Homo Sapiens; identical to SEQ ID NO: 24677

SEQ ID NO: 59885 - RNA, 64 nt, Homo Sapiens; identical to SEQ ID NO: 24678

SEQ ID NO: 59886 - RNA, 64 nt, Homo Sapiens; identical to SEQ ID NO: 24679

SEQ ID NO: 59887 - RNA, 64 nt, Homo Sapiens; identical to SEQ ID NO: 24680

SEQ ID NO: 59888 - RNA, 64 nt, Homo Sapiens; identical to SEQ ID NO: 24681

SEQ ID NO: 59889 - RNA, 64 nt, Homo Sapiens; identical to SEQ ID NO: 24682

SEQ ID NO: 59890 - RNA, 64 nt, Homo Sapiens
agggucuguccccagaugcucagugugcauagaccauuuccaggucaagucuaaccagccucag

SEQ ID NO: 59891 - RNA, 64 nt, Homo Sapiens
ucuguagaguuuauugucaauugacacuuuugaacauuuccagugaaaacagccagaagccacc

SEQ ID NO: 59892 - RNA, 64 nt, Homo Sapiens
cauguaccauguuuuauaaaucaaguaucuaacucauuuccaaaaaucaguguguuuagacuuu

SEQ ID NO: 59893 - RNA, 64 nt, Homo Sapiens
cuugaaauauaggugugaacugcuugcaaauaugcauuuccaaacaugaauacuuuuguauugc

SEQ ID NO: 59894 - RNA, 64 nt, Homo Sapiens
auuaaaaaaaaaauccauuugguacuagguguuucauuuccagaaaaagacaagaggaagggca

SEQ ID NO: 59895 - RNA, 64 nt, Homo Sapiens
gaccacaugugagcuucuuuguccacagcuucagcauuuccagagacugaaaauaaugucuaca

SEQ ID NO: 59896 - RNA, 64 nt, Homo Sapiens
uuaguuuuucagaaaaugcaucccugauuucauucauuuccagcuugaaagccagccauauuac

SEQ ID NO: 59897 - RNA, 64 nt, Homo Sapiens
uuacucuagucccuaccaaacugcucuagaaggucauuuccauuuuguuugugauauuuagacg

SEQ ID NO: 59898 - RNA, 64 nt, Homo Sapiens
uccaccauggacucaaucugagaacaacagcauucauuuccauucauuuccauacuggcuuuug

SEQ ID NO: 59899 - RNA, 64 nt, Homo Sapiens
acucaaucugagaacaacagcauucauuuccauucauuuccauacuggcuuuugauuauaugca

SEQ ID NO: 59900 - RNA, 64 nt, Homo Sapiens
aguagcauaaacuuacgguggggcuacauuuguucauuuccagccucaacuuuucuuccuuaug

SEQ ID NO: 59901 - RNA, 64 nt, Homo Sapiens
ugcaaagugacuagagaaaaaauuucaauucuuacauuuccauuaucuugaggguagagccaca

SEQ ID NO: 59902 - RNA, 64 nt, Homo Sapiens
caucuucugaaaacuaggcgccugggcauugaggcauuuccauauccccugcagcaaacguuug

SEQ ID NO: 59903 - RNA, 64 nt, Homo Sapiens
uacugcugcagcauuuugguaaugcaaaauaacucauuuccaacaugugauugaacacuuuagu

SEQ ID NO: 59904 - RNA, 64 nt, Homo Sapiens
uuuaauguuuuuuucacuuaauauuuuauauauacauuuccauguauugauguaguuaguccac

SEQ ID NO: 59905 - RNA, 64 nt, Homo Sapiens
aaauguuuucauaggcuauuauauauucucgcagcauuuccaguuaagaggauauuagguauau

SEQ ID NO: 59906 - RNA, 64 nt, Homo Sapiens
agauguuacccaaacucaucuucuaaaaucugugcauuuccaugguggcugacacacuugucau

SEQ ID NO: 59907 - RNA, 64 nt, Homo Sapiens
cacaaagugagcauuucuuuuuaaauuuucuugacauuuccaagcuuauuaugaauaauauugc

SEQ ID NO: 59908 - RNA, 64 nt, Homo Sapiens
aacuccacuguuucuauaauauacaucacuaaaacauuuccacuuuccuuagauaucaguuagg

SEQ ID NO: 59909 - RNA, 64 nt, Homo Sapiens
ugccuuauugcuacuucaagucuauggaaaaugacauuuccauuaggagaaaagauaucacaac

SEQ ID NO: 59910 - RNA, 64 nt, Homo Sapiens
ccaccacaaaguugccacagcccucacuguagcccauuuccacccacaucccaacuucauuucc

SEQ ID NO: 59911 - RNA, 64 nt, Homo Sapiens
uuguucuguauaggaacagacagagcguccguagcauuuccagugaaacuggaagugcaugagg

SEQ ID NO: 59912 - RNA, 64 nt, Homo Sapiens
uaacuguuguguugaaucaguuucucacauuuuccauuuccaaacaccaaccagauucaugagc

SEQ ID NO: 59913 - RNA, 64 nt, Homo Sapiens
ugaaggagaggcaaggaaaacgaaaugagugugucauuuccacaaggcacugggcuuuaaagag

SEQ ID NO: 59914 - RNA, 64 nt, Homo Sapiens
cuccuaccugcgcagucuaaacauagcuguggaucauuuccaacuuucaacuucacuccgggcc

SEQ ID NO: 59915 - RNA, 64 nt, Homo Sapiens
agcgaggcugguuuccugugcagcagguggaguucauuuccaacccagagguccgugcacagaa

SEQ ID NO: 59916 - RNA, 64 nt, Homo Sapiens
aauggauaaaccaaggauuuuguguuuaacaauccauuuccagugucuucgccacauaaaauag

SEQ ID NO: 59917 - RNA, 64 nt, Homo Sapiens
uuuaaaaggauaguuuaugaguaaucuuuaaaaccauuuccauaccaucuguauauaaccauuu

SEQ ID NO: 59918 - RNA, 64 nt, Homo Sapiens
uuuagauccuacuccauacccacugcggccagcacauuuccacucugggauuccaggcgugagc

SEQ ID NO: 59919 - RNA, 64 nt, Homo Sapiens
uuauuuguuuguuuguuuauucauggccuuccuacauuuccacuaucccugugcuccuuaagcc

SEQ ID NO: 59920 - RNA, 64 nt, Homo Sapiens
ccagaaaaugggcagagagagaugaccucggaagcauuuccacagauggugucaggguuucaag

SEQ ID NO: 59921 - RNA, 64 nt, Homo Sapiens
cugccaacuguggucaaaguucauaggugucguacauuuccauuauuugcuaaaaucaugcaau

SEQ ID NO: 59922 - RNA, 64 nt, Homo Sapiens
uuacuaucaaauuauaguaaccuuguaccagaaacauuuccaauguagucuuugcaucagcuua

SEQ ID NO: 59923 - RNA, 64 nt, Homo Sapiens
accauggauucugccuuuggcagaagcaucguggcauuuccagaugagaaugcccagaaagugc

SEQ ID NO: 59924 - RNA, 64 nt, Homo Sapiens
uucauuuucgagccaucaguguauauggcugcuacauuuccauugaacagauccaaaguuagca

SEQ ID NO: 59925 - RNA, 64 nt, Homo Sapiens
aggaaagggaaagucaugauauauuuuauucuugcauuuccauaaagguucauuguuuaaugaa

SEQ ID NO: 59926 - RNA, 64 nt, Homo Sapiens
ucaucacuguuggagaucaucgugggggaggucccauuuccacuuuuugggcaaccuccuucga

SEQ ID NO: 59927 - RNA, 60 nt, Homo Sapiens
gaauucacaggagcaugguuaacaggcuuucauuuccacaaaagacuuggcaugaacuga

SEQ ID NO: 59928 - RNA, 64 nt, Homo Sapiens
ucaacucuaaaugaagucuugugacagguuaugacauuuccaugauaaguguucugaccaggga

SEQ ID NO: 59929 - RNA, 64 nt, Homo Sapiens
ucuuuucagugaucuggauaggaaaggacaaauacauuuccagacuuguauauacuuugccacu

SEQ ID NO: 59930 - RNA, 64 nt, Homo Sapiens
aaaucguccauucuuuuaaauguugucucacuugcauuuccagucuuggccaucaaaucaauga

SEQ ID NO: 59931 - RNA, 64 nt, Homo Sapiens
guacaaaguggcaucucauggugguuuuaauuugcauuuccauaauaucuaauuagguugagcu

SEQ ID NO: 59932 - RNA, 64 nt, Homo Sapiens
guguaggcaauuauguccugggugacucaccccucauuuccagaaaaaauuuaauuuugaaaaa

SEQ ID NO: 59933 - RNA, 64 nt, Homo Sapiens
aacguauuuauagcaugaagcuguuucuaccaaacauuuccagaaccgaaaaaagaaaagaaau

SEQ ID NO: 59934 - RNA, 64 nt, Homo Sapiens
ugcuugagccugggaggcagcucagguggcugaggcauaagaaucacgccuguaauaccagcua

SEQ ID NO: 59935 - RNA, 64 nt, Homo Sapiens
uguuugagcccgggagacagcuugggaggcugaggcauaagaaucgugccuguaaucccagcua

SEQ ID NO: 59936 - RNA, 64 nt, Homo Sapiens
agccugggggaaggagaaaggaggggagaaagcgggcucucacccccucaggagugggcacggg

SEQ ID NO: 59937 - RNA, 64 nt, Homo Sapiens
agugcugggauuacaggcgugagccacugcacccggcucucacuggucuuacgccaccuucugg

SEQ ID NO: 59938 - RNA, 64 nt, Homo Sapiens
cacccucccccgccacuccugaaccccgucgaggggcucucagcucagcgccagccugucccau

SEQ ID NO: 59939 - RNA, 64 nt, Homo Sapiens
gggaaccaugaagacaggaugggggcuggccucuggcucucaugggguccaaguuuuguguauu

SEQ ID NO: 59940 - RNA, 64 nt, Homo Sapiens
auucucuuccugcuucugcucugggccgguggguggcucucagaaaauacuugcugcuggcaaa

SEQ ID NO: 59941 - RNA, 64 nt, Homo Sapiens
uucuuuuccccucuaaccuaggacccucauuaccggcucucauagcacagucuacugcuuugua

SEQ ID NO: 59942 - RNA, 64 nt, Homo Sapiens
uucccuguuccuucugggucaggcugucacuuccggcucucagcccuaucuccugcaaccucag

SEQ ID NO: 59943 - RNA, 64 nt, Homo Sapiens
uuugccaaagguuuacuuccagcaucugagcucuggcucucaccccugaagcucaguuauagug

SEQ ID NO: 59944 - RNA, 64 nt, Homo Sapiens
aguuucuguuaugauugccauuuucuaacuagaaggcucucauaccuuaaaaaguaaacuuauu

SEQ ID NO: 59945 - RNA, 64 nt, Homo Sapiens
uauuguuuaacucacuaguuucuaaugguucacuggcucucaucuuagcauucuggaauucuca

SEQ ID NO: 59946 - RNA, 64 nt, Homo Sapiens
cuaggaaaggcgagcuggacucugucuccaugguggcucucaccccagggaccuaggaacagcc

SEQ ID NO: 59947 - RNA, 64 nt, Homo Sapiens
caucccaggacuccaaacagggaucugucucuuuggcucucagcucugcuuucauuugaguugg

SEQ ID NO: 59948 - RNA, 64 nt, Homo Sapiens
ccugccacaucugcacugcagcggaugaccaccaggcucucaucugggacauccagcaaaugcc

SEQ ID NO: 59949 - RNA, 64 nt, Homo Sapiens
ucccacuggcagcaugguagagcugagagaaacaggcucucaggguaccugacuugaggggaau

SEQ ID NO: 59950 - RNA, 64 nt, Homo Sapiens
gacccuucgacauccugcuuccuccagaacuucaggcucucaguuguccaauacauggcucugc

SEQ ID NO: 59951 - RNA, 64 nt, Homo Sapiens
gccccuucgccauccuagagcccccagaacuuaaggcucucacugguccaauacauggcucugc

SEQ ID NO: 59952 - RNA, 64 nt, Homo Sapiens
auuuccuaagagauacauugcacauuguguggauggcucucaccaguagacuccccuuuaaaug

SEQ ID NO: 59953 - RNA, 64 nt, Homo Sapiens
ccucuuagcuguccuugcuuccccaucaugaugaggcucucacccaagaugucagaauaagacu

SEQ ID NO: 59954 - RNA, 64 nt, Homo Sapiens
gccagccucagauacuucugugggcccugaagugggcucucaaggucagaccaagguugcugau

SEQ ID NO: 59955 - RNA, 64 nt, Homo Sapiens
aaagccaaaggugccaggccuuagagcagacaagggcucucagcccuggcaugcccccuaaagg

SEQ ID NO: 59956 - RNA, 64 nt, Homo Sapiens
ccuccaucccacucuuguuaugacuccacaguguccagacuaauuugugcaugaacugaaauaa

SEQ ID NO: 59957 - RNA, 64 nt, Homo Sapiens
ggugggggccauauccuagaccucucuguaucccccagacuaucuguaacagugccaggcacac

SEQ ID NO: 59958 - RNA, 64 nt, Homo Sapiens
ugccacccucucccuugccaaagaagaaacucuccccccaaauccuccaaccucuggggccaca

SEQ ID NO: 59959 - RNA, 64 nt, Homo Sapiens
cacagcccugccccuccaguuccuuggcaguucucccccaaaccaggucuguacagguguucuu

SEQ ID NO: 59960 - RNA, 64 nt, Homo Sapiens
cggugagggggcagaaggacucagcgccccuggacccccaaaugcugcaugaacacauuuucag

SEQ ID NO: 59961 - RNA, 64 nt, Homo Sapiens
agucuggguucugguguccacucacccaccccaccccccaaaaucagacaaaugcuacuuuguc

SEQ ID NO: 59962 - RNA, 64 nt, Homo Sapiens
ccucaugcagaccugggguccuccugggcccuggcccccaaaccucuuggcacccgguuguuac

SEQ ID NO: 59963 - RNA, 64 nt, Homo Sapiens
cuuggcacccgguuguuacccccuggcagcuucucccccaaacucuccuaccauguggcccugc

SEQ ID NO: 59964 - RNA, 64 nt, Homo Sapiens
aagaccugucuauggcucucguuccccagauaggcccccaaauaaaagagcccuggagcaucag

SEQ ID NO: 59965 - RNA, 64 nt, Homo Sapiens
ccuccguugaacauucuguaugacaucuccacugcccccaaagaaggagaucagaaaaucccuc

SEQ ID NO: 59966 - RNA, 64 nt, Homo Sapiens
ucgaagaauuuucuucuugccaaaugucgaccagcccccaaauguucaguggaacccuugcccc

SEQ ID NO: 59967 - RNA, 64 nt, Homo Sapiens
ucgaccagcccccaaauguccaguggaacccuugcccccaaaugcgugaauuugggggauuuuu

SEQ ID NO: 59968 - RNA, 64 nt, Homo Sapiens
agaccagugcagccagagagaccaccaaacagagcccccaaaagacagacaucucugcuagcug

SEQ ID NO: 59969 - RNA, 64 nt, Homo Sapiens
agucagacaugauccuccagauugacagacaagucccccaaaugaguacacaucuccagcuauu

SEQ ID NO: 59970 - RNA, 64 nt, Homo Sapiens
ggacaccaagcagaauucugcauggugacagucucccccaaacauggccugcugggcccaagug

SEQ ID NO: 59971 - RNA, 64 nt, Homo Sapiens
cccguuucucccucaaguuugaguauuucgggagcccccaaaacagccugagcaaaaagaccag

SEQ ID NO: 59972 - RNA, 64 nt, Homo Sapiens
gccugaagacuuaaguuuuguagaaccuuugagucccccaaacuauccaccaguuuuucuaagc

SEQ ID NO: 59973 - RNA, 64 nt, Homo Sapiens
aucacugcacaguccuacuaagugaaagcaucaucccccaaaggaaccuugacgaggauacaaa

SEQ ID NO: 59974 - RNA, 64 nt, Homo Sapiens
cugcucugaaaucuccuuuagccaucaccccaaccccccaaaauuaguuuguguuacuuaugga

SEQ ID NO: 59975 - RNA, 64 nt, Homo Sapiens
acucaaagaguauauguucccuccaggucagcugcccccaaacccccuccuuacgcuuugucac

SEQ ID NO: 59976 - RNA, 64 nt, Homo Sapiens
ccucaacgugcgaggauuccuggaccgcuacugccccccaaacugccccccgagcuucuucccc

SEQ ID NO: 59977 - RNA, 64 nt, Homo Sapiens
ucuagguagcaacagguaucgaggacucuccaaacccccaaagcagagagagggcugaucccau

SEQ ID NO: 59978 - RNA, 64 nt, Homo Sapiens
uccuuuaaaggagcaugcauauauuuucaucuuucccccaaaccccuggaccccugcccccaaa

SEQ ID NO: 59979 - RNA, 64 nt, Homo Sapiens
auuuucaucuuucccccaaagcccuggaccccugcccccaaaaugauuccaaaaauguuucuga

SEQ ID NO: 59980 - RNA, 64 nt, Homo Sapiens
uggagccaaagccucucacagugcugauuuaccucccccaaaaugcccccaaacccccaugcaa

SEQ ID NO: 59981 - RNA, 64 nt, Homo Sapiens
ccucucacagugcugauuuaccucccccaaaaugcccccaaacccccaugcaaguuuacagcca

SEQ ID NO: 59982 - RNA, 64 nt, Homo Sapiens
acacuugcucucucaauaugguggccaucuccaucccccaaagcgggcuugcagcagcagcagu

SEQ ID NO: 59983 - RNA, 64 nt, Homo Sapiens
guguccguucuuaauucccaaaaacacagccucucccccaaaggacuuuuuuaaaggggauuaa

SEQ ID NO: 59984 - RNA, 64 nt, Homo Sapiens
gacacccaccgucgucagggcccggcaccucacucccccaaaaugggaggagcagcuguguguc

SEQ ID NO: 59985 - RNA, 64 nt, Homo Sapiens
cagcccaugcuugaugccagcaacccagauccugcccccaaagccaagaagaucaagucucagc

SEQ ID NO: 59986 - RNA, 64 nt, Homo Sapiens
ucuuccgaggucucccugaaaugaauguauuucucccccaaaagagcugauauuuaauguuuua

SEQ ID NO: 59987 - RNA, 64 nt, Homo Sapiens
ccacucuaaauuccaaagccaucaaaaggagacacccccaaaucgaaacaugcacacugcaaau

SEQ ID NO: 59988 - RNA, 64 nt, Homo Sapiens
gucaaaugggcacaccacagcagaauggcaauaacccccaaaaggcaugcauugcucuuaaccg

SEQ ID NO: 59989 - RNA, 64 nt, Homo Sapiens
cguguucucuuuugucaggacucccuucuuccuccccccaaacauauugaggaaagucagucua

SEQ ID NO: 59990 - RNA, 64 nt, Homo Sapiens
uaaguauucuaugucaugguauggugcuuuuuuucccccaaaucaggaaaggaaaaucagguag

SEQ ID NO: 59991 - RNA, 64 nt, Homo Sapiens
aauucagaagcaucaccaugcaugguggcgaaugcccccaaacucucccccaaauguauuucuc

SEQ ID NO: 59992 - RNA, 64 nt, Homo Sapiens
ucaccaugcaugguggcgaaugcccccaaacucucccccaaauguauuucucccuucgcugggu

SEQ ID NO: 59993 - RNA, 64 nt, Homo Sapiens
gucuccacaugaagauguacgaaauagauggugccccccaaauuuggcaaagagcuugacccag

SEQ ID NO: 59994 - RNA, 64 nt, Homo Sapiens
uguguaaaacaguuucaucuucugagauuuuuuucccccaaauucuagcuuaacccuuugagac

SEQ ID NO: 59995 - RNA, 64 nt, Homo Sapiens
uacaaccuuuuccuuaaggucuuuuaccaccucccccccaaaaaaaucccccaaaacugauuca

SEQ ID NO: 59996 - RNA, 64 nt, Homo Sapiens
uuaaggucuuuuaccaccucccccccaaaaaaaucccccaaaacugauucagauuuucauacuu

SEQ ID NO: 59997 - RNA, 64 nt, Homo Sapiens
auagcucacaaggggagagcaucccacccaccuccccccaaaaaugauuggauaaauauuuccc

SEQ ID NO: 59998 - RNA, 64 nt, Homo Sapiens
cagugagcuccagauucuucuggcccuaucuugacccccaaaucaguccagggcagggaaauau

SEQ ID NO: 59999 - RNA, 64 nt, Homo Sapiens
uuuaaaugauagagguuuuugugggaaucaaaaucccccaaauguuaagguauaugguaaaaaa

SEQ ID NO: 60000 - RNA, 64 nt, Homo Sapiens
auaaacuuuguuuuaacauaauuaguacuguuuucccccaaaaguacaaguuuuugaguagcaa

SEQ ID NO: 60001 - RNA, 64 nt, Homo Sapiens
auggaaucccaaauccccagcguaacuccuaggacccccaaaucccccuagaagaccccaaugc

SEQ ID NO: 60002 - RNA, 64 nt, Homo Sapiens
aaaagaguaacagacauucaaaacauaggucacacccccaaagccccuuaaguccucuugaaau

SEQ ID NO: 60003 - RNA, 64 nt, Homo Sapiens
cagaccccaugucacccagauacucccauaauaacccccaaauagaggccccauuauuaacaga

SEQ ID NO: 60004 - RNA, 64 nt, Homo Sapiens
cccaucccuuccccaccuccccuaucccaacucacccccaaaccgcuuggcgcuccuccuccgu

SEQ ID NO: 60005 - RNA, 64 nt, Homo Sapiens
cacgacucacuuccacaccgacuuuucuccccaacccccaaaccgacccccggcccggcccgga

SEQ ID NO: 60006 - RNA, 64 nt, Homo Sapiens
ccagggaaggacuuggagagacagccuccagggccccccaaaucucucuauuggaggugagauc

SEQ ID NO: 60007 - RNA, 64 nt, Homo Sapiens
uagccccugccccggaggaauugcagggcuaaggcccccaaacagcaccccagcuaccccuucu

SEQ ID NO: 60008 - RNA, 64 nt, Homo Sapiens
acauauacaugagaacuuagacacaagggaccaucccccaaacucuacucuuauacccagaaaa

SEQ ID NO: 60009 - RNA, 64 nt, Homo Sapiens
cuacacaguaucaaaugaaugggucaauucagcacccccaaauuuaauucuguggggaaaaauu

SEQ ID NO: 60010 - RNA, 64 nt, Homo Sapiens
auucugacaaguuugguccaugauguugaauguucccccaaagcccacuuucuggggaucauuu

SEQ ID NO: 60011 - RNA, 64 nt, Homo Sapiens
guuguuucugaagcucgagugaugugaaauugagcccccaaaagguacuauucauugauucagu

SEQ ID NO: 60012 - RNA, 64 nt, Homo Sapiens
ggaguggaagagaggugugaagaaaccucuccgaacaaaugaaccagcaguaaguuucuaaaaa

SEQ ID NO: 60013 - RNA, 64 nt, Homo Sapiens
agccuuaguaaaguugugauugaagaaacuuaauacaaaugaacuagagguuuguaaucaugcc

SEQ ID NO: 60014 - RNA, 64 nt, Homo Sapiens
gaauagaaucccugccuacuuaaguaacuguuggacaaaugauauauauuucuucuaaggaaaa

SEQ ID NO: 60015 - RNA, 64 nt, Homo Sapiens
cuaaggaaaaaguuuauuauuuacucuuuacuagacaaaugaguagcauauagaagaaaguuaa

SEQ ID NO: 60016 - RNA, 64 nt, Homo Sapiens
augucuaagaggcauaugcugcauauguuagauaacaaaugaggaaucccugaaaccaugauug

SEQ ID NO: 60017 - RNA, 64 nt, Homo Sapiens
cccugugugacuuggaguuaauuacaaagcagugacaaaugaugaaaaauacuuauauauuucu

SEQ ID NO: 60018 - RNA, 64 nt, Homo Sapiens
auacuuaagugagcaaaaauuauuuaaaggaaucacaaaugaucagaggacugugcauuuuugc

SEQ ID NO: 60019 - RNA, 64 nt, Homo Sapiens
gcaugaggccauguuuauauaguaacauauacagacaaaugauucuugugcucaugcaacuuag

SEQ ID NO: 60020 - RNA, 64 nt, Homo Sapiens
auuuccacuugcaggccagcuuaaccucugaaacacaaaugaucuugagaccacuuuaguguac

SEQ ID NO: 60021 - RNA, 64 nt, Homo Sapiens
guaaaguuagauguugaaacccaguuuaucuuauacaaaugagccucugcuuguucuacaaagg

SEQ ID NO: 60022 - RNA, 64 nt, Homo Sapiens
uugugccagucucuaaguuggcaacuuuggcugaacaaaugaguaguggcuucaguguccuugc

SEQ ID NO: 60023 - RNA, 64 nt, Homo Sapiens
gaaaaacauucucacauagccucuauguaaucagacaaaugacauuugauuucaagagcagagg

SEQ ID NO: 60024 - RNA, 64 nt, Homo Sapiens
aaaugagaaagucucacaccaaaugaauaaauggacaaaugagucuggccucauuuuuuaaaac

SEQ ID NO: 60025 - RNA, 64 nt, Homo Sapiens
aaauggacaaaugaguaaauccucauuuuuuaaaacaaaugaaugcaugagucaccaugccugg

SEQ ID NO: 60026 - RNA, 64 nt, Homo Sapiens
ucacuuauuacaaagacaaacuucauagaugcauacaaaugagcaaacauuuugcuauacagua

SEQ ID NO: 60027 - RNA, 64 nt, Homo Sapiens
aacaauacucaacaguaauuuuacuguuaccugcacaaaugaaacuugauguauuccacuguua

SEQ ID NO: 60028 - RNA, 64 nt, Homo Sapiens
aaaaauguauguaaacauucaaaugauuaucugaacaaaugagauuuugugguguuuucuuuaa

SEQ ID NO: 60029 - RNA, 64 nt, Homo Sapiens
aaguaaauggagagguaaaagaaaggcauuggggacaaaugaaagagaugauguagauuuuucg

SEQ ID NO: 60030 - RNA, 64 nt, Homo Sapiens
guccaucagacagaucuggcuaagucaggguuugacaaaugacaggggcagauccugacuacac

SEQ ID NO: 60031 - RNA, 64 nt, Homo Sapiens
agcuccuugaguaucuagaaacauccaaaagcucacaaaugagagucagggcagccagcuguag

SEQ ID NO: 60032 - RNA, 64 nt, Homo Sapiens
uuuucaggugucauggacugcucuacgccacuccacaaaugaugaugcgacugcgaacacugaa

SEQ ID NO: 60033 - RNA, 64 nt, Homo Sapiens
uuuccacgcaguucuuuccacuggcaaaaaugcaacaaaugaauccugcuuugcaaacaucaac

SEQ ID NO: 60034 - RNA, 64 nt, Homo Sapiens
cugcuuugcaaauucaagagccuccccuggguuaacaaaugagccauccccagggcccaccccc

SEQ ID NO: 60035 - RNA, 64 nt, Homo Sapiens
acccaaagggcuuauugacucuuucuauuguuaaacaaaugauuuccacaaacagaucaggaag

SEQ ID NO: 60036 - RNA, 64 nt, Homo Sapiens
cuagaaacuucuuuaaagugccacauuuggcaguacaaaugagucugaguguaauagcccagag

SEQ ID NO: 60037 - RNA, 64 nt, Homo Sapiens
accuuaaaauuguauaaggcugaaugaacuucauacaaaugaaaaaaaucucauaaaaauacau

SEQ ID NO: 60038 - RNA, 64 nt, Homo Sapiens
acuuaucagggcccuagaaacuagaggucucccuacaaaugaaggagaauucagguucuaagga

SEQ ID NO: 60039 - RNA, 64 nt, Homo Sapiens
aguuuguucuuuugugaaaccaauccuaguuugcacaaaugaauaccuggcucugagaaacucg

SEQ ID NO: 60040 - RNA, 64 nt, Homo Sapiens
ucuaagauuuugugaauugguugaauaguucuauacaaaugaaguauggagguguguauguuua

SEQ ID NO: 60041 - RNA, 64 nt, Homo Sapiens
gugacucaaauuuuucacccauuuacacauauccacaaaugacugcaaaagugccacggauauc

SEQ ID NO: 60042 - RNA, 64 nt, Homo Sapiens
acaaacuaaaucauaaaauagcaauauugauaacacaaaugaccuuugaagugucauuuuuaug

SEQ ID NO: 60043 - RNA, 64 nt, Homo Sapiens
uauacuauuagauaagaauuaguacuuauaauauacaaaugaauucuauggaagaaaacccaau

SEQ ID NO: 60044 - RNA, 64 nt, Homo Sapiens
agucuagggaccaugaaugaauaggccagcugggacaaaugaauuuaaaaaaucagaaaaaugc

SEQ ID NO: 60045 - RNA, 64 nt, Homo Sapiens
agggcaauacaacugucacaucagaaacaagaaaacaaaugauaaaggaacucauuuaucaaua

SEQ ID NO: 60046 - RNA, 64 nt, Homo Sapiens
ccaagagagcugucaguuuucagcugucaguaacacaaaugaguuuaugguaacacaaaugagu

SEQ ID NO: 60047 - RNA, 64 nt, Homo Sapiens
cagcugucaguaacacaaaugaguuuaugguaacacaaaugaguuuugcuaucucucugagaag

SEQ ID NO: 60048 - RNA, 64 nt, Homo Sapiens
auugcuuaguuuucuuacuguuaaggagcguuguugaccauaauuuauguaguuauucuaaagu

SEQ ID NO: 60049 - RNA, 64 nt, Homo Sapiens
uugcaacauugucucauuaagaaaagauguugguugaccauaauuuaugcuugaaguauuuggu

SEQ ID NO: 60050 - RNA, 64 nt, Homo Sapiens
ugguuuaaaaaaagggucagacuuuuaaacacucugaccauagaaauguuuuucaaaauggcaa

SEQ ID NO: 60051 - RNA, 64 nt, Homo Sapiens
uguuaaauaaaaaaucaguaucauggaaaagauaugaccauaauuuagucuccucaagugaaaa

SEQ ID NO: 60052 - RNA, 64 nt, Homo Sapiens
cuuacaaugagaauuaagauuuuuaaacugaaguugaccauacagguugcauuagcccuaacug

SEQ ID NO: 60053 - RNA, 64 nt, Homo Sapiens
aauacuuguuucaacuuagagaacaguuaugaugugaccauagcauggcacaacuaaaaaucua

SEQ ID NO: 60054 - RNA, 64 nt, Homo Sapiens
cccuguuuuaaauuauaagaugucauccccuugugucagagacagaccccuuggcuuuugcuug

SEQ ID NO: 60055 - RNA, 64 nt, Homo Sapiens
aucccccagcacugauguuguuacugauucuccugucagagaucugggaggucuccacugagga

SEQ ID NO: 60056 - RNA, 64 nt, Homo Sapiens
ggugccccguguaggcaucgucggucgguuugccgucagagauggcgcaucucgcugcaucccc

SEQ ID NO: 60057 - RNA, 64 nt, Homo Sapiens
ugaucgucuuuccuuuguauuggagaaggacugggucagagaucuguuggagagagagaauaaa

SEQ ID NO: 60058 - RNA, 64 nt, Homo Sapiens
gcagaacugggguggauuuggguuggaagugagggucagagaggagucagagagaaucccuagu

SEQ ID NO: 60059 - RNA, 64 nt, Homo Sapiens
guggauuuggguuggaagugagggucagagaggagucagagagaaucccuagucuucaagcaga

SEQ ID NO: 60060 - RNA, 64 nt, Homo Sapiens
ccugggcuggccggcgccguacugccugcguugugucagagaauaggaaaagcagcuuuguuug

SEQ ID NO: 60061 - RNA, 64 nt, Homo Sapiens
gcucggguuugagcagggagcaggcagagcugcagucagagacauuagaaaaccagucugaauu

SEQ ID NO: 60062 - RNA, 64 nt, Homo Sapiens
cggcugccggaaaugcaagucagcugccgaaagugucagagauuaugugcaccuccccgaggug

SEQ ID NO: 60063 - RNA, 64 nt, Homo Sapiens
aaacucccagaggugucagacagcugccgaaagugucagagaugaggugcggcuuccagaggua

SEQ ID NO: 60064 - RNA, 64 nt, Homo Sapiens
aaacucccaaaggugccagagagcugcccaaagugucagagaugaggugcggcuuccagaggua

SEQ ID NO: 60065 - RNA, 64 nt, Homo Sapiens
aaacucccaaaggugccagagagcuccccaaggugucagagaugagguucgacucccagaggug

SEQ ID NO: 60066 - RNA, 64 nt, Homo Sapiens
cucauccuucaaggagcauaaaagauaccgugcuucuccacaucacucccuucccuuguuuuuu

SEQ ID NO: 60067 - RNA, 64 nt, Homo Sapiens
cuugauaaauucaaucaccaccagggagaguccuucuccacagguauuuaugccacuaccucca

SEQ ID NO: 60068 - RNA, 64 nt, Homo Sapiens
aggguguguguguguguguucauucugaaggugaucuccacaagcauugaguucccauguggau

SEQ ID NO: 60069 - RNA, 64 nt, Homo Sapiens
gaggcuaaaugucacccacgaaaaguuacauuccucuccacaauuuuuaaaauauuauuuuaac

SEQ ID NO: 60070 - RNA, 64 nt, Homo Sapiens
uuccauuuacagaguaugagggcucuccuaacccucuccacacacaucucuaguacuaccugaa

SEQ ID NO: 60071 - RNA, 64 nt, Homo Sapiens
augcaccauucuggguacagcuacuugcaggguaucuccacagcguggcuuucucacauucggu

SEQ ID NO: 60072 - RNA, 64 nt, Homo Sapiens
uguuguguuccuagggcuuccuacugacucuccuucuccacauuugagaaacauuucuguugcg

SEQ ID NO: 60073 - RNA, 64 nt, Homo Sapiens
aucuugggguguguccuaugaagauccuuucuggucuccacaguaggccagaguugggggcucu

SEQ ID NO: 60074 - RNA, 64 nt, Homo Sapiens
uccagucaaguaggaaucagugcagccuguaaguucuccacauugacacacacacacacacaca

SEQ ID NO: 60075 - RNA, 64 nt, Homo Sapiens
gacacagucuggugcccagaugauggaagggccuucuccacagggaguuuccagcuaagccuga

SEQ ID NO: 60076 - RNA, 64 nt, Homo Sapiens
cuccuccuccaguucugaugagaggaaaaaggcuucuccacaacgcuguguaacacacucaccg

SEQ ID NO: 60077 - RNA, 59 nt, Homo Sapiens
acccuggcucaggagguugaugccaugggaaccugaaccugaaacacuucaugguagua

SEQ ID NO: 60078 - RNA, 59 nt, Homo Sapiens
gcucaggagguugaugccaugggaaccugaaccugaaacacuucaugguaguaauuucc

SEQ ID NO: 60079 - RNA, 59 nt, Homo Sapiens
aaaugaguaagaacuggcaguguauaaaaaaccugaaaauguauguguuguuuaagaaa

SEQ ID NO: 60080 - RNA, 59 nt, Homo Sapiens
gccucuuuagcaaaagccuguuaauuugaaaccugaaauuucacuaaaggucaguuguu

SEQ ID NO: 60081 - RNA, 59 nt, Homo Sapiens
cugcuuggcauuugaguagcacaaaaacaaaccugaaaaaaaauauaaaaguaaaacaa

SEQ ID NO: 60082 - RNA, 59 nt, Homo Sapiens
aauuugaagcuauucuguaauuaaaauauaaccugaauucagcuugcagaauggaagcu

SEQ ID NO: 60083 - RNA, 59 nt, Homo Sapiens
acuuaaacguuaauuuuugugcaaaaacaaaccugaaaaauaugcuucggaaacugugc

SEQ ID NO: 60084 - RNA, 59 nt, Homo Sapiens
guaaauguuuguaaaggguucagugacuuaaccugaauuguuucuuuuuccacgguagu

SEQ ID NO: 60085 - RNA, 59 nt, Homo Sapiens
agguguuuucucuuggacaucccuaaauaaaccugaagcauguccuuauaggucacuac

SEQ ID NO: 60086 - RNA, 59 nt, Homo Sapiens
cucaccuccuuuucucucagugacucuggaaccugaaugcagcuuacaagacaagccug

SEQ ID NO: 60087 - RNA, 59 nt, Homo Sapiens
uuuaauugccuauuacuucucucaaagagaaccugaagucagaacacaugagcagggug

SEQ ID NO: 60088 - RNA, 59 nt, Homo Sapiens
cagagaacaauaguagucucaagaauggaaaccugaaugucugagggaaugggcuggua

SEQ ID NO: 60089 - RNA, 59 nt, Homo Sapiens
agcugauuucuuugauucccuagcugcaaaaccugaaauugaccacuaggugacagaau

SEQ ID NO: 60090 - RNA, 59 nt, Homo Sapiens
aaacauuuugccagacuuucuccaaaugaaaccugaaucaauuuuucuaaaucuagguu

SEQ ID NO: 60091 - RNA, 59 nt, Homo Sapiens
cagaagugcaauguauuuuucuccugugaaaccugaaucuacaaguuuuccugccaagc

SEQ ID NO: 60092 - RNA, 59 nt, Homo Sapiens
ugccacuuucaugcaguuugaaaccugaaaaccugaaaagcaaacguugacuucugggc

SEQ ID NO: 60093 - RNA, 59 nt, Homo Sapiens
ccugaaaaugccacuuucauuucugggcaaaccugaaaacaagcccagcaaacguugac

SEQ ID NO: 60094 - RNA, 59 nt, Homo Sapiens
ugaauuuaugcuugggaagccugaucccaaaccugaagggaagggacuuggaucuccuu

SEQ ID NO: 60095 - RNA, 59 nt, Homo Sapiens
aaucucuuagauguggaaauauuuuuucgaaccugaaaaugcagcugguagaauuucaa

SEQ ID NO: 60096 - RNA, 59 nt, Homo Sapiens
uaauaauacaagaacuguuucccccucaaaaccugaaccugaauuauuuguaaaaacug

SEQ ID NO: 60097 - RNA, 59 nt, Homo Sapiens
uacaagaacuguuucccccucaaaaccugaaccugaauuauuuguaaaaacugaaauuu

SEQ ID NO: 60098 - RNA, 59 nt, Homo Sapiens
gaugccauguagaauggaagcgacuugguaaccugaacuaccagcuaaaugccagugag

SEQ ID NO: 60099 - RNA, 59 nt, Homo Sapiens
uucagcauauuuguucuaaacaucacucaaaccugaaacgacaauguauuguaguccau

SEQ ID NO: 60100 - RNA, 59 nt, Homo Sapiens
ucaaacuauaaagcaaaaacauuuauuaaaaccugaauuaauccuuuuuggagggagga

SEQ ID NO: 60101 - RNA, 59 nt, Homo Sapiens
ccuuuuuggagggaggaguagagauauauaaccugaaaauacuuauucuuucuuaucga

SEQ ID NO: 60102 - RNA, 64 nt, Homo Sapiens
uuuggagaugugaaagccaaaagccccuggcagugguggggaauguugacugaguguucagcag

SEQ ID NO: 60103 - RNA, 64 nt, Homo Sapiens
aaaccccaaccaaaaaaaauaauaaggcaugauugguggggagggaauguguauuuaggggcau

SEQ ID NO: 60104 - RNA, 64 nt, Homo Sapiens
ccuccugggaugaggaagacaaccccuugugucugguggggaucgcgagagccucggaccuccc

SEQ ID NO: 60105 - RNA, 64 nt, Homo Sapiens
uggcgguccugccgcaugcaccagcccugccugagguggggagcugugacucguggcgcaugcc

SEQ ID NO: 60106 - RNA, 64 nt, Homo Sapiens
gaaggaacaugaucccuccaguuugaggacgggggguggggaagggggugggggagcaucugcu

SEQ ID NO: 60107 - RNA, 64 nt, Homo Sapiens
ugccugcagagaggccugccacccucauuccucugguggggagcaggaagugggggcuacccau

SEQ ID NO: 60108 - RNA, 64 nt, Homo Sapiens
cuguacugagauggaacugugggagggaagaugagguggggagucccaggcucaggaacugcca

SEQ ID NO: 60109 - RNA, 64 nt, Homo Sapiens
gguacgaguccacuguugcuugaacuacuugggagguggggagggcacaucccaccccaucccc

SEQ ID NO: 60110 - RNA, 64 nt, Homo Sapiens
agagagagccacggagaggaaaagcagaugcagggguggggagcgcagcucggcggaggcugcg

SEQ ID NO: 60111 - RNA, 64 nt, Homo Sapiens
cucugacaugacuuauguguguguguguuuuugggguggggagggagggagagaagagggggcu

SEQ ID NO: 60112 - RNA, 64 nt, Homo Sapiens
cacaagaaaauaaucccacauauacaaggucagggguggggaagaguauuaaugguaucuuaau

SEQ ID NO: 60113 - RNA, 64 nt, Homo Sapiens
caccgcuggccauuacacagguuuuguuguuugggguggggagggggcuuuuguucccuuuuga

SEQ ID NO: 60114 - RNA, 64 nt, Homo Sapiens
ccagcauccuccauaucaaagacccuaagaaucagguggggaaggaggugaucugccaggugcu

SEQ ID NO: 60115 - RNA, 64 nt, Homo Sapiens
gcacugagcucacagacugacuugggcuccuacugguggggaccucuguuagucacuuuaccuc

SEQ ID NO: 60116 - RNA, 64 nt, Homo Sapiens
uccgaggcccuggggaucaaaggucaaugaguuagguggggagaaagaucccugggggcuccug

SEQ ID NO: 60117 - RNA, 64 nt, Homo Sapiens
gggaagguuugcagagagaggaagaagagggcaggguggggaggagcucugggccagaggaugc

SEQ ID NO: 60118 - RNA, 64 nt, Homo Sapiens
ugccgguggccugagccagggugcuggggcugcggguggggaaaggaggccccagcacuucaga

SEQ ID NO: 60119 - RNA, 64 nt, Homo Sapiens
uagagcuucuccgaaugacaaucagcucgugccagguggggaccaggauaugacuccuggugcc

SEQ ID NO: 60120 - RNA, 64 nt, Homo Sapiens
ucugaacuccagggaccagcccuggugggcaugggguggggagcagggaguugcccuuccccuc

SEQ ID NO: 60121 - RNA, 64 nt, Homo Sapiens
acaauuggcccagcacccuggggcacgggagaaggguggggaccguugcugucacuacucaggc

SEQ ID NO: 60122 - RNA, 64 nt, Homo Sapiens
uaaaagaugugauuuaucuggggggcucagguaugguggggaaguggauucaggaaucugggga

SEQ ID NO: 60123 - RNA, 64 nt, Homo Sapiens
uuauagauguugcugggaucguguccagggugccgguggggaugggaguuuggcuaacaguccu

SEQ ID NO: 60124 - RNA, 64 nt, Homo Sapiens
gcugcagagaagaggccuggcuucuggagcauuugguggggacaugaggagcaucacagggcuc

SEQ ID NO: 60125 - RNA, 64 nt, Homo Sapiens
ccauggcucagaggaaggguaccccacagacacugguggggagagcucuguauggaggcugcuc

SEQ ID NO: 60126 - RNA, 64 nt, Homo Sapiens
uucucccagaguggccccagccacuuaagcaugggguggggagcgaagucuacuugaucugagg

SEQ ID NO: 60127 - RNA, 64 nt, Homo Sapiens
acgcccccuaucgccaccugccagccagcagggugguggggacuccugagcccagccugggggc

SEQ ID NO: 60128 - RNA, 64 nt, Homo Sapiens
uugugcacaugcgugugggaagggguugcuaggggguggggacggcuaaccaggguaagaaugu

SEQ ID NO: 60129 - RNA, 64 nt, Homo Sapiens
ggugucuugcccuggggggcuuggaaccucugaagguggggagcggaacaccuggcauccuucc

SEQ ID NO: 60130 - RNA, 64 nt, Homo Sapiens
cccagcacuugcauuaccgucccugcucuucccagguggggacaguggcccaagcaaggccuca

SEQ ID NO: 60131 - RNA, 64 nt, Homo Sapiens
agaggaggauuggugguagggggcaggcagaggggguggggagaaguuuccugggcuccaucaa

SEQ ID NO: 60132 - RNA, 64 nt, Homo Sapiens
gcacuugauuguguggggaaacaaaggugggagggguggggaauacuggaaauaaucagggcaa

SEQ ID NO: 60133 - RNA, 64 nt, Homo Sapiens
cagaccuggacacuagggucaggcggggugcugugguggggagaggcauggcuggggugggggu

SEQ ID NO: 60134 - RNA, 64 nt, Homo Sapiens
gugcugugguggggagaggcauggcugggguggggguggggagaccugguuggccgugguccag

SEQ ID NO: 60135 - RNA, 64 nt, Homo Sapiens
auguacuccguaucaaauaagggaguaggggguagguggggaagauaaguaauagcagccauuu

SEQ ID NO: 60136 - RNA, 64 nt, Homo Sapiens
agguugcuacugugcaaugcguugucaaaacugggguggggaaagaugucuggagacauguugg

SEQ ID NO: 60137 - RNA, 64 nt, Homo Sapiens
cagggcuggaccgacguccugguuaugggguggggguggggacucuguuacacgcaugaauggg

SEQ ID NO: 60138 - RNA, 64 nt, Homo Sapiens
auggacaggcccuggucacugccuggggccucuggguggggaccgggcacuguggggagugcau

SEQ ID NO: 60139 - RNA, 64 nt, Homo Sapiens
uccacugggugaagccagcugggcuccugagucugguggggacuuggagaaccuuuaugucuag

SEQ ID NO: 60140 - RNA, 64 nt, Homo Sapiens
augcaccaauccacacucuguaucuggcuacucugguggggacuuggagaaccuuuguguccac

SEQ ID NO: 60141 - RNA, 64 nt, Homo Sapiens
cccccaguacccucccuacacaagacuaggccaggguggggaccacccaguccugcuucagagc

SEQ ID NO: 60142 - RNA, 64 nt, Homo Sapiens
gugccgugcucucagcagaccaguuccuaggugugguggggaauccccucccaccuuuguagug

SEQ ID NO: 60143 - RNA, 64 nt, Homo Sapiens
caguccacuggggagugcuggaauggggaccugggguggggaggcagagggucacuuuacauag

SEQ ID NO: 60144 - RNA, 64 nt, Homo Sapiens
gaggcagaaccugguggcuggaggcauucccagagguggggaagagagccugcccggccggaga

SEQ ID NO: 60145 - RNA, 64 nt, Homo Sapiens
uuuauucuucggaggagguggacauuucggaagugguggggacuaagggaagaacucucuaguu

SEQ ID NO: 60146 - RNA, 64 nt, Homo Sapiens
uuaaucuggggaagaacagagccagggaaagaaugguggggaccccuguacuugggggagacac

SEQ ID NO: 60147 - RNA, 64 nt, Homo Sapiens
uggugauggagcagagucugggggaagggucguggguggggaauuuaucaccaacauccauugu

SEQ ID NO: 60148 - RNA, 64 nt, Homo Sapiens
aggcuccccccaugcuccugguuucugcuuaggagguggggacuugggcugggauggggacggc

SEQ ID NO: 60149 - RNA, 64 nt, Homo Sapiens
gguaagcaggaggccaggggguccccagggcugagguggggagccuucuacggcgaaagccugc

SEQ ID NO: 60150 - RNA, 64 nt, Homo Sapiens
cuccacugcgcgccucucccaggucucagcucuggguggggagcaguggccgcuaccgacagcg

SEQ ID NO: 60151 - RNA, 64 nt, Homo Sapiens
cugugccuugcuagcugaccuggagaugcugccugguggggaucagacagagauuggagagaag

SEQ ID NO: 60152 - RNA, 64 nt, Homo Sapiens
gagaccugagucugcaugugcacgguggcgagaagguggggaucgugggccgcacuggggcugg

SEQ ID NO: 60153 - RNA, 64 nt, Homo Sapiens
gaacaucacagagcagccagagagcuggaggggagguggggagaccggcccugccaccaaguug

SEQ ID NO: 60154 - RNA, 64 nt, Homo Sapiens
auugcuugaaccugggagguacuuuggaggcugagguggggagagcaugccuguaaucccagcu

SEQ ID NO: 60155 - RNA, 64 nt, Homo Sapiens
gacaugcaugugagggauggcccugggaaggagggguggggaacaacgcuggagccaagagaag

SEQ ID NO: 60156 - RNA, 64 nt, Homo Sapiens
cccucacccccccaccaccccuucccauuucaucgguggggacguggagaggguggggcgggcu

SEQ ID NO: 60157 - RNA, 64 nt, Homo Sapiens
agcuuaugaggaagugaggagguggcgucacaaggguggggagggggccuuggggaagggcggc

SEQ ID NO: 60158 - RNA, 64 nt, Homo Sapiens
gaaaccaucugauuggcuuucugagguuuggcuggguggggacugcucauuuggccacucugca

SEQ ID NO: 60159 - RNA, 64 nt, Homo Sapiens
cauuuuguucagaaccaugcugggcuagcuaaaggguggggagagggaagaugggccccaccac

SEQ ID NO: 60160 - RNA, 64 nt, Homo Sapiens
ccgaccccaucugccuccuuaagccacaguccuugguggggaacucuaagggggacggagucag

SEQ ID NO: 60161 - RNA, 64 nt, Homo Sapiens
uucccagccucugcugacagcaccucagcuaccagguggggaguggaaauucagccugcuuaga

SEQ ID NO: 60162 - RNA, 64 nt, Homo Sapiens
agaggcagauucaauuuucuucgaaguaauuuuggguggggagaugacuacagacauuaaauaa

SEQ ID NO: 60163 - RNA, 64 nt, Homo Sapiens
ggugcucugcuggucuucaaacuuuuacggggcggguggggaggaaucccuguucauuguaagc

SEQ ID NO: 60164 - RNA, 64 nt, Homo Sapiens
uuuuguuggcuuguuugccaugaagguagauguggguggggagaagacacaaggcaguuuguuc

SEQ ID NO: 60165 - RNA, 64 nt, Homo Sapiens
ucuuguuaaaccggagugaaaacuucaggggaaggguggggagucagccaagugccucagugug

SEQ ID NO: 60166 - RNA, 64 nt, Homo Sapiens
guggcgacgucccugaggggccagucuccucacugguggggaacgcaagagaaucugcguagau

SEQ ID NO: 60167 - RNA, 64 nt, Homo Sapiens
cucuuuucgaaaugccccucugagucaggagccugguggggacaagauggaggauguccacaga

SEQ ID NO: 60168 - RNA, 64 nt, Homo Sapiens
aagcagccuuucccgucccccagcccccagccuugguggggacccacugggccagcagcccccc

SEQ ID NO: 60169 - RNA, 64 nt, Homo Sapiens
agcccuaggcagguccugguugccacucaucugggguggggagcuccccugcagggccuuuucc

SEQ ID NO: 60170 - RNA, 64 nt, Homo Sapiens
gggcucacaugggcccaggcacccccgaccccuggguggggaaggacccccaccucccacccug

SEQ ID NO: 60171 - RNA, 64 nt, Homo Sapiens
agcaugaagcagugagcagagaagaagcucagaggguggggagacaugguccuggggcagcaag

SEQ ID NO: 60172 - RNA, 64 nt, Homo Sapiens
uuacuaauuguaugauaguguuuuuauauggaagaauguacagcuuauggacaaauguacaccu

SEQ ID NO: 60173 - RNA, 64 nt, Homo Sapiens
guuuuuauauggaagaauguacagcuuauggacaaauguacaccuuuuuguuacuuuaauaaaa

SEQ ID NO: 60174 - RNA, 64 nt, Homo Sapiens
cagauuccugucccuuugccaaacaggagcaggaaauguacacaccugaggauggugguuaagg

SEQ ID NO: 60175 - RNA, 64 nt, Homo Sapiens
agcccuuaagguaagagaugaauugcuucucugaaauguacaugagaauaaguauagcuagaga

SEQ ID NO: 60176 - RNA, 64 nt, Homo Sapiens
gaaaaccccuaaaaauccccgaccaggcucuaugaauguacaugucuaugaauguacauggaau

SEQ ID NO: 60177 - RNA, 64 nt, Homo Sapiens
gaaugaccaggcucuaugaagaccaggcucuaugaauguacaugaacaaggacuccucgcugcu

SEQ ID NO: 60178 - RNA, 64 nt, Homo Sapiens
ugaagggcuuggucuucccugagagcugggaucuaauguacaagcuuccauaauggaugggaca

SEQ ID NO: 60179 - RNA, 64 nt, Homo Sapiens
uaaagaguacuuuaacgccccauaaaaagguagcaauguacagaagucauguaaauaaaauaga

SEQ ID NO: 60180 - RNA, 64 nt, Homo Sapiens
gaaaucuggacagugcuccauugugcuuuucaaaaauguacacgagugcaauuaauacaaguua

SEQ ID NO: 60181 - RNA, 64 nt, Homo Sapiens
uuucugucuugcgugauuuguauucuguacuuuuaauguacauauauguauaucuucuagccuu

SEQ ID NO: 60182 - RNA, 64 nt, Homo Sapiens
uuguuguuuguuucauaaaguauaauuugcaauaaauguacauauuccccucauuuuaguuuaa

SEQ ID NO: 60183 - RNA, 64 nt, Homo Sapiens
agaaacucuugagagagaggaguccucugauggaaauguacagcuuccuuuucacaugaccaca

SEQ ID NO: 60184 - RNA, 64 nt, Homo Sapiens
aauacaaaaaacaaaaacaaaaaaaaaagaggguaauguacaaguuucuguauguauaaaguca

SEQ ID NO: 60185 - RNA, 64 nt, Homo Sapiens
auaaaaucuuuauauguuccacauguuaagaauaaauguacauuaaaucuuguuaagcacugug

SEQ ID NO: 60186 - RNA, 64 nt, Homo Sapiens
aauaaaaacguugccccauuaaaauuuguauguaaauguacagacaucuguuguaccuuugggg

SEQ ID NO: 60187 - RNA, 64 nt, Homo Sapiens
aauuuggcuuuugcuagaguuuuagacggagugaaauguacauggagcguuuccgggacugcau

SEQ ID NO: 60188 - RNA, 64 nt, Homo Sapiens
auguagcugugaaggccauuaaaaagacaaacuuaauguacagagcauuuauucagaucaagua

SEQ ID NO: 60189 - RNA, 64 nt, Homo Sapiens
cuguauuuagauauuuuauuucuggaaaaaaugaaauguacauaaaaauaaaacacuuaaaguu

SEQ ID NO: 60190 - RNA, 64 nt, Homo Sapiens
agucuggcuaggaaaccagaucugggguaaagucaauguacacuuccuccuuauuggaauauuu

SEQ ID NO: 60191 - RNA, 64 nt, Homo Sapiens
uaaacuaaaacuaguauaauuuagucuuuucaugaauguacauacauaaaauuauacauaaaaa

SEQ ID NO: 60192 - RNA, 64 nt, Homo Sapiens
aaugagcaggaaaaggcacauacucaguuuuuuaaauguacaaucaacaaguaaaaauaaccuc

SEQ ID NO: 60193 - RNA, 64 nt, Homo Sapiens
gaagccuuuuaaaaaaugacuuacacauauucucaauguacaguaaaacagacagaagugagcu

SEQ ID NO: 60194 - RNA, 64 nt, Homo Sapiens
acgcuauuaaguggcuuagacccuugucauuuuuaauguacaaaaaaggcuacuuguauaauaa

SEQ ID NO: 60195 - RNA, 64 nt, Homo Sapiens
ugaagaugauuauugugaaaaauguacuaaauaaaauguacauccugaauacugaaaacuguga

SEQ ID NO: 60196 - RNA, 64 nt, Homo Sapiens
ugcauuuccaaacugccuuaauggacguuguagaaauguacaaaucuuauuuucaagagaauuu

SEQ ID NO: 60197 - RNA, 64 nt, Homo Sapiens
guauuuuauagaauugaaguuagaacagucuuaaaauguacaguauugugaagugugcuauauu

SEQ ID NO: 60198 - RNA, 64 nt, Homo Sapiens
gcaaaauaaguacuaaauucauuaucguuaagcaaauguacaauaugcucaggcaccgcagaga

SEQ ID NO: 60199 - RNA, 64 nt, Homo Sapiens
uuuuuuggucucuuuuucuuauauucaaguuacaaauguacaaguauccuuacuaagagugcuc

SEQ ID NO: 60200 - RNA, 64 nt, Homo Sapiens
uuuggcucuacuccuugguucacuuuucugcugaaauguacaugccgcuucgcuuucuguuuau

SEQ ID NO: 60201 - RNA, 64 nt, Homo Sapiens
ccuaacugcauuuguuuugagguucuuuugggguaauguacacauggcagcuuuaauagccaug

SEQ ID NO: 60202 - RNA, 64 nt, Homo Sapiens
uaguuauaggccacuguuuuuaaggugcacaguaaauguacagacacugucaaauucuuuuccu

SEQ ID NO: 60203 - RNA, 64 nt, Homo Sapiens
aauaaaauauuagauuuauaauugaaucauauuaaauguacagauacaugagacugcagauuau

SEQ ID NO: 60204 - RNA, 64 nt, Homo Sapiens
gaugauauuaucacuuguugauuuaauguacaaaaauguacaugagcuuacuucuuucuccuaa

SEQ ID NO: 60205 - RNA, 64 nt, Homo Sapiens
aauguacauggaugauauuauuucuccuaaauuuaauguacaaagcaauuccauagcuuacuuc

SEQ ID NO: 60206 - RNA, 64 nt, Homo Sapiens
ccugaggcaucagaacuuuggggcaguuuaaaugaauguacauuuacaaccucagugugucauu

SEQ ID NO: 60207 - RNA, 64 nt, Homo Sapiens
uguacgucugucaucauuguguacauuuuguccaaauguacaucuuacauuucuuuguacaucu

SEQ ID NO: 60208 - RNA, 64 nt, Homo Sapiens
uuauucuaaauauuuucauuuuuauuugucaucaaauguacaacuuaaauuguuuuaauaguga

SEQ ID NO: 60209 - RNA, 64 nt, Homo Sapiens
ugggauugugaagauuuacuuccaugaauguuaaaauguacaggcaaagcaucaccauuacaag

SEQ ID NO: 60210 - RNA, 64 nt, Homo Sapiens
uuuuucuuugggguggaucugaugccauugauauaucuaaaaugugggauaaaacuucuuuaau

SEQ ID NO: 60211 - RNA, 64 nt, Homo Sapiens
cagacuuguaaauagaacuauuucaauguaguuaaucuaaaaacaaaaaagaaaaccccaguca

SEQ ID NO: 60212 - RNA, 64 nt, Homo Sapiens
ccuuguccuuguuaagaauuucuugaagugauuuaucuaaaauaaagguuggcaaacuuuuucu

SEQ ID NO: 60213 - RNA, 64 nt, Homo Sapiens
auuuggccccugggcuguaguuugcugaccccucaucuaaaaaauaggcuauacuacaauugca

SEQ ID NO: 60214 - RNA, 64 nt, Homo Sapiens
accugucuuucacuuuuugagacagacugaauauaucuaaaauuuccagcaauaaaaaaaaaag

SEQ ID NO: 60215 - RNA, 64 nt, Homo Sapiens
uuuucacuugguuagcuaaagaagauguaaaaauaucuaaaauaauguucauggugaaucuuau

SEQ ID NO: 60216 - RNA, 64 nt, Homo Sapiens
guuaauagugcguaccucuauucuggaaguuuauaucuaaaaauaaauaaaacuggaaaaaaau

SEQ ID NO: 60217 - RNA, 64 nt, Homo Sapiens
cacaauauggaagaaguauuaggucugccaaucuaucuaaaagcacagggaagggguuggggac

SEQ ID NO: 60218 - RNA, 64 nt, Homo Sapiens
aaauaaauagaaaacaccagaguaaaaugcugacaucuaaaacugaagugagaggaccaaguau

SEQ ID NO: 60219 - RNA, 64 nt, Homo Sapiens
uaagcaaaguagucauuaaagagacauuugcacaaucuaaaaugcauuccugcaagcauugauu

SEQ ID NO: 60220 - RNA, 64 nt, Homo Sapiens
augaacuguauuuuaaauuuguuaggucugaagaaucuaaaacuguuaauuuaacccuuaacuu

SEQ ID NO: 60221 - RNA, 64 nt, Homo Sapiens
uugaaugcuuuaaaauguucugucuguagguaacaucuaaaacacaaguggguuuauuuaaauu

SEQ ID NO: 60222 - RNA, 64 nt, Homo Sapiens
aaaaucauguauacccucacccaucuaaguugauaucuaaaauuuuaucuaaguugguaucuaa

SEQ ID NO: 60223 - RNA, 64 nt, Homo Sapiens
cuaaguugauaucuaaaauuuuaucuaaguugguaucuaaaauuuuucaugggaaguuaaauag

SEQ ID NO: 60224 - RNA, 64 nt, Homo Sapiens
aguuaaauacuuagaauguuuuagaguuuuuucuaucuaaaauuguggcaauuccauacauauu

SEQ ID NO: 60225 - RNA, 64 nt, Homo Sapiens
uaccacaaaaauacauccccuguccuucuugagaaucuaaaacauaaaucaaucuaugcuguuc

SEQ ID NO: 60226 - RNA, 64 nt, Homo Sapiens
uacuauaacaaccguguuuuuaaucuucgcugaaaucuaaaauaccaaauuuuaaguuucuaaa

SEQ ID NO: 60227 - RNA, 64 nt, Homo Sapiens
aaggaaauguuaucaaaagaguacugaaaucauuaucuaaaauacuagcaauaaagucuccuug

SEQ ID NO: 60228 - RNA, 64 nt, Homo Sapiens
gcauggaagaucauuuauuaggucauggucaugcaucuaaaagugggaaaucaaaucaguaacu

SEQ ID NO: 60229 - RNA, 64 nt, Homo Sapiens
cucaccaaaauauaguuaaugaaugugcuuuuccaucuaaaauauuauuucuaacuauuaggag

SEQ ID NO: 60230 - RNA, 64 nt, Homo Sapiens
uaacugugcacuauaagggauagugauacacuguaucuaaaaaaugguggccgcaaccacuugc

SEQ ID NO: 60231 - RNA, 64 nt, Homo Sapiens
uaaagaucuaaauacaaaggauauacagucuugaaucuaaaauaauuugcuaacuaacuauuuu

SEQ ID NO: 60232 - RNA, 64 nt, Homo Sapiens
uauuuugauucuucagagagaacuacuaauaaaaaucuaaaagguaugucuuggugugauaacu

SEQ ID NO: 60233 - RNA, 64 nt, Homo Sapiens
uguuuauaguguucauguaaaaaaaagacaaaauaucuaaaaaauguuacuauuauuccuuuga

SEQ ID NO: 60234 - RNA, 64 nt, Homo Sapiens
cugcuucagggcugggcgcgggacaugcaaucuuaucuaaaagcucuucccucaaaauuuucau

SEQ ID NO: 60235 - RNA, 64 nt, Homo Sapiens
agaagcuccuucuguuggaaguugaguaccugugaucuaaaauguccuggaggcagaugacauc

SEQ ID NO: 60236 - RNA, 64 nt, Homo Sapiens
accugugaucuaaaauguccuggaggcagaugacaucuaaaauaugugcuuuccaaccagcaca

SEQ ID NO: 60237 - RNA, 64 nt, Homo Sapiens
uauaguugaauuucuuuaaaaaguuuucuauuuuaucuaaaaucuuuccauuauaucuaaauua

SEQ ID NO: 60238 - RNA, 64 nt, Homo Sapiens
aaacuggacuuagcuugaguuaaaggcaaagaaaaucuaaaaacauaaauguuauauuucacaa

SEQ ID NO: 60239 - RNA, 64 nt, Homo Sapiens
uauacaaaaauaaaaagugguuacauuuucacucaucuaaaaagauagcaucuuuaggauauau

SEQ ID NO: 60240 - RNA, 64 nt, Homo Sapiens
ggauuuaguucaguuuagcuuuuuaauuuagcauaucuaaaauauuaucauacuaaaguuguuc

SEQ ID NO: 60241 - RNA, 64 nt, Homo Sapiens
aacaucgagaaacuaugggaaaaaaaauugcaaaaucuaaaauaaaaaaugcaaaaucuaaaau

SEQ ID NO: 60242 - RNA, 64 nt, Homo Sapiens
aaaaaauugcaaaaucuaaaauaaaaaaugcaaaaucuaaaauaaaaaauggaaaggaaacuuu

SEQ ID NO: 60243 - RNA, 64 nt, Homo Sapiens
ucuauuuaucuuauaucguagaucugauaacccuaucuaaaagaaagucacacgcuaaauguau

SEQ ID NO: 60244 - RNA, 64 nt, Homo Sapiens
guaauuuuauagaauaauucugggauuugagaggaucuaaaacuauuuuucuguauaaauauua

SEQ ID NO: 60245 - RNA, 64 nt, Homo Sapiens
aggccaccaaauuuaaaaaaugaagaucacugucaucuaaaagcggagacaggugcagaugagg

SEQ ID NO: 60246 - RNA, 64 nt, Homo Sapiens
cagccacugucagcaaagccugaagguaacaaucaucuaaaagccugagcucaggagagcaaga

SEQ ID NO: 60247 - RNA, 64 nt, Homo Sapiens
aaauaugcaauauauguucauaucuaugggaaaaaucuaaaaugugugccagaugcccuguugg

SEQ ID NO: 60248 - RNA, 64 nt, Homo Sapiens
augcuuaagcuuuggggaauuuuuuuuuaaggggaucuaaaaaaauguuuuuagaacauguaaa

SEQ ID NO: 60249 - RNA, 64 nt, Homo Sapiens
ggaauuuaucccaggaauucaagguugguucaacaucuaaaaaucaaauaagcuaauauacagu

SEQ ID NO: 60250 - RNA, 64 nt, Homo Sapiens
agcaguuagguuaggaauucaagguuuguucaacaucuaaaaaucaaauaagcuaauaaagaaa

SEQ ID NO: 60251 - RNA, 64 nt, Homo Sapiens
uuaguggcuuuugcuugggauguguggacuucucaucuaaaaggaauccucccuaacaauucgu

SEQ ID NO: 60252 - RNA, 64 nt, Homo Sapiens
guaagguauuaggcccuuuuuugagcuauuuuucaucuaaaagauucuugcauguugaagauau

SEQ ID NO: 60253 - RNA, 64 nt, Homo Sapiens
gcuccuacuuuaaguaccuuaccagcgaauuuaaaucuaaaaauaaauguguaaucuaaaauau

SEQ ID NO: 60254 - RNA, 64 nt, Homo Sapiens
uaccagcgaauuuaaaucuaaaugaaaauguguaaucuaaaauauuuauccuaggugauuuuua

SEQ ID NO: 60255 - RNA, 64 nt, Homo Sapiens
auacauguuuauguaaacaaccccuugauuuuccaucuaaaaauggaccagggagaugccacua

SEQ ID NO: 60256 - RNA, 64 nt, Homo Sapiens
aacuguaauuauuugaaugauuugaaacuuugagaucuaaaaauagggaaauugagcugcuuuu

SEQ ID NO: 60257 - RNA, 60 nt, Homo Sapiens
acagcccuauggaauuugcaaucugugauugccuuguaaaaaggagagugcauauggcac

SEQ ID NO: 60258 - RNA, 60 nt, Homo Sapiens
caagugcaauguauaugaaaaccaaucugagccuuguaucucuuaaauauuuauuuuuuu

SEQ ID NO: 60259 - RNA, 60 nt, Homo Sapiens
uuuuucuaucuuuccaaaauugaccacuuugccuuguagcuauuuucaguucuuaugcug

SEQ ID NO: 60260 - RNA, 60 nt, Homo Sapiens
ccuuuucugagcacaagucuauauaaggcugccuuguaccaucccaccaucuuaccugga

SEQ ID NO: 60261 - RNA, 64 nt, Homo Sapiens
uaaagauuugacauucaacuguaguauccauauguugcuuaaauuuccuuaugagccccaugau

SEQ ID NO: 60262 - RNA, 64 nt, Homo Sapiens
gauuaucagguucuguuaaauuguuacauguaucuugcuuaaauuucuguuuauuaauuuauau

SEQ ID NO: 60263 - RNA, 64 nt, Homo Sapiens
ccucuuuuuggaauuuuuaaauaaauacgugaaauugcuuaaaaucuucuauauacauuuuaua

SEQ ID NO: 60264 - RNA, 64 nt, Homo Sapiens
ccacuuaugcaucagucauucuuucucccugguuuugcuuaauuugagcauugccccagccaca

SEQ ID NO: 60265 - RNA, 64 nt, Homo Sapiens
aaggccuuuaucaugcugaaucgggaccuaaauuuugcuuaagggaacuccaacccagaguucu

SEQ ID NO: 60266 - RNA, 64 nt, Homo Sapiens
ccaggagcucaagucccacccugagacaggaggauugcuuaagcagucccagcuacucaggagg

SEQ ID NO: 60267 - RNA, 64 nt, Homo Sapiens
aguuuucuuauggcaaaaauuugagagcugacuguugcuuaagaugcgugugcauuuuuuuaac

SEQ ID NO: 60268 - RNA, 64 nt, Homo Sapiens
cuucugcuaaguguuagccagaauuuauccauguuugcuuaauguuuuucaucauuuguuuuau

SEQ ID NO: 60269 - RNA, 64 nt, Homo Sapiens
agacuauaaaugcuuugcaaaaaugguuucacguuugcuuaaaugcuucaucacagucacauuc

SEQ ID NO: 60270 - RNA, 64 nt, Homo Sapiens
uauuauguaaucacaacuuacuuucugcuuguaguugcuuaaaauuauguauuuugucuugggc

SEQ ID NO: 60271 - RNA, 64 nt, Homo Sapiens
gucauacuuuacuggcuuuggaguucaaauuaacuugcuuaaguaugguaucgugauuucuauu

SEQ ID NO: 60272 - RNA, 64 nt, Homo Sapiens
cuguuccaauuuuaacuuuuacuaaagacagacauugcuuaaacugcacauauauuaacuugug

SEQ ID NO: 60273 - RNA, 64 nt, Homo Sapiens
uugauuggcaaaaagcaagauauaagagauucauuugcuuaacauuucuacauaauauuuaugg

SEQ ID NO: 60274 - RNA, 64 nt, Homo Sapiens
uuuagaucuauuucuuuauacuuuuucuaaucaauugcuuaauaguacuuuggaugauuaucac

SEQ ID NO: 60275 - RNA, 64 nt, Homo Sapiens
acaucucccacauucauaccaauauacgucagguuugcuuaaccauugauuuuuuuuuuuuuuu

SEQ ID NO: 60276 - RNA, 64 nt, Homo Sapiens
auaaugacaugcauuuaucaucauugagauugguuugcuuaaaauuaacuuauuuuguagaaga

SEQ ID NO: 60277 - RNA, 64 nt, Homo Sapiens
ggauuauaccacacacauccugucacuugcuuuuuugcuuaagaguauaucuaagagaauccuu

SEQ ID NO: 60278 - RNA, 64 nt, Homo Sapiens
cacacucaacuguugugugaaugagccagacacauugcuuaaccugaguccgagauggacaaug

SEQ ID NO: 60279 - RNA, 64 nt, Homo Sapiens
uauguugauacaaagucugcuuuugcuauucuuuuugcuuaaauacuccuaucauuuucugaau

SEQ ID NO: 60280 - RNA, 64 nt, Homo Sapiens
ugguauuuuuaauuuacuucaaugauuagcucaguugcuuaacuggaguuuuaauccugugaua

SEQ ID NO: 60281 - RNA, 64 nt, Homo Sapiens
ugcaggcuguuucuguauuauuuucacacucauauugcuuaaauauuacauauuagggauugua

SEQ ID NO: 60282 - RNA, 64 nt, Homo Sapiens
uucaaaccaggaaggauuugacuaucauuagauuuugcuuaacuuuaugaaagcuaaaauauuc

SEQ ID NO: 60283 - RNA, 64 nt, Homo Sapiens
ggugaucauuucucaugaagaugcuuauaaaugguugcuuaacccauucuagauguagggucug

SEQ ID NO: 60284 - RNA, 64 nt, Homo Sapiens
gguugggagaauauuuuuuuuuuauucauucuguuugcuuaauucagaguacaguuugugcuau

SEQ ID NO: 60285 - RNA, 64 nt, Homo Sapiens
uguuuugaaccucaaacuagauaaacccuaggaauugcuuaacugcaacaaguaauuuucauuc

SEQ ID NO: 60286 - RNA, 64 nt, Homo Sapiens
ucucugcaacuaaguuuaaagcagugugacuguguugcuuaaauaucaaguauuguuuauaacc

SEQ ID NO: 60287 - RNA, 64 nt, Homo Sapiens
ccuuaauguuaaaaucugaauuucuuuuagcauuuugcuuaaaagcaauaugcuauuugcuuau

SEQ ID NO: 60288 - RNA, 64 nt, Homo Sapiens
caugugauuguuuguguguccccuuuccucuucuuugcuuaacacaauuaucuuguguuaagga

SEQ ID NO: 60289 - RNA, 64 nt, Homo Sapiens
uauugacuugguaagucuacgugaaguggcuugauugcuuaaacugauguaaagaaacugaaca

SEQ ID NO: 60290 - RNA, 64 nt, Homo Sapiens; identical to SEQ ID NO: 60289

SEQ ID NO: 60291 - RNA, 64 nt, Homo Sapiens
aaaguauuuuauaauacaguacacacaugcaauuuugcuuaacaugaguguuuggggguucaac

SEQ ID NO: 60292 - RNA, 64 nt, Homo Sapiens
aaagcuaugagacaaauaguugguuauaucaaguuugcuuaauauaucucuugccacugugugg

SEQ ID NO: 60293 - RNA, 64 nt, Homo Sapiens
aaaaugugugcuugcugcugcugugagugaaccauugcuuaagauaaaaaacuuaacuagaucu

SEQ ID NO: 60294 - RNA, 64 nt, Homo Sapiens
uuuaacagauuguauuccuuucaaguuucuauacuugcuuaagcaaucuugauuugaguaaggg

SEQ ID NO: 60295 - RNA, 64 nt, Homo Sapiens
ccggggagcaaagugucuuaugauuucuccuuaauugcuuaagguuuuacuuuugaaacaggaa

SEQ ID NO: 60296 - RNA, 64 nt, Homo Sapiens
cuuuuuccucuagauacucccaguuagcaaacuuuugcuuaagcuaccaguguuaacccuucug

SEQ ID NO: 60297 - RNA, 64 nt, Homo Sapiens
gcugaaaaguagagcucaaaaacaguaguucaauuugcuuaauuauugcuuaaaauaaugguac

SEQ ID NO: 60298 - RNA, 64 nt, Homo Sapiens
gagcucaaaaacaguaguucaauuugcuuaauuauugcuuaaaauaaugguacuauguaaaauu

SEQ ID NO: 60299 - RNA, 64 nt, Homo Sapiens
ucaaacugcuaagaaggggcagaucaaauuaagguugcuuaagaagagaaauguaauuugccug

SEQ ID NO: 60300 - RNA, 64 nt, Homo Sapiens
uauccuccuuuccuuccccagagcuuucuuuaucuugcuuaacuccucugcaugaaguuucugu

SEQ ID NO: 60301 - RNA, 64 nt, Homo Sapiens
ugggaacgugcugagccagcuccuuuagaugacagaccuucaucaggagcugagccugccucuc

SEQ ID NO: 60302 - RNA, 64 nt, Homo Sapiens
agcugagccugccucucuccuacugaggcucugcgaccuucaggcuagacacacucaggaggac

SEQ ID NO: 60303 - RNA, 64 nt, Homo Sapiens
caguuagagaagaggaguggugauaaagcccacugaccuucacacauucuaaaaauugguuggc

SEQ ID NO: 60304 - RNA, 64 nt, Homo Sapiens
ccuggacuuuggacccuuggccuaggagccuaaggaccuucaccccugugcaccacccaagaaa

SEQ ID NO: 60305 - RNA, 64 nt, Homo Sapiens
uguucagagaggucccccucugccacuugacagggaccuucaaaccucgacagugaugcaagga

SEQ ID NO: 60306 - RNA, 64 nt, Homo Sapiens
aaccagauaccccaggugggccggagggaccccagaccuucagagggcugcccugguguucucc

SEQ ID NO: 60307 - RNA, 64 nt, Homo Sapiens
gguugggaaaacaccucauuugaccuugccagcugaccuucaaacccugcauuugaaccgacca

SEQ ID NO: 60308 - RNA, 64 nt, Homo Sapiens
auuucuuaacauuguguucuaugauuauuuguaagaccuucaccaaguucugauaucuuuuaaa

SEQ ID NO: 60309 - RNA, 64 nt, Homo Sapiens
agugcacuuuccacucuaccuagugacuggcccugaccuucagguccucgcuguccccucucug

SEQ ID NO: 60310 - RNA, 64 nt, Homo Sapiens
gggcuuuguauuuuacaccuacucuuauugucuggaccuucaaaugggcaaucuuaacaucuuu

SEQ ID NO: 60311 - RNA, 64 nt, Homo Sapiens
uguccagcucaaccuuugugguuucuccuguuggaaagcugaugugccuucagaugucauugau

SEQ ID NO: 60312 - RNA, 64 nt, Homo Sapiens
caacugauuuauacaaaaugcauaguuugagaacaaagcugaugccuuaguucuuacagaaccu

SEQ ID NO: 60313 - RNA, 64 nt, Homo Sapiens
ucaauucggugggcaauuuuuggacaugaaccagaaagcugaaagcugaggcugacacggacug

SEQ ID NO: 60314 - RNA, 64 nt, Homo Sapiens
ggugggcaauuuuuggacaugaaccagaaagcugaaagcugaggcugacacggacuguaggugc

SEQ ID NO: 60315 - RNA, 64 nt, Homo Sapiens
agaguaucaugaaguaaacuacaaacuucagaagaaagcugacauuuuaaugaauuuuuuaaaa

SEQ ID NO: 60316 - RNA, 64 nt, Homo Sapiens
uccagcuuuguguaauucucuuugccagcugcacaaagcugauuuuuuccaaagucuaaagacu

SEQ ID NO: 60317 - RNA, 64 nt, Homo Sapiens
gugugucaccgaggugcgggaggggaggagcauuaaagcugaaagaucgcucugcucggggagc

SEQ ID NO: 60318 - RNA, 64 nt, Homo Sapiens
guauuuggggagcaggggaggggaggguguugagaaagcugaacuggagucaaucacccuuccc

SEQ ID NO: 60319 - RNA, 64 nt, Homo Sapiens
cugguuaucucuuuaaggacgaaaauacaguagaaaagcugauugccgguuagucagguuuguu

SEQ ID NO: 60320 - RNA, 64 nt, Homo Sapiens
auuuccuaauuguauagaauaagaaaauacucuuaaagcugaguguaacuaaaaaagugaagau

SEQ ID NO: 60321 - RNA, 64 nt, Homo Sapiens
cacccacccacacacacacacacagaagaaaaugaaagcugacacaccucgaagccuucuuucc

SEQ ID NO: 60322 - RNA, 64 nt, Homo Sapiens
auuuagagauggcagagagugagguaguggcgagaaagcugacuccauucaucagauccaguuu

SEQ ID NO: 60323 - RNA, 64 nt, Homo Sapiens
gugggcagggaggcaccauucaggaaccuggaccaaagcugacgaggcugggccaagccaggga

SEQ ID NO: 60324 - RNA, 64 nt, Homo Sapiens
ggaacucccaagaacagcaggcccaccuaccuucaaagcugaagccgccaggaccgccaaagaa

SEQ ID NO: 60325 - RNA, 64 nt, Homo Sapiens
ccugcaggaagcugccuuucgaagaaaaaagcugaaagcugaguaccccaauucacucaaccaa

SEQ ID NO: 60326 - RNA, 64 nt, Homo Sapiens
gcugaguccugcaggaagcucaaccaagaagaaaaaagcugaaaacucgacaccccaauucacu

SEQ ID NO: 60327 - RNA, 64 nt, Homo Sapiens
ugaaugccacugaagagcugugauagcauguuucaaagcugaacucuacagagcgagugcugag

SEQ ID NO: 60328 - RNA, 64 nt, Homo Sapiens
uugcauaaagguauugagagggaacaaaaaacauaaagcugagaaucuugagagagcucaucua

SEQ ID NO: 60329 - RNA, 64 nt, Homo Sapiens
cagaagcauccaggcugcaggaacccuagaaagcaaagcugauacucuagacuguuccaaagcu

SEQ ID NO: 60330 - RNA, 64 nt, Homo Sapiens
ccuagaaagcaaagcugauacucuagacuguuccaaagcugaacggaaaauuaaccuccugcuu

SEQ ID NO: 60331 - RNA, 64 nt, Homo Sapiens
caucacugaccuggugguggggcugugaccugggcagcucaagacuggugccccuugcugaucu

SEQ ID NO: 60332 - RNA, 64 nt, Homo Sapiens
gcuaauuagaccccuccccuugugucaacuccggcagcucaagacccccgagcaacauuuguag

SEQ ID NO: 60333 - RNA, 64 nt, Homo Sapiens
gguggcucugaggugccugucccacccccacccccagcucaauggacuggaaggggaagggaca

SEQ ID NO: 60334 - RNA, 64 nt, Homo Sapiens
cacaagaagaagggcacccuaguucuaccucaggcagcucaagcagcgaccgcccccuccucua

SEQ ID NO: 60335 - RNA, 64 nt, Homo Sapiens
guuaaugugauggauggcacauauaauguauuuucagcucaauuuccacaguuaucuuagcugg

SEQ ID NO: 60336 - RNA, 64 nt, Homo Sapiens
agacccaagugaagaucuggucgcugcaucccugcagcucaacggcgcgcccgcaggguggaga

SEQ ID NO: 60337 - RNA, 64 nt, Homo Sapiens
aauagggucuuuucaaaccuuaguggaggagggucagcucaauuugggcaaugcauuuguuccc

SEQ ID NO: 60338 - RNA, 64 nt, Homo Sapiens
ugagaggcagcucugaugcacuauugugugucagcagcucaaaggcccuaaaacacugaagguu

SEQ ID NO: 60339 - RNA, 64 nt, Homo Sapiens
aaaaccugcaauucugcauugguaccaguguuaccagcucaacuuggaagggaaaaaagaaagu

SEQ ID NO: 60340 - RNA, 64 nt, Homo Sapiens
uaaaggagaauguugcuaauuggcugagucuacccagcucaaggaaagagacaguaggacauug

SEQ ID NO: 60341 - RNA, 64 nt, Homo Sapiens
ccaucuucucacagauuaagcugguguuuggccuauaugagaaaaaccgcaguuuuacuacauu

SEQ ID NO: 60342 - RNA, 64 nt, Homo Sapiens
aaaaauaugaaaucuugcuaggaccuauacaaucauaugagaacuuugaguaaagaaacaauaa

SEQ ID NO: 60343 - RNA, 64 nt, Homo Sapiens
uacagaagaaaauaauaagcauuaacaacugugaauaugagaaaugggacaccucagaaaacuu

SEQ ID NO: 60344 - RNA, 64 nt, Homo Sapiens
acuauuguuuggggaaguucgagagaaaagaaaaauaugagagauacuuacuguuaacugucuu

SEQ ID NO: 60345 - RNA, 64 nt, Homo Sapiens
uuuauuuagaaaaaucuaaaaauucugguuuuaaauaugagaaucaguggaaaauaaggguaua

SEQ ID NO: 60346 - RNA, 64 nt, Homo Sapiens
gcucaugcaguugcuuagaauaaucauuacuguuauaugagaaacauuuuaguaauuuaauaaa

SEQ ID NO: 60347 - RNA, 64 nt, Homo Sapiens
uauaaaaauaauuaaaacaaaagcaaauuucuagauaugagaaaugaguguacauuuaugugug

SEQ ID NO: 60348 - RNA, 64 nt, Homo Sapiens
ggaaaaaauuagacaagucucuggaaaaaaaaaaauaugagauucugagcaaguuuucaccuau

SEQ ID NO: 60349 - RNA, 64 nt, Homo Sapiens
cccccacucuacuaaaaauaagggacuagaauguauaugagaaagaaaaugggcagucagaauu

SEQ ID NO: 60350 - RNA, 64 nt, Homo Sapiens
ccccuacauucuccuugucuuaaggguacuauaaauaugagauuuaaacuuugucauguauagg

SEQ ID NO: 60351 - RNA, 64 nt, Homo Sapiens
uaugaugaaaaucuaagugaaaaaagacauuaaaauaugagauguauuuauaaacuuugcuaug

SEQ ID NO: 60352 - RNA, 64 nt, Homo Sapiens
uucuuuuuuauuaggugagcuguugcugcaucagauaugagagaugugaaagcaugugaucaau

SEQ ID NO: 60353 - RNA, 64 nt, Homo Sapiens
aaaauucuuggaaaaguggcaagaccaaaaugacaaugaugaugauaaugaugaugacgacgac

SEQ ID NO: 60354 - RNA, 64 nt, Homo Sapiens
aaaguggcaagaccaaaaugacaaugaugaugauaaugaugaugacgacgacaacgaugaugcu

SEQ ID NO: 60355 - RNA, 64 nt, Homo Sapiens
aaguauaauuagcuuguuccuggacuucauuuucaaugaugaaccaaauuccugaauuauuuau

SEQ ID NO: 60356 - RNA, 64 nt, Homo Sapiens
auagccaagaccacaagcaaaagcacauacuggaaaugaugaguuagaaucugauuugacuggg

SEQ ID NO: 60357 - RNA, 64 nt, Homo Sapiens
uauuugcaucuggcuggucauagccuuuguuacuaaugaugacauucaguucucuuuuguuuuu

SEQ ID NO: 60358 - RNA, 64 nt, Homo Sapiens
ugauauaucaauucauguguuuggcauaccagugaaugaugaagaacaugagauuaauuuaauu

SEQ ID NO: 60359 - RNA, 64 nt, Homo Sapiens
guuuuuauuccuggcauccaucacagaggaagaaaaugaugaugcucaucuucguacuugaugc

SEQ ID NO: 60360 - RNA, 64 nt, Homo Sapiens
uucuguggugcuuaaggaaaaagugggaccaagcaaugaugaucacuuggauucuuuccuauaa

SEQ ID NO: 60361 - RNA, 64 nt, Homo Sapiens
aacauuugcauucuuauucucacauugcauuaauaaugaugauauauauucucauuucucuguu

SEQ ID NO: 60362 - RNA, 64 nt, Homo Sapiens
uauaagugaauuuugugcucauuuauaaguauaaaaugaugauacuauuugaauucugagcauu

SEQ ID NO: 60363 - RNA, 64 nt, Homo Sapiens
auuaugugaaaccaauauuggcaaauaguacuuuaaugaugaaguaaaugaccagaaauuauag

SEQ ID NO: 60364 - RNA, 64 nt, Homo Sapiens
uaagugucagauacuaggcagguguuagggaugaaaugaugaaugaggcauggaccuguuccuc

SEQ ID NO: 60365 - RNA, 64 nt, Homo Sapiens
ccacaguugguuaucugcuagacuccuucuccacaaugaugaauuuuucaacuauguuuaucca

SEQ ID NO: 60366 - RNA, 64 nt, Homo Sapiens
gcacuucugguggaugaauuuggauggcauugcaaaugaugacaugacgucccuccucaagagc

SEQ ID NO: 60367 - RNA, 64 nt, Homo Sapiens
caguuuugcuuuaguacaauaguauacauuuuauaaugaugaacuuauaaugauuaagggacau

SEQ ID NO: 60368 - RNA, 64 nt, Homo Sapiens
agauuuuucaaaaucgccaggacuggugaauauaaaugaugauugaacuggaauaauauugggg

SEQ ID NO: 60369 - RNA, 64 nt, Homo Sapiens
caucagaaaacuuaauuugguugaagagauggcaaaugaugagcauuuuuaaaaggaccuggau

SEQ ID NO: 60370 - RNA, 64 nt, Homo Sapiens
caaaaguuugacagugauauaauaacaaaauuaaaaugaugaaauuaacaaagggagccugcug

SEQ ID NO: 60371 - RNA, 64 nt, Homo Sapiens
ccugacaacagaauuuccacaguuucuuacuggaaaugaugacuucauuuucugucacucagug

SEQ ID NO: 60372 - RNA, 64 nt, Homo Sapiens
uugcuuccuaccuuuauggaugcagcacuuuguaaaugaugagacaacauaaauuuaucaaauu

SEQ ID NO: 60373 - RNA, 64 nt, Homo Sapiens
uaaaaaaaacaacagcguaaucugcccuuuuuacaaugaugauuuugucagaaaaaucuauaag

SEQ ID NO: 60374 - RNA, 64 nt, Homo Sapiens
ccagaccagugucuacagauuauuaauuugccugaaugaugagauuuccaugcacuuguuauuu

SEQ ID NO: 60375 - RNA, 64 nt, Homo Sapiens
aauaaaaugcacaccaaaaucauauggauaugauuccagucaaaauacuuucacaauuucccuu

SEQ ID NO: 60376 - RNA, 64 nt, Homo Sapiens
ugcaugguacugacugagcuagcccuguaauguauccagucagcagaaagaggccuaggagagc

SEQ ID NO: 60377 - RNA, 64 nt, Homo Sapiens
gucagucuuuguucaaacaucuguuuguucuaucuccagucauuaaaucagugcugcugcauga

SEQ ID NO: 60378 - RNA, 64 nt, Homo Sapiens
gcugcaugacacucuuaacuccugacuuuuuauauccagucauaaaguugacuuucagcacaaa

SEQ ID NO: 60379 - RNA, 64 nt, Homo Sapiens
uuuuaagcaaggcauggggagagaguugagcacuuccagucaguggacucagaccuuuaaacag

SEQ ID NO: 60380 - RNA, 64 nt, Homo Sapiens
cauuucccaaaguuucucuuccuugugaccuaaguccagucacaccggcaguuccuccagcuac

SEQ ID NO: 60381 - RNA, 64 nt, Homo Sapiens
cucuugucccucacugccccuccugaccagcuccuccagucauggccaggggaccccccggaga

SEQ ID NO: 60382 - RNA, 64 nt, Homo Sapiens
ucuugauggacccuuagguuccacauuuucuuuauccagucaucuauguauauaaguauauaca

SEQ ID NO: 60383 - RNA, 64 nt, Homo Sapiens
uggauauguauauaaguauauauacaccacauuauccagucaucuauguguauguauauaagua

SEQ ID NO: 60384 - RNA, 64 nt, Homo Sapiens
uaauggcauuguacagacauuggucuuuguuaauuccagucagauaauagcuuauuaaaggaaa

SEQ ID NO: 60385 - RNA, 64 nt, Homo Sapiens
agggacaauagaaaccugcaucacugaucuucacuccagucacuuguggauuaauuguagcauu

SEQ ID NO: 60386 - RNA, 64 nt, Homo Sapiens
guaacacuguuuauugaaagcccccauacaaguauccagucauuuggaucaggguucuuuuuuu

SEQ ID NO: 60387 - RNA, 64 nt, Homo Sapiens
agucacuacaacugauuaguagcaagaagggaguuccagucaaguauucauguaccugugaucc

SEQ ID NO: 60388 - RNA, 64 nt, Homo Sapiens
gcacagcaaagccaugugcaaugccgggcggccuuccagucauugccaggggucucuacugccc

SEQ ID NO: 60389 - RNA, 64 nt, Homo Sapiens
cacucauccaggguaggaggacguucucuagcucuccagucaccugagaggucuugggucugcc

SEQ ID NO: 60390 - RNA, 64 nt, Homo Sapiens
uucugggaaacagggacugaggccacacaucauuuccagucaucuguguguuuuuaaggccagc

SEQ ID NO: 60391 - RNA, 64 nt, Homo Sapiens
gaccaguuagcuggcagguuguccagcuuuuuauuccagucauaauaggugacaguguuaaccg

SEQ ID NO: 60392 - RNA, 64 nt, Homo Sapiens
gggugagccaggucuagcccaacagucuaaacuauccagucaauaccgagugaaguggcagcca

SEQ ID NO: 60393 - RNA, 64 nt, Homo Sapiens
agcuuccuggaaggagacugcgucuucucucaauuccagucaucucagucguugucguuaggug

SEQ ID NO: 60394 - RNA, 64 nt, Homo Sapiens
ugugcauuuaauuuggcauagcagaaacaacaaauccagucauggcucagaacuauuacaacau

SEQ ID NO: 60395 - RNA, 64 nt, Homo Sapiens
cuuggaggccucugccuagauccccugccugauauccagucagcuugcaggcuguccagccuca

SEQ ID NO: 60396 - RNA, 64 nt, Homo Sapiens
gugcccagcagggugggcugugcagccuggaaccuccagucacugagucaggagccagggacug

SEQ ID NO: 60397 - RNA, 64 nt, Homo Sapiens
gcgcccggcaggagucaggaugcagcccgaaaccuccagucacucuccugugagccggggacca

SEQ ID NO: 60398 - RNA, 64 nt, Homo Sapiens
caacaucaguuuuugacccaacuaaccuugacuguauucaaacuuaugagaguauaaaggaucu

SEQ ID NO: 60399 - RNA, 64 nt, Homo Sapiens
gcuuugagaauccugggauuugugcugcugcuguuauucaaagaucaaaggaguaaaacauagu

SEQ ID NO: 60400 - RNA, 64 nt, Homo Sapiens
uaguauuacuuaccuaguccauccauacucauauuauucaaauauauaggugguacuuuugaaa

SEQ ID NO: 60401 - RNA, 64 nt, Homo Sapiens
cauugguucucuugguuuaacugagguuuaugaauauucaaaccuuugcugggggaaagaaaug

SEQ ID NO: 60402 - RNA, 64 nt, Homo Sapiens
uugcucaauacagcaaauuauucaucgauaccauuauucaaauauguauaauguauuuauaaua

SEQ ID NO: 60403 - RNA, 64 nt, Homo Sapiens
cauugcuguguucucuuucauagcaguuuguuuuuauucaaagaacaucauugaagacaaggga

SEQ ID NO: 60404 - RNA, 64 nt, Homo Sapiens
gauguguguggacaucucugaccauccaucgcuguauucaaauggauuguuuuauuccauucug

SEQ ID NO: 60405 - RNA, 64 nt, Homo Sapiens
uguauuuaugcaagcaaaauugaugagaaaauuauauucaaauaaagcaaaaauuaaaaaaaaa

SEQ ID NO: 60406 - RNA, 64 nt, Homo Sapiens
ccuugcauuaaaauauggaaagcagagcaguacauauucaaauguauucagaaagucaaaagau

SEQ ID NO: 60407 - RNA, 64 nt, Homo Sapiens
auaacagguccaaguuagagugauguguguauauuauucaaaaaaauguacuggugugauaucu

SEQ ID NO: 60408 - RNA, 64 nt, Homo Sapiens
aagcucuuuuguagucuauugaauauuuuauagauauucaaaauuuccuacaaacuauaauuuu

SEQ ID NO: 60409 - RNA, 64 nt, Homo Sapiens
uauuccucaaguguuaauauacugacuuaugcaguauucaaaccaucuagugcaauguuuuugu

SEQ ID NO: 60410 - RNA, 64 nt, Homo Sapiens
uuaaguaucuuaagaauagugccaguagguucuuuauucaaauuagaccuuagaauguuacaua

SEQ ID NO: 60411 - RNA, 64 nt, Homo Sapiens
gauugucuuauucugagcaaagauacucuucaucuauucaaauguuugcaaaauuuuccagccc

SEQ ID NO: 60412 - RNA, 64 nt, Homo Sapiens
gugaaacuaaaacuuuaugguacugcuuuguugauauucaaaguguuuucaugauuuuaggaau

SEQ ID NO: 60413 - RNA, 64 nt, Homo Sapiens
guacaucuucccccccccccuuuugauguacacauauucaaaaaaguaaaaguuaacuuuuugg

SEQ ID NO: 60414 - RNA, 64 nt, Homo Sapiens
aacauauauucuugcuugcagccauagcuuacucuauucaaauaagcuaauuuggucauucuuu

SEQ ID NO: 60415 - RNA, 64 nt, Homo Sapiens
cacugcuaucuuugggacuaacacaaaacuccuuuauucaaaaugaaauucauauauccaggca

SEQ ID NO: 60416 - RNA, 64 nt, Homo Sapiens
agaucaggaagccaauuuucuguguguuuuucaguauucaaauauggaacucuuuauuuaaaua

SEQ ID NO: 60417 - RNA, 64 nt, Homo Sapiens
caagcuaagugcuuccguugugacccuuucuguauauucaaaccgccaccugcaacucacugca

SEQ ID NO: 60418 - RNA, 64 nt, Homo Sapiens
uggggaucugugguguauguugucuuaaaauggguauucaaaaaucaaccuucuagguuucucu

SEQ ID NO: 60419 - RNA, 64 nt, Homo Sapiens
agcuguaauuuaguuaauaaguuaguuaaguuuuuauucaaagcuaugagacccuuacgugauu

SEQ ID NO: 60420 - RNA, 64 nt, Homo Sapiens
uccagaauauuuuuaaguaaaaaaccaucuuaaguauucaaaauuuccuugguuuuuuaaaggu

SEQ ID NO: 60421 - RNA, 64 nt, Homo Sapiens
uuuuaagagaaaguaaauuuucacauuagauuucuauucaaaguacuaauaucuacauggucca

SEQ ID NO: 60422 - RNA, 64 nt, Homo Sapiens
uaauuaugaggugaaacaauuucuuaaucaagaauauucaaauguuuucaaaacugcuaaauuu

SEQ ID NO: 60423 - RNA, 64 nt, Homo Sapiens
gaaauauauauauauauauaaaauguucguauucuauucaaaaggcuuaaaaccuagaacuuca

SEQ ID NO: 60424 - RNA, 64 nt, Homo Sapiens
uacaggugcauauauacuugcuuucaucaauaucuauucaaauacucugaggccuguauggccc

SEQ ID NO: 60425 - RNA, 64 nt, Homo Sapiens
uaaaagacacuguauccccucuuaaauacuugaauauucaaauuuaucauauaacuuuguagaa

SEQ ID NO: 60426 - RNA, 64 nt, Homo Sapiens
ugcagugaaggcaucaacuuaauucaaagcauuguauucaaaguauuuuauucaaguguuucaa

SEQ ID NO: 60427 - RNA, 64 nt, Homo Sapiens
auucaaacauuuuauucaagaagaggaggaauuuuauucaaagcuaaaauaagguuuacucuga

SEQ ID NO: 60428 - RNA, 64 nt, Homo Sapiens
cuuguucauacucaaauaguaguuauuuugaagauauucaaacuuauauugaagaagugacuuu

SEQ ID NO: 60429 - RNA, 64 nt, Homo Sapiens
acuuuaguuccucuuguuuuaagcuucuuucauguauucaaaucagcauuuuuuucuaagaaau

SEQ ID NO: 60430 - RNA, 64 nt, Homo Sapiens
uguuuccuugaugagcccugaauuuguaaugugcuauucaaacuaauucuucaucuuuaaaggg

SEQ ID NO: 60431 - RNA, 64 nt, Homo Sapiens
acaaauuauagaauccacccuguuucaaagguuuuauucaaaccgaauuuuaauacuaauggaa

SEQ ID NO: 60432 - RNA, 64 nt, Homo Sapiens
ccaaaacacuacucagacacuuaguuugugacaauauucaaagguccuggggagcuuuggucua

SEQ ID NO: 60433 - RNA, 64 nt, Homo Sapiens
auuuguuaggccaauauuuugcuuacaguuuuccuauucaaacaucucaaauuuauaaauauuu

SEQ ID NO: 60434 - RNA, 64 nt, Homo Sapiens
uugacaaucagagcacugggcuuucacugagcuuuauucaaauuagucauuaauuacuguccuc

SEQ ID NO: 60435 - RNA, 64 nt, Homo Sapiens
uuuuugaacugacugaauuauuuccaaguuuaauuauucaaaacuuuggcuuuauugcagugac

SEQ ID NO: 60436 - RNA, 64 nt, Homo Sapiens
uuaguaugggacaauugaauagggagaguuagguuauucaaaaaaccucucuuaguagaaacaa

SEQ ID NO: 60437 - RNA, 64 nt, Homo Sapiens
gaaaaccggauuucaaauaacacuuaaccaaaacuauucaaaauggacauucugccaugacaua

SEQ ID NO: 60438 - RNA, 64 nt, Homo Sapiens
ccacacugaccaaaucuggaucuuuggacuaaaguauucaaaauagcauagcaaagcucacugu

SEQ ID NO: 60439 - RNA, 64 nt, Homo Sapiens
aagcaauauguugucacuccuaauucucaaguacuauucaaauuguaguaaaucuuaaaguuuu

SEQ ID NO: 60440 - RNA, 64 nt, Homo Sapiens
aaguguguuaauuaauaaaauggcacauaguauguauucaaaaccuaguagcuagcagagagcc

SEQ ID NO: 60441 - RNA, 64 nt, Homo Sapiens
uuacuagacgaacaaucuuuaucagaucacucuguauucaaagccagaauaaaagggugaggac

SEQ ID NO: 60442 - RNA, 64 nt, Homo Sapiens
auucaguaaaauaacauuaccuuauuuuuuuucuuauucaaauucuggaacuauagcaaauaau

SEQ ID NO: 60443 - RNA, 64 nt, Homo Sapiens
cuggaacuauagcaaauaauucguuaaauugucauauucaaaacaaauguggauacagucuugg

SEQ ID NO: 60444 - RNA, 64 nt, Homo Sapiens
uuauauccugaucaccuuuuggaaugcuucauauuauucaaaaauacauauuuuccuuaauaga

SEQ ID NO: 60445 - RNA, 64 nt, Homo Sapiens
uuucagcaccauauaauagauuuauuucuaaagguauucaaauguguuuaauagaugaauuuau

SEQ ID NO: 60446 - RNA, 64 nt, Homo Sapiens
uguucucuuauuucugaggcccuucagucuccuuuauucaaagcacucagcaugccaaagcacc

SEQ ID NO: 60447 - RNA, 64 nt, Homo Sapiens
gggaaacuucuuagggcaaacccaccucccacucuauucaaaguuaucucucugcucacugaga

SEQ ID NO: 60448 - RNA, 64 nt, Homo Sapiens
aucuuccuauuuaacuagcuuggggacuucaguugaaaauuagguucuaaguuguucuugcagg

SEQ ID NO: 60449 - RNA, 64 nt, Homo Sapiens
aggcucucaagucuucccaaggccagaaucgaaagaaaauuaaaauuugaaugcugaauauucu

SEQ ID NO: 60450 - RNA, 64 nt, Homo Sapiens
ugaaauucaaauugcaguguauuuugugucacaugaaaauuauaaaaaaauuccaaagacugau

SEQ ID NO: 60451 - RNA, 64 nt, Homo Sapiens
ggugggccacugaaagucccuuuuauuuuuucaugaaaauuauugggagguuuuuuuuuucuau

SEQ ID NO: 60452 - RNA, 64 nt, Homo Sapiens
gagaaaccucuaguuuugccuaaaaauacagacagaaaauuaggcaaauaaugcauuuuauuua

SEQ ID NO: 60453 - RNA, 64 nt, Homo Sapiens
uguauccacaaccuaguuaucgucaauuacugcagaaaauuaugauaaauguaguuucaucugu

SEQ ID NO: 60454 - RNA, 64 nt, Homo Sapiens
ugaaaccuaaaguaguugccgguacuaagacugugaaaauuauguuuaucugaaugaaaauggu

SEQ ID NO: 60455 - RNA, 64 nt, Homo Sapiens
agugcccucuuaaaaauacauucaaacacaacuugaaaauuaaaguauuagcauacucuauagu

SEQ ID NO: 60456 - RNA, 64 nt, Homo Sapiens
caggaucaaaugcuauugcaucugaaugguucuugaaaauuagcucaguguuucuaagaaugag

SEQ ID NO: 60457 - RNA, 64 nt, Homo Sapiens
agcccauuuucagaaagaucacaagaaagacauggaaaauuagcucccugauacucaaagucua

SEQ ID NO: 60458 - RNA, 64 nt, Homo Sapiens
uguuuagugagcaguaugauuuguacaugccauugaaaauuauuaaucagaagaaaauuaagca

SEQ ID NO: 60459 - RNA, 64 nt, Homo Sapiens
auuuguacaugccauugaaaauuauuaaucagaagaaaauuaagcagggucuuugcuauacaaa

SEQ ID NO: 60460 - RNA, 64 nt, Homo Sapiens
aaaaauaaaauaauuuuagaaacaccauguguuagaaaauuauaggugccaaaauucauuuucu

SEQ ID NO: 60461 - RNA, 64 nt, Homo Sapiens
auguuguaaaaccuugaaaaaaauggauauaaaugaaaauuaccauauagaggaaauguagaca

SEQ ID NO: 60462 - RNA, 64 nt, Homo Sapiens
aaaugcagaacuaagauuuuugacucuaaagagagaaaauuacaaggguguugccuuauagcaa

SEQ ID NO: 60463 - RNA, 64 nt, Homo Sapiens
auuuacagaucauauuuauuuuacuauuuuuguagaaaauuauuaauuuugauuguauuuuugu

SEQ ID NO: 60464 - RNA, 64 nt, Homo Sapiens
uaaguacuccuaaagugaccauuauuagggaccagaaaauuauaucuuggcuaaguaauagagg

SEQ ID NO: 60465 - RNA, 64 nt, Homo Sapiens
ggaaauauucaauugagacuugaggggaauaauagaaaauuaagguagauccccaauauuuugg

SEQ ID NO: 60466 - RNA, 64 nt, Homo Sapiens
uauaaaacuuugaagauaacuuuuacuuaaauaugaaaauuauaguuugaaaauuaggcucaag

SEQ ID NO: 60467 - RNA, 64 nt, Homo Sapiens
gauaacuuuuacuuaaauaugaaaauuauaguuugaaaauuaggcucaagcaaauaucaaauac

SEQ ID NO: 60468 - RNA, 64 nt, Homo Sapiens
gaauauuuuguuucuuggaacccaaugauccuaagaaaauuauguacuuuuaccugaaaauuaa

SEQ ID NO: 60469 - RNA, 64 nt, Homo Sapiens
ccaaugauccuaagaaaauuauguacuuuuaccugaaaauuaaaaccaauauuuauaaaaagug

SEQ ID NO: 60470 - RNA, 64 nt, Homo Sapiens
aauaaguuauaaugaacaguuaaaaaugcucauugaaaauuaaauaaaacaaaaaggcaguuau

SEQ ID NO: 60471 - RNA, 64 nt, Homo Sapiens
aauccucaagaaaauugacuucauuauuuggaaggaaaauuaguauuuuuuuuaauauuauaug

SEQ ID NO: 60472 - RNA, 64 nt, Homo Sapiens
uaaauaaaacauucuccaucgcaucucuacagaugaaaauuacaauauaaagaugaggacagaa

SEQ ID NO: 60473 - RNA, 64 nt, Homo Sapiens
agcauuucuuucucuccccauuuaaucaugaagagaaaauuaguuaugguuaaaagauuuuuuu

SEQ ID NO: 60474 - RNA, 64 nt, Homo Sapiens
ccauguaaacauuucaacucggucuuucuguagggaaaauuauuuugaauuuaaaggguguaca

SEQ ID NO: 60475 - RNA, 64 nt, Homo Sapiens
uggcaaucauaagaaacauccuuguacagaaagugaaaauuaguuuaaaacuacuaauuugcug

SEQ ID NO: 60476 - RNA, 64 nt, Homo Sapiens
uccuaucccgugaguggauuucugcaacuggagagaaaauuaaucaguucauguacaaggcccc

SEQ ID NO: 60477 - RNA, 64 nt, Homo Sapiens
ccucaaaugacaguagcauuuagugcccuuggaagaaaauuaggcccaagugaagcauggcaua

SEQ ID NO: 60478 - RNA, 64 nt, Homo Sapiens
guaaguugagaaaaauuuauaagccaaagguucagaaaauuaaacuacagaauauuaaauauua

SEQ ID NO: 60479 - RNA, 64 nt, Homo Sapiens
uauuccuuacaacuggaguggguagaagccuuaugaaaauuauacugagaaccugaucucguuu

SEQ ID NO: 60480 - RNA, 64 nt, Homo Sapiens
uuugaagaaaacaggcuauuaugaaaaagcaguagaaaauuacuguugucuuuuuuauauuuuu

SEQ ID NO: 60481 - RNA, 64 nt, Homo Sapiens
gcaauguuggucgccuuuuaagguaauuuuuacugaaaauuagggggggaaagguaggaagaag

SEQ ID NO: 60482 - RNA, 64 nt, Homo Sapiens
cuagaggaaccuaaaaaggguauccuuuucugaggaaaauuauuguuccuuaaguuuuucaagu

SEQ ID NO: 60483 - RNA, 64 nt, Homo Sapiens
ucacuauuaauuacauuaaauuauuugcuccuuugaaaauuaaaauguuuucucuuguuuguaa

SEQ ID NO: 60484 - RNA, 64 nt, Homo Sapiens
ugugauaaccuuugaaccuuaggugauaaguguugaaaauuaaacauaaauugagagaagaaga

SEQ ID NO: 60485 - RNA, 64 nt, Homo Sapiens
agaaugcauaucuuacuuugccauucuuugauuagaaaauuaagauuuguacuuuuaguaacua

SEQ ID NO: 60486 - RNA, 64 nt, Homo Sapiens
uaguuaaucauaauauuugaucuuaggauuguaggaaaauuaucuaauucuuuagaugaauguu

SEQ ID NO: 60487 - RNA, 64 nt, Homo Sapiens
uugcuaucaagaauaaaccacuuuugcuugcacugaaaauuaaauuacagugggcagguauuug

SEQ ID NO: 60488 - RNA, 64 nt, Homo Sapiens
uugcuaucaagagcaaacuacuuuugcuugcacugaaaauuaaaagugagcagguauguguuug

SEQ ID NO: 60489 - RNA, 64 nt, Homo Sapiens
augugucaauaaauauuuucucagaauauggaaagaaaauuaaauuguguauuuuguuuauuuc

SEQ ID NO: 60490 - RNA, 64 nt, Homo Sapiens
agugugauacauaggaaucauaaccacuaauuuugaaaauuaccauaacuguuauuuaaauacu

SEQ ID NO: 60491 - RNA, 64 nt, Homo Sapiens
augauaagcaaaaugaaagaaauaaugauuaagggaaaauuaagugacuguguuacacugcuuc

SEQ ID NO: 60492 - RNA, 64 nt, Homo Sapiens
agucguugaaaaaaauuuuguaucaaaauguuuggaaaauuagaagcuucuccuuaaccuguau

SEQ ID NO: 60493 - RNA, 64 nt, Homo Sapiens
gcaaaacagguguucuuaucuaaaacgucaauuagaaaauuaucugcgguuguuaaucuacugu

SEQ ID NO: 60494 - RNA, 64 nt, Homo Sapiens
aguauaaauuccuuugaaacuauaagucuuugaggaaaauuauaagguaaaauuuuccuguuuu

SEQ ID NO: 60495 - RNA, 64 nt, Homo Sapiens
uucacugcagagcaauuacuucacccuagacuaugaaaauuauaauuauucaccauuuugaagc

SEQ ID NO: 60496 - RNA, 64 nt, Homo Sapiens
caccauuuugaagcucacccuuaucaaauauaaggaaaauuauuagaggacguagucauuucau

SEQ ID NO: 60497 - RNA, 64 nt, Homo Sapiens
agaauuauuuaaauuacaguuaaauguacuuuuugaaaauuaauuugaaaauuaguaugguaau

SEQ ID NO: 60498 - RNA, 64 nt, Homo Sapiens
augguaauuaaauguacuuuauugcucuucuuuugaaaauuaguaagauuacuucugacauucc

SEQ ID NO: 60499 - RNA, 64 nt, Homo Sapiens
uauaccuguuaaguucguaucauuguggaauacagaaaauuaaaaugaguccugcuucuagcuc

SEQ ID NO: 60500 - RNA, 64 nt, Homo Sapiens
cacaaaguguauacauguauuuacuuaugccauagaaaauuaaacagcaauucauaaaaacugc

SEQ ID NO: 60501 - RNA, 64 nt, Homo Sapiens
agaagcagggaaguauuguuggguggaauguauugaaaauuauuaaagcucguuguaguagaaa

SEQ ID NO: 60502 - RNA, 64 nt, Homo Sapiens
auaaucucuaauccuacuacagaagcaaaaauaagaaaauuaaaagaggaaaacugaccaaaac

SEQ ID NO: 60503 - RNA, 64 nt, Homo Sapiens
gccaaauaauuguaaaauuuucaugucauaaucagaaaauuacuauugcugaaucgcacagcag

SEQ ID NO: 60504 - RNA, 64 nt, Homo Sapiens
ugugauccaguuugauauuuuagaggauauggaagaaaauuaaggaagauacacgaggaugaag

SEQ ID NO: 60505 - RNA, 64 nt, Homo Sapiens
gauuugaagucauauuaggaaauauuuagacaaugaaaauuaucaagagauaauuuaccuuuca

SEQ ID NO: 60506 - RNA, 64 nt, Homo Sapiens
aaucaacuaaaaauucgucuaucgaauuagggcugaaaauuacuguuaaagaguguugcaguau

SEQ ID NO: 60507 - RNA, 64 nt, Homo Sapiens
uacauuuacauuuaugcaaauuuuuuaaauaggagaaaauuaagaaauuguguuaaaggccuaa

SEQ ID NO: 60508 - RNA, 64 nt, Homo Sapiens
ccacguuugguagcaucaguuguugaguuaaaaagaaaauuauugcauuugaucuggauggauu

SEQ ID NO: 60509 - RNA, 64 nt, Homo Sapiens
uuggaaugagauggaaaguagaugaaacuacuuugaaaauuacgacaguuaagggcugggugcg

SEQ ID NO: 60510 - RNA, 64 nt, Homo Sapiens
gaggucagcaguugagaccagccaaaaggaaaaagaaaauuaugagaguuacuuaaagguaaca

SEQ ID NO: 60511 - RNA, 64 nt, Homo Sapiens
aaaacuaauagccaaaaaacugugugcaacauaagaaaauuauguuagagaggaaucuuguuuu

SEQ ID NO: 60512 - RNA, 64 nt, Homo Sapiens
agaaaggggaaauuuuugguuuacauaauacuaggaaaauuaugaucuagaacuaggcauaacc

SEQ ID NO: 60513 - RNA, 64 nt, Homo Sapiens
ugguacaauaauuauuguaaagaguucauuuaaggaaaauuacucuguaaauuaugcauuauaa

SEQ ID NO: 60514 - RNA, 64 nt, Homo Sapiens
ccaaugaagaagacaaagucaaaacauuuugaaggaaaauuaaauggcugugagcaacugcgac

SEQ ID NO: 60515 - RNA, 64 nt, Homo Sapiens
auauuuguacuucauuugugaaaucaaaccuucugaaaauuaugguuuuuuuaugguacucgaa

SEQ ID NO: 60516 - RNA, 64 nt, Homo Sapiens
aauuauaaagauuguuuaaacaguauucuuuuuugaaaauuagcuuuuccacaguaaagccgaa

SEQ ID NO: 60517 - RNA, 64 nt, Homo Sapiens
augugaauguaaggugaugugaccuuguuggugagaaaauuaaacuuuacauuugacuugauuu

SEQ ID NO: 60518 - RNA, 64 nt, Homo Sapiens
ggguugaaaaaagugaaaagaauauuuucaacaugaaaauuauaugaaauuuaaguuuuggugu

SEQ ID NO: 60519 - RNA, 64 nt, Homo Sapiens
aaaauuggccaggcuugguguauuugauguggaugaaaauuauccaauaagcuauauuuauucu

SEQ ID NO: 60520 - RNA, 64 nt, Homo Sapiens
ucuccccuaacauccaguucauuaccaaaaaugugaaaauuaaucacauuauaaaaauucaaaa

SEQ ID NO: 60521 - RNA, 64 nt, Homo Sapiens
uuguaaucaagauuuuauguaacauuuguaaagggaaaauuagcacuuuugugguucuuaaggg

SEQ ID NO: 60522 - RNA, 64 nt, Homo Sapiens
gugccccccacuuaauauggauagauuuuaaugggaaaauuauaauucagauuaaauaaaaaac

SEQ ID NO: 60523 - RNA, 64 nt, Homo Sapiens
aaacuugcuuacagagcugugaaauggugccuuugaaaauuagauugaauugagaaaauuacag

SEQ ID NO: 60524 - RNA, 64 nt, Homo Sapiens
ggaaauggugccuuugaaaacuuuuuugaauugagaaaauuacauuuagccuaacccucauguc

SEQ ID NO: 60525 - RNA, 64 nt, Homo Sapiens
guauguucucucugucacugacuuauuuguaagagaaaauuaguuggacuuguuuauuuucuag

SEQ ID NO: 60526 - RNA, 64 nt, Homo Sapiens
aauaaacuauucuuugaaacuuguuggguagaaugaaaauuaaagccauaaugguagaagaugg

SEQ ID NO: 60527 - RNA, 64 nt, Homo Sapiens
uucuugaugcugaccuuuuugguuaugaaacucagaaaauuaaaaggugccuccauuuaucaag

SEQ ID NO: 60528 - RNA, 64 nt, Homo Sapiens
uugguuaauguaauaauccuuaggaccuucucuggaaaauuauucagugagcauuacuuuuaaa

SEQ ID NO: 60529 - RNA, 64 nt, Homo Sapiens
auugcguuggcauguacgugggugggaagaaaaagaaaauuaacaggauuuacacaauuauaau

SEQ ID NO: 60530 - RNA, 64 nt, Homo Sapiens
agcugcuaaauacgugucuggcagguaaaagcuggaaaauuacuuaaaacaggaaagugucaau

SEQ ID NO: 60531 - RNA, 64 nt, Homo Sapiens
uaagcauauugguguuuucucaauuagucacugagaaaauuaacacuuuaggcaguggcuauuu

SEQ ID NO: 60532 - RNA, 64 nt, Homo Sapiens
aaccaauaugguuuucuuuaugucuuggcugcuugaaaauuaaaaaaaaaaaagguuuguucaa

SEQ ID NO: 60533 - RNA, 64 nt, Homo Sapiens
ucuuuacuucugggaauuuguauguaacagccuagaaaauuaaaaggagguggaugcauccaaa

SEQ ID NO: 60534 - RNA, 64 nt, Homo Sapiens
ugucacacacacaaaaaauccuuuucaauccugagaaaauuaaaggcguuuuacucacauggcu

SEQ ID NO: 60535 - RNA, 64 nt, Homo Sapiens; identical to SEQ ID NO: 60533

SEQ ID NO: 60536 - RNA, 64 nt, Homo Sapiens
gucacacacacaaaaaaauccuuuucaauccugagaaaauuaaagguguuuuacucacauggau

SEQ ID NO: 60537 - RNA, 64 nt, Homo Sapiens
aaugauuugguucagggcaaucaacugagugcaacauugagaauuucaagguaguaggucucuu

SEQ ID NO: 60538 - RNA, 64 nt, Homo Sapiens
aauuuuuuauuauuauauccuuugaaaauauacacauugagaauaaaggacacugucaggcaaa

SEQ ID NO: 60539 - RNA, 64 nt, Homo Sapiens
gacaacuaaaacauuccauugacauauaaaguaacauugagaauauacauuagaacuuaaugca

SEQ ID NO: 60540 - RNA, 64 nt, Homo Sapiens
auuucacauuuuauauggcugaucaauuuucauacauugagaaaccaagucaaucaagcaggaa

SEQ ID NO: 60541 - RNA, 64 nt, Homo Sapiens
gcaaaacaggaaaguuuccagauagguauuguaucauugagaaugcagcacagauagugugggc

SEQ ID NO: 60542 - RNA, 64 nt, Homo Sapiens
gaguuguguuuucagcacuauauuggucaagauagccaagcaguuuguauaauuucugucacua

SEQ ID NO: 60543 - RNA, 64 nt, Homo Sapiens
uggucaacaugugugaucuuugugucuccuuuuugccaagcacauucugauuuucuuguuggaa

SEQ ID NO: 60544 - RNA, 64 nt, Homo Sapiens
aagucauguuuucuuuaguguuuguuuacgugaugccaagcaucuaauaggaucaucuugugaa

SEQ ID NO: 60545 - RNA, 64 nt, Homo Sapiens
ugacuuaauaggaucaucuuuagcuucagcgcgugccaagcaguugcucacugauuguuaacug

SEQ ID NO: 60546 - RNA, 64 nt, Homo Sapiens
acagaccuuaucaucuggguuaagcggagcaagugccaagcagaccuuccagccagaaaagugg

SEQ ID NO: 60547 - RNA, 64 nt, Homo Sapiens
uuccucuuuuacagcuggagaguucaggagcugugccaagcacucaauuugaaugccuacaaua

SEQ ID NO: 60548 - RNA, 64 nt, Homo Sapiens
ucaaagaccccugagcugccaaccacggagaugugccaagcaucucaucucuccugcacacuuu

SEQ ID NO: 60549 - RNA, 64 nt, Homo Sapiens
cucuaguucaauggccagucauagcagaagggaggccaagcaccaguccaucaccccucccagg

SEQ ID NO: 60550 - RNA, 64 nt, Homo Sapiens
gcagaaugccucagaaagggcauggugaaaauaagccaagcagugacacaagcacaggcuguag

SEQ ID NO: 60551 - RNA, 64 nt, Homo Sapiens
cacgucuccaagagcucccgacuccaguuaggaugccaagcagccagcucuccuugagcugacc

SEQ ID NO: 60552 - RNA, 64 nt, Homo Sapiens
ccugugugacuguggcagugagcagaggcugagggcaggcaaaggcaggcaagguacccgaaga

SEQ ID NO: 60553 - RNA, 64 nt, Homo Sapiens
uacccgaagaagcagaggcugccccaaugcaccugcaggcaagguggcccaacagaaaaacccu

SEQ ID NO: 60554 - RNA, 64 nt, Homo Sapiens
auguuuaauuugaacuaucucuagaaaagaauuugcaggcaaccguguuuugcguuuacuuccu

SEQ ID NO: 60555 - RNA, 64 nt, Homo Sapiens
aaaaaaccaccucacugcaaauguguauauaguugcaggcaaaaugacgcagaauaguuuugca

SEQ ID NO: 60556 - RNA, 64 nt, Homo Sapiens
agccugggucuaggcuaagggagggccaggagcagcaggcaaggucauccacuugagggcgccu

SEQ ID NO: 60557 - RNA, 64 nt, Homo Sapiens
ucgagaacggauccagaaauagcucugagcagcagcaggcaacucgggggggacucaacagcag

SEQ ID NO: 60558 - RNA, 64 nt, Homo Sapiens
cagguccaggggaguccagugggcaggacccuuggcaggcaagccccucccuucacucccagga

SEQ ID NO: 60559 - RNA, 64 nt, Homo Sapiens
ggcagcaaggcagggcagcccagagguggcagcggcaggcaaucuggucacuaggucuuuguga

SEQ ID NO: 60560 - RNA, 64 nt, Homo Sapiens
auuaugcugcuauugaagaacuggcuuagcagcugcaggcaagcgcuccagcuccuccaaaguu

SEQ ID NO: 60561 - RNA, 64 nt, Homo Sapiens
cucugugguccuaagaccuguauguuauugggaugcaggcaaaccuuuccacaucaagaguccu

SEQ ID NO: 60562 - RNA, 64 nt, Homo Sapiens
gagcuggcuuggacccauuugaggacugaacuaggcaggcaauggcuccagugcccucccucug

SEQ ID NO: 60563 - RNA, 64 nt, Homo Sapiens
gcaugguggugcccugggccgucccugugugaacgcaggcaaaagcagcccagucccccucacu

SEQ ID NO: 60564 - RNA, 64 nt, Homo Sapiens
cgugcaugcuuuaaaaaacacagucacgcaccaagcaggcaaauagcuuuaguccuucucaccu

SEQ ID NO: 60565 - RNA, 64 nt, Homo Sapiens
cggauaguaagaaaacaaacagcccaagugaaaagcaggcaaaagacuugaauagacacuucac

SEQ ID NO: 60566 - RNA, 64 nt, Homo Sapiens
auagagccaaguccaaacuggcaagcucaaugaugcaggcaauaaaccgccuuuuuggcagccu

SEQ ID NO: 60567 - RNA, 64 nt, Homo Sapiens
ugcgucgauuuuuuuuuuuuggaagacguugcaagcaggcaaaacccugacgucccccagcaaa

SEQ ID NO: 60568 - RNA, 64 nt, Homo Sapiens
ggccugacccaugagaccgucuggaguccaggaagcaggcaacucucagccauggcaaguccau

SEQ ID NO: 60569 - RNA, 64 nt, Homo Sapiens
aaacuaagucuguggcucuuugguggucaacuaaagguauuaggucaaagaaaaucaaccucug

SEQ ID NO: 60570 - RNA, 64 nt, Homo Sapiens
gaaaguacccaagucugugucguucuaggagucuagguauuaugugccacacaguaucuccugg

SEQ ID NO: 60571 - RNA, 64 nt, Homo Sapiens
uagaauauaaauccuuagaaauguuuagagucguagguauuaaccuuaaaugagguauuaagua

SEQ ID NO: 60572 - RNA, 64 nt, Homo Sapiens
uaauguuuagagucguagguaaucagcuuaaaugagguauuaagaaagugacuagagaaaaaga

SEQ ID NO: 60573 - RNA, 64 nt, Homo Sapiens
auauugauugggaaaacauuugcugccauuacagagguauuaaaacuaaauuucacuacuagau

SEQ ID NO: 60574 - RNA, 64 nt, Homo Sapiens
uaaaaguuuuauaugcuuuauuaauguuuucaaaagguauuauacaugugauacauuuuuuaag

SEQ ID NO: 60575 - RNA, 64 nt, Homo Sapiens
cuugcugcauaucuugacauuuauguuaaccuucagguauuaaacaucuguguccuguugucau

SEQ ID NO: 60576 - RNA, 64 nt, Homo Sapiens
ggaccugguuucagaaugggguaucaaaagaccaagguauuauggugguguguagugcugcugu

SEQ ID NO: 60577 - RNA, 64 nt, Homo Sapiens
uagauacccaccaugagguguucugggcaucugaagguauuaagaguucagugggaaaaaucuc

SEQ ID NO: 60578 - RNA, 64 nt, Homo Sapiens
guuuccagaagaguggagagugugguuucaggcaagguauuaaugauacaauuccgugguauac

SEQ ID NO: 60579 - RNA, 64 nt, Homo Sapiens
uuauuuuuuuaauuuuaauuugugugagagagaaagguauuaauaaaagguguuugugugugug

SEQ ID NO: 60580 - RNA, 64 nt, Homo Sapiens
uuaaaacaucugguuuucauugaucugaauuuugagguauuauugauucaggauauauauuauu

SEQ ID NO: 60581 - RNA, 64 nt, Homo Sapiens
uguagaauuagucaucuuuugaguaauucauccuuacagcuauccagaauuugauuuugaacuu

SEQ ID NO: 60582 - RNA, 64 nt, Homo Sapiens
uugagauauaguucacauaaguuuuuauuuuuccuacagcuacacaaaguccagguuagcacag

SEQ ID NO: 60583 - RNA, 64 nt, Homo Sapiens; identical to SEQ ID NO: 44500

SEQ ID NO: 60584 - RNA, 64 nt, Homo Sapiens; identical to SEQ ID NO: 44501

SEQ ID NO: 60585 - RNA, 64 nt, Homo Sapiens; identical to SEQ ID NO: 44502

SEQ ID NO: 60586 - RNA, 64 nt, Homo Sapiens; identical to SEQ ID NO: 44503

SEQ ID NO: 60587 - RNA, 64 nt, Homo Sapiens; identical to SEQ ID NO: 44504

SEQ ID NO: 60588 - RNA, 64 nt, Homo Sapiens; identical to SEQ ID NO: 44505

SEQ ID NO: 60589 - RNA, 64 nt, Homo Sapiens; identical to SEQ ID NO: 44506

SEQ ID NO: 60590 - RNA, 64 nt, Homo Sapiens; identical to SEQ ID NO: 44507

SEQ ID NO: 60591 - RNA, 64 nt, Homo Sapiens; identical to SEQ ID NO: 44508

SEQ ID NO: 60592 - RNA, 64 nt, Homo Sapiens; identical to SEQ ID NO: 44509

SEQ ID NO: 60593 - RNA, 64 nt, Homo Sapiens; identical to SEQ ID NO: 44510

SEQ ID NO: 60594 - RNA, 64 nt, Homo Sapiens; identical to SEQ ID NO: 44511

SEQ ID NO: 60595 - RNA, 64 nt, Homo Sapiens; identical to SEQ ID NO: 44512

SEQ ID NO: 60596 - RNA, 64 nt, Homo Sapiens; identical to SEQ ID NO: 44513

SEQ ID NO: 60597 - RNA, 64 nt, Homo Sapiens; identical to SEQ ID NO: 44514

SEQ ID NO: 60598 - RNA, 64 nt, Homo Sapiens; identical to SEQ ID NO: 44515

SEQ ID NO: 60599 - RNA, 64 nt, Homo Sapiens; identical to SEQ ID NO: 44516

SEQ ID NO: 60600 - RNA, 64 nt, Homo Sapiens; identical to SEQ ID NO: 44517

SEQ ID NO: 60601 - RNA, 64 nt, Homo Sapiens; identical to SEQ ID NO: 44518

SEQ ID NO: 60602 - RNA, 64 nt, Homo Sapiens; identical to SEQ ID NO: 44519

SEQ ID NO: 60603 - RNA, 64 nt, Homo Sapiens; identical to SEQ ID NO: 44520

SEQ ID NO: 60604 - RNA, 64 nt, Homo Sapiens; identical to SEQ ID NO: 44521

SEQ ID NO: 60605 - RNA, 64 nt, Homo Sapiens; identical to SEQ ID NO: 44522

SEQ ID NO: 60606 - RNA, 64 nt, Homo Sapiens; identical to SEQ ID NO: 44523

SEQ ID NO: 60607 - RNA, 64 nt, Homo Sapiens; identical to SEQ ID NO: 44524

SEQ ID NO: 60608 - RNA, 64 nt, Homo Sapiens; identical to SEQ ID NO: 44525

SEQ ID NO: 60609 - RNA, 64 nt, Homo Sapiens; identical to SEQ ID NO: 44526

SEQ ID NO: 60610 - RNA, 64 nt, Homo Sapiens; identical to SEQ ID NO: 44527

SEQ ID NO: 60611 - RNA, 64 nt, Homo Sapiens; identical to SEQ ID NO: 44528

SEQ ID NO: 60612 - RNA, 64 nt, Homo Sapiens; identical to SEQ ID NO: 44529

SEQ ID NO: 60613 - RNA, 64 nt, Homo Sapiens; identical to SEQ ID NO: 44530

SEQ ID NO: 60614 - RNA, 64 nt, Homo Sapiens; identical to SEQ ID NO: 44531

SEQ ID NO: 60615 - RNA, 64 nt, Homo Sapiens; identical to SEQ ID NO: 44532

SEQ ID NO: 60616 - RNA, 64 nt, Homo Sapiens; identical to SEQ ID NO: 44533

SEQ ID NO: 60617 - RNA, 64 nt, Homo Sapiens; identical to SEQ ID NO: 44534

SEQ ID NO: 60618 - RNA, 64 nt, Homo Sapiens; identical to SEQ ID NO: 44535

SEQ ID NO: 60619 - RNA, 64 nt, Homo Sapiens; identical to SEQ ID NO: 44536

SEQ ID NO: 60620 - RNA, 64 nt, Homo Sapiens; identical to SEQ ID NO: 44537

SEQ ID NO: 60621 - RNA, 64 nt, Homo Sapiens; identical to SEQ ID NO: 44538

SEQ ID NO: 60622 - RNA, 64 nt, Homo Sapiens; identical to SEQ ID NO: 44539

SEQ ID NO: 60623 - RNA, 64 nt, Homo Sapiens; identical to SEQ ID NO: 44540

SEQ ID NO: 60624 - RNA, 64 nt, Homo Sapiens; identical to SEQ ID NO: 44541

SEQ ID NO: 60625 - RNA, 64 nt, Homo Sapiens; identical to SEQ ID NO: 44542

SEQ ID NO: 60626 - RNA, 64 nt, Homo Sapiens; identical to SEQ ID NO: 44543

SEQ ID NO: 60627 - RNA, 64 nt, Homo Sapiens; identical to SEQ ID NO: 44544

SEQ ID NO: 60628 - RNA, 64 nt, Homo Sapiens; identical to SEQ ID NO: 44545

SEQ ID NO: 60629 - RNA, 64 nt, Homo Sapiens; identical to SEQ ID NO: 44546

SEQ ID NO: 60630 - RNA, 64 nt, Homo Sapiens; identical to SEQ ID NO: 44547

SEQ ID NO: 60631 - RNA, 64 nt, Homo Sapiens; identical to SEQ ID NO: 44548

SEQ ID NO: 60632 - RNA, 64 nt, Homo Sapiens; identical to SEQ ID NO: 44549

SEQ ID NO: 60633 - RNA, 64 nt, Homo Sapiens; identical to SEQ ID NO: 44550

SEQ ID NO: 60634 - RNA, 64 nt, Homo Sapiens; identical to SEQ ID NO: 44551

SEQ ID NO: 60635 - RNA, 64 nt, Homo Sapiens; identical to SEQ ID NO: 44552

SEQ ID NO: 60636 - RNA, 64 nt, Homo Sapiens; identical to SEQ ID NO: 44553

SEQ ID NO: 60637 - RNA, 64 nt, Homo Sapiens; identical to SEQ ID NO: 44554

SEQ ID NO: 60638 - RNA, 64 nt, Homo Sapiens; identical to SEQ ID NO: 44555

SEQ ID NO: 60639 - RNA, 64 nt, Homo Sapiens; identical to SEQ ID NO: 44556

SEQ ID NO: 60640 - RNA, 64 nt, Homo Sapiens; identical to SEQ ID NO: 44557

SEQ ID NO: 60641 - RNA, 64 nt, Homo Sapiens; identical to SEQ ID NO: 44558

SEQ ID NO: 60642 - RNA, 64 nt, Homo Sapiens; identical to SEQ ID NO: 44559

SEQ ID NO: 60643 - RNA, 64 nt, Homo Sapiens; identical to SEQ ID NO: 44560

SEQ ID NO: 60644 - RNA, 64 nt, Homo Sapiens; identical to SEQ ID NO: 44561

SEQ ID NO: 60645 - RNA, 64 nt, Homo Sapiens; identical to SEQ ID NO: 44562

SEQ ID NO: 60646 - RNA, 64 nt, Homo Sapiens; identical to SEQ ID NO: 44563

SEQ ID NO: 60647 - RNA, 64 nt, Homo Sapiens; identical to SEQ ID NO: 44564

SEQ ID NO: 60648 - RNA, 64 nt, Homo Sapiens; identical to SEQ ID NO: 44565

SEQ ID NO: 60649 - RNA, 64 nt, Homo Sapiens; identical to SEQ ID NO: 44566

SEQ ID NO: 60650 - RNA, 64 nt, Homo Sapiens; identical to SEQ ID NO: 44567

SEQ ID NO: 60651 - RNA, 64 nt, Homo Sapiens; identical to SEQ ID NO: 44568

SEQ ID NO: 60652 - RNA, 64 nt, Homo Sapiens; identical to SEQ ID NO: 44569

SEQ ID NO: 60653 - RNA, 64 nt, Homo Sapiens; identical to SEQ ID NO: 44570

SEQ ID NO: 60654 - RNA, 64 nt, Homo Sapiens; identical to SEQ ID NO: 44571

SEQ ID NO: 60655 - RNA, 64 nt, Homo Sapiens; identical to SEQ ID NO: 44572

SEQ ID NO: 60656 - RNA, 64 nt, Homo Sapiens; identical to SEQ ID NO: 44573

SEQ ID NO: 60657 - RNA, 64 nt, Homo Sapiens; identical to SEQ ID NO: 44574

SEQ ID NO: 60658 - RNA, 64 nt, Homo Sapiens; identical to SEQ ID NO: 44575

SEQ ID NO: 60659 - RNA, 64 nt, Homo Sapiens; identical to SEQ ID NO: 44576

SEQ ID NO: 60660 - RNA, 64 nt, Homo Sapiens; identical to SEQ ID NO: 44577

SEQ ID NO: 60661 - RNA, 64 nt, Homo Sapiens; identical to SEQ ID NO: 44578

SEQ ID NO: 60662 - RNA, 64 nt, Homo Sapiens; identical to SEQ ID NO: 44579

SEQ ID NO: 60663 - RNA, 64 nt, Homo Sapiens; identical to SEQ ID NO: 44580

SEQ ID NO: 60664 - RNA, 64 nt, Homo Sapiens; identical to SEQ ID NO: 44581

SEQ ID NO: 60665 - RNA, 64 nt, Homo Sapiens; identical to SEQ ID NO: 44582

SEQ ID NO: 60666 - RNA, 64 nt, Homo Sapiens; identical to SEQ ID NO: 44583

SEQ ID NO: 60667 - RNA, 64 nt, Homo Sapiens; identical to SEQ ID NO: 44584

SEQ ID NO: 60668 - RNA, 64 nt, Homo Sapiens; identical to SEQ ID NO: 44585

SEQ ID NO: 60669 - RNA, 64 nt, Homo Sapiens; identical to SEQ ID NO: 44586

SEQ ID NO: 60670 - RNA, 64 nt, Homo Sapiens; identical to SEQ ID NO: 44587

SEQ ID NO: 60671 - RNA, 64 nt, Homo Sapiens; identical to SEQ ID NO: 44588

SEQ ID NO: 60672 - RNA, 64 nt, Homo Sapiens; identical to SEQ ID NO: 44589

SEQ ID NO: 60673 - RNA, 64 nt, Homo Sapiens; identical to SEQ ID NO: 44590

SEQ ID NO: 60674 - RNA, 64 nt, Homo Sapiens; identical to SEQ ID NO: 44591

SEQ ID NO: 60675 - RNA, 64 nt, Homo Sapiens; identical to SEQ ID NO: 44592

SEQ ID NO: 60676 - RNA, 64 nt, Homo Sapiens; identical to SEQ ID NO: 44593

SEQ ID NO: 60677 - RNA, 64 nt, Homo Sapiens; identical to SEQ ID NO: 44594

SEQ ID NO: 60678 - RNA, 64 nt, Homo Sapiens; identical to SEQ ID NO: 44595

SEQ ID NO: 60679 - RNA, 64 nt, Homo Sapiens; identical to SEQ ID NO: 44596

SEQ ID NO: 60680 - RNA, 64 nt, Homo Sapiens; identical to SEQ ID NO: 44597

SEQ ID NO: 60681 - RNA, 64 nt, Homo Sapiens; identical to SEQ ID NO: 44598

SEQ ID NO: 60682 - RNA, 64 nt, Homo Sapiens; identical to SEQ ID NO: 44599

SEQ ID NO: 60683 - RNA, 64 nt, Homo Sapiens; identical to SEQ ID NO: 44600

SEQ ID NO: 60684 - RNA, 64 nt, Homo Sapiens; identical to SEQ ID NO: 44601

SEQ ID NO: 60685 - RNA, 64 nt, Homo Sapiens; identical to SEQ ID NO: 44602

SEQ ID NO: 60686 - RNA, 64 nt, Homo Sapiens; identical to SEQ ID NO: 44603

SEQ ID NO: 60687 - RNA, 64 nt, Homo Sapiens; identical to SEQ ID NO: 44604

SEQ ID NO: 60688 - RNA, 64 nt, Homo Sapiens; identical to SEQ ID NO: 44605

SEQ ID NO: 60689 - RNA, 64 nt, Homo Sapiens; identical to SEQ ID NO: 44606

SEQ ID NO: 60690 - RNA, 64 nt, Homo Sapiens; identical to SEQ ID NO: 44607

SEQ ID NO: 60691 - RNA, 64 nt, Homo Sapiens; identical to SEQ ID NO: 44608

SEQ ID NO: 60692 - RNA, 64 nt, Homo Sapiens; identical to SEQ ID NO: 44609

SEQ ID NO: 60693 - RNA, 64 nt, Homo Sapiens; identical to SEQ ID NO: 44610

SEQ ID NO: 60694 - RNA, 56 nt, Homo Sapiens; identical to SEQ ID NO: 44611

SEQ ID NO: 60695 - RNA, 64 nt, Homo Sapiens; identical to SEQ ID NO: 44612

SEQ ID NO: 60696 - RNA, 64 nt, Homo Sapiens; identical to SEQ ID NO: 44613

SEQ ID NO: 60697 - RNA, 64 nt, Homo Sapiens; identical to SEQ ID NO: 44614

SEQ ID NO: 60698 - RNA, 64 nt, Homo Sapiens; identical to SEQ ID NO: 44615

SEQ ID NO: 60699 - RNA, 64 nt, Homo Sapiens; identical to SEQ ID NO: 44616

SEQ ID NO: 60700 - RNA, 64 nt, Homo Sapiens; identical to SEQ ID NO: 44617

SEQ ID NO: 60701 - RNA, 64 nt, Homo Sapiens; identical to SEQ ID NO: 44618

SEQ ID NO: 60702 - RNA, 64 nt, Homo Sapiens; identical to SEQ ID NO: 44619

SEQ ID NO: 60703 - RNA, 64 nt, Homo Sapiens; identical to SEQ ID NO: 44620

SEQ ID NO: 60704 - RNA, 64 nt, Homo Sapiens; identical to SEQ ID NO: 44621

SEQ ID NO: 60705 - RNA, 64 nt, Homo Sapiens; identical to SEQ ID NO: 44622

SEQ ID NO: 60706 - RNA, 64 nt, Homo Sapiens; identical to SEQ ID NO: 44623

SEQ ID NO: 60707 - RNA, 64 nt, Homo Sapiens; identical to SEQ ID NO: 44624

SEQ ID NO: 60708 - RNA, 64 nt, Homo Sapiens; identical to SEQ ID NO: 44625

SEQ ID NO: 60709 - RNA, 64 nt, Homo Sapiens; identical to SEQ ID NO: 44626

SEQ ID NO: 60710 - RNA, 64 nt, Homo Sapiens; identical to SEQ ID NO: 44627

SEQ ID NO: 60711 - RNA, 64 nt, Homo Sapiens; identical to SEQ ID NO: 44628

SEQ ID NO: 60712 - RNA, 64 nt, Homo Sapiens; identical to SEQ ID NO: 44629

SEQ ID NO: 60713 - RNA, 64 nt, Homo Sapiens; identical to SEQ ID NO: 44630

SEQ ID NO: 60714 - RNA, 64 nt, Homo Sapiens; identical to SEQ ID NO: 44631

SEQ ID NO: 60715 - RNA, 64 nt, Homo Sapiens; identical to SEQ ID NO: 44632

SEQ ID NO: 60716 - RNA, 64 nt, Homo Sapiens; identical to SEQ ID NO: 44633

SEQ ID NO: 60717 - RNA, 64 nt, Homo Sapiens; identical to SEQ ID NO: 44634

SEQ ID NO: 60718 - RNA, 64 nt, Homo Sapiens; identical to SEQ ID NO: 44635

SEQ ID NO: 60719 - RNA, 64 nt, Homo Sapiens; identical to SEQ ID NO: 44636

SEQ ID NO: 60720 - RNA, 64 nt, Homo Sapiens; identical to SEQ ID NO: 44637

SEQ ID NO: 60721 - RNA, 64 nt, Homo Sapiens; identical to SEQ ID NO: 44638

SEQ ID NO: 60722 - RNA, 64 nt, Homo Sapiens; identical to SEQ ID NO: 44639

SEQ ID NO: 60723 - RNA, 64 nt, Homo Sapiens; identical to SEQ ID NO: 44640

SEQ ID NO: 60724 - RNA, 64 nt, Homo Sapiens; identical to SEQ ID NO: 44641

SEQ ID NO: 60725 - RNA, 64 nt, Homo Sapiens; identical to SEQ ID NO: 44642

SEQ ID NO: 60726 - RNA, 64 nt, Homo Sapiens; identical to SEQ ID NO: 44643

SEQ ID NO: 60727 - RNA, 64 nt, Homo Sapiens; identical to SEQ ID NO: 44644

SEQ ID NO: 60728 - RNA, 64 nt, Homo Sapiens; identical to SEQ ID NO: 44645

SEQ ID NO: 60729 - RNA, 64 nt, Homo Sapiens; identical to SEQ ID NO: 44646

SEQ ID NO: 60730 - RNA, 64 nt, Homo Sapiens; identical to SEQ ID NO: 44647

SEQ ID NO: 60731 - RNA, 64 nt, Homo Sapiens; identical to SEQ ID NO: 44648

SEQ ID NO: 60732 - RNA, 64 nt, Homo Sapiens; identical to SEQ ID NO: 44649

SEQ ID NO: 60733 - RNA, 64 nt, Homo Sapiens; identical to SEQ ID NO: 44650

SEQ ID NO: 60734 - RNA, 64 nt, Homo Sapiens; identical to SEQ ID NO: 44651

SEQ ID NO: 60735 - RNA, 64 nt, Homo Sapiens; identical to SEQ ID NO: 44652

SEQ ID NO: 60736 - RNA, 64 nt, Homo Sapiens; identical to SEQ ID NO: 44653

SEQ ID NO: 60737 - RNA, 64 nt, Homo Sapiens; identical to SEQ ID NO: 44654

SEQ ID NO: 60738 - RNA, 64 nt, Homo Sapiens; identical to SEQ ID NO: 44655

SEQ ID NO: 60739 - RNA, 64 nt, Homo Sapiens; identical to SEQ ID NO: 44656

SEQ ID NO: 60740 - RNA, 64 nt, Homo Sapiens; identical to SEQ ID NO: 44657

SEQ ID NO: 60741 - RNA, 64 nt, Homo Sapiens; identical to SEQ ID NO: 44658

SEQ ID NO: 60742 - RNA, 64 nt, Homo Sapiens; identical to SEQ ID NO: 44659

SEQ ID NO: 60743 - RNA, 64 nt, Homo Sapiens; identical to SEQ ID NO: 44660

SEQ ID NO: 60744 - RNA, 64 nt, Homo Sapiens; identical to SEQ ID NO: 44661

SEQ ID NO: 60745 - RNA, 64 nt, Homo Sapiens; identical to SEQ ID NO: 44662

SEQ ID NO: 60746 - RNA, 64 nt, Homo Sapiens; identical to SEQ ID NO: 44663

SEQ ID NO: 60747 - RNA, 64 nt, Homo Sapiens; identical to SEQ ID NO: 44664

SEQ ID NO: 60748 - RNA, 64 nt, Homo Sapiens; identical to SEQ ID NO: 44665

SEQ ID NO: 60749 - RNA, 64 nt, Homo Sapiens; identical to SEQ ID NO: 44666

SEQ ID NO: 60750 - RNA, 64 nt, Homo Sapiens; identical to SEQ ID NO: 44667

SEQ ID NO: 60751 - RNA, 64 nt, Homo Sapiens; identical to SEQ ID NO: 44668

SEQ ID NO: 60752 - RNA, 64 nt, Homo Sapiens; identical to SEQ ID NO: 44669

SEQ ID NO: 60753 - RNA, 64 nt, Homo Sapiens; identical to SEQ ID NO: 44670

SEQ ID NO: 60754 - RNA, 64 nt, Homo Sapiens; identical to SEQ ID NO: 44671

SEQ ID NO: 60755 - RNA, 64 nt, Homo Sapiens; identical to SEQ ID NO: 44672

SEQ ID NO: 60756 - RNA, 64 nt, Homo Sapiens; identical to SEQ ID NO: 44673

SEQ ID NO: 60757 - RNA, 64 nt, Homo Sapiens; identical to SEQ ID NO: 44674

SEQ ID NO: 60758 - RNA, 64 nt, Homo Sapiens; identical to SEQ ID NO: 44675

SEQ ID NO: 60759 - RNA, 64 nt, Homo Sapiens; identical to SEQ ID NO: 44676

SEQ ID NO: 60760 - RNA, 64 nt, Homo Sapiens; identical to SEQ ID NO: 44677

SEQ ID NO: 60761 - RNA, 64 nt, Homo Sapiens; identical to SEQ ID NO: 44678

SEQ ID NO: 60762 - RNA, 64 nt, Homo Sapiens; identical to SEQ ID NO: 44679

SEQ ID NO: 60763 - RNA, 64 nt, Homo Sapiens; identical to SEQ ID NO: 44680

SEQ ID NO: 60764 - RNA, 64 nt, Homo Sapiens; identical to SEQ ID NO: 44681

SEQ ID NO: 60765 - RNA, 64 nt, Homo Sapiens; identical to SEQ ID NO: 44682

SEQ ID NO: 60766 - RNA, 64 nt, Homo Sapiens; identical to SEQ ID NO: 44683

SEQ ID NO: 60767 - RNA, 64 nt, Homo Sapiens; identical to SEQ ID NO: 44684

SEQ ID NO: 60768 - RNA, 64 nt, Homo Sapiens; identical to SEQ ID NO: 44685

SEQ ID NO: 60769 - RNA, 64 nt, Homo Sapiens; identical to SEQ ID NO: 44686

SEQ ID NO: 60770 - RNA, 64 nt, Homo Sapiens; identical to SEQ ID NO: 44687

SEQ ID NO: 60771 - RNA, 64 nt, Homo Sapiens; identical to SEQ ID NO: 44688

SEQ ID NO: 60772 - RNA, 64 nt, Homo Sapiens; identical to SEQ ID NO: 44689

SEQ ID NO: 60773 - RNA, 64 nt, Homo Sapiens; identical to SEQ ID NO: 44690

SEQ ID NO: 60774 - RNA, 64 nt, Homo Sapiens; identical to SEQ ID NO: 44691

SEQ ID NO: 60775 - RNA, 64 nt, Homo Sapiens; identical to SEQ ID NO: 44692

SEQ ID NO: 60776 - RNA, 64 nt, Homo Sapiens; identical to SEQ ID NO: 44693

SEQ ID NO: 60777 - RNA, 64 nt, Homo Sapiens; identical to SEQ ID NO: 44694

SEQ ID NO: 60778 - RNA, 64 nt, Homo Sapiens; identical to SEQ ID NO: 44695

SEQ ID NO: 60779 - RNA, 64 nt, Homo Sapiens; identical to SEQ ID NO: 44696

SEQ ID NO: 60780 - RNA, 64 nt, Homo Sapiens; identical to SEQ ID NO: 44697

SEQ ID NO: 60781 - RNA, 64 nt, Homo Sapiens; identical to SEQ ID NO: 44698

SEQ ID NO: 60782 - RNA, 64 nt, Homo Sapiens; identical to SEQ ID NO: 44699

SEQ ID NO: 60783 - RNA, 64 nt, Homo Sapiens; identical to SEQ ID NO: 44700

SEQ ID NO: 60784 - RNA, 64 nt, Homo Sapiens; identical to SEQ ID NO: 44701

SEQ ID NO: 60785 - RNA, 64 nt, Homo Sapiens; identical to SEQ ID NO: 44702

SEQ ID NO: 60786 - RNA, 64 nt, Homo Sapiens; identical to SEQ ID NO: 44703

SEQ ID NO: 60787 - RNA, 64 nt, Homo Sapiens; identical to SEQ ID NO: 44704

SEQ ID NO: 60788 - RNA, 64 nt, Homo Sapiens; identical to SEQ ID NO: 44705

SEQ ID NO: 60789 - RNA, 64 nt, Homo Sapiens; identical to SEQ ID NO: 44706

SEQ ID NO: 60790 - RNA, 64 nt, Homo Sapiens; identical to SEQ ID NO: 44707

SEQ ID NO: 60791 - RNA, 64 nt, Homo Sapiens; identical to SEQ ID NO: 44708

SEQ ID NO: 60792 - RNA, 64 nt, Homo Sapiens; identical to SEQ ID NO: 44709

SEQ ID NO: 60793 - RNA, 64 nt, Homo Sapiens; identical to SEQ ID NO: 44710

SEQ ID NO: 60794 - RNA, 64 nt, Homo Sapiens; identical to SEQ ID NO: 44711

SEQ ID NO: 60795 - RNA, 64 nt, Homo Sapiens; identical to SEQ ID NO: 44712

SEQ ID NO: 60796 - RNA, 64 nt, Homo Sapiens; identical to SEQ ID NO: 44713

SEQ ID NO: 60797 - RNA, 64 nt, Homo Sapiens; identical to SEQ ID NO: 44714

SEQ ID NO: 60798 - RNA, 64 nt, Homo Sapiens; identical to SEQ ID NO: 44715

SEQ ID NO: 60799 - RNA, 64 nt, Homo Sapiens; identical to SEQ ID NO: 44716

SEQ ID NO: 60800 - RNA, 64 nt, Homo Sapiens; identical to SEQ ID NO: 44717

SEQ ID NO: 60801 - RNA, 64 nt, Homo Sapiens; identical to SEQ ID NO: 44718

SEQ ID NO: 60802 - RNA, 64 nt, Homo Sapiens; identical to SEQ ID NO: 44719

SEQ ID NO: 60803 - RNA, 64 nt, Homo Sapiens; identical to SEQ ID NO: 44720

SEQ ID NO: 60804 - RNA, 64 nt, Homo Sapiens; identical to SEQ ID NO: 44721

SEQ ID NO: 60805 - RNA, 64 nt, Homo Sapiens; identical to SEQ ID NO: 44722

SEQ ID NO: 60806 - RNA, 64 nt, Homo Sapiens; identical to SEQ ID NO: 44723

SEQ ID NO: 60807 - RNA, 64 nt, Homo Sapiens; identical to SEQ ID NO: 44724

SEQ ID NO: 60808 - RNA, 64 nt, Homo Sapiens; identical to SEQ ID NO: 44725

SEQ ID NO: 60809 - RNA, 64 nt, Homo Sapiens; identical to SEQ ID NO: 44726

SEQ ID NO: 60810 - RNA, 64 nt, Homo Sapiens; identical to SEQ ID NO: 44727

SEQ ID NO: 60811 - RNA, 64 nt, Homo Sapiens; identical to SEQ ID NO: 44728

SEQ ID NO: 60812 - RNA, 64 nt, Homo Sapiens; identical to SEQ ID NO: 44729

SEQ ID NO: 60813 - RNA, 64 nt, Homo Sapiens; identical to SEQ ID NO: 44730

SEQ ID NO: 60814 - RNA, 64 nt, Homo Sapiens; identical to SEQ ID NO: 44731

SEQ ID NO: 60815 - RNA, 64 nt, Homo Sapiens; identical to SEQ ID NO: 44732

SEQ ID NO: 60816 - RNA, 64 nt, Homo Sapiens; identical to SEQ ID NO: 44733

SEQ ID NO: 60817 - RNA, 64 nt, Homo Sapiens; identical to SEQ ID NO: 44734

SEQ ID NO: 60818 - RNA, 64 nt, Homo Sapiens; identical to SEQ ID NO: 44735

SEQ ID NO: 60819 - RNA, 64 nt, Homo Sapiens; identical to SEQ ID NO: 44736

SEQ ID NO: 60820 - RNA, 64 nt, Homo Sapiens; identical to SEQ ID NO: 44737

SEQ ID NO: 60821 - RNA, 64 nt, Homo Sapiens; identical to SEQ ID NO: 44738

SEQ ID NO: 60822 - RNA, 64 nt, Homo Sapiens; identical to SEQ ID NO: 44739

SEQ ID NO: 60823 - RNA, 64 nt, Homo Sapiens; identical to SEQ ID NO: 44740

SEQ ID NO: 60824 - RNA, 64 nt, Homo Sapiens; identical to SEQ ID NO: 44741

SEQ ID NO: 60825 - RNA, 64 nt, Homo Sapiens; identical to SEQ ID NO: 44742

SEQ ID NO: 60826 - RNA, 64 nt, Homo Sapiens; identical to SEQ ID NO: 44743

SEQ ID NO: 60827 - RNA, 64 nt, Homo Sapiens; identical to SEQ ID NO: 44744

SEQ ID NO: 60828 - RNA, 64 nt, Homo Sapiens; identical to SEQ ID NO: 44745

SEQ ID NO: 60829 - RNA, 64 nt, Homo Sapiens; identical to SEQ ID NO: 44746

SEQ ID NO: 60830 - RNA, 64 nt, Homo Sapiens; identical to SEQ ID NO: 44747

SEQ ID NO: 60831 - RNA, 64 nt, Homo Sapiens; identical to SEQ ID NO: 44748

SEQ ID NO: 60832 - RNA, 64 nt, Homo Sapiens; identical to SEQ ID NO: 44749

SEQ ID NO: 60833 - RNA, 64 nt, Homo Sapiens; identical to SEQ ID NO: 44750

SEQ ID NO: 60834 - RNA, 64 nt, Homo Sapiens; identical to SEQ ID NO: 44751

SEQ ID NO: 60835 - RNA, 64 nt, Homo Sapiens; identical to SEQ ID NO: 44752

SEQ ID NO: 60836 - RNA, 64 nt, Homo Sapiens; identical to SEQ ID NO: 44753

SEQ ID NO: 60837 - RNA, 64 nt, Homo Sapiens; identical to SEQ ID NO: 44754

SEQ ID NO: 60838 - RNA, 64 nt, Homo Sapiens; identical to SEQ ID NO: 44755

SEQ ID NO: 60839 - RNA, 64 nt, Homo Sapiens; identical to SEQ ID NO: 44756

SEQ ID NO: 60840 - RNA, 64 nt, Homo Sapiens; identical to SEQ ID NO: 44757

SEQ ID NO: 60841 - RNA, 64 nt, Homo Sapiens; identical to SEQ ID NO: 44758

SEQ ID NO: 60842 - RNA, 64 nt, Homo Sapiens; identical to SEQ ID NO: 44759

SEQ ID NO: 60843 - RNA, 64 nt, Homo Sapiens; identical to SEQ ID NO: 44760

SEQ ID NO: 60844 - RNA, 64 nt, Homo Sapiens; identical to SEQ ID NO: 44761

SEQ ID NO: 60845 - RNA, 64 nt, Homo Sapiens; identical to SEQ ID NO: 44762

SEQ ID NO: 60846 - RNA, 64 nt, Homo Sapiens; identical to SEQ ID NO: 44763

SEQ ID NO: 60847 - RNA, 64 nt, Homo Sapiens; identical to SEQ ID NO: 44764

SEQ ID NO: 60848 - RNA, 64 nt, Homo Sapiens; identical to SEQ ID NO: 44765

SEQ ID NO: 60849 - RNA, 64 nt, Homo Sapiens; identical to SEQ ID NO: 44766

SEQ ID NO: 60850 - RNA, 64 nt, Homo Sapiens; identical to SEQ ID NO: 44767

SEQ ID NO: 60851 - RNA, 64 nt, Homo Sapiens; identical to SEQ ID NO: 44768

SEQ ID NO: 60852 - RNA, 64 nt, Homo Sapiens; identical to SEQ ID NO: 44769

SEQ ID NO: 60853 - RNA, 64 nt, Homo Sapiens; identical to SEQ ID NO: 44770

SEQ ID NO: 60854 - RNA, 64 nt, Homo Sapiens; identical to SEQ ID NO: 44771

SEQ ID NO: 60855 - RNA, 64 nt, Homo Sapiens; identical to SEQ ID NO: 44772

SEQ ID NO: 60856 - RNA, 64 nt, Homo Sapiens; identical to SEQ ID NO: 44773

SEQ ID NO: 60857 - RNA, 64 nt, Homo Sapiens; identical to SEQ ID NO: 44774

SEQ ID NO: 60858 - RNA, 64 nt, Homo Sapiens; identical to SEQ ID NO: 44775

SEQ ID NO: 60859 - RNA, 64 nt, Homo Sapiens; identical to SEQ ID NO: 44776

SEQ ID NO: 60860 - RNA, 57 nt, Homo Sapiens; identical to SEQ ID NO: 44777

SEQ ID NO: 60861 - RNA, 64 nt, Homo Sapiens; identical to SEQ ID NO: 44778

SEQ ID NO: 60862 - RNA, 64 nt, Homo Sapiens; identical to SEQ ID NO: 44779

SEQ ID NO: 60863 - RNA, 64 nt, Homo Sapiens; identical to SEQ ID NO: 44780

SEQ ID NO: 60864 - RNA, 64 nt, Homo Sapiens; identical to SEQ ID NO: 44781

SEQ ID NO: 60865 - RNA, 64 nt, Homo Sapiens; identical to SEQ ID NO: 44782

SEQ ID NO: 60866 - RNA, 64 nt, Homo Sapiens; identical to SEQ ID NO: 44783

SEQ ID NO: 60867 - RNA, 64 nt, Homo Sapiens; identical to SEQ ID NO: 44784

SEQ ID NO: 60868 - RNA, 64 nt, Homo Sapiens; identical to SEQ ID NO: 44785

SEQ ID NO: 60869 - RNA, 64 nt, Homo Sapiens; identical to SEQ ID NO: 44786

SEQ ID NO: 60870 - RNA, 64 nt, Homo Sapiens; identical to SEQ ID NO: 44773

SEQ ID NO: 60871 - RNA, 64 nt, Homo Sapiens; identical to SEQ ID NO: 44788

SEQ ID NO: 60872 - RNA, 63 nt, Homo Sapiens
uuucauacccuuguaaguggguuaugugguggguauggucaguuuuuucuuuuuucuuuucuu

SEQ ID NO: 60873 - RNA, 63 nt, Homo Sapiens
gccaccacgccuggccaguuucuucauuuuacauauggucacauuggcgccuagaacaguuag

SEQ ID NO: 60874 - RNA, 63 nt, Homo Sapiens
aacuuccucuaaggauaauguauaaucauaguauauggucaaguccaagaaaucgauguuacc

SEQ ID NO: 60875 - RNA, 63 nt, Homo Sapiens
accaaaaaugaaagaggccaucacagcuaauccuauggucaccaaaaggauuagaaagaaaca

SEQ ID NO: 60876 - RNA, 63 nt, Homo Sapiens
aaaaggauuagaaagaaauaucauagcugauccuauggucaccaccaaaagugaaagaggcca

SEQ ID NO: 60877 - RNA, 63 nt, Homo Sapiens
uccaagaaaucgauguuaccuauaaucauaguauauggucaagagcuuccucuaaggauaaua

SEQ ID NO: 60878 - RNA, 64 nt, Homo Sapiens
cucagcuagcauuacccuucuggauggucuggcccaccuccagcaaauccaguuuccauggccc

SEQ ID NO: 60879 - RNA, 64 nt, Homo Sapiens
ccuucggacuuaaaccugccuaggauaggaugaucaccuccaguggcaacagaauuugaauauc

SEQ ID NO: 60880 - RNA, 64 nt, Homo Sapiens
acgcccauguuugcagcugauacuuguuugggcacaccuccaaguucucgggauuagaaggaca

SEQ ID NO: 60881 - RNA, 64 nt, Homo Sapiens
gaggcaauucacuugccagcacagauggccaacccaccuccagauuccccagugcuuccacacc

SEQ ID NO: 60882 - RNA, 64 nt, Homo Sapiens
aacaccucaucauccuucucaucgcuaacaccaccaccuccaucggcacccaagcgggcaucau

SEQ ID NO: 60883 - RNA, 64 nt, Homo Sapiens
ucugggucccagaccuggcccgaccccucugcuucaccuccagcucugcugcuccucuacucuu

SEQ ID NO: 60884 - RNA, 64 nt, Homo Sapiens
gaggacgcuucgucuucggcaggugacuuguucccaccuccagggucagaggagguguggucag

SEQ ID NO: 60885 - RNA, 64 nt, Homo Sapiens
cuucggaaggccuuccuggaggagggacaggacccaccuccaucuccacacccacaagcuaccu

SEQ ID NO: 60886 - RNA, 64 nt, Homo Sapiens
cccucaccacucacucaaccaggccucugggagccaccuccaauggccagggccaugcagaugg

SEQ ID NO: 60887 - RNA, 64 nt, Homo Sapiens
ccaacguagaccugcaggugaggcaaggaccgaacaccuccaccaggaauugagcucaugaagc

SEQ ID NO: 60888 - RNA, 64 nt, Homo Sapiens
auaacaaagaagaagcaaugcuuucuugggccugcaccuccaagaauuaagauuuuuacuucau

SEQ ID NO: 60889 - RNA, 64 nt, Homo Sapiens
acccagagcuuaagccacaguccugcucaggcuacaccuccaagggugggaccaggcccaccuu

SEQ ID NO: 60890 - RNA, 64 nt, Homo Sapiens
aucaauucaucaguaaggucagaugcuguuugcacaccuccagcaauagggugcucacugccuc

SEQ ID NO: 60891 - RNA, 64 nt, Homo Sapiens
gccaucggguagcgauggucuaugccauggggaacaccuccauugguguggccaagcugccccc

SEQ ID NO: 60892 - RNA, 64 nt, Homo Sapiens
cuucccagcccugagaccacuggucacaguuggccaccuccaacgggagaccuuguccuuggcc

SEQ ID NO: 60893 - RNA, 64 nt, Homo Sapiens
gccacaauaaaccuguaccccaccagcccccuuucaccuccagucagcacaccggugcuggcca

SEQ ID NO: 60894 - RNA, 64 nt, Homo Sapiens
gugcaggcagcugccggaggccgcugcagagccgcaccuccauugccagccggccacgcccacg

SEQ ID NO: 60895 - RNA, 64 nt, Homo Sapiens
cuugagagcucagcaccaugaaggcucugccagacaccuccaagaaagugccaagccauuugug

SEQ ID NO: 60896 - RNA, 64 nt, Homo Sapiens
gccagccagccccgucaggggauaggcugguccucaccuccagacaguucauauaccugccuga

SEQ ID NO: 60897 - RNA, 64 nt, Homo Sapiens
aagguaaugguggcagaaccaacugcgcagcaggcaccuccagacuuagagcgagagcagagca

SEQ ID NO: 60898 - RNA, 64 nt, Homo Sapiens
acgaaugaaaugcuccguauuugccagcucagcgcaccuccacaguguucuuagaauucgcauu

SEQ ID NO: 60899 - RNA, 64 nt, Homo Sapiens
cucggcuuuccccggggggcgaggagccuguguccaccuccaguauggaagggggugccucucg

SEQ ID NO: 60900 - RNA, 64 nt, Homo Sapiens
ggccaggugccugaggacagcacugaaggccgugcaccuccaccuccagccuccagucaccuca

SEQ ID NO: 60901 - RNA, 64 nt, Homo Sapiens
gugccugaggacagcacugaaggccgugcaccuccaccuccagccuccagucaccucaccuagc

SEQ ID NO: 60902 - RNA, 64 nt, Homo Sapiens
uggacaaggccagaccaaagcaagcagggccuggcaccuccauccugaggugcugccccuccau

SEQ ID NO: 60903 - RNA, 64 nt, Homo Sapiens
cccagagcugcccaaguucacugggcuccacccccaccuccaggaggggaggagaggaccugac

SEQ ID NO: 60904 - RNA, 64 nt, Homo Sapiens
caggcagggccucucaguccuugugggucugugucaccuccaucucagucuuggccuggcuaug

SEQ ID NO: 60905 - RNA, 64 nt, Homo Sapiens
ccaggaaggcugugugggucuggagcccacgucccaccuccacacccuuggcuugggcccaugc

SEQ ID NO: 60906 - RNA, 64 nt, Homo Sapiens
ggacaucuucugagccaggacgucccugaggcuccaccuccaagcucagacagggcccaggcuu

SEQ ID NO: 60907 - RNA, 64 nt, Homo Sapiens
cuucuugauggguacaggcugaguggggcgcccucaccuccagccagccucuuccugcagagga

SEQ ID NO: 60908 - RNA, 64 nt, Homo Sapiens
aaguguucagaagguucuuuuuuauauuguccuccaccuccaucauuuucaauaaaagauaggg

SEQ ID NO: 60909 - RNA, 64 nt, Homo Sapiens
gcacaacucgggcgggggugccccucccaccagucaccuccacuuuccuagaccucauggcugu

SEQ ID NO: 60910 - RNA, 64 nt, Homo Sapiens
cgggacccaggcguccgggccccauucaacuccccaccuccagcgaccucaacccugaaccccu

SEQ ID NO: 60911 - RNA, 64 nt, Homo Sapiens
ggggcaggcgcccucaucugauagggcagccuaccaccuccaagguggcagcgcccaggagggc

SEQ ID NO: 60912 - RNA, 64 nt, Homo Sapiens
cuuccgggagcccagagagcaaggggaggagcgacaccuccaggauggaagguggcugcaugcc

SEQ ID NO: 60913 - RNA, 64 nt, Homo Sapiens
cugacuagcacucagagggacuuuccuccucacccaccuccaaauggcuucuuuuaaguacccc

SEQ ID NO: 60914 - RNA, 64 nt, Homo Sapiens
uguugccccaguugaaaagcacaagggcuccucccaccuccacccacauaucacuuuagcccua

SEQ ID NO: 60915 - RNA, 64 nt, Homo Sapiens
ucccucauuugcacugcucuguaagccucccccucaccuccauucauaacccagucucaaugcc

SEQ ID NO: 60916 - RNA, 64 nt, Homo Sapiens
gaggcagggucaggccucagcaucucacauccaccaccuccaggaggggagaccacugguaagu

SEQ ID NO: 60917 - RNA, 64 nt, Homo Sapiens
cuccuggcccccgccuuccacgcccuuccgauuccaccuccaccuccaccucccccugccacag

SEQ ID NO: 60918 - RNA, 64 nt, Homo Sapiens
gcccccgccuuccacgcccuuccgauuccaccuccaccuccaccucccccugccacagagggga

SEQ ID NO: 60919 - RNA, 64 nt, Homo Sapiens
uggggacaggauuugccaguucacccacagaucacaccuccauccccaaagagguagcacugca

SEQ ID NO: 60920 - RNA, 64 nt, Homo Sapiens
ucagcagaccaggcccugucccuaccuggagccucaccuccaaggaaauucauguucuccuuaa

SEQ ID NO: 60921 - RNA, 64 nt, Homo Sapiens
cccaccugguccucucccaucugcuaguuccagacaccuccacgaccugccccacucaccaccu

SEQ ID NO: 60922 - RNA, 64 nt, Homo Sapiens
ugccccacucaccaccucugcccagguaugcucccaccuccaccagucucccccgaccccgggu

SEQ ID NO: 60923 - RNA, 64 nt, Homo Sapiens
aggggccagccugccuccaccucccacccccuuccaccuccaucagucaugugugcagagucag

SEQ ID NO: 60924 - RNA, 64 nt, Homo Sapiens
gcugcuggaaggggagagguucucagcaucaggccaccuccaccccaaugccaggauagaugua

SEQ ID NO: 60925 - RNA, 64 nt, Homo Sapiens
aguauuacuuguaacgcaauccccaucccuuccccaccuccagcaucccaacucacccccaaac

SEQ ID NO: 60926 - RNA, 64 nt, Homo Sapiens
cgcacgggcccuggcccccuaggaccgaagcacacaccuccacgcgcuuuugcaugcccgggcg

SEQ ID NO: 60927 - RNA, 64 nt, Homo Sapiens
gcccugcaugcacuggcugagauccugcuggcaucaccuccagacacccagugccucaccucca

SEQ ID NO: 60928 - RNA, 64 nt, Homo Sapiens
uccugcuggcaucaccuccaaccacccagugccucaccuccagacaucuccgggugucugagaa

SEQ ID NO: 60929 - RNA, 64 nt, Homo Sapiens
uuggcccacacagguaccauaggucguuccccagcaccuccaggcacccacccagcccaguucu

SEQ ID NO: 60930 - RNA, 64 nt, Homo Sapiens
cgccucugguuggacauucccaggaccaggaucacaccuccaggaggcuggcccaacggacaga

SEQ ID NO: 60931 - RNA, 64 nt, Homo Sapiens
uggcacuacccaaguggaguggagaacauccccccaccuccauuacuggcaaucuggacucgau

SEQ ID NO: 60932 - RNA, 64 nt, Homo Sapiens
cuugcucaugggagaaggcucaguggacaugccccaccuccagauuugccccauuuccccaguc

SEQ ID NO: 60933 - RNA, 64 nt, Homo Sapiens
cauucuguuugccccauuucuccagaagccugcccaccuccaccucugcaacucuagcccuaua

SEQ ID NO: 60934 - RNA, 64 nt, Homo Sapiens
gaaaacaaaguauugcuaaguacuauaacauauuggccacuaaaauucauauugagauuaucuu

SEQ ID NO: 60935 - RNA, 64 nt, Homo Sapiens
gaggcuucaucaggcuguggugggcggggguguuggccacuaggcaaugguaugggcagggcuu

SEQ ID NO: 60936 - RNA, 64 nt, Homo Sapiens
uuaagaagacuuagauucauuuauugcuaucugaggccacuagugagauuucagaucucucuuu

SEQ ID NO: 60937 - RNA, 64 nt, Homo Sapiens
cucccaccuguauguccagcaaacucuugcauguggccacuaggaggaauguguaagaauguuc

SEQ ID NO: 60938 - RNA, 64 nt, Homo Sapiens
ccuuaucccaucggccaugucuggggaggaacauggccacuaccggcucugguuugagaucgug

SEQ ID NO: 60939 - RNA, 64 nt, Homo Sapiens
acccugcaagcaacucugcuugcccaggcccgauggccacuaggcccucugagagaugaugucc

SEQ ID NO: 60940 - RNA, 64 nt, Homo Sapiens
ccucccuugcagccaacucucucucccugcuccaggccacuaggaacccggacugcugcccguc

SEQ ID NO: 60941 - RNA, 64 nt, Homo Sapiens
cccagacccagcccagccuguccucuggcugaguggccacuagguugguccagauugaaaagug

SEQ ID NO: 60942 - RNA, 64 nt, Homo Sapiens
gaauuccaggguugagagacuccccugagccagaggccacuagguauucuugcucccagaggcu

SEQ ID NO: 60943 - RNA, 64 nt, Homo Sapiens
aacuauaugucuggucccuugcugcucuuguuuaggccacuaucauagauauauuucaaauauu

SEQ ID NO: 60944 - RNA, 64 nt, Homo Sapiens
ggaugaaggacccaucucaauguccucauccuagggccacuagggguacuccuucucccagccc

SEQ ID NO: 60945 - RNA, 64 nt, Homo Sapiens
uuaaguauacaaucuuuaaauaauauagugaaauggccacuacuaauuuaagcaagaaauauuu

SEQ ID NO: 60946 - RNA, 64 nt, Homo Sapiens
gcugcucggcaggagggccgagguccaugcugcaggccacuacggugucugugggagcgggcac

SEQ ID NO: 60947 - RNA, 64 nt, Homo Sapiens
uuuuuggaguccacuuaacuccccugcuuuccuaggccacuacuuuauacuuucucucuucugu

SEQ ID NO: 60948 - RNA, 64 nt, Homo Sapiens
gguuuuuguucaagagccaggaccaaggcccuugggccacuacccugcuaggcucuggagcugu

SEQ ID NO: 60949 - RNA, 64 nt, Homo Sapiens
gaauuuuuacagauauuucagaucagugguguugggccacuauuguuaccucaaauuuauuuuu

SEQ ID NO: 60950 - RNA, 64 nt, Homo Sapiens
ccaucuucaaugaccccuuaggugguuuucccuuggccacuagcacggguguggcccuggaugu

SEQ ID NO: 60951 - RNA, 64 nt, Homo Sapiens
aacugaccccucagcagggcgaacgccucuccuaggccacuacaacauccuaggucuaagaguu

SEQ ID NO: 60952 - RNA, 64 nt, Homo Sapiens
auguguaaaauggacugaaacagugcuguuacuuggccacuaagaaaaugcacaaagaagaagg

SEQ ID NO: 60953 - RNA, 64 nt, Homo Sapiens
ggucauuauuucuuucuuucaacaggauacaaauggccacuagaaaccauuacuaagagaaugc

SEQ ID NO: 60954 - RNA, 64 nt, Homo Sapiens
uuuuaaaauugcuggugaaauguuaccagaguugggccacuaucaaccaucaguguccacuauu

SEQ ID NO: 60955 - RNA, 64 nt, Homo Sapiens
uacuaguuguuuguugagauagaaagaucucuuaggccacuaguuuucugaucacacagaauug

SEQ ID NO: 60956 - RNA, 64 nt, Homo Sapiens
ugcuacauaauuacuuucaacugcaguccauguuggccacuaacuuuuauucaggaccuaguau

SEQ ID NO: 60957 - RNA, 64 nt, Homo Sapiens
uugucuucacccauguauuugugcuccaagucacggccacuaggugccuucauugugaggaagg

SEQ ID NO: 60958 - RNA, 64 nt, Homo Sapiens
uauaugaaaaaagucguaucgagagaaugcaaauggccacuaagugaaaagaaaaaucacagaa

SEQ ID NO: 60959 - RNA, 64 nt, Homo Sapiens
accuuccugcugagccucacagcagugagacuggggccacuacauuugcuccauccuccuggga

SEQ ID NO: 60960 - RNA, 64 nt, Homo Sapiens
aacaacuucugccaucuucuggggccuguacacuggccacuaguagcugccauaucuuuuuccc

SEQ ID NO: 60961 - RNA, 64 nt, Homo Sapiens
guagcauguuauccacuguggaagccuucuuccaggccacuaagcuagaucguuuccugacaga

SEQ ID NO: 60962 - RNA, 64 nt, Homo Sapiens
guaaaagagucugcucuauccaugcaaucagacaggccacuaagccccuccccccauuuacaug

SEQ ID NO: 60963 - RNA, 64 nt, Homo Sapiens
gagcugaauuuucuggaaaaugcuucuuggcuggggccacuaccuccuuuccuaucuuuacauc

SEQ ID NO: 60964 - RNA, 64 nt, Homo Sapiens
gagcugccuaggaucagagagccuucauggaaguggccacuacguggggaucccuucagagaua

SEQ ID NO: 60965 - RNA, 64 nt, Homo Sapiens
gguaauaacacaucuuaguauuaagaguuuuacaggccacuaguauaagauaggcaucguggua

SEQ ID NO: 60966 - RNA, 64 nt, Homo Sapiens
aaguccagccagcgugcagcugcauccagaaaccggccacuacccagcccaucucugccugugc

SEQ ID NO: 60967 - RNA, 64 nt, Homo Sapiens
uuaacuggaggucccagcacauguguuuucaagaggccacuaggcauucuucacugagugcugc

SEQ ID NO: 60968 - RNA, 64 nt, Homo Sapiens
cgcaggggcaucucuccccucccagaaugcuguaggccacuaggccacccacucccacaccuag

SEQ ID NO: 60969 - RNA, 64 nt, Homo Sapiens
cagaggaggggccgcugccaaggcccucuggaguggccacuaagauacaccuguagcccuggag

SEQ ID NO: 60970 - RNA, 64 nt, Homo Sapiens
acguggguggggggauagacucagccuaggcuguggccacuaagagggcugcuucugugaguuc

SEQ ID NO: 60971 - RNA, 64 nt, Homo Sapiens
gucaaaaaaaaaaaaaaaauuaauagauaaaacaggccacuagagggugcaguuauaaagaaau

SEQ ID NO: 60972 - RNA, 64 nt, Homo Sapiens
agagcuuuuguuaaugcccccagaaagcuggcaaggccacuagcacauuccucuucuggggcuu

SEQ ID NO: 60973 - RNA, 64 nt, Homo Sapiens
uggacuaauauguaucuuucaaagaccaauguuuggccacuaacuauagaggucuuuggacucu

SEQ ID NO: 60974 - RNA, 64 nt, Homo Sapiens
auauauuacguuuuuguuauuaaaaaacuucauuggccacuagugaaguuagucaauaaaagac

SEQ ID NO: 60975 - RNA, 64 nt, Homo Sapiens
gaccagggagcuuauuuuucuaaugauaugucuuggccacuauguguguauuagauaucaaugu

SEQ ID NO: 60976 - RNA, 64 nt, Homo Sapiens
gucugcagccuaagcaggugcccuggugcuggugggccacuagcgcccugccccgacaccagaa

SEQ ID NO: 60977 - RNA, 64 nt, Homo Sapiens
cagugaacucccuugggucaagacaguacucaacggccacuaccuccacgcuucccagagccug

SEQ ID NO: 60978 - RNA, 64 nt, Homo Sapiens
ccaggugaugacugcaaagcaguguccaggagcaggccacuacugcccagagagcagaggagga

SEQ ID NO: 60979 - RNA, 64 nt, Homo Sapiens
gcccccaccucgaaacccacaguccccaguggagggccacuacucauccccauugguuucccag

SEQ ID NO: 60980 - RNA, 64 nt, Homo Sapiens
ggcagucucuggaagggcugugcacugcccagugggccacuagguucaggucuucuucacagcc

SEQ ID NO: 60981 - RNA, 64 nt, Homo Sapiens
uuaaaaaaaaauuaaaaguugucaucuaaaagcuggccacuaaacagaugaggugaagaucacu

SEQ ID NO: 60982 - RNA, 64 nt, Homo Sapiens
ggcuaacugaugaauuagaagccaucugacagcaggccacuagugacaguuucuuuuguguucc

SEQ ID NO: 60983 - RNA, 64 nt, Homo Sapiens
cuacccaaaugcuacagagaaauguuuucuacuuggccacuaucaggguucgucaucuauugug

SEQ ID NO: 60984 - RNA, 64 nt, Homo Sapiens
gggaagcaguugccccacaauuggagccgagucaggccacuaugaacccuucucacccuguggg

SEQ ID NO: 60985 - RNA, 64 nt, Homo Sapiens
uguguauccagaagaagagaagcaagauauugauggccacuaagcacucuggguaccaaauuua

SEQ ID NO: 60986 - RNA, 64 nt, Homo Sapiens
auuuucuuuucaacuugaaagaaacuggacauuaggccacuauguguuguuacugccacuagug

SEQ ID NO: 60987 - RNA, 64 nt, Homo Sapiens
aaaacucuugguuuuguuuuuuuggaaaugagugggccacuaagccacacuuucccuucauccu

SEQ ID NO: 60988 - RNA, 64 nt, Homo Sapiens
gagagaacagcccauaaugcuccccgggagcagaggccacuaauggagagugggaagagccugg

SEQ ID NO: 60989 - RNA, 64 nt, Homo Sapiens
ucacaaagcaguggggcaugagcuguguuucaggggccacuaaauaacagcugguacugacccc

SEQ ID NO: 60990 - RNA, 64 nt, Homo Sapiens
cguuaccuacuguugucauuguuauuacagcuauggccacuauuauuaaagagcuguguaacau

SEQ ID NO: 60991 - RNA, 64 nt, Homo Sapiens
cuuuaaacucugcacaagcaaguguguagcuuaaggccacuacugguaaggaaaccaagugucc

SEQ ID NO: 60992 - RNA, 64 nt, Homo Sapiens
agaaauguggggucugaggaagccauuugagucuggccacuagacaucucaucagccacuugug

SEQ ID NO: 60993 - RNA, 64 nt, Homo Sapiens
auggauaucauguauccuucugucauagcuaucaggccacuauccuuucuucacuguguucaag

SEQ ID NO: 60994 - RNA, 64 nt, Homo Sapiens
agaggagaugguggagacggcaggagagaagcaaggccacuaaauucauuccuguuuuucuugg

SEQ ID NO: 60995 - RNA, 64 nt, Homo Sapiens
gaacccugcuguucccccuuaaggcuggcuucagggccacuaugucagaaccucucaacccaac

SEQ ID NO: 60996 - RNA, 64 nt, Homo Sapiens
agucuuuguugguuagaggacugccugugauccuggccacuaggccaagaggcccuaugaaggu

SEQ ID NO: 60997 - RNA, 64 nt, Homo Sapiens
ggagaucuuccccuaaccuuugggccaauuuacuggccacuaauuucguuuaaauaccauugug

SEQ ID NO: 60998 - RNA, 64 nt, Homo Sapiens
aaagggugugaaguagaggugcaguuaaguggggggccacuagucuaacagacggucacaacca

SEQ ID NO: 60999 - RNA, 64 nt, Homo Sapiens
uguaaaaacuaugcaaguguaggaucaagguucaggccacuacagaaaggcauuugccuucaua

SEQ ID NO: 61000 - RNA, 64 nt, Homo Sapiens
aaguggguuugccccaucaccuccuuugcucucuggccacuauuguuuacgguuucuuauaacu

SEQ ID NO: 61001 - RNA, 64 nt, Homo Sapiens
cugcggcuggccacugugucagcugccuggccggggccacuaggggcccuggucaccuccagac

SEQ ID NO: 61002 - RNA, 64 nt, Homo Sapiens
gaaaguauguuuucucuaaaaugauggcauuugaggccacuaguuaguuaaagaacauaagugg

SEQ ID NO: 61003 - RNA, 64 nt, Homo Sapiens
ugcuugugaaaagguauaauccguucacaucuuuggccacuauuaugucggcuaccgugucugg

SEQ ID NO: 61004 - RNA, 64 nt, Homo Sapiens
ccuaagauuauuuaguuuauauauaaaaguaaguggccacuauuuauucucucauaucccugaa

SEQ ID NO: 61005 - RNA, 64 nt, Homo Sapiens
auuucccugacccugccuucugccaugaccccagggccacuagucucuuccccuguuuuuaagu

SEQ ID NO: 61006 - RNA, 64 nt, Homo Sapiens
aauuaaccaucuaccucugucaccugaguaacuuggccacuaauuguaccaagaaaaaauuagu

SEQ ID NO: 61007 - RNA, 64 nt, Homo Sapiens
ccacuguuugcucuccugcagaucagagugccauggccacuaccgcuuucuuggauauaaccau

SEQ ID NO: 61008 - RNA, 64 nt, Homo Sapiens
uugaugauggcugaugugugguucuucccagcauggccacuauuccuucuaguucaggacuccu

SEQ ID NO: 61009 - RNA, 64 nt, Homo Sapiens
agucucacuugggacaggccacagccagggguccggccacuacccgcccgugggauaaaagcca

SEQ ID NO: 61010 - RNA, 64 nt, Homo Sapiens
uccuuccgggccugagcugcccaucugccuagccggccacuagggcaccaucuucucaagggcu

SEQ ID NO: 61011 - RNA, 64 nt, Homo Sapiens
gaugagccaagaggaguggggagggaguccucagggccacuaguauuugcauuccaucccuugg

SEQ ID NO: 61012 - RNA, 64 nt, Homo Sapiens
cgcccgugggauaaaagccaacagccagggguccggccacuaccagucucacuugggacaggcc

SEQ ID NO: 61013 - RNA, 64 nt, Homo Sapiens
cuccaggcacuggugagagacaugaacacugacuggccacuagcuggccuggcccuguugaguc

SEQ ID NO: 61014 - RNA, 64 nt, Homo Sapiens
uugaggaggggggaggggggaacaggauauccaaggccacuacauugaauugucuuuauuaaca

SEQ ID NO: 61015 - RNA, 64 nt, Homo Sapiens
gcuucagacucaaguacccagccccuguggcccuggccacuaaagggccugacacccccucccc

SEQ ID NO: 61016 - RNA, 64 nt, Homo Sapiens
cacccgucuccugauuuucaucaugguagacugaggccacuaaaagaggucacagucacgaagc

SEQ ID NO: 61017 - RNA, 64 nt, Homo Sapiens
gcauaguacguggaugucagccuugugcgaugauggccacuaaacuucaguaugaaaccaguuu

SEQ ID NO: 61018 - RNA, 64 nt, Homo Sapiens
cacauggcgaauuuggcugcgcgggucuuugcggggccacuaggagggacgcgcgucugcccag

SEQ ID NO: 61019 - RNA, 64 nt, Homo Sapiens
uccccccugcccauggaguagagcccgagauccuggccacuaugccaguucugaccucgcaucc

SEQ ID NO: 61020 - RNA, 64 nt, Homo Sapiens
acaaaauaccacagaccaaaccuuaaugagcucaggccacuaucguuuguuuguuuuuaaucug

SEQ ID NO: 61021 - RNA, 64 nt, Homo Sapiens
gguaaaaaugaaaucauuccaccuucaggaaccuggccacuauaacagagacgugaugugggaa

SEQ ID NO: 61022 - RNA, 64 nt, Homo Sapiens
ccuggcacauuugaguauuugugcugggauuacaggccacuacaacccaccucagccucccaaa

SEQ ID NO: 61023 - RNA, 64 nt, Homo Sapiens
aaucuaugauacgaauauacguucuguuuuuauuggccacuaauaaguuguucugcauaucauu

SEQ ID NO: 61024 - RNA, 64 nt, Homo Sapiens
gugacccaugacccacagugcuggccuccuguggggccacuauagcagccaccagaagccgcga

SEQ ID NO: 61025 - RNA, 64 nt, Homo Sapiens
cucugacucuuccagcacccccgucgcccucccaggccacuaggcugggccugagcugggugcc

SEQ ID NO: 61026 - RNA, 64 nt, Homo Sapiens
gugcaucaaccaggaagaguucuauccccaagcuggccacuaucacauaugcuuacucuugcuu

SEQ ID NO: 61027 - RNA, 64 nt, Homo Sapiens
uccgaugaaggcagccccugcccuggcaugggggggccacuagaugcaccugggagcccccugg

SEQ ID NO: 61028 - RNA, 64 nt, Homo Sapiens
acagacaaaaugcauuacaccuguaguguaaaguggccacuaugaaucccuauguaugagagga

SEQ ID NO: 61029 - RNA, 64 nt, Homo Sapiens
gcugaguggaugaguuuuuuuguuaauuugaaagggccacuauuucaaccuuaccccaccccuc

SEQ ID NO: 61030 - RNA, 64 nt, Homo Sapiens
gggguccugaggccaagaaacccccaucacacucggccacuaguuuagaccaggcaggcaaagg

SEQ ID NO: 61031 - RNA, 64 nt, Homo Sapiens
accccuucauagcugcauuuaaaaaugguguucaggccacuauggcugcugugguuugaauauu

SEQ ID NO: 61032 - RNA, 64 nt, Homo Sapiens
uaggggacugagaaagcacaaacaguaagguucaggccacuauucauggagcugcuuucugggg

SEQ ID NO: 61033 - RNA, 64 nt, Homo Sapiens
cggggcgugcauguugcccuccuucccugggucaggccacuaggggccccacagccacgggguc

SEQ ID NO: 61034 - RNA, 64 nt, Homo Sapiens
caaggucuagcuaggcccaagauuguggcagaggggccacuacccagccucaggcccaggcacu

SEQ ID NO: 61035 - RNA, 64 nt, Homo Sapiens
cgcugugccaggugggcaggcaggagcaaggccugcgagggaggaacgggccgcuccccgccag

SEQ ID NO: 61036 - RNA, 64 nt, Homo Sapiens
ggcaucagaccuuaaccaccaggcccacagcccagcgagggagaggucgugaggccagcucccg

SEQ ID NO: 61037 - RNA, 64 nt, Homo Sapiens
gaggcgggggauccuggagccccugugucggggggcgagggaggggagguggccgucgaguuga

SEQ ID NO: 61038 - RNA, 64 nt, Homo Sapiens
cuggcccugcuggcccggguaucgggaaggaggagcgagggaaugacggagguagggugcaggg

SEQ ID NO: 61039 - RNA, 64 nt, Homo Sapiens
caacacgcugauucuccuccuucacacuaacacagcgagggacuugcaacuguaaugagaauuu

SEQ ID NO: 61040 - RNA, 64 nt, Homo Sapiens
cagaaauugaggacagcgauaggaggaagaggaggcgagggaaucugcugggaaagcagcccug

SEQ ID NO: 61041 - RNA, 64 nt, Homo Sapiens
cagcucuguuucugcugcuuauaaauuucccauugcgagggaccuguggcuccaacuucaggaa

SEQ ID NO: 61042 - RNA, 64 nt, Homo Sapiens
uugaggcugcagugaacuauggaggauuguuugagcgagggaagcuacuugggugguugaggca

SEQ ID NO: 61043 - RNA, 64 nt, Homo Sapiens
gaauggcacagcccaaagaaggaaaaggcagggagcgagggagaagacuauauuguacacaccu

SEQ ID NO: 61044 - RNA, 64 nt, Homo Sapiens
uuccugaggcuucccuccugcugcuaccacugaugcgagggaaaggccaguggcuggagacccc

SEQ ID NO: 61045 - RNA, 64 nt, Homo Sapiens
agccagccaagagccgggcggcugccgcgacacugcgagggagccugcagggggcccggccucc

SEQ ID NO: 61046 - RNA, 64 nt, Homo Sapiens
cgugggugacggugccuaggaggaccugggacgugcgagggaaaaccguccugugcugcucgag

SEQ ID NO: 61047 - RNA, 64 nt, Homo Sapiens
gaauuccuggucuuggcagauggcucugggaacagcgagggagcacagaagucguggccugagg

SEQ ID NO: 61048 - RNA, 64 nt, Homo Sapiens
auacaggagaggaugaagggaggagcuccaggaggcgagggaagagcccuagcagggcggccau

SEQ ID NO: 61049 - RNA, 64 nt, Homo Sapiens
gugugugacaugucaugccuucugagggggcucugcgagggacgggauugagggacagaaggau

SEQ ID NO: 61050 - RNA, 64 nt, Homo Sapiens
acuccuaaggacuuuugggauuuugaugagaccugcgagggagaagacacugagaagccaguga

SEQ ID NO: 61051 - RNA, 64 nt, Homo Sapiens
ggggugggauuuuuggugcacaugaaggaaaggggcgagggagguuguaaaugcucuaacugga

SEQ ID NO: 61052 - RNA, 64 nt, Homo Sapiens
ggagacuccaagcugggcugagccagagcagaaggcgagggauucccagccggacggggguucu

SEQ ID NO: 61053 - RNA, 64 nt, Homo Sapiens
ugaugauuuguuccaguucucccagggcagaggggcgagggagaggcuuuugcugugagaguag

SEQ ID NO: 61054 - RNA, 64 nt, Homo Sapiens
cuuaagggcaaagugaguuaauguguagacaaaggcgagggacaagagagaguuaacaucuaga

SEQ ID NO: 61055 - RNA, 64 nt, Homo Sapiens
uagaaacuagguuuugaaagauuacaugauucaagcgagggauuuuaaaguaaagauguauuua

SEQ ID NO: 61056 - RNA, 64 nt, Homo Sapiens
gaaaagcagcccagucagaugugggaacgugccagcgagggagagaccuuuccacugcagagag

SEQ ID NO: 61057 - RNA, 64 nt, Homo Sapiens
gaugagcggaagguggagguuggggagcuggggggcgagggagacgugggccgcuagggacucc

SEQ ID NO: 61058 - RNA, 64 nt, Homo Sapiens
cgaaggcugcggccgggcugucucuccccaguuggcgagggacacugcgaggacagguugucuu

SEQ ID NO: 61059 - RNA, 64 nt, Homo Sapiens
cucuguaugaaacagaagagcgccuccacgggaggcgagggaggggaaagaucaaggaaccaag

SEQ ID NO: 61060 - RNA, 64 nt, Homo Sapiens
cuacuugggaggcugagguggaaggauugcuugagcgagggaggucgaggcugcagugagccac

SEQ ID NO: 61061 - RNA, 64 nt, Homo Sapiens
gaguacuagagcugcuugcaagcuggguggcugcgcgagggaccugcagggaccuuguaagcgg

SEQ ID NO: 61062 - RNA, 64 nt, Homo Sapiens
agguucuccgcauucccaugucggcgccuccugcgcgagggagcggaucucacggacugccggg

SEQ ID NO: 61063 - RNA, 64 nt, Homo Sapiens
ggagggagagggggaggggaggccgggagggcgagcgagggagagcugggguaucagugagggc

SEQ ID NO: 61064 - RNA, 64 nt, Homo Sapiens
cagcuaauaacugaucucguagcaccuguaaugugcgagggaccagcaggacugaugucuccua

SEQ ID NO: 61065 - RNA, 64 nt, Homo Sapiens
uccccacacagcgcugggccagagaggcauuggugcgagggauugaauaaagaaacaaaugaau

SEQ ID NO: 61066 - RNA, 64 nt, Homo Sapiens
ugggacugaagcuuucccgcuccguccuucccuggcgagggagcuguacauuucccugugguuc

SEQ ID NO: 61067 - RNA, 64 nt, Homo Sapiens
cgagcucccggccagccgccggcccgcaggcagcgcgagggaggagcugcgccgccggcuccgc

SEQ ID NO: 61068 - RNA, 64 nt, Homo Sapiens
agacgcggacccuggauagugguucuaugacucugcgagggacaggcccacgcguguggggaga

SEQ ID NO: 61069 - RNA, 64 nt, Homo Sapiens
gguggcaacagcagcaggacagggcacggagggagcgagggagagaggaccggucccagcuuuu

SEQ ID NO: 61070 - RNA, 64 nt, Homo Sapiens
gcgaacugucgaauguugcgggcggggggcgggggcgagggagguaggaggagccagggacugg

SEQ ID NO: 61071 - RNA, 64 nt, Homo Sapiens
uuucugguuucauuucaaauaaacuagguuaguugcgagggaugucauuaaugcauugauaaga

SEQ ID NO: 61072 - RNA, 64 nt, Homo Sapiens
aguggaggugccagggaggccuuuggccccagaggcgagggaccggguguccccccacacccug

SEQ ID NO: 61073 - RNA, 64 nt, Homo Sapiens
gaaccuuacuugcacuuuauagccuaggagcacagcgagggaaugguaauacuaucaagagaag

SEQ ID NO: 61074 - RNA, 64 nt, Homo Sapiens
gguggauuaccaguauuguuuagcccaaaagggugcgagggagacagaaaauuccuagcucaca

SEQ ID NO: 61075 - RNA, 64 nt, Homo Sapiens
gauuguaaguuuguguguuuaaacuuuuuuuugagcgagggaagaaaaagcuguaugcauuuca

SEQ ID NO: 61076 - RNA, 64 nt, Homo Sapiens
uguagaugcagacucaccgaccgggaccucagacgcgagggaaaggagcacuaaguggggcucg

SEQ ID NO: 61077 - RNA, 64 nt, Homo Sapiens
aaagcuaccacucuggcugcuagacagcuugguggcgagggagaugacuccuuguagcugauac

SEQ ID NO: 61078 - RNA, 64 nt, Homo Sapiens
gggcaggggaaacuaagggcaagcaggauacagggcgagggauguggcaggugagggggcuccc

SEQ ID NO: 61079 - RNA, 64 nt, Homo Sapiens
agaugagccagugccucgcaugauaccagaggaggcgagggacagagacagcaaggcagacagu

SEQ ID NO: 61080 - RNA, 64 nt, Homo Sapiens
cccaaagagagaugcuuguuaggggcuggcuaaggcgagggauacugaauuccuguggacccac

SEQ ID NO: 61081 - RNA, 64 nt, Homo Sapiens
uccgcugcaucucagcaaaguuagaaccugacuagcgagggacccucuuguggggcagcccacc

SEQ ID NO: 61082 - RNA, 64 nt, Homo Sapiens
uagaagugaagaccuuauuaauaggagcauaauugcgagggagaaucaugguucugcagucugg

SEQ ID NO: 61083 - RNA, 64 nt, Homo Sapiens
ccuuccccugucggaagccguugcuugaccccgggcgagggaggcgguagccuccggguccggg

SEQ ID NO: 61084 - RNA, 64 nt, Homo Sapiens
cugcuggacccaccccgcugcccucagaucccccgcgagggaggauauuuagcgaacucggucu

SEQ ID NO: 61085 - RNA, 64 nt, Homo Sapiens
cuuccuacauugucaccaucaggcacugaaugaggcgagggaccucuggagagggccucugaga

SEQ ID NO: 61086 - RNA, 64 nt, Homo Sapiens; identical to SEQ ID NO: 61085

SEQ ID NO: 61087 - RNA, 64 nt, Homo Sapiens
aggguguucaccaugauaacgaguagggucuauggcgagggaaaccaugaccuucaccucugga

SEQ ID NO: 61088 - RNA, 64 nt, Homo Sapiens
ggauauagggcaugucacaauugcugucacuuuggcgagggagugaagaaugucaucucccgaa

SEQ ID NO: 61089 - RNA, 64 nt, Homo Sapiens
ggagccccuugggcaggucacacaaccugucccagcgagggacaccgaguggcccuucauguac

SEQ ID NO: 61090 - RNA, 64 nt, Homo Sapiens
cuuggccuugcagcgagccccuggcccacgccgagcgagggaugcuucucccuacagcaugucc

SEQ ID NO: 61091 - RNA, 64 nt, Homo Sapiens
caauugaaaaggaacuugccacagugcccuuggugcgagggaagcuuauggggugagaauauag

SEQ ID NO: 61092 - RNA, 50 nt, Homo Sapiens
acaagugcaccauccagugagcgagggaugcuggggcggggcuuggccag

SEQ ID NO: 61093 - RNA, 64 nt, Homo Sapiens
gggccaugcccggcugacggcugcuguggaugccgcgagggacggacacacguccggggcaccc

SEQ ID NO: 61094 - RNA, 64 nt, Homo Sapiens
cuuggucuaccgugcugaccagggugaaggcacggcgagggacuccucccagacgugccucuug

SEQ ID NO: 61095 - RNA, 64 nt, Homo Sapiens
ccuuugccaacaccucccaaggauggaggacugggcgagggacugggaaagaggcauauuuagu

SEQ ID NO: 61096 - RNA, 64 nt, Homo Sapiens
auucauucugaacccuccaaaggaacucuagagggcgagggaugaugagggaagcaauagguag

SEQ ID NO: 61097 - RNA, 64 nt, Homo Sapiens
ugagacguacuuggcuacagauuucugccuuguuuugcgacauugucccauucacacagauauu

SEQ ID NO: 61098 - RNA, 64 nt, Homo Sapiens
gggacucacuggacucuguuugauccugaacuuguugcgacagaugugcgguuaccugcuugag

SEQ ID NO: 61099 - RNA, 64 nt, Homo Sapiens
gugaaggcuuaaaugaguuuaguaacugaauccauugcgacauuacaacccgggaucguuugca

SEQ ID NO: 61100 - RNA, 64 nt, Homo Sapiens
caggugguguuuuuuuuuuuccugugaccucuuauugcgacaugugggacccccaguguucuug

SEQ ID NO: 61101 - RNA, 64 nt, Homo Sapiens
augccucccaggaaaaaaauacauauguauuuuuuugcgacagggucgugcucuugucucccag

SEQ ID NO: 61102 - RNA, 64 nt, Homo Sapiens
ccaguggaaauuguauguaugcugcaucauuuaauugcgacauagcaagacugcauggauaagg

SEQ ID NO: 61103 - RNA, 64 nt, Homo Sapiens
ggcucuggacugugacugcgccuggauucugccauugcgacacauuuuugugccuuucagcccc

SEQ ID NO: 61104 - RNA, 64 nt, Homo Sapiens
cccagguggaggggaccacccugcgaucagguguuugcgacagggguugggccagcugaggcaa

SEQ ID NO: 61105 - RNA, 64 nt, Homo Sapiens
ggccuacagaauuagacuuuucguggggcacuauuugcgacauaugccuccucccugcauuucc

SEQ ID NO: 61106 - RNA, 64 nt, Homo Sapiens
ggaaaauaaccaagcacaaaaaugucuuguuuuguugcgacauaagauuaacuauuugcaccga

SEQ ID NO: 61107 - RNA, 64 nt, Homo Sapiens
ucaagguguucucuguagcuggcucucuggacacuugcgacacccuuuggacccuacacacuuc

SEQ ID NO: 61108 - RNA, 64 nt, Homo Sapiens
uaaggcaagcagguagcguguccauaguacuugguugcgacauuugcacuacauccacuuuagu

SEQ ID NO: 61109 - RNA, 64 nt, Homo Sapiens
aggccaggggaaaaaccccucauggaccacgcaguugcgacaggggcugggcuccugggcugaa

SEQ ID NO: 61110 - RNA, 64 nt, Homo Sapiens
ccugagauaguaaguauuauguucuauuuaauacuugcgacaacggucaaagugcuuuuuguaa

SEQ ID NO: 61111 - RNA, 64 nt, Homo Sapiens
agcuccccguacuggugccgccgcaguggccaaguugcgacacugcccacggccccucccucug

SEQ ID NO: 61112 - RNA, 64 nt, Homo Sapiens
agccacaccagagugugcaggagagagguccagauugcgacaggcagacaacacucuagaacug

SEQ ID NO: 61113 - RNA, 64 nt, Homo Sapiens
cccaaagccguaagggccgagcgcccccaugugguugcgacacugggcggcgucugggucucug

SEQ ID NO: 61114 - RNA, 64 nt, Homo Sapiens
cugccugugcguccgcccaccgcugcccugucuguugcgacacccucccccccacauacacacg

SEQ ID NO: 61115 - RNA, 64 nt, Homo Sapiens
caggacaggccagucauucuaacuuggauucagauugcgacaugaacuuuuccccaagcccacc

SEQ ID NO: 61116 - RNA, 64 nt, Homo Sapiens
aagggcuuuucugaaauuuaaucuagucaguacuagcaucuauaaacuauaugcagauuuuaaa

SEQ ID NO: 61117 - RNA, 64 nt, Homo Sapiens
guggcggcggcuccucuucuggaaauggcaugaaagcaucuacuagcgguucaucggcuguuug

SEQ ID NO: 61118 - RNA, 64 nt, Homo Sapiens
aaugaaaggugaguaaccagagaagugaaagggaagcaucuaaagaauugaacuaggggcugga

SEQ ID NO: 61119 - RNA, 64 nt, Homo Sapiens
uuacacucuccuagaguauagcaaguuuguaaauagcaucuaugggcuugauguagcagucaua

SEQ ID NO: 61120 - RNA, 64 nt, Homo Sapiens
uacauguguauauguaaagaauuucaaucaaaugaaacguuauccuauuggauagacuaggcaa

SEQ ID NO: 61121 - RNA, 64 nt, Homo Sapiens
cauuguacagaaauuaacagccauauuggucuagaaacguuaaacuuaauuuuuuuccauuugu

SEQ ID NO: 61122 - RNA, 64 nt, Homo Sapiens
ucuugcaauuguaugugugauuauggaguuuugaaaacguuacauuuuuuaaaucuuaaaacug

SEQ ID NO: 61123 - RNA, 64 nt, Homo Sapiens
uuaucaaagacuaaucuguggauagacuucaaagaaacguuaccaguccauguaguucucuaca

SEQ ID NO: 61124 - RNA, 64 nt, Homo Sapiens
gguguaacaguccaggaaacuagcgaccuuuggaaaacguuagcuuggcuacuguaauuguaaa

SEQ ID NO: 61125 - RNA, 64 nt, Homo Sapiens
auacccaguaaggaaaaugacugaauuagaagacaaacguuagcaacaggguuggaaggauuuc

SEQ ID NO: 61126 - RNA, 64 nt, Homo Sapiens
augaccuggcaacaaaaagucauuuaagaauuugaaacguuaugaauagcuguugacguuugcu

SEQ ID NO: 61127 - RNA, 64 nt, Homo Sapiens
uuucuuuauauacuauucccaccauggggagcgaaaacguuaaaaucacaaggaauugcccaau

SEQ ID NO: 61128 - RNA, 64 nt, Homo Sapiens
aaucucuugccauucauuaguguuauuucauuguaaacguuauugugccaaauguacuguauuc

SEQ ID NO: 61129 - RNA, 64 nt, Homo Sapiens
uugaagcuugaaagaagagucuuugguauuuuguaaacguuagcagacuuuccugccaguguca

SEQ ID NO: 61130 - RNA, 64 nt, Homo Sapiens
acaggucaggaaaagccugcugaauuuauguuguaaacguuacuuaacacaguauaaagaugaa

SEQ ID NO: 61131 - RNA, 64 nt, Homo Sapiens
auacaaaaaucaauucaagauggauuaaagacuuaaacguuagaccuaaaaccauaaaaacccu

SEQ ID NO: 61132 - RNA, 64 nt, Homo Sapiens
gucagacacuggacaauguaauguaugcaacugcaaacguuacaacugcagccagaacaauggc

SEQ ID NO: 61133 - RNA, 64 nt, Homo Sapiens
agaauauaagauauacuauauacauuuuguccauaaacguuaugcugaauaguuguugaaacag

SEQ ID NO: 61134 - RNA, 64 nt, Homo Sapiens
agaaguucuaagcgggagauaaggggcgcuuagaaaacguuaaugacgucaaacaagcugaaug

SEQ ID NO: 61135 - RNA, 64 nt, Homo Sapiens
aguuuuaaacaguuaagauuucuguuacuacaguaaacguuaagguuauguuacaaauucauau

SEQ ID NO: 61136 - RNA, 64 nt, Homo Sapiens
uauaaugaaaucaacuaaaagcacagguucuugaaaacguuauuaggaaauuauugacaguuuu

SEQ ID NO: 61137 - RNA, 64 nt, Homo Sapiens
uguugcaacccgaggauggguuuguugcugaaguaaacguuacuuaaucucuagagagguccac

SEQ ID NO: 61138 - RNA, 64 nt, Homo Sapiens
gguaguuauaguacuccaaaucaaggaccaacuuaaacguuaauuuuugugcaaaaacaaaccu

SEQ ID NO: 61139 - RNA, 64 nt, Homo Sapiens
uaucaucuccuaaucuuacccugacccuuuugucaaacguuaucuagauuaaaccucaguauag

SEQ ID NO: 61140 - RNA, 64 nt, Homo Sapiens
uguauauugguaagugguuuuagaauauaaaauaaaacguuacuggcuuaugccaaauggaaga

SEQ ID NO: 61141 - RNA, 64 nt, Homo Sapiens
uauguguaaaugccaccuauuaauacgggacugaaaacguuagagacacacugcauugcagaua

SEQ ID NO: 61142 - RNA, 64 nt, Homo Sapiens
cugagcuuccauaagucagcugaguuuuaaagguaaacguuauggcugaaauaguaaagcaccu

SEQ ID NO: 61143 - RNA, 64 nt, Homo Sapiens
aaaccccaucgugguccauguuuaaagcggaggcaaacguuaacacauccacaacccuaagccu

SEQ ID NO: 61144 - RNA, 64 nt, Homo Sapiens
aauuguuaaaggcuaugauugauuuuaagaauccaaacguuaagguaacuaaaguuagaaaguu

SEQ ID NO: 61145 - RNA, 64 nt, Homo Sapiens
ucauugcaaaaauauuuuauugagaauuaaaauaaaacguuaucuuguguuuguauauaaaugg

SEQ ID NO: 61146 - RNA, 64 nt, Homo Sapiens
gggucuugaagauuuuuggcacuuauuuucuagaaaacguuaaucuuaguuuaaaaaaaaaaag

SEQ ID NO: 61147 - RNA, 64 nt, Homo Sapiens
acagccgucucccagggaaucccuucugcaaaccaaacguuacuuagacugcaagcuagaaagc

SEQ ID NO: 61148 - RNA, 64 nt, Homo Sapiens
ucauuguaugugcuucacuacgggggggagaaggaaacguuagcaucauguuucccauuuaggg

SEQ ID NO: 61149 - RNA, 64 nt, Homo Sapiens
auaucaagaugugaaggacuaauucaggaugcaaaaacguuauugggggguuguaaauaucaac

SEQ ID NO: 61150 - RNA, 64 nt, Homo Sapiens
ucuugacuugccuguuuuggccauuagcugccuuaaacguuaacagcacauuugaaugccuuau

SEQ ID NO: 61151 - RNA, 64 nt, Homo Sapiens
guguggagaaagcaauaaacauuaugagaauguuaaacguuaugcaaaauuauacuuuuaaaua

SEQ ID NO: 61152 - RNA, 64 nt, Homo Sapiens
acagacuguuuacuaaggagcuaaaccacugagaaaacguuauuaaaauuguaauaccuaggua

SEQ ID NO: 61153 - RNA, 64 nt, Homo Sapiens
aaauggauuuacuuugcuaacaacuuugccuuugaaacguuaauagaaagucuaauguuaaaaa

SEQ ID NO: 61154 - RNA, 64 nt, Homo Sapiens
ucuacauauaaauccuggaauuuuauucugaaguaaacguuagcuccuucccuguuugucaaug

SEQ ID NO: 61155 - RNA, 64 nt, Homo Sapiens
uuuugaauagguuggaauugaaaaaacaauuaucaaacguuaagaacaaagacagggauaaauu

SEQ ID NO: 61156 - RNA, 64 nt, Homo Sapiens
aaaauuauauuuguaauuagaguauguuguaguuaaacguuaauuacuuuuaaagggauuuugc

SEQ ID NO: 61157 - RNA, 64 nt, Homo Sapiens
uuucaguuuuaaauaaucagcucuugaguugucaaaacguuaaugaucccagcgaugucagaca

SEQ ID NO: 61158 - RNA, 64 nt, Homo Sapiens
aguacuucccuuugucugugccauaagugcuugaaaacguuaagguuuucuguuuuguuuuguu

SEQ ID NO: 61159 - RNA, 64 nt, Homo Sapiens
ugcacucaaauguuauaauucauccuaauguacaaaacguuauagaaauggacagcaugcaauu

SEQ ID NO: 61160 - RNA, 64 nt, Homo Sapiens
auaaucugaauaaauaaaaucuuguuuaguuuuuaaacguuaguuaccuugguacagcuuuuca

SEQ ID NO: 61161 - RNA, 64 nt, Homo Sapiens
auuuuuaugagggagcaaaaguuagacugagaacaaacguuagaaaaucacuucagauuguguu

SEQ ID NO: 61162 - RNA, 64 nt, Homo Sapiens
gcaugagaaaacacagggcauuucuaggacaguaaaacguuaaaguacuggauuaagaaaacaa

SEQ ID NO: 61163 - RNA, 64 nt, Homo Sapiens
guuucacuggaaaggaaagaugaugcucaguuuuaaacguuaaaaguguacaaguugcuuuguu

SEQ ID NO: 61164 - RNA, 64 nt, Homo Sapiens
gguuucuuaugcucuuuuuagggaaucauaaauuaaacguuaauuauaaauuagaaugacaagu

SEQ ID NO: 61165 - RNA, 64 nt, Homo Sapiens
uggggaaggacaguguggugugacuauuggcuugaaacguuauggauaugguuggagucaccca

SEQ ID NO: 61166 - RNA, 64 nt, Homo Sapiens
ccuuugagacugacaugauuacaaaauguacauaaaacguuaguuuuagcugaguucaguuaau

SEQ ID NO: 61167 - RNA, 64 nt, Homo Sapiens
guacuaagauaguuuuaagaaaguugaccuguuaaaacguuaauaaacugcucauaaagacuaa

SEQ ID NO: 61168 - RNA, 64 nt, Homo Sapiens
auaagcaagaauugccagaaugaaucacugguggaaacguuaggugacuuuucuucuuacaugc

SEQ ID NO: 61169 - RNA, 64 nt, Homo Sapiens
ugcuaaccaccugcccagaagggaagugagggaaaaacguuaggaaaggacuuaagaauuuggg

SEQ ID NO: 61170 - RNA, 64 nt, Homo Sapiens
ggagcugagaggccucccuuggagagauggaaggaaacguuauaccuuguaccccucggucucc

SEQ ID NO: 61171 - RNA, 64 nt, Homo Sapiens
uucaugaagccuuuaagugcugcuucugucagucaaacguuaaaaacuuuaacauuuucaaagu

SEQ ID NO: 61172 - RNA, 64 nt, Homo Sapiens
uaacuugggccauccuaucaccuuuuaaacaagaaaacguuaaacuuaagugccaaugggccca

SEQ ID NO: 61173 - RNA, 64 nt, Homo Sapiens
uuuucuccaugguguuaaugauauuagagaugaaaaacguuagcaguugauuuuuguccaaaag

SEQ ID NO: 61174 - RNA, 64 nt, Homo Sapiens
gguuuuuuaugaugagcaaauauaaguuaaugccaaacguuauguuaaaguuauuuuuucaaau

SEQ ID NO: 61175 - RNA, 64 nt, Homo Sapiens
aaguuggaauguuggagaugaugccuaaaaauggaaacguuaagggaacugaaggacgcgguua

SEQ ID NO: 61176 - RNA, 64 nt, Homo Sapiens
gcaccagugaguugaaaaaagauagcaaaaucagaaacguuaggaaaaacuccucuucacgauu

SEQ ID NO: 61177 - RNA, 64 nt, Homo Sapiens
aauaguuuuuaucuaauaaaauucuaaaaagucaaaacguuaacauuaaccuucuaaacaguau

SEQ ID NO: 61178 - RNA, 64 nt, Homo Sapiens
accuucugcuuagaguacuuaaucuaaucaauaaaaacguuagaaaggauuaccacuguacaca

SEQ ID NO: 61179 - RNA, 64 nt, Homo Sapiens
agcugguaguaaaaaaugaggcauauugugagaaaaacguuaggaaucuccugcuaauagguau

SEQ ID NO: 61180 - RNA, 64 nt, Homo Sapiens
uuagaccaguaauugugcuacugaaauugucacaaaacguuauuccuugauuugguuuuuaaau

SEQ ID NO: 61181 - RNA, 64 nt, Homo Sapiens
uucauguacuauggaaaaguauucaaaacauguuaaacguuacuagauuaaauuuaauuaauua

SEQ ID NO: 61182 - RNA, 64 nt, Homo Sapiens
uauuuuuuuauuuaugauacgcgugguacagaauaaacguuauugacuccggacacugacagcc

SEQ ID NO: 61183 - RNA, 64 nt, Homo Sapiens
guaaacagcaugaggauaugguaacgugauguaaaaacguuacuauggacuguaaccaguugcu

SEQ ID NO: 61184 - RNA, 64 nt, Homo Sapiens
ugcaacuuaauuuuuuuuuuuaaugcuaucuucaaaacguuagagaaaguucuucaaaagugca

SEQ ID NO: 61185 - RNA, 64 nt, Homo Sapiens
aaguugucaucuuacuuacucacaaaggaggggaaaacguuauuuucauagcugcuuuuagaaa

SEQ ID NO: 61186 - RNA, 64 nt, Homo Sapiens
agaauacacaggauauuuuggggggcagagaauaaaacguuaguuaaucccuuugucugucaau

SEQ ID NO: 61187 - RNA, 64 nt, Homo Sapiens
aucauuucuugggcccuccugaaacuuacacacaaaacguuaagugaugaacauuaaauagcaa

SEQ ID NO: 61188 - RNA, 64 nt, Homo Sapiens
caaguuuucaaucuuggacuuugaaaacaggauuaaacguuaguauucgugugaaucagacuaa

SEQ ID NO: 61189 - RNA, 64 nt, Homo Sapiens
uaggaaccgucugauagcauuaacuuccagaaauaaacguuauaguauauugcuguaucuacuu

SEQ ID NO: 61190 - RNA, 64 nt, Homo Sapiens
uaaacugagguuucauugacgugucccuauuaauaaacguuauuugccccacaauguuucuuaa

SEQ ID NO: 61191 - RNA, 64 nt, Homo Sapiens
agaguuggcguuuccuguucugggugcuacugccaaacguuaugguacuuagagucgggaugca

SEQ ID NO: 61192 - RNA, 64 nt, Homo Sapiens
uauuuauacugguggaccauucagaaaaagugggaaacguuauuacuuaaugguuacagcacug

SEQ ID NO: 61193 - RNA, 64 nt, Homo Sapiens
ccaaaaauaaauuguuuaaaacuuuucuuauuaaaaacguuacaaaguauucaauugucuguuc

SEQ ID NO: 61194 - RNA, 64 nt, Homo Sapiens
cugucgcucgaacccgaucuaaaacguccgcucaaaacguuaccgagacguugucccggagauc

SEQ ID NO: 61195 - RNA, 64 nt, Homo Sapiens
uauguagagcauguaggaaaguuguaaaugugagaaacguuauuguguucaaccguaaaaccuu

SEQ ID NO: 61196 - RNA, 62 nt, Homo Sapiens
gguaauacugaagaaaaauaaaaauagauuuugaaaacguuacuuacauuucuaugauuaug

SEQ ID NO: 61197 - RNA, 64 nt, Homo Sapiens
auuuccccaguugcccuuuaaguucuucuauuucaaacguuaauuuugcuucucuuucuaaaaa

SEQ ID NO: 61198 - RNA, 64 nt, Homo Sapiens
agccaucccaaacaacuaccagaauaauggauuaaaacguuaacuguuuuaagucacuaaguuu

SEQ ID NO: 61199 - RNA, 64 nt, Homo Sapiens
cucaagauguauggugugucauuugugaaaauagaaacguuauuuuuccuaguuuaguaucaac

SEQ ID NO: 61200 - RNA, 64 nt, Homo Sapiens
gcucaggcguuaauaauggacauaaaaagucauaaaacguuagagcuggaaggaaucuuaacua

SEQ ID NO: 61201 - RNA, 64 nt, Homo Sapiens
guugaugccucccucacaggcagucucaucuguacaccgacagggcgagcuggccucugcccca

SEQ ID NO: 61202 - RNA, 64 nt, Homo Sapiens
gucccuaccccagagcuuccucccuaaucgacuccaccgacaagugacagucuccuuccagcuc

SEQ ID NO: 61203 - RNA, 64 nt, Homo Sapiens
gccaaaagagggugcugccccuagccugggcccccaccgacagacugcagcugcguuacugugc

SEQ ID NO: 61204 - RNA, 64 nt, Homo Sapiens
acuguugccugcaaggacaccuacuugucaccaucaccgacaucauuggccuuccuuaggcugg

SEQ ID NO: 61205 - RNA, 64 nt, Homo Sapiens
aggaacccacggccaccaccaccuucagcuccugcaccgacaucuucuuggcagcacuccacuc

SEQ ID NO: 61206 - RNA, 64 nt, Homo Sapiens
gucgggggguggcugccagggggcaaggagaaagcaccgacaaucuuugauuacugaaaguauu

SEQ ID NO: 61207 - RNA, 64 nt, Homo Sapiens
gcuuuucuugaaugaacagcuaaugcccaauauccaccgacacuaauaagcaugaaucaaaugg

SEQ ID NO: 61208 - RNA, 64 nt, Homo Sapiens
caaagcaaauuuuuuuaaaagcagcguauguaagcaccgacacccacucaaaacagcucuuucu

SEQ ID NO: 61209 - RNA, 64 nt, Homo Sapiens
ccucccagcaccacacacccauuccccuucuacucaccgacaucgagucucccacagggaggcc

SEQ ID NO: 61210 - RNA, 64 nt, Homo Sapiens
uguaaaauguucuaagauaaaccauaaaagaaaacaccgacagcaaauuuuuuaugaucucuaa

SEQ ID NO: 61211 - RNA, 64 nt, Homo Sapiens
gaugaggaggaagaagaaaacagcaagucaaugucaccgacagucaucaacuccuucuagcauc

SEQ ID NO: 61212 - RNA, 64 nt, Homo Sapiens
cccagaacccucugggggcccucccggcgccacccaccgacacccagucucggcagcagcuccg

SEQ ID NO: 61213 - RNA, 64 nt, Homo Sapiens
ccuguccucgcugggacaagugcuccccucuggucaccgacaccuauagaagcucagccuggcc

SEQ ID NO: 61214 - RNA, 64 nt, Homo Sapiens
accaucaugccuugaguguucuuaaguuuuuccucaccgacaguaaucuacaucuggaccauuc

SEQ ID NO: 61215 - RNA, 64 nt, Homo Sapiens
augcugugugcuggagacaccuuaacagaacagucaccgacaacgcugcacaucacaacauuua

SEQ ID NO: 61216 - RNA, 64 nt, Homo Sapiens
agcaggagcagcuccuacagugaacuauuggcaccaccgacagugacaccagggcacauggcug

SEQ ID NO: 61217 - RNA, 64 nt, Homo Sapiens
gacggcugugacgcagccggagggaggcacuagucaccgacagcggccuugaagacagagcaaa

SEQ ID NO: 61218 - RNA, 64 nt, Homo Sapiens
gagcaguggaaaggggcuaucuucugagucacaucaccgacacugacccagcgaaaauguggcc

SEQ ID NO: 61219 - RNA, 64 nt, Homo Sapiens
cugucaugcacccaccacgucgcucugcagcauucaccgacaguagggcacgucacugcagaca

SEQ ID NO: 61220 - RNA, 64 nt, Homo Sapiens
gcugcgagccaggcucugggcgcagaggagggggcaccgacagcugggcuagccccacccagag

SEQ ID NO: 61221 - RNA, 64 nt, Homo Sapiens
acaccaggcaggagugagccgccuuggaaggaggcaccgacacggcaaagggguuuuagcugca

SEQ ID NO: 61222 - RNA, 64 nt, Homo Sapiens
aagaaagaaacacaaaaacacaacccucaggaaccaccgacagaugccucugcccugaucguca

SEQ ID NO: 61223 - RNA, 64 nt, Homo Sapiens
ccuuggguuggcaagaaggcaugcguuuuaaaaccaccgacagcaaaaaggaauccauaccaug

SEQ ID NO: 61224 - RNA, 64 nt, Homo Sapiens
gccaccaccaccaccaacacaacagcaauggcaacaccgacagcaaccaaucagauauauacaa

SEQ ID NO: 61225 - RNA, 64 nt, Homo Sapiens
caacuggcagcugcgggacccuuggcuugucccccaccgacaagucccaccugcugggugagga

SEQ ID NO: 61226 - RNA, 64 nt, Homo Sapiens
gcugcccggccugccuggggcugggagccccagacaccgacacccugaggacguguggagcuaa

SEQ ID NO: 61227 - RNA, 64 nt, Homo Sapiens
ugacccugcagcuggugcucugugucuucgcuuccaccgacagccgucagacaucaggcucccc

SEQ ID NO: 61228 - RNA, 64 nt, Homo Sapiens
ccccuggaggaggaguaccuaacggccgagccugcaccgacaacacgcugugcucccucccaac

SEQ ID NO: 61229 - RNA, 64 nt, Homo Sapiens
aaacugucagcucugcuuucccucugugcgagugcaccgacagacauccacccacagagaaaug

SEQ ID NO: 61230 - RNA, 64 nt, Homo Sapiens
ccgagugcacccgcuuagccuuuacauuccucuccaccgacaaaaggaaggggaaacucaauca

SEQ ID NO: 61231 - RNA, 64 nt, Homo Sapiens
ccgcauuccacccccaacaucuuucaaaagaccccaccgacagacugugccuuugucagcucuu

SEQ ID NO: 61232 - RNA, 64 nt, Homo Sapiens
gcagaggaaacagaaacucccaacuguccuuacccaccgacaucacagccccuaugaagaaagu

SEQ ID NO: 61233 - RNA, 64 nt, Homo Sapiens
gagccuucaggugccaaagccauacucaggcccccaccgacauuguccacccuggccagaaggg

SEQ ID NO: 61234 - RNA, 64 nt, Homo Sapiens
accuagccuaggugagacacugcagccaggcaaccaccgacacacgccccuucucaaagccaga

SEQ ID NO: 61235 - RNA, 64 nt, Homo Sapiens
cucagguuccugaccguggccugguaccugagaccaccgacaucccaacuugccacccgcgucc

SEQ ID NO: 61236 - RNA, 64 nt, Homo Sapiens
ggcgagggcugcuuccucgccucuuccuucuuuccaccgacagggcggucugugguagagaacu

SEQ ID NO: 61237 - RNA, 64 nt, Homo Sapiens
caccugggagcacggcgccucaguacgcaggucccaccgacacugggcuucggugccgcguggg

SEQ ID NO: 61238 - RNA, 64 nt, Homo Sapiens
uuagagcuuguggcuugaauguuaaaggugugaccaccgacaccacucaugucaauggcugaaa

SEQ ID NO: 61239 - RNA, 59 nt, Homo Sapiens
gcccucccuccguggggauagcugcccgacaccgacaccaggucaucuucuacaccuag

SEQ ID NO: 61240 - RNA, 64 nt, Homo Sapiens
cuccucggccuccuccucuugcugccucccccaacaccgacaccgcccacccccacugaccccc

SEQ ID NO: 61241 - RNA, 64 nt, Homo Sapiens
uccccggcuuccagacccuagcuuuccgaccccacaccgacaacucgcucucacacccccucca

SEQ ID NO: 61242 - RNA, 64 nt, Homo Sapiens
caucaccuccuucuuggaaccgucucuaugacgucaccgacagcgggacacgcccuucagagcc

SEQ ID NO: 61243 - RNA, 64 nt, Homo Sapiens
gaguacucagaaaucaagaucaggaaccaaaggucaccgacacuacuuccacaaggugcaaccu

SEQ ID NO: 61244 - RNA, 64 nt, Homo Sapiens
cuugaaagguguagguuugauuacuaggagauaccaccgacauuuuucaauaaaguacugcaaa

SEQ ID NO: 61245 - RNA, 64 nt, Homo Sapiens
cugcgauggcguucauguccgucucgcucaucaucaccgacauguccuucuuaucuggaaagag

SEQ ID NO: 61246 - RNA, 64 nt, Homo Sapiens
ugcccagccuguucacaugccccacagcacaugacaccgacagccuggacaucagggacuuuug

SEQ ID NO: 61247 - RNA, 64 nt, Homo Sapiens
ccccgauuaaacccacaccuugcagcugcccugccaccgacagacaucaccaacacggccuccc

SEQ ID NO: 61248 - RNA, 64 nt, Homo Sapiens
uggagcuagaaggaaaagcuaagguuacacugugcaccgacaugauuccauauuuuuuuaagaa

SEQ ID NO: 61249 - RNA, 64 nt, Homo Sapiens
cuacuaguacuuuguuccuggccaggaaaaaaaucaccgacacaaaaugcucaugccaguuaau

SEQ ID NO: 61250 - RNA, 64 nt, Homo Sapiens; identical to SEQ ID NO: 45231

SEQ ID NO: 61251 - RNA, 64 nt, Homo Sapiens; identical to SEQ ID NO: 45232

SEQ ID NO: 61252 - RNA, 64 nt, Homo Sapiens; identical to SEQ ID NO: 45233

SEQ ID NO: 61253 - RNA, 64 nt, Homo Sapiens; identical to SEQ ID NO: 45234

SEQ ID NO: 61254 - RNA, 64 nt, Homo Sapiens; identical to SEQ ID NO: 45235

SEQ ID NO: 61255 - RNA, 64 nt, Homo Sapiens; identical to SEQ ID NO: 45236

SEQ ID NO: 61256 - RNA, 64 nt, Homo Sapiens; identical to SEQ ID NO: 45237

SEQ ID NO: 61257 - RNA, 64 nt, Homo Sapiens; identical to SEQ ID NO: 45238

SEQ ID NO: 61258 - RNA, 64 nt, Homo Sapiens; identical to SEQ ID NO: 45239

SEQ ID NO: 61259 - RNA, 64 nt, Homo Sapiens; identical to SEQ ID NO: 45240

SEQ ID NO: 61260 - RNA, 64 nt, Homo Sapiens; identical to SEQ ID NO: 45241

SEQ ID NO: 61261 - RNA, 64 nt, Homo Sapiens; identical to SEQ ID NO: 45242

SEQ ID NO: 61262 - RNA, 64 nt, Homo Sapiens; identical to SEQ ID NO: 45243

SEQ ID NO: 61263 - RNA, 64 nt, Homo Sapiens; identical to SEQ ID NO: 45244

SEQ ID NO: 61264 - RNA, 64 nt, Homo Sapiens; identical to SEQ ID NO: 45245

SEQ ID NO: 61265 - RNA, 64 nt, Homo Sapiens; identical to SEQ ID NO: 45246

SEQ ID NO: 61266 - RNA, 64 nt, Homo Sapiens; identical to SEQ ID NO: 45247

SEQ ID NO: 61267 - RNA, 64 nt, Homo Sapiens; identical to SEQ ID NO: 45248

SEQ ID NO: 61268 - RNA, 64 nt, Homo Sapiens; identical to SEQ ID NO: 45249

SEQ ID NO: 61269 - RNA, 64 nt, Homo Sapiens; identical to SEQ ID NO: 45250

SEQ ID NO: 61270 - RNA, 64 nt, Homo Sapiens; identical to SEQ ID NO: 45251

SEQ ID NO: 61271 - RNA, 64 nt, Homo Sapiens; identical to SEQ ID NO: 45252

SEQ ID NO: 61272 - RNA, 64 nt, Homo Sapiens; identical to SEQ ID NO: 45253

SEQ ID NO: 61273 - RNA, 64 nt, Homo Sapiens; identical to SEQ ID NO: 45254

SEQ ID NO: 61274 - RNA, 64 nt, Homo Sapiens; identical to SEQ ID NO: 45255

SEQ ID NO: 61275 - RNA, 64 nt, Homo Sapiens; identical to SEQ ID NO: 45256

SEQ ID NO: 61276 - RNA, 64 nt, Homo Sapiens; identical to SEQ ID NO: 45257

SEQ ID NO: 61277 - RNA, 64 nt, Homo Sapiens; identical to SEQ ID NO: 45258

SEQ ID NO: 61278 - RNA, 64 nt, Homo Sapiens; identical to SEQ ID NO: 45259

SEQ ID NO: 61279 - RNA, 64 nt, Homo Sapiens; identical to SEQ ID NO: 45260

SEQ ID NO: 61280 - RNA, 64 nt, Homo Sapiens; identical to SEQ ID NO: 45261

SEQ ID NO: 61281 - RNA, 64 nt, Homo Sapiens; identical to SEQ ID NO: 45262

SEQ ID NO: 61282 - RNA, 64 nt, Homo Sapiens; identical to SEQ ID NO: 45263

SEQ ID NO: 61283 - RNA, 64 nt, Homo Sapiens; identical to SEQ ID NO: 45264

SEQ ID NO: 61284 - RNA, 64 nt, Homo Sapiens; identical to SEQ ID NO: 45265

SEQ ID NO: 61285 - RNA, 64 nt, Homo Sapiens; identical to SEQ ID NO: 45266

SEQ ID NO: 61286 - RNA, 64 nt, Homo Sapiens; identical to SEQ ID NO: 45267

SEQ ID NO: 61287 - RNA, 64 nt, Homo Sapiens; identical to SEQ ID NO: 45268

SEQ ID NO: 61288 - RNA, 64 nt, Homo Sapiens; identical to SEQ ID NO: 45269

SEQ ID NO: 61289 - RNA, 64 nt, Homo Sapiens; identical to SEQ ID NO: 45270

SEQ ID NO: 61290 - RNA, 64 nt, Homo Sapiens; identical to SEQ ID NO: 45271

SEQ ID NO: 61291 - RNA, 64 nt, Homo Sapiens; identical to SEQ ID NO: 45272

SEQ ID NO: 61292 - RNA, 64 nt, Homo Sapiens; identical to SEQ ID NO: 45273

SEQ ID NO: 61293 - RNA, 64 nt, Homo Sapiens; identical to SEQ ID NO: 45274

SEQ ID NO: 61294 - RNA, 64 nt, Homo Sapiens; identical to SEQ ID NO: 45275

SEQ ID NO: 61295 - RNA, 64 nt, Homo Sapiens; identical to SEQ ID NO: 45276

SEQ ID NO: 61296 - RNA, 64 nt, Homo Sapiens; identical to SEQ ID NO: 45277

SEQ ID NO: 61297 - RNA, 64 nt, Homo Sapiens; identical to SEQ ID NO: 45278

SEQ ID NO: 61298 - RNA, 64 nt, Homo Sapiens; identical to SEQ ID NO: 45279

SEQ ID NO: 61299 - RNA, 64 nt, Homo Sapiens; identical to SEQ ID NO: 45280

SEQ ID NO: 61300 - RNA, 64 nt, Homo Sapiens
gggaaaauggggccuucgaccccagcgggcuaccugaaccaaggcgucucuuuaaguggggcgc

SEQ ID NO: 61301 - RNA, 64 nt, Homo Sapiens
caucgucuuauauaugaagcgccuugagugugcaugaaccaaaggaaauaacauugaagaagga

SEQ ID NO: 61302 - RNA, 64 nt, Homo Sapiens
guuuuuaaggaaacaaaacuccacgccuggcccaugaaccaagugggauuacaggugugagcca

SEQ ID NO: 61303 - RNA, 64 nt, Homo Sapiens
guuuuuuuuuguuuuuuuuuuauuaaaugguaaaugaaccaagugauagcaaauaucuaucugc

SEQ ID NO: 61304 - RNA, 64 nt, Homo Sapiens
gugccuucuuaaggaaaccauuugauaggaaagaugaaccaaauaacucaaugauggaugagcu

SEQ ID NO: 61305 - RNA, 64 nt, Homo Sapiens
augauggaugagcugguagaaaaaaagcugguggugaaccaaggucaaacuggaaauuauaguc

SEQ ID NO: 61306 - RNA, 64 nt, Homo Sapiens
ugucaguuuuguauuggggaugcuguuuauagagugaaccaagauaauaugcuuuggccaaauu

SEQ ID NO: 61307 - RNA, 64 nt, Homo Sapiens
uaagacuuacuaaaggaagauugccuuugggucuugaaccaaaaauaaauaauagagcagaugg

SEQ ID NO: 61308 - RNA, 64 nt, Homo Sapiens
gcagcuuucucuggaaaaugaaugcuaauuagugugaaccaaaagaguaaguaagagucugaag

SEQ ID NO: 61309 - RNA, 64 nt, Homo Sapiens
uccccuccgcacaggaaagguacccaguagauaaugaaccaaauuaaguucccucccuccagcc

SEQ ID NO: 61310 - RNA, 64 nt, Homo Sapiens
gcaggaagagguugcuggaggggcuugagucgccugaaccaagagcccaugugcaagaaaauga

SEQ ID NO: 61311 - RNA, 56 nt, Homo Sapiens
gcaggaagagguugcucagggucaccugaaccaagaggaagaaaaugagggcuuga

SEQ ID NO: 61312 - RNA, 64 nt, Homo Sapiens
uguaguugacuccaagucucugugagcagugacuugaaccaaacacaccaggaauaauccauuc

SEQ ID NO: 61313 - RNA, 64 nt, Homo Sapiens
ccacuguccuuagaagaaagggcauuuuuacuuuugaaccaaaaagagaaaaaaaaaucagaag

SEQ ID NO: 61314 - RNA, 64 nt, Homo Sapiens
aauaaauuccuugaaagauauaaccccccaagauugaaccaagaagaaauugcaucccugaaca

SEQ ID NO: 61315 - RNA, 64 nt, Homo Sapiens
guugcauuucuauacaccaguaauguccaagcuaugaaccaaaucaagaauggaaucccauuca

SEQ ID NO: 61316 - RNA, 64 nt, Homo Sapiens
cguuuugacaccuuuccuauagaugauauaggaaugaaccaauacgcuuuuauuacccuuucua

SEQ ID NO: 61317 - RNA, 64 nt, Homo Sapiens
auguauguaguccuacaacugcaaaacgucuuacugaaccaacaaucaaaaaaugguucuguuu

SEQ ID NO: 61318 - RNA, 64 nt, Homo Sapiens
uauacuaguccuuuuaagggaaguuuuuguuagagauuggaaauuaucugugagauuugacacu

SEQ ID NO: 61319 - RNA, 64 nt, Homo Sapiens
uaaaauuuuucaaagaacaauugcuugcauccuagauuggaaauauucaaauaaacauauauuc

SEQ ID NO: 61320 - RNA, 64 nt, Homo Sapiens
ccuguaauccuuguacuguucggcugaauuugaagauuggaagacuuauauugagaccaguaac

SEQ ID NO: 61321 - RNA, 64 nt, Homo Sapiens
aagaccccucauuaaaagccaaggacguucuuaagauuggaacugacauaauuagucuugacuu

SEQ ID NO: 61322 - RNA, 64 nt, Homo Sapiens
gaacucucugguauuauuaauuuuuaauauauuugauuggaaaaauaacccucaagccaguuga

SEQ ID NO: 61323 - RNA, 64 nt, Homo Sapiens
caggcaugacucaaaccuggaguagcagaguugggauuggaauuuugcucaacaucauauagua

SEQ ID NO: 61324 - RNA, 64 nt, Homo Sapiens
auugcauagcuggauacccaucaucuguuucucugauuggaagcugcuguuguacagaaagacc

SEQ ID NO: 61325 - RNA, 64 nt, Homo Sapiens
cugagauacagacuuguucauagguguggggccugauuggaacaggaucugccauuggucacaa

SEQ ID NO: 61326 - RNA, 64 nt, Homo Sapiens
acugaguugccugccauccaaaggggaugggcgggauuggaagaagcuguggcagcucuuuucc

SEQ ID NO: 61327 - RNA, 64 nt, Homo Sapiens
uuuucuagcauuugccagucccugugccuggacugauuggaacacuuuguuuuucucccugugc

SEQ ID NO: 61328 - RNA, 64 nt, Homo Sapiens
uguacauuacuucuaguuuuggaugagaccaugagauuggaaaaagcgauuuuauuaucuuggg

SEQ ID NO: 61329 - RNA, 64 nt, Homo Sapiens
aguuuucuguuuaaggcuuuuuguaccuuuuucagauuggaauucugggauuuuaugugccuuu

SEQ ID NO: 61330 - RNA, 64 nt, Homo Sapiens
cauuguaggucauuagggaaaaacaccugaucuugauuggaaagcuugguaaagaauaacccac

SEQ ID NO: 61331 - RNA, 64 nt, Homo Sapiens
cgcucuugguaaagaauaacuugucugauacauagauuggaaggaacaaagaaaauuuaccacc

SEQ ID NO: 61332 - RNA, 64 nt, Homo Sapiens
gacguccugaagagccagucaaguccaccugucugguccauaguuugccaugcuguuggccugg

SEQ ID NO: 61333 - RNA, 64 nt, Homo Sapiens
auuucauaaaaugaagaaaaacaagaagugcauagguccauaaucugaaagaccugcuccuucc

SEQ ID NO: 61334 - RNA, 64 nt, Homo Sapiens
auacacagacaaaaacacaaaaacucugaggggaucuggugaaucuccaaauuauugugggugu

SEQ ID NO: 61335 - RNA, 64 nt, Homo Sapiens
cacaaauguuccacaaggcgggaguguuucacuuucuggugauaaacuugauggucauuguuau

SEQ ID NO: 61336 - RNA, 64 nt, Homo Sapiens
guuauuauuaggaguguucuaacagcaguaguaaucuggugaauuauuuucuuagucugaaaaa

SEQ ID NO: 61337 - RNA, 64 nt, Homo Sapiens
aaaaagucuuguacuaaguuccccaaaauaagauucuggugaaguggaaugagaauggggauac

SEQ ID NO: 61338 - RNA, 64 nt, Homo Sapiens
uucugccugguggggccauugagaaaucaccuugucuggugauuacuagagcugaaaagaagcu

SEQ ID NO: 61339 - RNA, 64 nt, Homo Sapiens
ugaugaaugugggaagggcuuacuagcuggaaacucuggugacgaaaccccuuagaacucuccc

SEQ ID NO: 61340 - RNA, 64 nt, Homo Sapiens
auggccuugugaaguccagucaugugcacgugagucuggugaaaccgcagcacagccuuccauu

SEQ ID NO: 61341 - RNA, 64 nt, Homo Sapiens
gggagagcccuucccauccugagcuucugcugccucuggugagaccaggucuucauggggcccu

SEQ ID NO: 61342 - RNA, 64 nt, Homo Sapiens
ggguggggccguggcacuuugccuuucuacugaaucuggugaugccuuguaggaaauuccaagg

SEQ ID NO: 61343 - RNA, 64 nt, Homo Sapiens
augucuuucauggcaucugagaguguggggacugucuggugaugccuguccugccaaguggcaa

SEQ ID NO: 61344 - RNA, 64 nt, Homo Sapiens
gugucacgagcuuuguuacuagguagccugugcaucuggugaguaaagggaggcgugccugaga

SEQ ID NO: 61345 - RNA, 64 nt, Homo Sapiens
gcgacugggugggugaagcagcugcauacacauuucuggugaggagaggcauacaagucuguuu

SEQ ID NO: 61346 - RNA, 64 nt, Homo Sapiens
acuaugcaagcuauaagacaaauggcagcauauuucuggugagaauacauacacaugaacaaag

SEQ ID NO: 61347 - RNA, 64 nt, Homo Sapiens
acaauacccccacauauucaaaagauuuuccaaaucuggugaaauauuugaauaaauaauggcu

SEQ ID NO: 61348 - RNA, 64 nt, Homo Sapiens
ugcucccugccccucccccugccuuuccacucugucuggugagcucugcuuuuucagugcacca

SEQ ID NO: 61349 - RNA, 64 nt, Homo Sapiens
cuuuguguuccuagaagagcuucauuucagugaaucuggugaccuccaucugcuugcugucaua

SEQ ID NO: 61350 - RNA, 64 nt, Homo Sapiens
gacaaaagaacuugaaccuaucaaccucuguuauucuggugacugcacuuauucagauguaucu

SEQ ID NO: 61351 - RNA, 64 nt, Homo Sapiens
aaauaugguauuucaugauccaaaugggucacuaucuggugaaaaugucgacuauuagugauaa

SEQ ID NO: 61352 - RNA, 64 nt, Homo Sapiens
ggagucaaaaaacuugauuucagguccuagcucuagcacuuacagcugugugaucuugggcaag

SEQ ID NO: 61353 - RNA, 64 nt, Homo Sapiens
auauuuugauuuuacccagcuuaaucuguaaaguagcacuuaaauauaucugauagcaacacuu

SEQ ID NO: 61354 - RNA, 64 nt, Homo Sapiens
uguuuacaaagcccuuucacugccuuguguggucagcacuuaacugauaaucaguauaauaauu

SEQ ID NO: 61355 - RNA, 64 nt, Homo Sapiens
auucagcuugucucauccccccagagugacugagagcacuuaaccccaccuguggccccuaaac

SEQ ID NO: 61356 - RNA, 64 nt, Homo Sapiens
cuguaaauugaauaauuuauagcagauagcaguuagcacuuaauuuguuuuaaauuaauuuuuu

SEQ ID NO: 61357 - RNA, 64 nt, Homo Sapiens
aaauaaagguacuuuacagcgaaacugucgcugaagcacuuaaguuaaucaauuaguaauggcg

SEQ ID NO: 61358 - RNA, 64 nt, Homo Sapiens
gaaagcuaaaacaacccauuugcuacccauccaaagcacuuacaguuuagcaaauauuaaagag

SEQ ID NO: 61359 - RNA, 64 nt, Homo Sapiens
ccauaaaagagaaaaaaauucggaaagugaucagagcacuuauucaaaauacagugauagaagu

SEQ ID NO: 61360 - RNA, 64 nt, Homo Sapiens
cauuuuacaauagauaaaugcuugugcuaccuaaagcacuuagcacacaguuaaauuauauuua

SEQ ID NO: 61361 - RNA, 64 nt, Homo Sapiens
aauaaaucacuauacugauauuuugauacaagcaagcacuuacaugguaaucacuauauagauc

SEQ ID NO: 61362 - RNA, 64 nt, Homo Sapiens
acucuacucaucuuuagagaugaaucaucuauuaagcacuuaccaaaacauaucauuaaacuga

SEQ ID NO: 61363 - RNA, 64 nt, Homo Sapiens
uguauuauaauuaguuuugugaauagaaaaauaaagcacuuauguuuaaauuuguuacagugac

SEQ ID NO: 61364 - RNA, 64 nt, Homo Sapiens
aaaagugagguguggaacuccaggcaacgacccaagcacuuauuuuuuaagagggaaaggacuu

SEQ ID NO: 61365 - RNA, 64 nt, Homo Sapiens
agauuaucgaucuaugagacaucuugauauguaaagcacuuaauauuaaaggcauaaaagugaa

SEQ ID NO: 61366 - RNA, 64 nt, Homo Sapiens
gaacgagagcaucuuguucaacguuguugcacaaagcacuuaaaagauuucggcaucgacacgg

SEQ ID NO: 61367 - RNA, 64 nt, Homo Sapiens
gcaacaauuguaagucgacucccacagugagcugagcacuuacacacccccucaauagccagca

SEQ ID NO: 61368 - RNA, 64 nt, Homo Sapiens
cauuccaaguacuuuuuuuuaggaaaaaaaggguagcacuuauuaaauauuuuuaugccuacuu

SEQ ID NO: 61369 - RNA, 56 nt, Homo Sapiens
acaauuaaauagaaauagguaaccuuagcacuuagcauggaaaaccuaaagaguaa

SEQ ID NO: 61370 - RNA, 64 nt, Homo Sapiens
cugcugcuccuauauuuuuuaagaaauauaauaaagcacuuagggcaggggaaaucaucucggu

SEQ ID NO: 61371 - RNA, 64 nt, Homo Sapiens
uuucuaggauuaacugagagauuaaaggaacagcagcacuuaggcucaaaaucgccccuacaaa

SEQ ID NO: 61372 - RNA, 64 nt, Homo Sapiens
gugcagguaguguuuaguuaucuacugcauuaugagcacuuaaaguacugcuagcuguagaacu

SEQ ID NO: 61373 - RNA, 64 nt, Homo Sapiens
caacuuucuauuuuuagccuauauuuggaaagaaagcacuuaacauuuuaggaauucuuuuuaa

SEQ ID NO: 61374 - RNA, 64 nt, Homo Sapiens
cacauuuaggaaaagacauauguauuuuauccauagcacuuauucugcuguuauuuucuacauu

SEQ ID NO: 61375 - RNA, 64 nt, Homo Sapiens
uuguuuauauccauuuuuucuacaguuuagaaagagcacuuauucaauauuuuugaaaauuuag

SEQ ID NO: 61376 - RNA, 64 nt, Homo Sapiens
cugccauauccugcuggcuccuugcuugauuucccucagcaaacccuugaacuugcuaggccau

SEQ ID NO: 61377 - RNA, 64 nt, Homo Sapiens
aaggcaaguggugauggcgccacugcacuccuaccucagcaacagaguaagacucugucccaaa

SEQ ID NO: 61378 - RNA, 64 nt, Homo Sapiens
ccugggggcccacgacucaccuggugggccugggcucagcaaacagcccucccucccaguauuu

SEQ ID NO: 61379 - RNA, 64 nt, Homo Sapiens
cacaauuugcacuccccucagcuagacgcacagacucagcaauaaaccuuugcaucaggcucca

SEQ ID NO: 61380 - RNA, 64 nt, Homo Sapiens
uuucagcaucggcucuucagcagauccaaacccccucagcaacuugcagaggaccuguccccuc

SEQ ID NO: 61381 - RNA, 64 nt, Homo Sapiens
ccgacacuugugaaacuccgagaagugcuguggucucagcaaugcaccuguuuuguacaugauu

SEQ ID NO: 61382 - RNA, 64 nt, Homo Sapiens
gcccauagacuacaguucuucagaggccauaugucucagcaaguacugguuauauucuuuuuuu

SEQ ID NO: 61383 - RNA, 64 nt, Homo Sapiens
guauucuuagaccaaaaaucauaaccugcuguuucucagcaaagccuugcucucuggagcuuac

SEQ ID NO: 61384 - RNA, 64 nt, Homo Sapiens
gggaugacacagcaaggaugacucagcacugccccucagcaaggaugacucagcacugccgcuc

SEQ ID NO: 61385 - RNA, 64 nt, Homo Sapiens; identical to SEQ ID NO: 61384

SEQ ID NO: 61386 - RNA, 64 nt, Homo Sapiens
gugaugacacagcaaggaugacucagcacugccccucagcaaggaugacucagcacugccgcuc

SEQ ID NO: 61387 - RNA, 64 nt, Homo Sapiens
gacaugacucagcagggaugacucagcaccgccccucagcaaggaugacucagcagggaugauu

SEQ ID NO: 61388 - RNA, 64 nt, Homo Sapiens
gcugccuugaaaucaagagacaauaacuuugaaccucagcaagaccuugaaccgccgguucauu

SEQ ID NO: 61389 - RNA, 64 nt, Homo Sapiens
aaaguguggcauagcuaccugcccauccccaacccucagcaaaguagaaucucuuuucugguaa

SEQ ID NO: 61390 - RNA, 64 nt, Homo Sapiens
aggagucccucccagaaaggaggucuucugcaccccccucaaugcaggguugaugcaggucugc

SEQ ID NO: 61391 - RNA, 64 nt, Homo Sapiens
gcagucagagagcaagccccccaggacccuggggccccucaacuuuccuggcucgucucaaagg

SEQ ID NO: 61392 - RNA, 64 nt, Homo Sapiens
cuauauuuugacacuaaaaaccuagcguccagcuccccucaacgcuuugcguuagggugaagac

SEQ ID NO: 61393 - RNA, 64 nt, Homo Sapiens
gaugagcaggucaggcugugcaaccuucccuagcccccucaauagccuggacccucaaccccug

SEQ ID NO: 61394 - RNA, 64 nt, Homo Sapiens
cccagcagcccucaacaggcucggcgcccaccacccccucaagcuuauuuauacagugccuugc

SEQ ID NO: 61395 - RNA, 64 nt, Homo Sapiens
gccaagugugaccccacugcuggacuucugugggccccucaacauggauauggugcagagaagc

SEQ ID NO: 61396 - RNA, 64 nt, Homo Sapiens
gcacaugugccacuguucagucaggggacaaucuccccucaaccucaucagucaucaggugugc

SEQ ID NO: 61397 - RNA, 64 nt, Homo Sapiens
cccaaagguccgcacccugugcaguguccagagaccccucaaucgcuguuaggacagcaaagca

SEQ ID NO: 61398 - RNA, 64 nt, Homo Sapiens
uuaaugaacaagguggaccaaagggcugaaccagccccucaaccaggacccuggggggccugcu

SEQ ID NO: 61399 - RNA, 64 nt, Homo Sapiens
ccaucucugaccagcugggaaccugcuuggggucccccucaaaccugugucuggggugugggcu

SEQ ID NO: 61400 - RNA, 64 nt, Homo Sapiens
cugcccugaacaugccccagaugugcagggcgucccccucaaccagucauugcacagcaaagcc

SEQ ID NO: 61401 - RNA, 64 nt, Homo Sapiens
uugcagaugcccaccuggaaagacccaccggagcccccucaacuugagucuccucacagcagag

SEQ ID NO: 61402 - RNA, 64 nt, Homo Sapiens
gaccagagcgcccucugaugagcccacugcccacccccucaagccaauccccuccuugggcacu

SEQ ID NO: 61403 - RNA, 64 nt, Homo Sapiens
ugcccugguggagaaagcacugaccugucaugccccccucaaaccuccucuucugacgugccuu

SEQ ID NO: 61404 - RNA, 64 nt, Homo Sapiens
ucuucugcccauagacggggaugacucagcacuaccccucaacagagaugacuuugaugacucu

SEQ ID NO: 61405 - RNA, 64 nt, Homo Sapiens
agcacuaccccuuaacagggaugacuccgcacugccccucaacagggaugacucagcagagaug

SEQ ID NO: 61406 - RNA, 64 nt, Homo Sapiens
acagggaugacucagcagggaugacucagcaccgccccucaacaggcaugacucugcagagaug

SEQ ID NO: 61407 - RNA, 64 nt, Homo Sapiens
ucaacagggaugacucagggauggcuuaguacugccccucaacagggaugacucagcagggaug

SEQ ID NO: 61408 - RNA, 64 nt, Homo Sapiens; identical to SEQ ID NO: 61406

SEQ ID NO: 61409 - RNA, 64 nt, Homo Sapiens
aguacugccccucagcagggaugacucagcacugccccucaacagggaugacucagcagggaug

SEQ ID NO: 61410 - RNA, 64 nt, Homo Sapiens
aguacugccccucagcagggaugacucagcaccgccccucaacagggaugacucagcacugccc

SEQ ID NO: 61411 - RNA, 64 nt, Homo Sapiens
agcaccgccccucaacagggaugacucagcacugccccucaacagggaugacucagcagggaug

SEQ ID NO: 61412 - RNA, 64 nt, Homo Sapiens
gcagggaugacucagcagggaugacucagcaccaccccucaacagggaugacucagcagggaug

SEQ ID NO: 61413 - RNA, 64 nt, Homo Sapiens
acagggaugacucagcagggaugacucagcacugccccucaacagggaugacugcagggaugac

SEQ ID NO: 61414 - RNA, 64 nt, Homo Sapiens
gcagggaugacucagcagggaugacucagcaccgccccucaacaggcaugacucugcagagaug

SEQ ID NO: 61415 - RNA, 64 nt, Homo Sapiens
gcagggauggcucagcagggaugacucagcauugccccucaacagggaugacucagcagacuca

SEQ ID NO: 61416 - RNA, 64 nt, Homo Sapiens
acucagcagacucagcagggaugacucagcacugccccucaacagacaugacucagcagggaug

SEQ ID NO: 61417 - RNA, 62 nt, Homo Sapiens
ugucaucacuucuauagauuuccuaacuccaccaugccuauuucugguuauauaauugcucu

SEQ ID NO: 61418 - RNA, 62 nt, Homo Sapiens
gaggcuggaaacuccaagauuaaggcagauuucaugccuauugagggccugcuuucugauua

SEQ ID NO: 61419 - RNA, 62 nt, Homo Sapiens
ccuuuggguuccauguuuuccuuguucccucccaugccuagcuggauugcagaguuaaguuu

SEQ ID NO: 61420 - RNA, 62 nt, Homo Sapiens
cuacaaaaaauaauuagccuggccugguggugcaugccuaguccuagcugaucuggaggcug

SEQ ID NO: 61421 - RNA, 62 nt, Homo Sapiens
uaaaaauacaaaauuggcagggugugguggcacaugccuauaaucccagcuacuugggaggc

SEQ ID NO: 61422 - RNA, 62 nt, Homo Sapiens
aaaaguaaaauaauaggccaggcaugguggcucaugccuauaagcacccugggaggccgagg

SEQ ID NO: 61423 - RNA, 62 nt, Homo Sapiens
uaaaggagaauaacuggccgggcacgguggcucaugccuauaaaauuccagcacuuugggag

SEQ ID NO: 61424 - RNA, 64 nt, Homo Sapiens
cuuacauuuagugcaaauugagaaacaaacuuuaucucccuauuuagcauuaacauaaaauacc

SEQ ID NO: 61425 - RNA, 64 nt, Homo Sapiens
aaaacagcaggaaauuuuuauucauccuaaauuuucucccuaucguuugucuuuauauuuuauc

SEQ ID NO: 61426 - RNA, 64 nt, Homo Sapiens
cuugcuuagccaagagauacacaaugaaacauacucucccuacaaaggcucucaaaacagcaga

SEQ ID NO: 61427 - RNA, 64 nt, Homo Sapiens
augccaaaguggcauuauguaggcugcaguggaaucucccuaggggaggagaggcaguagaguc

SEQ ID NO: 61428 - RNA, 64 nt, Homo Sapiens
guuuaucauuauuuugauauccauuacccucaccucucccuaguucauaaauaggucuauagca

SEQ ID NO: 61429 - RNA, 64 nt, Homo Sapiens
ucccagccagggacacuguguggaguucgcacacucucccuaugucuccgggugcuccaguuuc

SEQ ID NO: 61430 - RNA, 64 nt, Homo Sapiens
ccugccuuagauuccucaauccaucauacucaggucucccuacuacucccaacccuaccaugcu

SEQ ID NO: 61431 - RNA, 64 nt, Homo Sapiens
ccugaaaugcugugagcuugcugcagacagcuuaucucccuaacgaacccucaacuauugacug

SEQ ID NO: 61432 - RNA, 64 nt, Homo Sapiens
gagcugccucccugcugccgccuaagccugugccucucccuaaacuggcaucugucucuugcua

SEQ ID NO: 61433 - RNA, 64 nt, Homo Sapiens
cucccagccaaccuagugccccaccccccauccuucucccuacagcuuuugagagaggcuguga

SEQ ID NO: 61434 - RNA, 63 nt, Homo Sapiens
aaggagcccaugugguuggauaaaaucaagaaaaggcugaaugagcacgguuacccccaagug

SEQ ID NO: 61435 - RNA, 63 nt, Homo Sapiens
auaaggauuuuggccaaaugggacuuagacuggaggcugaauuugagaaggauuucaaggaag

SEQ ID NO: 61436 - RNA, 63 nt, Homo Sapiens
uguuguauaacugaccugugguacucucaauaaaggcugaaaaugaauuuuggcaugaugacu

SEQ ID NO: 61437 - RNA, 63 nt, Homo Sapiens
uauagguacaucuguuuucaguaugcuaucuguaggcugaaauaugaauaaugaccuuaugaa

SEQ ID NO: 61438 - RNA, 63 nt, Homo Sapiens
uauccaggaaagggggcuugugacuguucuuuaaggcugaagaucaaccaauggguggccuug

SEQ ID NO: 61439 - RNA, 63 nt, Homo Sapiens
aaaaaagugggcucguauuuugugggggaggauaggcugaaaaguaaguagcgcagcagccuc

SEQ ID NO: 61440 - RNA, 63 nt, Homo Sapiens
ucacuauucacaggacauuggcauuaucuacuaaggcugaaaaugugcauauuccaugacuca

SEQ ID NO: 61441 - RNA, 63 nt, Homo Sapiens
aaauaauaacagacaaggucaaaaaauagaugcaggcugaaaagaaaaggaagugggcuaaga

SEQ ID NO: 61442 - RNA, 63 nt, Homo Sapiens
aauuugaaagcagcaauuugucaauagauuuuuaggcugaauuuacgacgcaauaaaauaaca

SEQ ID NO: 61443 - RNA, 63 nt, Homo Sapiens
gaauguaauuuuuauuuucuugcauauggagguaggcugaaaacucuaccccacccuacaaaa

SEQ ID NO: 61444 - RNA, 63 nt, Homo Sapiens
gucucaagauuccccacacuccgcauagugcauaggcugaaauaucaguuaucaguacaagug

SEQ ID NO: 61445 - RNA, 63 nt, Homo Sapiens
auuccuggaacucaugcaggacuggaaagcagcaggcugaacacugaggccaggaaaagaagc

SEQ ID NO: 61446 - RNA, 63 nt, Homo Sapiens
cacgaauuacucaaaaaguaacucucaaaacauaggcugaaagagauugugaugucauauuuc

SEQ ID NO: 61447 - RNA, 63 nt, Homo Sapiens
aagggcgcagugugauauuucagucuaucagggaggcugaagcuuaauauugcacacccaaac

SEQ ID NO: 61448 - RNA, 63 nt, Homo Sapiens
ccugcggaaggagcuggagacagcuacaagcagaggcugaacaggcccuccgagguggagcag

SEQ ID NO: 61449 - RNA, 63 nt, Homo Sapiens
ccugcggaaggagcuggagacagcuacaagcagaggcugaacaggcccuccgagguggaacag

SEQ ID NO: 61450 - RNA, 63 nt, Homo Sapiens
gcagccucuucaaaaugagcccuguccugccuaaggcugaacuuguuuucugggaacaccaua

SEQ ID NO: 61451 - RNA, 63 nt, Homo Sapiens
ccuccuggacuccugcacacgcuccuuccucugaggcugaaauucagaauauuagugaccuca

SEQ ID NO: 61452 - RNA, 63 nt, Homo Sapiens
gguggcaugagccuguguucccagcugcuuaggaggcugaagcaggaggauugauugagccug

SEQ ID NO: 61453 - RNA, 63 nt, Homo Sapiens
ggucacaaccugagguacucugcugagugggcaaggcugaagaagaggccuguggaaugcagc

SEQ ID NO: 61454 - RNA, 63 nt, Homo Sapiens
aagcaggguggccuccagagccuugccauaaaaaggcugaaggcagccgggcgcaguggcuca

SEQ ID NO: 61455 - RNA, 63 nt, Homo Sapiens
gacuccgucucaaaaaaaaaaaaaaaacaaaaaaggcugaaggcagcuguagcuccacacaga

SEQ ID NO: 61456 - RNA, 63 nt, Homo Sapiens
uuaagagguuuguauauaaaucuguuauagaacaggcugaaauuucuuguucauaagauuaug

SEQ ID NO: 61457 - RNA, 63 nt, Homo Sapiens
caccuaacauuauacuucauggugauagacugaaggcugaauguuuuccccuuaagauuggga

SEQ ID NO: 61458 - RNA, 63 nt, Homo Sapiens
cacuagaauccugaccuguagguugcugucggcaggcugaagagacacagggcccagcaccca

SEQ ID NO: 61459 - RNA, 63 nt, Homo Sapiens
ggcugacaggucggggggcugaggaggcugaggaggcugaagacaggccuggugguggcagug

SEQ ID NO: 61460 - RNA, 64 nt, Homo Sapiens
ugagagagaagaaggggagaggcugggcugggccugcccugaauggucucuucccgaugccagu

SEQ ID NO: 61461 - RNA, 64 nt, Homo Sapiens
uggacaagcugugcacgucuuuugagagacgcagugcccugaccccaccccccaagugaaacgg

SEQ ID NO: 61462 - RNA, 64 nt, Homo Sapiens
cuaggaagccagcucuggggcuccuaagccaggcugcccugaugacuacuucuguagcaggggc

SEQ ID NO: 61463 - RNA, 64 nt, Homo Sapiens
caaauguuagcacuugcuagccuggaaacgccuuugcccugaucgggucugguauaaaaacacu

SEQ ID NO: 61464 - RNA, 64 nt, Homo Sapiens
auggcucugcccccaggucguccccaucuaucugugcccugagcaugccccaucucgacuccca

SEQ ID NO: 61465 - RNA, 64 nt, Homo Sapiens
aaggaagagcccuggaggugguugggggcaaaugugcccugaguccuuggggugguucugcuua

SEQ ID NO: 61466 - RNA, 64 nt, Homo Sapiens
agugcaugauccccauguugcaauauggagucucugcccugagaucuuccccaucucaguuuuc

SEQ ID NO: 61467 - RNA, 64 nt, Homo Sapiens
gauuuucaaggccuuaacaaaguuaaaggaccacugcccugagguuacugcacugaggccaagu

SEQ ID NO: 61468 - RNA, 64 nt, Homo Sapiens
cuugaauuucaagcucagaggaaacuuugucucaugcccugacaugaaguggcaaacacggaag

SEQ ID NO: 61469 - RNA, 64 nt, Homo Sapiens
uaguaugaggacauuuguuugaauuauagaaauuugcccugagcugaacuggguuguguuaaca

SEQ ID NO: 61470 - RNA, 64 nt, Homo Sapiens
gcucuugcugucuucagcagcaucucaggguagcugcccugaccucggagcagucugucgcccc

SEQ ID NO: 61471 - RNA, 64 nt, Homo Sapiens
gcccugggcuucagccuuugugcaguacucucgaugcccugaacacacaccuucccuuugccca

SEQ ID NO: 61472 - RNA, 64 nt, Homo Sapiens
ccguaguccugcaaaguguccuuuguggggcugaugcccugaucccaguccagacgggugcugc

SEQ ID NO: 61473 - RNA, 64 nt, Homo Sapiens
cccggugcaggcucccgaccagugcugcccuguuugcccugagaaacaagaugucagagacuug

SEQ ID NO: 61474 - RNA, 64 nt, Homo Sapiens
agagcgagcugacagcagcaacacugucagaaggugcccugagacggccggcucagccuucccu

SEQ ID NO: 61475 - RNA, 64 nt, Homo Sapiens
cugcaggcagagccccucagugcucugagaaaccugcccugaacucaccgccuccccugccugg

SEQ ID NO: 61476 - RNA, 64 nt, Homo Sapiens
gaggaagccaagguggccaaggcccucgguccccugcccugauagggcuuaccugugggugggg

SEQ ID NO: 61477 - RNA, 64 nt, Homo Sapiens
ccccccacucuccuuuagggagcugagguucuucugcccugagcccugcagcagcggcagucac

SEQ ID NO: 61478 - RNA, 64 nt, Homo Sapiens
uuggccugacccugugggagucagaagccauggcugcccugaaguggggacggaauagacucac

SEQ ID NO: 61479 - RNA, 64 nt, Homo Sapiens
caccacccuggacuggcccaggugggugauucucugcccugagccccguugagccacgcugucu

SEQ ID NO: 61480 - RNA, 64 nt, Homo Sapiens
cauggcugcugacugacuccgacccccaagccuaugcccugagcgggacuggucacugccucag

SEQ ID NO: 61481 - RNA, 64 nt, Homo Sapiens
uagccaugguugggugggugucuucucucccuucugcccugacguuucaucucucaucucucuu

SEQ ID NO: 61482 - RNA, 64 nt, Homo Sapiens
guuggguguuuuuccuuuaauaguuuucuuccccugcccugaugacuuacugcccagagccucg

SEQ ID NO: 61483 - RNA, 64 nt, Homo Sapiens
augccccagggcacugaggggucccccucaacccugcccugaacagcaaagccaugugcagggc

SEQ ID NO: 61484 - RNA, 64 nt, Homo Sapiens
ggcuguccaggccuucucccgggaaaacacacccugcccugaggccuggcucucugcggcuggu

SEQ ID NO: 61485 - RNA, 64 nt, Homo Sapiens
ggccggaggaaccgagguguugccagugcuaagcugcccugaggguuuccuucggggaccagcc

SEQ ID NO: 61486 - RNA, 64 nt, Homo Sapiens
agccuguucccacucagcagugagaguuccucuuugcccugaggcucagucucucucguauuuu

SEQ ID NO: 61487 - RNA, 64 nt, Homo Sapiens
ggagaauuauauaaagguuuucuuagaacaauuuugcccugauuacugaagcgucaaauaaagc

SEQ ID NO: 61488 - RNA, 64 nt, Homo Sapiens
gaagaaaguugaccuugugucacuauuuauuuuaugcccugaucagacuagcaacuuagauaag

SEQ ID NO: 61489 - RNA, 64 nt, Homo Sapiens
cccccagcacugccagggacugcccugucugcugugcccugaccacaggcugcuucauggcguu

SEQ ID NO: 61490 - RNA, 64 nt, Homo Sapiens
ucccagcgucccgagcccagcacugucucuucagugcccugauuucucacccagagguuucacc

SEQ ID NO: 61491 - RNA, 64 nt, Homo Sapiens
uacguggagcugcugccccgacaucacugcagagugcccugagcgagaggagggcuacugccuc

SEQ ID NO: 61492 - RNA, 64 nt, Homo Sapiens
aggagcauggagcucuacagcgagcccgggaggcugcccugagcucugccccaggagcgugcac

SEQ ID NO: 61493 - RNA, 64 nt, Homo Sapiens
acagugcuuguagcuuugaucccgucacucuccaugcccugacagagacgaggagggcucuggu

SEQ ID NO: 61494 - RNA, 64 nt, Homo Sapiens
cgaggagggcucuggucccggaagccaggcaggcugcccugagagacgcugugaucuccaccuu

SEQ ID NO: 61495 - RNA, 64 nt, Homo Sapiens
caauccugggaccauaauagaauagaguccagcugccucugagccagucaacacucauuugaca

SEQ ID NO: 61496 - RNA, 64 nt, Homo Sapiens
agaccaugucuuuuuaaaaugguuguauuuggaagccucugaaguugaugguuauagcgggugg

SEQ ID NO: 61497 - RNA, 64 nt, Homo Sapiens
cugaggguggcuuccucccauccccagccccuuggccucugaggcucucuuugaguuuggguuc

SEQ ID NO: 61498 - RNA, 64 nt, Homo Sapiens
ccgccccauuuacaggaaucggccaucaccuguggccucugagaccugccugguuggcagcggg

SEQ ID NO: 61499 - RNA, 64 nt, Homo Sapiens
agguagcucugacucuugucgguugaacacaucagccucugaaacuccaguuaaaucaaacauu

SEQ ID NO: 61500 - RNA, 64 nt, Homo Sapiens
ccucaagauaaauauggguuaaugccugcaugaugccucugaauucaggaauugcagggaaaac

SEQ ID NO: 61501 - RNA, 64 nt, Homo Sapiens
gagcagcagggaucaucacaugcagccaaacuuggccucugaagggggaagguagugggaauag

SEQ ID NO: 61502 - RNA, 64 nt, Homo Sapiens
guuaucccgguuccaagccugggacugcagucgugccucugacucacgaugcucagacacagaa

SEQ ID NO: 61503 - RNA, 64 nt, Homo Sapiens
auuaucccgguuccaagacgagggcuguggccgcgccucugacucaggaugcucagacaagaau

SEQ ID NO: 61504 - RNA, 64 nt, Homo Sapiens
gacaggcuuucuggaggaaucaggcccugggacagccucugagcuccuggggguguuucucuga

SEQ ID NO: 61505 - RNA, 64 nt, Homo Sapiens
gagggacccaggaaacuaagauuugagauucagugccucugaaagacuaccaaaaucuaaguug

SEQ ID NO: 61506 - RNA, 64 nt, Homo Sapiens
gccaagcgacguggcgggcuaacaagaagcaggggccucugagugagcguggccuacgugagcc

SEQ ID NO: 61507 - RNA, 64 nt, Homo Sapiens
cuuggcuugagucccacgugccagcagcggaagcgccucugaccccuacucuccucccuugcuc

SEQ ID NO: 61508 - RNA, 64 nt, Homo Sapiens
gaucaggcgaggccagcgagcggggggcaugcuggccucugagcggggcuccugugccgguggg

SEQ ID NO: 61509 - RNA, 64 nt, Homo Sapiens
uccaaacccagggcagccauccugccuucuagaugccucugagcuuggccaacagauuucuugu

SEQ ID NO: 61510 - RNA, 64 nt, Homo Sapiens
gacagaauuuuucucuuaacaugagaggaagauggccucugaugggaggaacacgucauaucag

SEQ ID NO: 61511 - RNA, 64 nt, Homo Sapiens
cuggugggcuuccuggacuccugcacagcugggggccucugagcgugugcggccgccgcgcugu

SEQ ID NO: 61512 - RNA, 64 nt, Homo Sapiens
ccucgcucucuguuccagcacuucaccagcaccugccucugagacugcccgucucccagagaug

SEQ ID NO: 61513 - RNA, 64 nt, Homo Sapiens
agcaggcuacccgcaucccaaguagagucucucugccucugagguuuauuuuucuaugccaggc

SEQ ID NO: 61514 - RNA, 64 nt, Homo Sapiens
cagcuugccaguaccugagccggucgggucaucugccucugagggaccguccucaccgagcucc

SEQ ID NO: 61515 - RNA, 64 nt, Homo Sapiens
guguugaucaggaggcguccacagcauuguucucgccucugaaugaugcuucuuucuguguugg

SEQ ID NO: 61516 - RNA, 64 nt, Homo Sapiens
ccugccugcucugggccaugcagaucaggccuuggccucugagcccucagagcugguggggcuc

SEQ ID NO: 61517 - RNA, 64 nt, Homo Sapiens
ccuggagcaguggcccacuuccgaccuggggauggccucugaucuuucuggacaagaccucugg

SEQ ID NO: 61518 - RNA, 64 nt, Homo Sapiens
guccuuccaggccucuuccccuuuccuccaucucuggcaacaguucuugggguuuggcaauugu

SEQ ID NO: 61519 - RNA, 64 nt, Homo Sapiens
ggggaagagaauuacauuuccagggucagaaacuuggcaacaguuuuccuagagugacucagac

SEQ ID NO: 61520 - RNA, 64 nt, Homo Sapiens
ugaaugucagccuaagaggccaagcugcagaucguggcaacagaugagcucuguuaaccuccug

SEQ ID NO: 61521 - RNA, 64 nt, Homo Sapiens
gcuauucugaaccuugcuuuuuucagauauauguuggcaacaguuccaugucaguacauaguuu

SEQ ID NO: 61522 - RNA, 64 nt, Homo Sapiens
uuucagccccaggccuuugcugcaagugacccuguggcaacaguggauucucagacaugauacu

SEQ ID NO: 61523 - RNA, 64 nt, Homo Sapiens
guugaccuucucagcaucucccuuuugccuuagauggcaacacccuccagucuguagcagagca

SEQ ID NO: 61524 - RNA, 64 nt, Homo Sapiens
uuuggucaaaauucauaccuaaaugugaugaguguggcaacaccaaacuggagagaaaccuuac

SEQ ID NO: 61525 - RNA, 64 nt, Homo Sapiens
uuccaucacaauucaacccuaaguguaaugaguguggcaacaccauaguggagagaaaccuuaa

SEQ ID NO: 61526 - RNA, 57 nt, Homo Sapiens
uagaagaaaagccugaaacugaguugaauagagaagugugacccugugacaaaauga

SEQ ID NO: 61527 - RNA, 57 nt, Homo Sapiens
acugaugaaggauucauaaucacaaauauagagaauuccuauuuaaaaaaauagaaa

SEQ ID NO: 61528 - RNA, 57 nt, Homo Sapiens
gaaaaaacugaagguacuuuacucccuauagagaaaccauugccaucauuguagcaa

SEQ ID NO: 61529 - RNA, 57 nt, Homo Sapiens
cuuuuaucaacuguauacugguguuuaauagagaaugauugucuuccgaguuuuuug

SEQ ID NO: 61530 - RNA, 57 nt, Homo Sapiens
agcaauugauaaaguaaaugcacauaaauagagaaagcauuuaacaauaaucugaua

SEQ ID NO: 61531 - RNA, 57 nt, Homo Sapiens
gagaagguuucucuuuugcauagauagauagagaaauuagauagauagauagauaga

SEQ ID NO: 61532 - RNA, 57 nt, Homo Sapiens
uggaaccuuaaauacuucugguaaaccauagagaauggaggauggcugugaugaagc

SEQ ID NO: 61533 - RNA, 57 nt, Homo Sapiens
cagaacaaauacauaaaauaacuucccauagagaacaggauauagcaauaauagcuc

SEQ ID NO: 61534 - RNA, 57 nt, Homo Sapiens
auaaaaguguguucuuaacuuugagaaauagagaaaugauuuacuuuucugaucucu

SEQ ID NO: 61535 - RNA, 57 nt, Homo Sapiens
ggcuaugccuguaauuuuuaauagaaaauagagaaaaugaauuauuuucauauaaau

SEQ ID NO: 61536 - RNA, 57 nt, Homo Sapiens
uccucugguuagucucucaaaauuugcauagagaagguuuaagguguauuggcaugu

SEQ ID NO: 61537 - RNA, 57 nt, Homo Sapiens
gguuuugucaaauguuuucuaacuuuuauagagaaagacaacauaaauuuagaccau

SEQ ID NO: 61538 - RNA, 57 nt, Homo Sapiens
aucauguugacuuugugaauauagcauauagagaauauuuuauuugacuuauagaga

SEQ ID NO: 61539 - RNA, 57 nt, Homo Sapiens
gcauauagagaauaaucauguugacuuauagagaauacauuaccacuaaaauuuuau

SEQ ID NO: 61540 - RNA, 65 nt, Homo Sapiens
auuuaauuuguuaaauuaucuuuaguaucaaaucacuacuagaccuacuaaauugggcagggcuu

SEQ ID NO: 61541 - RNA, 65 nt, Homo Sapiens
ugucccagaagucacuguauucuguggauuuuuggcuacuagaagagaaggagggggucugggca

SEQ ID NO: 61542 - RNA, 64 nt, Homo Sapiens
uaccugaugaagagcauaauuucugcauauccauccucaauaccaugguaaauucuggggcaau

SEQ ID NO: 61543 - RNA, 64 nt, Homo Sapiens
caauagagaagcaacagaacugccacaaaguauaccucaauauaauuccucuaguucugcuucu

SEQ ID NO: 61544 - RNA, 64 nt, Homo Sapiens
aacaccugcucucaccugagccccaggugaaggggcccgggaacaccugcucucaccugagccc

SEQ ID NO: 61545 - RNA, 64 nt, Homo Sapiens
aacaccugcucucaccugagccccaggugaaggggcccgggaacaccugcucucaccugaaccc

SEQ ID NO: 61546 - RNA, 64 nt, Homo Sapiens; identical to SEQ ID NO: 61544

SEQ ID NO: 61547 - RNA, 64 nt, Homo Sapiens; identical to SEQ ID NO: 61545

SEQ ID NO: 61548 - RNA, 64 nt, Homo Sapiens; identical to SEQ ID NO: 61544

SEQ ID NO: 61549 - RNA, 64 nt, Homo Sapiens
aacaccuccugucaccugagccccaggugaaggggcccgggaacaccucucaccugaacccggg

SEQ ID NO: 61550 - RNA, 64 nt, Homo Sapiens
uuugagacaggugccugggguguguguguggacagcccgggagccggaaggagacugugguuuu

SEQ ID NO: 61551 - RNA, 64 nt, Homo Sapiens
cugauggcacccacacagaggccucucuggcucagcccgggaucgggcacuguggucaggccca

SEQ ID NO: 61552 - RNA, 64 nt, Homo Sapiens
aagcccaggccagccugcugggaccuccgccucugcccgggagagcgugcugcuccuuugcuuc

SEQ ID NO: 61553 - RNA, 64 nt, Homo Sapiens
agagugcauggugcagagggguagcaggcgcuaggcccgggaggaauuaguggaggccacaguu

SEQ ID NO: 61554 - RNA, 64 nt, Homo Sapiens
ccugcugacccccuccuccagagcagccagcccagcccgggaacaagacggacuuccucucccu

SEQ ID NO: 61555 - RNA, 64 nt, Homo Sapiens
uacgccaagggcagguuucuggagacucccuugugcccgggauggcaagggcaccgggcuggcg

SEQ ID NO: 61556 - RNA, 64 nt, Homo Sapiens
guauauucuggcaaacugucucuuacuggucagaaugucauagaagugaugucggcugcuagcu

SEQ ID NO: 61557 - RNA, 64 nt, Homo Sapiens
gugaugucggcugcuagcuuccuucagaugacugaugucauaaguguauguaagacuuuuauua

SEQ ID NO: 61558 - RNA, 64 nt, Homo Sapiens
gguggguuuuuaagucuuaaaagauuaagugguaaugucauaguaaauuuugaccugccuaugu

SEQ ID NO: 61559 - RNA, 64 nt, Homo Sapiens
ccuagguaacuuugaauugaagguauuccuagaaaugucauagaguuaaucccaccccaucaaa

SEQ ID NO: 61560 - RNA, 64 nt, Homo Sapiens
cacuguguagccuguguaugaaugcugaagacagaugucauaccacaauaauugaugcccuuaa

SEQ ID NO: 61561 - RNA, 64 nt, Homo Sapiens
ucaccaccuggacaauaauugauggaaaaguuucaugucauaagauucuaugcuuuaaaaugag

SEQ ID NO: 61562 - RNA, 64 nt, Homo Sapiens
aaccaauuggaagggaaguuagacaagcuuuggggaagagaaaaggaauauaguccauuuccaa

SEQ ID NO: 61563 - RNA, 64 nt, Homo Sapiens
gagcaggaacucccaaccuuaaguuaauuucacugaagagaauuuucccuuuuuuuuuuuuuuu

SEQ ID NO: 61564 - RNA, 64 nt, Homo Sapiens
gcuuaaaggggcuagagugaacuugggccacugugaagagaaccauaucaagacucuuuggaca

SEQ ID NO: 61565 - RNA, 64 nt, Homo Sapiens
guuuagcccaaaaccaagucaagugaaaaaggaggaagagaaaaaauauuuuccugccaggcau

SEQ ID NO: 61566 - RNA, 64 nt, Homo Sapiens
auuugguagaagaaauauuuuucaccugagagaggaagagaaauuucucuaguaacacaaagag

SEQ ID NO: 61567 - RNA, 64 nt, Homo Sapiens
caaguaacuggugaacuuuggagguuuggagcuugaagagaauggcuaagaagauuugaauuau

SEQ ID NO: 61568 - RNA, 64 nt, Homo Sapiens
auuuagcuaguaacgugaucaauugcaauagaaugaagagaaacauaaauucauuguauguuag

SEQ ID NO: 61569 - RNA, 64 nt, Homo Sapiens
cuguuaaagcaaaaauuuuuuuaaaaauaaucaugaagagaagguucucaggcaacauuugcuu

SEQ ID NO: 61570 - RNA, 64 nt, Homo Sapiens
gugacugagcugagaaguaauucggaauuguggggaagagaagauuaaagaacuucaacauagu

SEQ ID NO: 61571 - RNA, 64 nt, Homo Sapiens
aaguaacccaaaguacuacuuggaagagagggaggaagagaaggaagccuuaucucagucuauu

SEQ ID NO: 61572 - RNA, 64 nt, Homo Sapiens
cacuaauauuauuacccauagaaucacaucuucagaagagaagaaagagaacauggcauuaaaa

SEQ ID NO: 61573 - RNA, 64 nt, Homo Sapiens
uggcauuaaaagaaucacaucaggucaccagagggaagagaacaagugcugcuacaaucuaagu

SEQ ID NO: 61574 - RNA, 64 nt, Homo Sapiens
cuucaugaagaacuuucuagaaggacaagucuaagaagagaaagacaacagugauucugaagag

SEQ ID NO: 61575 - RNA, 64 nt, Homo Sapiens
acaagucuaagaagagaaagacaacagugauucugaagagaaggaaacaaguguucagggcaua

SEQ ID NO: 61576 - RNA, 64 nt, Homo Sapiens
gugugaggauuucccaguacuggauggagaaugagaagagaaagucagccuuucuggggcuuuc

SEQ ID NO: 61577 - RNA, 64 nt, Homo Sapiens
gauaaaggcaacccaaugaaaccacagagaggcagaagagaacgggcagaaguacagaacagaa

SEQ ID NO: 61578 - RNA, 64 nt, Homo Sapiens
auucugugaauuuuugaaagucaacaguucaggagaagagaaggaauuugaagagaaaaaggaa

SEQ ID NO: 61579 - RNA, 64 nt, Homo Sapiens
gaaagucaacaguucaggagaagagaaggaauuugaagagaaaaaggaaaauuaaaauuacuaa

SEQ ID NO: 61580 - RNA, 64 nt, Homo Sapiens
ucucugaaagcagaaaaaggcacugauauaaagggaagagaaggaggcucaccggagggaagag

SEQ ID NO: 61581 - RNA, 64 nt, Homo Sapiens
gauauaaagggaagagaaggaggcucaccggagggaagagaacauagugaagauucccgccuuu

SEQ ID NO: 61582 - RNA, 64 nt, Homo Sapiens
ccauacugaaagaagagcaagccaacagcuuggggaagagaauuaaugcaaaugaacuagacau

SEQ ID NO: 61583 - RNA, 64 nt, Homo Sapiens
acucauuuaauauucugacaaucaaaauccuggggaagagaauacaaacuauacacggucgucc

SEQ ID NO: 61584 - RNA, 64 nt, Homo Sapiens
gacauggcguauuuuguauuaaacaaauggaagagaagagaaagacucaccucccaaucacccc

SEQ ID NO: 61585 - RNA, 64 nt, Homo Sapiens
gaaaggacauggcguauuuuaccccaaacaaauggaagagaagauuaaaacucaccucccaauc

SEQ ID NO: 61586 - RNA, 64 nt, Homo Sapiens
auggaauaucagaguuacagagcuuagccauucagaagagaaaauugaaaggaaaguauguccu

SEQ ID NO: 61587 - RNA, 64 nt, Homo Sapiens
aucaugagccaauuugauaggcuauccugcuuuggaagagaagcuacuacgucggccauaaaca

SEQ ID NO: 61588 - RNA, 64 nt, Homo Sapiens
cuauuuauauauuguaucagauggagagaccagagaagagaacaagcuguugauuccuaagcag

SEQ ID NO: 61589 - RNA, 64 nt, Homo Sapiens
uucauaccuacuugaacaucagaggguccaucaugaagagaaagccuaugaguaugaugaauau

SEQ ID NO: 61590 - RNA, 64 nt, Homo Sapiens
gcaaaugguacuguccacagugcacugcugcaaugaagagaagaggcagcagacacaaauaaag

SEQ ID NO: 61591 - RNA, 64 nt, Homo Sapiens
cuucagcugaagauuuuauauaggacuuuaaaaagaagagaagagaaagaagaaacaaugcauu

SEQ ID NO: 61592 - RNA, 64 nt, Homo Sapiens
gcugaagauuuuauauaggacuuuaaaaagaagagaagagaaagaagaaacaaugcauuuccag

SEQ ID NO: 61593 - RNA, 64 nt, Homo Sapiens
cguuuaaauccuguacagguuccuuucagaccuggaagagaacuuugagaacaauaucuucucc

SEQ ID NO: 61594 - RNA, 64 nt, Homo Sapiens
ucacccgccucaaacugcugcuccagaacauucugaagagaacacagccuggcuccucggagga

SEQ ID NO: 61595 - RNA, 64 nt, Homo Sapiens
gagugaaaguuuagcccacuauucuucuguagaggaagagaaaguucagggugauaaacagaau

SEQ ID NO: 61596 - RNA, 64 nt, Homo Sapiens
aaaagucucccucagaaagugggcaguagaugaugaagagaaaacaagaaugagaagcuugaau

SEQ ID NO: 61597 - RNA, 64 nt, Homo Sapiens
cuugagcauccuuggcaacaucacagggaagauugaagagaacgaucuugucguuucuuggaag

SEQ ID NO: 61598 - RNA, 64 nt, Homo Sapiens
uuuugcuguuaaugccagaaucaguuuauaauuggaagagaaaucauacguuuucucaagaacu

SEQ ID NO: 61599 - RNA, 64 nt, Homo Sapiens
acucuguuauuaaagguggcggauauuuaaggaagaagagaaugccuuuuagaaggucugauaa

SEQ ID NO: 61600 - RNA, 64 nt, Homo Sapiens
uauuuguucaggguugucccccacuuccaauuaugaagagaaaacccuguucacuuuuucucuu

SEQ ID NO: 61601 - RNA, 64 nt, Homo Sapiens
ggagaaacccuaaaaagagaggaaggaaaagaaagaagagaagguuucuggggaaaggggacaa

SEQ ID NO: 61602 - RNA, 64 nt, Homo Sapiens
aggcugaaaagaaggaauauuuuuuuuaacuggugaagagaaaaaaaagagcucagacauuuuc

SEQ ID NO: 61603 - RNA, 64 nt, Homo Sapiens
gacuugcauaaccaaaauaauacacuuguuucaugaagagaaaguuauuuuagccuuagagccu

SEQ ID NO: 61604 - RNA, 64 nt, Homo Sapiens
aaagggauugauaaaaugcuagaaucuucuagaagaagagaaaccggagcaacauaaugcucau

SEQ ID NO: 61605 - RNA, 64 nt, Homo Sapiens
ggucauuuacaucaggaaaguuccagcggugacagaagagaaagaaccaaacaaugacuccuca

SEQ ID NO: 61606 - RNA, 64 nt, Homo Sapiens
caaacucggugucauucugaaucugcagcacccagaagagaagcuucucaguggaaagaguuug

SEQ ID NO: 61607 - RNA, 64 nt, Homo Sapiens
cugagccaggguuuaagucacguuuauuuccgaggaagagaauggaagagaaugcccaaaggaa

SEQ ID NO: 61608 - RNA, 64 nt, Homo Sapiens
cccaaaggaacguuuauuucacgagacuugauuggaagagaauggugucuuuaacguagaugag

SEQ ID NO: 61609 - RNA, 64 nt, Homo Sapiens
ggaagacuugaaagaaaggggcaggagcucagaugaagagaaauccuaaguuaccuuucuaggu

SEQ ID NO: 61610 - RNA, 64 nt, Homo Sapiens
gaagggaagaaaaggugaaaaauuagaaauguucgaagagaacugaugacacugagaacagauc

SEQ ID NO: 61611 - RNA, 64 nt, Homo Sapiens
uaucuagugaggaugaagagaauuagaguccucagaagagaacuuuaccgaagaggggccaaga

SEQ ID NO: 61612 - RNA, 64 nt, Homo Sapiens
uagaaacaguuaaagugucucaagagaagaaaaagaagagaaacauuugucaauccuagccuuc

SEQ ID NO: 61613 - RNA, 64 nt, Homo Sapiens
acuaagagaauaucucuuggugucauaucuaggggaagagaauuaacuagaauuaaauuuaaug

SEQ ID NO: 61614 - RNA, 64 nt, Homo Sapiens
ccaaaggaagucaaggaagaaaaagcauggaaaggaagagaacugauuccuacugaaaauucaa

SEQ ID NO: 61615 - RNA, 64 nt, Homo Sapiens
agaggaaacaucuuaccaucuggucauucauacugaagagaaacuccauaaguaucaucucugu

SEQ ID NO: 61616 - RNA, 64 nt, Homo Sapiens
agggacauucaaacaaaggaggaggagucauagggaagagaaagaaauggaagcacagcuucuu

SEQ ID NO: 61617 - RNA, 64 nt, Homo Sapiens
aaagggaacaucuuaccaucuggccauucacacugaagagaaacuucauaagcauccucucuuu

SEQ ID NO: 61618 - RNA, 64 nt, Homo Sapiens
agggauauuuaaacaaaggaagaggaaauauagggaagagaaagaaaccacagcuucuuuuaga

SEQ ID NO: 61619 - RNA, 64 nt, Homo Sapiens
ccuucagugaugccucugugugaaauauaaagaagaagagaaagauucacacuacagagaaacu

SEQ ID NO: 61620 - RNA, 64 nt, Homo Sapiens
cuuuugaggacaaucuguauuauuaauucacucugaagagaaacaaauagcauucaguaacucc

SEQ ID NO: 61621 - RNA, 64 nt, Homo Sapiens
ucccaaacuaucagccuugauuaauuucuaguaggaagagaauaauuacauuugcggggggggg

SEQ ID NO: 61622 - RNA, 64 nt, Homo Sapiens
guauuuuguuugggaaaaaaacuaucaaaaugaggaagagaauuuccccuauuuaugcacuagg

SEQ ID NO: 61623 - RNA, 62 nt, Homo Sapiens
ugaaaauccucaauaaaauacuggcaaaccgaauccagcagcacaucaaaaagcuuauccac

SEQ ID NO: 61624 - RNA, 62 nt, Homo Sapiens
gcugguucaacauacgcaaaucaauaaauguaauccagcauauaaacagaaccaaagacaga

SEQ ID NO: 61625 - RNA, 64 nt, Homo Sapiens
caucacugaggcugcgggcaccacgcgggguccggccugggauccaggcuaagggccggcggaa

SEQ ID NO: 61626 - RNA, 64 nt, Homo Sapiens
aaucccggcgcggguuccgcugacgcagcgccccgccugggagccgcgggcaggcgagacuggc

SEQ ID NO: 61627 - RNA, 64 nt, Homo Sapiens
cccagaccucccaguggggacggggcagggccuggccugggaagagcacagcugcagaucccag

SEQ ID NO: 61628 - RNA, 64 nt, Homo Sapiens
guuaacuacccuacaccucugggcccugcaggaggccugggagggcaaggguccuacggaggga

SEQ ID NO: 61629 - RNA, 64 nt, Homo Sapiens
acacuagacaugccaacucgggagcauucugccugccugggaacgggguggacgagggaguguc

SEQ ID NO: 61630 - RNA, 64 nt, Homo Sapiens
gugugcacacguguguaugagugcgcagaucugugccugggaucgugcauuugaggggccaggg

SEQ ID NO: 61631 - RNA, 64 nt, Homo Sapiens
gggucugcccugcccauacugagccugccaaagugccugggaagcccacccagauucugaaaca

SEQ ID NO: 61632 - RNA, 64 nt, Homo Sapiens
cagcuacucuguccaggccaguccacaggggcaggccugggacccucuuggucccuggucccuc

SEQ ID NO: 61633 - RNA, 64 nt, Homo Sapiens
cccagugaacuuacacuuggagccuccagagccagccugggacucuaagcccucgaaccaaggc

SEQ ID NO: 61634 - RNA, 64 nt, Homo Sapiens
agagucccacagucuagggaggagcccuaggccagccugggauauguguugagccugggaugga

SEQ ID NO: 61635 - RNA, 64 nt, Homo Sapiens
gaggagcccuaggccagccugguuucuguguugagccugggaugcacaguuccuccccuaaucu

SEQ ID NO: 61636 - RNA, 64 nt, Homo Sapiens
uccuuguucuccccucugcuggaggagacauggagccugggaacaguuuaggcuuucgcggagg

SEQ ID NO: 61637 - RNA, 64 nt, Homo Sapiens
cugaggcuggagacaggggugggccgggaaggcagccugggaaugugggugcuggcugagcuuu

SEQ ID NO: 61638 - RNA, 64 nt, Homo Sapiens
ggcaauccucaaaugcggggggugggcuuguggggccugggaggggauggagcaucaacagcag

SEQ ID NO: 61639 - RNA, 64 nt, Homo Sapiens
acugcucccaccuccugacaaggcuucugcuggggccugggacauccgcuuggagcuauuuucc

SEQ ID NO: 61640 - RNA, 64 nt, Homo Sapiens
auuccaccgaucuucacuucucugagggauuacagccugggagggcuuaggauauucucauguu

SEQ ID NO: 61641 - RNA, 64 nt, Homo Sapiens
uggcuguuaguaggucugugguugaguagcgacugccugggagauggggaucugggugaagggg

SEQ ID NO: 61642 - RNA, 64 nt, Homo Sapiens
aaaaauaaaaaauuaaccaggugugguggcacgugccugggagucccagcgacuugggaggcug

SEQ ID NO: 61643 - RNA, 64 nt, Homo Sapiens
cgacuugggaggcugaggugggaggauuguuugagccugggaggucgaggcuguagugagcccu

SEQ ID NO: 61644 - RNA, 64 nt, Homo Sapiens
gcccuggggaagaggccuugggggucugcucugugccugggaucaguggggccccaaagcccag

SEQ ID NO: 61645 - RNA, 64 nt, Homo Sapiens
ugucugcauggcagaagcgucucccuuggccacggccugggagggugguuccuguucucagcau

SEQ ID NO: 61646 - RNA, 64 nt, Homo Sapiens
agauucaaucuauauuugucgggaaauaaauggugccugggaugaggggucccagaaagggaca

SEQ ID NO: 61647 - RNA, 64 nt, Homo Sapiens
ugguucguuugcucuucuggggggcaggacaagggccugggauugaagggaugugaggcacugu

SEQ ID NO: 61648 - RNA, 64 nt, Homo Sapiens
ugccuaaauucagaagccucggcugaguggaggugccugggagcgagcacucgcggcgugggug

SEQ ID NO: 61649 - RNA, 64 nt, Homo Sapiens
gcaggacacaggacacagcagcucgggaagccacgccugggaaguucugugagggagaaucagg

SEQ ID NO: 61650 - RNA, 64 nt, Homo Sapiens
cucucccaggggcugaugggcacccucauccccugccugggaggaggugcgguguggccaccgc

SEQ ID NO: 61651 - RNA, 64 nt, Homo Sapiens
cccuguauuaggccauuaugauuagagauaagcagccugggagaaacauacaagaccuguggcu

SEQ ID NO: 61652 - RNA, 64 nt, Homo Sapiens
caggggcuucugggaaauacagguuuuggauucugccugggaagagagucauaguaugaagaag

SEQ ID NO: 61653 - RNA, 64 nt, Homo Sapiens
uuuucugcagcaagcacugucaagacagcggcaggccugggauggagcccaucucuccaguucc

SEQ ID NO: 61654 - RNA, 64 nt, Homo Sapiens
gccugcgccugaguucgcggguccuccgcaggccgccugggaaccggagccuggcgugccggag

SEQ ID NO: 61655 - RNA, 64 nt, Homo Sapiens
guugcucuggcaggggcagaauccucacaggaucgccugggaggugaggugugugugacccacu

SEQ ID NO: 61656 - RNA, 64 nt, Homo Sapiens
gugugugcucucagggaagggcccaggaucccaugccugggaggagcugccagagagaagcaaa

SEQ ID NO: 61657 - RNA, 64 nt, Homo Sapiens
uaaacuuuccugaguuuagaaauuuaguccuuuggccugggagguccaggcugcaaugagccaa

SEQ ID NO: 61658 - RNA, 64 nt, Homo Sapiens
cugcaaugagccaagaucacgccacugaacuccagccugggagacagcaagacccugucugaaa

SEQ ID NO: 61659 - RNA, 64 nt, Homo Sapiens
uccuucacuguucccucuggcuucccauaguggggccugggaggguuccccuggccuuaaaagg

SEQ ID NO: 61660 - RNA, 64 nt, Homo Sapiens
ccucuucacuguggccacagcccccuugcccuccgccugggaucugaguacauauuguggugau

SEQ ID NO: 61661 - RNA, 64 nt, Homo Sapiens
cugccaggggguggggcuucugggacaucugugugccugggaggaaguuggccugcccggccuu

SEQ ID NO: 61662 - RNA, 64 nt, Homo Sapiens
ggccaggugaaugggaggccggcagguggcuggggccugggagaaucugaaccuggucucagca

SEQ ID NO: 61663 - RNA, 64 nt, Homo Sapiens
ccaggaguauggcugaggccuugcccacccaccugccugggaagugcagaguggauggacgggu

SEQ ID NO: 61664 - RNA, 64 nt, Homo Sapiens
cugaguccucugccccuuccaaggacacuaaugagccugggaggguggcagggaggaggggaca

SEQ ID NO: 61665 - RNA, 64 nt, Homo Sapiens
cccggggcgaccggaaaagggaagagcugaggcugccugggagguccgccagugcuuucaguag

SEQ ID NO: 61666 - RNA, 64 nt, Homo Sapiens
gaccuuguggacaaugguuugugggucugagauggccugggaaggaagucucugggaucccgcu

SEQ ID NO: 61667 - RNA, 64 nt, Homo Sapiens
agauuugcuggaucauaugaucucuuugguauaugccugggagcuguggacauauguuuucauu

SEQ ID NO: 61668 - RNA, 64 nt, Homo Sapiens
aucagucuguccaggucagcugggggauuggcuagccugggaggugcuugccaucucuagggau

SEQ ID NO: 61669 - RNA, 64 nt, Homo Sapiens
uggcccuuggggggcugcagcacagggcucgcacgccugggagggcugggcucccgugucuucu

SEQ ID NO: 61670 - RNA, 64 nt, Homo Sapiens
gacgggcugguauagucccaggcuggagcuggaugccugggaaccacucaccuccuucugugcc

SEQ ID NO: 61671 - RNA, 64 nt, Homo Sapiens
uuuuuucggaggggguugguggggaggucgggaugccugggaucccuuccuggagaggcaggcu

SEQ ID NO: 61672 - RNA, 64 nt, Homo Sapiens
cgccagggagcaccuggugagucugccggcgguggccugggauuggcugugaggucccuccgca

SEQ ID NO: 61673 - RNA, 64 nt, Homo Sapiens
cuguccaggaagagcuguguggccuggcaagcaagccugggagccggcgggaggucugccaggc

SEQ ID NO: 61674 - RNA, 64 nt, Homo Sapiens
gccccuggagggccuggcauguuuguccugcucugccugggacugagcgaguggacuuagggcu

SEQ ID NO: 61675 - RNA, 64 nt, Homo Sapiens
acuggggucugaagaucagggucaguguggcugugccugggaauuccagaccugagguugggaa

SEQ ID NO: 61676 - RNA, 64 nt, Homo Sapiens
uucuaccuaggacucuucccuggagucaugggcugccugggacccaggacccaugagggggcug

SEQ ID NO: 61677 - RNA, 64 nt, Homo Sapiens
gcugcucugcuggcugcugucggccugggauguggccugggacuuggcugggcccacggaaggu

SEQ ID NO: 61678 - RNA, 64 nt, Homo Sapiens
uggccugggacugcugcucucccacggaaggucggccugggauggcucauagggaauggcuggg

SEQ ID NO: 61679 - RNA, 64 nt, Homo Sapiens
gggggccugcccuucucugcgggagagucaaauggccugggagaaccgucuuuucaaauggccu

SEQ ID NO: 61680 - RNA, 64 nt, Homo Sapiens
gucaaauggccugggagaggcgucuuuucaaauggccugggagaaaugguaugugaagaugcac

SEQ ID NO: 61681 - RNA, 64 nt, Homo Sapiens
uuggaagggagggguggugggagaaggaagcauggccugggagcgagaggguccaagggugaug

SEQ ID NO: 61682 - RNA, 64 nt, Homo Sapiens
gugaggagaggcccccuguggggccauccugguggccugggagcgugccugugugugaaccugg

SEQ ID NO: 61683 - RNA, 64 nt, Homo Sapiens
ucaccaagcagaucccuccuucccaggggccucagccugggaagccaacaaauucagccuccuc

SEQ ID NO: 61684 - RNA, 64 nt, Homo Sapiens
agguuugggcggauuucgggcugguaccgugagcgccugggauguauagugcggggcccugcga

SEQ ID NO: 61685 - RNA, 64 nt, Homo Sapiens
caccaucugcauguccccacugggccugagucuagccugggagccaggauacugggguccuuuu

SEQ ID NO: 61686 - RNA, 64 nt, Homo Sapiens
gcaauuacuuuguucacuguaugcacccgcgggggccugggaguccccauuugcagguggguag

SEQ ID NO: 61687 - RNA, 64 nt, Homo Sapiens
auuuacuuauuaguuuuuaaaaauugcgcuacuugccugggaaacauagcagaccucguuucua

SEQ ID NO: 61688 - RNA, 64 nt, Homo Sapiens
uuacagugagcaaagauugugccacuacacuccagccugggagacagagcgagacucuugucuc

SEQ ID NO: 61689 - RNA, 64 nt, Homo Sapiens
ugucacuggcuucagugaacacagacacugcagagccugggagcaggggaggggaauaguugag

SEQ ID NO: 61690 - RNA, 64 nt, Homo Sapiens
gaaucggucucauuagagugacucuuagaagguggccugggacuagacagccccucugagcaca

SEQ ID NO: 61691 - RNA, 64 nt, Homo Sapiens
ggauggcugggucccccagccccugccagcagcugccugggaaggccguguuucagcccugaug

SEQ ID NO: 61692 - RNA, 64 nt, Homo Sapiens
uccaggagacccuagaugugcucguacucccucggccugggauuucagagcuggaaauauagaa

SEQ ID NO: 61693 - RNA, 64 nt, Homo Sapiens
cuauccaugcacuuggguggaggggagucucugugccugggaauuaggaccccugcuccaacca

SEQ ID NO: 61694 - RNA, 64 nt, Homo Sapiens
cagccuggauccuuccagagcaucccuccuggaggccugggaugggguaggucugcagcuagcc

SEQ ID NO: 61695 - RNA, 64 nt, Homo Sapiens
aagggaagccugauauucagcucgggaaagaaaugccugggaggagggacuggaaaccuuccuc

SEQ ID NO: 61696 - RNA, 64 nt, Homo Sapiens
agcugggugucagccacggaugccaccacuggcggccugggaccguccugagguacagagccac

SEQ ID NO: 61697 - RNA, 64 nt, Homo Sapiens
ugagggucuggcacauccuuaauccugugccccugccugggacagaaauguggcuccaguugcu

SEQ ID NO: 61698 - RNA, 64 nt, Homo Sapiens
ccuggagcuacagggacagggagccaucauuccugccugggaauccuggaagacuuccugcagg

SEQ ID NO: 61699 - RNA, 64 nt, Homo Sapiens
ccucugcagagacucccuucaccucgcacuuacugccugggaaccacggcccuucucuucugug

SEQ ID NO: 61700 - RNA, 64 nt, Homo Sapiens
cucuggccaggguugcuuggagaaggcucagugugccugggacagggcuuaccaccugccacca

SEQ ID NO: 61701 - RNA, 64 nt, Homo Sapiens
cuccauugcauuugucaccuuggccuucaucccagccugggauguccucauagguagguggccu

SEQ ID NO: 61702 - RNA, 64 nt, Homo Sapiens
ugacgggccugacaucuccccuuccugacauguugccugggaugaaagcaccccugaguuccau

SEQ ID NO: 61703 - RNA, 64 nt, Homo Sapiens
guccaucagcugccuccagccuggcuccugaagggccugggaggcacucaagguguucgugggg

SEQ ID NO: 61704 - RNA, 64 nt, Homo Sapiens
cccgagcgcagaggcggagcugugcucagcacaggccugggaccucccccggcaggcaccugug

SEQ ID NO: 61705 - RNA, 64 nt, Homo Sapiens
agccagucugccucuuccuccuacuucugcuguagccugggaccagaccuggccaaggucagcc

SEQ ID NO: 61706 - RNA, 64 nt, Homo Sapiens
agucucuuucugugaaggcuuuuuuuuuccuuuggccugggaauuuuucccauuuuuaugaagg

SEQ ID NO: 61707 - RNA, 64 nt, Homo Sapiens
cuaccugggaggcugagguaugaggauugcuugagccugggaguuugaggcugcagugagcuau

SEQ ID NO: 61708 - RNA, 64 nt, Homo Sapiens
accucuuugcuuuucacaccccaguggcugcccagccugggagcccaccuuuccagcaagaccc

SEQ ID NO: 61709 - RNA, 64 nt, Homo Sapiens
acuuggaagcggccucucucugcaggagccgugggccugggaagccuucuccagaggcugucac

SEQ ID NO: 61710 - RNA, 64 nt, Homo Sapiens
gcuggagaggcagacgguggggaaccuggcugcagccugggaagucccacccucuggaggccug

SEQ ID NO: 61711 - RNA, 64 nt, Homo Sapiens
cuggcugcagccugggaaggcccacccucuggaggccugggaaccuaccugcaccugcuguggu

SEQ ID NO: 61712 - RNA, 64 nt, Homo Sapiens
ggcucccacccuccccugaggcuuaggccucucugccugggauggagccuuggcccacacugag

SEQ ID NO: 61713 - RNA, 64 nt, Homo Sapiens
uggcacacucccucuccuugggccccgcuugguggccugggauccgaucgcccaggcuggagcu

SEQ ID NO: 61714 - RNA, 64 nt, Homo Sapiens
ccacucaagaggcacaggcgggaggaucacuugagccugggagguugugguugcagugagcuau

SEQ ID NO: 61715 - RNA, 64 nt, Homo Sapiens
gcacagccaacagccaccagcagccaggagacaggccugggacgggcucucccucacagccucc

SEQ ID NO: 61716 - RNA, 64 nt, Homo Sapiens
uccagcggccaguucacuacgcaguaucucuggggccugggaccagccacgugccgagcuguca

SEQ ID NO: 61717 - RNA, 64 nt, Homo Sapiens
auggccuuucccuucugcaggugcgggcaggugggccugggaccggugcuggggccucuccuug

SEQ ID NO: 61718 - RNA, 64 nt, Homo Sapiens
guggugccgggggcagggugcgugggaggacggagccugggagcggggcggggccgccgcgcaa

SEQ ID NO: 61719 - RNA, 64 nt, Homo Sapiens
ugggcuccugcccaggacaggcaccagggucauggccugggaccuggacacuggccccuccacc

SEQ ID NO: 61720 - RNA, 64 nt, Homo Sapiens
guaaacguucaggaggaccagggcagcaucuggggccugggauggccacagaaggggcaggcca

SEQ ID NO: 61721 - RNA, 64 nt, Homo Sapiens
gucucugcgaagucaaaggccugacagcucuguggccugggaauccauuuuccugcggcagagc

SEQ ID NO: 61722 - RNA, 64 nt, Homo Sapiens
cagaccaggaagcugugggcgggaggcugcagaugccugggacuuugcucccaagaggaggaga

SEQ ID NO: 61723 - RNA, 64 nt, Homo Sapiens
gccagggucugauggcuggaugaucuucccugcagccugggaugguucuucguucucuuccccg

SEQ ID NO: 61724 - RNA, 64 nt, Homo Sapiens
gaagacacugggaggaggaggaagccaccuucaggccugggaagcaggcucuuggggaggcaga

SEQ ID NO: 61725 - RNA, 64 nt, Homo Sapiens
agagucuuaucugagcugagccaggcuagcuggagccugggauuucuaugcaguggccccuuag

SEQ ID NO: 61726 - RNA, 64 nt, Homo Sapiens
agcuaacccagguccccucauuccuucaacuugugccugggagugugugguguuagggugcagc

SEQ ID NO: 61727 - RNA, 64 nt, Homo Sapiens
aaagcaggaugcaggaugggaggacaggaaggcagccugggacauuuaaaaaaauaaaaaugaa

SEQ ID NO: 61728 - RNA, 64 nt, Homo Sapiens
cuguguccaugaucugagugauagcugcacugcugccugggauugcagcugaggugggagugga

SEQ ID NO: 61729 - RNA, 64 nt, Homo Sapiens
uuuuacuaaugcauucaucgcucaucuucauugcucaugguaugucaaaccuuugggguuugac

SEQ ID NO: 61730 - RNA, 64 nt, Homo Sapiens
aaaaauauaauuucuuucuuuacuuauauucaccucaugguagguuauauugaaggcugacaug

SEQ ID NO: 61731 - RNA, 64 nt, Homo Sapiens
auucaugcguguuugaauaggcauguucgugguaucaugguaucaugcaaguucaugguaucgu

SEQ ID NO: 61732 - RNA, 64 nt, Homo Sapiens
gugcauguucgugguaucauaccgugaugcaaguucaugguauccuacacauacguagcccggc

SEQ ID NO: 61733 - RNA, 64 nt, Homo Sapiens
aaggaaacuuugaaggguuaaauagagauuuaaaaaaauaaaauaaaaaggcugggcuagggug

SEQ ID NO: 61734 - RNA, 64 nt, Homo Sapiens
aacuuugaaggguuaaauagagauuuaaaaaaauaaaauaaaaaggcugggcuagggugcuuuu

SEQ ID NO: 61735 - RNA, 64 nt, Homo Sapiens
uuauuuguguucuaacaggaggaugaacuugcugaaaauaaaacuuugcuauguauuuacucuu

SEQ ID NO: 61736 - RNA, 64 nt, Homo Sapiens
agcaccaguauauugcuggcagcuauuguauuaaaaaauaaaguauauuuucacuaucauaaag

SEQ ID NO: 61737 - RNA, 64 nt, Homo Sapiens
aaguuacuguuguuuacagugaguuuggggaaaaaaaauaaaauaaaaauggcuuucccagucc

SEQ ID NO: 61738 - RNA, 64 nt, Homo Sapiens
acuguuguuuacagugaguuuggggaaaaaaaauaaaauaaaaauggcuuucccaguccuugca

SEQ ID NO: 61739 - RNA, 64 nt, Homo Sapiens
caugcuaucagaaacaguauuuucuucccaaaucaaaauaaaagaaauaugaucagagcuugaa

SEQ ID NO: 61740 - RNA, 64 nt, Homo Sapiens
aauaugaucagagcuugaacacaggcuuauuuuuaaaauaaaaauauuuuuaacauggguuucc

SEQ ID NO: 61741 - RNA, 64 nt, Homo Sapiens
augcuagcaugauuuuuuuauauauagaaguuuaaaaauaaaccaggucagguuuguauaugua

SEQ ID NO: 61742 - RNA, 64 nt, Homo Sapiens
uuucagccaucaguucaagagccaaugccuuuuuaaaauaaagcuucuguggucuuguuuuuaa

SEQ ID NO: 61743 - RNA, 64 nt, Homo Sapiens
uuuguaguggaguucauaucacauuauguuuugcaaaauaaaacuuguuuugucacaauauuuu

SEQ ID NO: 61744 - RNA, 64 nt, Homo Sapiens
uaauuuuaauaaauuauauaauuauacauauuguaaaauaaagaccgguauuuuauuuucugcu

SEQ ID NO: 61745 - RNA, 64 nt, Homo Sapiens
uggauagaacccauacaugaauuaaaugaugcacaaaauaaauggcuguugaaauuuggaaaug

SEQ ID NO: 61746 - RNA, 64 nt, Homo Sapiens
gagcuaaugauagauagaaaugcccacucaaagaaaaauaaacagagacaaauguuaaaauugc

SEQ ID NO: 61747 - RNA, 64 nt, Homo Sapiens
auacagacuguuuuucccccuguuguuucacuuuaaaauaaaaagaaauccuugauuaaucaga

SEQ ID NO: 61748 - RNA, 64 nt, Homo Sapiens
uauggacugccuuauugcuguugcuuaucauuugaaaauaaaauccagcucagguuguaacuug

SEQ ID NO: 61749 - RNA, 64 nt, Homo Sapiens
cccauagaaacauucucguuuaaacaacaacaacaaaauaaauuuaucagcacuagauauuaga

SEQ ID NO: 61750 - RNA, 64 nt, Homo Sapiens
gcucuguagcuaacccuuauaaacuaggcucaguaaaauaaagcacucuuauuuuuugaucugg

SEQ ID NO: 61751 - RNA, 64 nt, Homo Sapiens
aguguauuuuuucagguuucuggaaauaaauaguaaaauaaauggcacaaauaguuucaauaaa

SEQ ID NO: 61752 - RNA, 64 nt, Homo Sapiens
cuaaagaaauuauauuuuguucuauugcuaggguaaaauaaauacauuuguguccaacugaaau

SEQ ID NO: 61753 - RNA, 64 nt, Homo Sapiens
ucuagugaacaaaaggugccuauucuuuuuuaaaaaaauaaaauaaaacauaaauauuacucuu

SEQ ID NO: 61754 - RNA, 64 nt, Homo Sapiens
ugaacaaaaggugccuauucuuuuuuaaaaaaauaaaauaaaacauaaauauuacucuuccaua

SEQ ID NO: 61755 - RNA, 64 nt, Homo Sapiens
caauagccuagggcugaauuuuugucagauaaauaaaauaaaucauucauccuuuuuuuugauu

SEQ ID NO: 61756 - RNA, 64 nt, Homo Sapiens
cuaaauguauuuuagacuuccuguagggggcgauaaaauaaaaugcuaaacaacuggguauaca

SEQ ID NO: 61757 - RNA, 64 nt, Homo Sapiens
aaaaaucaugucaucuucuauuuguacagaaaugaaaauaaaauaugaaaauaaugaaagaaau

SEQ ID NO: 61758 - RNA, 64 nt, Homo Sapiens
ugggcaaaugucauuguuaccucuguguguuaagaaaauaaaaauauuuucuaaaggucuguau

SEQ ID NO: 61759 - RNA, 64 nt, Homo Sapiens
ugaacauuuuucuuuuauuguuuuaucuucacagaaaauaaaagguguuaauuugcuuuuuaaa

SEQ ID NO: 61760 - RNA, 64 nt, Homo Sapiens
gcugaguugauuuucuagguucuuacguauuugaaaaauaaaauugcaauucgagauaagugcu

SEQ ID NO: 61761 - RNA, 64 nt, Homo Sapiens
gauccugucucaaaaauuaauuaauuaauuaauuaaaauaaacuagguaaacuuggauaggcag

SEQ ID NO: 61762 - RNA, 64 nt, Homo Sapiens
uaccuugugucuucucuuguaaaaaugaaacucaaaaauaaaauaaaugugucaaauuuugaaa

SEQ ID NO: 61763 - RNA, 64 nt, Homo Sapiens
ugugucuucucuuguaaaaaugaaacucaaaaauaaaauaaaugugucaaauuuugaaaaaaaa

SEQ ID NO: 61764 - RNA, 64 nt, Homo Sapiens
cgcuucccucaguucaccaaaguuaccaaaauguaaaauaaaauaagacuggcucagguaagua

SEQ ID NO: 61765 - RNA, 64 nt, Homo Sapiens
uuaaaucuagaaaccauuaguuugagaucucucaaaaauaaaaauaaaaauugcuuucagagag

SEQ ID NO: 61766 - RNA, 64 nt, Homo Sapiens
cuagaaaccauuaguuugagaucucucaaaaauaaaaauaaaaauugcuuucagagaguagccc

SEQ ID NO: 61767 - RNA, 64 nt, Homo Sapiens
aaaagcuaaauauggcacacuuguucuuuacagaaaaauaaagauauuuuaaacaaaauacuag

SEQ ID NO: 61768 - RNA, 64 nt, Homo Sapiens
agguagcugugcagauguggaucaacauuuguuuaaaauaaaguauuaauacuuuaaagucaaa

SEQ ID NO: 61769 - RNA, 64 nt, Homo Sapiens
uaucggcggcacaaucacuuuguagaaacuguaaaaaauaaaaguaucuccuagucccuuaauu

SEQ ID NO: 61770 - RNA, 64 nt, Homo Sapiens
uuuauuuauucacacuugaauugcauuugugaucaaaauaaauguuuaaaucgcuaaaggaaaa

SEQ ID NO: 61771 - RNA, 64 nt, Homo Sapiens
gcacuggaagaguuuaguguuucuuguaugcuugaaaauaaaguauguacuguuuugaaugugu

SEQ ID NO: 61772 - RNA, 64 nt, Homo Sapiens
cagccuaggagacaaaacgagacuucauuuaaaaaaaauaaaaauaaaaauaaaaauaaaguca

SEQ ID NO: 61773 - RNA, 64 nt, Homo Sapiens
aggagacaaaacgagacuucauuuaaaaaaaauaaaaauaaaaauaaaaauaaagucaucuugc

SEQ ID NO: 61774 - RNA, 64 nt, Homo Sapiens
caaaacgagacuucauuuaaaaaaaauaaaaauaaaaauaaaaauaaagucaucuugccaccca

SEQ ID NO: 61775 - RNA, 64 nt, Homo Sapiens
gagacuucauuuaaaaaaaauaaaaauaaaaauaaaaauaaagucaucuugccacccacccccu

SEQ ID NO: 61776 - RNA, 64 nt, Homo Sapiens
auugaaguauauucaaccaaauacuuuaauguauaaaauaaauauuauacaauauacuuguaua

SEQ ID NO: 61777 - RNA, 64 nt, Homo Sapiens
ucauuuuuuaaaaaauggacucuugaaaucuguuaaaauaaaauuguacauuuggagauguuuc

SEQ ID NO: 61778 - RNA, 64 nt, Homo Sapiens
uccacccugggcaacagagcaagaccccaucucaaaaauaaauaaauauauauaaaaaauaaaa

SEQ ID NO: 61779 - RNA, 64 nt, Homo Sapiens
agaccccaucucaaaaauaaauaaauauauauaaaaaauaaaaagcuauuucuaguuuauuuca

SEQ ID NO: 61780 - RNA, 64 nt, Homo Sapiens
acuagagucauauaagaaauaaaaauugggcaauaaaauaaaaugauucaguguuucuuuucua

SEQ ID NO: 61781 - RNA, 64 nt, Homo Sapiens
gcugcaaaagggaucuucgaaacugggcagagaaaaaauaaaguggaauauuaaguaaaaguug

SEQ ID NO: 61782 - RNA, 64 nt, Homo Sapiens
gauaauagaacuagugacuagucacacaucuugaaaaauaaaacccauauugucaccuguaccu

SEQ ID NO: 61783 - RNA, 64 nt, Homo Sapiens
aguugaacucucugucuucaaucccuuagauugcaaaauaaaauugauugaagugcagagaaaa

SEQ ID NO: 61784 - RNA, 64 nt, Homo Sapiens
aaaauaaaauaaaauaaaauaaauaaaauaaaauaaaauaaaauucaaaaaauaaaauaaaaua

SEQ ID NO: 61785 - RNA, 64 nt, Homo Sapiens
aaaauaaaauaaaauaaaauaaauaaaauaaaauaaaauaaaaucugucucaaaaaauaaaaua

SEQ ID NO: 61786 - RNA, 64 nt, Homo Sapiens
aaaauaaaauaaaauaaaauaaauaaaauaaaauaaaauaaaauacacucugucucaaaaaaua

SEQ ID NO: 61787 - RNA, 64 nt, Homo Sapiens
aaaauaaaauaaaauaaaauaaauaaaauaaaauaaaauaaaaugagugacacucugucucaaa

SEQ ID NO: 61788 - RNA, 64 nt, Homo Sapiens
aaaauaaaauaaaauaaaauucaaaaaauaaaauaaaauaaaaucaacagagugacacucuguc

SEQ ID NO: 61789 - RNA, 64 nt, Homo Sapiens
aaaauaaaauaaaauaaaaucugucucaaaaaauaaaauaaaaucugggcaacagagugacacu

SEQ ID NO: 61790 - RNA, 64 nt, Homo Sapiens
aaaauaaaauaaaauaaaauacacucugucucaaaaaauaaaauccagccugggcaacagagug

SEQ ID NO: 61791 - RNA, 64 nt, Homo Sapiens
guauuucccuccuugccuguaaaauaaaaauuaaaaaauaaagguaaugagacucagucuccga

SEQ ID NO: 61792 - RNA, 64 nt, Homo Sapiens
uuaaaaaauaaaggguauuugacucagucuccgaaaaauaaaaacagucuaagcaacauaauga

SEQ ID NO: 61793 - RNA, 64 nt, Homo Sapiens
gacaaaugaaaaggcacauccacuuuuuaaauguaaaauaaaaagauccacuuagagcaauaac

SEQ ID NO: 61794 - RNA, 64 nt, Homo Sapiens
uaagccacaaaacuaaaaggccaaauucugcaaaaaaauaaaaaaaggaggcugcacuacaaac

SEQ ID NO: 61795 - RNA, 64 nt, Homo Sapiens
uacaacaugaagauucagauaaagguaaaaaaauaaaauaaaauguagugccaaaaacuuuuua

SEQ ID NO: 61796 - RNA, 64 nt, Homo Sapiens
aaaauuacaacaugaagauuuuuuaaaagguaaaaaaauaaaauaccuuguagugccaaaaacu

SEQ ID NO: 61797 - RNA, 64 nt, Homo Sapiens
aguugugccugaaaugaaucaaacaaaacaaaaaaaaauaaaaagguuucuuuuacugauuuaa

SEQ ID NO: 61798 - RNA, 64 nt, Homo Sapiens
aauuuaagaaaaccauuuuaguguuauguuuaaaaaaauaaauaccaguuuuaacaccuuccuc

SEQ ID NO: 61799 - RNA, 64 nt, Homo Sapiens
uuucaauguuuuuuuggucugcaaauccccugugaaaauaaaauaaaaauaauguucuuuuuau

SEQ ID NO: 61800 - RNA, 64 nt, Homo Sapiens
aaagcaucuucuccuaguugucuuuggccaaaccaaaauaaagaucauaauuuaaccauuagca

SEQ ID NO: 61801 - RNA, 64 nt, Homo Sapiens
agucuuccucuggaaagagauuuccuagaauuuaaaaauaaaaaccaauuugaauaagucaugc

SEQ ID NO: 61802 - RNA, 64 nt, Homo Sapiens
uggaauuuuuuacccauacaccccuacauuaguaaaaauaaaaauagaaggaaacauauguucu

SEQ ID NO: 61803 - RNA, 64 nt, Homo Sapiens
agaaacuauccaggagugguaccuugucuccacaaaaauaaaaaagccuggacaacauagugag

SEQ ID NO: 61804 - RNA, 64 nt, Homo Sapiens
accauuuuguuucccuuucaaaaauaaauaaaauaaaauaaagcugccacuguagcgccuuuuu

SEQ ID NO: 61805 - RNA, 64 nt, Homo Sapiens
aaagcaccauuuuguuucccuuuuuaaaauaaauaaaauaaaaucguccugccacuguagcgcc

SEQ ID NO: 61806 - RNA, 64 nt, Homo Sapiens
aaauaaaauaaagcaccauuuguagcgccuuuuuaaaauaaauaccccagcagcguccugccac

SEQ ID NO: 61807 - RNA, 64 nt, Homo Sapiens
gaaauagaucuuauuauucuaaaaauaaauaaauaaaauaaaaucagagugagacucugucuca

SEQ ID NO: 61808 - RNA, 64 nt, Homo Sapiens
aauaaaauaaaaugaaauagagacucugucucaaaaaauaaauaccagucugggugacagagug

SEQ ID NO: 61809 - RNA, 64 nt, Homo Sapiens
uucuggugaaacaaauuaaaaucugccacaucucaaaauaaaaccaacaugaccaauguuuuuc

SEQ ID NO: 61810 - RNA, 64 nt, Homo Sapiens
aaaacccaaaaauaaugcauacauaucauuuuuaaaaauaaaaacaugacccauaguauuaaau

SEQ ID NO: 61811 - RNA, 64 nt, Homo Sapiens
auaaaauuauuucuaaugaucauugaacugcuuuaaaauaaauauaccauuuugcuaccaguua

SEQ ID NO: 61812 - RNA, 64 nt, Homo Sapiens
auaaagucaauaauaguccuuauacuugcacaugaaaauaaaauuguugccuuuuuaaaauaau

SEQ ID NO: 61813 - RNA, 52 nt, Homo Sapiens
gagaaacuuuuuuccuacaauaaaaauaaaaugggaggaaacucaacuuuga

SEQ ID NO: 61814 - RNA, 64 nt, Homo Sapiens
accaguuuuguguuggggggcaaugacaacaaaaaaaauaaaugauuuuuuugcuuccuaauaa

SEQ ID NO: 61815 - RNA, 64 nt, Homo Sapiens
gccccccauucugguccccuccuguuuuuauuguaaaauaaauuguucugcugagguuugaacu

SEQ ID NO: 61816 - RNA, 64 nt, Homo Sapiens
auaacaauaauacgggggaauuuuguaaaaaauaaaaauaaauacgauucacucuuuucuccug

SEQ ID NO: 61817 - RNA, 64 nt, Homo Sapiens
uaaauaauaacaauaauacgcuccuguuuuguaaaaaauaaaaaccaacccgauucacucuuuu

SEQ ID NO: 61818 - RNA, 64 nt, Homo Sapiens
ugguucuaauagaacucaguaaaaaauaaaaauaaaaauaaauuacagagcaagacucugucuc

SEQ ID NO: 61819 - RNA, 64 nt, Homo Sapiens
uaaauuugguucuaauagaaugucucaaaaaauaaaaauaaaaaugggugacagagcaagacuc

SEQ ID NO: 61820 - RNA, 64 nt, Homo Sapiens
uaaaaauaaauuugguucuaagacucugucucaaaaaauaaaaaccagccugggugacagagca

SEQ ID NO: 61821 - RNA, 64 nt, Homo Sapiens
cuauaaaaacccauccccuagcccuauaguuacaaaaauaaaaaaagcuauuguuauaguagcu

SEQ ID NO: 61822 - RNA, 64 nt, Homo Sapiens
aagaaguauuuauaggauuaagcacaauuuuuuaaaaauaaauuugccccguaaaaggguuaac

SEQ ID NO: 61823 - RNA, 64 nt, Homo Sapiens
gcuaaaucuuaaaagaaacuuaagauaagagacuaaaauaaaauuggguacaagugguccaaac

SEQ ID NO: 61824 - RNA, 64 nt, Homo Sapiens
ggagaaaggcuuaggaaguucacaauacauugcuaaaauaaagaagauaaagucgcacauuuuc

SEQ ID NO: 61825 - RNA, 64 nt, Homo Sapiens
uuuaaaaagcaggcacuaauuguauuuaaaauguaaaauaaacuuuuuuuuaugagaaaaauac

SEQ ID NO: 61826 - RNA, 64 nt, Homo Sapiens
accccaacguugaccuuaccuauuuaaagucuccaaaauaaaacuacaugagcuacauguuaaa

SEQ ID NO: 61827 - RNA, 64 nt, Homo Sapiens
ucuauuuagauguugauucuaaacaaguaaaauaaaaauaaaagaugaauuuucuuuucugucc

SEQ ID NO: 61828 - RNA, 64 nt, Homo Sapiens
uaaaagucuauuuagauguucuguccaaacaaguaaaauaaaaaaagcugaugaauuuucuuuu

SEQ ID NO: 61829 - RNA, 64 nt, Homo Sapiens
uuaauuuggggggauuauuuuauauuuuuauguaaaaauaaaaaucuuguuaagagugcaauau

SEQ ID NO: 61830 - RNA, 64 nt, Homo Sapiens
augaaugaaucucaaaauuaaauaucuaaauacuaaaauaaacucuguaccaaauauuuuaugg

SEQ ID NO: 61831 - RNA, 64 nt, Homo Sapiens
ggaaaacagacuuaaauuuuuaaaauacauuuauaaaauaaaaauggauuaaacaaguauaaaa

SEQ ID NO: 61832 - RNA, 64 nt, Homo Sapiens
acauuuauaaaauaaaaagggauuaaacaaguauaaaauaaaaugaugugcuaggucuaagaug

SEQ ID NO: 61833 - RNA, 64 nt, Homo Sapiens
uguauaaaauuuaaaaaaacauaaauuuauaaugaaaauaaacacuggguccaaagugauuuac

SEQ ID NO: 61834 - RNA, 64 nt, Homo Sapiens
auuggcaaacaauacagcaacagaugcaaaaugcaaaauaaaauuagaaggauuuuauucucaa

SEQ ID NO: 61835 - RNA, 64 nt, Homo Sapiens
uugauuuagaaaugaagaaaggaaaaauuagucgaaaauaaaggagccgaauauaauggaaaua

SEQ ID NO: 61836 - RNA, 64 nt, Homo Sapiens
cuccagcuuggcgacagagcaagacccccucucaaaaauaaauaaaauaaaguaaaauaaauau

SEQ ID NO: 61837 - RNA, 64 nt, Homo Sapiens
ggcgacagagcaagacccccucucaaaaauaaauaaaauaaaguaaaauaaauauaaauaauug

SEQ ID NO: 61838 - RNA, 64 nt, Homo Sapiens
caagacccccucucaaaaauaaauaaaauaaaguaaaauaaauauaaauaauuguggccgggug

SEQ ID NO: 61839 - RNA, 64 nt, Homo Sapiens
gugagaccccugucuauauauuuuuuuaauuuaaaaaauaaaagaauaaaauuguguagcucag

SEQ ID NO: 61840 - RNA, 64 nt, Homo Sapiens
uuauuguagauacaauuuucugauuaaaucuggaaaaauaaaaggcagccuguuuuuucugcuu

SEQ ID NO: 61841 - RNA, 64 nt, Homo Sapiens
auuguauuaacagcugagguagcuaaaguuauuuaaaauaaaauuaaauuuaugauccaaguag

SEQ ID NO: 61842 - RNA, 64 nt, Homo Sapiens
uauguacagauuaaaauuauugcuacauuugaggaaaauaaaauugcuugcuucuauguaauuc

SEQ ID NO: 61843 - RNA, 64 nt, Homo Sapiens
guaccauuuauugguuuggggaccaucuuaauuaaaaauaaaugcccaaaauguagaacuuuaa

SEQ ID NO: 61844 - RNA, 64 nt, Homo Sapiens
ugggucuuuuuucuugagcuuauaauguaccuggaaaauaaaccucuugagaaaaagaaaaguu

SEQ ID NO: 61845 - RNA, 64 nt, Homo Sapiens
aauaguaccauacaugaguuauuucuaaguuugaaaaauaaaaagaaauugcaucacacuaauu

SEQ ID NO: 61846 - RNA, 64 nt, Homo Sapiens
cuaaauuaacaugaaauacuucauuuugauugagaaaauaaaaucagauuuuuucaaagucaau

SEQ ID NO: 61847 - RNA, 64 nt, Homo Sapiens
cgggagcaucuguauuuuuauguuaaaagcccacaaaauaaaaauaaaaaguaacugagaugaa

SEQ ID NO: 61848 - RNA, 64 nt, Homo Sapiens
caucuguauuuuuauguuaaaagcccacaaaauaaaaauaaaaaguaacugagaugaauuuacc

SEQ ID NO: 61849 - RNA, 64 nt, Homo Sapiens
uggcgcaauauuuaugggagugggagggauggggaaaauaaacuuaacucuacaaaagcaaacu

SEQ ID NO: 61850 - RNA, 64 nt, Homo Sapiens
uaucuaauauaccauuguauucacuaacuaacucaaaauaaacacauuuaaucuugacaucuca

SEQ ID NO: 61851 - RNA, 64 nt, Homo Sapiens
uuuuuaaaugcuacuuuguaaaggugaccuuuaaaaaauaaaaggaaaauaaagaauguuaguu

SEQ ID NO: 61852 - RNA, 64 nt, Homo Sapiens
uacuuuguaaaggugaccuuuaaaaaauaaaaggaaaauaaagaauguuaguuucauucugccg

SEQ ID NO: 61853 - RNA, 64 nt, Homo Sapiens
uacauagugaauuuuaaaauguagaagaaagcaaaaaauaaaauaaguccuaaagugaagaagc

SEQ ID NO: 61854 - RNA, 64 nt, Homo Sapiens
gaacaaaaugaaguuaacuuaguguuuagcauuaaaaauaaaaguuguaccuugacccuagaau

SEQ ID NO: 61855 - RNA, 64 nt, Homo Sapiens
aguagaccugauuuucaaaaucugcccucagaugaaaauaaaauaaacgaaacauuuagacaau

SEQ ID NO: 61856 - RNA, 64 nt, Homo Sapiens
accugauuuucaaaaucugcccucagaugaaaauaaaauaaacgaaacauuuagacaauggcua

SEQ ID NO: 61857 - RNA, 64 nt, Homo Sapiens
agagcgagaccuugucucuaaaaauaauaguaauaaaauaaaaauaacguuuuaugacuauuua

SEQ ID NO: 61858 - RNA, 64 nt, Homo Sapiens
ugcuaaguuaaaauacaguuuaguuauuugcuuuaaaauaaacucuucuuuuuuucuuuaaagu

SEQ ID NO: 61859 - RNA, 64 nt, Homo Sapiens
aggugaauuggcucucauggaaauuuggaauuacaaaauaaacguccuggggguuacccagaau

SEQ ID NO: 61860 - RNA, 64 nt, Homo Sapiens
ccagaauacagauuuaaaaguuugccuguagagcaaaauaaaacagucaguuguagucauuaau

SEQ ID NO: 61861 - RNA, 64 nt, Homo Sapiens
ugaauaaaguuauguucugauaguuuguacagaaaaaauaaaauggaugcccauguuuuauugc

SEQ ID NO: 61862 - RNA, 64 nt, Homo Sapiens
acacuucacugccauuuucuauucacauaaaagaaaaauaaauguggaaauuucauccuuggaa

SEQ ID NO: 61863 - RNA, 64 nt, Homo Sapiens
uaaccagauaaaaguagcacaugugcuuuuguuaaaaauaaaguuaaaaguuaaaguuaaaaaa

SEQ ID NO: 61864 - RNA, 64 nt, Homo Sapiens
uuggaugucucgcuucacaauaaaacacagcuuaaaaauaaaauaacugaaagaaauagaauuc

SEQ ID NO: 61865 - RNA, 64 nt, Homo Sapiens
auaaaagcaauagcuggaauauacucccaguuuuaaaauaaaugccugauugauuuaaagcaag

SEQ ID NO: 61866 - RNA, 64 nt, Homo Sapiens
uuauguauguuccuaaugcuuauggaacuccuccaaaauaaaguuacucaaagagagcaaauau

SEQ ID NO: 61867 - RNA, 64 nt, Homo Sapiens
uuuuugcaucauuuaaacaugcagaagauguuuaaaaauaaaaaaaaaacugcuuuauccuccu

SEQ ID NO: 61868 - RNA, 64 nt, Homo Sapiens
uucuuuucaaauauuuguaggacaacuuugaaucaaaauaaauuauguuccuucuccaauuuga

SEQ ID NO: 61869 - RNA, 64 nt, Homo Sapiens
gccccucaggggaauucggagcuagaggacauggaaaauaaagccaggaaagucaaaaaaacga

SEQ ID NO: 61870 - RNA, 64 nt, Homo Sapiens
aaagcgcaaagaggagaaugaagauccagaaaggaaaauaaagaagaagggcuucggcgccaug

SEQ ID NO: 61871 - RNA, 64 nt, Homo Sapiens
gaauaauuauuaaugaaagauuuuugaaauauaaaaaauaaauuaggcccaauccaagaaauug

SEQ ID NO: 61872 - RNA, 64 nt, Homo Sapiens
uuucaauauaaccagcaauuuagguggcaucuauaaaauaaaaaauuucuacuguggacauccc

SEQ ID NO: 61873 - RNA, 64 nt, Homo Sapiens
ucaaagacuauuaaaggagcuguacagagguaaaaaaauaaauguggaacauuauuaacuuacu

SEQ ID NO: 61874 - RNA, 64 nt, Homo Sapiens
guuuuaaaaugacuugacuauaaaaaaaaauuaaaaaauaaaaauaaaugacuuggcuguaaua

SEQ ID NO: 61875 - RNA, 64 nt, Homo Sapiens
aaaugacuugacuauaaaaaaaaauuaaaaaauaaaaauaaaugacuuggcuguaauaaggcau

SEQ ID NO: 61876 - RNA, 64 nt, Homo Sapiens
cugaucauguuuugcuacaguuugcaggugaaaaaaaauaaauauuauaaaauaugcuauuguu

SEQ ID NO: 61877 - RNA, 64 nt, Homo Sapiens
ugggggcucuuacugacuuuaaauuagcgcuuauaaaauaaaaauguuuaguucaagaagagac

SEQ ID NO: 61878 - RNA, 64 nt, Homo Sapiens
ugcagccugggcgacagagcgagauucugccucaaaaauaaacaaauaaauuuuaaaaauaaau

SEQ ID NO: 61879 - RNA, 64 nt, Homo Sapiens
agauucugccucaaaaauaaacaaauaaauuuuaaaaauaaauaaauaauaaaaggaaguguua

SEQ ID NO: 61880 - RNA, 64 nt, Homo Sapiens
gcauaagauaugagauacaugaaccugaacuauuaaaauaaaauauuauauuuaacccuuaguu

SEQ ID NO: 61881 - RNA, 64 nt, Homo Sapiens
gccuggccaacauggcaaaaccacaucucuacuaaaaauaaaaaaauuagcugggugugguggu

SEQ ID NO: 61882 - RNA, 64 nt, Homo Sapiens
cuccagccggggugacagagugagacuccgacugaaaauaaauaaauaaauaaauaaauaaaua

SEQ ID NO: 61883 - RNA, 64 nt, Homo Sapiens
aaaaauauuuuuagcagaacagauggguuuuguaaaaauaaaaauuuguuaugaaauaaaaaaa

SEQ ID NO: 61884 - RNA, 64 nt, Homo Sapiens
gaguguaaauucuuuuuaaugagguaagcugaucaaaauaaauagggguauaucuauuucugaa

SEQ ID NO: 61885 - RNA, 64 nt, Homo Sapiens
uuaaaauuuauauguauuaaauguguaacuucuaaaaauaaaacagaaauuguucuuuuaaaau

SEQ ID NO: 61886 - RNA, 64 nt, Homo Sapiens
uuugagcaccugauuauauuuaacauuuuguaagaaaauaaaaguuaguuuggguucauuucua

SEQ ID NO: 61887 - RNA, 64 nt, Homo Sapiens
accguaggaaugggcucaacuuuuacugaggauuaaaauaaaaaugcuacagagcacccaguga

SEQ ID NO: 61888 - RNA, 64 nt, Homo Sapiens
guuucaaggauuccugaccauaaaggauuaggcaaaaauaaaauaaaaauauguuuacauugga

SEQ ID NO: 61889 - RNA, 64 nt, Homo Sapiens
uuccuuuagaagaucacucucauauuuuuaaauaaaaauaaauaacugcuuuacuuugauguau

SEQ ID NO: 61890 - RNA, 64 nt, Homo Sapiens
ccuucuaaaccacauuggaaggggaggauaugagaaaauaaauuuauacuauugagaaaucuau

SEQ ID NO: 61891 - RNA, 64 nt, Homo Sapiens
aaauuaaaguacacauuguagucccuuuauugaaaaaauaaaaaccuguucauacacccauuuu

SEQ ID NO: 61892 - RNA, 64 nt, Homo Sapiens
ugcucagauaggacaauuaacagagguugaguauaaaauaaacccuuuucucuaaucagagaua

SEQ ID NO: 61893 - RNA, 64 nt, Homo Sapiens
caaaaaaguuugauugagacguuuuaaauuuaaaaaaauaaaaaacucucugagagaaaagggu

SEQ ID NO: 61894 - RNA, 64 nt, Homo Sapiens
aaaagccaaacaagccuuagacaccaaaaaccuaaaaauaaacagaugagguuaggucaugagg

SEQ ID NO: 61895 - RNA, 64 nt, Homo Sapiens
augaggaaaaguuuaaccuauaggauuccaugugaaaauaaaauccuuaucggggcgaaccuuu

SEQ ID NO: 61896 - RNA, 64 nt, Homo Sapiens
uuuauaaggaauacuguuauuuuuuuaaaaccauaaaauaaauuuuuauacaauaauuuaaaua

SEQ ID NO: 61897 - RNA, 64 nt, Homo Sapiens
gcaaacauuaaaaacaagagaauuaaguauuuuaaaaauaaauguguacuccacaaguauguac

SEQ ID NO: 61898 - RNA, 64 nt, Homo Sapiens
aacuuguucugaaguugucuugcuuuuauucaucaaaauaaaauuuuuuucaauugccagcuac

SEQ ID NO: 61899 - RNA, 64 nt, Homo Sapiens
ugacagcuuuagcacaauuuaguuaaagucauuaaaaauaaaaaaauaaaaucuugucuagcac

SEQ ID NO: 61900 - RNA, 64 nt, Homo Sapiens
cuugucuagcacaguuaaaguauuucuguggcugaaaauaaaauagaguuauguuggauaguuu

SEQ ID NO: 61901 - RNA, 64 nt, Homo Sapiens
ggcaacuuuauuaaugccuaagaacacuguaccuaaaauaaagauaaccuaaaugaccuaaaua

SEQ ID NO: 61902 - RNA, 64 nt, Homo Sapiens
caaacaauaacauguuuaucaucccagaacaccaaaaauaaaaacccuuuugucuuuuaaaaua

SEQ ID NO: 61903 - RNA, 64 nt, Homo Sapiens
gcacaccaaaauguauacauuaugauuccagucaaaaauaaaauacaauuucccuucauaugga

SEQ ID NO: 61904 - RNA, 64 nt, Homo Sapiens
uauuaaaauuaaauucauucuuaagaaucacacaaaaauaaaugaauguuuugaaaguguuuua

SEQ ID NO: 61905 - RNA, 64 nt, Homo Sapiens
agcuggguuugacuuuugaguacacuguggugauaaaauaaaagcuuauuuuaagcuuguaaaa

SEQ ID NO: 61906 - RNA, 64 nt, Homo Sapiens
uuaaaaauguuuaauuugguuucauuaggggcugaaaauaaauguuaguuuugagguaacugca

SEQ ID NO: 61907 - RNA, 64 nt, Homo Sapiens
aauuaauaaaaugguguaguaaauaaaauaaaauaaaauaaaauagagcaagacucuaucucaa

SEQ ID NO: 61908 - RNA, 64 nt, Homo Sapiens
aaaauaauuaauaaaauggucucaaaaauaaaauaaaauaaaaugcaacagagcaagacucuau

SEQ ID NO: 61909 - RNA, 64 nt, Homo Sapiens
aaaauaaaauaauuaauaaaucuaucucaaaaauaaaauaaaauccugagcaacagagcaagac

SEQ ID NO: 61910 - RNA, 64 nt, Homo Sapiens
aaaauaaaauaaaauaauuaaagacucuaucucaaaaauaaaauuccagccugagcaacagagc

SEQ ID NO: 61911 - RNA, 64 nt, Homo Sapiens
aagcuaucugcaccucaaaagagauaguaacaacaaaauaaagcuauaauuguuggaccuccuu

SEQ ID NO: 61912 - RNA, 64 nt, Homo Sapiens
uguuguuaaauuuuaaacaauaaagaacaacaacaaaauaaagccaaugagccacagcaaaaag

SEQ ID NO: 61913 - RNA, 64 nt, Homo Sapiens
ccagaaucauaauuuucaagcuuuccgucucccuaaaauaaaaaaauucauuucacuuuaaagu

SEQ ID NO: 61914 - RNA, 64 nt, Homo Sapiens
aauacaguaaaguuuaaaaagcucuucuauuuaaaaaauaaaaacuuauguauuauuuucuaua

SEQ ID NO: 61915 - RNA, 64 nt, Homo Sapiens
gcugggaccaucccaaaagaaauuuuuuucuuuuaaaauaaacagcauuuguuggcucuauuuu

SEQ ID NO: 61916 - RNA, 64 nt, Homo Sapiens
ugguuuaaucacuaccauuguauaaaauuccuuaaaaauaaagagauggugcuaaaauucuucc

SEQ ID NO: 61917 - RNA, 64 nt, Homo Sapiens
cauucaauaaauaugacuuuauuuuuugguuguuaaaauaaacgugcauuguuaggcuguuaga

SEQ ID NO: 61918 - RNA, 64 nt, Homo Sapiens
acacugccgaaaaaaaaaaagguauguauuuaacaaaauaaacggcuuaauggguaauuuuuga

SEQ ID NO: 61919 - RNA, 64 nt, Homo Sapiens
acaucugccuucuugauauuuccuaauguaaaauaaaauaaaacuugagauugugguuuuuucu

SEQ ID NO: 61920 - RNA, 64 nt, Homo Sapiens
aaaacacaucugccuucuuguuucuuccuaauguaaaauaaaauuugcuuugagauugugguuu

SEQ ID NO: 61921 - RNA, 64 nt, Homo Sapiens
aagcaaauuugagucaaauauguuuacuccuaacaaaauaaagcacuaaacacaggcuacuuuc

SEQ ID NO: 61922 - RNA, 64 nt, Homo Sapiens
uacacacacacacacaccccaaauauguguguauaaaauaaacaaguaauauauuagaauauac

SEQ ID NO: 61923 - RNA, 64 nt, Homo Sapiens
guuaugaguaguaaaaauaauuuuguacaaaguaaaaauaaacucuuggauuugcauuuuugua

SEQ ID NO: 61924 - RNA, 64 nt, Homo Sapiens
uuaaaaaacuccugucuugcugcauguauucacuaaaauaaaauguuguuguuguuuuauauaa

SEQ ID NO: 61925 - RNA, 64 nt, Homo Sapiens
aguauugaagacuuacauggucaccuaaccuuugaaaauaaagucuauaauaaauuaacaagau

SEQ ID NO: 61926 - RNA, 64 nt, Homo Sapiens
agaacucuggaguggucuaaaccaaaaggaaaagaaaauaaagaucacauuuuucuacuauuug

SEQ ID NO: 61927 - RNA, 64 nt, Homo Sapiens
cccaccuuguugcaaaagcuugucaugcaccaaaaaaauaaaacugucucguuagaguauuuga

SEQ ID NO: 61928 - RNA, 64 nt, Homo Sapiens
aaaaaaaagacgaacuauugcaauaaaaauaaaaaaaauaaaaaucauuaucacacaaagagac

SEQ ID NO: 61929 - RNA, 64 nt, Homo Sapiens
aaauaaaaaaaaaaaaagaccaaagagaccaauaaaaauaaaaaauguguaggucauuaucaca

SEQ ID NO: 61930 - RNA, 64 nt, Homo Sapiens
gugaaaugucaaagacauguaggauaugguacuaaaaauaaaauauucugaugagcacugacaa

SEQ ID NO: 61931 - RNA, 64 nt, Homo Sapiens
cauuuuaaugugcauucugaacaguaauaugcauaaaauaaaccuguaauaaauuuauuguggu

SEQ ID NO: 61932 - RNA, 64 nt, Homo Sapiens
uacgagaaggcaaugugagguccuucuugugauaaaaauaaaauuucaggaaucacuauguauu

SEQ ID NO: 61933 - RNA, 64 nt, Homo Sapiens
uuuuguucuuguauugcuuucuuucaacaguuucaaaauaaaauaucauauaaauauugaggga

SEQ ID NO: 61934 - RNA, 64 nt, Homo Sapiens
ucauauauuuuaugaaucagaauaaccuucaaauaaaauaaaucuaagucgguuaaaauggauu

SEQ ID NO: 61935 - RNA, 64 nt, Homo Sapiens
auaaauauauuuuuauagaaaaacaaaucuacauaaaauaaaucuacuguuuagugagcaguau

SEQ ID NO: 61936 - RNA, 64 nt, Homo Sapiens
ugcauaaucaaggcacuguaaaucuuauaauuuuaaaauaaauuacuuaagaacaguugucauu

SEQ ID NO: 61937 - RNA, 64 nt, Homo Sapiens
aauaauucuugcauuuuuuccccauaaccugguuaaaauaaauacgccauuggcaauacuucau

SEQ ID NO: 61938 - RNA, 64 nt, Homo Sapiens
cugugucugauguuucuucucauguaagaaauaaaaaauaaaaauaaaauaaaauauauuggua

SEQ ID NO: 61939 - RNA, 64 nt, Homo Sapiens
cugauguuucuucucauguaagaaauaaaaaauaaaaauaaaauaaaauauauugguauguaac

SEQ ID NO: 61940 - RNA, 64 nt, Homo Sapiens
guuucuucucauguaagaaauaaaaaauaaaaauaaaauaaaauauauugguauguaacuacag

SEQ ID NO: 61941 - RNA, 64 nt, Homo Sapiens
aaaauaaaauauauugguauguaacuacaggaaaaaaauaaaaaauauauaguggacaguaacc

SEQ ID NO: 61942 - RNA, 64 nt, Homo Sapiens
aaaaaaaagauguuauacaaccaucaaaguggcaaaaauaaaaaaaaucaaguauuggcaaaga

SEQ ID NO: 61943 - RNA, 64 nt, Homo Sapiens
aauaaaaaugacaacaaaguaaaaggguaucccaaaaauaaaacuauccuuuuggaaaaaaaaa

SEQ ID NO: 61944 - RNA, 64 nt, Homo Sapiens
aaaucaccaagaaaaacagcuucucaguuaagugaaaauaaaccaguuaaaacagaaccuuuaa

SEQ ID NO: 61945 - RNA, 64 nt, Homo Sapiens
aaaccacaaggcuugagaauagaaauuaaaagcaaaaauaaaguucggccugggucucucuuug

SEQ ID NO: 61946 - RNA, 64 nt, Homo Sapiens
agccugggcaacaagagcgaaacucuugucugaaaaaauaaaguucaucccaacuuucaagucu

SEQ ID NO: 61947 - RNA, 64 nt, Homo Sapiens
uggguaacacggggagacccgucuuuaguaaauaaaaauaaauuuauuaauaaaacuaaaaauu

SEQ ID NO: 61948 - RNA, 64 nt, Homo Sapiens
acaggcauagaguucagacuuuuuuuaaauaguaaaaauaaaauuaaagcugaaaacugcaacu

SEQ ID NO: 61949 - RNA, 64 nt, Homo Sapiens
aauguaaauacuguuuuuaacaacuaugauuuggaaaauaaaucaaugcuauaacuauguugau

SEQ ID NO: 61950 - RNA, 64 nt, Homo Sapiens
aauggaucacacgauuucuuuaagggaauuaaaaaaaauaaaagaauuacggcuuuuacagcaa

SEQ ID NO: 61951 - RNA, 64 nt, Homo Sapiens
uucuggacggacuuauuaaaauacaaacagacaaaaaauaaaacaaaacuugaguucuauuuac

SEQ ID NO: 61952 - RNA, 64 nt, Homo Sapiens
uuuuaaauuacaaccacaguugaauaauaaccuaaaaauaaauuuuaguuugcuaaaaauuuac

SEQ ID NO: 61953 - RNA, 64 nt, Homo Sapiens
acaguuaaucuaaagucuuauuauuucuucuaguaaaauaaaauauuguuagauuaguucucau

SEQ ID NO: 61954 - RNA, 64 nt, Homo Sapiens
ugauaauuacuuauuuguguuuuucaugguuaaaaaaauaaaagaagcacaaugaccaguacau

SEQ ID NO: 61955 - RNA, 64 nt, Homo Sapiens
uuuacuauaguguagcuacuggcuucauuuaauaaaaauaaaugauuuugaaauuaaauauaau

SEQ ID NO: 61956 - RNA, 64 nt, Homo Sapiens
gaacuccuuucauaucaagacaaguuauuuguaaaaaauaaagaagggguuuuaauacaaaccu

SEQ ID NO: 61957 - RNA, 64 nt, Homo Sapiens
uuuggauuaaaauguugacaugauuucacauuugaaaauaaacucaucucuuauuuugaaguua

SEQ ID NO: 61958 - RNA, 64 nt, Homo Sapiens
uuugaaggugagaugauaaacuugcaaaacucacaaaauaaagagucaaacuuuuagaaugaca

SEQ ID NO: 61959 - RNA, 64 nt, Homo Sapiens
ccuggacaacagagcaagacucugucucaaaaaaaaaauaaaaaauaaaaaauaaaaaauaaaa

SEQ ID NO: 61960 - RNA, 64 nt, Homo Sapiens
aacagagcaagacucugucucaaaaaaaaaauaaaaaauaaaaaauaaaaaauaaaagaaacau

SEQ ID NO: 61961 - RNA, 64 nt, Homo Sapiens
caagacucugucucaaaaaaaaaauaaaaaauaaaaaauaaaaaauaaaagaaacauaagauaa

SEQ ID NO: 61962 - RNA, 64 nt, Homo Sapiens
cugucucaaaaaaaaaauaaaaaauaaaaaauaaaaaauaaaagaaacauaagauaaguaccuc

SEQ ID NO: 61963 - RNA, 64 nt, Homo Sapiens
gucugagcaacauggcaaaacccugugucuacaaaaaauaaaaaauuagcugggcaugacggcc

SEQ ID NO: 61964 - RNA, 64 nt, Homo Sapiens
uuuuuuaguucuuaaaaauuuauuuuuaaguucuaaaauaaaauaaaaauaaguucuuaaaauu

SEQ ID NO: 61965 - RNA, 64 nt, Homo Sapiens
uaguucuuaaaaauuuauuuuuaaguucuaaaauaaaauaaaaauaaguucuuaaaauuuauuu

SEQ ID NO: 61966 - RNA, 64 nt, Homo Sapiens
aaacucauccauagauaauucaagauuuguauucaaaauaaacauaguuuucacaguuacaaaa

SEQ ID NO: 61967 - RNA, 64 nt, Homo Sapiens
uuguauucaaaauaaacauaguuuucacaguuacaaaauaaaucaccuauuuuaucuuuuccuu

SEQ ID NO: 61968 - RNA, 64 nt, Homo Sapiens
auuauuuuuuuuaauuuaaguccuaaauauaguuaaaauaaauaauguuuuaguaaaaugauac

SEQ ID NO: 61969 - RNA, 64 nt, Homo Sapiens
uccagccaggugacauagcgagauccugucuaaaaaaauaaaaaauaaauaauggaacacagca

SEQ ID NO: 61970 - RNA, 64 nt, Homo Sapiens
aggugacauagcgagauccugucuaaaaaaauaaaaaauaaauaauggaacacagcaaguccua

SEQ ID NO: 61971 - RNA, 64 nt, Homo Sapiens
aauugcuguaggauccuguucuuucagcaggugaaaaauaaaacgcaguucaaauuucaugguu

SEQ ID NO: 61972 - RNA, 64 nt, Homo Sapiens
auuauuacugcaguaguugacuuugcuguauggaaaaauaaagugaaauugcccuaauaaaacu

SEQ ID NO: 61973 - RNA, 64 nt, Homo Sapiens
uauagguaaucaaugaauauugaaguuucagcuuaaaauaaacaguugugaaccaagaucuaua

SEQ ID NO: 61974 - RNA, 64 nt, Homo Sapiens
agaaauuuuuaucaguuuccagucucaaaaauacaaaauaaaaacaaacguuuuuaauacuauu

SEQ ID NO: 61975 - RNA, 64 nt, Homo Sapiens
uaagccccauggaucaauacauaaacuaugcauaaaaauaaaauuucauauuuucgcucguaaa

SEQ ID NO: 61976 - RNA, 64 nt, Homo Sapiens
gguaagccucucuuacuccuguuaugcacuuuuuaaaauaaauacugaauuccagaaagaauuu

SEQ ID NO: 61977 - RNA, 64 nt, Homo Sapiens
uuaccucucugugccucaguuuucccaugcaugaaaaauaaaauaaaauaaaacggggauucua

SEQ ID NO: 61978 - RNA, 64 nt, Homo Sapiens
ucucugugccucaguuuucccaugcaugaaaaauaaaauaaaauaaaacggggauucuaauguu

SEQ ID NO: 61979 - RNA, 64 nt, Homo Sapiens
gugccucaguuuucccaugcaugaaaaauaaaauaaaauaaaacggggauucuaauguuuguaa

SEQ ID NO: 61980 - RNA, 64 nt, Homo Sapiens
auaacuauauauauugccaucacacacgaacaauaaaauaaaguguucuauuaaccugaucucu

SEQ ID NO: 61981 - RNA, 64 nt, Homo Sapiens
caccaaacaggaaagaacuaugucugaaauauaaaaaauaaaaauaaaaaaacaacuaugaaua

SEQ ID NO: 61982 - RNA, 64 nt, Homo Sapiens
acaggaaagaacuaugucugaaauauaaaaaauaaaaauaaaaaaacaacuaugaauaugcaca

SEQ ID NO: 61983 - RNA, 64 nt, Homo Sapiens
ccauuuugccugacaauugcaaaucagagcauacaaaauaaaacugugcaguuuuguuugguuu

SEQ ID NO: 61984 - RNA, 64 nt, Homo Sapiens
gccugggcaacauagugagaccuugucucuacaaaaaauaaaauaaaauaaaaaccaaauuagc

SEQ ID NO: 61985 - RNA, 64 nt, Homo Sapiens
ggcaacauagugagaccuugucucuacaaaaaauaaaauaaaauaaaaaccaaauuagccagac

SEQ ID NO: 61986 - RNA, 64 nt, Homo Sapiens
cauagugagaccuugucucuacaaaaaauaaaauaaaauaaaaaccaaauuagccagacauggu

SEQ ID NO: 61987 - RNA, 64 nt, Homo Sapiens
aaaaaaauucaacagaugaaaacuuuaaaaaauaaaaauaaacagaauguacuaaaaaccaaug

SEQ ID NO: 61988 - RNA, 64 nt, Homo Sapiens
uaaacaaaaaaaauucaacaccaaugaacuuuaaaaaauaaaaauuuugagaauguacuaaaaa

SEQ ID NO: 61989 - RNA, 64 nt, Homo Sapiens
aauuuaaaaaaugggcuaaccaacaauaaggagaaaaauaaaucuauaaauaacucuuauaaca

SEQ ID NO: 61990 - RNA, 64 nt, Homo Sapiens
uuuaaaaugacauuuuacagaaauugugcaaaauaaaauaaacagcaaaauuacucuacuguua

SEQ ID NO: 61991 - RNA, 64 nt, Homo Sapiens
aaacauuuaaaaugacauuuuguuaaaauugugcaaaauaaaauccacagcaaaauuacucuac

SEQ ID NO: 61992 - RNA, 64 nt, Homo Sapiens
ccauuauucuuaauauggccuuccuauuucucuuaaaauaaaauucucuuaaaauaaaauccau

SEQ ID NO: 61993 - RNA, 64 nt, Homo Sapiens
ccauuuccuauuucucuuaauuccuguuucucuuaaaauaaaauugauuaugcuuaacagcugu

SEQ ID NO: 61994 - RNA, 64 nt, Homo Sapiens
auaaaggguuuucuucuguuacuuuuuguugaccaaaauaaaauugcugcugaguuaugcacag

SEQ ID NO: 61995 - RNA, 64 nt, Homo Sapiens
auagcauuguuaaagauaguauuccccauggguaaaaauaaauaaacaauguuuguacuuaugc

SEQ ID NO: 61996 - RNA, 64 nt, Homo Sapiens
caauuaaagaacuuggcaugacuuuuuauguaaaaaaauaaaaucuuuauccaauuuuuacuga

SEQ ID NO: 61997 - RNA, 64 nt, Homo Sapiens
gaaaaggaaacgaagaagcuagacaagcaaacucaaaauaaagaaggucaagagagagagaccc

SEQ ID NO: 61998 - RNA, 64 nt, Homo Sapiens
ccucuuuguuuaaaccauuggaauucuuguaaauaaaauaaaucccagccgccauccuucucca

SEQ ID NO: 61999 - RNA, 64 nt, Homo Sapiens
ucaccacuuccccaaagaaggaugcacaaucccuaaaauaaagacaggugaggguuacacugaa

SEQ ID NO: 62000 - RNA, 64 nt, Homo Sapiens
aauauuuaaauuccaaggagccaccuucuaacaaaaaauaaauaaucuuauucuucauguaauc

SEQ ID NO: 62001 - RNA, 64 nt, Homo Sapiens
ucccuaccuugcuucaguuagugcuguuuauaguaaaauaaaacaaugaagacauuuaacgguu

SEQ ID NO: 62002 - RNA, 64 nt, Homo Sapiens
cagagguuauauacaauuuauaugccacaauuuaaaaauaaaacuguauauuaggauuuaaauu

SEQ ID NO: 62003 - RNA, 64 nt, Homo Sapiens
guauauuaggauuuaaauuuaagaaauuuagggcaaaauaaaguugauuuaauuccuuuuuaga

SEQ ID NO: 62004 - RNA, 64 nt, Homo Sapiens
caguaucugccuucuggcuccccuccccccacacaaaauaaaaagcuaguacugugccgcuucc

SEQ ID NO: 62005 - RNA, 64 nt, Homo Sapiens
uuucaggcuuugugguccuguguguuucugcauuaaaauaaaugcaaucaguguaacuaggggc

SEQ ID NO: 62006 - RNA, 64 nt, Homo Sapiens
auucuauucauauuugucagcucuguuaaaaauuaaaauaaaugauaaguaugcuuuauuuuac

SEQ ID NO: 62007 - RNA, 64 nt, Homo Sapiens
uguuacuuuuuuccuucuuuauagcaaauauuaaaaaauaaaacgaacuaaggcauuaaagaaa

SEQ ID NO: 62008 - RNA, 64 nt, Homo Sapiens
cugaccccaaagacaaauaaauauuuaaaaaauaaaaauaaaaggacccugucucaaaaaauau

SEQ ID NO: 62009 - RNA, 64 nt, Homo Sapiens
uaaaagcugaccccaaagacaaauauauauuuaaaaaauaaaaagagagagacccugucucaaa

SEQ ID NO: 62010 - RNA, 64 nt, Homo Sapiens
auuauuugacaacaauccaauuugagauuuuuuuaaaauaaauucugaauguguuugaacaugu

SEQ ID NO: 62011 - RNA, 64 nt, Homo Sapiens
ucuucuugaggugggguggaaaaaauaaaaacaaaaaauaaauugaccgagugagacuguuucu

SEQ ID NO: 62012 - RNA, 64 nt, Homo Sapiens
caaaaaauaaauuucuucuuugagacuguuucuaaaaauaaaaacuccagccugggugaccgag

SEQ ID NO: 62013 - RNA, 64 nt, Homo Sapiens
uuguuugacugaaagugauuuaugaacuaacuugaaaauaaaagcucuuuagugucaguuaaau

SEQ ID NO: 62014 - RNA, 64 nt, Homo Sapiens
cagugaaaaaaaaaaucaaacagugaauaggggaaaaauaaacauuuauuuuauccaaguaccc

SEQ ID NO: 62015 - RNA, 64 nt, Homo Sapiens
ucacaauguaauacuacuacauugaucaaauuugaaaauaaaauauuuuauuauuuucaucuuu

SEQ ID NO: 62016 - RNA, 64 nt, Homo Sapiens
aguaaucagaagcuaaaguaauaaaguaaaaauaaaaauaaaaacaaaaauaauaauaauaaua

SEQ ID NO: 62017 - RNA, 64 nt, Homo Sapiens
uaaaaaaguaaucagaagcuauaauaauaaaguaaaaauaaaaaccaucucaaaaauaauaaua

SEQ ID NO: 62018 - RNA, 64 nt, Homo Sapiens
acuguuucccuuuggaacuaugaaaguacuccuuaaaauaaaaccagcccucauauaauagguu

SEQ ID NO: 62019 - RNA, 64 nt, Homo Sapiens
uaaaauauaggcuuuaaaaacaaaauuaaaaaauaaaauaaauaaagugagacccugucacuaa

SEQ ID NO: 62020 - RNA, 64 nt, Homo Sapiens
aaauauaaaauauaggcuuuacuaacaaaauuaaaaaauaaaaucaauaaagugagacccuguc

SEQ ID NO: 62021 - RNA, 64 nt, Homo Sapiens
gucuguguucuaaacaauuccacaauaaaugcaaaaaauaaaaauuauguuauguauauuuuac

SEQ ID NO: 62022 - RNA, 64 nt, Homo Sapiens
guuaaaagguuuuauguuaugcuuaaaauguuuaaaaauaaauguuguuauauuucaauaagaa

SEQ ID NO: 62023 - RNA, 64 nt, Homo Sapiens
agaacuccauaaauauuaaauaaaagcaaaggaaaaaauaaaucugcacaaagauuagcacacu

SEQ ID NO: 62024 - RNA, 64 nt, Homo Sapiens
gacaacgcaagaccuaguggcacccaaggagaggaaaauaaaauccauuuccuuccaguaaauc

SEQ ID NO: 62025 - RNA, 64 nt, Homo Sapiens
aaaagugggagaauuccuugaacagcaguauuugaaaauaaauauccacuugcagguuuaugga

SEQ ID NO: 62026 - RNA, 64 nt, Homo Sapiens
uucuaauguagcuaucucgcagcaguuuuuuaaaaaaauaaauaguacacugggcagacuucag

SEQ ID NO: 62027 - RNA, 64 nt, Homo Sapiens
cuguuuguuaguaugaaaaguuaacuuuuuuuccaaaauaaaagagugaauuuuucauguuaag

SEQ ID NO: 62028 - RNA, 64 nt, Homo Sapiens
guuaaguuaaaaaucuuugucuuguacuauuucaaaaauaaaaagacagcaaugacuuuauauc

SEQ ID NO: 62029 - RNA, 64 nt, Homo Sapiens
acugauguucuucacuaaauggauggccacaagaaaaauaaaguaaaugucuuaaauaauuuaa

SEQ ID NO: 62030 - RNA, 64 nt, Homo Sapiens
aguauggauacauccauucacugugguacauuuuaaaauaaaauauuuuagcagugaauaugga

SEQ ID NO: 62031 - RNA, 64 nt, Homo Sapiens
ugaauucaccacagcuggaauagcuguggaaaacaaaauaaaacaacaaaauuaauaaugaaau

SEQ ID NO: 62032 - RNA, 64 nt, Homo Sapiens
uugccuuuuauuccuuuaaaauuucgccuggcaaaaaauaaauaaauggaacuaucacuuuaua

SEQ ID NO: 62033 - RNA, 64 nt, Homo Sapiens
aguaaugcaaacaaauuauuuuuuacaaaaaaacaaaauaaauaaaauuagacuuccuucccuc

SEQ ID NO: 62034 - RNA, 64 nt, Homo Sapiens
ugaaauauugaaaauauugaaaauauuauuauugaaaauaaaaucuugaucucaacuauccccc

SEQ ID NO: 62035 - RNA, 64 nt, Homo Sapiens
uauuugguuaguaccuucacugagcaauaguggaaaaauaaaaaaauaaguaaacagaaaaaac

SEQ ID NO: 62036 - RNA, 64 nt, Homo Sapiens
acccauauuaugaagaaauacucugcaacucuuaaaaauaaauguaaugugccaggcgcaaugg

SEQ ID NO: 62037 - RNA, 64 nt, Homo Sapiens
cauagugagacuuggucucuaaaaaagaaaaaaaaaaauaaaacugauguaaugaauauauaau

SEQ ID NO: 62038 - RNA, 64 nt, Homo Sapiens
ucuacaaugaacauguuuuauuuuuacuuuuguuaaaauaaauaacauuuaauuugacggaaaa

SEQ ID NO: 62039 - RNA, 64 nt, Homo Sapiens
aaaagaaacaagagagaaaaaaaucaaaauaauuaaaauaaauuguuagagaaaaguuacuuua

SEQ ID NO: 62040 - RNA, 64 nt, Homo Sapiens
augucaacugaagaucugacuguacuaaauaugaaaaauaaagcagcacauacuuucucuacug

SEQ ID NO: 62041 - RNA, 64 nt, Homo Sapiens
uccuuaaccuccagcagacuccugcucucuauccaaaauaaagaucacagagcagcaaguucau

SEQ ID NO: 62042 - RNA, 64 nt, Homo Sapiens
uguucuccucuaucuuagagggguauucuucuugaaaauaaaaaauauugaaaugcuguauuuu

SEQ ID NO: 62043 - RNA, 64 nt, Homo Sapiens
guauauuuuagaaauuuguuaaugagaguaaaagaaaauaaauguguauagcucaguuuggaua

SEQ ID NO: 62044 - RNA, 64 nt, Homo Sapiens
uuguuuaaauguccauuuuuauucuuuauguuugaaaauaaauuauggggauccuauuuagcuc

SEQ ID NO: 62045 - RNA, 64 nt, Homo Sapiens
aaugacuuuagugacauuauaaaacugaaacuggaaaauaaaauggcuuaucugcugauguuua

SEQ ID NO: 62046 - RNA, 64 nt, Homo Sapiens
aaauaaaauggcuuaucugcugauguuuaucuuuaaaauaaauaaaaucuugcuagugugaaua

SEQ ID NO: 62047 - RNA, 64 nt, Homo Sapiens
uuuaaauggaugcauacaguccacaucauacaauaaaauaaaagguaauucagggucccaaaga

SEQ ID NO: 62048 - RNA, 64 nt, Homo Sapiens
aagaauaacuauaaaauaugaaagcucuaaauuuaaaauaaauuuagagauagaaucaugguac

SEQ ID NO: 62049 - RNA, 64 nt, Homo Sapiens
uuuuauggucacaaguuaucccuccucaguaugaaaaauaaauuagauauugaaaaaugucuaa

SEQ ID NO: 62050 - RNA, 64 nt, Homo Sapiens
cuguagaauuuauuuuaacuaugaccuuuaauugaaaauaaauaauuaaaauaucagacauguu

SEQ ID NO: 62051 - RNA, 64 nt, Homo Sapiens
cuauauauuuaugauaaaucuuuuccauuuguacaaaauaaaauuccauuucauugugaccuac

SEQ ID NO: 62052 - RNA, 64 nt, Homo Sapiens
ccuauauuuauguaacuguauacugaauucugacaaaauaaaaaaagauaccuuauugacgaaa

SEQ ID NO: 62053 - RNA, 57 nt, Homo Sapiens
auaacauccauaguguuuagagagaaaaaaauaaaccaauaaccuaccuacugacaa

SEQ ID NO: 62054 - RNA, 64 nt, Homo Sapiens
uucaucucuagggauguuuaacauuuauaauugcaaaauaaaccaacuauaaaaaaagaaacua

SEQ ID NO: 62055 - RNA, 64 nt, Homo Sapiens
ucuuaauucuggguugcuuguuuuuuaggugacaaaaauaaaauauuguauuuuaauucauggg

SEQ ID NO: 62056 - RNA, 64 nt, Homo Sapiens
uaccuuuccucugccugaaagacgugucucaagaaaaauaaauucuauuuuagaugcagguacu

SEQ ID NO: 62057 - RNA, 64 nt, Homo Sapiens
uaaaucaggagauggcugauucauaauggguaauaaaauaaauagcacuuucgagcugaugucg

SEQ ID NO: 62058 - RNA, 64 nt, Homo Sapiens
cuaggguuuuaaaaguaucucuggaaaauaaauaaaaauaaaaaaacauucuaguaacuggcca

SEQ ID NO: 62059 - RNA, 64 nt, Homo Sapiens
aaaauaaaaacuaggguuuuuaacuggccacuggaaaauaaauaaaaaaauaaaaacauucuag

SEQ ID NO: 62060 - RNA, 64 nt, Homo Sapiens
cauucuaguaacuggccacuuuuauaacaugcaaaaaauaaaaauucaaaccacagagaaaaua

SEQ ID NO: 62061 - RNA, 64 nt, Homo Sapiens
aguaauaaagaauaaaauacuuaaggauaaauaaaaaauaaaguuuuugaaagugagcauucau

SEQ ID NO: 62062 - RNA, 64 nt, Homo Sapiens
uauugaggaacauugcuuguguguugcagucccuaaaauaaaaauuucuuuauguuuuaugaaa

SEQ ID NO: 62063 - RNA, 64 nt, Homo Sapiens
auuucauuugcacacaaugauaaacauuauuauuaaaauaaauuaacacauuaaccagaaagcu

SEQ ID NO: 62064 - RNA, 64 nt, Homo Sapiens
cucuguguaauuuuuccauuaaauauucuuuacuaaaauaaaaaaaauguuuuuaaauauaaac

SEQ ID NO: 62065 - RNA, 64 nt, Homo Sapiens
uugugugauaauuuugaugaauugugaaaaaaacaaaauaaauucuuauuugucuucuuuuugc

SEQ ID NO: 62066 - RNA, 64 nt, Homo Sapiens
ucaugucagacccagaaaggcucuaguuaaaaagaaaauaaaucaaacaaaacagauaugcuua

SEQ ID NO: 62067 - RNA, 64 nt, Homo Sapiens
uuaauuuaaaaaguaucugacuuaugucgcucaaaaaauaaaauucucccaaauauguucaauu

SEQ ID NO: 62068 - RNA, 64 nt, Homo Sapiens
agaggauacuacaggcuggguaucauagaaguaaaaaauaaaacguggaagcuaaaaaaauuga

SEQ ID NO: 62069 - RNA, 64 nt, Homo Sapiens
uaacauauuggugaagaugcgacugucucaaaauaaaauaaaaacagccugggugacagaguga

SEQ ID NO: 62070 - RNA, 64 nt, Homo Sapiens
aaaaauaacauauuggugaaagugagacugucucaaaauaaaaucacuccagccugggugacag

SEQ ID NO: 62071 - RNA, 64 nt, Homo Sapiens
aaaaaaguacucauuucuucaacuuaaaggcauuaaaauaaacucaaauguaaaagucaccaaa

SEQ ID NO: 62072 - RNA, 64 nt, Homo Sapiens
auaaauuuugaaacuaugaguccagaaucaaaagaaaauaaaaugaauugaccuuaauuuguuu

SEQ ID NO: 62073 - RNA, 64 nt, Homo Sapiens
aggcuaauauauaauuuuucaaaaaggagagaagaaaauaaagaugucucaaaaaaaaaaaaaa

SEQ ID NO: 62074 - RNA, 64 nt, Homo Sapiens
guuugacuucuaaacucuguccucuuguaguuauaaaauaaaacauugugcuuuaaaaaaauaa

SEQ ID NO: 62075 - RNA, 64 nt, Homo Sapiens
ugucauugugcuuuaaaaaaaaaacaauucacuaaaaauaaauaugauuuuuuuaaaagucaca

SEQ ID NO: 62076 - RNA, 64 nt, Homo Sapiens
augauguaaacaaaaaaaauuuauugacuguaauaaaauaaaauuuucauauauaaaaguauau

SEQ ID NO: 62077 - RNA, 64 nt, Homo Sapiens
ggcagauuuaccucucauguaagcuugcaaacucaaaauaaauugauuuauucuauuaaauugu

SEQ ID NO: 62078 - RNA, 64 nt, Homo Sapiens
cauauuguucauguuuuucuuuaaaugagucuuaaaaauaaagguguuuugucgacaguaucuu

SEQ ID NO: 62079 - RNA, 64 nt, Homo Sapiens
ucuuuacuaauaggcaauugaucauugguccuaaaaaauaaaaauaacuucuagcuaaaauugu

SEQ ID NO: 62080 - RNA, 64 nt, Homo Sapiens
gucuucacuauguagcauaccugccaacaaaauaaaaauaaaaaaaauguugaaaccaacugaa

SEQ ID NO: 62081 - RNA, 64 nt, Homo Sapiens
uaaaaagucuucacuauguaacugaacugccaacaaaauaaaaacucaauaaauguugaaacca

SEQ ID NO: 62082 - RNA, 64 nt, Homo Sapiens
aauuuuuaaugaccugggucucuaagugaaauuuaaaauaaauauuaauuuucugaaagauaau

SEQ ID NO: 62083 - RNA, 64 nt, Homo Sapiens
uuugaagugcuacuauaauacagucuagucagacaaaauaaaguacaaaaagaaaauacauaug

SEQ ID NO: 62084 - RNA, 64 nt, Homo Sapiens
uucacugcuccacuccagguaucuugaaagagguaaaauaaacccugguggaauauauggagag

SEQ ID NO: 62085 - RNA, 64 nt, Homo Sapiens
aauaugcaauaacauuaaauaugaauaagcauaaaaaauaaauauagaaaguaauaaauucugu

SEQ ID NO: 62086 - RNA, 64 nt, Homo Sapiens
uauguugaauuggcacuuucguaaaauaaacacaaaaauaaauuauguguucuaaagucuuuuu

SEQ ID NO: 62087 - RNA, 64 nt, Homo Sapiens
caaaaauaaauuuauguugauaaagucuuuuuguaaaauaaacacuaguguuccucauguguuc

SEQ ID NO: 62088 - RNA, 64 nt, Homo Sapiens
uuuuuacuuaaauaaugcaugacacugagggaaaaaaauaaagcuaaacaauaaagaagauuca

SEQ ID NO: 62089 - RNA, 64 nt, Homo Sapiens
aaucacuaaggauuggagaacaccaaucaaucaaaaaauaaauaggacguaacuuagcauggau

SEQ ID NO: 62090 - RNA, 64 nt, Homo Sapiens
uuucugcauuucaggugagucaaugaaggaaaccaaaauaaauacaaaacaaaauuuccaaaaa

SEQ ID NO: 62091 - RNA, 64 nt, Homo Sapiens
cucaggcaagcauuucuuuagccuuuuuccccaaaaaauaaacugaucauguugggauuaacuu

SEQ ID NO: 62092 - RNA, 64 nt, Homo Sapiens
caauaaaaucuucacaauaaggaaaucuuugguaaaaauaaagacuuugaaugcucaaacuaug

SEQ ID NO: 62093 - RNA, 64 nt, Homo Sapiens
gaaucuuaaaauaggaacaucuccaucucaaaaaaaaauaaaaaccucggugacaagagcgaga

SEQ ID NO: 62094 - RNA, 64 nt, Homo Sapiens
acauuucuaaugaggauucacauuaauauaauauaaaauaaauaggucaguuacuggucucuuu

SEQ ID NO: 62095 - RNA, 64 nt, Homo Sapiens
cuccgaauguuauguuuugcuuuuaucucacaguaaaauaaauauaauuaaugguuugcaugug

SEQ ID NO: 62096 - RNA, 64 nt, Homo Sapiens
ucugaagggaaagggcucuuuuccugcuguuucaaaaauaaaagaacacauuagauguuacugu

SEQ ID NO: 62097 - RNA, 64 nt, Homo Sapiens
cuagcuaaucucgguagaugucauuacaaccuggaaaauaaaucacccuaagugacacaaauug

SEQ ID NO: 62098 - RNA, 64 nt, Homo Sapiens
uauuugaagugauauauuugguuaaacauuucuaaaaauaaacuaccaauacuaaauaguaaga

SEQ ID NO: 62099 - RNA, 64 nt, Homo Sapiens
auaaaaccacuaauuguuccguuaagcuucacagaaaauaaaaccucuauuacuagacauuuau

SEQ ID NO: 62100 - RNA, 64 nt, Homo Sapiens
cgagauugcaccacugcacuccagcuugggugauaaaauaaaauaaaauagucgugaaucuugu

SEQ ID NO: 62101 - RNA, 64 nt, Homo Sapiens
uugcaccacugcacuccagcuugggugauaaaauaaaauaaaauagucgugaaucuuguucaaa

SEQ ID NO: 62102 - RNA, 64 nt, Homo Sapiens
agaugcacaacaaaagaaacaucagaaguuuauaaaaauaaaucugacuauaugcauccucauu

SEQ ID NO: 62103 - RNA, 64 nt, Homo Sapiens
augucuucgagauguagaaauaaggaauauucugaaaauaaaaauuauacaguaguaaagauaa

SEQ ID NO: 62104 - RNA, 64 nt, Homo Sapiens
aaccaucuuuauuauggucauauuucacagcaccaaaauaaaucaucuuuauuaaguagaugaa

SEQ ID NO: 62105 - RNA, 64 nt, Homo Sapiens
uagggauucacugacuagauuuuacugaacuaugaaaauaaauacacauaauuuuucacaaaau

SEQ ID NO: 62106 - RNA, 64 nt, Homo Sapiens
acuccagccugggcgacagagugagacuaucucaaaaauaaauaaauaaauaaauaaauaguau

SEQ ID NO: 62107 - RNA, 64 nt, Homo Sapiens
uuucauucuuuaaauauuauugacuuacaguuuaaaaauaaauaaauaaaagcauacuauaguu

SEQ ID NO: 62108 - RNA, 64 nt, Homo Sapiens
augaauauuugcucauguuuucuaaauuccuuauaaaauaaaauuaauucgaauucaaucugca

SEQ ID NO: 62109 - RNA, 64 nt, Homo Sapiens
guucuauuuucccuguauugguaucuccuuaaauaaaauaaaauauuccuauuguaagugauau

SEQ ID NO: 62110 - RNA, 64 nt, Homo Sapiens
agugauaugagaaaucuuuaaccagccuuaucuaaaaauaaaaagagaagccauuguaagacau

SEQ ID NO: 62111 - RNA, 64 nt, Homo Sapiens
acuccagccugggcaauaagagcaaaacuccaucaaaauaaaauaaaauaaaauauaaaauaac

SEQ ID NO: 62112 - RNA, 64 nt, Homo Sapiens
agccugggcaauaagagcaaaacuccaucaaaauaaaauaaaauaaaauauaaaauaacuuaaa

SEQ ID NO: 62113 - RNA, 64 nt, Homo Sapiens
gggcaauaagagcaaaacuccaucaaaauaaaauaaaauaaaauauaaaauaacuuaaaaagaa

SEQ ID NO: 62114 - RNA, 64 nt, Homo Sapiens
auauguaacuuaaaucuagacaccaucaaagcauaaaauaaaaauaaaaagcguugcugaaucu

SEQ ID NO: 62115 - RNA, 64 nt, Homo Sapiens
aacuuaaaucuagacaccaucaaagcauaaaauaaaaauaaaaagcguugcugaaucugggucg

SEQ ID NO: 62116 - RNA, 64 nt, Homo Sapiens
uguuuuuggauugucaaagaggaugcuuagucuuaaaauaaaaauaaauuuaaaaaucaucuua

SEQ ID NO: 62117 - RNA, 64 nt, Homo Sapiens
uggauugucaaagaggaugcuuagucuuaaaauaaaaauaaauuuaaaaaucaucuuauaauua

SEQ ID NO: 62118 - RNA, 64 nt, Homo Sapiens
augucuagauuauauagguuuagguugaaguuauaaaauaaaauaaaauucauuuuccacugga

SEQ ID NO: 62119 - RNA, 64 nt, Homo Sapiens
uagauuauauagguuuagguugaaguuauaaaauaaaauaaaauucauuuuccacuggaacucu

SEQ ID NO: 62120 - RNA, 64 nt, Homo Sapiens
auccaccaauaucauguguagauauuauguauagaaaauaaaauaaauuauggcucuaacuucu

SEQ ID NO: 62121 - RNA, 64 nt, Homo Sapiens
ccaauaucauguguagauauuauguauagaaaauaaaauaaauuauggcucuaacuucuguguu

SEQ ID NO: 62122 - RNA, 64 nt, Homo Sapiens
cauuaucccucaaaaaguuaccaccacaucagaaaaaauaaaaaaaaaauaguaaaguaggcag

SEQ ID NO: 62123 - RNA, 64 nt, Homo Sapiens
uuacagaguaauuacauggugauuuuugcaauguaaaauaaaguguuucugauuauuuucuaug

SEQ ID NO: 62124 - RNA, 64 nt, Homo Sapiens
uauacuucuccauacacagaccucugcagaaugcaaaauaaaacuugcagugaaugaauuuagc

SEQ ID NO: 62125 - RNA, 64 nt, Homo Sapiens
uguauuugugaauaacaaacccacgguucaacagaaaauaaaugugccaauuagcuucuacuaa

SEQ ID NO: 62126 - RNA, 64 nt, Homo Sapiens
cacgaggacauaguggucaccaggagggguagcaaaaauaaaguucccaucucugucaccuagc

SEQ ID NO: 62127 - RNA, 64 nt, Homo Sapiens
caucaguaacaaaagaaauuaacuguucuuggaaaaaauaaaaaauaggugccuaguaaauguu

SEQ ID NO: 62128 - RNA, 64 nt, Homo Sapiens
acaauugaucugucauccauuacaguguuaaaagaaaauaaauuaccaguuuucuuuaugauga

SEQ ID NO: 62129 - RNA, 64 nt, Homo Sapiens
aaaaaggaaaaucauucagguccuucaaaaaauaaaaauaaaagagaccaccaguaaauaaucc

SEQ ID NO: 62130 - RNA, 64 nt, Homo Sapiens
uaaaagaaaaaggaaaaucauaauccuccuucaaaaaauaaaaaucuuuuagaccaccaguaaa

SEQ ID NO: 62131 - RNA, 64 nt, Homo Sapiens
uuaaauaguuguuuccucuaaaaauuagacuuugaaaauaaagcuuguuuguucagucugaauu

SEQ ID NO: 62132 - RNA, 64 nt, Homo Sapiens
uuauucccuauaacuuaaaauaacacuaucugccaaaauaaacuuaugcaacuuuaauuuuguu

SEQ ID NO: 62133 - RNA, 64 nt, Homo Sapiens
gcagcaauaugucauuaacaucuuaauaaugaauaaaauaaaaacccccacagagugccuagaa

SEQ ID NO: 62134 - RNA, 64 nt, Homo Sapiens
cguauguuugaccaaguaguuuucaaauaagaaaaaaauaaagaguaaagaucagaugguaauc

SEQ ID NO: 62135 - RNA, 64 nt, Homo Sapiens
cauuuucaguaugugauauaaaauguaaauggauaaaauaaaauggacaaguuuauaucaaguu

SEQ ID NO: 62136 - RNA, 64 nt, Homo Sapiens
uguaagcaaaauuuucuuuuuuauaaggaagaauaaaauaaacgugacccauuuugauaagucu

SEQ ID NO: 62137 - RNA, 64 nt, Homo Sapiens
uaaucuuuuaaaaugugucacagauuugggggacaaaauaaaaucuuuguuacuuuuguccccc

SEQ ID NO: 62138 - RNA, 64 nt, Homo Sapiens
aauguguuuuuaucguaauuugacuguggcuuuuaaaauaaagaacagcaaaaugccugcacca

SEQ ID NO: 62139 - RNA, 64 nt, Homo Sapiens
uuuuuauucuuuacucuugauaaaugguauuuuuaaaauaaaugaaacuuggggcaauugaugc

SEQ ID NO: 62140 - RNA, 64 nt, Homo Sapiens
uuuauagagauccuugaguacucaggcuuucuuaaaaauaaauugaaaaaaauauacaugcuua

SEQ ID NO: 62141 - RNA, 64 nt, Homo Sapiens
auagaaagguguaaguauauccuguuugauguaaaaaauaaaaaguuacagcaucaucacauua

SEQ ID NO: 62142 - RNA, 64 nt, Homo Sapiens
uauuucuuaaaaauaaguguaaguaacuacaaguaaaauaaauuaaaaauuauuucuaggguuu

SEQ ID NO: 62143 - RNA, 64 nt, Homo Sapiens
cuauaauauagauaucaaauugggaauauuuuucaaaauaaauauaauuguuuuacccucaagc

SEQ ID NO: 62144 - RNA, 64 nt, Homo Sapiens
uacauaaagaaccaaaaagguuuaucaaguaauuaaaauaaaucgcuaaucaacuacccuuucu

SEQ ID NO: 62145 - RNA, 64 nt, Homo Sapiens
uuauuaucgaggaguuuuaaaguacuguaacuuuaaaauaaauaacuacaaagcuucuuugucc

SEQ ID NO: 62146 - RNA, 64 nt, Homo Sapiens
uuucuguuugcagauaugauugauguauuucaccaaaauaaaauauuuuuauguuuauaaagug

SEQ ID NO: 62147 - RNA, 64 nt, Homo Sapiens
uugagcaugcauggauauacccaauaguacacacaaaauaaauguuuacuuaagagccauucua

SEQ ID NO: 62148 - RNA, 64 nt, Homo Sapiens
ggaagaggucccaaauuuggaguaaagaugggagaaaauaaauaugugcuauuuccuuggcgag

SEQ ID NO: 62149 - RNA, 64 nt, Homo Sapiens
ccuuuugcugucuuucucuaaauaugauuacuuuaaaauaaaaaaguaacaaggugucuuuucc

SEQ ID NO: 62150 - RNA, 64 nt, Homo Sapiens
augccguauaggaugucagacaauaccacugguuaaaauaaagccuauuuuucaaauuuaguga

SEQ ID NO: 62151 - RNA, 64 nt, Homo Sapiens
guuaauaguaugaucuuuaaaguuuugacaauauaaaauaaacuugguaacuguuuuacaaaua

SEQ ID NO: 62152 - RNA, 64 nt, Homo Sapiens
cuguuggucauaaguuaacuguauuaagaacaguaaaauaaauaaaaaccaauaguacuaauuu

SEQ ID NO: 62153 - RNA, 64 nt, Homo Sapiens
uccaaagaauuugcuuuauguuuuuagcuauuuaaaaauaaauccaucaaaaauaaaguaugca

SEQ ID NO: 62154 - RNA, 64 nt, Homo Sapiens
uuauguuuuuagcuauuuaaaaauaaauccaucaaaaauaaaguaugcaaauguaucuuuuaaa

SEQ ID NO: 62155 - RNA, 64 nt, Homo Sapiens
gucauguugugacaaauugaucacuuguguacgaaaaauaaaucuccuuaaaaacuaaauaaaa

SEQ ID NO: 62156 - RNA, 64 nt, Homo Sapiens
aauuaauacaguaguaguaaucauuuucuaggggaaaauaaaagaauaaaucacuauacugaua

SEQ ID NO: 62157 - RNA, 64 nt, Homo Sapiens
gaaaguguaggugaaaaaacuuguaacuguauugaaaauaaauaccauuaaacugugaucaguu

SEQ ID NO: 62158 - RNA, 64 nt, Homo Sapiens
cuuuguuuugguacauuugguugugcuuguggggaaaauaaaaacgcagagauccuuauauauu

SEQ ID NO: 62159 - RNA, 64 nt, Homo Sapiens
cuccagccugggugacaaagcaagacugugucucaaaauaaauaaauaaaauaaaauaaaauga

SEQ ID NO: 62160 - RNA, 64 nt, Homo Sapiens
gacaaagcaagacugugucucaaaauaaauaaauaaaauaaaauaaaaugacguacagagauuc

SEQ ID NO: 62161 - RNA, 64 nt, Homo Sapiens
agcaagacugugucucaaaauaaauaaauaaaauaaaauaaaaugacguacagagauucuauau

SEQ ID NO: 62162 - RNA, 64 nt, Homo Sapiens
gguuuuaugcuauuccuguguucuccaaaacaagaaaauaaaaagacaugacuuauucucuguu

SEQ ID NO: 62163 - RNA, 64 nt, Homo Sapiens
auguaugcuuuaaauagagaauuuauuucuuuuaaaaauaaagcuaucuuuccuuauccauguu

SEQ ID NO: 62164 - RNA, 64 nt, Homo Sapiens
cuucuuggauuucacccaacuaaaaggauuuuuaaaaauaaauaacagucuuaccuaaauuauu

SEQ ID NO: 62165 - RNA, 64 nt, Homo Sapiens
uugagauaugacgguguacuuacugccuuguagcaaaauaaagaugugcccuuauuuuaccuac

SEQ ID NO: 62166 - RNA, 64 nt, Homo Sapiens
gauaaguuuacacacugugcaaucucacaaucugaaaauaaaguugaguuggcuguguuuucuc

SEQ ID NO: 62167 - RNA, 64 nt, Homo Sapiens
aaaauauauauggaacugaaacauuaacuuagcuaaaauaaaagcaaucuguguuugagaugaa

SEQ ID NO: 62168 - RNA, 64 nt, Homo Sapiens
agguaaacauuuuaaccuguaaucuuagccacaaaaaauaaaucaauuaaaaaaauaguuauga

SEQ ID NO: 62169 - RNA, 64 nt, Homo Sapiens
uuguuagcuucgaugaagucaauuuauacccuauaaaauaaaacugaagauuuuuuugaagauu

SEQ ID NO: 62170 - RNA, 64 nt, Homo Sapiens
ccauauauuaauaaaaaccugucuugagcaccagaaaauaaaauugucaguuuagcauuacauu

SEQ ID NO: 62171 - RNA, 64 nt, Homo Sapiens
aaaaaucccuaaaaacucucacaguuucacuucaaaaauaaaaacaugcuauaaguauguacau

SEQ ID NO: 62172 - RNA, 64 nt, Homo Sapiens
guuuacuugucugcagaauaacuauuugugguuuaaaauaaaagauaguuguggccaccugcug

SEQ ID NO: 62173 - RNA, 64 nt, Homo Sapiens
ucaguuaaauauuggaagcucaucauccucaaguaaaauaaauaucaugcuuuuuggaaauuua

SEQ ID NO: 62174 - RNA, 64 nt, Homo Sapiens
cuuaauuacauauacaggaauguuaaaauuucugaaaauaaaugagagaaucaauugcugaaag

SEQ ID NO: 62175 - RNA, 64 nt, Homo Sapiens
ucucagaauugugauuuuaguguuuguaugauuaaaaauaaauuacugcaguuaaaucauauaa

SEQ ID NO: 62176 - RNA, 64 nt, Homo Sapiens
aggaauuauguggucagugcuuguauaacuguguaaaauaaaaaaaaauguguauuuagaauau

SEQ ID NO: 62177 - RNA, 64 nt, Homo Sapiens
auuuuauuccauuugcuuguguugcaauacuuuaaaaauaaaaauguuacaaaccugugggccu

SEQ ID NO: 62178 - RNA, 64 nt, Homo Sapiens
uaauuuaaaaaauucugugucuuguuuucaucaaaaaauaaaaaaaagugucacuaccguauuu

SEQ ID NO: 62179 - RNA, 64 nt, Homo Sapiens
gucacuaccguauuucuuguaugugcuugaaggaaaaauaaaguuaguacuuuugucuucuccc

SEQ ID NO: 62180 - RNA, 64 nt, Homo Sapiens
uuuuggauuaaauuaguuugugaaggauuauggaaaaauaaaacugucacuguuggacgucagc

SEQ ID NO: 62181 - RNA, 64 nt, Homo Sapiens
aauauucucuauuugaauuauuucugucacaguaaaaauaaaauacuuugaguuuugagcuacu

SEQ ID NO: 62182 - RNA, 64 nt, Homo Sapiens
uaucauguuaaccucugcuuuuaucucagauguuaaaauaaaugguuuggugcuuuuuauaaaa

SEQ ID NO: 62183 - RNA, 64 nt, Homo Sapiens
aaaaaaaaaaacaaaaaaaaaaaaacaaaagaaaaaaauaaaaauacgguggcaauauuaugua

SEQ ID NO: 62184 - RNA, 64 nt, Homo Sapiens
uacauuauguguaacagauugauuuucucagcacaaaauaaaaagcaucuguauuaauguaaag

SEQ ID NO: 62185 - RNA, 64 nt, Homo Sapiens
uuaucuugguacauaccuauuugaaaaugcuacuaaaauaaaaauaaaucuuugccaaaaauuu

SEQ ID NO: 62186 - RNA, 64 nt, Homo Sapiens
ugguacauaccuauuugaaaaugcuacuaaaauaaaaauaaaucuuugccaaaaauuuuuuuuc

SEQ ID NO: 62187 - RNA, 64 nt, Homo Sapiens
uguuauggaaaaugucaaccuuuguaagaaaaccaaaauaaaaauugaaaaauaaaaaccauaa

SEQ ID NO: 62188 - RNA, 64 nt, Homo Sapiens
ucaaccuuuguaagaaaaccaaaauaaaaauugaaaaauaaaaaccauaaacauuugcaccacu

SEQ ID NO: 62189 - RNA, 64 nt, Homo Sapiens
cagccuggauaacagagcgagacccugucucaaaaaaauaaaauaaaaaauaaaaacacccuug

SEQ ID NO: 62190 - RNA, 64 nt, Homo Sapiens
uggauaacagagcgagacccugucucaaaaaaauaaaauaaaaaauaaaaacacccuugccugc

SEQ ID NO: 62191 - RNA, 64 nt, Homo Sapiens
cagagcgagacccugucucaaaaaaauaaaauaaaaaauaaaaacacccuugccugcgcuccau

SEQ ID NO: 62192 - RNA, 64 nt, Homo Sapiens
agaagcacuaagacugcuucuaggcuuuauuuauaaaauaaacaccuuaucccuaacaugggca

SEQ ID NO: 62193 - RNA, 64 nt, Homo Sapiens
aucauguacauuugaaaauauuugcacacauuuaaaaauaaauguaaaguugucuuuuaaacua

SEQ ID NO: 62194 - RNA, 64 nt, Homo Sapiens
ggucugcauuucuacuguaaaaugcaauuugaaaaaaauaaaacgcaaaaaaagaaacuguaaa

SEQ ID NO: 62195 - RNA, 64 nt, Homo Sapiens
aaauuaaauggaaugaaugauauguauauuacucaaaauaaaguuucuuucacuuuaauaauca

SEQ ID NO: 62196 - RNA, 64 nt, Homo Sapiens
guauuugcuggugucguguaaauauugguauuuuaaaauaaaaacuguuacaucacuauuuuaa

SEQ ID NO: 62197 - RNA, 64 nt, Homo Sapiens
aucacaacaauuugacacccuucauucauuuauaaaaauaaaugagcuaguucuuuaguaguua

SEQ ID NO: 62198 - RNA, 64 nt, Homo Sapiens
acuuucucuaguuuuggagcaauuuuauaucaauaaaauaaaauuaccuuuaaacccauaaauu

SEQ ID NO: 62199 - RNA, 64 nt, Homo Sapiens
uaguaggcaagaccccucagauguaaaguucuacaaaauaaagcuuuuauuuauauuucacaua

SEQ ID NO: 62200 - RNA, 64 nt, Homo Sapiens
augaaaaaagaacuauaauaaguguacauauaugaaaauaaaugcagauuccuaauucuaugac

SEQ ID NO: 62201 - RNA, 64 nt, Homo Sapiens
caaucaaacacagaauuugaauaaagcugaguauaaaauaaaacuuacaguuuugugauauaaa

SEQ ID NO: 62202 - RNA, 64 nt, Homo Sapiens
ugaguauaaaauaaaaccaacaguuuugugauauaaaauaaagcauaaccuuauaccugaauua

SEQ ID NO: 62203 - RNA, 62 nt, Homo Sapiens
uauggcucuuuauuuuccuucugccucugacccaaaaauaaagaaaucacauuuaaaauaaa

SEQ ID NO: 62204 - RNA, 64 nt, Homo Sapiens
gccucugacccaaaaauaaaaugaaaucacauuuaaaauaaacuaaagcugcuuauaaauguaa

SEQ ID NO: 62205 - RNA, 64 nt, Homo Sapiens
ugagggcauguugcauauugauuucccccaaaacaaaauaaaauagcucuagguucuucagcac

SEQ ID NO: 62206 - RNA, 64 nt, Homo Sapiens
aaaaggagaggcagacaaugaauaauaauaaagaaaaauaaauacuagaaacucuaaaaacaaa

SEQ ID NO: 62207 - RNA, 64 nt, Homo Sapiens
ccauauuucaaacaaaacacaauaugugcauuguaaaauaaaugugcuuguuacaauucgaccu

SEQ ID NO: 62208 - RNA, 64 nt, Homo Sapiens
gugucacugugguaggcauuaaagcuuucuuguuaaaauaaaaggcccuucccaguauacuuga

SEQ ID NO: 62209 - RNA, 64 nt, Homo Sapiens
ggaaugaucaucuuggcuugccagcggaaaguugaaaauaaacuuuggggagggcauggaagau

SEQ ID NO: 62210 - RNA, 64 nt, Homo Sapiens
uucacugcccuaucaaaauacccucacauacuauaaaauaaauccaacacacacacacacacac

SEQ ID NO: 62211 - RNA, 64 nt, Homo Sapiens
aaacccaaagaaaguuuauuaaauuuauuauaggaaaauaaaucacauuuuacauaaaaugcua

SEQ ID NO: 62212 - RNA, 64 nt, Homo Sapiens
gacuauuaaccagaaaagaaaagagcguuugauuaaaauaaagucauaagaaguccauauacug

SEQ ID NO: 62213 - RNA, 64 nt, Homo Sapiens
auccaacuucuuugcauuacaguaaaaaaguaaaaaaauaaaucugaagaauuuauauuuggaa

SEQ ID NO: 62214 - RNA, 64 nt, Homo Sapiens
cgauucccagauuccauacacuuacaagucagguaaaauaaaaucacaauuuuaaauaauucau

SEQ ID NO: 62215 - RNA, 64 nt, Homo Sapiens
uucacacaauaaaaaacaacaaaauauuauuaguaaaauaaaauuaauuaguuaaaauauauua

SEQ ID NO: 62216 - RNA, 64 nt, Homo Sapiens
uuauuucuauccaaauuugaaggauugacuuaugaaaauaaauuuuacaugaagcucaaguguu

SEQ ID NO: 62217 - RNA, 64 nt, Homo Sapiens
ccugcuucagugucuuaaugaguaguaaucauacaaaauaaaaauuuguaacucaacugguaac

SEQ ID NO: 62218 - RNA, 64 nt, Homo Sapiens
aaauguuaucaaaagauguuugaaaucauuaucuaaaauaaaggcaauaaagucuccuugguac

SEQ ID NO: 62219 - RNA, 64 nt, Homo Sapiens
aaugaaauguuucaaugauacaauauaaauaaggaaaauaaaucuacuucuguaaagagaauau

SEQ ID NO: 62220 - RNA, 64 nt, Homo Sapiens
gacuuuucaaauuauaaugaauuuuuauuaugaaaaaauaaaauuugcaucagaucauggaugc

SEQ ID NO: 62221 - RNA, 64 nt, Homo Sapiens
uuugcuuuuuuuuuuuuuuuaaaagacaaagcaaaaaauaaaccucucaugcuaaaaauacaac

SEQ ID NO: 62222 - RNA, 64 nt, Homo Sapiens
auuuaaaaucaaaucaaaaauauuacaaaacagaaaaauaaaugaagaaugaaaacugcugacg

SEQ ID NO: 62223 - RNA, 64 nt, Homo Sapiens
gauguagaaaucuaaaugaaaaugucauauguuaaaaauaaagaaucuuaguucagaaauacau

SEQ ID NO: 62224 - RNA, 64 nt, Homo Sapiens
cguuauuagcugauuuuacucauuuuauauuugcaaaauaaauuucuaauauuuauugaaauug

SEQ ID NO: 62225 - RNA, 64 nt, Homo Sapiens
cagaaaaggguguguuuggaugaaaguaaaaaaaaaaauaaaaucuuucacugucucuaauggc

SEQ ID NO: 62226 - RNA, 64 nt, Homo Sapiens
auuuauuauuucaaaagaauaugucuuaaaagggaaaauaaaaacuuucuguugaaucacaaca

SEQ ID NO: 62227 - RNA, 64 nt, Homo Sapiens
caaagcaaccugucuuacauucuuacauuaucuuaaaauaaauauuucugcccuugaaucaaga

SEQ ID NO: 62228 - RNA, 64 nt, Homo Sapiens
cuagccugggcaacggugagacccugccucaaaaaaaauaaaaauaaaaauaaaacacuuuaau

SEQ ID NO: 62229 - RNA, 64 nt, Homo Sapiens
ugggcaacggugagacccugccucaaaaaaaauaaaaauaaaaauaaaacacuuuaauuagaau

SEQ ID NO: 62230 - RNA, 64 nt, Homo Sapiens
acggugagacccugccucaaaaaaaauaaaaauaaaaauaaaacacuuuaauuagaaucuauuu

SEQ ID NO: 62231 - RNA, 60 nt, Homo Sapiens
auggaucccuuacuauuuagaauaaggaacaaaauaaacccuuguguauguaucacccaa

SEQ ID NO: 62232 - RNA, 64 nt, Homo Sapiens
uaaagaaacauaaggacacauuuucaaauuaauaaaaauaaaggcauuuuaaggauggccugug

SEQ ID NO: 62233 - RNA, 64 nt, Homo Sapiens
cgagcacaauggucuuacauuggauuuuuguaaaaaaauaaaaauaaauggagacuuuaacuca

SEQ ID NO: 62234 - RNA, 64 nt, Homo Sapiens
caauggucuuacauuggauuuuuguaaaaaaauaaaaauaaauggagacuuuaacucaagcagc

SEQ ID NO: 62235 - RNA, 64 nt, Homo Sapiens
gaaaccaaaguuuauuaauaauuuuuauauaacuaaaauaaaauagauguggagggaucuguga

SEQ ID NO: 62236 - RNA, 64 nt, Homo Sapiens
cccagacuagugaguuaaguacaagaucucucuaaaaauaaacagaugaaaaucuauccccauu

SEQ ID NO: 62237 - RNA, 64 nt, Homo Sapiens
ggcagaaugaaguauguuuguuuauuuuucuuuaaaaauaaaggauuuuggaacucuggagagu

SEQ ID NO: 62238 - RNA, 64 nt, Homo Sapiens
uaccuaggcaacauggugaaaccuugucucuaccaaaauaaaaauuagcugggcaugguggcac

SEQ ID NO: 62239 - RNA, 64 nt, Homo Sapiens
ugcuauaguggaaucuuugguuuugcaucauaguaaaauaaaauaaacccaucacauuuggaac

SEQ ID NO: 62240 - RNA, 64 nt, Homo Sapiens
uaguggaaucuuugguuuugcaucauaguaaaauaaaauaaacccaucacauuuggaacauaac

SEQ ID NO: 62241 - RNA, 64 nt, Homo Sapiens
aauauucauucagacaaaucagaaagggcacuugaaaauaaauuuugauucugagccaggagaa

SEQ ID NO: 62242 - RNA, 64 nt, Homo Sapiens
ccuauggugugaaauccuuuguuauuuuucuaaaaaaauaaaauuuaaaaagaaagaaaacuaa

SEQ ID NO: 62243 - RNA, 64 nt, Homo Sapiens
gguauuucaaagcucuuuuccuaacugguuaaguaaaauaaaaaauugagcuuucuagaauauu

SEQ ID NO: 62244 - RNA, 64 nt, Homo Sapiens
aaaaaaagagagaguaacuacagaagaacuuuaaaaaauaaaaaauaagcuuaccuuggauucu

SEQ ID NO: 62245 - RNA, 64 nt, Homo Sapiens
aguuuuguuuuucacaaagcucuuauuaugaagcaaaauaaaaauucuaguuucuuguaugauu

SEQ ID NO: 62246 - RNA, 64 nt, Homo Sapiens
agaguauuugcacugcugaagagucacuaugagcaaaauaaaacaaauaagacucaaacugcuc

SEQ ID NO: 62247 - RNA, 64 nt, Homo Sapiens
uagcagaaaggcauggcuaauaauguugguggugaaaauaaauaaauaaguaaacaaaaugaag

SEQ ID NO: 62248 - RNA, 64 nt, Homo Sapiens
caaaugcauauaaaucuugauaaacaaagucuauaaaauaaaacaugggacauuagcuuuggga

SEQ ID NO: 62249 - RNA, 64 nt, Homo Sapiens
uguuaaaauguuugauuccuugggaauggccuuaaaaauaaauguaauaaagucagaguggugg

SEQ ID NO: 62250 - RNA, 64 nt, Homo Sapiens
aucucaguuuaauauaaaaugagcuaaguuuuuaaaaauaaauuauaaacuuggagauuagaaa

SEQ ID NO: 62251 - RNA, 64 nt, Homo Sapiens
uuuuuaaaaauaaauuauaaacuuggagauuagaaaaauaaagcaguugcuguagaauaggcug

SEQ ID NO: 62252 - RNA, 64 nt, Homo Sapiens
guuuuaaccagacuuucucuuaaaaacauuagauaaaauaaaagauucaccggauggauucuga

SEQ ID NO: 62253 - RNA, 64 nt, Homo Sapiens
uguguaggagugaagacaggaucccgugcuuaaaaaaauaaaaaauaaaaaaauaaaaaaaaaa

SEQ ID NO: 62254 - RNA, 64 nt, Homo Sapiens
gagugaagacaggaucccgugcuuaaaaaaauaaaaaauaaaaaaauaaaaaaaaaauaagacu

SEQ ID NO: 62255 - RNA, 64 nt, Homo Sapiens
acaggaucccgugcuuaaaaaaauaaaaaauaaaaaaauaaaaaaaaaauaagacuuuaacugc

SEQ ID NO: 62256 - RNA, 64 nt, Homo Sapiens
uuugcuucucgggaaagcaaagaagcugcuuuaaaaaauaaaaaggggacuaaaaauuuguuuu

SEQ ID NO: 62257 - RNA, 64 nt, Homo Sapiens
aauauugugaaaaugaaucuguuaugauaaagaaaaaauaaaguggaaacuuuuagaguauuac

SEQ ID NO: 62258 - RNA, 64 nt, Homo Sapiens
auuugcauguaaacaaugauuucaaaauacuugaaaaauaaaauuuuaacccaaaugaauaacu

SEQ ID NO: 62259 - RNA, 64 nt, Homo Sapiens
uuuaaaaccccauuuuccuaaagaacaaaguaguaaaauaaaaaaaaauuuaaaaaauuaaaaa

SEQ ID NO: 62260 - RNA, 64 nt, Homo Sapiens
aaguaguaaaauaaaaaaaaauuuaaaaaauuaaaaaauaaaaaaaagaggucacuaaaagacc

SEQ ID NO: 62261 - RNA, 64 nt, Homo Sapiens
uagugucucuauuuaugagaucacugaacuuuucaaaauaaagcuuuugcauagaauaaugaag

SEQ ID NO: 62262 - RNA, 64 nt, Homo Sapiens
cacugcuguaaagcaaaauauuugugaaagugccaaaauaaagucugucaugccaaaaguaaau

SEQ ID NO: 62263 - RNA, 64 nt, Homo Sapiens
auuuacacaggguuuauacaagauucugauaaaaaaaauaaauuuaguguguuaugaaugacua

SEQ ID NO: 62264 - RNA, 64 nt, Homo Sapiens
gcuuucuggaagaagacacccgaauacucugaaaaaaauaaaaauuuuuaaacccccaugaaca

SEQ ID NO: 62265 - RNA, 64 nt, Homo Sapiens
uuaggauauagugguaaugggggaauaccuugcuaaaauaaaacgcaauauacuauauguaaua

SEQ ID NO: 62266 - RNA, 64 nt, Homo Sapiens
aaguguaauuaauucuuucauacuguuaauguaaaaaauaaagcagagaacugugauuuaaaag

SEQ ID NO: 62267 - RNA, 64 nt, Homo Sapiens
caguuaacauagagugguuucaaacuauuuuuuaaaaauaaauaauugcauuuuauuaccauuu

SEQ ID NO: 62268 - RNA, 64 nt, Homo Sapiens
ggaccagaaaagaaaagaaaugaguacauuaaguaaaauaaaauuaggcuuauuaugauacuag

SEQ ID NO: 62269 - RNA, 64 nt, Homo Sapiens
uaugcuaauaaaauccugagaaaugugaaguuauaaaauaaauauauacaaaguaaaauguuau

SEQ ID NO: 62270 - RNA, 64 nt, Homo Sapiens
uguuugacuugucagguguuuuuguaauguuugaaaaauaaagcagucaaaaaaaaaaauaccu

SEQ ID NO: 62271 - RNA, 64 nt, Homo Sapiens
uggauagguggugacccacuaaaauaaaauaaauaaaauaaaaaagguaaacaaagaaaugaca

SEQ ID NO: 62272 - RNA, 64 nt, Homo Sapiens
aaauaaaaauggauaggugggaaaugacaaaaauaaaauaaauaaaaaaggauagguaaacaaa

SEQ ID NO: 62273 - RNA, 64 nt, Homo Sapiens
aaauaaaauaaaaauggauaacaaagaaaugacaaaaauaaaauauuuaaaaaaggauagguaa

SEQ ID NO: 62274 - RNA, 64 nt, Homo Sapiens
agcuauguauuaacacugccauuucuccuuugauaaaauaaaugaauugcuuacuuuggaauac

SEQ ID NO: 62275 - RNA, 64 nt, Homo Sapiens
caccuagucuaaggaugcuaaauaaaauaaaauaaaaauaaauuaaaaaggacaauuucaaaaa

SEQ ID NO: 62276 - RNA, 64 nt, Homo Sapiens
uaaauucaccuagucuaaggcaaaaaaauaaaauaaaauaaaaaacaugaaaaaaggacaauuu

SEQ ID NO: 62277 - RNA, 64 nt, Homo Sapiens
aaaaauaaauucaccuagucaauuucaaaaaaauaaaauaaaauuuuugacaugaaaaaaggac

SEQ ID NO: 62278 - RNA, 64 nt, Homo Sapiens
aaaauaaaaauaaauucaccaggacaauuucaaaaaaauaaaauaaauguuuugacaugaaaaa

SEQ ID NO: 62279 - RNA, 64 nt, Homo Sapiens
cccaauuccauugggaaaaaauugagaaaaaaauaaaauaaauugaaaaauaaauaacaagaua

SEQ ID NO: 62280 - RNA, 64 nt, Homo Sapiens
aaauucccaauuccauugggagauaauugagaaaaaaauaaaauauugagaaaaauaaauaaca

SEQ ID NO: 62281 - RNA, 64 nt, Homo Sapiens
acaagauaauugagaaaaaacaaaauaauugagaaaaauaaauaaacuugagccaaucugagag

SEQ ID NO: 62282 - RNA, 64 nt, Homo Sapiens
aagcacaaguacgaacuuagccuauuuauaaaauaaaauaaaccuuggaaccaugcgagugaua

SEQ ID NO: 62283 - RNA, 64 nt, Homo Sapiens
aaaccaagcacaaguacgaaugauaccuauuuauaaaauaaaaucgcauuuggaaccaugcgag

SEQ ID NO: 62284 - RNA, 64 nt, Homo Sapiens
uaugaaaacaguacacuguuuauauaauaccucaaaaauaaaaaugucuauacacuucacacuu

SEQ ID NO: 62285 - RNA, 64 nt, Homo Sapiens
aaaacugcuuacaccagaaggauuggcaaaaacuaaaauaaauuacacuuuucuaaggacugaa

SEQ ID NO: 62286 - RNA, 64 nt, Homo Sapiens
aauaaaaaaagaaagcaugacauauuacaaaaacaaaauaaaauaagaauacuauuuccaaacu

SEQ ID NO: 62287 - RNA, 64 nt, Homo Sapiens
uauucacauuguuaagaaaauuccuccauuugagaaaauaaagcauccacuaugccuuaauggu

SEQ ID NO: 62288 - RNA, 64 nt, Homo Sapiens
aauuauaaauaucauuguacuuugaagucuauaaaaaauaaaauagugucuauaaaagaaacac

SEQ ID NO: 62289 - RNA, 64 nt, Homo Sapiens
aaguucuuaaaaaauuuauaguucuuccuuuuuuaaaauaaaauuuuucugccaaaauaaaccu

SEQ ID NO: 62290 - RNA, 64 nt, Homo Sapiens
uguucuuccuuuuuuaaaauuuuacuuuucugccaaaauaaaccaaauuuugcauauucucuau

SEQ ID NO: 62291 - RNA, 64 nt, Homo Sapiens
cugucaaguucuuuucaaaacacuaugucuuauuaaaauaaaaccuuuuaagccauuuccucuu

SEQ ID NO: 62292 - RNA, 64 nt, Homo Sapiens
uauuuaauaauuuuuguuucuugacacuuuagaaaaaauaaacaugcccuggcaguggcuacau

SEQ ID NO: 62293 - RNA, 64 nt, Homo Sapiens
gugugaaaaaguaaagauaacuaaaaaauuuagaaaaauaaauccaguauuuguaaagugaaua

SEQ ID NO: 62294 - RNA, 64 nt, Homo Sapiens
cauuguucugucaauaauuguuaccaaagagauaaaaauaaaagcagaauguauaucaucccau

SEQ ID NO: 62295 - RNA, 64 nt, Homo Sapiens
agccugggugacagagugagacucugucucaaaaaaaauaaaauaaaaagucaauuuagaaugu

SEQ ID NO: 62296 - RNA, 64 nt, Homo Sapiens
gggugacagagugagacucugucucaaaaaaaauaaaauaaaaagucaauuuagaaugugaaau

SEQ ID NO: 62297 - RNA, 64 nt, Homo Sapiens
agaauugaugguuguauaagaacuagcucauguaaaaauaaaauaacauuauuacauugccuca

SEQ ID NO: 62298 - RNA, 64 nt, Homo Sapiens
ggucgauugaauuggaccuuuucaguuguucagaaaaauaaaaauaauuucucauauuaaauac

SEQ ID NO: 62299 - RNA, 64 nt, Homo Sapiens
uacgauuuuuaaguaaguuggggaccaucaguuuaaaauaaaugcaauacuauuucaugauaaa

SEQ ID NO: 62300 - RNA, 64 nt, Homo Sapiens
uguuuuugucgugucuauaaaggaagaacaaaacaaaauaaaaacagagcccuagagaaaugcu

SEQ ID NO: 62301 - RNA, 64 nt, Homo Sapiens
gcuuuuuuaguaauagguccagauaugagugcuaaaaauaaagaugauagcauguucuucuguc

SEQ ID NO: 62302 - RNA, 64 nt, Homo Sapiens
agucauuuaccaggauucccguagggcguuuuguaaaauaaacuauaauauuaaugaaaaguau

SEQ ID NO: 62303 - RNA, 64 nt, Homo Sapiens
aacuguaaauacauuuguaccucucuuguauucuaaaauaaaaauuacuuggaacauuuaucau

SEQ ID NO: 62304 - RNA, 64 nt, Homo Sapiens
aguaacacuuuaaaacaagaucaacaaaagaaaaaaaauaaaacccaguaaaacaaauguguau

SEQ ID NO: 62305 - RNA, 64 nt, Homo Sapiens
uuuacuauuuccuuuauauaguuuaucuucugccaaaauaaaaagaggcauuuuaaucugcaca

SEQ ID NO: 62306 - RNA, 64 nt, Homo Sapiens
ugugccuaaaaccuccaguuauauuaaaaaaaauaaaauaaauacaauguacucuuuuacuuuu

SEQ ID NO: 62307 - RNA, 64 nt, Homo Sapiens
aaauaugugccuaaaaccuccuuuuauauuaaaaaaaauaaaaucucaacaauguacucuuuua

SEQ ID NO: 62308 - RNA, 64 nt, Homo Sapiens
agccagcguacacaaugagacuaaauugcaaaauaaaauaaaauaagaguuguaggaugcaggg

SEQ ID NO: 62309 - RNA, 64 nt, Homo Sapiens
aaaauagccagcguacacaacagggcuaaauugcaaaauaaaauuuaucaagaguuguaggaug

SEQ ID NO: 62310 - RNA, 64 nt, Homo Sapiens
ccaucuaaauagaaggguucauaauaaauauugcaaaauaaaauaguacauuugaauugaauau

SEQ ID NO: 62311 - RNA, 64 nt, Homo Sapiens
uuauucucugauaaagagcuaaaacuuuccaaauaaaauaaaugcagauagucucauauuuagg

SEQ ID NO: 62312 - RNA, 64 nt, Homo Sapiens
gacaugaaacugcaaaaauggauauggcuggaccaaaauaaaauuuuuuuuucuccuacaagga

SEQ ID NO: 62313 - RNA, 64 nt, Homo Sapiens
uuaaagagggcauaaaggagauagauguaaagacaaaauaaaggaacaaugacuguaacguguu

SEQ ID NO: 62314 - RNA, 64 nt, Homo Sapiens
uaauauuuauaauggauauucuuccaauucuuuuaaaauaaaauguauguaauauauguaacau

SEQ ID NO: 62315 - RNA, 64 nt, Homo Sapiens
ucagaggccuaucuccacuuccugcuaggauuuaaaaauaaaaaagccucuuaaaaaaaaaaaa

SEQ ID NO: 62316 - RNA, 64 nt, Homo Sapiens
uagaaacacaacucuacuagauuaauaaaaguaaaaaauaaaaaaaaucuguauuaaaaauaaa

SEQ ID NO: 62317 - RNA, 64 nt, Homo Sapiens
uaauaaaaguaaaaaauaaagaaaaucuguauuaaaaauaaaaugguugaaaaugccccuuacu

SEQ ID NO: 62318 - RNA, 64 nt, Homo Sapiens
agcaaaucucuuuaccgggacuagauauuccuagaaaauaaagaaccagucaacucuaagaaga

SEQ ID NO: 62319 - RNA, 64 nt, Homo Sapiens
ccugccaccaaauuauuucuaaaaauaaaugaauaaaauaaaaaacacagcaagacucugucuc

SEQ ID NO: 62320 - RNA, 64 nt, Homo Sapiens
aauaaaauaaaaaccugccaaagacucugucucaaaaauaaaugaccagccugggcaacacagc

SEQ ID NO: 62321 - RNA, 64 nt, Homo Sapiens
ccagucugggugacagagcaagacuccaucucaaaaaauaaauaaauagaaagagagagagagg

SEQ ID NO: 62322 - RNA, 64 nt, Homo Sapiens
gauuuaccaauguuguuuuuuuuuaacaagaaaaaaaauaaaagcacauugucauuuuuuuucc

SEQ ID NO: 62323 - RNA, 64 nt, Homo Sapiens
aagacaaaugaagccuaaucguuuuucuagaaggaaaauaaauucuaauugauaaugaauuucg

SEQ ID NO: 62324 - RNA, 64 nt, Homo Sapiens
acacacacacacacacacacacacacacacacacaaaauaaauccgggugugccugaaccucag

SEQ ID NO: 62325 - RNA, 64 nt, Homo Sapiens
ggcuuuuugacagcuuuuugagaccucuuaagaaaaaauaaaaaguaaaaaaugaaaggaaucu

SEQ ID NO: 62326 - RNA, 64 nt, Homo Sapiens
ucgguuucugcuguauuaaugacaauuauucaugaaaauaaaaaaugaaauauuuuguauacua

SEQ ID NO: 62327 - RNA, 64 nt, Homo Sapiens
ccucaaacugaggcuuaaaguauucccuuuuauaaaaauaaaugcuugggguaggguggagugg

SEQ ID NO: 62328 - RNA, 64 nt, Homo Sapiens
aggguggaguggggagggauuaaaacccauccaaaaaauaaauaaaaacuauauaggugcuaug

SEQ ID NO: 62329 - RNA, 64 nt, Homo Sapiens
gcaguacagaggaaaacaggaaccugauuuuuuuaaaauaaauuuuaaauaaaauagaauuacu

SEQ ID NO: 62330 - RNA, 64 nt, Homo Sapiens
aguauaaaaaagcaaauacuuggugagugauuuaaaaauaaaaccaaaacaaaacacaaaaaga

SEQ ID NO: 62331 - RNA, 64 nt, Homo Sapiens
caguuugaagcaguucuucaugccacuuaguuugaaaauaaaauucuagauaugcaaaugauuu

SEQ ID NO: 62332 - RNA, 64 nt, Homo Sapiens
uagauaugcaaaugauuuucuuagaaaacuucacaaaauaaaagaucuuguuuuuuuuuccaua

SEQ ID NO: 62333 - RNA, 64 nt, Homo Sapiens
uuugacaauugguagaaggugcacauuuuaagcaaaaauaaaaguuuuauaguuuuaaauacau

SEQ ID NO: 62334 - RNA, 64 nt, Homo Sapiens
aaauguuuucucucuuaaaauauuucuccuguguaaaauaaaucauuguuguuaguaaugguug

SEQ ID NO: 62335 - RNA, 64 nt, Homo Sapiens
aaagaagugcuuuuuggauauggcagcacuuguaaaaauaaagcaguaagcaaaauccuuuuaa

SEQ ID NO: 62336 - RNA, 64 nt, Homo Sapiens
gggugacagagcgagacucugucucaaaaaaaaaaaaauaaagccgggcgugguggcucacgcc

SEQ ID NO: 62337 - RNA, 64 nt, Homo Sapiens
gcaacaagagcgaaacugucucaaaaaaaagaagaaaauaaauaaauaaaaaucagagcacaag

SEQ ID NO: 62338 - RNA, 64 nt, Homo Sapiens
aagccaacuucuguauaccuucacccauuucaugaaaauaaaaucaaaagggaaaucaaaaaua

SEQ ID NO: 62339 - RNA, 64 nt, Homo Sapiens
ccauuucaugaaaauaaaaucaaaagggaaaucaaaaauaaagaaaacgcuaaagaaaaaacaa

SEQ ID NO: 62340 - RNA, 64 nt, Homo Sapiens
uaacacuugugucaaaaugauauagcuuaguauaaaaauaaaauucaacguuuuggccaaaaug

SEQ ID NO: 62341 - RNA, 64 nt, Homo Sapiens
uuuuugguuuacaguguaauaauaccucauuuaaaaaauaaaaaccacuacuguuacauuuuau

SEQ ID NO: 62342 - RNA, 64 nt, Homo Sapiens
aguuuauaguaguuugagcagaggaugauuugcaaaaauaaaaauaaaguuauuuuacucuccu

SEQ ID NO: 62343 - RNA, 64 nt, Homo Sapiens
uaguaguuugagcagaggaugauuugcaaaaauaaaaauaaaguuauuuuacucuccucuugca

SEQ ID NO: 62344 - RNA, 64 nt, Homo Sapiens
aaagggaaggauuuaaggaggugaagucgggucaaaaauaaaauauauauacauauauacauug

SEQ ID NO: 62345 - RNA, 64 nt, Homo Sapiens
gaagguuacugagugaguuauugggagucuuaauaaaauaaacuagauauuagguccauucauu

SEQ ID NO: 62346 - RNA, 64 nt, Homo Sapiens
augaacccuuccugagcuuuaugguccuaaaagcaaaauaaaaacuauucgaaugaaaagacaa

SEQ ID NO: 62347 - RNA, 64 nt, Homo Sapiens
uuuuauguuuagauagggcugggcaaggaaaaagaaaauaaagacaaccauauuuagcagugca

SEQ ID NO: 62348 - RNA, 64 nt, Homo Sapiens
ucucugaaguauuccaugcccugacaaggaugcuaaaauaaaaguaaguaagaagcuauguaaa

SEQ ID NO: 62349 - RNA, 64 nt, Homo Sapiens
gaacuugcaauauuuuugcauacacaaaccuacaaaaauaaacuauaucuguuuugguauauug

SEQ ID NO: 62350 - RNA, 64 nt, Homo Sapiens
caggcaaauaacuagagacugacauaaaguugaaaaaauaaaugagcugcaucuauaugucacu

SEQ ID NO: 62351 - RNA, 64 nt, Homo Sapiens
acuaagcagcuuuuguuuggcaaaaugcaaaugcaaaauaaauauguuuuuuucucacuuccua

SEQ ID NO: 62352 - RNA, 64 nt, Homo Sapiens
ugagucccaauagagcuguuggggauuuuaauugaaaauaaacuuaagacauuuccuaauuuau

SEQ ID NO: 62353 - RNA, 64 nt, Homo Sapiens
gcccaucaauaaguuugauauuuugcaauaaaaaaaaauaaauuaaaaaguuuucugaaaaaac

SEQ ID NO: 62354 - RNA, 64 nt, Homo Sapiens
aauugggaaagaagguggguaacauuagaauuuuaaaauaaaauauccauuaccuggcacuagc

SEQ ID NO: 62355 - RNA, 64 nt, Homo Sapiens
auaaugauuuauugcagaaugauuugcuuuaaaaaaaauaaaaguuuuuguccuuuccuucacu

SEQ ID NO: 62356 - RNA, 64 nt, Homo Sapiens
uaaauacaaaaaaaaauagccucaaaaaaaaauuaaaauaaauugcaacagagcaagacucugc

SEQ ID NO: 62357 - RNA, 64 nt, Homo Sapiens
acuaucaggauugaaaacagaaauauauuuugaaaaaauaaagagcaaauuagcaucccauggc

SEQ ID NO: 62358 - RNA, 64 nt, Homo Sapiens
ucuguuucuaacuaaaauguuuuuucuauuuucaaaaauaaaauauuuuaaaaauauuguuuga

SEQ ID NO: 62359 - RNA, 64 nt, Homo Sapiens
uaagccacaaggaaugggugcucuaaaaaaaaugaaaauaaacaacaacauagcaagauuccau

SEQ ID NO: 62360 - RNA, 64 nt, Homo Sapiens
uuagauuuaagucgagcucaccauaaaauaaaauaaaauaaaauauuuauuagagggagcaugg

SEQ ID NO: 62361 - RNA, 64 nt, Homo Sapiens
aaaauuuagauuuaagucgacauggccauaaaauaaaauaaaauuuuagauuuauuagagggag

SEQ ID NO: 62362 - RNA, 64 nt, Homo Sapiens
aaaauaaaauuuagauuuaagggagcauggccauaaaauaaaauuaaaauuuagauuuauuaga

SEQ ID NO: 62363 - RNA, 64 nt, Homo Sapiens
gcuagaauuugauuggauuuuagucaauuuccacaaaauaaaguuaaaacacuuuagaaucagc

SEQ ID NO: 62364 - RNA, 64 nt, Homo Sapiens
auauacccgagccauuaaccaaaauaaagaagauaaaauaaauucuaucauuauuccaaaauac

SEQ ID NO: 62365 - RNA, 64 nt, Homo Sapiens
agauaaaauaaauuauauacuuauuccaaaauacaaaauaaagaauuuucagaugcagcuauca

SEQ ID NO: 62366 - RNA, 64 nt, Homo Sapiens
gcuguuauuucuacuguguuaaaaacugauacuuaaaauaaaugaucaaaaugcacuuuuuaau

SEQ ID NO: 62367 - RNA, 64 nt, Homo Sapiens
auuccuugaaaauauaaauaaaauguuuuuauuuaaaauaaaguuauggucaguaggcaaucuu

SEQ ID NO: 62368 - RNA, 64 nt, Homo Sapiens
ccucccuaauccuauuaucuagagaagaugccauaaaauaaacagaagugcuaagaacuccaug

SEQ ID NO: 62369 - RNA, 64 nt, Homo Sapiens
uacaauuaaggcugacauuaauuguuucaugcagaaaauaaagagucuuuagucaaaucucugc

SEQ ID NO: 62370 - RNA, 64 nt, Homo Sapiens
cuugaggaugugaacauaaauuuauuuuuucuugaaaauaaagcucacauugugcuacuacgac

SEQ ID NO: 62371 - RNA, 64 nt, Homo Sapiens
uuuacccaaaaguauaagauuuugguuguauaacaaaauaaaagacuaagauaguuuuaagauu

SEQ ID NO: 62372 - RNA, 64 nt, Homo Sapiens
uugagucguugacuuuuguaccuucuuuauaaugaaaauaaaucucucauugugcuuucccuuc

SEQ ID NO: 62373 - RNA, 64 nt, Homo Sapiens
ucaggugcuauaacauguagacauaagguauuucaaaauaaaucuagauuguaggagaugacag

SEQ ID NO: 62374 - RNA, 64 nt, Homo Sapiens
auuguauuaaaaauuuaaaacagauguuuauauuaaaauaaaauuuaucuuugucuauaacuga

SEQ ID NO: 62375 - RNA, 64 nt, Homo Sapiens
agauuguguugcuauuuuuugcucucaguacccuaaaauaaacuuuguccuuuaagucugcuag

SEQ ID NO: 62376 - RNA, 64 nt, Homo Sapiens
aagaagcuggacauggugggcauguagagacacaaaaauaaauguguuguauuuaaaagguagc

SEQ ID NO: 62377 - RNA, 64 nt, Homo Sapiens
ggguugguuauauugcaauauguuuauuauuauuaaaauaaacagguuuuuaaaagacugacag

SEQ ID NO: 62378 - RNA, 64 nt, Homo Sapiens
cuuuauaaacaccaucugcuuuuuaagaaaauggaaaauaaaaauaaaggaaaucaaauguuau

SEQ ID NO: 62379 - RNA, 64 nt, Homo Sapiens
ugccuugagagaccacucagagguugcagcagagaaaauaaaugagguggaugucagaucuggu

SEQ ID NO: 62380 - RNA, 64 nt, Homo Sapiens
uguugaucaagacauggaguucaccuaaaaaaauaaaauaaaaaccauucuauuguguucuacu

SEQ ID NO: 62381 - RNA, 64 nt, Homo Sapiens
aaaaauguugaucaagacaucuacuucaccuaaaaaaauaaaauuugagccauucuauuguguu

SEQ ID NO: 62382 - RNA, 64 nt, Homo Sapiens
acaucauauauauguguaaauguacccauucuuaaaaauaaaucugugcuuuaugugguagugu

SEQ ID NO: 62383 - RNA, 64 nt, Homo Sapiens
uugugcuuuaugugguaguguuacccugaaacagaaaauaaauaaaacacauuugccuaucuuc

SEQ ID NO: 62384 - RNA, 64 nt, Homo Sapiens
caauaaagacaauucugacuuauguacaaaaacuaaaauaaaguauaugaacaugauuuuucuu

SEQ ID NO: 62385 - RNA, 64 nt, Homo Sapiens
auauagcuacuuucaguugaguaaaaugaacaauaaaauaaagcauaaaagcuuuggaaacucu

SEQ ID NO: 62386 - RNA, 64 nt, Homo Sapiens
uuugccaaauccuucagauuuggaaauggaaaaaaaaauaaauccugugucuacuuuaaaaaac

SEQ ID NO: 62387 - RNA, 64 nt, Homo Sapiens
uuguggccuuauauaucacauaagggguuuguccaaaauaaauaugauaauaaaaucgcuacuu

SEQ ID NO: 62388 - RNA, 64 nt, Homo Sapiens
aauagacacuaaaaucauguguuccuaauuuaguaaaauaaaagauuuguucuguaaaugcugc

SEQ ID NO: 62389 - RNA, 64 nt, Homo Sapiens
gccuggccaacauggcgaaaacccaucucuacuaaaaauaaaauuagccaugcguggugcuugu

SEQ ID NO: 62390 - RNA, 64 nt, Homo Sapiens
aaacacaaaauugguuucaaaauguuuucauguaaaaauaaauuaacuuuucuguaauuagauu

SEQ ID NO: 62391 - RNA, 64 nt, Homo Sapiens
ccugggcuacagagagcaagacucugucucaaaaaaaauaaaauaaaauaaauaaaaaaagaua

SEQ ID NO: 62392 - RNA, 64 nt, Homo Sapiens
gcuacagagagcaagacucugucucaaaaaaaauaaaauaaaauaaauaaaaaaagauauagua

SEQ ID NO: 62393 - RNA, 64 nt, Homo Sapiens
agagagcaagacucugucucaaaaaaaauaaaauaaaauaaauaaaaaaagauauaguauuaau

SEQ ID NO: 62394 - RNA, 64 nt, Homo Sapiens
gaauaaaauuuucuacaucaaaguaagacuugagaaaauaaacuuauguguauauauguuuaaa

SEQ ID NO: 62395 - RNA, 64 nt, Homo Sapiens
uccagccugggcgacagagcaagacuccaucucaaaaauaaaauaaaaaaagaaagaaagaaaa

SEQ ID NO: 62396 - RNA, 64 nt, Homo Sapiens
ccugggcgacagagcaagacuccaucucaaaaauaaaauaaaaaaagaaagaaagaaaagaaga

SEQ ID NO: 62397 - RNA, 64 nt, Homo Sapiens
uggugggaaaugggggaucuucaauguuuauuuuaaaauaaaauaaaauaaguucuugacuuuu

SEQ ID NO: 62398 - RNA, 64 nt, Homo Sapiens
ggaaaugggggaucuucaauguuuauuuuaaaauaaaauaaaauaaguucuugacuuuucucau

SEQ ID NO: 62399 - RNA, 64 nt, Homo Sapiens
aaacacuggccauggccgugggaguacugggaguaaaauaaaaauaucgagguauagacuagca

SEQ ID NO: 62400 - RNA, 64 nt, Homo Sapiens
cuuuguuuucucuuauucuagguaaggcauauuaaaaauaaauauguaaagaagaaaaauaaaa

SEQ ID NO: 62401 - RNA, 64 nt, Homo Sapiens
guaaggcauauuaaaaauaaauauguaaagaagaaaaauaaaaguugucuucauggaagcaacu

SEQ ID NO: 62402 - RNA, 64 nt, Homo Sapiens
aagugucaaauaaaaaauuaccaucauuaucauuaaaauaaauuuucacuguauuugagauggg

SEQ ID NO: 62403 - RNA, 64 nt, Homo Sapiens
caacuacuuugucgguugcucugaggguuaaaugaaaauaaaaagaaaaugugaaacagcacca

SEQ ID NO: 62404 - RNA, 64 nt, Homo Sapiens
uccagcccggccuacaagaacaaaacuccaucucaaaauaaauaaaaaaauaaauaaaaauaaa

SEQ ID NO: 62405 - RNA, 64 nt, Homo Sapiens
uacaagaacaaaacuccaucucaaaauaaauaaaaaaauaaauaaaaauaaaaauagacuauau

SEQ ID NO: 62406 - RNA, 64 nt, Homo Sapiens
aaacuccaucucaaaauaaauaaaaaaauaaauaaaaauaaaaauagacuauauauagucuuug

SEQ ID NO: 62407 - RNA, 64 nt, Homo Sapiens
agucuuugaauucauuuauuuuaaauaaaugaauaaaauaaaauaaaaaagaauauucagucgu

SEQ ID NO: 62408 - RNA, 64 nt, Homo Sapiens
uugaauucauuuauuuuaaauaaaugaauaaaauaaaauaaaaaagaauauucagucguuggca

SEQ ID NO: 62409 - RNA, 64 nt, Homo Sapiens
aaaauuuccuuaggagugcagagggcucauugggaaaauaaaaauaauaaaaauaaauaaaacu

SEQ ID NO: 62410 - RNA, 64 nt, Homo Sapiens
gugcagagggcucauugggaaaauaaaaauaauaaaaauaaauaaaacuuccuaaaagaaaaga

SEQ ID NO: 62411 - RNA, 64 nt, Homo Sapiens
cucccacauuuuaagauuuuaaaaaugaaaccaaaaaauaaauugaagaaaacuguaaacuuua

SEQ ID NO: 62412 - RNA, 64 nt, Homo Sapiens
gcagccuaggugacagucagacccugucucaaaaaaaauaaaaaaaauuuaaaauaaucuuggg

SEQ ID NO: 62413 - RNA, 64 nt, Homo Sapiens
acauuucagagcaaucugcauauuuaacagaccuaaaauaaauccuauuaggcaagucaguuga

SEQ ID NO: 62414 - RNA, 64 nt, Homo Sapiens
ugucuacaauacaauaccuguauucaaaauaacaaaaauaaagccugauucuuuguuucuagaa

SEQ ID NO: 62415 - RNA, 64 nt, Homo Sapiens
agagcaagacuccgucucacaaaaaugaauaaauaaaauaaaaauaaaaauguuacuuuuuaaa

SEQ ID NO: 62416 - RNA, 64 nt, Homo Sapiens
agacuccgucucacaaaaaugaauaaauaaaauaaaaauaaaaauguuacuuuuuaaaaaguaa

SEQ ID NO: 62417 - RNA, 64 nt, Homo Sapiens
cauguaacaagccugcacauguaccccagaaucuaaaauaaaaauaaaaagaaaaacaaagaau

SEQ ID NO: 62418 - RNA, 64 nt, Homo Sapiens
acaagccugcacauguaccccagaaucuaaaauaaaaauaaaaagaaaaacaaagaauguacuc

SEQ ID NO: 62419 - RNA, 64 nt, Homo Sapiens
agccugggugacagagcaagacccugucucaaaaaaaauaaaauaaaaggcuuucugccuucau

SEQ ID NO: 62420 - RNA, 64 nt, Homo Sapiens
gggugacagagcaagacccugucucaaaaaaaauaaaauaaaaggcuuucugccuucauugccu

SEQ ID NO: 62421 - RNA, 64 nt, Homo Sapiens
aggccaucagagcaaauuuggggguuucucaaauaaaauaaaaauaaaaacaaauacuguguuu

SEQ ID NO: 62422 - RNA, 64 nt, Homo Sapiens
ucagagcaaauuuggggguuucucaaauaaaauaaaaauaaaaacaaauacuguguuucagaag

SEQ ID NO: 62423 - RNA, 64 nt, Homo Sapiens
cagaacugagaugucuguaugacagccacuccuaaaaauaaacaacaacaaaaacaaaaaaaga

SEQ ID NO: 62424 - RNA, 64 nt, Homo Sapiens
aacaacaaaaacaaaaaaagaagaaaacuaaauaaaaauaaaaauaaaaauaagauccacuucu

SEQ ID NO: 62425 - RNA, 64 nt, Homo Sapiens
aaaaacaaaaaaagaagaaaacuaaauaaaaauaaaaauaaaaauaagauccacuucucucugc

SEQ ID NO: 62426 - RNA, 64 nt, Homo Sapiens
aaaguaaccuuauauuuaaaagaugauuuugcaaaaaauaaaaaauaaaaaauaugccuucugg

SEQ ID NO: 62427 - RNA, 64 nt, Homo Sapiens
ccuuauauuuaaaagaugauuuugcaaaaaauaaaaaauaaaaaauaugccuucuggagugaug

SEQ ID NO: 62428 - RNA, 64 nt, Homo Sapiens
uuaaaaaacugugccuccgucuuccuaaaaauaaaaaauaaaauuuguaugguuugcaaaaggg

SEQ ID NO: 62429 - RNA, 64 nt, Homo Sapiens
auaaaauuuaaaaaacugugaaaagggcuuccuaaaaauaaaaauuauaucuuguaugguuugc

SEQ ID NO: 62430 - RNA, 64 nt, Homo Sapiens
ccugaaguauaaagcaucuauggaucauugugaaaaaauaaauuaaaaccuucaucuaauacuu

SEQ ID NO: 62431 - RNA, 64 nt, Homo Sapiens
aaaaaaccuucaucuaauacugucaauuaaaagcaaaauaaaacaaauauguauauuuauuauu

SEQ ID NO: 62432 - RNA, 64 nt, Homo Sapiens
agaauuucaaauuuaaaauuuacuuuguagauuaaaaauaaaucucccuuuuaaaaaauaaaaa

SEQ ID NO: 62433 - RNA, 64 nt, Homo Sapiens
uacuuuguagauuaaaaauaugguucccuuuuaaaaaauaaaaaauaagauuucaauaaugaaa

SEQ ID NO: 62434 - RNA, 64 nt, Homo Sapiens
ucgaauauuaaaaaguuguauuuuacuuagauauaaaauaaaccgcaggaguauucuggaaucu

SEQ ID NO: 62435 - RNA, 64 nt, Homo Sapiens
ucccaugucuuccauuuguguugucccccuuuuaaaaauaaacuauuuuugcuauucugaucau

SEQ ID NO: 62436 - RNA, 64 nt, Homo Sapiens
cucuuauaaauuucuauuuuuuuuacaaguaacaaaaauaaaaaauuuucucuaggaaauauac

SEQ ID NO: 62437 - RNA, 64 nt, Homo Sapiens
aauagaacaaggcugaggauaucucuguaaagcuaaaauaaagauucucauaacuugagaccua

SEQ ID NO: 62438 - RNA, 64 nt, Homo Sapiens
uaaaauagcucugaacauuuagaaaucagcaguuaaaauaaaaugagucgagagaucugaauag

SEQ ID NO: 62439 - RNA, 64 nt, Homo Sapiens
uuccaauugcaaccaaacguaagaaauggaauccaaaauaaauuggcacaccuuucugaaaucc

SEQ ID NO: 62440 - RNA, 64 nt, Homo Sapiens
ucaacucaagcauaaagcuuaaucacuuugggagaaaauaaaauaacauuuauaggaggaaaaa

SEQ ID NO: 62441 - RNA, 64 nt, Homo Sapiens
agauaaagggucagcaacaaaggcuaccugaaaaaaaauaaauaugagccuacucuaguucaag

SEQ ID NO: 62442 - RNA, 64 nt, Homo Sapiens
uucugugucuaaggcaacuaaauaauuuuauagaaaaauaaagcaaaagaaaauuucucucggg

SEQ ID NO: 62443 - RNA, 64 nt, Homo Sapiens
cacacaaggacgucugcgcaacacacacacacacaaaauaaagaccagcaaaacacacacacac

SEQ ID NO: 62444 - RNA, 64 nt, Homo Sapiens
aagauagauccauuuggacauauuuaggcaagagaaaauaaaccaacccauuaggcaugccuaa

SEQ ID NO: 62445 - RNA, 64 nt, Homo Sapiens
auauuaauuuuugaaacccacacugacaagauggaaaauaaauuucaagaacaccuuuguuuug

SEQ ID NO: 62446 - RNA, 64 nt, Homo Sapiens
ccuuuggguucuugaauggaauuuugaaaaaauaaaaauaaaagaaaggaaaaaagguacuucu

SEQ ID NO: 62447 - RNA, 64 nt, Homo Sapiens
uaaaagccuuuggguucuugacuucuauuuugaaaaaauaaaaaauaauaaaaggaaaaaaggu

SEQ ID NO: 62448 - RNA, 64 nt, Homo Sapiens
uuguuuucaucacugacuuuaauagaguauguuuaaaauaaauauuaauuuaaggauauauauu

SEQ ID NO: 62449 - RNA, 64 nt, Homo Sapiens
agaggugagaauauuguuaccuuauaugaaguaaaaaauaaaucaaaaaugaauuacacuguau

SEQ ID NO: 62450 - RNA, 64 nt, Homo Sapiens
uucuaaauaaaaaguugaaauauaccuuuuaaauaaaauaaauuucuugggacuuauguauaua

SEQ ID NO: 62451 - RNA, 64 nt, Homo Sapiens
aaaaugccaaccuuagaaaaauggaucaaauugcaaaauaaagagauuuuuuuuuacuguaagu

SEQ ID NO: 62452 - RNA, 64 nt, Homo Sapiens
uauguauucuccuaacugaaaaaaacugaaaauaaaaauaaaaaacagagugagacuccaucuc

SEQ ID NO: 62453 - RNA, 64 nt, Homo Sapiens
uaaaaauauguauucuccuacaucucaaaaacugaaaauaaaaaugggugacagagugagacuc

SEQ ID NO: 62454 - RNA, 64 nt, Homo Sapiens
aauaaacaaauaaaaaauucccaucucaaaaaauaaaauaaauaugggcaacaacagcaaaacu

SEQ ID NO: 62455 - RNA, 64 nt, Homo Sapiens
aaauaaauaaacaaauaaaaaaacuccaucucaaaaaauaaaauuagccugggcaacaacagca

SEQ ID NO: 62456 - RNA, 64 nt, Homo Sapiens
auaugagcaccauugaauucggcccucagucuaaaaaauaaaaaucaguuggaaaaccuuuuca

SEQ ID NO: 62457 - RNA, 64 nt, Homo Sapiens
cauugcagaccgcacaggugguugccugggauucaaaauaaaggagaaggacucauccagcaaa

SEQ ID NO: 62458 - RNA, 64 nt, Homo Sapiens
uguguauacacuacauuuguuuauaaccagaagcaaaauaaacucagcccacaaagcuagaauc

SEQ ID NO: 62459 - RNA, 64 nt, Homo Sapiens
ccuuaaagauuaacuacaaagauaaacauggccaaaaauaaauaaauaaauauggccauauguc

SEQ ID NO: 62460 - RNA, 50 nt, Homo Sapiens
agaagagguugaagagguaaaaaauaaauaaauacauaaaaagcaaacaa

SEQ ID NO: 62461 - RNA, 64 nt, Homo Sapiens
aaucuuuuaugcaccaaaguuggucuugaaaaggaaaauaaaaucacuuucuugcuugguaagc

SEQ ID NO: 62462 - RNA, 64 nt, Homo Sapiens
cgagagcaaaucaaaaccucuauccagacaagacaaaauaaaacucaccaucuccugaagaccu

SEQ ID NO: 62463 - RNA, 64 nt, Homo Sapiens
cuauaggccauaaagaaugggacugcauuggaccaaaauaaaugggaaaaucgugguuugaaaa

SEQ ID NO: 62464 - RNA, 64 nt, Homo Sapiens
uuacauacuuuugcaaaauaaguaaauaauaaauaaaauaaaagccaaccuucaaagaaacuug

SEQ ID NO: 62465 - RNA, 64 nt, Homo Sapiens
gugcguuaaauaagcaaauaaacaguggcucauaaaaauaaaagucgcauuccauaucuuugga

SEQ ID NO: 62466 - RNA, 64 nt, Homo Sapiens
cugagaaguagauuguuacccaguaaugaaauaaaaaauaaaaauaaaaggauuuuuuucucua

SEQ ID NO: 62467 - RNA, 64 nt, Homo Sapiens
aguagauuguuacccaguaaugaaauaaaaaauaaaaauaaaaggauuuuuuucucuauuguuu

SEQ ID NO: 62468 - RNA, 64 nt, Homo Sapiens
uaauuguaaguuguuaacuccuguauauaucauuaaaauaaaucugaaguugaaguaguguuuu

SEQ ID NO: 62469 - RNA, 64 nt, Homo Sapiens
uaaccuuaggauuccugaaaagaauuucaaaaaaaaaauaaagacacuguugccaaugugaccc

SEQ ID NO: 62470 - RNA, 64 nt, Homo Sapiens
gaacauacuaauggcauauauuuguuacaauuaaaaaauaaauuuacuacuuaauccuauguug

SEQ ID NO: 62471 - RNA, 64 nt, Homo Sapiens
acugaguauuuaugugaaaacucucuagaagguaaaaauaaagauaauucuucaaaugaagucu

SEQ ID NO: 62472 - RNA, 64 nt, Homo Sapiens
uuugguggugaggaggaagaacaaauaauagaagaaaauaaaaaugagauagaagaaaaguaag

SEQ ID NO: 62473 - RNA, 64 nt, Homo Sapiens
aaaauuuuaacauuggcaucuaaaguguuauuugaaaauaaaauuauuuuccuguucauugauu

SEQ ID NO: 62474 - RNA, 64 nt, Homo Sapiens
gaacuuauugugaaaguugugcuguuuucuaaguaaaauaaaaaauaaaaaauuagcaauuuau

SEQ ID NO: 62475 - RNA, 64 nt, Homo Sapiens
uugugaaaguugugcuguuuucuaaguaaaauaaaaaauaaaaaauuagcaauuuaugauagcc

SEQ ID NO: 62476 - RNA, 64 nt, Homo Sapiens
uguaaguuauuaaaugguuaaucauggccuuuuaaaaauaaaauaaagugauaccuuuacaaug

SEQ ID NO: 62477 - RNA, 64 nt, Homo Sapiens
guuauuaaaugguuaaucauggccuuuuaaaaauaaaauaaagugauaccuuuacaaugaagac

SEQ ID NO: 62478 - RNA, 64 nt, Homo Sapiens
guuuucgacacuggacuggaagaacaagucuauaaaaauaaaaauggacaauuaacagugguga

SEQ ID NO: 62479 - RNA, 64 nt, Homo Sapiens
agguuggagaacgaaugaauacaaauuuuauuguaaaauaaaaauguauauaaagcauaugagc

SEQ ID NO: 62480 - RNA, 64 nt, Homo Sapiens
uuuaaaaaauaauaauaaaaauuuaaaaaaauuaaaaauaaaaaaaaccacagaaaacaacuuu

SEQ ID NO: 62481 - RNA, 64 nt, Homo Sapiens
uuuguagaagagauugagaaugguacucuaaucaaaaauaaaguuuuguagugggaccagaaau

SEQ ID NO: 62482 - RNA, 64 nt, Homo Sapiens
aacgaugugcaauacauuuuuuucucuuuccuugaaaauaaaaagagaaacaaguauuuugcua

SEQ ID NO: 62483 - RNA, 64 nt, Homo Sapiens
uauaugauauuuuucaugcuccacuauuuuauuaaaaauaaaauauguucuuuaguuugcugcu

SEQ ID NO: 62484 - RNA, 64 nt, Homo Sapiens
uugcuacuguuuuuccuuuuuuuacuaugacaggaaaauaaaugcaauuuuaguggaauugauu

SEQ ID NO: 62485 - RNA, 64 nt, Homo Sapiens
uuaaagggcauugauagcauaccaaacaaaaggcaaaauaaagugaccuuuuuauauauuuuuu

SEQ ID NO: 62486 - RNA, 64 nt, Homo Sapiens
aucacugaaauauuuaugacagugcauaauuugcaaaauaaaaaauguacacuagcauaauauu

SEQ ID NO: 62487 - RNA, 64 nt, Homo Sapiens
auaauuguuaauauggaauaagcucaaauaugucaaaauaaauguaaaaaaugaguguugccca

SEQ ID NO: 62488 - RNA, 64 nt, Homo Sapiens
uuaucucagcuucuguuagcuucuguuuaaaauaaaaauaaaauuguaaccccuuuuuccuuuc

SEQ ID NO: 62489 - RNA, 64 nt, Homo Sapiens
uaaaauuuaucucagcuucuccuuucuucuguuuaaaauaaaaauaaaaauguaaccccuuuuu

SEQ ID NO: 62490 - RNA, 64 nt, Homo Sapiens
aagcaagacaaauuaaaaauggacuugcauaaccaaaauaaacaacuuguuucaugaagagaaa

SEQ ID NO: 62491 - RNA, 64 nt, Homo Sapiens
cacacacagagcauuuuaguauuaaaaauacuaaaaaauaaagagauaaagcaagucuaucaac

SEQ ID NO: 62492 - RNA, 64 nt, Homo Sapiens
aagugagauggcauggugagauguuacuuauuuuaaaauaaaugauccuuuugauaaauuuaaa

SEQ ID NO: 62493 - RNA, 64 nt, Homo Sapiens
caauccuuuugauaaauuuaaaugcuuuaaaauaaaaauaaaaaaagucugauccauauuuaau

SEQ ID NO: 62494 - RNA, 64 nt, Homo Sapiens
uaaaaacaauccuuuugauauuuaauaaugcuuuaaaauaaaaacuuuucaagucugauccaua

SEQ ID NO: 62495 - RNA, 64 nt, Homo Sapiens
uucacauuuauguggcuuguguaaugccguaggaaaaauaaaacgaugaaauaauuuuucuagg

SEQ ID NO: 62496 - RNA, 64 nt, Homo Sapiens
guuucugaaaauguuuaagucuaccagcucauacaaaauaaaugauuaaauuuaacucugguuu

SEQ ID NO: 62497 - RNA, 63 nt, Homo Sapiens
ggagcuguuuuguggcuuugucuagucuuacuagaaaauaaaauuacuaggguauugaauaaa

SEQ ID NO: 62498 - RNA, 64 nt, Homo Sapiens
gugcaagucuucaggauggcguuaagcuaucugaaaaauaaaaugaacacacucgauuaaaaau

SEQ ID NO: 62499 - RNA, 64 nt, Homo Sapiens
cccauggaaaugguuuaagaaaaauaaauagauaaaaauaaaaaagagcaagacuccaucucaa

SEQ ID NO: 62500 - RNA, 64 nt, Homo Sapiens
gauaaaaauaaaaacccaugagacuccaucucaaaaaauaaauaccagccugggcaacagagca

SEQ ID NO: 62501 - RNA, 64 nt, Homo Sapiens
uugaauguguacuuaagucugaaaacuguaacagaaaauaaauuucuucaacuccuuuuggcaa

SEQ ID NO: 62502 - RNA, 64 nt, Homo Sapiens
aauaaauaaaaucuuuuccauuaaaguaaaauaaaaaauaaauaaagucuuuuccucccagaac

SEQ ID NO: 62503 - RNA, 64 nt, Homo Sapiens
auaaauaaauaaauaaaaucccagaacuuaaaguaaaauaaaaaauuaaagaagucuuuuccuc

SEQ ID NO: 62504 - RNA, 64 nt, Homo Sapiens
ucauaauguuagucuuauuggaaguguagaaaauaaaauaaauuaauagcaauaaaaguuagac

SEQ ID NO: 62505 - RNA, 64 nt, Homo Sapiens
aaauuucauaauguuagucuuagacgaaguguagaaaauaaaaugcuauaauagcaauaaaagu

SEQ ID NO: 62506 - RNA, 64 nt, Homo Sapiens
aaugcauuauguaaggucagugacuuuucagaagaaaauaaacacauuaaggaaguauaugauc

SEQ ID NO: 62507 - RNA, 64 nt, Homo Sapiens
uguuuucuuuauaaauugccuggacucauaagccaaaauaaaucaucuuggacuccucagccuu

SEQ ID NO: 62508 - RNA, 64 nt, Homo Sapiens
uguagacccuaacaguuguguaacauuugaagaaaaaauaaaacuaucacauaagacaucauga

SEQ ID NO: 62509 - RNA, 64 nt, Homo Sapiens
aauaaauaaaauuaaaaaaaaaaaaauaaaaauaaaaauaaauaauaaagugcuaaaguguaaa

SEQ ID NO: 62510 - RNA, 64 nt, Homo Sapiens
uaaauaaauaaauaaaauuauguaaaaaaaaauaaaaauaaaaacagggaauaaagugcuaaag

SEQ ID NO: 62511 - RNA, 64 nt, Homo Sapiens
uaaaaauaaauaaauaaauacuaaaguguaaaaaaaaauaaaaauaacuucagggaauaaagug

SEQ ID NO: 62512 - RNA, 64 nt, Homo Sapiens
guggaaaaagguaucuucugcuaaaaaguauacaaaaauaaaaaauauuuacauuuucacucau

SEQ ID NO: 62513 - RNA, 64 nt, Homo Sapiens
cuguggugcacauuucuaccuuguguauguguuuaaaauaaaacacuguuuuugucaaggaugg

SEQ ID NO: 62514 - RNA, 64 nt, Homo Sapiens
uuauguauuaguguccuuuaggauauugaaagaaaaaauaaacuucccauugucccuuuauuua

SEQ ID NO: 62515 - RNA, 64 nt, Homo Sapiens
gcaggacagaaauuguguuguguguguggucugcaaaauaaacaaaucuguucauauuuaacuu

SEQ ID NO: 62516 - RNA, 64 nt, Homo Sapiens
aucguuuguuauuuaucucauguuuuauaaaauaaaaauaaaauaaaauuuguuguaaacugca

SEQ ID NO: 62517 - RNA, 64 nt, Homo Sapiens
uaaaauaucguuuguuauuuacugcauguuuuauaaaauaaaaauuuuuaaaaauuuguuguaa

SEQ ID NO: 62518 - RNA, 64 nt, Homo Sapiens
aaaauuguuuucauuaccucugucucaaaaaauaaaaauaaaaaugggugacagagcgagacca

SEQ ID NO: 62519 - RNA, 64 nt, Homo Sapiens
uaaaaaaaaauuguuuucauagaccaugucucaaaaaauaaaaaccagccugggugacagagcg

SEQ ID NO: 62520 - RNA, 64 nt, Homo Sapiens
aucuacuguacacaaucugauauuccaaaauaacaaaauaaauacuaagccauaaaauaaauuu

SEQ ID NO: 62521 - RNA, 64 nt, Homo Sapiens
uuauuccaaaauaacaaaauagauccuaagccauaaaauaaauuccucucaaggcaggggucau

SEQ ID NO: 62522 - RNA, 64 nt, Homo Sapiens
uuacagaacaacugguggaauuguuucugucaggaaaauaaaucuaaaaauaauaaugcagugg

SEQ ID NO: 62523 - RNA, 64 nt, Homo Sapiens
aggaugguagaaagugauuacaauugcuguuuguaaaauaaauccagauauggaugccuucuaa

SEQ ID NO: 62524 - RNA, 64 nt, Homo Sapiens
guuggccagaauuaagcaacugacaagcucagggaaaauaaauauccccauuuuacugcaaagu

SEQ ID NO: 62525 - RNA, 64 nt, Homo Sapiens
gguuugaggaauuaguuuaacauuuuacagauuuaaaauaaacaguaauuuuuauuuucagaac

SEQ ID NO: 62526 - RNA, 64 nt, Homo Sapiens
aaugguacuuucauuuuauaugccuuuguuuguaaaaauaaaauuccauuaacuagucuugaaa

SEQ ID NO: 62527 - RNA, 64 nt, Homo Sapiens
cauucagauugaaauucuaauugaaauuggcuuuaaaauaaaacaucuuugaaacaauauuauu

SEQ ID NO: 62528 - RNA, 64 nt, Homo Sapiens
augacauuuaguaucuaaggcaugggagagccuaaaaauaaauuggucccauuucaauuuccac

SEQ ID NO: 62529 - RNA, 64 nt, Homo Sapiens
gugugccugauuauuuuugcguugauuaagauguaaaauaaaaauuuccuuuuguauuuguaau

SEQ ID NO: 62530 - RNA, 64 nt, Homo Sapiens
accuuaauucuuuauugacuaaaugaggcuuuuaaaaauaaaguugaugcuccugucaaaaggg

SEQ ID NO: 62531 - RNA, 64 nt, Homo Sapiens
ugcuaugcaaucuugaauaugauaaccauuucaaaaaauaaaauaauuuaaggaaauucuuuag

SEQ ID NO: 62532 - RNA, 64 nt, Homo Sapiens
uaaaaauacauucaaaauuagucauuauuuugaaaaaauaaauuuauguaaaauuuuuacuaau

SEQ ID NO: 62533 - RNA, 64 nt, Homo Sapiens
gaguaugagucuucuguaauuuaauuuccaggaaaaaauaaaaauuuaguaaagcuuuucuuuu

SEQ ID NO: 62534 - RNA, 64 nt, Homo Sapiens
aaagcuagauacuggaaaccaaugucauugcuaaaaaauaaauauaaccuggcaaaaucuuguu

SEQ ID NO: 62535 - RNA, 64 nt, Homo Sapiens
auaacaugccugagggagagugggaauuuuguguaaaauaaaagaauccacacaaccaaguuca

SEQ ID NO: 62536 - RNA, 64 nt, Homo Sapiens
agauguccacacaaauggauuccuacauuauuggaaaauaaaugcuuugauacgccucaucuua

SEQ ID NO: 62537 - RNA, 64 nt, Homo Sapiens
aaacuuagcuaggcauguugaaaaauaaaaaauaaaaauaaaaauaguuagaccucaucucuac

SEQ ID NO: 62538 - RNA, 64 nt, Homo Sapiens
uaaaaaaaacuuagcuaggccucuacaaaaauaaaaaauaaaaagaaacauaguuagaccucau

SEQ ID NO: 62539 - RNA, 64 nt, Homo Sapiens
auaaaaauaaaaaaaacuuaaccucaucucuacaaaaauaaaaacagccuggaaacauaguuag

SEQ ID NO: 62540 - RNA, 64 nt, Homo Sapiens
aaguuuuaaaaacugaucaauaaaaaaaauuuaaaaaauaaaaagauaauauaaaauaaaaacu

SEQ ID NO: 62541 - RNA, 64 nt, Homo Sapiens
cuuaaaaaaaauuuaaaaaauuuguagauaauauaaaauaaaaaguuaagggaaaaacuuuuac

SEQ ID NO: 62542 - RNA, 64 nt, Homo Sapiens
aauggcaauagauuuuaaaauacguuuuugugcaaaaauaaaugaaaagcuggugacauauuua

SEQ ID NO: 62543 - RNA, 64 nt, Homo Sapiens
accccuacaaaaaaacuuuagaaaaaaaacacaaaaaauaaaaacccaauucuaagcagaaaaa

SEQ ID NO: 62544 - RNA, 64 nt, Homo Sapiens
ucgcagugaacuuaaagcaaagaccucuuaguaaaaaauaaaaaaaaauaaaaaauaaaaauaa

SEQ ID NO: 62545 - RNA, 64 nt, Homo Sapiens
cuuaaagcaaagaccucuuaguaaaaaauaaaaaaaaauaaaaaauaaaaauaaaaaaaguuaa

SEQ ID NO: 62546 - RNA, 64 nt, Homo Sapiens
caaagaccucuuaguaaaaaauaaaaaaaaauaaaaaauaaaaauaaaaaaaguuaaauuuauu

SEQ ID NO: 62547 - RNA, 64 nt, Homo Sapiens
ccucuuaguaaaaaauaaaaaaaaauaaaaaauaaaaauaaaaaaaguuaaauuuauuuauaga

SEQ ID NO: 62548 - RNA, 64 nt, Homo Sapiens
ucgagaaacuaugggaaaaaaaauugcaaaaucuaaaauaaaaaaugcaaaaucuaaaauaaaa

SEQ ID NO: 62549 - RNA, 64 nt, Homo Sapiens
aauugcaaaaucuaaaauaaaaaaugcaaaaucuaaaauaaaaaauggaaaggaaacuuugaac

SEQ ID NO: 62550 - RNA, 64 nt, Homo Sapiens
gcaacaagagcaaaacuccgucucaaaaaagaugaaaauaaaauaaaauauauauuuacaggcc

SEQ ID NO: 62551 - RNA, 64 nt, Homo Sapiens
aagagcaaaacuccgucucaaaaaagaugaaaauaaaauaaaauauauauuuacaggccuacaa

SEQ ID NO: 62552 - RNA, 64 nt, Homo Sapiens
auauuguuguuuaucuuguuuggaaguguguuucaaaauaaacaugucuagaauuuaaaguuuu

SEQ ID NO: 62553 - RNA, 64 nt, Homo Sapiens
aaaacugguuccaauuuuuuggucauuucucagaaaaauaaaauacuuauaaauccuauauuuu

SEQ ID NO: 62554 - RNA, 64 nt, Homo Sapiens
ucauggaguuuuuaaaaauuguuauaauuaaguaaaaauaaagcugaauugugucauuugugua

SEQ ID NO: 62555 - RNA, 64 nt, Homo Sapiens
acuccaaucaaggucuuguugauauuauauaguaaaaauaaaaccaaaaauaaauauuauucaa

SEQ ID NO: 62556 - RNA, 64 nt, Homo Sapiens
gucuuguugauauuauauaguaaaaauaaaaccaaaaauaaauauuauucaaguggcucuucua

SEQ ID NO: 62557 - RNA, 64 nt, Homo Sapiens
aaugguaucuaauuaauaacuagucugacaucagaaaauaaaauugaggcugauuuuuaaaaau

SEQ ID NO: 62558 - RNA, 64 nt, Homo Sapiens
agaaacccacuguuaaaauuuaaaaaggugcuuuaaaauaaaacgccuauaaagauugugcagu

SEQ ID NO: 62559 - RNA, 64 nt, Homo Sapiens
gaaaaugugggaauaccaaauguccuuuauaagaaaaauaaauuuuauuuuaagggacauacua

SEQ ID NO: 62560 - RNA, 64 nt, Homo Sapiens
aucuaacuauucagggacauuuuuccauuuccaaaaaauaaaauuuauuaugcuuuauaaccuc

SEQ ID NO: 62561 - RNA, 64 nt, Homo Sapiens
aucucacguugugaggguuuuuuuuuucucauuuaaaauaaaaaaggaagaaagaaaauaauuu

SEQ ID NO: 62562 - RNA, 64 nt, Homo Sapiens
acagcuacauuuucaacaaaaaagcaaacagagaaaaauaaaugaacuuuaacacuguaaguuc

SEQ ID NO: 62563 - RNA, 64 nt, Homo Sapiens
ggagucuuugaagcugaaaauauaaaacaaauaaaaaauaaaaaaauaaaaacccacaaaaaug

SEQ ID NO: 62564 - RNA, 64 nt, Homo Sapiens
ugaagcugaaaauauaaaacaaauaaaaaauaaaaaaauaaaaacccacaaaaauguugaacca

SEQ ID NO: 62565 - RNA, 64 nt, Homo Sapiens
auuuguuaguuccuguaugaaagauugugggggaaaaauaaacgucgugccguuagcuuuuucc

SEQ ID NO: 62566 - RNA, 64 nt, Homo Sapiens
aucaaaggcaagauaucauuuauuggacuucuugaaaauaaaaguuacaaaauccaacaacaac

SEQ ID NO: 62567 - RNA, 64 nt, Homo Sapiens
agcauucuuauucacuuuaugccgguauuuagaaaaaauaaauuauagcaaguaugauuucuaa

SEQ ID NO: 62568 - RNA, 64 nt, Homo Sapiens
ccucuuuaauggaagcugcaaaauuaauauuaguaaaauaaacaauaauuucuuuuuuuaaagg

SEQ ID NO: 62569 - RNA, 64 nt, Homo Sapiens
aauaaguaguuucauuacgauuuuauuaacuuuuaaaauaaagacuaaaaauugagagguuucc

SEQ ID NO: 62570 - RNA, 64 nt, Homo Sapiens
gcauauauccaaucacaaguagaaagaagccagaaaaauaaauguucagcaggaauuacacauu

SEQ ID NO: 62571 - RNA, 64 nt, Homo Sapiens
aguguaauugggacguuuguacuuuauacauuuaaaaauaaaagggugacuacagucaacaaua

SEQ ID NO: 62572 - RNA, 64 nt, Homo Sapiens
aaaauagauuauuacgucuuggucucuuugauuuaaaauaaauauguuuguuaggaaauggaau

SEQ ID NO: 62573 - RNA, 64 nt, Homo Sapiens
ugauaguacauguguuguucauauuuuugcagguaaaauaaagcuuuuuccaaguguagcuaaa

SEQ ID NO: 62574 - RNA, 64 nt, Homo Sapiens
aaaauauauaaguguaacauguuuuuuuuucuuaaaaauaaaaagccaaaagcuuucacugaag

SEQ ID NO: 62575 - RNA, 64 nt, Homo Sapiens
ccuuuuaagggaacuuccugggaaaguucagaaaaaaauaaagugcagucagacauucgucaug

SEQ ID NO: 62576 - RNA, 64 nt, Homo Sapiens
uccaaucuggcaacagagcgagaccuugucuuuaaaaauaaaaauaaaaacaucuuuacaacau

SEQ ID NO: 62577 - RNA, 64 nt, Homo Sapiens
cuggcaacagagcgagaccuugucuuuaaaaauaaaaauaaaaacaucuuuacaacauuccugu

SEQ ID NO: 62578 - RNA, 64 nt, Homo Sapiens
augagaauuagaaaauaagggacaacagggguuaaaaauaaacugauuuaauuugcucuauagu

SEQ ID NO: 62579 - RNA, 64 nt, Homo Sapiens
uuugucacaaaguaguccauuccugaucucacuuaaaauaaaucacaaguaaauuugaauuuuc

SEQ ID NO: 62580 - RNA, 64 nt, Homo Sapiens
uucugacgaacugccuggaggaggggaauauauaaaaauaaaauuggugucacuucuuuucugc

SEQ ID NO: 62581 - RNA, 64 nt, Homo Sapiens
uccauacgcucauagucacauauggaauuuugagaaaauaaagcaugcugucuuuaggaauuuu

SEQ ID NO: 62582 - RNA, 64 nt, Homo Sapiens
cacuuuggauuuuucuacaaaggcagugguguccaaaauaaaaucucugcccuaaauuuuacua

SEQ ID NO: 62583 - RNA, 64 nt, Homo Sapiens
uuuuagaaacaucuuuagcccaaaguaacuaguaaaaauaaauggagugguauccuaucuucuu

SEQ ID NO: 62584 - RNA, 64 nt, Homo Sapiens
gagauuuuuuuuuucacaguugaguuaguuugugaaaauaaagaacucuguagcucaccaaggu

SEQ ID NO: 62585 - RNA, 64 nt, Homo Sapiens
uuuccaguuuugcuugacaguuucuaaacaaacaaaaauaaacucaaugaaaggaaagauguuu

SEQ ID NO: 62586 - RNA, 64 nt, Homo Sapiens
aaauucauacaacaucagugguuacagcuauacuaaaauaaaacuuuauaugcuaauuaucuuc

SEQ ID NO: 62587 - RNA, 64 nt, Homo Sapiens
acuuuauaugcuaauuaucuucaagggucuuucuaaaauaaaagggguuguuaggcuacugcaa

SEQ ID NO: 62588 - RNA, 64 nt, Homo Sapiens
aacugcagaccucuaaacauaaguaggaaaaagaaaaauaaaagaauauuaccaauaauuaaag

SEQ ID NO: 62589 - RNA, 64 nt, Homo Sapiens
ugaccucaucauuaauaagugaagaauacaucagaaaauaaaauauucacucuccauuagaaaa

SEQ ID NO: 62590 - RNA, 64 nt, Homo Sapiens
acucaauguuucuggacauucucuuugauaacaaaaaauaaauuuuaaaaaggaauuuuguaaa

SEQ ID NO: 62591 - RNA, 64 nt, Homo Sapiens
gaauuuaaauaucuuuuaaagaaaaaaacaccuaaaaauaaaucuuaacagaaaauucuguucu

SEQ ID NO: 62592 - RNA, 64 nt, Homo Sapiens
uuuaaccaauacauuuaaaauuguacagaacaaaaaaauaaaaucaaagacugaucuuguacag

SEQ ID NO: 62593 - RNA, 64 nt, Homo Sapiens
aauuuagucaucagagauacuuuccuaaaaaggaaaaauaaaaaacaaaauggugccacuuugg

SEQ ID NO: 62594 - RNA, 64 nt, Homo Sapiens
uauuuugagaugucauacuguacacuguauuguaaaaauaaaaaguaaaauuauauuucaaauu

SEQ ID NO: 62595 - RNA, 64 nt, Homo Sapiens
gcucuuuauugaagacaaacacucaccaaaaagaaaaauaaaaguuuucagagaaacuaauuuu

SEQ ID NO: 62596 - RNA, 64 nt, Homo Sapiens
ucuguaccaaacugauuucaaaaguacuacauugaaaauaaaccggugacuguuuuucuucaua

SEQ ID NO: 62597 - RNA, 64 nt, Homo Sapiens
auauauauauaauauauacauauauacauaguguaaaauaaaauguuucuuggacaagaaaucc

SEQ ID NO: 62598 - RNA, 64 nt, Homo Sapiens
augcccuuuuuacccguugacguuuauuuuacguaaaauaaacuguuguuuccaaugcaaucaa

SEQ ID NO: 62599 - RNA, 64 nt, Homo Sapiens
guggacacauuuggaucacauuuauacaguuauaaaaauaaagguuugauuuuggucguucuuc

SEQ ID NO: 62600 - RNA, 64 nt, Homo Sapiens
ccuaaaaccucuuuaaaaacggucaguuaacuaaaaaauaaaaaucaagucuuuaggagaguag

SEQ ID NO: 62601 - RNA, 64 nt, Homo Sapiens
cagaguaccagaaaggguaucuagaaaugccuuuaaaauaaauuuugccuaaaagagaagguau

SEQ ID NO: 62602 - RNA, 64 nt, Homo Sapiens
uguuucucucucaaccacuuuaauaaaaaggccaaaaauaaaaugcccuaaaaugcuagaauaa

SEQ ID NO: 62603 - RNA, 64 nt, Homo Sapiens
aguggaagcccuaaaaugcugaguuaaccaucuaaaaauaaaagggcaaauagguaucaucaau

SEQ ID NO: 62604 - RNA, 64 nt, Homo Sapiens
aaauuauucaaagacuggauugcuuaaacuauugaaaauaaaucuuuccuaagaggucuagaaa

SEQ ID NO: 62605 - RNA, 64 nt, Homo Sapiens
gaaacuuugucuccuguguuuauauuuauuucauaaaauaaauagaaaaauagcauagaaauca

SEQ ID NO: 62606 - RNA, 64 nt, Homo Sapiens
auuaaaggauuguugauaaccagggaaaaaaauaaaaauaaaaaaguauauugguucgaaaucc

SEQ ID NO: 62607 - RNA, 64 nt, Homo Sapiens
uaaaaaauuaaaggauuguuaaaucccagggaaaaaaauaaaaagcuaggaguauauugguucg

SEQ ID NO: 62608 - RNA, 64 nt, Homo Sapiens
aggugugagaauugugugugcaauagagaacuucaaaauaaaacaaguagaucaaaauagaaca

SEQ ID NO: 62609 - RNA, 64 nt, Homo Sapiens
cuauaaaaauguacuuuagguauauuaaaaacacaaaauaaaaaagauugacuauaccaaacau

SEQ ID NO: 62610 - RNA, 64 nt, Homo Sapiens
caaaauaaggaauccuuuuaaaauaaaaaauaaaaaaauaaaaagagccagaccuugucucaaa

SEQ ID NO: 62611 - RNA, 64 nt, Homo Sapiens
aauaaaaacaaaauaaggaagucucaaaaaauaaaaaauaaaaagagagagagagccagaccuu

SEQ ID NO: 62612 - RNA, 64 nt, Homo Sapiens
auaaaaaaauaaaaacaaaaagaccuugucucaaaaaauaaaaaagccugagagagagagagcc

SEQ ID NO: 62613 - RNA, 64 nt, Homo Sapiens
aaguaccuguaguguauuuacuaggcuaaggacaaaaauaaacuacuuaaaacuguggauuggc

SEQ ID NO: 62614 - RNA, 64 nt, Homo Sapiens
cucacauauuucacuacuuacuuaugggaguuugaaaauaaauauuaguuuuucuaaauagacc

SEQ ID NO: 62615 - RNA, 64 nt, Homo Sapiens
gaaauaucacugagcaguuguuauuacucaaaguaaaauaaauguguaugagauagaaaaauuu

SEQ ID NO: 62616 - RNA, 64 nt, Homo Sapiens
auuguuucuucaauugugacgucacuugauuagaaaaauaaaccccuuaugauucagcagcuug

SEQ ID NO: 62617 - RNA, 64 nt, Homo Sapiens
accugguugcagcacauucaaacccuaaagcaguaaaauaaaaaugguguugagauuuacgugg

SEQ ID NO: 62618 - RNA, 64 nt, Homo Sapiens
aaauggauagaaaaaaacuauaauaacugaauaaaaaauaaauaggaucuuuuguccauuccau

SEQ ID NO: 62619 - RNA, 64 nt, Homo Sapiens
aguacgaguuagacauaugagguuacugaguuaaaaaauaaaaagaagcauucugugauccccu

SEQ ID NO: 62620 - RNA, 64 nt, Homo Sapiens
uuagacauaucacaccuaaagcuguugcucuaacaaaauaaacccaaauaauuuugccuucuag

SEQ ID NO: 62621 - RNA, 64 nt, Homo Sapiens
ucucaggaccagccuagagagaucccaucucuaaaaaauaaaauauaagaaaauaaaacuuagg

SEQ ID NO: 62622 - RNA, 64 nt, Homo Sapiens
agagagaucccaucucuaaaaaauaaaauauaagaaaauaaaacuuaggggauauacagauuua

SEQ ID NO: 62623 - RNA, 64 nt, Homo Sapiens
gggauuguaggcaaacccaccuguggcaucacugaaaauaaauuugaucauaccuaagagguua

SEQ ID NO: 62624 - RNA, 64 nt, Homo Sapiens
acugugugacuuggcuagaguugggaguucccccaaaauaaacguguccccauuuuaccagaac

SEQ ID NO: 62625 - RNA, 64 nt, Homo Sapiens
ucuccccuaauuuuuauucccagugccgauguucaaaauaaacuuucuccagucugggaaccuu

SEQ ID NO: 62626 - RNA, 64 nt, Homo Sapiens
uugugcuuaauguaaagccgcuuuauaaaacuguaaaauaaaguuuuuuucuuaaaaagaauau

SEQ ID NO: 62627 - RNA, 64 nt, Homo Sapiens
cuaauaugaaauaacagacuaacauuuuaggggaaaaauaaauacaauuuagacucuaaaaagu

SEQ ID NO: 62628 - RNA, 64 nt, Homo Sapiens
uucccuacaaugggaaaugucacaagaaugugcaaaaauaaaaaucugaggaaaaaacccacau

SEQ ID NO: 62629 - RNA, 64 nt, Homo Sapiens
gauuauguauuuuuaacuaauuuuauugcauuauaaaauaaaaguaugugauguuguuaauuuc

SEQ ID NO: 62630 - RNA, 63 nt, Homo Sapiens
aaaaaaaaggaaggaaaaaaaacaaaacaaaacaaaauaaaacaaggauuuggcaugcuguaa

SEQ ID NO: 62631 - RNA, 64 nt, Homo Sapiens
uuuuuauaaaauuaaaaaaaccaguuuguaaggaaaaauaaaaguaucaggucuccuaacuacc

SEQ ID NO: 62632 - RNA, 64 nt, Homo Sapiens
agcuauuaucaggucuccuagcuuuggugccaagaaaauaaaaaaaggaacacauaaguaaguu

SEQ ID NO: 62633 - RNA, 64 nt, Homo Sapiens
uccaaguuacacaguuuggcuucagaauacuuuaaaaauaaaguguuaaaauucuuggaaaauu

SEQ ID NO: 62634 - RNA, 64 nt, Homo Sapiens
auaaauaucuuuaaagagaauuugguuucaugaaaaaauaaacgaguauuguugaaucaauuac

SEQ ID NO: 62635 - RNA, 64 nt, Homo Sapiens
uaauacaaauaaaaauacagcaaaaauauuagaaaaaauaaaaaggauuaaaccaauugcagau

SEQ ID NO: 62636 - RNA, 64 nt, Homo Sapiens
auuauugcuuugugacaauuguaaacgacuuuaaaaaauaaaugccauuugccuauaaauaccu

SEQ ID NO: 62637 - RNA, 64 nt, Homo Sapiens
ugacauugaauucgaacuguuucacugcaauguuaaaauaaauauuuucuguuuagcagcauuu

SEQ ID NO: 62638 - RNA, 64 nt, Homo Sapiens
cauuuaaaaaguaaugcugacauuauuuguacauaaaauaaaacuuauggguacaacguauguu

SEQ ID NO: 62639 - RNA, 64 nt, Homo Sapiens
auucuuugcaguaaaauauuggcuagugauguauaaaauaaaauaacuaauggcaaaaauucau

SEQ ID NO: 62640 - RNA, 64 nt, Homo Sapiens
auuuauaaauaacuuuuguucaagguagaauuuuaaaauaaaagacuuacugauuaauuuuuaa

SEQ ID NO: 62641 - RNA, 64 nt, Homo Sapiens
guuugacuugaaucauuucuuuauaaaucuauagaaaauaaacuguucuguugagggcaaaaua

SEQ ID NO: 62642 - RNA, 64 nt, Homo Sapiens
caguuccugagucacacaauaaaugaaauaaaauaaaauaaaauucgcuauuuaaguuaaauuu

SEQ ID NO: 62643 - RNA, 64 nt, Homo Sapiens
aaaaucaguuccugagucacaauuuaaaugaaauaaaauaaaauaagugucgcuauuuaaguua

SEQ ID NO: 62644 - RNA, 64 nt, Homo Sapiens
aaauuucucaaacuaauuuaauuguaccuuguacaaaauaaaacuauguucacugugcagaggg

SEQ ID NO: 62645 - RNA, 64 nt, Homo Sapiens
aaugaguacaucuccccuucucagaaaaagcaaaaaaauaaauacacaauacuuugggcaauaa

SEQ ID NO: 62646 - RNA, 64 nt, Homo Sapiens
uuagagcaaaguuuaaaacuucucaaaauaaaauaaaauaaaacugggcaauagcaagacucca

SEQ ID NO: 62647 - RNA, 64 nt, Homo Sapiens
aaaacuuagagcaaaguuuacuccaucucaaaauaaaauaaaaucagcuugggcaauagcaaga

SEQ ID NO: 62648 - RNA, 64 nt, Homo Sapiens
aaaauaaaacuuagagcaaacaagacuccaucucaaaauaaaaucacuccagcuugggcaauag

SEQ ID NO: 62649 - RNA, 64 nt, Homo Sapiens
auaaauuaaaaaaguugccgaccuauuucaauaaaaaauaaaauuguuucacaaguuuugggcc

SEQ ID NO: 62650 - RNA, 64 nt, Homo Sapiens
uauuuucauaaaugguuugccuuuuaugccuuuuaaaauaaauuuuuucuuuuuacacuaauaa

SEQ ID NO: 62651 - RNA, 64 nt, Homo Sapiens
auauuuuguucuauugguaggugcugguauaauuaaaauaaaauuggucuuucugggccuuacu

SEQ ID NO: 62652 - RNA, 64 nt, Homo Sapiens
auuaauaggaguugugagccgcuuuaaggaaaauaaaauaaaauccaaauguaauuuuaugucu

SEQ ID NO: 62653 - RNA, 64 nt, Homo Sapiens
aaaauauuaauaggaguuguugucugcuuuaaggaaaauaaaauuucuuccaaauguaauuuua

SEQ ID NO: 62654 - RNA, 64 nt, Homo Sapiens
ucaauuuuacaccucauaugcauugagaauaacaaaaauaaauaauacuauaacucugaucuuc

SEQ ID NO: 62655 - RNA, 64 nt, Homo Sapiens
uacuacauuucuaacguauucauuaacaucaugaaaaauaaaagugauuaauuuagauuagaau

SEQ ID NO: 62656 - RNA, 64 nt, Homo Sapiens
auugauaaaagguguuuggauucaccuguuuuuaaaaauaaaacaugauguauaaaaaagugga

SEQ ID NO: 62657 - RNA, 64 nt, Homo Sapiens
aaaugcuuguuucauuuuuaggugggagaaauccaaaauaaaguuauauauuuauauuuuuggg

SEQ ID NO: 62658 - RNA, 64 nt, Homo Sapiens
guuuucuuuuggaacuacaaaaauguagacuuuuaaaauaaacucagacaaagcauugacuuuu

SEQ ID NO: 62659 - RNA, 64 nt, Homo Sapiens
caaugauuuauuuuuuucccuuuuguguuacuccaaaauaaagguaugugaaguuagugagucu

SEQ ID NO: 62660 - RNA, 64 nt, Homo Sapiens
ucagccuggaccacagagcaagacccuguguaaaaaaauaaaauaaaaaacagauuggaugucu

SEQ ID NO: 62661 - RNA, 64 nt, Homo Sapiens
cuggaccacagagcaagacccuguguaaaaaaauaaaauaaaaaacagauuggaugucuuucuu

SEQ ID NO: 62662 - RNA, 64 nt, Homo Sapiens
cgugagccacugugcccagccuaagccauuucuuaaaauaaaaaugcuaaaggacuaguaagua

SEQ ID NO: 62663 - RNA, 64 nt, Homo Sapiens
ucuuaaaauaaaaaugcuaaaggacuaguaaguaaaaauaaaacuuccuaugggauuucccagu

SEQ ID NO: 62664 - RNA, 64 nt, Homo Sapiens
aggacuuuuacuuuuuauuacauaaaaauauuaaaaaauaaauaaaaaaaauaaaauuuuaaac

SEQ ID NO: 62665 - RNA, 64 nt, Homo Sapiens
uuuauuacauaaaaauauuaaaaaauaaauaaaaaaaauaaaauuuuaaacuaacuuaaccugc

SEQ ID NO: 62666 - RNA, 64 nt, Homo Sapiens
agccuggaugacaagcaagacccucccuccaaagaaaauaaagcucaaaauaaaauaugauuug

SEQ ID NO: 62667 - RNA, 64 nt, Homo Sapiens
aagcaagacccucccuccaaagaaaauaaagcucaaaauaaaauaugauuuguguucauguaga

SEQ ID NO: 62668 - RNA, 64 nt, Homo Sapiens
ccugggcaacacagcgagacuccgucucaaggaaaaaauaaaaauaaaaagcgggcacgggccc

SEQ ID NO: 62669 - RNA, 64 nt, Homo Sapiens
caacacagcgagacuccgucucaaggaaaaaauaaaaauaaaaagcgggcacgggcccgugaca

SEQ ID NO: 62670 - RNA, 64 nt, Homo Sapiens
aaacaagcaacaccuuaaaagaguuuuauuucugaaaauaaauuaauuuuuuguaaauaaaaug

SEQ ID NO: 62671 - RNA, 64 nt, Homo Sapiens
aaaauaaauuaauuuuuuguaaauaaaauguuuaaaaauaaaaaagaaacuaaaguuacuugua

SEQ ID NO: 62672 - RNA, 64 nt, Homo Sapiens
caaagaaaacaaaauauaagggaaaaauaugagaaaaauaaaaauaaaaagagaauaauaggcc

SEQ ID NO: 62673 - RNA, 64 nt, Homo Sapiens
aaacaaaauauaagggaaaaauaugagaaaaauaaaaauaaaaagagaauaauaggccaggcac

SEQ ID NO: 62674 - RNA, 64 nt, Homo Sapiens
auguccguucaucccugagaggucugaaagaauaaaaauaaauucuaaaaaaagccucugucug

SEQ ID NO: 62675 - RNA, 64 nt, Homo Sapiens
acucuauaacugcagaaauuagauaauguuuuauaaaauaaauuugccacauaauaugggaugc

SEQ ID NO: 62676 - RNA, 64 nt, Homo Sapiens
acucuuuuguaaauuacaguuauuucaguauuguaaaauaaauguugacucauuucaugcaggu

SEQ ID NO: 62677 - RNA, 64 nt, Homo Sapiens
cagcacucuggugcgggaagaagcagaagcaaaaaaaauaaaaauaaaaaaauaaauaaaaaua

SEQ ID NO: 62678 - RNA, 64 nt, Homo Sapiens
ucuggugcgggaagaagcagaagcaaaaaaaauaaaaauaaaaaaauaaauaaaaauaaaaaaa

SEQ ID NO: 62679 - RNA, 64 nt, Homo Sapiens
gggaagaagcagaagcaaaaaaaauaaaaauaaaaaaauaaauaaaaauaaaaaaaauaaaaaa

SEQ ID NO: 62680 - RNA, 64 nt, Homo Sapiens
agaagcaaaaaaaauaaaaauaaaaaaauaaauaaaaauaaaaaaaauaaaaaaggaaaaaaaa

SEQ ID NO: 62681 - RNA, 64 nt, Homo Sapiens
aaaaauaaaaauaaaaaaauaaauaaaaauaaaaaaaauaaaaaaggaaaaaaaaaaaagaaga

SEQ ID NO: 62682 - RNA, 64 nt, Homo Sapiens
cuguguacaaagagaugugaaauacuuucaggcaaaaauaaacuguaagugacucaucaauguc

SEQ ID NO: 62683 - RNA, 64 nt, Homo Sapiens
uugugugaauugacuaccguuguuugcaaacccgaaaauaaaagacguucauuauguaugaaaa

SEQ ID NO: 62684 - RNA, 64 nt, Homo Sapiens
gaacauauagaaugcagagauuuuuuuuuccauuaaaauaaauggguauuggugguuaaaacug

SEQ ID NO: 62685 - RNA, 64 nt, Homo Sapiens
gaguuucaggaaugaaguagaagguaguuauuuaaaaauaaaaaacacaguccgucccuaccaa

SEQ ID NO: 62686 - RNA, 64 nt, Homo Sapiens
ugaaacuuccagugugaguugaccccaucauuuaaaaauaaaguccccggguuccuuaaugccu

SEQ ID NO: 62687 - RNA, 64 nt, Homo Sapiens
acuagauaaaaaaaaaaauuuagacucugugucaaaaauaaauguccagccugggcaacagagc

SEQ ID NO: 62688 - RNA, 64 nt, Homo Sapiens
cccagacuagaauaggguucuaaauugcugauccaaaauaaaaaucaguacugacuguguaagc

SEQ ID NO: 62689 - RNA, 64 nt, Homo Sapiens
caauuuuuaaaaagagaauauaaaaaaauaaaauaaaauaaaacgcaacauagugagauucugu

SEQ ID NO: 62690 - RNA, 64 nt, Homo Sapiens
aaaaccaauuuuuaaaaagaucuguuaaaaaaauaaaauaaaauccugggcaacauagugagau

SEQ ID NO: 62691 - RNA, 64 nt, Homo Sapiens
aaaauaaaaccaauuuuuaagagauucuguuaaaaaaauaaaauaccaaccugggcaacauagu

SEQ ID NO: 62692 - RNA, 64 nt, Homo Sapiens
uaaaaaaaauuagcugagugcccugucucuacuaaaaauaaauugccuaggcaacauagugaga

SEQ ID NO: 62693 - RNA, 64 nt, Homo Sapiens
cuuuuaugauugggaauuuaauaauacuugucuuaaaauaaaaggauuuccauccuguauuugc

SEQ ID NO: 62694 - RNA, 64 nt, Homo Sapiens
uguaaaagggaaauuugaacaacaaaaaccaaaaaaaauaaaaauaaaaaacuucaaaaguuga

SEQ ID NO: 62695 - RNA, 64 nt, Homo Sapiens
agggaaauuugaacaacaaaaaccaaaaaaaauaaaaauaaaaaacuucaaaaguugacaagaa

SEQ ID NO: 62696 - RNA, 64 nt, Homo Sapiens
aaaguugcuugagccaagugcuuaaaaaguuaauaaaauaaaaugaucuguaugauaccugcaa

SEQ ID NO: 62697 - RNA, 64 nt, Homo Sapiens
uaaaacuuuguguuuuggcaaucguuuuauaacuaaaauaaaaugaaagcuaaaucuacacgcu

SEQ ID NO: 62698 - RNA, 64 nt, Homo Sapiens
caaaccacuggaaaacaugcauuuuggaaacuuuaaaauaaaugguuaacauggcauuucuaag

SEQ ID NO: 62699 - RNA, 64 nt, Homo Sapiens
uauaguaaggucaagaagaguaucaaaguauaauaaaauaaaaauuguauacucuccauauauu

SEQ ID NO: 62700 - RNA, 64 nt, Homo Sapiens
ggaaaucuugauugcuuccaguuuucagugauuaaaaauaaagccgcuauaaacauuugugugc

SEQ ID NO: 62701 - RNA, 64 nt, Homo Sapiens
uucuagugccuugguuuucuuucuugaugcuggaaaaauaaacaaaccgguauugaguguuuag

SEQ ID NO: 62702 - RNA, 64 nt, Homo Sapiens
acguagggaggcccugagaacuaaauuuugccccaaaauaaaaacagaaauuaugagauugccu

SEQ ID NO: 62703 - RNA, 64 nt, Homo Sapiens
uucuauugaaaaaggaaaaucagcaauucagcaaaaaauaaauaaaaaauaaaaauguaaauau

SEQ ID NO: 62704 - RNA, 64 nt, Homo Sapiens
aaggaaaaucagcaauucagcaaaaaauaaauaaaaaauaaaaauguaaauaugauaguaauaa

SEQ ID NO: 62705 - RNA, 64 nt, Homo Sapiens
gggagagagagagagaugcuguugagcacaugacaaaauaaaauaaaauggaugauucauucuu

SEQ ID NO: 62706 - RNA, 64 nt, Homo Sapiens
agagagagagaugcuguugagcacaugacaaaauaaaauaaaauggaugauucauucuuaagug

SEQ ID NO: 62707 - RNA, 64 nt, Homo Sapiens
auaaugagacaacuuguuaaucucuuuaauacuaaaaauaaauuacucuucuauuucagggacu

SEQ ID NO: 62708 - RNA, 64 nt, Homo Sapiens
aauuacucuucuauuucagggacuuagguaauuuaaaauaaaccuucaauuuauggucuucugu

SEQ ID NO: 62709 - RNA, 64 nt, Homo Sapiens
uguuaacucauuucucaugccauuagcucucuacaaaauaaagcaaaguaguucuagugugguc

SEQ ID NO: 62710 - RNA, 64 nt, Homo Sapiens
uuugccugcuaaacaaguuagaauaggaaauaguaaaauaaauccaaacaagaguguaauauug

SEQ ID NO: 62711 - RNA, 64 nt, Homo Sapiens
caaugucauuacauagaacacuucagacacaggaaaaauaaacguggauuuuaaaaaaucaauc

SEQ ID NO: 62712 - RNA, 64 nt, Homo Sapiens
aaucuacauaaaugauuuacagguuaaaagaauaaaaauaaagguaacuuuaccuuucuuaaau

SEQ ID NO: 62713 - RNA, 64 nt, Homo Sapiens
auagugagagacccuguaucugaaaguaauaauaaaaauaaaaaauauaaaugaggucucguug

SEQ ID NO: 62714 - RNA, 64 nt, Homo Sapiens
cagccugggcaacaaagcaagacucugucucaaaaaaauaaaaauaaaaaaaaaaucuuaguuc

SEQ ID NO: 62715 - RNA, 64 nt, Homo Sapiens
gggcaacaaagcaagacucugucucaaaaaaauaaaaauaaaaaaaaaaucuuaguuccaugga

SEQ ID NO: 62716 - RNA, 64 nt, Homo Sapiens
uguauuaaaauucaacuauggauguauaugaaacaaaauaaauggagauaauuuuucucccaca

SEQ ID NO: 62717 - RNA, 64 nt, Homo Sapiens
uucuuuuguacguaauaggacauuucauccuagaaaaauaaaguaauguuuuugacauuggauu

SEQ ID NO: 62718 - RNA, 64 nt, Homo Sapiens
aauaagaaguuaccuacuccaaaaagaaaaaaugaaaauaaagguuaagaauuaaaaaaauaca

SEQ ID NO: 62719 - RNA, 64 nt, Homo Sapiens
aguaucacagcucuuuuagaggaaguuuauucagaaaauaaagggccaacagaguaaaguggaa

SEQ ID NO: 62720 - RNA, 64 nt, Homo Sapiens
uugcucuguuguauaagaucaucauuaaaauaaaaaaauaaauccuuucaaauacaccuuuuug

SEQ ID NO: 62721 - RNA, 64 nt, Homo Sapiens
aauaaaucuugcucuguuguccuuuuugaucauuaaaauaaaaaucauagugcuuucaaauaca

SEQ ID NO: 62722 - RNA, 64 nt, Homo Sapiens
uuucauucagacuaccuuuguacuugagguguuuaaaauaaauuuuuuguagaaauguaaagau

SEQ ID NO: 62723 - RNA, 64 nt, Homo Sapiens
gaacagugaggugguagcaaguuagaccgcauaaaaaauaaaguagcucuuacgaaaaacccag

SEQ ID NO: 62724 - RNA, 64 nt, Homo Sapiens
uuacuuacaagcauaacagauaaaaguaaaaauaaaaauaaaccaacuuccagaauagugauuu

SEQ ID NO: 62725 - RNA, 64 nt, Homo Sapiens
uaaaccuuacuuacaagcauugauuuuaaaaguaaaaauaaaaauucuuuaacuuccagaauag

SEQ ID NO: 62726 - RNA, 64 nt, Homo Sapiens
auuuguuuucugcuagaugcuaaaaugaaaacaaaaaauaaaauuuaagaaacucuaaagguua

SEQ ID NO: 62727 - RNA, 62 nt, Homo Sapiens
cagaugcccuauuuucugugauaaaacgcaauuaaaaauaaauguaucuaaaggauggaaaa

SEQ ID NO: 62728 - RNA, 64 nt, Homo Sapiens
gcaauuaaaaauaaacagauaucuaaaggauggaaaaauaaaaccccuuuuacauucugugugu

SEQ ID NO: 62729 - RNA, 64 nt, Homo Sapiens
guacuuaguguaaaauaauucauaguaaaaaaauaaaauaaauaaguucuaggggguugaacua

SEQ ID NO: 62730 - RNA, 64 nt, Homo Sapiens
aaauaguacuuaguguaaaaaacuacauaguaaaaaaauaaaauaaaacaguucuaggggguug

SEQ ID NO: 62731 - RNA, 64 nt, Homo Sapiens
aacagcauuacuauuucuaaguagaacccacuucaaaauaaaaaagaauuaaaaccaaucauaa

SEQ ID NO: 62732 - RNA, 64 nt, Homo Sapiens
guaaucuucauuuuaguauuuaugcuuagaugugaaaauaaauguuauuuguugaucauuucua

SEQ ID NO: 62733 - RNA, 64 nt, Homo Sapiens
uuuguccagccuauugcaggcuuuuccugacuuuaaaauaaauugugaucaauaauaguaccuu

SEQ ID NO: 62734 - RNA, 64 nt, Homo Sapiens
uucaucucacaguaaagccuauuuccccaggaaaaaaauaaaugccuuugaaugaaaauucuga

SEQ ID NO: 62735 - RNA, 64 nt, Homo Sapiens
uuaauguuuuaagcuuaauagccuuugcacuuuuaaaauaaaaaccaaguaugcaaaucaaaga

SEQ ID NO: 62736 - RNA, 64 nt, Homo Sapiens
ucaucuaggagcaaggugagaaaucacaaugagaaaaauaaauggaaacaccacugcuagggga

SEQ ID NO: 62737 - RNA, 64 nt, Homo Sapiens
aucaagcacuccuaccuuaauuauugcacuagagaaaauaaauuccaaauuaggaaguguuucc

SEQ ID NO: 62738 - RNA, 64 nt, Homo Sapiens
auucugguauuuugacauguuauaauacgcaaguaaaauaaaacaauaguuuacucagcucaug

SEQ ID NO: 62739 - RNA, 64 nt, Homo Sapiens
agcaaaacauaaauuaaaacucaaaugccaggacaaaauaaaacaauauaccagauggagagga

SEQ ID NO: 62740 - RNA, 64 nt, Homo Sapiens
ccugugaccuaguuggugcaguggcuugaaugccaaaauaaagcgugugcacuggauagugugu

SEQ ID NO: 62741 - RNA, 64 nt, Homo Sapiens
agaaccuccauauacauuaauuuuuuucugccuaaaaauaaaauugcguuguggcagcaauuug

SEQ ID NO: 62742 - RNA, 64 nt, Homo Sapiens
aacauuuacguuguuaccaagauuuuugcuauugaaaauaaaguuuuuaugaauauuuauauau

SEQ ID NO: 62743 - RNA, 64 nt, Homo Sapiens
cuuuaauaauuguaagccaggcuuuugguaccugaaaauaaaugaaaaaguggaaugggauaug

SEQ ID NO: 62744 - RNA, 64 nt, Homo Sapiens
guugauuguacuguucucauaaaugaguaacugcaaaauaaauaacagaaauucucaaucacug

SEQ ID NO: 62745 - RNA, 64 nt, Homo Sapiens
guaugucgauugaauuguacaaucuguuacuaaaaaaauaaauuuuuaagagcucaauuugaaa

SEQ ID NO: 62746 - RNA, 64 nt, Homo Sapiens
cauucauguuuguuaaaaacguaaauggcugucuaaaauaaagaguuccucugaaccccaaacu

SEQ ID NO: 62747 - RNA, 64 nt, Homo Sapiens
aauugaaaaccugcaauuguaccuuuguuuuucuaaaauaaagugccuauggcacaaauuguaa

SEQ ID NO: 62748 - RNA, 64 nt, Homo Sapiens
ggauuuacugaguagagguuugauugacuuucgcaaaauaaacaaauggggaaaaaaagucuug

SEQ ID NO: 62749 - RNA, 64 nt, Homo Sapiens
auaaucugaaaaccucauguaaacgcccaggauuaaaauaaaaugcuauguaaaaauaaaauuc

SEQ ID NO: 62750 - RNA, 64 nt, Homo Sapiens
ucaaacgcccaggauuaaaaaaugcagcuauguaaaaauaaaauuguuuugagggaauauacua

SEQ ID NO: 62751 - RNA, 64 nt, Homo Sapiens
agccugggcgacagagcaagacucugucucaaaaaaaauaaaaaauaaucagggcacaguggcu

SEQ ID NO: 62752 - RNA, 64 nt, Homo Sapiens
uccagccugggcaacaagagcaaaacuccgucucaaaauaaaaagaaaagaaaagaauggacag

SEQ ID NO: 62753 - RNA, 64 nt, Homo Sapiens
ucugggcaauauagugaggcucccaucuguacuaaaaauaaaaaaguuaggcguggcgaugugc

SEQ ID NO: 62754 - RNA, 64 nt, Homo Sapiens
cgggcuucugcauccauucccucuuuuuguuuuuaaaauaaauuguauuuuugaaucaaggagg

SEQ ID NO: 62755 - RNA, 64 nt, Homo Sapiens
ccagccugggggacagagcacgacccugucuccaaaaauaaaauaaaaauaaaaauaaauauug

SEQ ID NO: 62756 - RNA, 64 nt, Homo Sapiens
cugggggacagagcacgacccugucuccaaaaauaaaauaaaaauaaaaauaaauauuggcggg

SEQ ID NO: 62757 - RNA, 64 nt, Homo Sapiens
gacagagcacgacccugucuccaaaaauaaaauaaaaauaaaaauaaauauuggcgggggaacc

SEQ ID NO: 62758 - RNA, 64 nt, Homo Sapiens
gcacgacccugucuccaaaaauaaaauaaaaauaaaaauaaauauuggcgggggaacccucugg

SEQ ID NO: 62759 - RNA, 64 nt, Homo Sapiens
cagccugggcaauauagcaagaccccucacuacaaaaauaaaacaucaaaaacaaaaacaauua

SEQ ID NO: 62760 - RNA, 64 nt, Homo Sapiens
uccaggcuggguaacagaaugagaccuuaucucaaaaauaaacaaacuaauaaaaagcaaaaaa

SEQ ID NO: 62761 - RNA, 64 nt, Homo Sapiens
ucccugaaugacugcauggauagaaccacuaagaaaaauaaacuuuuauauuuuuauagcuacu

SEQ ID NO: 62762 - RNA, 64 nt, Homo Sapiens
gccuggucgacagagugagacuccaucucaagaaaaaauaaaaauaaaguuguucucugaagag

SEQ ID NO: 62763 - RNA, 64 nt, Homo Sapiens
ucgacagagugagacuccaucucaagaaaaaauaaaaauaaaguuguucucugaagagcaaaug

SEQ ID NO: 62764 - RNA, 64 nt, Homo Sapiens
gcuuaguccaucagcaucuuauucuggguaauaaaaaauaaaaauaaacggauaccuguuuucc

SEQ ID NO: 62765 - RNA, 64 nt, Homo Sapiens
uccaucagcaucuuauucuggguaauaaaaaauaaaaauaaacggauaccuguuuuccacugcu

SEQ ID NO: 62766 - RNA, 64 nt, Homo Sapiens
guuuauacgaaaauauauuuucaaagguguaguaaaaauaaaaaaaauuuuaauccaaauuugu

SEQ ID NO: 62767 - RNA, 64 nt, Homo Sapiens
cgaauauucuacuaaaugagaguucugaguauagaaaauaaaacuaaaguugguagaaaaauua

SEQ ID NO: 62768 - RNA, 64 nt, Homo Sapiens
aaauaacauuuaggaagcaaauagauuaaacacaaaaauaaaacuaaagcauaggaauuauguu

SEQ ID NO: 62769 - RNA, 64 nt, Homo Sapiens
uuuuaaauauaauuuuauuucuuucaacaaauauaaaauaaaaaacaacuuuggaacaaugacu

SEQ ID NO: 62770 - RNA, 64 nt, Homo Sapiens
aauugcugggaauauuugacucuccguauuggagaaaauaaaauuacaacauuacgacauacua

SEQ ID NO: 62771 - RNA, 64 nt, Homo Sapiens
uaguuuuuauaccuuaaaaagacugguagcauauaaaauaaaucuuaaaagcuaauuauacaca

SEQ ID NO: 62772 - RNA, 64 nt, Homo Sapiens
gccugggcgacagagugagacucccucucaaaagaaaauaaaaauaaaaauaaacuggccaggu

SEQ ID NO: 62773 - RNA, 64 nt, Homo Sapiens
gcgacagagugagacucccucucaaaagaaaauaaaaauaaaaauaaacuggccaggugcggug

SEQ ID NO: 62774 - RNA, 64 nt, Homo Sapiens
gagugagacucccucucaaaagaaaauaaaaauaaaaauaaacuggccaggugcgguggcucac

SEQ ID NO: 62775 - RNA, 64 nt, Homo Sapiens
accugggcaagagagagagacuuugucucuauuaaaaauaaaaaugauuggccgagcauggugg

SEQ ID NO: 62776 - RNA, 64 nt, Homo Sapiens
cacaggcugcaccauaagacccacucacaauaaaaaaauaaaaggccgagccgggcaugguugc

SEQ ID NO: 62777 - RNA, 64 nt, Homo Sapiens
cgagccgggcaugguugcucacucccguaauaaaaaaauaaaagaacaggcugagccgggcaug

SEQ ID NO: 62778 - RNA, 64 nt, Homo Sapiens
auucugcaaagauaaauaauaucccugcauuaucaaaauaaaguagcagaccucucaauucaca

SEQ ID NO: 62779 - RNA, 64 nt, Homo Sapiens
cauuaaugauacaugaaucuuggccacaaugagaaaaauaaaaaugaaaaaagagcaggcaucc

SEQ ID NO: 62780 - RNA, 64 nt, Homo Sapiens
acagaaagcaaggggugccucucaaaauaaauaaaaaauaaaagcaacaagagcgaaacucugu

SEQ ID NO: 62781 - RNA, 64 nt, Homo Sapiens
aaaaauaaaagacagaaagccgaaacucugucucaaaauaaauauccagccugggcaacaagag

SEQ ID NO: 62782 - RNA, 64 nt, Homo Sapiens
aucuaagggcucaggaaccaugucaaaaaaauaaaaaauaaaaaggugacagaaugagacucug

SEQ ID NO: 62783 - RNA, 64 nt, Homo Sapiens
auaaaaaaucuaagggcucagacucugugucaaaaaaauaaaaacagccugggugacagaauga

SEQ ID NO: 62784 - RNA, 64 nt, Homo Sapiens
cagugcucaaaggguuaaguaucaaagaacacucaaaauaaacuuuuaaagguauuuauuagaa

SEQ ID NO: 62785 - RNA, 64 nt, Homo Sapiens
aauaauaauguaugaagcucuuugguuaaaaaauaaaauaaaauuugaagcacuuuugcauuaa

SEQ ID NO: 62786 - RNA, 64 nt, Homo Sapiens
aaaauaauaauaauguaugaauuaauuugguuaaaaaauaaaauguacuuugaagcacuuuugc

SEQ ID NO: 62787 - RNA, 64 nt, Homo Sapiens
caacccaaguaaagaacagcaaaaaggaaacaacaaaauaaaacgaauaaguauuuccgucaag

SEQ ID NO: 62788 - RNA, 64 nt, Homo Sapiens
aucguaugauaugagauacacagugugauuauaaaaaauaaaagaauuugguuagggauuaugu

SEQ ID NO: 62789 - RNA, 64 nt, Homo Sapiens
uuacuaagccaaagagaaaaaagcuugugaaaggaaaauaaaaacaaagcauuauggcugucac

SEQ ID NO: 62790 - RNA, 64 nt, Homo Sapiens
accaguuuguaaauggaaaauggggacgauucccaaaauaaaucgaugcuuuaugaaaagguua

SEQ ID NO: 62791 - RNA, 64 nt, Homo Sapiens
aauaagacagcacuuuauacaaauaagauaaaauaaaauaaacaagagcaaaauuucaucucaa

SEQ ID NO: 62792 - RNA, 64 nt, Homo Sapiens
aaacaaauaagacagcacuucucaaaaauaagauaaaauaaaaucaacaagagcaaaauuucau

SEQ ID NO: 62793 - RNA, 64 nt, Homo Sapiens
ugguaauaaucuuuuuucaaaccuugagacaaugaaaauaaacucuagauccagaguucagaag

SEQ ID NO: 62794 - RNA, 64 nt, Homo Sapiens
aaaaggacuguaggaggcaguauuauaaaaaaacaaaauaaaugauauagcaagacucugccuc

SEQ ID NO: 62795 - RNA, 64 nt, Homo Sapiens
acucgcuucccccauagccaccccagaaauggugaaaauaaaauaaagcagguuuuucuccucu

SEQ ID NO: 62796 - RNA, 64 nt, Homo Sapiens
cuucccccauagccaccccagaaauggugaaaauaaaauaaagcagguuuuucuccucuaccuu

SEQ ID NO: 62797 - RNA, 64 nt, Homo Sapiens
aaaggucuuuuuaaaccaguuuagauuucaagaaaaaauaaauggaaaucaucgaaaauucauu

SEQ ID NO: 62798 - RNA, 64 nt, Homo Sapiens
aaucaucgaaaauucauuucacauuaauggucuaaaaauaaaccaaaggacauuaugugugcau

SEQ ID NO: 62799 - RNA, 64 nt, Homo Sapiens
uaauuaugcaugugauuuuaacauuuaauauucaaaaauaaaucucuugcuggauuugagagua

SEQ ID NO: 62800 - RNA, 64 nt, Homo Sapiens
ugcuuguagaaacaauuuugaaagccccuugaggaaaauaaaaaucaagaagaacacuuuucuc

SEQ ID NO: 62801 - RNA, 64 nt, Homo Sapiens
acuccagccugggagggugagacuccaucuaaaaaaaauaaaauaaauggcaaccccuggucua

SEQ ID NO: 62802 - RNA, 64 nt, Homo Sapiens
agccugggagggugagacuccaucuaaaaaaaauaaaauaaauggcaaccccuggucuaagaua

SEQ ID NO: 62803 - RNA, 64 nt, Homo Sapiens
cuuugccuauaugguagagcaauaaugcuuuuuaaaaauaaacuucugaaaacccaaggccagg

SEQ ID NO: 62804 - RNA, 64 nt, Homo Sapiens
ucuugacuuuaaaaaaauuauuaaaaacaaaaaaaaaauaaauuuuuuugcaauccuuuccuca

SEQ ID NO: 62805 - RNA, 64 nt, Homo Sapiens
augauauaaaggagauacauguuucuuccuuuaaaaaauaaacggaaguuacauuguuaauguu

SEQ ID NO: 62806 - RNA, 64 nt, Homo Sapiens
ucagggagccuaaugagguuuuuaauaucaucuaaaaauaaagcauugaagugaaguuggugaa

SEQ ID NO: 62807 - RNA, 64 nt, Homo Sapiens
auucccacugcugggccucuaucuccaugacaacaaaauaaaaacagagguugcuugacucauu

SEQ ID NO: 62808 - RNA, 64 nt, Homo Sapiens
aaaaggccacaaaaguucccucucacuuucaguaaaaauaaauaaaacagcagcagcaaacaaa

SEQ ID NO: 62809 - RNA, 64 nt, Homo Sapiens
auaaauauuguguugugcagcauuaaaaaaaaucaaaauaaaaauuaaaugugagcaaagaaug

SEQ ID NO: 62810 - RNA, 64 nt, Homo Sapiens
agccuaggcaacaagagugaaauuccgucucaaaaaaauaaauaaauaaauaaauaaauaaguu

SEQ ID NO: 62811 - RNA, 64 nt, Homo Sapiens
gguuucuaaaacccuuaacacugguaagggcucaaaaauaaacguauguguucauauucgauca

SEQ ID NO: 62812 - RNA, 64 nt, Homo Sapiens
uuucccugugcuccuuuuacgucuucagaaggugaaaauaaauacagagcuccaugcacacagu

SEQ ID NO: 62813 - RNA, 64 nt, Homo Sapiens
caaccaaaaaaauugaaggacuuuaaugaaaaaaaaaauaaaaauuuuugugaugaucaaugga

SEQ ID NO: 62814 - RNA, 64 nt, Homo Sapiens
uuggcuaaaaauuuuaaaaauuuuucuaggcauaaaaauaaaagaguccuaaacgucccaugua

SEQ ID NO: 62815 - RNA, 64 nt, Homo Sapiens
cuagacaucaaauuuagaucagauaauuuaaagaaaaauaaauaaaaguaguucuuuaaauaag

SEQ ID NO: 62816 - RNA, 64 nt, Homo Sapiens
acuucacaaaaacgguaaugucagcaaagcuuugaaaauaaagggaagucuguuaaagccauug

SEQ ID NO: 62817 - RNA, 64 nt, Homo Sapiens
aauaacaaugugcucucggggacaucacuuguacaaaauaaacacaggcaaaauccuugcuuau

SEQ ID NO: 62818 - RNA, 64 nt, Homo Sapiens
cagcucuacuggucuugugggucacugguagaccaaaauaaaacauugacugucacuguuccuu

SEQ ID NO: 62819 - RNA, 64 nt, Homo Sapiens
uggccauuugcuuuuucaccaaacaaaaacacuaaaaauaaaaaagaaccccuacaugaaacag

SEQ ID NO: 62820 - RNA, 64 nt, Homo Sapiens
aacauuuuuuucaagcagggaaauaaaaaaaauaaaaauaaaaacaauccccucaaaaaaauaa

SEQ ID NO: 62821 - RNA, 64 nt, Homo Sapiens
uaaaaaaacauuuuuuucaaaaauaaaaauaaaaaaaauaaaaaacugugcaauccccucaaaa

SEQ ID NO: 62822 - RNA, 64 nt, Homo Sapiens
aaauaaaaauaaaaaaacaucccucaaaaaaauaaaaauaaaaauggaaauaaacugugcaauc

SEQ ID NO: 62823 - RNA, 64 nt, Homo Sapiens
uaaaaaaaauaaaaauaaaagcaauccccucaaaaaaauaaaaaaguguuuggaaauaaacugu

SEQ ID NO: 62824 - RNA, 64 nt, Homo Sapiens
uguuaacaggaaugcaguguccuguuaccuugaaaaaauaaaaacugucauuuguaugcaauuu

SEQ ID NO: 62825 - RNA, 64 nt, Homo Sapiens
ggcaaggaucuacugucauucuuuuauuuagauaaaaauaaagagagaauucaucuugaguuau

SEQ ID NO: 62826 - RNA, 64 nt, Homo Sapiens
cgcuggggaagggggcuccagaaagugaccaugaaaaauaaauuaucacucacugccaaaaaua

SEQ ID NO: 62827 - RNA, 64 nt, Homo Sapiens
acagcuuaaagagaaaaaugauaaauaauuaauuaaaauaaaaagcaagacucugucucaauaa

SEQ ID NO: 62828 - RNA, 64 nt, Homo Sapiens
aaccauaauccccagugcagaaauacauaaauaaaaaauaaaccagacuccgucucaaaaaaau

SEQ ID NO: 62829 - RNA, 64 nt, Homo Sapiens
cauaaauaaaaaauaaaccagacuccgucucaaaaaaauaaauacaggcugggcgacagagcga

SEQ ID NO: 62830 - RNA, 64 nt, Homo Sapiens
aguuuccuauuuuugguuuauuuauuuuagaagaaaaauaaaauuauuugggcauuuuuguuua

SEQ ID NO: 62831 - RNA, 64 nt, Homo Sapiens
uugccuagcauuuuauagauauuuauuauuuaaaaaaauaaagauauguuuuuaaugaagagag

SEQ ID NO: 62832 - RNA, 64 nt, Homo Sapiens
uucccuguauuugauaaaacacauaauuuugagaaaaauaaaguuuuaaauguaucuaugucuc

SEQ ID NO: 62833 - RNA, 64 nt, Homo Sapiens
guuuguuauaccaauaaaugcuuuagcugcaacuaaaauaaaaaaguuaaagguaagaaaauga

SEQ ID NO: 62834 - RNA, 64 nt, Homo Sapiens
ccuaccaaaaauagccaguaguaucugaaaaugaaaaauaaaugaaguaucucuaggaaacagu

SEQ ID NO: 62835 - RNA, 64 nt, Homo Sapiens
gauuuaaaaaacugaaaagguauaccucaacccaaaaauaaagguuuguuuugguuuguuaugg

SEQ ID NO: 62836 - RNA, 64 nt, Homo Sapiens
uuuuuucuucuauuaaaauauaacauugugaaagaaaauaaaauuuaugcuauucuuugcuuug

SEQ ID NO: 62837 - RNA, 64 nt, Homo Sapiens
auagaaauccaauuaagacucacuuggguaaaaaaaaauaaaaaaauaaacaaaauaaacugcu

SEQ ID NO: 62838 - RNA, 64 nt, Homo Sapiens
ccaauuaagacucacuuggguaaaaaaaaauaaaaaaauaaacaaaauaaacugcucacuuauu

SEQ ID NO: 62839 - RNA, 64 nt, Homo Sapiens
acucacuuggguaaaaaaaaauaaaaaaauaaacaaaauaaacugcucacuuauuugaaaaauu

SEQ ID NO: 62840 - RNA, 64 nt, Homo Sapiens
uuuacuuucuaucagcugagcaaccucucaagaaaaaauaaauaaauaaauaaaccucucuuua

SEQ ID NO: 62841 - RNA, 64 nt, Homo Sapiens
ccagccaacauugugagacauaaucucuacaaauaaaauaaauuaguuggacaugauggugugc

SEQ ID NO: 62842 - RNA, 64 nt, Homo Sapiens
cagccugagugacagagugagacuuugcaaccaaaaaauaaaauaauaauaauaaugaaauaaa

SEQ ID NO: 62843 - RNA, 64 nt, Homo Sapiens
gucugaaagugaacucucauaauucaaauuguauaaaauaaagcuacauuucuaagagcuuggu

SEQ ID NO: 62844 - RNA, 64 nt, Homo Sapiens
acugcauaggauuauccccugacauuccaagagcaaaauaaagcucuugagaguaauuguuguc

SEQ ID NO: 62845 - RNA, 64 nt, Homo Sapiens
caggggucuagugcccugcauuccuuugaggcaaaaaauaaaugggcuaugacugguuaaaugu

SEQ ID NO: 62846 - RNA, 64 nt, Homo Sapiens
aauaucuguggaacauguaaauacugucaaauggaaaauaaaauaaguuauaauuuuugugaau

SEQ ID NO: 62847 - RNA, 64 nt, Homo Sapiens
ugauguaaauguuuuacuuucaacuguguucuuuaaaauaaauccuaccugguuuuuaaauuuu

SEQ ID NO: 62848 - RNA, 64 nt, Homo Sapiens
augcauacaguuaaacauucaaucaaaaauaaagaaaauaaaaauucuuggaaaaaauuuuaag

SEQ ID NO: 62849 - RNA, 64 nt, Homo Sapiens
aaauaaaaaaugcauacaguaauuuuaagaaucaaaaauaaagauauuucuauuucuuggaaaa

SEQ ID NO: 62850 - RNA, 64 nt, Homo Sapiens
uucugggccuuacuuguuuucaaaaaugucuuagaaaauaaaaaguauuuaugcccuuauaucc

SEQ ID NO: 62851 - RNA, 64 nt, Homo Sapiens
uacacagguaauuuaguaucaguagugaaugcagaaaauaaaaauuaaucaauggauauccuuc

SEQ ID NO: 62852 - RNA, 64 nt, Homo Sapiens
aaguguuuuacauaguaagguuaaacauuuuuacaaaauaaauauacaguauuuuuauucauau

SEQ ID NO: 62853 - RNA, 64 nt, Homo Sapiens
aagacuuucuaugugguuugaaagcaagucuaccaaaauaaacucuuuaaaccaaugccuauaa

SEQ ID NO: 62854 - RNA, 64 nt, Homo Sapiens
gcaguuauugauucuugccauugauggagaagggaaaauaaauucuuccuauucuuucuuaaau

SEQ ID NO: 62855 - RNA, 64 nt, Homo Sapiens
uuugguauuuuguggucaugccugacacuugauaaaaauaaauaucucaacuuuaauaaguuau

SEQ ID NO: 62856 - RNA, 64 nt, Homo Sapiens
agugaaagaagcaagcugugccugucucaaaaauaaaauaaaaaccuggaccacagagcaggcc

SEQ ID NO: 62857 - RNA, 64 nt, Homo Sapiens
aaaaaagugaaagaagcaagaggccccugucucaaaaauaaaauuauagccuggaccacagagc

SEQ ID NO: 62858 - RNA, 64 nt, Homo Sapiens
uaaaaaacuagccaggugugccccgucucuacaaaaaauaaauugccugggucacauagcaaga

SEQ ID NO: 62859 - RNA, 64 nt, Homo Sapiens
aauggugggguuuucugcuuuguuuuuauuuaagaaaauaaacacgacauauuuaaagaagguu

SEQ ID NO: 62860 - RNA, 64 nt, Homo Sapiens
gauuggaugaaagucaaagguugucuacuuuaagaaaauaaaauacccugaauggagcccagca

SEQ ID NO: 62861 - RNA, 64 nt, Homo Sapiens
auuccccuuuaauuguggauaguuuaaaguuuaaaaaauaaaguucuugcugggcacaguggcu

SEQ ID NO: 62862 - RNA, 64 nt, Homo Sapiens
ccagcuugggcaacagagugagacuuaaucuugaaaaauaaauaaaugaaaaauaaaauucuug

SEQ ID NO: 62863 - RNA, 64 nt, Homo Sapiens
cagccugggugacagagugagacccuauuucaaaaaaauaaaaauuggaagaagagcuuaaaaa

SEQ ID NO: 62864 - RNA, 64 nt, Homo Sapiens
ggaauacaauguccuuccauagcaugggaagaagaaaauaaacaucuccuuuccaacagcugug

SEQ ID NO: 62865 - RNA, 64 nt, Homo Sapiens
aagguggccuuucucccaagcugguggauaaugaaaaauaaagcaucccaucucucggcguucc

SEQ ID NO: 62866 - RNA, 64 nt, Homo Sapiens
uggcaucaucuuuuugcucuagcccuuccucuccaaaauaaaaucaaauaaaggaaaaucucca

SEQ ID NO: 62867 - RNA, 64 nt, Homo Sapiens
uguagauguuuuaauaacaauuuuuguccuucuuaaaauaaaaugaaagaaacuugcuucccuu

SEQ ID NO: 62868 - RNA, 64 nt, Homo Sapiens
gaaagaaacuugcuucccuuagccuuuguucuagaaaauaaacuugugcacuuugaccucuguc

SEQ ID NO: 62869 - RNA, 64 nt, Homo Sapiens
aauaguuagauauucuagauuuacauuaaauuguaaaauaaauggacuuauugaagcauaucuu

SEQ ID NO: 62870 - RNA, 64 nt, Homo Sapiens
gaggcugugucacuggcauguccuuaaccuuggcaaaauaaacuuucuaaauugaaaccugucu

SEQ ID NO: 62871 - RNA, 64 nt, Homo Sapiens
acuugagacuugugacaagccagacucuguucugaaaauaaaaaucucuuuuuaaaaauaaaac

SEQ ID NO: 62872 - RNA, 64 nt, Homo Sapiens
cagacucuguucugaaaauauccuucucuuuuuaaaaauaaaacacuagcauuuaucacuuuuu

SEQ ID NO: 62873 - RNA, 64 nt, Homo Sapiens
caccuugauuuugagcuggaauguuucaaugagcaaaauaaauuagacaaaaguuuacuuucuu

SEQ ID NO: 62874 - RNA, 64 nt, Homo Sapiens
auuuuuaaaaagacuguuuuuaaaaaggugcuacaaaauaaagugcuaucuuuuucuguuucuc

SEQ ID NO: 62875 - RNA, 64 nt, Homo Sapiens
ugcagcacguggaggggaacacauacaugucuugaaaauaaacugcuagaauaaagaaaugcug

SEQ ID NO: 62876 - RNA, 64 nt, Homo Sapiens
aauacuagaguaucuagaagggugaaaacaaaaaaaaauaaaaagaaacacagacgcccaggug

SEQ ID NO: 62877 - RNA, 64 nt, Homo Sapiens
aucuacugcacaccaacuguuuauagaauacacaaaaauaaaauguaauaacuguauucuguga

SEQ ID NO: 62878 - RNA, 64 nt, Homo Sapiens
guuuagaaauuagcuccagguucuuaaacuaacaaaaauaaaaccuaagcaugccacagagcua

SEQ ID NO: 62879 - RNA, 64 nt, Homo Sapiens
gugggagaggaaaugucagggcaugugcucugauaaaauaaaggcagggaaacaagcugaauua

SEQ ID NO: 62880 - RNA, 64 nt, Homo Sapiens
ucaugauuugaaaaguacaccuugcaaaguuuuaaaaauaaaguuuuuaggcaaaugcgauaag

SEQ ID NO: 62881 - RNA, 64 nt, Homo Sapiens
uugcugcaugacccuccaaguagaccuguggcuuaaaauaaagaaaaugcagcaaaaagaaugc

SEQ ID NO: 62882 - RNA, 64 nt, Homo Sapiens
uuguacacauugauauuuaaugacaaauuuacuuaaaauaaauugaccccuuguucuuacuugc

SEQ ID NO: 62883 - RNA, 64 nt, Homo Sapiens
ggcaacaugaugccagauuugagaaaggaucugcaaaauaaagauaccacaauucaucuuaaaa

SEQ ID NO: 62884 - RNA, 64 nt, Homo Sapiens
uaugaggaauggauugucagguugcugaaguauaaaaauaaacucuugguuguccugugcuuau

SEQ ID NO: 62885 - RNA, 64 nt, Homo Sapiens
acucuggcucaucuaguccugcuccuugugcuauaaaauaaaugcagacuaauuuccugcccaa

SEQ ID NO: 62886 - RNA, 64 nt, Homo Sapiens
gaaauaaggagaaaagagaaugggagagugagagaaaauaaaaaaggcaaaagggagagagagg

SEQ ID NO: 62887 - RNA, 64 nt, Homo Sapiens
guguaauuuagguuuuucaacaaagcccuugucuaaaauaaaaggcauuauuggaaauauuuga

SEQ ID NO: 62888 - RNA, 64 nt, Homo Sapiens
ugaaagccuacaaugaaucauuguucaaccuugaaaaauaaaauuuuguaaaacaucgguugau

SEQ ID NO: 62889 - RNA, 64 nt, Homo Sapiens
acuaacauacucacugugaacccagccuauugcaaaaauaaaaucuuuuuauaauauuaucuau

SEQ ID NO: 62890 - RNA, 64 nt, Homo Sapiens
uauuuuugacaugcuccuauuuuuguaacuugaaaaaauaaaauuuugccuugugacagauuuu

SEQ ID NO: 62891 - RNA, 64 nt, Homo Sapiens
cacuuuuaaaaaugacacauauuuaaacacuuagaaaauaaaguuaacacuuacugaagugcua

SEQ ID NO: 62892 - RNA, 64 nt, Homo Sapiens
ggccugauauuaguucuuagagcuucuuguggcaaaaauaaaaugauuuaauucugauguuuga

SEQ ID NO: 62893 - RNA, 64 nt, Homo Sapiens
aucccauacuaucugcuuggauuuggagagccaaaaaauaaagcugauugucaugugauuaaau

SEQ ID NO: 62894 - RNA, 64 nt, Homo Sapiens
aggugaagcauacuccaguguuuuagggguuuugaaaauaaauauuuaaauuucacaguccuca

SEQ ID NO: 62895 - RNA, 64 nt, Homo Sapiens
aaauacaaauagcugacccgcgucucaaaacauaaaaauaaaaaugggccacagagcaagacuc

SEQ ID NO: 62896 - RNA, 64 nt, Homo Sapiens
auaguaauaauauugaacauguuugcugacuauaaaaauaaaucgaaaagcuuuuaagucucau

SEQ ID NO: 62897 - RNA, 64 nt, Homo Sapiens
ucauagucaagauuugguagaauguaacaacccaaaaauaaaugggcccagauagguugaucuu

SEQ ID NO: 62898 - RNA, 64 nt, Homo Sapiens
augucaccacaaugguguauaugcagaaaauuccaaaauaaaugagaaacaccuuuuaagcuga

SEQ ID NO: 62899 - RNA, 64 nt, Homo Sapiens
gcagugguucucaacuaggguuuugaugaugcacaaaauaaacauacuguaguagaaacuuuag

SEQ ID NO: 62900 - RNA, 64 nt, Homo Sapiens
ccgaggcuuacuguaguagaaugccuccuuuguaaaaauaaacaauuuugguucuacuugcuau

SEQ ID NO: 62901 - RNA, 64 nt, Homo Sapiens
augaacaacuuucaacaaugacuacugcaauuagaaaauaaaauuguaaagaaaucagauacaa

SEQ ID NO: 62902 - RNA, 64 nt, Homo Sapiens
guuugaaauccaagaauaauuaagcuaugcacagaaaauaaaauauuccuauaauacagugcua

SEQ ID NO: 62903 - RNA, 64 nt, Homo Sapiens
gucaugcugcagaauauguuuacagcugagaaauaaaauaaaaucaguuucugaaugaaaaagc

SEQ ID NO: 62904 - RNA, 64 nt, Homo Sapiens
acuuguugaaaagccuuuuuauagcaacuuguaaaaaauaaaauuauauauaaauuuuaauuuc

SEQ ID NO: 62905 - RNA, 64 nt, Homo Sapiens
ugauuucacggaugugguuuuguggaaaaaaauaaaaauaaaagaguugacaugaagucaucua

SEQ ID NO: 62906 - RNA, 64 nt, Homo Sapiens
uaaaagugauuucacggaugcaucuauguggaaaaaaauaaaaauuuuguaguugacaugaagu

SEQ ID NO: 62907 - RNA, 64 nt, Homo Sapiens
aguuuaaugcagugaucuuuagaauaauauuaacaaaauaaagguaauaauuguucaauguuua

SEQ ID NO: 62908 - RNA, 64 nt, Homo Sapiens
uagaaauauggcaugacauguuuaaugcuagcaaaaaauaaauucaucguuuaaauaggaaaaa

SEQ ID NO: 62909 - RNA, 64 nt, Homo Sapiens
cuuaguucauacccuuccagaaaaauaaauaaauaaaauaaauuaacagugaaacuccaucuca

SEQ ID NO: 62910 - RNA, 64 nt, Homo Sapiens
aauaaaauaaauucuuaguuaaacuccaucucaaaaaauaaauacuccagccugggcaacagug

SEQ ID NO: 62911 - RNA, 64 nt, Homo Sapiens
uuaaaaugauauauaagacaugugaguuuuuauaaaaauaaauucaguggacgcaaaauaaugu

SEQ ID NO: 62912 - RNA, 64 nt, Homo Sapiens
caguggacgcaaaauaauguuaaagguaauuguaaaaauaaauaucaaaaacuaucacuugcua

SEQ ID NO: 62913 - RNA, 64 nt, Homo Sapiens
gcucuggucccaccucuggauguggagcucuuuaaaaauaaauugcacccccacauccaaagga

SEQ ID NO: 62914 - RNA, 64 nt, Homo Sapiens
aguacagaagggcuuauaauuauacacagguaaaaaaauaaaauuuuuaaaaaguaaagcaaua

SEQ ID NO: 62915 - RNA, 64 nt, Homo Sapiens
ugucuguuuucaaccaaagaauaacuaucaaaacaaaauaaauuucuaauacauauuaaaagac

SEQ ID NO: 62916 - RNA, 64 nt, Homo Sapiens
auauaauucaaugguugucauuuuaauuauaauaaaaauaaaguauauaaaguaaaauucacca

SEQ ID NO: 62917 - RNA, 64 nt, Homo Sapiens
caaauguuuauuucagaaggguauucccauuuuuaaaauaaauaagcuugggaaaaaugaaauu

SEQ ID NO: 62918 - RNA, 64 nt, Homo Sapiens
aaagaaauaugucaccuuuggaguucauuauuuaaaaauaaacuauaguauuuuugcagccuaa

SEQ ID NO: 62919 - RNA, 64 nt, Homo Sapiens
uccuuucgauuuagccaacuaacaagaaaauacuaaaauaaaaaguuuuuugauuaaaaaugug

SEQ ID NO: 62920 - RNA, 64 nt, Homo Sapiens
ucugaucgcauaaaaauauguguaaacaaaaaauaaaauaaaauucuauauuuuuauauucaug

SEQ ID NO: 62921 - RNA, 64 nt, Homo Sapiens
aaaauucugaucgcauaaaaucauguguaaacaaaaaauaaaaucuuuuucuauauuuuuauau

SEQ ID NO: 62922 - RNA, 64 nt, Homo Sapiens
ucauucugaauaucagccuuaccauaguuauauaaaaauaaaggucugcaguaaggugguuuaa

SEQ ID NO: 62923 - RNA, 64 nt, Homo Sapiens
gauuuuuccaguguugauuucucaaaguaguuagaaaauaaacauuccaaucacuuaguagccc

SEQ ID NO: 62924 - RNA, 64 nt, Homo Sapiens
auaaaacauuuccaaucacugccuacuagacuugaaaauaaaguaaccccacuuauggguguaa

SEQ ID NO: 62925 - RNA, 64 nt, Homo Sapiens
uaauuaaaaaccuaagaaauauguuuggcaaaauaaaauaaaggaauaaaagguauucccaggu

SEQ ID NO: 62926 - RNA, 64 nt, Homo Sapiens
aaagguaauuaaaaaccuaacagguauguuuggcaaaauaaaauaaaaaaauaaaagguauucc

SEQ ID NO: 62927 - RNA, 64 nt, Homo Sapiens
guauucccagguauguuuggcccaagguaaaaaaaaaauaaaaguuaugguuuggaaccaucac

SEQ ID NO: 62928 - RNA, 64 nt, Homo Sapiens
gcucaguaaugcucacgauaccaauuguuuugacaaaauaaauuuacuaaacuuggccuaaaau

SEQ ID NO: 62929 - RNA, 64 nt, Homo Sapiens
gcacugcaugugcucuguuuauucugauuuuacuaaaauaaaaaguucaaaagucuuccugcug

SEQ ID NO: 62930 - RNA, 64 nt, Homo Sapiens
uuuuuguuuuuuagccuguuauauuuccuucuguaaaauaaaauauguccagaagaggcauguu

SEQ ID NO: 62931 - RNA, 64 nt, Homo Sapiens
ccuauugcugauacugucuuugcauaaaugaauaaaaauaaacuuuuuuucuucaaauguguuu

SEQ ID NO: 62932 - RNA, 64 nt, Homo Sapiens; identical to SEQ ID NO: 62930

SEQ ID NO: 62933 - RNA, 64 nt, Homo Sapiens; identical to SEQ ID NO: 62931

SEQ ID NO: 62934 - RNA, 64 nt, Homo Sapiens
auuaaaaaaaaacaugagcucucuguaaaaaauaaaaauaaaacgcaacacagugagaacucau

SEQ ID NO: 62935 - RNA, 64 nt, Homo Sapiens
uaaaacauuaaaaaaaaacaacucaucucuguaaaaaauaaaaaaccuaggcaacacagugaga

SEQ ID NO: 62936 - RNA, 64 nt, Homo Sapiens
agcaucuuuucuaguugaaauggugaacugauaggaaaacaaaugaguagaaagaguucaugaa

SEQ ID NO: 62937 - RNA, 64 nt, Homo Sapiens
gccuggacugaguauaacagcuuuaugauuaugagaaaacaaauucuuuauuuuuuuuuucugu

SEQ ID NO: 62938 - RNA, 64 nt, Homo Sapiens
ugugcaugaaccaaaggaaauaacauugaagaaggaaaacaauauguagaaaguauuuuagaaa

SEQ ID NO: 62939 - RNA, 64 nt, Homo Sapiens
gauaauugauggucagagccagcacuggaauuuugaaaacaaauaaggugauuaucuauuuuag

SEQ ID NO: 62940 - RNA, 64 nt, Homo Sapiens
aucugaauaauuauggaaguugggacauguuaaggaaaacaaauauguucaucaccaacaauca

SEQ ID NO: 62941 - RNA, 64 nt, Homo Sapiens
aaagaaaaauauauauucauucuuuggugcuguagaaaacaaaacuccuuuuccuauuugaauu

SEQ ID NO: 62942 - RNA, 64 nt, Homo Sapiens
cugcauauacagguaccauuauaaggaugguauagaaaacaacggugccacaugcaaguuuuga

SEQ ID NO: 62943 - RNA, 64 nt, Homo Sapiens
uaggagcagggguuuuuaggucugcuuuaaaugggaaaacaacgacugcccccuggcugaagag

SEQ ID NO: 62944 - RNA, 64 nt, Homo Sapiens
aucugugaguuuaggagucugagauaaauagguugaaaacaaucuucugaucauugaggauggu

SEQ ID NO: 62945 - RNA, 64 nt, Homo Sapiens
uauuaccccagggcccaacauacuuauucugccugaaaacaauguguaaaguaagggauagucu

SEQ ID NO: 62946 - RNA, 64 nt, Homo Sapiens
uguuucacuaggaacaccucauacauuuugaggagaaaacaaagaaggaguaaacagcuuauuu

SEQ ID NO: 62947 - RNA, 64 nt, Homo Sapiens
auaauaaccagugcugugaaaaagauuuuauaaggaaaacaaauguacacaauuuauaaaguaa

SEQ ID NO: 62948 - RNA, 64 nt, Homo Sapiens
gaaauuuaaaucuccaaauauaaccuaacugcuggaaaacaagguauaggcuuccaacaccaaa

SEQ ID NO: 62949 - RNA, 64 nt, Homo Sapiens
caugugcaaagcaagcaaggaacauuugggguaagaaaacaaacaugaggcaaaagaaaaaaua

SEQ ID NO: 62950 - RNA, 64 nt, Homo Sapiens
ucagcagacauucacucuggcugcugggacaucagaaaacaaagucuucaucucucucuccagu

SEQ ID NO: 62951 - RNA, 64 nt, Homo Sapiens
ugacgaggaagguucuguuuugaguauagccagagaaaacaaggauggagaaaaaucuaggaca

SEQ ID NO: 62952 - RNA, 64 nt, Homo Sapiens
ugacgaggaagauucuguuuuggguauagccagagaaaacaaggauggagaaaaaucuaggaca

SEQ ID NO: 62953 - RNA, 64 nt, Homo Sapiens
auguacuuagugacuugacugagaaguuaggguagaaaacaaaaagggaguggauucugggagc

SEQ ID NO: 62954 - RNA, 64 nt, Homo Sapiens
augcuuucauaguuucagauaugguaguuaugaagaaaacaaugucauuugcugcuauuauugu

SEQ ID NO: 62955 - RNA, 64 nt, Homo Sapiens
cuggacagaaacaggaaugugagggaccuuuaaagaaaacaaaacugcacccgggugggggaca

SEQ ID NO: 62956 - RNA, 64 nt, Homo Sapiens
aucaaagaucuaauaauacaugacacgaggcacagaaaacaaaugccgagcugccgaauucagu

SEQ ID NO: 62957 - RNA, 64 nt, Homo Sapiens
aacuucugacucugagggguccuguuccaauucggaaaacaauaggggaaagccacaaaagcac

SEQ ID NO: 62958 - RNA, 64 nt, Homo Sapiens
aguuacucaggaaucaaaagagaaaaaaguuucugaaaacaaugaaaccauaaaagauaauauu

SEQ ID NO: 62959 - RNA, 64 nt, Homo Sapiens
caagcagcaucuuauguccugauuucauauaguagaaaacaaacauuggguccgacuucaaaau

SEQ ID NO: 62960 - RNA, 64 nt, Homo Sapiens
ggggcuuacuggaaucgucauaucucugaauauugaaaacaacaacuaaaaaaguggaccuucu

SEQ ID NO: 62961 - RNA, 64 nt, Homo Sapiens
acuguacacagcuccuucuguaaggcuggucuuagaaaacaaguacuuuaguaucaggacagga

SEQ ID NO: 62962 - RNA, 64 nt, Homo Sapiens
gaguaugguggcaauaucacaagggaggagagaggaaaacaauuaucuucucuacuuggauuau

SEQ ID NO: 62963 - RNA, 64 nt, Homo Sapiens
uuuaaagggauugugucuaucugacaugauggaggaaaacaaccaauuuuaguuauguaacaac

SEQ ID NO: 62964 - RNA, 64 nt, Homo Sapiens
guuacaguuuuauugcucuguuuacaguauuugggaaaacaacuuugcuggucagucuuagugu

SEQ ID NO: 62965 - RNA, 64 nt, Homo Sapiens
auuuuagaagagucaacucuuaagauuaucauuagaaaacaaauacgucaacaccuaugaaaag

SEQ ID NO: 62966 - RNA, 64 nt, Homo Sapiens
aacaaauacgucaacaccuaugaaaagaagcggggaaaacaacaacaaggacaacaacaaaaaa

SEQ ID NO: 62967 - RNA, 64 nt, Homo Sapiens
gguaauaaaggcaauuggaugauaucuguaggaggaaaacaaugacuaauuucuuccuuuugaa

SEQ ID NO: 62968 - RNA, 64 nt, Homo Sapiens
aaauaguuuuuagaacuuuuuguuuaauucugaagaaaacaauauauaugguuuacuucucgaa

SEQ ID NO: 62969 - RNA, 64 nt, Homo Sapiens
gaaccaugccuucauaauucucgaaaaggaaucugaaaacaauggugacagaagagaccuuguc

SEQ ID NO: 62970 - RNA, 64 nt, Homo Sapiens
uggaaguccagugaugggaaaacagugaaaaauugaaaacaaccaauguugccaccuuguuugu

SEQ ID NO: 62971 - RNA, 64 nt, Homo Sapiens
gcauguuuuucuaauaaauuuauauauuuguaaagaaaacaacagaaaucuuuaugcaauuugu

SEQ ID NO: 62972 - RNA, 64 nt, Homo Sapiens
aguauuuggcucuaggaaacauuuacuuguuugugaaaacaauaccccaagguaauaggaaaag

SEQ ID NO: 62973 - RNA, 64 nt, Homo Sapiens
uagagguaaauaucacauuaauggaagccauuaggaaaacaaacuuuauugugaggaccuucuc

SEQ ID NO: 62974 - RNA, 64 nt, Homo Sapiens
ugcuacuuguuaccucuauuauuucuuguuacaugaaaacaaaacugacugagaaccugcagcc

SEQ ID NO: 62975 - RNA, 64 nt, Homo Sapiens
ugauaugcuucaauuuuguaagcuauguuuuagagaaaacaauuuuuucuacuauuccuuucug

SEQ ID NO: 62976 - RNA, 64 nt, Homo Sapiens
acaaugaaaauauucauauuugcaucuugcuacugaaaacaaaaagacaguuauuuguuucuuc

SEQ ID NO: 62977 - RNA, 64 nt, Homo Sapiens
uuauuguuaaaggccuuuuauggaaaccaacuuggaaaacaaccuuaaauguggauguaucaga

SEQ ID NO: 62978 - RNA, 64 nt, Homo Sapiens
auguaucagauuugguuuauccagccaugggagagaaaacaaaccuaaguuuacuuuacuugua

SEQ ID NO: 62979 - RNA, 64 nt, Homo Sapiens
ugcacagccugaauggacguaagaaagaagcaacgaaaacaaaacuccagagacuggcucaaaa

SEQ ID NO: 62980 - RNA, 64 nt, Homo Sapiens
guaguuuccacagugugaggagggcacucaaggggaaaacaaauggaagcaggcuguagauuua

SEQ ID NO: 62981 - RNA, 64 nt, Homo Sapiens
uaaauguaguugucacacuauucaaucuguguaagaaaacaaacaacugucauaauggugaaug

SEQ ID NO: 62982 - RNA, 64 nt, Homo Sapiens
ugaggagacauucugucuuuugucuagaaaguaagaaaacaauaugauggcaaggugcuuguua

SEQ ID NO: 62983 - RNA, 64 nt, Homo Sapiens
uccaaauccacagcuuuuacgugauuuuguauaugaaaacaagucuuuagaauucuaauuguca

SEQ ID NO: 62984 - RNA, 64 nt, Homo Sapiens
acaacaguccuacuccgaugaagaaucaaaagcagaaaacaaaagauauguuuuucuuucccuu

SEQ ID NO: 62985 - RNA, 64 nt, Homo Sapiens
ccuaaacacaaagcaucaguuaugagccuuuaaggaaaacaaacaaaauauuugccaucuuuau

SEQ ID NO: 62986 - RNA, 64 nt, Homo Sapiens
aagucaaagcaaggaaacuauaaugaagaaaguggaaaacaaggacuccaguuaaaaaaaauuu

SEQ ID NO: 62987 - RNA, 64 nt, Homo Sapiens
auucacaacuuguuuuuggucagcacugcuugaggaaaacaagccuucaaacuagggccaagcc

SEQ ID NO: 62988 - RNA, 64 nt, Homo Sapiens
acuagauggguauguguguuuugggaaaugugaugaaaacaaagcacauugacaugcgaucagu

SEQ ID NO: 62989 - RNA, 64 nt, Homo Sapiens
caaacuuguucuuugcagcucuaaauuuaaaaaggaaaacaaaaaauguguuguaaacaagauu

SEQ ID NO: 62990 - RNA, 64 nt, Homo Sapiens
augcaucuaugugguugaaauggcuuucugguuugaaaacaaaacuuuaaagaguuaguguuaa

SEQ ID NO: 62991 - RNA, 64 nt, Homo Sapiens
uaacuauuuuuaaagugguuauuuacuuaaucuggaaaacaauguguauucuccuaacugaaau

SEQ ID NO: 62992 - RNA, 64 nt, Homo Sapiens
uuagagcaaagcugaccugguugugaaaacaaaugaaaacaaaaagagaguucucccuccacga

SEQ ID NO: 62993 - RNA, 64 nt, Homo Sapiens
gaaaacaaaauuagagcaaacccuccacgauugugaaaacaaauccaagccuccagagaguucu

SEQ ID NO: 62994 - RNA, 64 nt, Homo Sapiens
guauaaaauuccauuuuuuccugucaaaauuuaagaaaacaaauuuuaacuuucugaagaauau

SEQ ID NO: 62995 - RNA, 64 nt, Homo Sapiens
aaaccuaggagauaaauguaaaucacaauauuccgaaaacaaaauugguuuggucuuuauuaaa

SEQ ID NO: 62996 - RNA, 64 nt, Homo Sapiens
auggcaaugacuuauauucaucaugagauguaaagaaaacaauaguguuuaauauugaagugga

SEQ ID NO: 62997 - RNA, 64 nt, Homo Sapiens
uaauucugauugugucgugcuacucugaauuuuagaaaacaaacgcuacuuuuaaaaucccaga

SEQ ID NO: 62998 - RNA, 64 nt, Homo Sapiens
cugcagaagguguauguuggggagaacugaaagggaaaacaaaauacuugacauagucuuaagu

SEQ ID NO: 62999 - RNA, 64 nt, Homo Sapiens
uugacauagucuuaaguagaagaaggcaguuagagaaaacaaaguaucuacuggccuugucaac

SEQ ID NO: 63000 - RNA, 64 nt, Homo Sapiens
uacaaauuugaaacuuucauaauuguauuaaucagaaaacaagcacauugccauucuuugaaac

SEQ ID NO: 63001 - RNA, 64 nt, Homo Sapiens
auguuucuagacaugacagcaguaauaaaaggaugaaaacaagugucuucacuaagcguauggc

SEQ ID NO: 63002 - RNA, 64 nt, Homo Sapiens
uuuuuuaaagccucauucucguaacaaaaagaaagaaaacaacugugauuggaaauuuuuagcu

SEQ ID NO: 63003 - RNA, 64 nt, Homo Sapiens
auuuuauaauauuuaacccacucuguauugaccagaaaacaauguuauuuuuauuuucucccug

SEQ ID NO: 63004 - RNA, 64 nt, Homo Sapiens
aaauauucacuaauggugccacagcaucguuuaugaaaacaacuuauguacaugagucuucauc

SEQ ID NO: 63005 - RNA, 64 nt, Homo Sapiens
uguaucuccuaggauggcuguguaaaugcaggaugaaaacaauaucuguuuucauuucuuuuuc

SEQ ID NO: 63006 - RNA, 64 nt, Homo Sapiens
uuuguuuaguauaaauugucauagcugguuuacugaaaacaaacacauuuaaaauugguuuacc

SEQ ID NO: 63007 - RNA, 64 nt, Homo Sapiens
cccagcaccaaccucugagcccaagaccuugccugaaaacaagcagauaccgauugcuucaucc

SEQ ID NO: 63008 - RNA, 64 nt, Homo Sapiens
uucuggugggugcauuuucucuuucugagagauggaaaacaagcaaacaacuguuuaguggaaa

SEQ ID NO: 63009 - RNA, 64 nt, Homo Sapiens
ugaaaucauaccucagcucagcugaaagaucuccgaaaacaaagcaaauuuuuuucauguagga

SEQ ID NO: 63010 - RNA, 64 nt, Homo Sapiens
aggugcagugucaguuucaaaucaaauuaucuaagaaaacaagaaaacaaaggcagcagacuau

SEQ ID NO: 63011 - RNA, 64 nt, Homo Sapiens
ugucaguuucaaaucaaauuaucuaagaaaacaagaaaacaaaggcagcagacuauugguacac

SEQ ID NO: 63012 - RNA, 64 nt, Homo Sapiens
aucugaaagaaacgucuuuacaauuuuuaaaauggaaaacaaaaccuccaaguagcuccaaaug

SEQ ID NO: 63013 - RNA, 64 nt, Homo Sapiens
cgacucacaaaccuccaaguauaucugaaaugaagaaaacaaacgaaaaaguuccaugacucga

SEQ ID NO: 63014 - RNA, 64 nt, Homo Sapiens
ucaaggggacgcugugugugcugcaagugaccccgaaaacaaccacagccgucacaugguccuc

SEQ ID NO: 63015 - RNA, 64 nt, Homo Sapiens
acaugcucuguuuacaucgauaaaugcacuuaaggaaaacaaacaaauuaaagcucaucuuaaa

SEQ ID NO: 63016 - RNA, 64 nt, Homo Sapiens
ggcuggucaugagagcaaaccguaguccccuggagacagcgacuccagagaaccucuugggaga

SEQ ID NO: 63017 - RNA, 64 nt, Homo Sapiens
cuuguguauugcauuccagcagaccacugaaccagacagcgaagccaagaucauuguucuacuu

SEQ ID NO: 63018 - RNA, 64 nt, Homo Sapiens
cccuuuccauuuccucucauuccauucauggguggacagcgaccacaaagacucauggggcuuc

SEQ ID NO: 63019 - RNA, 64 nt, Homo Sapiens
agcugagauugugccacugcacuccagccugggugacagcgagacccugucucaaaauauguau

SEQ ID NO: 63020 - RNA, 64 nt, Homo Sapiens
ccuccuggcuccaagcuaagucacucaacagaaugacagcgaaccuccuggacccucaccauau

SEQ ID NO: 63021 - RNA, 64 nt, Homo Sapiens
cgggcagcuggggggcugagaaucagaaauugaggacagcgaugggaggaagaggaggcgaggg

SEQ ID NO: 63022 - RNA, 64 nt, Homo Sapiens
ccugguucuuaagcaaauucugcaggagcggagggacagcgacaugaaauagcaaauagaaaug

SEQ ID NO: 63023 - RNA, 64 nt, Homo Sapiens
caguacuuaagugucuguguacaggccgcugcaugacagcgauaagccacccccaggggccucc

SEQ ID NO: 63024 - RNA, 64 nt, Homo Sapiens
ucugaauguuugaacugccaagaaaaggcauggagacagcgaacuagaagaaagggcaagaagg

SEQ ID NO: 63025 - RNA, 64 nt, Homo Sapiens
gagcacccuccacauggacucccaccugcaaguggacagcgacauucaguccugcacugcucac

SEQ ID NO: 63026 - RNA, 56 nt, Homo Sapiens
ugccccucucacacaugugagggccggacagcgaacuggaggggggagaaauuuuc

SEQ ID NO: 63027 - RNA, 64 nt, Homo Sapiens
ccucagccgccucuguugcucagcagccggaggugacagcgacgcucggcucgggguuuuacug

SEQ ID NO: 63028 - RNA, 64 nt, Homo Sapiens
uuuccgaaaauggaggcauuccuuuccaaaucuggacagcgaucguuuuuaguguuucugucuc

SEQ ID NO: 63029 - RNA, 64 nt, Homo Sapiens
uaguguuuuguuugauaaagauuuuuaauguagugacagcgauucauucacaaaaauuaauaua

SEQ ID NO: 63030 - RNA, 64 nt, Homo Sapiens
uguuuccuuauaccagauccucagucucacuaaagacagcgauaugggagacacccaggggccu

SEQ ID NO: 63031 - RNA, 64 nt, Homo Sapiens
cgggcuugguuuugugaggucugagugaguggcugacagcgaucccgaggagcuccaugcggca

SEQ ID NO: 63032 - RNA, 64 nt, Homo Sapiens
gaaaaccucaagggcuuuccucgugcuuccuccugacagcgacacuggauuccauaaacaguuu

SEQ ID NO: 63033 - RNA, 64 nt, Homo Sapiens
acagcaaacagauuuuauuacagcccuaucuggagacagcgaauuuccucaugugguguaauua

SEQ ID NO: 63034 - RNA, 64 nt, Homo Sapiens
guuucugaucuuguuuucccuguggauauuggaggacagcgagguucuuucugauacuaaaaac

SEQ ID NO: 63035 - RNA, 64 nt, Homo Sapiens
ccuuccccauagagaccgugaaucacagcugauagacagcgaaguuaaagauuuuauuuuuaca

SEQ ID NO: 63036 - RNA, 64 nt, Homo Sapiens
gggggccuccaugccuucaccggagccguggggggacagcgacuggacaggugaggggcucgga

SEQ ID NO: 63037 - RNA, 64 nt, Homo Sapiens
uaauuuuauuacauaugauuucuuugcuguuauugacagcgauauuaaaauuaauauaucauua

SEQ ID NO: 63038 - RNA, 64 nt, Homo Sapiens
agauggugugaaaagcuugccuagcauagagacagacagcgaaguguagaguugugugaaaccc

SEQ ID NO: 63039 - RNA, 64 nt, Homo Sapiens
ucuuugcaaccucccagcugcgcucauuccagcugacagcgagaugcaagcaaaugcucagcuc

SEQ ID NO: 63040 - RNA, 64 nt, Homo Sapiens
ucggagggagcagcggaaugcggcgaagacucuggacagcgagggcacagggucccaaaccgag

SEQ ID NO: 63041 - RNA, 64 nt, Homo Sapiens
aacaaacuuucuucacuuuguauuauagguacaagacagcgacuuacguaucuuuucuccuccu

SEQ ID NO: 63042 - RNA, 64 nt, Homo Sapiens
uugaggaagguauucugucccacagguuucuguggacagcgauacagcaggagucagugaaauc

SEQ ID NO: 63043 - RNA, 64 nt, Homo Sapiens
aaccugaggccgugucuaggugcuggaggacauggacagcgacauuguggucugguaagagggg

SEQ ID NO: 63044 - RNA, 64 nt, Homo Sapiens
aggggacauuuucuggauucgccaggagcagauggacagcgaugcuucuacauuugagggccca

SEQ ID NO: 63045 - RNA, 64 nt, Homo Sapiens
agcuuucaauaguggcauaccugaaggagaaaaagacagcgauagcuucauugaccucuacuug

SEQ ID NO: 63046 - RNA, 64 nt, Homo Sapiens
cauguguggcccugucugcuuauccuuggaaggugacagcgauucccuguguagcucucacaug

SEQ ID NO: 63047 - RNA, 64 nt, Homo Sapiens
aucgagcucagguucgccacagaccaggaggacugacagcgaaggggucggcggcccucaggag

SEQ ID NO: 63048 - RNA, 64 nt, Homo Sapiens
gaaguuaucugcugggaacacagccuugaucagugacagcgaagacaguaauaggcacuggguc

SEQ ID NO: 63049 - RNA, 64 nt, Homo Sapiens
ucagcagccccggaagccugccucacccgacgaggacagcgagcggcccggcuccuuucugucu

SEQ ID NO: 63050 - RNA, 64 nt, Homo Sapiens
agaaaggaagagaaaugcaaaauggaggauggaggacagcgagacugggcuaggaguuggacgg

SEQ ID NO: 63051 - RNA, 64 nt, Homo Sapiens
accacacguagcccccaggcugcuggacacgucggacagcgaaguauccccgacaggacgggcu

SEQ ID NO: 63052 - RNA, 64 nt, Homo Sapiens
caguuugugguuaugaaaccgucuguggccucaugacagcgagagaugggaauacacuagaagg

SEQ ID NO: 63053 - RNA, 64 nt, Homo Sapiens
cucuaucucaaaaaaaaaaaacugcugccugggcgacagcgagaagccaagaucacagcacugc

SEQ ID NO: 63054 - RNA, 64 nt, Homo Sapiens
gcaggccugacccacggggcgcuauucccauugugacagcgauggcucugggagagccagcuuu

SEQ ID NO: 63055 - RNA, 64 nt, Homo Sapiens
acagcaggcaaguuccacagacuggggccugcuggacagcgaggggagggugagaucaacacgu

SEQ ID NO: 63056 - RNA, 64 nt, Homo Sapiens
cuuucccagagcugaaguuacaaguaaaagacaugacagcgauauaacaagccaaaugaacaga

SEQ ID NO: 63057 - RNA, 64 nt, Homo Sapiens
ggaaaaaugcccuuaaaucauuuccacgccgaaggacagcgaugggaccuaguacccacugaga

SEQ ID NO: 63058 - RNA, 64 nt, Homo Sapiens
ugggcaccugggagcaccaggugaugaggagguggacagcgagcgcaccagcacggcuaugaca

SEQ ID NO: 63059 - RNA, 64 nt, Homo Sapiens
ucggauagcacagccagcuaccugcucugauuaggacagcgaccccuguccuggcucucccggc

SEQ ID NO: 63060 - RNA, 64 nt, Homo Sapiens
ucuggcuuauaagaguucucacuagcucuuacuggacagcgauucacaaagcaaacuacuaacc

SEQ ID NO: 63061 - RNA, 64 nt, Homo Sapiens
gcauguccaucuguuggacaauggcuacuguacugacagcgagaggcgucacuguauguaguuc

SEQ ID NO: 63062 - RNA, 64 nt, Homo Sapiens
cuccuguguaccaagguauugcuuuuauuuacacgacagcgacucaaaaggcacucgauuaaug

SEQ ID NO: 63063 - RNA, 64 nt, Homo Sapiens
cuugcuuuuccugugcacacauguagcccaucaggacagcgagccgacgggucacgccaggggc

SEQ ID NO: 63064 - RNA, 64 nt, Homo Sapiens
gggccacccccaaguguugggccaucugccaagagacagcgacccaaagccgaaggacaggugg

SEQ ID NO: 63065 - RNA, 64 nt, Homo Sapiens
augggguaaggagaggccccagaaccccaaagcagacagcgagacccccagcggcagaggccuc

SEQ ID NO: 63066 - RNA, 64 nt, Homo Sapiens
guccuguaaacugugccaacuucaccuguccagggacagcgaagcuggggguggcggggggcau

SEQ ID NO: 63067 - RNA, 64 nt, Homo Sapiens
ggacgcuuagagucggcagagucugggguagggagacagcgacuuguccaaggucaagcacaga

SEQ ID NO: 63068 - RNA, 64 nt, Homo Sapiens
gccccaggaagguuugcacaagaguccaccugcagacagcgagaugguccccaugaaggcauuc

SEQ ID NO: 63069 - RNA, 64 nt, Homo Sapiens
uucucuauuggcauuuuuccgauucuguucagaugacagcgaccgccuuuucauuccccccgcc

SEQ ID NO: 63070 - RNA, 64 nt, Homo Sapiens
ggccgggaucguacuacugcacuccagcauggaagacagcgagacuccgucuccaaaaaaaaaa

SEQ ID NO: 63071 - RNA, 64 nt, Homo Sapiens
cgcagggggcucggaggacugccccgcagagcuggacagcgacauuggccucgguggcagggga

SEQ ID NO: 63072 - RNA, 64 nt, Homo Sapiens
ucaaauaggaaaaaaaauguccagcacuacaaagaucgcauagaaaucuugcaagauuuguaga

SEQ ID NO: 63073 - RNA, 64 nt, Homo Sapiens
aggaguuuuccagaaugcaauuccgagugagcaaaucgcauagcuguagaaugugcgugcuuuu

SEQ ID NO: 63074 - RNA, 64 nt, Homo Sapiens
cucuauuuuuaguuugcugaagacuugaaagugaaucgcauauaucaugacacuucuuggagug

SEQ ID NO: 63075 - RNA, 64 nt, Homo Sapiens
ccuagacuuagacuugauuucuuaacauuaggguaucgcauacucaaaugguagacaaugaccc

SEQ ID NO: 63076 - RNA, 64 nt, Homo Sapiens
aguuaaucuccucagacaguccaagacaucauguaucgcauauuugaauuaaacaugaaagaac

SEQ ID NO: 63077 - RNA, 64 nt, Homo Sapiens
accaucuuuccaucaaaucaaauuuauaccacauaucgcauauguauucuccauagauugaaga

SEQ ID NO: 63078 - RNA, 64 nt, Homo Sapiens
auccuuuaggucauuuucucuuuggauaauuuucaucgcauauccagcaacuauagaccaaagu

SEQ ID NO: 63079 - RNA, 64 nt, Homo Sapiens
agaggaaaaaaacaaaacucuggaacccugucaaaucgcauaaagcagauuuuuuuguucucag

SEQ ID NO: 63080 - RNA, 64 nt, Homo Sapiens
cugcauuucacguuuuauuguuuuagauuacacgaucgcauaugaauaaguuaucaugaaaagu

SEQ ID NO: 63081 - RNA, 64 nt, Homo Sapiens
gauauucuaagucguugaggcugaucuauuuauuaucgcauacacacacugccuuauuacauaa

SEQ ID NO: 63082 - RNA, 64 nt, Homo Sapiens
ccuacacaggacagggguuccuucugggcauuacaucgcauagaaaucaauaauuuguggugau

SEQ ID NO: 63083 - RNA, 64 nt, Homo Sapiens
gcugaguuuucuauuuuugccucuaccccgcuguaucgcauauuccccucuguuuacaucuccc

SEQ ID NO: 63084 - RNA, 64 nt, Homo Sapiens
guucagagacuggaaacugaaaugauaggagauuaucgcauagaacaagaaagcauguagcccu

SEQ ID NO: 63085 - RNA, 64 nt, Homo Sapiens
uguaucaaaauaucucauguuguaauuauuauaaaucgcauaccaagcaguagauacacccuga

SEQ ID NO: 63086 - RNA, 64 nt, Homo Sapiens
aaaucgugugaaaauggguuggaacccaucagugaucgcauauucauugaugaggguuugcuug

SEQ ID NO: 63087 - RNA, 64 nt, Homo Sapiens
ucaguccuguuacaaaauagauaacugagcaccuaucgcauaacauuuugcgguggcuuuuagc

SEQ ID NO: 63088 - RNA, 64 nt, Homo Sapiens; identical to SEQ ID NO: 61352

SEQ ID NO: 63089 - RNA, 64 nt, Homo Sapiens; identical to SEQ ID NO: 61353

SEQ ID NO: 63090 - RNA, 64 nt, Homo Sapiens; identical to SEQ ID NO: 61354

SEQ ID NO: 63091 - RNA, 64 nt, Homo Sapiens; identical to SEQ ID NO: 61355

SEQ ID NO: 63092 - RNA, 64 nt, Homo Sapiens; identical to SEQ ID NO: 61356

SEQ ID NO: 63093 - RNA, 64 nt, Homo Sapiens; identical to SEQ ID NO: 61357

SEQ ID NO: 63094 - RNA, 64 nt, Homo Sapiens; identical to SEQ ID NO: 61358

SEQ ID NO: 63095 - RNA, 64 nt, Homo Sapiens; identical to SEQ ID NO: 61359

SEQ ID NO: 63096 - RNA, 64 nt, Homo Sapiens; identical to SEQ ID NO: 61360

SEQ ID NO: 63097 - RNA, 64 nt, Homo Sapiens; identical to SEQ ID NO: 61361

SEQ ID NO: 63098 - RNA, 64 nt, Homo Sapiens; identical to SEQ ID NO: 61362

SEQ ID NO: 63099 - RNA, 64 nt, Homo Sapiens; identical to SEQ ID NO: 61363

SEQ ID NO: 63100 - RNA, 64 nt, Homo Sapiens; identical to SEQ ID NO: 61364

SEQ ID NO: 63101 - RNA, 64 nt, Homo Sapiens; identical to SEQ ID NO: 61365

SEQ ID NO: 63102 - RNA, 64 nt, Homo Sapiens; identical to SEQ ID NO: 61366

SEQ ID NO: 63103 - RNA, 64 nt, Homo Sapiens; identical to SEQ ID NO: 61367

SEQ ID NO: 63104 - RNA, 64 nt, Homo Sapiens; identical to SEQ ID NO: 61368

SEQ ID NO: 63105 - RNA, 56 nt, Homo Sapiens; identical to SEQ ID NO: 61369

SEQ ID NO: 63106 - RNA, 64 nt, Homo Sapiens; identical to SEQ ID NO: 61370

SEQ ID NO: 63107 - RNA, 64 nt, Homo Sapiens; identical to SEQ ID NO: 61371

SEQ ID NO: 63108 - RNA, 64 nt, Homo Sapiens; identical to SEQ ID NO: 61372

SEQ ID NO: 63109 - RNA, 64 nt, Homo Sapiens; identical to SEQ ID NO: 61373

SEQ ID NO: 63110 - RNA, 64 nt, Homo Sapiens; identical to SEQ ID NO: 61374

SEQ ID NO: 63111 - RNA, 64 nt, Homo Sapiens; identical to SEQ ID NO: 61375

SEQ ID NO: 63112 - RNA, 63 nt, Homo Sapiens; identical to SEQ ID NO: 57669

SEQ ID NO: 63113 - RNA, 63 nt, Homo Sapiens; identical to SEQ ID NO: 57670

SEQ ID NO: 63114 - RNA, 63 nt, Homo Sapiens; identical to SEQ ID NO: 57671

SEQ ID NO: 63115 - RNA, 63 nt, Homo Sapiens; identical to SEQ ID NO: 57672

SEQ ID NO: 63116 - RNA, 63 nt, Homo Sapiens; identical to SEQ ID NO: 57673

SEQ ID NO: 63117 - RNA, 63 nt, Homo Sapiens; identical to SEQ ID NO: 57674

SEQ ID NO: 63118 - RNA, 63 nt, Homo Sapiens; identical to SEQ ID NO: 57675

SEQ ID NO: 63119 - RNA, 63 nt, Homo Sapiens; identical to SEQ ID NO: 57676

SEQ ID NO: 63120 - RNA, 63 nt, Homo Sapiens; identical to SEQ ID NO: 57677

SEQ ID NO: 63121 - RNA, 63 nt, Homo Sapiens; identical to SEQ ID NO: 57678

SEQ ID NO: 63122 - RNA, 63 nt, Homo Sapiens; identical to SEQ ID NO: 57679

SEQ ID NO: 63123 - RNA, 63 nt, Homo Sapiens; identical to SEQ ID NO: 57680

SEQ ID NO: 63124 - RNA, 63 nt, Homo Sapiens; identical to SEQ ID NO: 57681

SEQ ID NO: 63125 - RNA, 63 nt, Homo Sapiens; identical to SEQ ID NO: 57682

SEQ ID NO: 63126 - RNA, 63 nt, Homo Sapiens; identical to SEQ ID NO: 57683

SEQ ID NO: 63127 - RNA, 63 nt, Homo Sapiens; identical to SEQ ID NO: 57684

SEQ ID NO: 63128 - RNA, 63 nt, Homo Sapiens; identical to SEQ ID NO: 57685

SEQ ID NO: 63129 - RNA, 63 nt, Homo Sapiens; identical to SEQ ID NO: 57686

SEQ ID NO: 63130 - RNA, 63 nt, Homo Sapiens; identical to SEQ ID NO: 57687

SEQ ID NO: 63131 - RNA, 63 nt, Homo Sapiens; identical to SEQ ID NO: 57688

SEQ ID NO: 63132 - RNA, 63 nt, Homo Sapiens; identical to SEQ ID NO: 57689

SEQ ID NO: 63133 - RNA, 63 nt, Homo Sapiens; identical to SEQ ID NO: 57690

SEQ ID NO: 63134 - RNA, 63 nt, Homo Sapiens; identical to SEQ ID NO: 57691

SEQ ID NO: 63135 - RNA, 63 nt, Homo Sapiens; identical to SEQ ID NO: 57692

SEQ ID NO: 63136 - RNA, 63 nt, Homo Sapiens; identical to SEQ ID NO: 57693

SEQ ID NO: 63137 - RNA, 63 nt, Homo Sapiens; identical to SEQ ID NO: 57694

SEQ ID NO: 63138 - RNA, 63 nt, Homo Sapiens; identical to SEQ ID NO: 57695

SEQ ID NO: 63139 - RNA, 63 nt, Homo Sapiens; identical to SEQ ID NO: 57696

SEQ ID NO: 63140 - RNA, 63 nt, Homo Sapiens; identical to SEQ ID NO: 57697

SEQ ID NO: 63141 - RNA, 63 nt, Homo Sapiens; identical to SEQ ID NO: 57698

SEQ ID NO: 63142 - RNA, 63 nt, Homo Sapiens; identical to SEQ ID NO: 57699

SEQ ID NO: 63143 - RNA, 63 nt, Homo Sapiens; identical to SEQ ID NO: 57700

SEQ ID NO: 63144 - RNA, 63 nt, Homo Sapiens; identical to SEQ ID NO: 57701

SEQ ID NO: 63145 - RNA, 63 nt, Homo Sapiens; identical to SEQ ID NO: 57702

SEQ ID NO: 63146 - RNA, 63 nt, Homo Sapiens; identical to SEQ ID NO: 57703

SEQ ID NO: 63147 - RNA, 63 nt, Homo Sapiens; identical to SEQ ID NO: 57704

SEQ ID NO: 63148 - RNA, 63 nt, Homo Sapiens; identical to SEQ ID NO: 57705

SEQ ID NO: 63149 - RNA, 63 nt, Homo Sapiens; identical to SEQ ID NO: 57706

SEQ ID NO: 63150 - RNA, 63 nt, Homo Sapiens; identical to SEQ ID NO: 57707

SEQ ID NO: 63151 - RNA, 63 nt, Homo Sapiens; identical to SEQ ID NO: 57708

SEQ ID NO: 63152 - RNA, 63 nt, Homo Sapiens; identical to SEQ ID NO: 57709

SEQ ID NO: 63153 - RNA, 63 nt, Homo Sapiens; identical to SEQ ID NO: 57710

SEQ ID NO: 63154 - RNA, 63 nt, Homo Sapiens; identical to SEQ ID NO: 57711

SEQ ID NO: 63155 - RNA, 63 nt, Homo Sapiens; identical to SEQ ID NO: 57712

SEQ ID NO: 63156 - RNA, 63 nt, Homo Sapiens; identical to SEQ ID NO: 57713

SEQ ID NO: 63157 - RNA, 63 nt, Homo Sapiens; identical to SEQ ID NO: 57714

SEQ ID NO: 63158 - RNA, 63 nt, Homo Sapiens; identical to SEQ ID NO: 57715

SEQ ID NO: 63159 - RNA, 63 nt, Homo Sapiens; identical to SEQ ID NO: 57716

SEQ ID NO: 63160 - RNA, 63 nt, Homo Sapiens; identical to SEQ ID NO: 57717

SEQ ID NO: 63161 - RNA, 63 nt, Homo Sapiens; identical to SEQ ID NO: 57718

SEQ ID NO: 63162 - RNA, 63 nt, Homo Sapiens; identical to SEQ ID NO: 57719

SEQ ID NO: 63163 - RNA, 63 nt, Homo Sapiens; identical to SEQ ID NO: 57720

SEQ ID NO: 63164 - RNA, 63 nt, Homo Sapiens; identical to SEQ ID NO: 57721

SEQ ID NO: 63165 - RNA, 63 nt, Homo Sapiens; identical to SEQ ID NO: 57722

SEQ ID NO: 63166 - RNA, 63 nt, Homo Sapiens; identical to SEQ ID NO: 57723

SEQ ID NO: 63167 - RNA, 63 nt, Homo Sapiens; identical to SEQ ID NO: 57724

SEQ ID NO: 63168 - RNA, 63 nt, Homo Sapiens; identical to SEQ ID NO: 57725

SEQ ID NO: 63169 - RNA, 63 nt, Homo Sapiens; identical to SEQ ID NO: 57726

SEQ ID NO: 63170 - RNA, 63 nt, Homo Sapiens; identical to SEQ ID NO: 57727

SEQ ID NO: 63171 - RNA, 63 nt, Homo Sapiens; identical to SEQ ID NO: 57728

SEQ ID NO: 63172 - RNA, 63 nt, Homo Sapiens; identical to SEQ ID NO: 57729

SEQ ID NO: 63173 - RNA, 63 nt, Homo Sapiens; identical to SEQ ID NO: 57730

SEQ ID NO: 63174 - RNA, 63 nt, Homo Sapiens; identical to SEQ ID NO: 57731

SEQ ID NO: 63175 - RNA, 63 nt, Homo Sapiens; identical to SEQ ID NO: 57732

SEQ ID NO: 63176 - RNA, 63 nt, Homo Sapiens; identical to SEQ ID NO: 57733

SEQ ID NO: 63177 - RNA, 63 nt, Homo Sapiens; identical to SEQ ID NO: 57734

SEQ ID NO: 63178 - RNA, 63 nt, Homo Sapiens; identical to SEQ ID NO: 57735

SEQ ID NO: 63179 - RNA, 63 nt, Homo Sapiens; identical to SEQ ID NO: 57736

SEQ ID NO: 63180 - RNA, 63 nt, Homo Sapiens; identical to SEQ ID NO: 57737

SEQ ID NO: 63181 - RNA, 63 nt, Homo Sapiens; identical to SEQ ID NO: 57738

SEQ ID NO: 63182 - RNA, 63 nt, Homo Sapiens; identical to SEQ ID NO: 57739

SEQ ID NO: 63183 - RNA, 63 nt, Homo Sapiens; identical to SEQ ID NO: 57740

SEQ ID NO: 63184 - RNA, 63 nt, Homo Sapiens; identical to SEQ ID NO: 57741

SEQ ID NO: 63185 - RNA, 63 nt, Homo Sapiens; identical to SEQ ID NO: 57742

SEQ ID NO: 63186 - RNA, 63 nt, Homo Sapiens; identical to SEQ ID NO: 57743

SEQ ID NO: 63187 - RNA, 63 nt, Homo Sapiens; identical to SEQ ID NO: 57744

SEQ ID NO: 63188 - RNA, 63 nt, Homo Sapiens; identical to SEQ ID NO: 57745

SEQ ID NO: 63189 - RNA, 63 nt, Homo Sapiens; identical to SEQ ID NO: 57746

SEQ ID NO: 63190 - RNA, 63 nt, Homo Sapiens; identical to SEQ ID NO: 57747

SEQ ID NO: 63191 - RNA, 63 nt, Homo Sapiens; identical to SEQ ID NO: 57748

SEQ ID NO: 63192 - RNA, 63 nt, Homo Sapiens; identical to SEQ ID NO: 57749

SEQ ID NO: 63193 - RNA, 63 nt, Homo Sapiens; identical to SEQ ID NO: 57750

SEQ ID NO: 63194 - RNA, 63 nt, Homo Sapiens; identical to SEQ ID NO: 57751

SEQ ID NO: 63195 - RNA, 63 nt, Homo Sapiens; identical to SEQ ID NO: 57752

SEQ ID NO: 63196 - RNA, 63 nt, Homo Sapiens; identical to SEQ ID NO: 57753

SEQ ID NO: 63197 - RNA, 63 nt, Homo Sapiens; identical to SEQ ID NO: 57754

SEQ ID NO: 63198 - RNA, 63 nt, Homo Sapiens; identical to SEQ ID NO: 57755

SEQ ID NO: 63199 - RNA, 63 nt, Homo Sapiens; identical to SEQ ID NO: 57756

SEQ ID NO: 63200 - RNA, 63 nt, Homo Sapiens; identical to SEQ ID NO: 57757

SEQ ID NO: 63201 - RNA, 63 nt, Homo Sapiens; identical to SEQ ID NO: 57758

SEQ ID NO: 63202 - RNA, 63 nt, Homo Sapiens; identical to SEQ ID NO: 57759

SEQ ID NO: 63203 - RNA, 63 nt, Homo Sapiens; identical to SEQ ID NO: 57760

SEQ ID NO: 63204 - RNA, 63 nt, Homo Sapiens; identical to SEQ ID NO: 57761

SEQ ID NO: 63205 - RNA, 63 nt, Homo Sapiens; identical to SEQ ID NO: 57762

SEQ ID NO: 63206 - RNA, 63 nt, Homo Sapiens; identical to SEQ ID NO: 57763

SEQ ID NO: 63207 - RNA, 63 nt, Homo Sapiens; identical to SEQ ID NO: 57764

SEQ ID NO: 63208 - RNA, 63 nt, Homo Sapiens; identical to SEQ ID NO: 57765

SEQ ID NO: 63209 - RNA, 63 nt, Homo Sapiens; identical to SEQ ID NO: 57766

SEQ ID NO: 63210 - RNA, 63 nt, Homo Sapiens; identical to SEQ ID NO: 57767

SEQ ID NO: 63211 - RNA, 63 nt, Homo Sapiens; identical to SEQ ID NO: 57768

SEQ ID NO: 63212 - RNA, 63 nt, Homo Sapiens; identical to SEQ ID NO: 57769

SEQ ID NO: 63213 - RNA, 63 nt, Homo Sapiens; identical to SEQ ID NO: 57770

SEQ ID NO: 63214 - RNA, 63 nt, Homo Sapiens; identical to SEQ ID NO: 57771

SEQ ID NO: 63215 - RNA, 63 nt, Homo Sapiens; identical to SEQ ID NO: 57772

SEQ ID NO: 63216 - RNA, 63 nt, Homo Sapiens; identical to SEQ ID NO: 57773

SEQ ID NO: 63217 - RNA, 63 nt, Homo Sapiens; identical to SEQ ID NO: 57774

SEQ ID NO: 63218 - RNA, 63 nt, Homo Sapiens; identical to SEQ ID NO: 57775

SEQ ID NO: 63219 - RNA, 63 nt, Homo Sapiens; identical to SEQ ID NO: 57776

SEQ ID NO: 63220 - RNA, 63 nt, Homo Sapiens; identical to SEQ ID NO: 57777

SEQ ID NO: 63221 - RNA, 63 nt, Homo Sapiens; identical to SEQ ID NO: 57778

SEQ ID NO: 63222 - RNA, 63 nt, Homo Sapiens; identical to SEQ ID NO: 57779

SEQ ID NO: 63223 - RNA, 63 nt, Homo Sapiens; identical to SEQ ID NO: 57780

SEQ ID NO: 63224 - RNA, 63 nt, Homo Sapiens; identical to SEQ ID NO: 57781

SEQ ID NO: 63225 - RNA, 63 nt, Homo Sapiens; identical to SEQ ID NO: 57782

SEQ ID NO: 63226 - RNA, 63 nt, Homo Sapiens; identical to SEQ ID NO: 57783

SEQ ID NO: 63227 - RNA, 63 nt, Homo Sapiens; identical to SEQ ID NO: 57784

SEQ ID NO: 63228 - RNA, 63 nt, Homo Sapiens; identical to SEQ ID NO: 57785

SEQ ID NO: 63229 - RNA, 63 nt, Homo Sapiens; identical to SEQ ID NO: 57786

SEQ ID NO: 63230 - RNA, 63 nt, Homo Sapiens; identical to SEQ ID NO: 57787

SEQ ID NO: 63231 - RNA, 63 nt, Homo Sapiens; identical to SEQ ID NO: 57788

SEQ ID NO: 63232 - RNA, 63 nt, Homo Sapiens; identical to SEQ ID NO: 57789

SEQ ID NO: 63233 - RNA, 63 nt, Homo Sapiens; identical to SEQ ID NO: 57790

SEQ ID NO: 63234 - RNA, 63 nt, Homo Sapiens; identical to SEQ ID NO: 57791

SEQ ID NO: 63235 - RNA, 63 nt, Homo Sapiens; identical to SEQ ID NO: 57792

SEQ ID NO: 63236 - RNA, 63 nt, Homo Sapiens; identical to SEQ ID NO: 57793

SEQ ID NO: 63237 - RNA, 63 nt, Homo Sapiens; identical to SEQ ID NO: 57794

SEQ ID NO: 63238 - RNA, 51 nt, Homo Sapiens; identical to SEQ ID NO: 57795

SEQ ID NO: 63239 - RNA, 63 nt, Homo Sapiens; identical to SEQ ID NO: 57796

SEQ ID NO: 63240 - RNA, 63 nt, Homo Sapiens; identical to SEQ ID NO: 57797

SEQ ID NO: 63241 - RNA, 63 nt, Homo Sapiens; identical to SEQ ID NO: 57798

SEQ ID NO: 63242 - RNA, 63 nt, Homo Sapiens; identical to SEQ ID NO: 57799

SEQ ID NO: 63243 - RNA, 63 nt, Homo Sapiens; identical to SEQ ID NO: 57800

SEQ ID NO: 63244 - RNA, 63 nt, Homo Sapiens; identical to SEQ ID NO: 57801

SEQ ID NO: 63245 - RNA, 63 nt, Homo Sapiens; identical to SEQ ID NO: 57802

SEQ ID NO: 63246 - RNA, 63 nt, Homo Sapiens; identical to SEQ ID NO: 57803

SEQ ID NO: 63247 - RNA, 63 nt, Homo Sapiens; identical to SEQ ID NO: 57804

SEQ ID NO: 63248 - RNA, 63 nt, Homo Sapiens; identical to SEQ ID NO: 57805

SEQ ID NO: 63249 - RNA, 63 nt, Homo Sapiens; identical to SEQ ID NO: 57806

SEQ ID NO: 63250 - RNA, 63 nt, Homo Sapiens; identical to SEQ ID NO: 57807

SEQ ID NO: 63251 - RNA, 63 nt, Homo Sapiens; identical to SEQ ID NO: 57808

SEQ ID NO: 63252 - RNA, 63 nt, Homo Sapiens; identical to SEQ ID NO: 57809

SEQ ID NO: 63253 - RNA, 63 nt, Homo Sapiens; identical to SEQ ID NO: 57810

SEQ ID NO: 63254 - RNA, 63 nt, Homo Sapiens; identical to SEQ ID NO: 57811

SEQ ID NO: 63255 - RNA, 63 nt, Homo Sapiens; identical to SEQ ID NO: 57812

SEQ ID NO: 63256 - RNA, 63 nt, Homo Sapiens; identical to SEQ ID NO: 57813

SEQ ID NO: 63257 - RNA, 63 nt, Homo Sapiens; identical to SEQ ID NO: 57814

SEQ ID NO: 63258 - RNA, 63 nt, Homo Sapiens; identical to SEQ ID NO: 57815

SEQ ID NO: 63259 - RNA, 63 nt, Homo Sapiens; identical to SEQ ID NO: 57816

SEQ ID NO: 63260 - RNA, 63 nt, Homo Sapiens; identical to SEQ ID NO: 57817

SEQ ID NO: 63261 - RNA, 63 nt, Homo Sapiens; identical to SEQ ID NO: 57818

SEQ ID NO: 63262 - RNA, 63 nt, Homo Sapiens; identical to SEQ ID NO: 57819

SEQ ID NO: 63263 - RNA, 63 nt, Homo Sapiens; identical to SEQ ID NO: 57820

SEQ ID NO: 63264 - RNA, 63 nt, Homo Sapiens; identical to SEQ ID NO: 57821

SEQ ID NO: 63265 - RNA, 63 nt, Homo Sapiens; identical to SEQ ID NO: 57822

SEQ ID NO: 63266 - RNA, 63 nt, Homo Sapiens; identical to SEQ ID NO: 57823

SEQ ID NO: 63267 - RNA, 63 nt, Homo Sapiens; identical to SEQ ID NO: 57824

SEQ ID NO: 63268 - RNA, 63 nt, Homo Sapiens; identical to SEQ ID NO: 57825

SEQ ID NO: 63269 - RNA, 63 nt, Homo Sapiens; identical to SEQ ID NO: 57826

SEQ ID NO: 63270 - RNA, 63 nt, Homo Sapiens; identical to SEQ ID NO: 57827

SEQ ID NO: 63271 - RNA, 63 nt, Homo Sapiens; identical to SEQ ID NO: 57828

SEQ ID NO: 63272 - RNA, 63 nt, Homo Sapiens; identical to SEQ ID NO: 57829

SEQ ID NO: 63273 - RNA, 63 nt, Homo Sapiens; identical to SEQ ID NO: 57830

SEQ ID NO: 63274 - RNA, 63 nt, Homo Sapiens; identical to SEQ ID NO: 57831

SEQ ID NO: 63275 - RNA, 63 nt, Homo Sapiens; identical to SEQ ID NO: 57832

SEQ ID NO: 63276 - RNA, 63 nt, Homo Sapiens; identical to SEQ ID NO: 57833

SEQ ID NO: 63277 - RNA, 63 nt, Homo Sapiens; identical to SEQ ID NO: 57834

SEQ ID NO: 63278 - RNA, 63 nt, Homo Sapiens; identical to SEQ ID NO: 57835

SEQ ID NO: 63279 - RNA, 63 nt, Homo Sapiens; identical to SEQ ID NO: 57836

SEQ ID NO: 63280 - RNA, 63 nt, Homo Sapiens; identical to SEQ ID NO: 57837

SEQ ID NO: 63281 - RNA, 63 nt, Homo Sapiens; identical to SEQ ID NO: 57838

SEQ ID NO: 63282 - RNA, 63 nt, Homo Sapiens; identical to SEQ ID NO: 57839

SEQ ID NO: 63283 - RNA, 63 nt, Homo Sapiens; identical to SEQ ID NO: 57840

SEQ ID NO: 63284 - RNA, 63 nt, Homo Sapiens; identical to SEQ ID NO: 57841

SEQ ID NO: 63285 - RNA, 63 nt, Homo Sapiens; identical to SEQ ID NO: 57842

SEQ ID NO: 63286 - RNA, 63 nt, Homo Sapiens; identical to SEQ ID NO: 57843

SEQ ID NO: 63287 - RNA, 63 nt, Homo Sapiens; identical to SEQ ID NO: 57844

SEQ ID NO: 63288 - RNA, 63 nt, Homo Sapiens; identical to SEQ ID NO: 57845

SEQ ID NO: 63289 - RNA, 63 nt, Homo Sapiens; identical to SEQ ID NO: 57846

SEQ ID NO: 63290 - RNA, 63 nt, Homo Sapiens; identical to SEQ ID NO: 57847

SEQ ID NO: 63291 - RNA, 63 nt, Homo Sapiens; identical to SEQ ID NO: 57848

SEQ ID NO: 63292 - RNA, 63 nt, Homo Sapiens; identical to SEQ ID NO: 57849

SEQ ID NO: 63293 - RNA, 63 nt, Homo Sapiens; identical to SEQ ID NO: 57850

SEQ ID NO: 63294 - RNA, 63 nt, Homo Sapiens; identical to SEQ ID NO: 57851

SEQ ID NO: 63295 - RNA, 63 nt, Homo Sapiens; identical to SEQ ID NO: 57852

SEQ ID NO: 63296 - RNA, 63 nt, Homo Sapiens; identical to SEQ ID NO: 57853

SEQ ID NO: 63297 - RNA, 63 nt, Homo Sapiens; identical to SEQ ID NO: 57854

SEQ ID NO: 63298 - RNA, 63 nt, Homo Sapiens; identical to SEQ ID NO: 57855

SEQ ID NO: 63299 - RNA, 63 nt, Homo Sapiens; identical to SEQ ID NO: 57856

SEQ ID NO: 63300 - RNA, 63 nt, Homo Sapiens; identical to SEQ ID NO: 57857

SEQ ID NO: 63301 - RNA, 63 nt, Homo Sapiens; identical to SEQ ID NO: 57858

SEQ ID NO: 63302 - RNA, 63 nt, Homo Sapiens; identical to SEQ ID NO: 57859

SEQ ID NO: 63303 - RNA, 63 nt, Homo Sapiens; identical to SEQ ID NO: 57860

SEQ ID NO: 63304 - RNA, 63 nt, Homo Sapiens; identical to SEQ ID NO: 57861

SEQ ID NO: 63305 - RNA, 63 nt, Homo Sapiens; identical to SEQ ID NO: 57862

SEQ ID NO: 63306 - RNA, 63 nt, Homo Sapiens; identical to SEQ ID NO: 57863

SEQ ID NO: 63307 - RNA, 63 nt, Homo Sapiens; identical to SEQ ID NO: 57864

SEQ ID NO: 63308 - RNA, 63 nt, Homo Sapiens; identical to SEQ ID NO: 57865

SEQ ID NO: 63309 - RNA, 63 nt, Homo Sapiens; identical to SEQ ID NO: 57866

SEQ ID NO: 63310 - RNA, 63 nt, Homo Sapiens; identical to SEQ ID NO: 57867

SEQ ID NO: 63311 - RNA, 63 nt, Homo Sapiens; identical to SEQ ID NO: 57868

SEQ ID NO: 63312 - RNA, 63 nt, Homo Sapiens; identical to SEQ ID NO: 57869

SEQ ID NO: 63313 - RNA, 63 nt, Homo Sapiens; identical to SEQ ID NO: 57870

SEQ ID NO: 63314 - RNA, 63 nt, Homo Sapiens; identical to SEQ ID NO: 57871

SEQ ID NO: 63315 - RNA, 63 nt, Homo Sapiens; identical to SEQ ID NO: 57872

SEQ ID NO: 63316 - RNA, 63 nt, Homo Sapiens; identical to SEQ ID NO: 57873

SEQ ID NO: 63317 - RNA, 63 nt, Homo Sapiens; identical to SEQ ID NO: 57874

SEQ ID NO: 63318 - RNA, 63 nt, Homo Sapiens; identical to SEQ ID NO: 57875

SEQ ID NO: 63319 - RNA, 63 nt, Homo Sapiens; identical to SEQ ID NO: 57876

SEQ ID NO: 63320 - RNA, 63 nt, Homo Sapiens; identical to SEQ ID NO: 57877

SEQ ID NO: 63321 - RNA, 63 nt, Homo Sapiens; identical to SEQ ID NO: 57878

SEQ ID NO: 63322 - RNA, 63 nt, Homo Sapiens; identical to SEQ ID NO: 57879

SEQ ID NO: 63323 - RNA, 63 nt, Homo Sapiens; identical to SEQ ID NO: 57880

SEQ ID NO: 63324 - RNA, 63 nt, Homo Sapiens; identical to SEQ ID NO: 57881

SEQ ID NO: 63325 - RNA, 63 nt, Homo Sapiens; identical to SEQ ID NO: 57882

SEQ ID NO: 63326 - RNA, 63 nt, Homo Sapiens; identical to SEQ ID NO: 57883

SEQ ID NO: 63327 - RNA, 63 nt, Homo Sapiens; identical to SEQ ID NO: 57884

SEQ ID NO: 63328 - RNA, 63 nt, Homo Sapiens; identical to SEQ ID NO: 57885

SEQ ID NO: 63329 - RNA, 63 nt, Homo Sapiens; identical to SEQ ID NO: 57886

SEQ ID NO: 63330 - RNA, 63 nt, Homo Sapiens; identical to SEQ ID NO: 57887

SEQ ID NO: 63331 - RNA, 63 nt, Homo Sapiens; identical to SEQ ID NO: 57888

SEQ ID NO: 63332 - RNA, 63 nt, Homo Sapiens; identical to SEQ ID NO: 57889

SEQ ID NO: 63333 - RNA, 63 nt, Homo Sapiens; identical to SEQ ID NO: 57890

SEQ ID NO: 63334 - RNA, 63 nt, Homo Sapiens; identical to SEQ ID NO: 57891

SEQ ID NO: 63335 - RNA, 63 nt, Homo Sapiens; identical to SEQ ID NO: 57892

SEQ ID NO: 63336 - RNA, 63 nt, Homo Sapiens; identical to SEQ ID NO: 57893

SEQ ID NO: 63337 - RNA, 63 nt, Homo Sapiens; identical to SEQ ID NO: 57894

SEQ ID NO: 63338 - RNA, 63 nt, Homo Sapiens; identical to SEQ ID NO: 57895

SEQ ID NO: 63339 - RNA, 63 nt, Homo Sapiens; identical to SEQ ID NO: 57896

SEQ ID NO: 63340 - RNA, 63 nt, Homo Sapiens; identical to SEQ ID NO: 57897

SEQ ID NO: 63341 - RNA, 63 nt, Homo Sapiens; identical to SEQ ID NO: 57898

SEQ ID NO: 63342 - RNA, 63 nt, Homo Sapiens; identical to SEQ ID NO: 57899

SEQ ID NO: 63343 - RNA, 63 nt, Homo Sapiens; identical to SEQ ID NO: 57900

SEQ ID NO: 63344 - RNA, 63 nt, Homo Sapiens; identical to SEQ ID NO: 57901

SEQ ID NO: 63345 - RNA, 63 nt, Homo Sapiens; identical to SEQ ID NO: 57902

SEQ ID NO: 63346 - RNA, 63 nt, Homo Sapiens; identical to SEQ ID NO: 57903

SEQ ID NO: 63347 - RNA, 63 nt, Homo Sapiens; identical to SEQ ID NO: 57904

SEQ ID NO: 63348 - RNA, 63 nt, Homo Sapiens; identical to SEQ ID NO: 57905

SEQ ID NO: 63349 - RNA, 63 nt, Homo Sapiens; identical to SEQ ID NO: 57906

SEQ ID NO: 63350 - RNA, 63 nt, Homo Sapiens; identical to SEQ ID NO: 57907

SEQ ID NO: 63351 - RNA, 63 nt, Homo Sapiens; identical to SEQ ID NO: 57908

SEQ ID NO: 63352 - RNA, 63 nt, Homo Sapiens; identical to SEQ ID NO: 57909

SEQ ID NO: 63353 - RNA, 63 nt, Homo Sapiens; identical to SEQ ID NO: 57910

SEQ ID NO: 63354 - RNA, 63 nt, Homo Sapiens; identical to SEQ ID NO: 57911

SEQ ID NO: 63355 - RNA, 63 nt, Homo Sapiens; identical to SEQ ID NO: 57912

SEQ ID NO: 63356 - RNA, 63 nt, Homo Sapiens; identical to SEQ ID NO: 57913

SEQ ID NO: 63357 - RNA, 63 nt, Homo Sapiens; identical to SEQ ID NO: 57914

SEQ ID NO: 63358 - RNA, 63 nt, Homo Sapiens; identical to SEQ ID NO: 57915

SEQ ID NO: 63359 - RNA, 63 nt, Homo Sapiens; identical to SEQ ID NO: 57916

SEQ ID NO: 63360 - RNA, 63 nt, Homo Sapiens; identical to SEQ ID NO: 57917

SEQ ID NO: 63361 - RNA, 63 nt, Homo Sapiens; identical to SEQ ID NO: 57918

SEQ ID NO: 63362 - RNA, 63 nt, Homo Sapiens; identical to SEQ ID NO: 57919

SEQ ID NO: 63363 - RNA, 63 nt, Homo Sapiens; identical to SEQ ID NO: 57920

SEQ ID NO: 63364 - RNA, 63 nt, Homo Sapiens; identical to SEQ ID NO: 57921

SEQ ID NO: 63365 - RNA, 63 nt, Homo Sapiens; identical to SEQ ID NO: 57922

SEQ ID NO: 63366 - RNA, 63 nt, Homo Sapiens; identical to SEQ ID NO: 57923

SEQ ID NO: 63367 - RNA, 63 nt, Homo Sapiens; identical to SEQ ID NO: 57924

SEQ ID NO: 63368 - RNA, 63 nt, Homo Sapiens; identical to SEQ ID NO: 57925

SEQ ID NO: 63369 - RNA, 63 nt, Homo Sapiens; identical to SEQ ID NO: 57926

SEQ ID NO: 63370 - RNA, 63 nt, Homo Sapiens; identical to SEQ ID NO: 57927

SEQ ID NO: 63371 - RNA, 63 nt, Homo Sapiens; identical to SEQ ID NO: 57928

SEQ ID NO: 63372 - RNA, 63 nt, Homo Sapiens; identical to SEQ ID NO: 57929

SEQ ID NO: 63373 - RNA, 63 nt, Homo Sapiens; identical to SEQ ID NO: 57930

SEQ ID NO: 63374 - RNA, 63 nt, Homo Sapiens; identical to SEQ ID NO: 57931

SEQ ID NO: 63375 - RNA, 63 nt, Homo Sapiens; identical to SEQ ID NO: 57932

SEQ ID NO: 63376 - RNA, 63 nt, Homo Sapiens; identical to SEQ ID NO: 57933

SEQ ID NO: 63377 - RNA, 63 nt, Homo Sapiens; identical to SEQ ID NO: 57934

SEQ ID NO: 63378 - RNA, 63 nt, Homo Sapiens; identical to SEQ ID NO: 57935

SEQ ID NO: 63379 - RNA, 63 nt, Homo Sapiens; identical to SEQ ID NO: 57936

SEQ ID NO: 63380 - RNA, 63 nt, Homo Sapiens; identical to SEQ ID NO: 57937

SEQ ID NO: 63381 - RNA, 63 nt, Homo Sapiens; identical to SEQ ID NO: 57938

SEQ ID NO: 63382 - RNA, 63 nt, Homo Sapiens; identical to SEQ ID NO: 57939

SEQ ID NO: 63383 - RNA, 63 nt, Homo Sapiens; identical to SEQ ID NO: 57940

SEQ ID NO: 63384 - RNA, 63 nt, Homo Sapiens; identical to SEQ ID NO: 57941

SEQ ID NO: 63385 - RNA, 63 nt, Homo Sapiens; identical to SEQ ID NO: 57942

SEQ ID NO: 63386 - RNA, 63 nt, Homo Sapiens; identical to SEQ ID NO: 57943

SEQ ID NO: 63387 - RNA, 63 nt, Homo Sapiens; identical to SEQ ID NO: 57944

SEQ ID NO: 63388 - RNA, 63 nt, Homo Sapiens; identical to SEQ ID NO: 57945

SEQ ID NO: 63389 - RNA, 63 nt, Homo Sapiens; identical to SEQ ID NO: 57946

SEQ ID NO: 63390 - RNA, 63 nt, Homo Sapiens; identical to SEQ ID NO: 57947

SEQ ID NO: 63391 - RNA, 63 nt, Homo Sapiens; identical to SEQ ID NO: 57948

SEQ ID NO: 63392 - RNA, 63 nt, Homo Sapiens; identical to SEQ ID NO: 57949

SEQ ID NO: 63393 - RNA, 63 nt, Homo Sapiens; identical to SEQ ID NO: 57950

SEQ ID NO: 63394 - RNA, 63 nt, Homo Sapiens; identical to SEQ ID NO: 57951

SEQ ID NO: 63395 - RNA, 63 nt, Homo Sapiens; identical to SEQ ID NO: 57952

SEQ ID NO: 63396 - RNA, 63 nt, Homo Sapiens; identical to SEQ ID NO: 57953

SEQ ID NO: 63397 - RNA, 63 nt, Homo Sapiens; identical to SEQ ID NO: 57954

SEQ ID NO: 63398 - RNA, 63 nt, Homo Sapiens; identical to SEQ ID NO: 57955

SEQ ID NO: 63399 - RNA, 63 nt, Homo Sapiens; identical to SEQ ID NO: 57956

SEQ ID NO: 63400 - RNA, 63 nt, Homo Sapiens; identical to SEQ ID NO: 57957

SEQ ID NO: 63401 - RNA, 63 nt, Homo Sapiens; identical to SEQ ID NO: 57958

SEQ ID NO: 63402 - RNA, 63 nt, Homo Sapiens; identical to SEQ ID NO: 57959

SEQ ID NO: 63403 - RNA, 63 nt, Homo Sapiens; identical to SEQ ID NO: 57960

SEQ ID NO: 63404 - RNA, 63 nt, Homo Sapiens; identical to SEQ ID NO: 57961

SEQ ID NO: 63405 - RNA, 63 nt, Homo Sapiens; identical to SEQ ID NO: 57962

SEQ ID NO: 63406 - RNA, 63 nt, Homo Sapiens; identical to SEQ ID NO: 57963

SEQ ID NO: 63407 - RNA, 63 nt, Homo Sapiens; identical to SEQ ID NO: 57964

SEQ ID NO: 63408 - RNA, 63 nt, Homo Sapiens; identical to SEQ ID NO: 57965

SEQ ID NO: 63409 - RNA, 63 nt, Homo Sapiens; identical to SEQ ID NO: 57966

SEQ ID NO: 63410 - RNA, 63 nt, Homo Sapiens; identical to SEQ ID NO: 57967

SEQ ID NO: 63411 - RNA, 63 nt, Homo Sapiens; identical to SEQ ID NO: 57968

SEQ ID NO: 63412 - RNA, 63 nt, Homo Sapiens; identical to SEQ ID NO: 57969

SEQ ID NO: 63413 - RNA, 63 nt, Homo Sapiens; identical to SEQ ID NO: 57970

SEQ ID NO: 63414 - RNA, 63 nt, Homo Sapiens; identical to SEQ ID NO: 57971

SEQ ID NO: 63415 - RNA, 63 nt, Homo Sapiens; identical to SEQ ID NO: 57972

SEQ ID NO: 63416 - RNA, 63 nt, Homo Sapiens; identical to SEQ ID NO: 57973

SEQ ID NO: 63417 - RNA, 63 nt, Homo Sapiens; identical to SEQ ID NO: 57974

SEQ ID NO: 63418 - RNA, 63 nt, Homo Sapiens; identical to SEQ ID NO: 57975

SEQ ID NO: 63419 - RNA, 63 nt, Homo Sapiens; identical to SEQ ID NO: 57976

SEQ ID NO: 63420 - RNA, 63 nt, Homo Sapiens; identical to SEQ ID NO: 57977

SEQ ID NO: 63421 - RNA, 63 nt, Homo Sapiens; identical to SEQ ID NO: 57978

SEQ ID NO: 63422 - RNA, 63 nt, Homo Sapiens; identical to SEQ ID NO: 57979

SEQ ID NO: 63423 - RNA, 63 nt, Homo Sapiens; identical to SEQ ID NO: 57980

SEQ ID NO: 63424 - RNA, 63 nt, Homo Sapiens; identical to SEQ ID NO: 57981

SEQ ID NO: 63425 - RNA, 63 nt, Homo Sapiens; identical to SEQ ID NO: 57982

SEQ ID NO: 63426 - RNA, 63 nt, Homo Sapiens; identical to SEQ ID NO: 57983

SEQ ID NO: 63427 - RNA, 63 nt, Homo Sapiens; identical to SEQ ID NO: 57984

SEQ ID NO: 63428 - RNA, 63 nt, Homo Sapiens; identical to SEQ ID NO: 57985

SEQ ID NO: 63429 - RNA, 63 nt, Homo Sapiens; identical to SEQ ID NO: 57984

SEQ ID NO: 63430 - RNA, 63 nt, Homo Sapiens; identical to SEQ ID NO: 57987

SEQ ID NO: 63431 - RNA, 63 nt, Homo Sapiens; identical to SEQ ID NO: 57988

SEQ ID NO: 63432 - RNA, 63 nt, Homo Sapiens; identical to SEQ ID NO: 57989

SEQ ID NO: 63433 - RNA, 63 nt, Homo Sapiens; identical to SEQ ID NO: 57990

SEQ ID NO: 63434 - RNA, 63 nt, Homo Sapiens; identical to SEQ ID NO: 57991

SEQ ID NO: 63435 - RNA, 63 nt, Homo Sapiens; identical to SEQ ID NO: 57992

SEQ ID NO: 63436 - RNA, 63 nt, Homo Sapiens; identical to SEQ ID NO: 57993

SEQ ID NO: 63437 - RNA, 63 nt, Homo Sapiens; identical to SEQ ID NO: 57994

SEQ ID NO: 63438 - RNA, 63 nt, Homo Sapiens; identical to SEQ ID NO: 57995

SEQ ID NO: 63439 - RNA, 63 nt, Homo Sapiens; identical to SEQ ID NO: 57996

SEQ ID NO: 63440 - RNA, 63 nt, Homo Sapiens; identical to SEQ ID NO: 57997

SEQ ID NO: 63441 - RNA, 63 nt, Homo Sapiens; identical to SEQ ID NO: 57998

SEQ ID NO: 63442 - RNA, 63 nt, Homo Sapiens; identical to SEQ ID NO: 57999

SEQ ID NO: 63443 - RNA, 63 nt, Homo Sapiens; identical to SEQ ID NO: 58000

SEQ ID NO: 63444 - RNA, 63 nt, Homo Sapiens; identical to SEQ ID NO: 58001

SEQ ID NO: 63445 - RNA, 63 nt, Homo Sapiens; identical to SEQ ID NO: 58002

SEQ ID NO: 63446 - RNA, 63 nt, Homo Sapiens; identical to SEQ ID NO: 58003

SEQ ID NO: 63447 - RNA, 63 nt, Homo Sapiens; identical to SEQ ID NO: 58004

SEQ ID NO: 63448 - RNA, 63 nt, Homo Sapiens; identical to SEQ ID NO: 58005

SEQ ID NO: 63449 - RNA, 63 nt, Homo Sapiens; identical to SEQ ID NO: 58006

SEQ ID NO: 63450 - RNA, 63 nt, Homo Sapiens; identical to SEQ ID NO: 58007

SEQ ID NO: 63451 - RNA, 63 nt, Homo Sapiens; identical to SEQ ID NO: 58008

SEQ ID NO: 63452 - RNA, 63 nt, Homo Sapiens; identical to SEQ ID NO: 58009

SEQ ID NO: 63453 - RNA, 63 nt, Homo Sapiens; identical to SEQ ID NO: 58010

SEQ ID NO: 63454 - RNA, 63 nt, Homo Sapiens; identical to SEQ ID NO: 58011

SEQ ID NO: 63455 - RNA, 63 nt, Homo Sapiens; identical to SEQ ID NO: 58012

SEQ ID NO: 63456 - RNA, 63 nt, Homo Sapiens; identical to SEQ ID NO: 58013

SEQ ID NO: 63457 - RNA, 63 nt, Homo Sapiens; identical to SEQ ID NO: 58014

SEQ ID NO: 63458 - RNA, 63 nt, Homo Sapiens; identical to SEQ ID NO: 58015

SEQ ID NO: 63459 - RNA, 63 nt, Homo Sapiens; identical to SEQ ID NO: 58016

SEQ ID NO: 63460 - RNA, 63 nt, Homo Sapiens; identical to SEQ ID NO: 58017

SEQ ID NO: 63461 - RNA, 63 nt, Homo Sapiens; identical to SEQ ID NO: 58018

SEQ ID NO: 63462 - RNA, 63 nt, Homo Sapiens; identical to SEQ ID NO: 58019

SEQ ID NO: 63463 - RNA, 63 nt, Homo Sapiens; identical to SEQ ID NO: 58020

SEQ ID NO: 63464 - RNA, 63 nt, Homo Sapiens; identical to SEQ ID NO: 58021

SEQ ID NO: 63465 - RNA, 63 nt, Homo Sapiens; identical to SEQ ID NO: 58022

SEQ ID NO: 63466 - RNA, 63 nt, Homo Sapiens; identical to SEQ ID NO: 58023

SEQ ID NO: 63467 - RNA, 63 nt, Homo Sapiens; identical to SEQ ID NO: 58024

SEQ ID NO: 63468 - RNA, 63 nt, Homo Sapiens; identical to SEQ ID NO: 58025

SEQ ID NO: 63469 - RNA, 63 nt, Homo Sapiens; identical to SEQ ID NO: 58026

SEQ ID NO: 63470 - RNA, 63 nt, Homo Sapiens; identical to SEQ ID NO: 58027

SEQ ID NO: 63471 - RNA, 63 nt, Homo Sapiens; identical to SEQ ID NO: 58028

SEQ ID NO: 63472 - RNA, 63 nt, Homo Sapiens; identical to SEQ ID NO: 58029

SEQ ID NO: 63473 - RNA, 63 nt, Homo Sapiens; identical to SEQ ID NO: 58030

SEQ ID NO: 63474 - RNA, 63 nt, Homo Sapiens; identical to SEQ ID NO: 58031

SEQ ID NO: 63475 - RNA, 63 nt, Homo Sapiens; identical to SEQ ID NO: 58032

SEQ ID NO: 63476 - RNA, 63 nt, Homo Sapiens; identical to SEQ ID NO: 58033

SEQ ID NO: 63477 - RNA, 57 nt, Homo Sapiens; identical to SEQ ID NO: 58034

SEQ ID NO: 63478 - RNA, 63 nt, Homo Sapiens; identical to SEQ ID NO: 58035

SEQ ID NO: 63479 - RNA, 63 nt, Homo Sapiens; identical to SEQ ID NO: 58036

SEQ ID NO: 63480 - RNA, 63 nt, Homo Sapiens; identical to SEQ ID NO: 58037

SEQ ID NO: 63481 - RNA, 63 nt, Homo Sapiens; identical to SEQ ID NO: 58038

SEQ ID NO: 63482 - RNA, 63 nt, Homo Sapiens; identical to SEQ ID NO: 58039

SEQ ID NO: 63483 - RNA, 63 nt, Homo Sapiens; identical to SEQ ID NO: 58040

SEQ ID NO: 63484 - RNA, 63 nt, Homo Sapiens; identical to SEQ ID NO: 58041

SEQ ID NO: 63485 - RNA, 63 nt, Homo Sapiens; identical to SEQ ID NO: 58042

SEQ ID NO: 63486 - RNA, 63 nt, Homo Sapiens; identical to SEQ ID NO: 58043

SEQ ID NO: 63487 - RNA, 63 nt, Homo Sapiens; identical to SEQ ID NO: 58044

SEQ ID NO: 63488 - RNA, 63 nt, Homo Sapiens; identical to SEQ ID NO: 58045

SEQ ID NO: 63489 - RNA, 63 nt, Homo Sapiens; identical to SEQ ID NO: 58046

SEQ ID NO: 63490 - RNA, 63 nt, Homo Sapiens; identical to SEQ ID NO: 58047

SEQ ID NO: 63491 - RNA, 63 nt, Homo Sapiens; identical to SEQ ID NO: 58048

SEQ ID NO: 63492 - RNA, 63 nt, Homo Sapiens; identical to SEQ ID NO: 58049

SEQ ID NO: 63493 - RNA, 63 nt, Homo Sapiens; identical to SEQ ID NO: 58050

SEQ ID NO: 63494 - RNA, 63 nt, Homo Sapiens; identical to SEQ ID NO: 58051

SEQ ID NO: 63495 - RNA, 63 nt, Homo Sapiens; identical to SEQ ID NO: 58052

SEQ ID NO: 63496 - RNA, 61 nt, Homo Sapiens; identical to SEQ ID NO: 58053

SEQ ID NO: 63497 - RNA, 63 nt, Homo Sapiens; identical to SEQ ID NO: 58054

SEQ ID NO: 63498 - RNA, 63 nt, Homo Sapiens; identical to SEQ ID NO: 58055

SEQ ID NO: 63499 - RNA, 63 nt, Homo Sapiens; identical to SEQ ID NO: 58056

SEQ ID NO: 63500 - RNA, 63 nt, Homo Sapiens; identical to SEQ ID NO: 58057

SEQ ID NO: 63501 - RNA, 63 nt, Homo Sapiens; identical to SEQ ID NO: 58058

SEQ ID NO: 63502 - RNA, 63 nt, Homo Sapiens; identical to SEQ ID NO: 58059

SEQ ID NO: 63503 - RNA, 63 nt, Homo Sapiens; identical to SEQ ID NO: 58060

SEQ ID NO: 63504 - RNA, 63 nt, Homo Sapiens; identical to SEQ ID NO: 58061

SEQ ID NO: 63505 - RNA, 63 nt, Homo Sapiens; identical to SEQ ID NO: 58062

SEQ ID NO: 63506 - RNA, 63 nt, Homo Sapiens; identical to SEQ ID NO: 58063

SEQ ID NO: 63507 - RNA, 63 nt, Homo Sapiens; identical to SEQ ID NO: 58064

SEQ ID NO: 63508 - RNA, 55 nt, Homo Sapiens; identical to SEQ ID NO: 58065

SEQ ID NO: 63509 - RNA, 63 nt, Homo Sapiens; identical to SEQ ID NO: 58066

SEQ ID NO: 63510 - RNA, 63 nt, Homo Sapiens; identical to SEQ ID NO: 58067

SEQ ID NO: 63511 - RNA, 63 nt, Homo Sapiens; identical to SEQ ID NO: 58068

SEQ ID NO: 63512 - RNA, 63 nt, Homo Sapiens; identical to SEQ ID NO: 58069

SEQ ID NO: 63513 - RNA, 63 nt, Homo Sapiens; identical to SEQ ID NO: 58070

SEQ ID NO: 63514 - RNA, 63 nt, Homo Sapiens; identical to SEQ ID NO: 58071

SEQ ID NO: 63515 - RNA, 63 nt, Homo Sapiens; identical to SEQ ID NO: 58072

SEQ ID NO: 63516 - RNA, 63 nt, Homo Sapiens; identical to SEQ ID NO: 58073

SEQ ID NO: 63517 - RNA, 63 nt, Homo Sapiens; identical to SEQ ID NO: 58074

SEQ ID NO: 63518 - RNA, 63 nt, Homo Sapiens; identical to SEQ ID NO: 58075

SEQ ID NO: 63519 - RNA, 63 nt, Homo Sapiens; identical to SEQ ID NO: 58076

SEQ ID NO: 63520 - RNA, 63 nt, Homo Sapiens; identical to SEQ ID NO: 58077

SEQ ID NO: 63521 - RNA, 63 nt, Homo Sapiens; identical to SEQ ID NO: 58078

SEQ ID NO: 63522 - RNA, 63 nt, Homo Sapiens; identical to SEQ ID NO: 58079

SEQ ID NO: 63523 - RNA, 63 nt, Homo Sapiens; identical to SEQ ID NO: 58080

SEQ ID NO: 63524 - RNA, 63 nt, Homo Sapiens; identical to SEQ ID NO: 58081

SEQ ID NO: 63525 - RNA, 63 nt, Homo Sapiens; identical to SEQ ID NO: 58082

SEQ ID NO: 63526 - RNA, 63 nt, Homo Sapiens; identical to SEQ ID NO: 58083

SEQ ID NO: 63527 - RNA, 63 nt, Homo Sapiens; identical to SEQ ID NO: 58084

SEQ ID NO: 63528 - RNA, 63 nt, Homo Sapiens; identical to SEQ ID NO: 58085

SEQ ID NO: 63529 - RNA, 63 nt, Homo Sapiens; identical to SEQ ID NO: 58086

SEQ ID NO: 63530 - RNA, 63 nt, Homo Sapiens; identical to SEQ ID NO: 58087

SEQ ID NO: 63531 - RNA, 63 nt, Homo Sapiens; identical to SEQ ID NO: 58088

SEQ ID NO: 63532 - RNA, 63 nt, Homo Sapiens; identical to SEQ ID NO: 58089

SEQ ID NO: 63533 - RNA, 63 nt, Homo Sapiens; identical to SEQ ID NO: 58087

SEQ ID NO: 63534 - RNA, 63 nt, Homo Sapiens; identical to SEQ ID NO: 58091

SEQ ID NO: 63535 - RNA, 63 nt, Homo Sapiens; identical to SEQ ID NO: 58092

SEQ ID NO: 63536 - RNA, 63 nt, Homo Sapiens; identical to SEQ ID NO: 58093

SEQ ID NO: 63537 - RNA, 63 nt, Homo Sapiens; identical to SEQ ID NO: 58094

SEQ ID NO: 63538 - RNA, 63 nt, Homo Sapiens; identical to SEQ ID NO: 58095

SEQ ID NO: 63539 - RNA, 63 nt, Homo Sapiens; identical to SEQ ID NO: 58096

SEQ ID NO: 63540 - RNA, 63 nt, Homo Sapiens; identical to SEQ ID NO: 58097

SEQ ID NO: 63541 - RNA, 63 nt, Homo Sapiens; identical to SEQ ID NO: 58098

SEQ ID NO: 63542 - RNA, 63 nt, Homo Sapiens; identical to SEQ ID NO: 58099

SEQ ID NO: 63543 - RNA, 63 nt, Homo Sapiens; identical to SEQ ID NO: 58100

SEQ ID NO: 63544 - RNA, 63 nt, Homo Sapiens; identical to SEQ ID NO: 58101

SEQ ID NO: 63545 - RNA, 64 nt, Homo Sapiens; identical to SEQ ID NO: 21195

SEQ ID NO: 63546 - RNA, 64 nt, Homo Sapiens; identical to SEQ ID NO: 21196

SEQ ID NO: 63547 - RNA, 64 nt, Homo Sapiens; identical to SEQ ID NO: 21197

SEQ ID NO: 63548 - RNA, 64 nt, Homo Sapiens; identical to SEQ ID NO: 21198

SEQ ID NO: 63549 - RNA, 64 nt, Homo Sapiens
cauacugaaagaguccauuguuuaaaaaucuuaauguaucaaacuguauaacuuggccgcugua

SEQ ID NO: 63550 - RNA, 64 nt, Homo Sapiens
uugaacuugauggcuaacuuacaaagauucucuauguaucaaauguaacuuacugcgacuaaac

SEQ ID NO: 63551 - RNA, 64 nt, Homo Sapiens
ggugauuuaugaugccuucugagccccccaccaauguaucaaugguggucaccagggggacagg

SEQ ID NO: 63552 - RNA, 64 nt, Homo Sapiens
acuaguuaagagucucaguuguaaagcccugugguguaucaacuguuaguaauugugcaguaaa

SEQ ID NO: 63553 - RNA, 64 nt, Homo Sapiens
aauauuggaugacuaacuaucaaauagauggauuuguaucaauaccaaauagcuucuguuuugu

SEQ ID NO: 63554 - RNA, 64 nt, Homo Sapiens
cuugaaucuagggagggggaauguagugaagggauguaucaagugggguggugggagggggagg

SEQ ID NO: 63555 - RNA, 64 nt, Homo Sapiens
gggaaucucagucgcacucaagcucugagaccuuuguaucaaaaauaggcauuugauuuccugu

SEQ ID NO: 63556 - RNA, 64 nt, Homo Sapiens
aauauuccauagggccauguugccagaaucuguauguaucaauacaggguuuuuccaagccagg

SEQ ID NO: 63557 - RNA, 64 nt, Homo Sapiens
uauauugauauguauuacacuauauauugauguguguaucaauauucggugauauauauugcau

SEQ ID NO: 63558 - RNA, 64 nt, Homo Sapiens
uucugacaagggucccuauaguuugggagcccuuuguaucaaugcagacacauuugugcccggc

SEQ ID NO: 63559 - RNA, 64 nt, Homo Sapiens
gucuuaaagauuggucccuugaaaauaugcuuccuguaucaaagguacguauguggugcaaaca

SEQ ID NO: 63560 - RNA, 64 nt, Homo Sapiens
uuuuuaggucuaaaagucuuuauauuauauacucuguaucaagucaaaauaucuuuggccauuu

SEQ ID NO: 63561 - RNA, 64 nt, Homo Sapiens
caauggcaacucuauuucaacgucucuccuguaggcuuuuaauugugagaccacagaccaggcc

SEQ ID NO: 63562 - RNA, 64 nt, Homo Sapiens
auaucugggauuucuguggacgauagggcucuucgcuuuuaauguauucuucucuaaccauaua

SEQ ID NO: 63563 - RNA, 64 nt, Homo Sapiens
ggggaaauagggcuuuaauauaauagaacuccuugcuuuuaauuuauaaaugaagaagacauac

SEQ ID NO: 63564 - RNA, 64 nt, Homo Sapiens
cguauguuuguaugguagagccucaauaguguuggcuuuuaaaaccccugaagggcauaccuaa

SEQ ID NO: 63565 - RNA, 64 nt, Homo Sapiens
caagaauagagucaucauguauucuuuguuauuugcuuuuaacaaccuuuaaaaaauauuaaaa

SEQ ID NO: 63566 - RNA, 64 nt, Homo Sapiens
auuguuuucuuuccuucucaaagguugaaaaaaugcuuuuaauuuuucacagccgagaaacagu

SEQ ID NO: 63567 - RNA, 64 nt, Homo Sapiens
cuccguuuguaaguaaacaauugcugccaguuuggcuuuuaaguuuuggauccugcucucacca

SEQ ID NO: 63568 - RNA, 64 nt, Homo Sapiens
caacagcuaccagaaauacacacuacaaucaccagcuuuuaaaauccauuuauucacuagccau

SEQ ID NO: 63569 - RNA, 64 nt, Homo Sapiens
uuuacuuaaauuuuauuuuaucuuauuuuuaggugcuuuuaaucucaaaauucugaaaagcgaa

SEQ ID NO: 63570 - RNA, 64 nt, Homo Sapiens
auaaaauaugaccaaaauauuuaaaaugcacaaugcuuuuaacuuaaaugugcuaacccuguuu

SEQ ID NO: 63571 - RNA, 64 nt, Homo Sapiens
ugggaauaauuuguauguauauauuuuuauucuggcuuuuaaaaaguacuucugugguuaaugu

SEQ ID NO: 63572 - RNA, 64 nt, Homo Sapiens
cagcaucagcagaaaaugaccgaugucaacucaugcuuuuaauuucaaaccauuucugucagua

SEQ ID NO: 63573 - RNA, 64 nt, Homo Sapiens
agagcugaucugcaucuguuuauccauuuuaguagcuuuuaaauaugauuuuaugugaagugcc

SEQ ID NO: 63574 - RNA, 64 nt, Homo Sapiens
gggaaugagugugguaagaaauuuauaaaguuuugcuuuuaaaacguggacauaacucauuuuu

SEQ ID NO: 63575 - RNA, 64 nt, Homo Sapiens
uucuccccagaggaacuuagggauuucaccccuggcuuuuaaaaaaaacgaaauaccgacaagc

SEQ ID NO: 63576 - RNA, 64 nt, Homo Sapiens
uuugaugccauauuuucaguguuacacuuuuauggcuuuuaauuuucgauuugacagauguaag

SEQ ID NO: 63577 - RNA, 64 nt, Homo Sapiens
gugagaaaccuuacaauguaaagaauguggcacagcuuuuaacuaaucuucaaaccuuacugaa

SEQ ID NO: 63578 - RNA, 64 nt, Homo Sapiens
agaggaacucuauaguugugaagaauguggcaaagcuuuuaaccaauccucauaccuuacuaua

SEQ ID NO: 63579 - RNA, 64 nt, Homo Sapiens
agagaaagccuacaauugugaagaauguggcaaagcuuuuaaccuuccuuaacccuuaacugua

SEQ ID NO: 63580 - RNA, 64 nt, Homo Sapiens
aaagaaacccuacaaaugugaagucuguggcaaagcuuuuaacugauucucaacucuuacuaca

SEQ ID NO: 63581 - RNA, 64 nt, Homo Sapiens
agagaaaccccacaaaugugaagaauguggcagagcuuuuaaccaguccgcaaagcucacugaa

SEQ ID NO: 63582 - RNA, 64 nt, Homo Sapiens
agaaaaacccuacaaaugugaagaauguggcaaagcuuuuaaccaguccucacaccuuaugaga

SEQ ID NO: 63583 - RNA, 64 nt, Homo Sapiens
agagaaacucuacaaaugugaagaauguggcaaagcuuuuaaccaagucucaacacuuacuaua

SEQ ID NO: 63584 - RNA, 64 nt, Homo Sapiens
agagaaaccccacaaauaugaagaaugugguaaugcuuuuaaccaauucucaaaucuuacuaaa

SEQ ID NO: 63585 - RNA, 64 nt, Homo Sapiens
uccuugaagaauaucuaagcuuuuucugagaugggcuuuuaaaauuauaauaagggaaguuuau

SEQ ID NO: 63586 - RNA, 64 nt, Homo Sapiens
gagaccugaagauuguaauauucaugucugugaagcuuuuaaacauuacacuugagaucaguca

SEQ ID NO: 63587 - RNA, 64 nt, Homo Sapiens
uuuccaaccuguaacucugaugugcucuggaucagcuuuuaacuuuuaaucauauauuacuguc

SEQ ID NO: 63588 - RNA, 64 nt, Homo Sapiens
cacagccagccucugaaaucauagcucuccaguggcuuuuaaagaaagcugguccucagcacua

SEQ ID NO: 63589 - RNA, 64 nt, Homo Sapiens
aaaaguuuucgauguauuggaauuauuugggaaugcuuuuaaaacaauuuguaauuauuucuuu

SEQ ID NO: 63590 - RNA, 64 nt, Homo Sapiens
aaacagcugagccugccuacuuugcccuuuuacagcuuuuaauuuuauggauuuuuaaaaauga

SEQ ID NO: 63591 - RNA, 64 nt, Homo Sapiens
agguuguccaggacuuccuuuuaauggaggaugggcuuuuaaaccacaucaucuuguacaacaa

SEQ ID NO: 63592 - RNA, 64 nt, Homo Sapiens
agaguucuucaauucaaugcacguucacccuagagcuuuuaacaucuuugcuaguuuuauaaag

SEQ ID NO: 63593 - RNA, 64 nt, Homo Sapiens
aucuaucuuuguauaauucauauuugggaauauggcuuuuaauaauguucuucccacaaauaau

SEQ ID NO: 63594 - RNA, 64 nt, Homo Sapiens
aaaaaaaccuuaauaagcuguaucuguuucauaugcuuuuaauuuuaaaggaauaacaaaacug

SEQ ID NO: 63595 - RNA, 64 nt, Homo Sapiens
cugcagugccagaggggccucuggagcaggccuggcuuuuaaauggggggcugaauuccagcuc

SEQ ID NO: 63596 - RNA, 64 nt, Homo Sapiens
aauacauuucuuguaaaaccuggcuuguugcuuggcuuuuaaagaugguguauguuuguaaaaa

SEQ ID NO: 63597 - RNA, 64 nt, Homo Sapiens
agagaaauccuacaaauaugaagaaugugacaaagcuuuuaaccacuucucaacccugccuaca

SEQ ID NO: 63598 - RNA, 64 nt, Homo Sapiens
agauaaauuauacaaaugugaagaauguggcaaagcuuuuaacaaauccucauccauuaguaaa

SEQ ID NO: 63599 - RNA, 64 nt, Homo Sapiens
agagaaacccuacaaaugugaaaaauguggcaaagcuuuuaaccaauuuucaaaccuuacuaaa

SEQ ID NO: 63600 - RNA, 64 nt, Homo Sapiens
agagaaaccauacaacugugaagaauguggcaaagcuuuuaaccaguccucaaacuuuauugaa

SEQ ID NO: 63601 - RNA, 64 nt, Homo Sapiens
agaaaaacccuacaaaugugaagaaugugucaaagcuuuuaacuguuccucaauccuuacuaaa

SEQ ID NO: 63602 - RNA, 64 nt, Homo Sapiens
agagaaacccuacaaaugugaagaacguggccuggcuuuuaacaaauccucaacauuuacuaag

SEQ ID NO: 63603 - RNA, 64 nt, Homo Sapiens
ggagcgaaacuacaauccugaaugaugucacagugcuuuuaacaauaccucaaacuuuucuaaa

SEQ ID NO: 63604 - RNA, 64 nt, Homo Sapiens
uuuuaauuauguacaggcaaaaaugcagcauuccgcuuuuaacuaucugcuuaaaagagcuaac

SEQ ID NO: 63605 - RNA, 64 nt, Homo Sapiens
ugcuuuauuuacuuuuguaaucuuggauuuuguagcuuuuaaaacuagaaaccauuguucuaac

SEQ ID NO: 63606 - RNA, 64 nt, Homo Sapiens
uuuuauauuuauguccccaaguccuugugaggaugcuuuuaaagaagggugcugggcaucacug

SEQ ID NO: 63607 - RNA, 64 nt, Homo Sapiens
uauacauccaccucuauaugagacacagaaucaagcuuuuaacagaguucauagucauauucau

SEQ ID NO: 63608 - RNA, 64 nt, Homo Sapiens
aguuuucuccaccuuuuucuaaccacuauuccaugcuuuuaaguuagagagcucagagcaauua

SEQ ID NO: 63609 - RNA, 64 nt, Homo Sapiens
caaauaauuguuuuacaaaauuucuuaagaaauugcuuuuaaaaugucuugcuguuuucaguau

SEQ ID NO: 63610 - RNA, 64 nt, Homo Sapiens
ccuuauuuauaaauugaggugguuugaauagauugcuuuuaaggucuuucugcucugugauucc

SEQ ID NO: 63611 - RNA, 64 nt, Homo Sapiens
uugaauaaauuaguuauuaagcuucaguuuucuagcuuuuaacugauuauaacaaugcacacac

SEQ ID NO: 63612 - RNA, 64 nt, Homo Sapiens
uugcacaaaaagauaccuuaaaauuugaaacauugcuuuuaaaacuacuuagcacuucagggca

SEQ ID NO: 63613 - RNA, 64 nt, Homo Sapiens
uaaauugauguugaugcaauccuuacaaaugauugcuuuuaaaauuuuaagcuaggaaaagaaa

SEQ ID NO: 63614 - RNA, 64 nt, Homo Sapiens
uuaacuuuucuaguuuuuaaacuucuggaacuuggcuuuuaaaucuuauuuucuaccuggauaa

SEQ ID NO: 63615 - RNA, 64 nt, Homo Sapiens
uauuuucuaccuggauaaacccucuccaauuuaugcuuuuaacuaguaguuccuuccucuuucu

SEQ ID NO: 63616 - RNA, 64 nt, Homo Sapiens
caacuuuuuaucuucugucuuuaacuuaaaaacagcuuuuaaaauaugucuuuauaagguucac

SEQ ID NO: 63617 - RNA, 64 nt, Homo Sapiens
uaaaccucaucguuguuaucuucccuuggauguuuugacaaaaaugacaaacaacaauuaaugu

SEQ ID NO: 63618 - RNA, 64 nt, Homo Sapiens
acaauuaauguuucccuuggugugaaguucacaguugacaaacaucuauccuuagacaauguag

SEQ ID NO: 63619 - RNA, 64 nt, Homo Sapiens
cagccuugguguguuuggggacucaauaaaacauuugacaaaacacaguacuccagaugucuac

SEQ ID NO: 63620 - RNA, 64 nt, Homo Sapiens
aauuauuuuuauuuguuuuaggagaugggaaucuuugacaaacaaaugcgacaaauaaaguugg

SEQ ID NO: 63621 - RNA, 64 nt, Homo Sapiens
cagaacuguuguagaaagcugccuuauaguuggcuugacaaagcauaauucucucauaacaaac

SEQ ID NO: 63622 - RNA, 64 nt, Homo Sapiens
ggggccuuucucuuugauaaauuuuuuuugucuguugacaaaaacaaaaaucuuuuuucaaaug

SEQ ID NO: 63623 - RNA, 64 nt, Homo Sapiens
aggucuaugaaguguagcugaaaucugaagagucuugacaaagggauuuacacccuugacaaaa

SEQ ID NO: 63624 - RNA, 64 nt, Homo Sapiens
aaucugaagagucuugacaaagggauuuacacccuugacaaaaccaaaagaaauuaacaggcca

SEQ ID NO: 63625 - RNA, 64 nt, Homo Sapiens
aucuuugaaucagaaggaaaaaaagcagcgcugguugacaaaggguguugaagauuuuugcugc

SEQ ID NO: 63626 - RNA, 64 nt, Homo Sapiens
guugucauuaaguaagauccaggucaaauuccauuugacaaaucccagggacuauccaggaauu

SEQ ID NO: 63627 - RNA, 64 nt, Homo Sapiens
gucuacgaucuugcaguuaugucucaaaucucacuugacaaaugucuuucucaauaccugcccu

SEQ ID NO: 63628 - RNA, 64 nt, Homo Sapiens
cagguuggcucauucuugcuuggaggcugagugauugacaaacaaccuuggcugcccaacugug

SEQ ID NO: 63629 - RNA, 64 nt, Homo Sapiens
cuuuagccuuuucauguuucugucucaaaacacuuugacaaagcucaccaacuuuaaaauauua

SEQ ID NO: 63630 - RNA, 64 nt, Homo Sapiens
aacacuaauuuuugaaaaagauagguuaaaguauuugacaaaagugaauacaauaauaacacuu

SEQ ID NO: 63631 - RNA, 64 nt, Homo Sapiens
uuacuaccauauguuauguauuguauaauauaucuugacaaauuuuaucuaaaaugcuuugagu

SEQ ID NO: 63632 - RNA, 64 nt, Homo Sapiens
cuuuaugcuaaaaauuuuguuuuauugagacuacuugacaaauaaggacaacgaaauaauucuc

SEQ ID NO: 63633 - RNA, 64 nt, Homo Sapiens
ucugacuacuauaaaaauauuugcauauauaaguuugacaaagaaaagaaaaucaauguuaaac

SEQ ID NO: 63634 - RNA, 64 nt, Homo Sapiens
guuuaacaugauuaauuuaaaaaguauuuagugcuugacaaaguagugucacucuuaagauguc

SEQ ID NO: 63635 - RNA, 64 nt, Homo Sapiens
guguacaaacacuaaaaaaaugaauauugaaaaauugacaaauuaaaguaccuguacagaaaau

SEQ ID NO: 63636 - RNA, 64 nt, Homo Sapiens
cacuauuauuuuuuguaccaauauugaauaaccauugacaaaaaucuuuuuaauuuacagcaaa

SEQ ID NO: 63637 - RNA, 64 nt, Homo Sapiens
gaaauaaagcuacacaccuacaaccaucuaaucuuugacaaaguugacaaaaauacgcaauggg

SEQ ID NO: 63638 - RNA, 64 nt, Homo Sapiens
cuacacaccuacaaccaucuaaucuuugacaaaguugacaaaaauacgcaauggggaaagaauu

SEQ ID NO: 63639 - RNA, 64 nt, Homo Sapiens
aagaucccaaaaauaauuguaacgaaagcaaaaauugacaaaugggacaugauuaaacagaauu

SEQ ID NO: 63640 - RNA, 64 nt, Homo Sapiens
aauguaauuuuuaccuuauugguuuuccuuuacuuugacaaaguguacugauaaaaacaaacau

SEQ ID NO: 63641 - RNA, 64 nt, Homo Sapiens
gcacagagcucuuuggcauuauaaucugaacucuuugacaaauuuuuuaauccuuuuacauaaa

SEQ ID NO: 63642 - RNA, 64 nt, Homo Sapiens
ucuaugagcacagguccuccuagugaagcuuaguuugacaaagggugucauaugcuuuccuaac

SEQ ID NO: 63643 - RNA, 64 nt, Homo Sapiens
gucagacauuuaccaacuauuuucuaaaacuaauuugacaaaucaugacacuagaaaacgccaa

SEQ ID NO: 63644 - RNA, 64 nt, Homo Sapiens
gaaauaaugccacauaucuacaacuaucugaccuuugacaaaccugacaaaaacaagcaauggg

SEQ ID NO: 63645 - RNA, 64 nt, Homo Sapiens
aaaacaccaaaagcaauggcaacaaaagccaaaauugacaaaugggaucuaauuaaacuaaaga

SEQ ID NO: 63646 - RNA, 64 nt, Homo Sapiens
aauaaaccagucucuuggagggcacaacccuuauuugacaaaacuuggauguuggcuugacugu

SEQ ID NO: 63647 - RNA, 64 nt, Homo Sapiens
uuccaaaacaaaaauaaagaccuguccaaaaguuuugacaaaaauacugauugcucccaaauaa

SEQ ID NO: 63648 - RNA, 64 nt, Homo Sapiens
uguuggcucaguaaugcucaagauaucaauuguuuugacaaaauaaauuuacugaacuugggcu

SEQ ID NO: 63649 - RNA, 64 nt, Homo Sapiens
ugcugcuaguuuuauguaauauuuauugaacauuuugacaaauauuuauuuuuguaagccuaaa

SEQ ID NO: 63650 - RNA, 64 nt, Homo Sapiens
uuuacuguguugaagcuaaaaaaauaauggcucuuugacaaaacuuguuauguugaucgcggua

SEQ ID NO: 63651 - RNA, 64 nt, Homo Sapiens
agaagaacguaaguuguacaaagauauuuguacuuugacaaacugaauuuaaauaaacuuuauu

SEQ ID NO: 63652 - RNA, 64 nt, Homo Sapiens
uguuggcucaguaaugcucacgauaccaauuguuuugacaaaauaaauuuacuaaacuuggccu

SEQ ID NO: 63653 - RNA, 64 nt, Homo Sapiens
cuuuaaaaacaaaucuuuucaauggcauaagaaguugacaaaaauuucuuaaagugcaauagau

SEQ ID NO: 63654 - RNA, 64 nt, Homo Sapiens
uuugcugcuaguuguguaauauuuauugaacauuuugacaaauauuuauuuuuguaagccuaaa

SEQ ID NO: 63655 - RNA, 63 nt, Homo Sapiens; identical to SEQ ID NO: 57615

SEQ ID NO: 63656 - RNA, 63 nt, Homo Sapiens; identical to SEQ ID NO: 57616

SEQ ID NO: 63657 - RNA, 63 nt, Homo Sapiens; identical to SEQ ID NO: 57617

SEQ ID NO: 63658 - RNA, 63 nt, Homo Sapiens; identical to SEQ ID NO: 57618

SEQ ID NO: 63659 - RNA, 63 nt, Homo Sapiens; identical to SEQ ID NO: 57619

SEQ ID NO: 63660 - RNA, 63 nt, Homo Sapiens; identical to SEQ ID NO: 57620

SEQ ID NO: 63661 - RNA, 50 nt, Homo Sapiens; identical to SEQ ID NO: 57621

SEQ ID NO: 63662 - RNA, 63 nt, Homo Sapiens; identical to SEQ ID NO: 57622

SEQ ID NO: 63663 - RNA, 63 nt, Homo Sapiens; identical to SEQ ID NO: 57623

SEQ ID NO: 63664 - RNA, 63 nt, Homo Sapiens; identical to SEQ ID NO: 57624

SEQ ID NO: 63665 - RNA, 63 nt, Homo Sapiens; identical to SEQ ID NO: 57625

SEQ ID NO: 63666 - RNA, 63 nt, Homo Sapiens; identical to SEQ ID NO: 57626

SEQ ID NO: 63667 - RNA, 63 nt, Homo Sapiens; identical to SEQ ID NO: 57627

SEQ ID NO: 63668 - RNA, 63 nt, Homo Sapiens; identical to SEQ ID NO: 57628

SEQ ID NO: 63669 - RNA, 63 nt, Homo Sapiens; identical to SEQ ID NO: 57629

SEQ ID NO: 63670 - RNA, 63 nt, Homo Sapiens; identical to SEQ ID NO: 57630

SEQ ID NO: 63671 - RNA, 63 nt, Homo Sapiens; identical to SEQ ID NO: 57631

SEQ ID NO: 63672 - RNA, 63 nt, Homo Sapiens; identical to SEQ ID NO: 57632

SEQ ID NO: 63673 - RNA, 63 nt, Homo Sapiens; identical to SEQ ID NO: 57633

SEQ ID NO: 63674 - RNA, 66 nt, Homo Sapiens; identical to SEQ ID NO: 57634

SEQ ID NO: 63675 - RNA, 66 nt, Homo Sapiens; identical to SEQ ID NO: 57635

SEQ ID NO: 63676 - RNA, 66 nt, Homo Sapiens; identical to SEQ ID NO: 57636

SEQ ID NO: 63677 - RNA, 66 nt, Homo Sapiens; identical to SEQ ID NO: 57637

SEQ ID NO: 63678 - RNA, 66 nt, Homo Sapiens; identical to SEQ ID NO: 57638

SEQ ID NO: 63679 - RNA, 66 nt, Homo Sapiens; identical to SEQ ID NO: 57639

SEQ ID NO: 63680 - RNA, 66 nt, Homo Sapiens; identical to SEQ ID NO: 57640

SEQ ID NO: 63681 - RNA, 66 nt, Homo Sapiens; identical to SEQ ID NO: 57641

SEQ ID NO: 63682 - RNA, 66 nt, Homo Sapiens; identical to SEQ ID NO: 57642

SEQ ID NO: 63683 - RNA, 66 nt, Homo Sapiens; identical to SEQ ID NO: 57643

SEQ ID NO: 63684 - RNA, 66 nt, Homo Sapiens; identical to SEQ ID NO: 57644

SEQ ID NO: 63685 - RNA, 66 nt, Homo Sapiens; identical to SEQ ID NO: 57645

SEQ ID NO: 63686 - RNA, 66 nt, Homo Sapiens; identical to SEQ ID NO: 57646

SEQ ID NO: 63687 - RNA, 66 nt, Homo Sapiens; identical to SEQ ID NO: 57647

SEQ ID NO: 63688 - RNA, 66 nt, Homo Sapiens; identical to SEQ ID NO: 57648

SEQ ID NO: 63689 - RNA, 66 nt, Homo Sapiens; identical to SEQ ID NO: 57649

SEQ ID NO: 63690 - RNA, 66 nt, Homo Sapiens; identical to SEQ ID NO: 57650

SEQ ID NO: 63691 - RNA, 66 nt, Homo Sapiens; identical to SEQ ID NO: 57651

SEQ ID NO: 63692 - RNA, 66 nt, Homo Sapiens; identical to SEQ ID NO: 57652

SEQ ID NO: 63693 - RNA, 66 nt, Homo Sapiens; identical to SEQ ID NO: 57653

SEQ ID NO: 63694 - RNA, 66 nt, Homo Sapiens; identical to SEQ ID NO: 57654

SEQ ID NO: 63695 - RNA, 66 nt, Homo Sapiens; identical to SEQ ID NO: 57655

SEQ ID NO: 63696 - RNA, 66 nt, Homo Sapiens; identical to SEQ ID NO: 57656

SEQ ID NO: 63697 - RNA, 66 nt, Homo Sapiens; identical to SEQ ID NO: 57657

SEQ ID NO: 63698 - RNA, 66 nt, Homo Sapiens; identical to SEQ ID NO: 57658

SEQ ID NO: 63699 - RNA, 66 nt, Homo Sapiens; identical to SEQ ID NO: 57659

SEQ ID NO: 63700 - RNA, 66 nt, Homo Sapiens; identical to SEQ ID NO: 57660

SEQ ID NO: 63701 - RNA, 66 nt, Homo Sapiens; identical to SEQ ID NO: 57661

SEQ ID NO: 63702 - RNA, 66 nt, Homo Sapiens; identical to SEQ ID NO: 57662

SEQ ID NO: 63703 - RNA, 66 nt, Homo Sapiens; identical to SEQ ID NO: 57663

SEQ ID NO: 63704 - RNA, 66 nt, Homo Sapiens; identical to SEQ ID NO: 57664

SEQ ID NO: 63705 - RNA, 66 nt, Homo Sapiens; identical to SEQ ID NO: 57665

SEQ ID NO: 63706 - RNA, 66 nt, Homo Sapiens; identical to SEQ ID NO: 57666

SEQ ID NO: 63707 - RNA, 66 nt, Homo Sapiens; identical to SEQ ID NO: 57667

SEQ ID NO: 63708 - RNA, 66 nt, Homo Sapiens; identical to SEQ ID NO: 57668

SEQ ID NO: 63709 - RNA, 63 nt, Homo Sapiens; identical to SEQ ID NO: 57669

SEQ ID NO: 63710 - RNA, 63 nt, Homo Sapiens; identical to SEQ ID NO: 57670

SEQ ID NO: 63711 - RNA, 63 nt, Homo Sapiens; identical to SEQ ID NO: 57671

SEQ ID NO: 63712 - RNA, 63 nt, Homo Sapiens; identical to SEQ ID NO: 57672

SEQ ID NO: 63713 - RNA, 63 nt, Homo Sapiens; identical to SEQ ID NO: 57673

SEQ ID NO: 63714 - RNA, 63 nt, Homo Sapiens; identical to SEQ ID NO: 57674

SEQ ID NO: 63715 - RNA, 63 nt, Homo Sapiens; identical to SEQ ID NO: 57675

SEQ ID NO: 63716 - RNA, 63 nt, Homo Sapiens; identical to SEQ ID NO: 57676

SEQ ID NO: 63717 - RNA, 63 nt, Homo Sapiens; identical to SEQ ID NO: 57677

SEQ ID NO: 63718 - RNA, 63 nt, Homo Sapiens; identical to SEQ ID NO: 57678

SEQ ID NO: 63719 - RNA, 63 nt, Homo Sapiens; identical to SEQ ID NO: 57679

SEQ ID NO: 63720 - RNA, 63 nt, Homo Sapiens; identical to SEQ ID NO: 57680

SEQ ID NO: 63721 - RNA, 63 nt, Homo Sapiens; identical to SEQ ID NO: 57681

SEQ ID NO: 63722 - RNA, 63 nt, Homo Sapiens; identical to SEQ ID NO: 57682

SEQ ID NO: 63723 - RNA, 63 nt, Homo Sapiens; identical to SEQ ID NO: 57683

SEQ ID NO: 63724 - RNA, 63 nt, Homo Sapiens; identical to SEQ ID NO: 57684

SEQ ID NO: 63725 - RNA, 63 nt, Homo Sapiens; identical to SEQ ID NO: 57685

SEQ ID NO: 63726 - RNA, 63 nt, Homo Sapiens; identical to SEQ ID NO: 57686

SEQ ID NO: 63727 - RNA, 63 nt, Homo Sapiens; identical to SEQ ID NO: 57687

SEQ ID NO: 63728 - RNA, 63 nt, Homo Sapiens; identical to SEQ ID NO: 57688

SEQ ID NO: 63729 - RNA, 63 nt, Homo Sapiens; identical to SEQ ID NO: 57689

SEQ ID NO: 63730 - RNA, 63 nt, Homo Sapiens; identical to SEQ ID NO: 57690

SEQ ID NO: 63731 - RNA, 63 nt, Homo Sapiens; identical to SEQ ID NO: 57691

SEQ ID NO: 63732 - RNA, 63 nt, Homo Sapiens; identical to SEQ ID NO: 57692

SEQ ID NO: 63733 - RNA, 63 nt, Homo Sapiens; identical to SEQ ID NO: 57693

SEQ ID NO: 63734 - RNA, 63 nt, Homo Sapiens; identical to SEQ ID NO: 57694

SEQ ID NO: 63735 - RNA, 63 nt, Homo Sapiens; identical to SEQ ID NO: 57695

SEQ ID NO: 63736 - RNA, 63 nt, Homo Sapiens; identical to SEQ ID NO: 57696

SEQ ID NO: 63737 - RNA, 63 nt, Homo Sapiens; identical to SEQ ID NO: 57697

SEQ ID NO: 63738 - RNA, 63 nt, Homo Sapiens; identical to SEQ ID NO: 57698

SEQ ID NO: 63739 - RNA, 63 nt, Homo Sapiens; identical to SEQ ID NO: 57699

SEQ ID NO: 63740 - RNA, 63 nt, Homo Sapiens; identical to SEQ ID NO: 57700

SEQ ID NO: 63741 - RNA, 63 nt, Homo Sapiens; identical to SEQ ID NO: 57701

SEQ ID NO: 63742 - RNA, 63 nt, Homo Sapiens; identical to SEQ ID NO: 57702

SEQ ID NO: 63743 - RNA, 63 nt, Homo Sapiens; identical to SEQ ID NO: 57703

SEQ ID NO: 63744 - RNA, 63 nt, Homo Sapiens; identical to SEQ ID NO: 57704

SEQ ID NO: 63745 - RNA, 63 nt, Homo Sapiens; identical to SEQ ID NO: 57705

SEQ ID NO: 63746 - RNA, 63 nt, Homo Sapiens; identical to SEQ ID NO: 57706

SEQ ID NO: 63747 - RNA, 63 nt, Homo Sapiens; identical to SEQ ID NO: 57707

SEQ ID NO: 63748 - RNA, 63 nt, Homo Sapiens; identical to SEQ ID NO: 57708

SEQ ID NO: 63749 - RNA, 63 nt, Homo Sapiens; identical to SEQ ID NO: 57709

SEQ ID NO: 63750 - RNA, 63 nt, Homo Sapiens; identical to SEQ ID NO: 57710

SEQ ID NO: 63751 - RNA, 63 nt, Homo Sapiens; identical to SEQ ID NO: 57711

SEQ ID NO: 63752 - RNA, 63 nt, Homo Sapiens; identical to SEQ ID NO: 57712

SEQ ID NO: 63753 - RNA, 63 nt, Homo Sapiens; identical to SEQ ID NO: 57713

SEQ ID NO: 63754 - RNA, 63 nt, Homo Sapiens; identical to SEQ ID NO: 57714

SEQ ID NO: 63755 - RNA, 63 nt, Homo Sapiens; identical to SEQ ID NO: 57715

SEQ ID NO: 63756 - RNA, 63 nt, Homo Sapiens; identical to SEQ ID NO: 57716

SEQ ID NO: 63757 - RNA, 63 nt, Homo Sapiens; identical to SEQ ID NO: 57717

SEQ ID NO: 63758 - RNA, 63 nt, Homo Sapiens; identical to SEQ ID NO: 57718

SEQ ID NO: 63759 - RNA, 63 nt, Homo Sapiens; identical to SEQ ID NO: 57719

SEQ ID NO: 63760 - RNA, 63 nt, Homo Sapiens; identical to SEQ ID NO: 57720

SEQ ID NO: 63761 - RNA, 63 nt, Homo Sapiens; identical to SEQ ID NO: 57721

SEQ ID NO: 63762 - RNA, 63 nt, Homo Sapiens; identical to SEQ ID NO: 57722

SEQ ID NO: 63763 - RNA, 63 nt, Homo Sapiens; identical to SEQ ID NO: 57723

SEQ ID NO: 63764 - RNA, 63 nt, Homo Sapiens; identical to SEQ ID NO: 57724

SEQ ID NO: 63765 - RNA, 63 nt, Homo Sapiens; identical to SEQ ID NO: 57725

SEQ ID NO: 63766 - RNA, 63 nt, Homo Sapiens; identical to SEQ ID NO: 57726

SEQ ID NO: 63767 - RNA, 63 nt, Homo Sapiens; identical to SEQ ID NO: 57727

SEQ ID NO: 63768 - RNA, 63 nt, Homo Sapiens; identical to SEQ ID NO: 57728

SEQ ID NO: 63769 - RNA, 63 nt, Homo Sapiens; identical to SEQ ID NO: 57729

SEQ ID NO: 63770 - RNA, 63 nt, Homo Sapiens; identical to SEQ ID NO: 57730

SEQ ID NO: 63771 - RNA, 63 nt, Homo Sapiens; identical to SEQ ID NO: 57731

SEQ ID NO: 63772 - RNA, 63 nt, Homo Sapiens; identical to SEQ ID NO: 57732

SEQ ID NO: 63773 - RNA, 63 nt, Homo Sapiens; identical to SEQ ID NO: 57733

SEQ ID NO: 63774 - RNA, 63 nt, Homo Sapiens; identical to SEQ ID NO: 57734

SEQ ID NO: 63775 - RNA, 63 nt, Homo Sapiens; identical to SEQ ID NO: 57735

SEQ ID NO: 63776 - RNA, 63 nt, Homo Sapiens; identical to SEQ ID NO: 57736

SEQ ID NO: 63777 - RNA, 63 nt, Homo Sapiens; identical to SEQ ID NO: 57737

SEQ ID NO: 63778 - RNA, 63 nt, Homo Sapiens; identical to SEQ ID NO: 57738

SEQ ID NO: 63779 - RNA, 63 nt, Homo Sapiens; identical to SEQ ID NO: 57739

SEQ ID NO: 63780 - RNA, 63 nt, Homo Sapiens; identical to SEQ ID NO: 57740

SEQ ID NO: 63781 - RNA, 63 nt, Homo Sapiens; identical to SEQ ID NO: 57741

SEQ ID NO: 63782 - RNA, 63 nt, Homo Sapiens; identical to SEQ ID NO: 57742

SEQ ID NO: 63783 - RNA, 63 nt, Homo Sapiens; identical to SEQ ID NO: 57743

SEQ ID NO: 63784 - RNA, 63 nt, Homo Sapiens; identical to SEQ ID NO: 57744

SEQ ID NO: 63785 - RNA, 63 nt, Homo Sapiens; identical to SEQ ID NO: 57745

SEQ ID NO: 63786 - RNA, 63 nt, Homo Sapiens; identical to SEQ ID NO: 57746

SEQ ID NO: 63787 - RNA, 63 nt, Homo Sapiens; identical to SEQ ID NO: 57747

SEQ ID NO: 63788 - RNA, 63 nt, Homo Sapiens; identical to SEQ ID NO: 57748

SEQ ID NO: 63789 - RNA, 63 nt, Homo Sapiens; identical to SEQ ID NO: 57749

SEQ ID NO: 63790 - RNA, 63 nt, Homo Sapiens; identical to SEQ ID NO: 57750

SEQ ID NO: 63791 - RNA, 63 nt, Homo Sapiens; identical to SEQ ID NO: 57751

SEQ ID NO: 63792 - RNA, 63 nt, Homo Sapiens; identical to SEQ ID NO: 57752

SEQ ID NO: 63793 - RNA, 63 nt, Homo Sapiens; identical to SEQ ID NO: 57753

SEQ ID NO: 63794 - RNA, 63 nt, Homo Sapiens; identical to SEQ ID NO: 57754

SEQ ID NO: 63795 - RNA, 63 nt, Homo Sapiens; identical to SEQ ID NO: 57755

SEQ ID NO: 63796 - RNA, 63 nt, Homo Sapiens; identical to SEQ ID NO: 57756

SEQ ID NO: 63797 - RNA, 63 nt, Homo Sapiens; identical to SEQ ID NO: 57757

SEQ ID NO: 63798 - RNA, 63 nt, Homo Sapiens; identical to SEQ ID NO: 57758

SEQ ID NO: 63799 - RNA, 63 nt, Homo Sapiens; identical to SEQ ID NO: 57759

SEQ ID NO: 63800 - RNA, 63 nt, Homo Sapiens; identical to SEQ ID NO: 57760

SEQ ID NO: 63801 - RNA, 63 nt, Homo Sapiens; identical to SEQ ID NO: 57761

SEQ ID NO: 63802 - RNA, 63 nt, Homo Sapiens; identical to SEQ ID NO: 57762

SEQ ID NO: 63803 - RNA, 63 nt, Homo Sapiens; identical to SEQ ID NO: 57763

SEQ ID NO: 63804 - RNA, 63 nt, Homo Sapiens; identical to SEQ ID NO: 57764

SEQ ID NO: 63805 - RNA, 63 nt, Homo Sapiens; identical to SEQ ID NO: 57765

SEQ ID NO: 63806 - RNA, 63 nt, Homo Sapiens; identical to SEQ ID NO: 57766

SEQ ID NO: 63807 - RNA, 63 nt, Homo Sapiens; identical to SEQ ID NO: 57767

SEQ ID NO: 63808 - RNA, 63 nt, Homo Sapiens; identical to SEQ ID NO: 57768

SEQ ID NO: 63809 - RNA, 63 nt, Homo Sapiens; identical to SEQ ID NO: 57769

SEQ ID NO: 63810 - RNA, 63 nt, Homo Sapiens; identical to SEQ ID NO: 57770

SEQ ID NO: 63811 - RNA, 63 nt, Homo Sapiens; identical to SEQ ID NO: 57771

SEQ ID NO: 63812 - RNA, 63 nt, Homo Sapiens; identical to SEQ ID NO: 57772

SEQ ID NO: 63813 - RNA, 63 nt, Homo Sapiens; identical to SEQ ID NO: 57773

SEQ ID NO: 63814 - RNA, 63 nt, Homo Sapiens; identical to SEQ ID NO: 57774

SEQ ID NO: 63815 - RNA, 63 nt, Homo Sapiens; identical to SEQ ID NO: 57775

SEQ ID NO: 63816 - RNA, 63 nt, Homo Sapiens; identical to SEQ ID NO: 57776

SEQ ID NO: 63817 - RNA, 63 nt, Homo Sapiens; identical to SEQ ID NO: 57777

SEQ ID NO: 63818 - RNA, 63 nt, Homo Sapiens; identical to SEQ ID NO: 57778

SEQ ID NO: 63819 - RNA, 63 nt, Homo Sapiens; identical to SEQ ID NO: 57779

SEQ ID NO: 63820 - RNA, 63 nt, Homo Sapiens; identical to SEQ ID NO: 57780

SEQ ID NO: 63821 - RNA, 63 nt, Homo Sapiens; identical to SEQ ID NO: 57781

SEQ ID NO: 63822 - RNA, 63 nt, Homo Sapiens; identical to SEQ ID NO: 57782

SEQ ID NO: 63823 - RNA, 63 nt, Homo Sapiens; identical to SEQ ID NO: 57783

SEQ ID NO: 63824 - RNA, 63 nt, Homo Sapiens; identical to SEQ ID NO: 57784

SEQ ID NO: 63825 - RNA, 63 nt, Homo Sapiens; identical to SEQ ID NO: 57785

SEQ ID NO: 63826 - RNA, 63 nt, Homo Sapiens; identical to SEQ ID NO: 57786

SEQ ID NO: 63827 - RNA, 63 nt, Homo Sapiens; identical to SEQ ID NO: 57787

SEQ ID NO: 63828 - RNA, 63 nt, Homo Sapiens; identical to SEQ ID NO: 57788

SEQ ID NO: 63829 - RNA, 63 nt, Homo Sapiens; identical to SEQ ID NO: 57789

SEQ ID NO: 63830 - RNA, 63 nt, Homo Sapiens; identical to SEQ ID NO: 57790

SEQ ID NO: 63831 - RNA, 63 nt, Homo Sapiens; identical to SEQ ID NO: 57791

SEQ ID NO: 63832 - RNA, 63 nt, Homo Sapiens; identical to SEQ ID NO: 57792

SEQ ID NO: 63833 - RNA, 63 nt, Homo Sapiens; identical to SEQ ID NO: 57793

SEQ ID NO: 63834 - RNA, 63 nt, Homo Sapiens; identical to SEQ ID NO: 57794

SEQ ID NO: 63835 - RNA, 51 nt, Homo Sapiens; identical to SEQ ID NO: 57795

SEQ ID NO: 63836 - RNA, 63 nt, Homo Sapiens; identical to SEQ ID NO: 57796

SEQ ID NO: 63837 - RNA, 63 nt, Homo Sapiens; identical to SEQ ID NO: 57797

SEQ ID NO: 63838 - RNA, 63 nt, Homo Sapiens; identical to SEQ ID NO: 57798

SEQ ID NO: 63839 - RNA, 63 nt, Homo Sapiens; identical to SEQ ID NO: 57799

SEQ ID NO: 63840 - RNA, 63 nt, Homo Sapiens; identical to SEQ ID NO: 57800

SEQ ID NO: 63841 - RNA, 63 nt, Homo Sapiens; identical to SEQ ID NO: 57801

SEQ ID NO: 63842 - RNA, 63 nt, Homo Sapiens; identical to SEQ ID NO: 57802

SEQ ID NO: 63843 - RNA, 63 nt, Homo Sapiens; identical to SEQ ID NO: 57803

SEQ ID NO: 63844 - RNA, 63 nt, Homo Sapiens; identical to SEQ ID NO: 57804

SEQ ID NO: 63845 - RNA, 63 nt, Homo Sapiens; identical to SEQ ID NO: 57805

SEQ ID NO: 63846 - RNA, 63 nt, Homo Sapiens; identical to SEQ ID NO: 57806

SEQ ID NO: 63847 - RNA, 63 nt, Homo Sapiens; identical to SEQ ID NO: 57807

SEQ ID NO: 63848 - RNA, 63 nt, Homo Sapiens; identical to SEQ ID NO: 57808

SEQ ID NO: 63849 - RNA, 63 nt, Homo Sapiens; identical to SEQ ID NO: 57809

SEQ ID NO: 63850 - RNA, 63 nt, Homo Sapiens; identical to SEQ ID NO: 57810

SEQ ID NO: 63851 - RNA, 63 nt, Homo Sapiens; identical to SEQ ID NO: 57811

SEQ ID NO: 63852 - RNA, 63 nt, Homo Sapiens; identical to SEQ ID NO: 57812

SEQ ID NO: 63853 - RNA, 63 nt, Homo Sapiens; identical to SEQ ID NO: 57813

SEQ ID NO: 63854 - RNA, 63 nt, Homo Sapiens; identical to SEQ ID NO: 57814

SEQ ID NO: 63855 - RNA, 63 nt, Homo Sapiens; identical to SEQ ID NO: 57815

SEQ ID NO: 63856 - RNA, 63 nt, Homo Sapiens; identical to SEQ ID NO: 57816

SEQ ID NO: 63857 - RNA, 63 nt, Homo Sapiens; identical to SEQ ID NO: 57817

SEQ ID NO: 63858 - RNA, 63 nt, Homo Sapiens; identical to SEQ ID NO: 57818

SEQ ID NO: 63859 - RNA, 63 nt, Homo Sapiens; identical to SEQ ID NO: 57819

SEQ ID NO: 63860 - RNA, 63 nt, Homo Sapiens; identical to SEQ ID NO: 57820

SEQ ID NO: 63861 - RNA, 63 nt, Homo Sapiens; identical to SEQ ID NO: 57821

SEQ ID NO: 63862 - RNA, 63 nt, Homo Sapiens; identical to SEQ ID NO: 57822

SEQ ID NO: 63863 - RNA, 63 nt, Homo Sapiens; identical to SEQ ID NO: 57823

SEQ ID NO: 63864 - RNA, 63 nt, Homo Sapiens; identical to SEQ ID NO: 57824

SEQ ID NO: 63865 - RNA, 63 nt, Homo Sapiens; identical to SEQ ID NO: 57825

SEQ ID NO: 63866 - RNA, 63 nt, Homo Sapiens; identical to SEQ ID NO: 57826

SEQ ID NO: 63867 - RNA, 63 nt, Homo Sapiens; identical to SEQ ID NO: 57827

SEQ ID NO: 63868 - RNA, 63 nt, Homo Sapiens; identical to SEQ ID NO: 57828

SEQ ID NO: 63869 - RNA, 63 nt, Homo Sapiens; identical to SEQ ID NO: 57829

SEQ ID NO: 63870 - RNA, 63 nt, Homo Sapiens; identical to SEQ ID NO: 57830

SEQ ID NO: 63871 - RNA, 63 nt, Homo Sapiens; identical to SEQ ID NO: 57831

SEQ ID NO: 63872 - RNA, 63 nt, Homo Sapiens; identical to SEQ ID NO: 57832

SEQ ID NO: 63873 - RNA, 63 nt, Homo Sapiens; identical to SEQ ID NO: 57833

SEQ ID NO: 63874 - RNA, 63 nt, Homo Sapiens; identical to SEQ ID NO: 57834

SEQ ID NO: 63875 - RNA, 63 nt, Homo Sapiens; identical to SEQ ID NO: 57835

SEQ ID NO: 63876 - RNA, 63 nt, Homo Sapiens; identical to SEQ ID NO: 57836

SEQ ID NO: 63877 - RNA, 63 nt, Homo Sapiens; identical to SEQ ID NO: 57837

SEQ ID NO: 63878 - RNA, 63 nt, Homo Sapiens; identical to SEQ ID NO: 57838

SEQ ID NO: 63879 - RNA, 63 nt, Homo Sapiens; identical to SEQ ID NO: 57839

SEQ ID NO: 63880 - RNA, 63 nt, Homo Sapiens; identical to SEQ ID NO: 57840

SEQ ID NO: 63881 - RNA, 63 nt, Homo Sapiens; identical to SEQ ID NO: 57841

SEQ ID NO: 63882 - RNA, 63 nt, Homo Sapiens; identical to SEQ ID NO: 57842

SEQ ID NO: 63883 - RNA, 63 nt, Homo Sapiens; identical to SEQ ID NO: 57843

SEQ ID NO: 63884 - RNA, 63 nt, Homo Sapiens; identical to SEQ ID NO: 57844

SEQ ID NO: 63885 - RNA, 63 nt, Homo Sapiens; identical to SEQ ID NO: 57845

SEQ ID NO: 63886 - RNA, 63 nt, Homo Sapiens; identical to SEQ ID NO: 57846

SEQ ID NO: 63887 - RNA, 63 nt, Homo Sapiens; identical to SEQ ID NO: 57847

SEQ ID NO: 63888 - RNA, 63 nt, Homo Sapiens; identical to SEQ ID NO: 57848

SEQ ID NO: 63889 - RNA, 63 nt, Homo Sapiens; identical to SEQ ID NO: 57849

SEQ ID NO: 63890 - RNA, 63 nt, Homo Sapiens; identical to SEQ ID NO: 57850

SEQ ID NO: 63891 - RNA, 63 nt, Homo Sapiens; identical to SEQ ID NO: 57851

SEQ ID NO: 63892 - RNA, 63 nt, Homo Sapiens; identical to SEQ ID NO: 57852

SEQ ID NO: 63893 - RNA, 63 nt, Homo Sapiens; identical to SEQ ID NO: 57853

SEQ ID NO: 63894 - RNA, 63 nt, Homo Sapiens; identical to SEQ ID NO: 57854

SEQ ID NO: 63895 - RNA, 63 nt, Homo Sapiens; identical to SEQ ID NO: 57855

SEQ ID NO: 63896 - RNA, 63 nt, Homo Sapiens; identical to SEQ ID NO: 57856

SEQ ID NO: 63897 - RNA, 63 nt, Homo Sapiens; identical to SEQ ID NO: 57857

SEQ ID NO: 63898 - RNA, 63 nt, Homo Sapiens; identical to SEQ ID NO: 57858

SEQ ID NO: 63899 - RNA, 63 nt, Homo Sapiens; identical to SEQ ID NO: 57859

SEQ ID NO: 63900 - RNA, 63 nt, Homo Sapiens; identical to SEQ ID NO: 57860

SEQ ID NO: 63901 - RNA, 63 nt, Homo Sapiens; identical to SEQ ID NO: 57861

SEQ ID NO: 63902 - RNA, 63 nt, Homo Sapiens; identical to SEQ ID NO: 57862

SEQ ID NO: 63903 - RNA, 63 nt, Homo Sapiens; identical to SEQ ID NO: 57863

SEQ ID NO: 63904 - RNA, 63 nt, Homo Sapiens; identical to SEQ ID NO: 57864

SEQ ID NO: 63905 - RNA, 63 nt, Homo Sapiens; identical to SEQ ID NO: 57865

SEQ ID NO: 63906 - RNA, 63 nt, Homo Sapiens; identical to SEQ ID NO: 57866

SEQ ID NO: 63907 - RNA, 63 nt, Homo Sapiens; identical to SEQ ID NO: 57867

SEQ ID NO: 63908 - RNA, 63 nt, Homo Sapiens; identical to SEQ ID NO: 57868

SEQ ID NO: 63909 - RNA, 63 nt, Homo Sapiens; identical to SEQ ID NO: 57869

SEQ ID NO: 63910 - RNA, 63 nt, Homo Sapiens; identical to SEQ ID NO: 57870

SEQ ID NO: 63911 - RNA, 63 nt, Homo Sapiens; identical to SEQ ID NO: 57871

SEQ ID NO: 63912 - RNA, 63 nt, Homo Sapiens; identical to SEQ ID NO: 57872

SEQ ID NO: 63913 - RNA, 63 nt, Homo Sapiens; identical to SEQ ID NO: 57873

SEQ ID NO: 63914 - RNA, 63 nt, Homo Sapiens; identical to SEQ ID NO: 57874

SEQ ID NO: 63915 - RNA, 63 nt, Homo Sapiens; identical to SEQ ID NO: 57875

SEQ ID NO: 63916 - RNA, 63 nt, Homo Sapiens; identical to SEQ ID NO: 57876

SEQ ID NO: 63917 - RNA, 63 nt, Homo Sapiens; identical to SEQ ID NO: 57877

SEQ ID NO: 63918 - RNA, 63 nt, Homo Sapiens; identical to SEQ ID NO: 57878

SEQ ID NO: 63919 - RNA, 63 nt, Homo Sapiens; identical to SEQ ID NO: 57879

SEQ ID NO: 63920 - RNA, 63 nt, Homo Sapiens; identical to SEQ ID NO: 57880

SEQ ID NO: 63921 - RNA, 63 nt, Homo Sapiens; identical to SEQ ID NO: 57881

SEQ ID NO: 63922 - RNA, 63 nt, Homo Sapiens; identical to SEQ ID NO: 57882

SEQ ID NO: 63923 - RNA, 63 nt, Homo Sapiens; identical to SEQ ID NO: 57883

SEQ ID NO: 63924 - RNA, 63 nt, Homo Sapiens; identical to SEQ ID NO: 57884

SEQ ID NO: 63925 - RNA, 63 nt, Homo Sapiens; identical to SEQ ID NO: 57885

SEQ ID NO: 63926 - RNA, 63 nt, Homo Sapiens; identical to SEQ ID NO: 57886

SEQ ID NO: 63927 - RNA, 63 nt, Homo Sapiens; identical to SEQ ID NO: 57887

SEQ ID NO: 63928 - RNA, 63 nt, Homo Sapiens; identical to SEQ ID NO: 57888

SEQ ID NO: 63929 - RNA, 63 nt, Homo Sapiens; identical to SEQ ID NO: 57889

SEQ ID NO: 63930 - RNA, 63 nt, Homo Sapiens; identical to SEQ ID NO: 57890

SEQ ID NO: 63931 - RNA, 63 nt, Homo Sapiens; identical to SEQ ID NO: 57891

SEQ ID NO: 63932 - RNA, 63 nt, Homo Sapiens; identical to SEQ ID NO: 57892

SEQ ID NO: 63933 - RNA, 63 nt, Homo Sapiens; identical to SEQ ID NO: 57893

SEQ ID NO: 63934 - RNA, 63 nt, Homo Sapiens; identical to SEQ ID NO: 57894

SEQ ID NO: 63935 - RNA, 63 nt, Homo Sapiens; identical to SEQ ID NO: 57895

SEQ ID NO: 63936 - RNA, 63 nt, Homo Sapiens; identical to SEQ ID NO: 57896

SEQ ID NO: 63937 - RNA, 63 nt, Homo Sapiens; identical to SEQ ID NO: 57897

SEQ ID NO: 63938 - RNA, 63 nt, Homo Sapiens; identical to SEQ ID NO: 57898

SEQ ID NO: 63939 - RNA, 63 nt, Homo Sapiens; identical to SEQ ID NO: 57899

SEQ ID NO: 63940 - RNA, 63 nt, Homo Sapiens; identical to SEQ ID NO: 57900

SEQ ID NO: 63941 - RNA, 63 nt, Homo Sapiens; identical to SEQ ID NO: 57901

SEQ ID NO: 63942 - RNA, 63 nt, Homo Sapiens; identical to SEQ ID NO: 57902

SEQ ID NO: 63943 - RNA, 63 nt, Homo Sapiens; identical to SEQ ID NO: 57903

SEQ ID NO: 63944 - RNA, 63 nt, Homo Sapiens; identical to SEQ ID NO: 57904

SEQ ID NO: 63945 - RNA, 63 nt, Homo Sapiens; identical to SEQ ID NO: 57905

SEQ ID NO: 63946 - RNA, 63 nt, Homo Sapiens; identical to SEQ ID NO: 57906

SEQ ID NO: 63947 - RNA, 63 nt, Homo Sapiens; identical to SEQ ID NO: 57907

SEQ ID NO: 63948 - RNA, 63 nt, Homo Sapiens; identical to SEQ ID NO: 57908

SEQ ID NO: 63949 - RNA, 63 nt, Homo Sapiens; identical to SEQ ID NO: 57909

SEQ ID NO: 63950 - RNA, 63 nt, Homo Sapiens; identical to SEQ ID NO: 57910

SEQ ID NO: 63951 - RNA, 63 nt, Homo Sapiens; identical to SEQ ID NO: 57911

SEQ ID NO: 63952 - RNA, 63 nt, Homo Sapiens; identical to SEQ ID NO: 57912

SEQ ID NO: 63953 - RNA, 63 nt, Homo Sapiens; identical to SEQ ID NO: 57913

SEQ ID NO: 63954 - RNA, 63 nt, Homo Sapiens; identical to SEQ ID NO: 57914

SEQ ID NO: 63955 - RNA, 63 nt, Homo Sapiens; identical to SEQ ID NO: 57915

SEQ ID NO: 63956 - RNA, 63 nt, Homo Sapiens; identical to SEQ ID NO: 57916

SEQ ID NO: 63957 - RNA, 63 nt, Homo Sapiens; identical to SEQ ID NO: 57917

SEQ ID NO: 63958 - RNA, 63 nt, Homo Sapiens; identical to SEQ ID NO: 57918

SEQ ID NO: 63959 - RNA, 63 nt, Homo Sapiens; identical to SEQ ID NO: 57919

SEQ ID NO: 63960 - RNA, 63 nt, Homo Sapiens; identical to SEQ ID NO: 57920

SEQ ID NO: 63961 - RNA, 63 nt, Homo Sapiens; identical to SEQ ID NO: 57921

SEQ ID NO: 63962 - RNA, 63 nt, Homo Sapiens; identical to SEQ ID NO: 57922

SEQ ID NO: 63963 - RNA, 63 nt, Homo Sapiens; identical to SEQ ID NO: 57923

SEQ ID NO: 63964 - RNA, 63 nt, Homo Sapiens; identical to SEQ ID NO: 57924

SEQ ID NO: 63965 - RNA, 63 nt, Homo Sapiens; identical to SEQ ID NO: 57925

SEQ ID NO: 63966 - RNA, 63 nt, Homo Sapiens; identical to SEQ ID NO: 57926

SEQ ID NO: 63967 - RNA, 63 nt, Homo Sapiens; identical to SEQ ID NO: 57927

SEQ ID NO: 63968 - RNA, 63 nt, Homo Sapiens; identical to SEQ ID NO: 57928

SEQ ID NO: 63969 - RNA, 63 nt, Homo Sapiens; identical to SEQ ID NO: 57929

SEQ ID NO: 63970 - RNA, 63 nt, Homo Sapiens; identical to SEQ ID NO: 57930

SEQ ID NO: 63971 - RNA, 63 nt, Homo Sapiens; identical to SEQ ID NO: 57931

SEQ ID NO: 63972 - RNA, 63 nt, Homo Sapiens; identical to SEQ ID NO: 57932

SEQ ID NO: 63973 - RNA, 63 nt, Homo Sapiens; identical to SEQ ID NO: 57933

SEQ ID NO: 63974 - RNA, 63 nt, Homo Sapiens; identical to SEQ ID NO: 57934

SEQ ID NO: 63975 - RNA, 63 nt, Homo Sapiens; identical to SEQ ID NO: 57935

SEQ ID NO: 63976 - RNA, 63 nt, Homo Sapiens; identical to SEQ ID NO: 57936

SEQ ID NO: 63977 - RNA, 63 nt, Homo Sapiens; identical to SEQ ID NO: 57937

SEQ ID NO: 63978 - RNA, 63 nt, Homo Sapiens; identical to SEQ ID NO: 57938

SEQ ID NO: 63979 - RNA, 63 nt, Homo Sapiens; identical to SEQ ID NO: 57939

SEQ ID NO: 63980 - RNA, 63 nt, Homo Sapiens; identical to SEQ ID NO: 57940

SEQ ID NO: 63981 - RNA, 63 nt, Homo Sapiens; identical to SEQ ID NO: 57941

SEQ ID NO: 63982 - RNA, 63 nt, Homo Sapiens; identical to SEQ ID NO: 57942

SEQ ID NO: 63983 - RNA, 63 nt, Homo Sapiens; identical to SEQ ID NO: 57943

SEQ ID NO: 63984 - RNA, 63 nt, Homo Sapiens; identical to SEQ ID NO: 57944

SEQ ID NO: 63985 - RNA, 63 nt, Homo Sapiens; identical to SEQ ID NO: 57945

SEQ ID NO: 63986 - RNA, 63 nt, Homo Sapiens; identical to SEQ ID NO: 57946

SEQ ID NO: 63987 - RNA, 63 nt, Homo Sapiens; identical to SEQ ID NO: 57947

SEQ ID NO: 63988 - RNA, 63 nt, Homo Sapiens; identical to SEQ ID NO: 57948

SEQ ID NO: 63989 - RNA, 63 nt, Homo Sapiens; identical to SEQ ID NO: 57949

SEQ ID NO: 63990 - RNA, 63 nt, Homo Sapiens; identical to SEQ ID NO: 57950

SEQ ID NO: 63991 - RNA, 63 nt, Homo Sapiens; identical to SEQ ID NO: 57951

SEQ ID NO: 63992 - RNA, 63 nt, Homo Sapiens; identical to SEQ ID NO: 57952

SEQ ID NO: 63993 - RNA, 63 nt, Homo Sapiens; identical to SEQ ID NO: 57953

SEQ ID NO: 63994 - RNA, 63 nt, Homo Sapiens; identical to SEQ ID NO: 57954

SEQ ID NO: 63995 - RNA, 63 nt, Homo Sapiens; identical to SEQ ID NO: 57955

SEQ ID NO: 63996 - RNA, 63 nt, Homo Sapiens; identical to SEQ ID NO: 57956

SEQ ID NO: 63997 - RNA, 63 nt, Homo Sapiens; identical to SEQ ID NO: 57957

SEQ ID NO: 63998 - RNA, 63 nt, Homo Sapiens; identical to SEQ ID NO: 57958

SEQ ID NO: 63999 - RNA, 63 nt, Homo Sapiens; identical to SEQ ID NO: 57959

SEQ ID NO: 64000 - RNA, 63 nt, Homo Sapiens; identical to SEQ ID NO: 57960

SEQ ID NO: 64001 - RNA, 63 nt, Homo Sapiens; identical to SEQ ID NO: 57961

SEQ ID NO: 64002 - RNA, 63 nt, Homo Sapiens; identical to SEQ ID NO: 57962

SEQ ID NO: 64003 - RNA, 63 nt, Homo Sapiens; identical to SEQ ID NO: 57963

SEQ ID NO: 64004 - RNA, 63 nt, Homo Sapiens; identical to SEQ ID NO: 57964

SEQ ID NO: 64005 - RNA, 63 nt, Homo Sapiens; identical to SEQ ID NO: 57965

SEQ ID NO: 64006 - RNA, 63 nt, Homo Sapiens; identical to SEQ ID NO: 57966

SEQ ID NO: 64007 - RNA, 63 nt, Homo Sapiens; identical to SEQ ID NO: 57967

SEQ ID NO: 64008 - RNA, 63 nt, Homo Sapiens; identical to SEQ ID NO: 57968

SEQ ID NO: 64009 - RNA, 63 nt, Homo Sapiens; identical to SEQ ID NO: 57969

SEQ ID NO: 64010 - RNA, 63 nt, Homo Sapiens; identical to SEQ ID NO: 57970

SEQ ID NO: 64011 - RNA, 63 nt, Homo Sapiens; identical to SEQ ID NO: 57971

SEQ ID NO: 64012 - RNA, 63 nt, Homo Sapiens; identical to SEQ ID NO: 57972

SEQ ID NO: 64013 - RNA, 63 nt, Homo Sapiens; identical to SEQ ID NO: 57973

SEQ ID NO: 64014 - RNA, 63 nt, Homo Sapiens; identical to SEQ ID NO: 57974

SEQ ID NO: 64015 - RNA, 63 nt, Homo Sapiens; identical to SEQ ID NO: 57975

SEQ ID NO: 64016 - RNA, 63 nt, Homo Sapiens; identical to SEQ ID NO: 57976

SEQ ID NO: 64017 - RNA, 63 nt, Homo Sapiens; identical to SEQ ID NO: 57977

SEQ ID NO: 64018 - RNA, 63 nt, Homo Sapiens; identical to SEQ ID NO: 57978

SEQ ID NO: 64019 - RNA, 63 nt, Homo Sapiens; identical to SEQ ID NO: 57979

SEQ ID NO: 64020 - RNA, 63 nt, Homo Sapiens; identical to SEQ ID NO: 57980

SEQ ID NO: 64021 - RNA, 63 nt, Homo Sapiens; identical to SEQ ID NO: 57981

SEQ ID NO: 64022 - RNA, 63 nt, Homo Sapiens; identical to SEQ ID NO: 57982

SEQ ID NO: 64023 - RNA, 63 nt, Homo Sapiens; identical to SEQ ID NO: 57983

SEQ ID NO: 64024 - RNA, 63 nt, Homo Sapiens; identical to SEQ ID NO: 57984

SEQ ID NO: 64025 - RNA, 63 nt, Homo Sapiens; identical to SEQ ID NO: 57985

SEQ ID NO: 64026 - RNA, 63 nt, Homo Sapiens; identical to SEQ ID NO: 57984

SEQ ID NO: 64027 - RNA, 63 nt, Homo Sapiens; identical to SEQ ID NO: 57987

SEQ ID NO: 64028 - RNA, 63 nt, Homo Sapiens; identical to SEQ ID NO: 57988

SEQ ID NO: 64029 - RNA, 63 nt, Homo Sapiens; identical to SEQ ID NO: 57989

SEQ ID NO: 64030 - RNA, 63 nt, Homo Sapiens; identical to SEQ ID NO: 57990

SEQ ID NO: 64031 - RNA, 63 nt, Homo Sapiens; identical to SEQ ID NO: 57991

SEQ ID NO: 64032 - RNA, 63 nt, Homo Sapiens; identical to SEQ ID NO: 57992

SEQ ID NO: 64033 - RNA, 63 nt, Homo Sapiens; identical to SEQ ID NO: 57993

SEQ ID NO: 64034 - RNA, 63 nt, Homo Sapiens; identical to SEQ ID NO: 57994

SEQ ID NO: 64035 - RNA, 63 nt, Homo Sapiens; identical to SEQ ID NO: 57995

SEQ ID NO: 64036 - RNA, 63 nt, Homo Sapiens; identical to SEQ ID NO: 57996

SEQ ID NO: 64037 - RNA, 63 nt, Homo Sapiens; identical to SEQ ID NO: 57997

SEQ ID NO: 64038 - RNA, 63 nt, Homo Sapiens; identical to SEQ ID NO: 57998

SEQ ID NO: 64039 - RNA, 63 nt, Homo Sapiens; identical to SEQ ID NO: 57999

SEQ ID NO: 64040 - RNA, 63 nt, Homo Sapiens; identical to SEQ ID NO: 58000

SEQ ID NO: 64041 - RNA, 63 nt, Homo Sapiens; identical to SEQ ID NO: 58001

SEQ ID NO: 64042 - RNA, 63 nt, Homo Sapiens; identical to SEQ ID NO: 58002

SEQ ID NO: 64043 - RNA, 63 nt, Homo Sapiens; identical to SEQ ID NO: 58003

SEQ ID NO: 64044 - RNA, 63 nt, Homo Sapiens; identical to SEQ ID NO: 58004

SEQ ID NO: 64045 - RNA, 63 nt, Homo Sapiens; identical to SEQ ID NO: 58005

SEQ ID NO: 64046 - RNA, 63 nt, Homo Sapiens; identical to SEQ ID NO: 58006

SEQ ID NO: 64047 - RNA, 63 nt, Homo Sapiens; identical to SEQ ID NO: 58007

SEQ ID NO: 64048 - RNA, 63 nt, Homo Sapiens; identical to SEQ ID NO: 58008

SEQ ID NO: 64049 - RNA, 63 nt, Homo Sapiens; identical to SEQ ID NO: 58009

SEQ ID NO: 64050 - RNA, 63 nt, Homo Sapiens; identical to SEQ ID NO: 58010

SEQ ID NO: 64051 - RNA, 63 nt, Homo Sapiens; identical to SEQ ID NO: 58011

SEQ ID NO: 64052 - RNA, 63 nt, Homo Sapiens; identical to SEQ ID NO: 58012

SEQ ID NO: 64053 - RNA, 63 nt, Homo Sapiens; identical to SEQ ID NO: 58013

SEQ ID NO: 64054 - RNA, 63 nt, Homo Sapiens; identical to SEQ ID NO: 58014

SEQ ID NO: 64055 - RNA, 63 nt, Homo Sapiens; identical to SEQ ID NO: 58015

SEQ ID NO: 64056 - RNA, 63 nt, Homo Sapiens; identical to SEQ ID NO: 58016

SEQ ID NO: 64057 - RNA, 63 nt, Homo Sapiens; identical to SEQ ID NO: 58017

SEQ ID NO: 64058 - RNA, 63 nt, Homo Sapiens; identical to SEQ ID NO: 58018

SEQ ID NO: 64059 - RNA, 63 nt, Homo Sapiens; identical to SEQ ID NO: 58019

SEQ ID NO: 64060 - RNA, 63 nt, Homo Sapiens; identical to SEQ ID NO: 58020

SEQ ID NO: 64061 - RNA, 63 nt, Homo Sapiens; identical to SEQ ID NO: 58021

SEQ ID NO: 64062 - RNA, 63 nt, Homo Sapiens; identical to SEQ ID NO: 58022

SEQ ID NO: 64063 - RNA, 63 nt, Homo Sapiens; identical to SEQ ID NO: 58023

SEQ ID NO: 64064 - RNA, 63 nt, Homo Sapiens; identical to SEQ ID NO: 58024

SEQ ID NO: 64065 - RNA, 63 nt, Homo Sapiens; identical to SEQ ID NO: 58025

SEQ ID NO: 64066 - RNA, 63 nt, Homo Sapiens; identical to SEQ ID NO: 58026

SEQ ID NO: 64067 - RNA, 63 nt, Homo Sapiens; identical to SEQ ID NO: 58027

SEQ ID NO: 64068 - RNA, 63 nt, Homo Sapiens; identical to SEQ ID NO: 58028

SEQ ID NO: 64069 - RNA, 63 nt, Homo Sapiens; identical to SEQ ID NO: 58029

SEQ ID NO: 64070 - RNA, 63 nt, Homo Sapiens; identical to SEQ ID NO: 58030

SEQ ID NO: 64071 - RNA, 63 nt, Homo Sapiens; identical to SEQ ID NO: 58031

SEQ ID NO: 64072 - RNA, 63 nt, Homo Sapiens; identical to SEQ ID NO: 58032

SEQ ID NO: 64073 - RNA, 63 nt, Homo Sapiens; identical to SEQ ID NO: 58033

SEQ ID NO: 64074 - RNA, 57 nt, Homo Sapiens; identical to SEQ ID NO: 58034

SEQ ID NO: 64075 - RNA, 63 nt, Homo Sapiens; identical to SEQ ID NO: 58035

SEQ ID NO: 64076 - RNA, 63 nt, Homo Sapiens; identical to SEQ ID NO: 58036

SEQ ID NO: 64077 - RNA, 63 nt, Homo Sapiens; identical to SEQ ID NO: 58037

SEQ ID NO: 64078 - RNA, 63 nt, Homo Sapiens; identical to SEQ ID NO: 58038

SEQ ID NO: 64079 - RNA, 63 nt, Homo Sapiens; identical to SEQ ID NO: 58039

SEQ ID NO: 64080 - RNA, 63 nt, Homo Sapiens; identical to SEQ ID NO: 58040

SEQ ID NO: 64081 - RNA, 63 nt, Homo Sapiens; identical to SEQ ID NO: 58041

SEQ ID NO: 64082 - RNA, 63 nt, Homo Sapiens; identical to SEQ ID NO: 58042

SEQ ID NO: 64083 - RNA, 63 nt, Homo Sapiens; identical to SEQ ID NO: 58043

SEQ ID NO: 64084 - RNA, 63 nt, Homo Sapiens; identical to SEQ ID NO: 58044

SEQ ID NO: 64085 - RNA, 63 nt, Homo Sapiens; identical to SEQ ID NO: 58045

SEQ ID NO: 64086 - RNA, 63 nt, Homo Sapiens; identical to SEQ ID NO: 58046

SEQ ID NO: 64087 - RNA, 63 nt, Homo Sapiens; identical to SEQ ID NO: 58047

SEQ ID NO: 64088 - RNA, 63 nt, Homo Sapiens; identical to SEQ ID NO: 58048

SEQ ID NO: 64089 - RNA, 63 nt, Homo Sapiens; identical to SEQ ID NO: 58049

SEQ ID NO: 64090 - RNA, 63 nt, Homo Sapiens; identical to SEQ ID NO: 58050

SEQ ID NO: 64091 - RNA, 63 nt, Homo Sapiens; identical to SEQ ID NO: 58051

SEQ ID NO: 64092 - RNA, 63 nt, Homo Sapiens; identical to SEQ ID NO: 58052

SEQ ID NO: 64093 - RNA, 61 nt, Homo Sapiens; identical to SEQ ID NO: 58053

SEQ ID NO: 64094 - RNA, 63 nt, Homo Sapiens; identical to SEQ ID NO: 58054

SEQ ID NO: 64095 - RNA, 63 nt, Homo Sapiens; identical to SEQ ID NO: 58055

SEQ ID NO: 64096 - RNA, 63 nt, Homo Sapiens; identical to SEQ ID NO: 58056

SEQ ID NO: 64097 - RNA, 63 nt, Homo Sapiens; identical to SEQ ID NO: 58057

SEQ ID NO: 64098 - RNA, 63 nt, Homo Sapiens; identical to SEQ ID NO: 58058

SEQ ID NO: 64099 - RNA, 63 nt, Homo Sapiens; identical to SEQ ID NO: 58059

SEQ ID NO: 64100 - RNA, 63 nt, Homo Sapiens; identical to SEQ ID NO: 58060

SEQ ID NO: 64101 - RNA, 63 nt, Homo Sapiens; identical to SEQ ID NO: 58061

SEQ ID NO: 64102 - RNA, 63 nt, Homo Sapiens; identical to SEQ ID NO: 58062

SEQ ID NO: 64103 - RNA, 63 nt, Homo Sapiens; identical to SEQ ID NO: 58063

SEQ ID NO: 64104 - RNA, 63 nt, Homo Sapiens; identical to SEQ ID NO: 58064

SEQ ID NO: 64105 - RNA, 55 nt, Homo Sapiens; identical to SEQ ID NO: 58065

SEQ ID NO: 64106 - RNA, 63 nt, Homo Sapiens; identical to SEQ ID NO: 58066

SEQ ID NO: 64107 - RNA, 63 nt, Homo Sapiens; identical to SEQ ID NO: 58067

SEQ ID NO: 64108 - RNA, 63 nt, Homo Sapiens; identical to SEQ ID NO: 58068

SEQ ID NO: 64109 - RNA, 63 nt, Homo Sapiens; identical to SEQ ID NO: 58069

SEQ ID NO: 64110 - RNA, 63 nt, Homo Sapiens; identical to SEQ ID NO: 58070

SEQ ID NO: 64111 - RNA, 63 nt, Homo Sapiens; identical to SEQ ID NO: 58071

SEQ ID NO: 64112 - RNA, 63 nt, Homo Sapiens; identical to SEQ ID NO: 58072

SEQ ID NO: 64113 - RNA, 63 nt, Homo Sapiens; identical to SEQ ID NO: 58073

SEQ ID NO: 64114 - RNA, 63 nt, Homo Sapiens; identical to SEQ ID NO: 58074

SEQ ID NO: 64115 - RNA, 63 nt, Homo Sapiens; identical to SEQ ID NO: 58075

SEQ ID NO: 64116 - RNA, 63 nt, Homo Sapiens; identical to SEQ ID NO: 58076

SEQ ID NO: 64117 - RNA, 63 nt, Homo Sapiens; identical to SEQ ID NO: 58077

SEQ ID NO: 64118 - RNA, 63 nt, Homo Sapiens; identical to SEQ ID NO: 58078

SEQ ID NO: 64119 - RNA, 63 nt, Homo Sapiens; identical to SEQ ID NO: 58079

SEQ ID NO: 64120 - RNA, 63 nt, Homo Sapiens; identical to SEQ ID NO: 58080

SEQ ID NO: 64121 - RNA, 63 nt, Homo Sapiens; identical to SEQ ID NO: 58081

SEQ ID NO: 64122 - RNA, 63 nt, Homo Sapiens; identical to SEQ ID NO: 58082

SEQ ID NO: 64123 - RNA, 63 nt, Homo Sapiens; identical to SEQ ID NO: 58083

SEQ ID NO: 64124 - RNA, 63 nt, Homo Sapiens; identical to SEQ ID NO: 58084

SEQ ID NO: 64125 - RNA, 63 nt, Homo Sapiens; identical to SEQ ID NO: 58085

SEQ ID NO: 64126 - RNA, 63 nt, Homo Sapiens; identical to SEQ ID NO: 58086

SEQ ID NO: 64127 - RNA, 63 nt, Homo Sapiens; identical to SEQ ID NO: 58087

SEQ ID NO: 64128 - RNA, 63 nt, Homo Sapiens; identical to SEQ ID NO: 58088

SEQ ID NO: 64129 - RNA, 63 nt, Homo Sapiens; identical to SEQ ID NO: 58089

SEQ ID NO: 64130 - RNA, 63 nt, Homo Sapiens; identical to SEQ ID NO: 58087

SEQ ID NO: 64131 - RNA, 63 nt, Homo Sapiens; identical to SEQ ID NO: 58091

SEQ ID NO: 64132 - RNA, 63 nt, Homo Sapiens; identical to SEQ ID NO: 58092

SEQ ID NO: 64133 - RNA, 63 nt, Homo Sapiens; identical to SEQ ID NO: 58093

SEQ ID NO: 64134 - RNA, 63 nt, Homo Sapiens; identical to SEQ ID NO: 58094

SEQ ID NO: 64135 - RNA, 63 nt, Homo Sapiens; identical to SEQ ID NO: 58095

SEQ ID NO: 64136 - RNA, 63 nt, Homo Sapiens; identical to SEQ ID NO: 58096

SEQ ID NO: 64137 - RNA, 63 nt, Homo Sapiens; identical to SEQ ID NO: 58097

SEQ ID NO: 64138 - RNA, 63 nt, Homo Sapiens; identical to SEQ ID NO: 58098

SEQ ID NO: 64139 - RNA, 63 nt, Homo Sapiens; identical to SEQ ID NO: 58099

SEQ ID NO: 64140 - RNA, 63 nt, Homo Sapiens; identical to SEQ ID NO: 58100

SEQ ID NO: 64141 - RNA, 63 nt, Homo Sapiens; identical to SEQ ID NO: 58101

SEQ ID NO: 64142 - RNA, 63 nt, Homo Sapiens; identical to SEQ ID NO: 58102

SEQ ID NO: 64143 - RNA, 63 nt, Homo Sapiens; identical to SEQ ID NO: 58103

SEQ ID NO: 64144 - RNA, 63 nt, Homo Sapiens; identical to SEQ ID NO: 58104

SEQ ID NO: 64145 - RNA, 63 nt, Homo Sapiens; identical to SEQ ID NO: 58105

SEQ ID NO: 64146 - RNA, 63 nt, Homo Sapiens; identical to SEQ ID NO: 58106

SEQ ID NO: 64147 - RNA, 63 nt, Homo Sapiens; identical to SEQ ID NO: 58107

SEQ ID NO: 64148 - RNA, 63 nt, Homo Sapiens; identical to SEQ ID NO: 58108

SEQ ID NO: 64149 - RNA, 63 nt, Homo Sapiens; identical to SEQ ID NO: 58109

SEQ ID NO: 64150 - RNA, 63 nt, Homo Sapiens; identical to SEQ ID NO: 58110

SEQ ID NO: 64151 - RNA, 63 nt, Homo Sapiens; identical to SEQ ID NO: 58111

SEQ ID NO: 64152 - RNA, 63 nt, Homo Sapiens; identical to SEQ ID NO: 58112

SEQ ID NO: 64153 - RNA, 63 nt, Homo Sapiens; identical to SEQ ID NO: 58113

SEQ ID NO: 64154 - RNA, 63 nt, Homo Sapiens; identical to SEQ ID NO: 58114

SEQ ID NO: 64155 - RNA, 63 nt, Homo Sapiens; identical to SEQ ID NO: 58115

SEQ ID NO: 64156 - RNA, 63 nt, Homo Sapiens; identical to SEQ ID NO: 58116

SEQ ID NO: 64157 - RNA, 63 nt, Homo Sapiens; identical to SEQ ID NO: 58117

SEQ ID NO: 64158 - RNA, 63 nt, Homo Sapiens; identical to SEQ ID NO: 58118

SEQ ID NO: 64159 - RNA, 63 nt, Homo Sapiens; identical to SEQ ID NO: 58119

SEQ ID NO: 64160 - RNA, 63 nt, Homo Sapiens; identical to SEQ ID NO: 58120

SEQ ID NO: 64161 - RNA, 63 nt, Homo Sapiens; identical to SEQ ID NO: 58121

SEQ ID NO: 64162 - RNA, 63 nt, Homo Sapiens; identical to SEQ ID NO: 58122

SEQ ID NO: 64163 - RNA, 63 nt, Homo Sapiens; identical to SEQ ID NO: 58123

SEQ ID NO: 64164 - RNA, 63 nt, Homo Sapiens; identical to SEQ ID NO: 58124

SEQ ID NO: 64165 - RNA, 63 nt, Homo Sapiens; identical to SEQ ID NO: 58125

SEQ ID NO: 64166 - RNA, 63 nt, Homo Sapiens; identical to SEQ ID NO: 58126

SEQ ID NO: 64167 - RNA, 63 nt, Homo Sapiens; identical to SEQ ID NO: 58127

SEQ ID NO: 64168 - RNA, 63 nt, Homo Sapiens; identical to SEQ ID NO: 58128

SEQ ID NO: 64169 - RNA, 63 nt, Homo Sapiens; identical to SEQ ID NO: 58129

SEQ ID NO: 64170 - RNA, 63 nt, Homo Sapiens; identical to SEQ ID NO: 58130

SEQ ID NO: 64171 - RNA, 63 nt, Homo Sapiens; identical to SEQ ID NO: 58131

SEQ ID NO: 64172 - RNA, 62 nt, Homo Sapiens
gcccaggccugugucccaagcaguacccaggcuuugcagaccacgcggggcagggcuccacu

SEQ ID NO: 64173 - RNA, 62 nt, Homo Sapiens
gaaaucugcagguuuuuaaugucuuguggaaauuugcagaggggcaggugugugguaaacgg

SEQ ID NO: 64174 - RNA, 62 nt, Homo Sapiens
uacaaauugugucuauacauuucuaagccuuguuugcagaauaaacagggcauuuagcaaac

SEQ ID NO: 64175 - RNA, 62 nt, Homo Sapiens
aaaucuuuuuucuuuuuuaauuaaaaaaaauauuugcagagaugagcucuugcuauguugcc

SEQ ID NO: 64176 - RNA, 62 nt, Homo Sapiens
gcagggacgguugccuuuccugggaagggcaguuugcagaaccagggguuuauauugcaggg

SEQ ID NO: 64177 - RNA, 62 nt, Homo Sapiens
caucucgccuguuggcucagugcuucaucccauuugcagagccucagacacgucuugguggu

SEQ ID NO: 64178 - RNA, 62 nt, Homo Sapiens
ugaaauucucaucaguccauugcucuugagucuuugcagagaaccucagaucaggugcaccu

SEQ ID NO: 64179 - RNA, 62 nt, Homo Sapiens
ugccugggcugggaaaggggccuuucuuuuguuuugcagauagauccacccacugaggaacu

SEQ ID NO: 64180 - RNA, 62 nt, Homo Sapiens
aaaggaaggagagaaggggcuucucagacuuauuugcagaagggcccagaacucaguaugaa

SEQ ID NO: 64181 - RNA, 62 nt, Homo Sapiens
ucuggccuaaccauggagauauugguuaucaguuugcagaugaauacacaguucuauccaac

SEQ ID NO: 64182 - RNA, 62 nt, Homo Sapiens
cggcugccugggcugagggcucgcuccagggcuuugcagacuggacccuuaccgguggcucu

SEQ ID NO: 64183 - RNA, 62 nt, Homo Sapiens
caggggggccuccuccuaggauaauaaacaauuuugcagaauuggacucccccucacucgca

SEQ ID NO: 64184 - RNA, 62 nt, Homo Sapiens
guucuuucacuuggaauuacuaagaucggaguuuugcagagguugauuaaagcaaccauacc

SEQ ID NO: 64185 - RNA, 62 nt, Homo Sapiens
acuuuaggaaaugagguuucauaauucugccuuuugcagauuuuuuuacuuuaaagcuguca

SEQ ID NO: 64186 - RNA, 62 nt, Homo Sapiens
aagggcccccaagguggucaugacuggucucauuugcagaagucuaagaauguaccuuuuuc

SEQ ID NO: 64187 - RNA, 62 nt, Homo Sapiens
cuacauguucugggggcccggagauagaugacuuugcagauggaaagaggugaaaaugaaga

SEQ ID NO: 64188 - RNA, 62 nt, Homo Sapiens
uacucuuguuuuugcauaacugguuuuguuuuuuugcagaauuaacuauaacaaucacuggc

SEQ ID NO: 64189 - RNA, 62 nt, Homo Sapiens
uuucuuaagaccugucgucaaacuuaaaagguuuugcagagggcaguaucaaaagaaagugg

SEQ ID NO: 64190 - RNA, 62 nt, Homo Sapiens
acagcagaggccaugcaguauuauauauucauuuugcagaaucugcaccuacagcucaauac

SEQ ID NO: 64191 - RNA, 62 nt, Homo Sapiens
ucuggaaauacugucuucuguuuccuuuugccuuugcagaaugugcuuuagccuuugucuga

SEQ ID NO: 64192 - RNA, 62 nt, Homo Sapiens
cugcauaugagugauaugugaucaugauucauuuugcagauuuacauuuugcuuguguggaa

SEQ ID NO: 64193 - RNA, 62 nt, Homo Sapiens
cguuuguuuccccgguggcccuugcuucuugcuuugcagacugccugcagccaugauuuugu

SEQ ID NO: 64194 - RNA, 62 nt, Homo Sapiens
cucuccugccgcucccugcagaggaugcucguuuugcagagaaggcaguguuccucuauucc

SEQ ID NO: 64195 - RNA, 62 nt, Homo Sapiens
uccuacagcagcugugucuccaacguugagacuuugcagauggcacagacuccauggauaau

SEQ ID NO: 64196 - RNA, 62 nt, Homo Sapiens
uuaggggaugacaucccaaacagcccggaguauuugcagaaggcucaggcaacgagugggcc

SEQ ID NO: 64197 - RNA, 62 nt, Homo Sapiens
aucuaugccuaacagagccccaguacaacuauuuugcagaauggcuguuacccuagaauuac

SEQ ID NO: 64198 - RNA, 62 nt, Homo Sapiens
ugucuaauaaauauugacuucucuugaauuauuuugcagacuagugagucuguaccauaagu

SEQ ID NO: 64199 - RNA, 62 nt, Homo Sapiens
ggccaauaccugccuuccaaagagauccuaccuuugcagauuugcuccuuucccauugccuu

SEQ ID NO: 64200 - RNA, 62 nt, Homo Sapiens
accuuaaagaccaucugguaucaucuucucauuuugcagaagagaaacugaggcccagaggc

SEQ ID NO: 64201 - RNA, 62 nt, Homo Sapiens
ggugaucuacauuugggugcuuguuucugagauuugcagagaaguauaacaugguaguuccu

SEQ ID NO: 64202 - RNA, 62 nt, Homo Sapiens
auuuacaucacuuuagaaaccacacucacacuuuugcagaguguugagcuuaauaacuaccu

SEQ ID NO: 64203 - RNA, 62 nt, Homo Sapiens
uaaaaaacaauuaucccuuacagacuugaacauuugcagacguuaugaucuugcuuccaacu

SEQ ID NO: 64204 - RNA, 62 nt, Homo Sapiens
cuuugguuuuggacaguuucuuaaaucaugauuuugcagaacaaaacaagcugggcacacug

SEQ ID NO: 64205 - RNA, 62 nt, Homo Sapiens
ugcuuuuggucuccuacccaaauuguguacccuuugcagaaacccacucuauaagcagggcu

SEQ ID NO: 64206 - RNA, 62 nt, Homo Sapiens
gagaauaggaagggcauuccugugaauaggaguuugcagaugcagggucuuagguuggggag

SEQ ID NO: 64207 - RNA, 62 nt, Homo Sapiens
cuuggcuggguuuaguguacuguaguagcauuuuugcagauucuguguugcuugugaagcgg

SEQ ID NO: 64208 - RNA, 62 nt, Homo Sapiens
ccaccggagcuagggcacuagucaaggccucauuugcagagggugucuguccacugacgacu

SEQ ID NO: 64209 - RNA, 62 nt, Homo Sapiens
ccuuggggaaaagggcccuucugaaaagugaguuugcagaaacauugaggagacuccacaga

SEQ ID NO: 64210 - RNA, 62 nt, Homo Sapiens
ugggcagugaaauuaccuuuucccuggugcucuuugcagaguguguggcuggcaaccucgac

SEQ ID NO: 64211 - RNA, 62 nt, Homo Sapiens
aaacuucagcaagcuagaacaauuuuuguacuuuugcagaaguguuuaguucuuaguggguu

SEQ ID NO: 64212 - RNA, 62 nt, Homo Sapiens
uaacauuaccuuccccagccccagagcaucuguuugcagaggccugugucuuucuucucuua

SEQ ID NO: 64213 - RNA, 62 nt, Homo Sapiens
auagguuuaacugaaugaaguaacaggaauauuuugcagaauuccaguuguacuuaagugug

SEQ ID NO: 64214 - RNA, 62 nt, Homo Sapiens
cugccccuccccucauugagauuuuaaauacguuugcagaaaugaaaacaaaaguaauggga

SEQ ID NO: 64215 - RNA, 62 nt, Homo Sapiens
uucaaauauuguaaaacuuugaaagcucuacauuugcagauguucaaauuugugucauacca

SEQ ID NO: 64216 - RNA, 62 nt, Homo Sapiens
agucaaauaaucaacacuaagggcucuuccauuuugcagauacauuuuuucccaaguagcug

SEQ ID NO: 64217 - RNA, 62 nt, Homo Sapiens
accaaagcaucccaaggaacacuaaggaugccuuugcagaacaaugcaaguucuaaaaauag

SEQ ID NO: 64218 - RNA, 62 nt, Homo Sapiens
ugaaaaagacugggugaccuggugaauugggauuugcagagaaaaacagaagcacaaauuuu

SEQ ID NO: 64219 - RNA, 62 nt, Homo Sapiens
ggggucucuucuuccagguaggacagagcacguuugcagaaguccaauaggcguagcuaucc

SEQ ID NO: 64220 - RNA, 62 nt, Homo Sapiens
gaaagaaaaacuaugguguacagaaagaaugauuugcagaaaguuuggaaaaaacugcaaau

SEQ ID NO: 64221 - RNA, 62 nt, Homo Sapiens
acacgcugcaugggccccgcgaacaccugcacuuugcagaggggugcugcuguguguggacu

SEQ ID NO: 64222 - RNA, 62 nt, Homo Sapiens
ugaaggaaaaucucuucguggagaauauuaauuuugcagaaaggauaggcauuagaugaaua

SEQ ID NO: 64223 - RNA, 62 nt, Homo Sapiens
aggggucugucuuuuaaacuggcagucuucaguuugcagaguuggaguuauugaagcagagu

SEQ ID NO: 64224 - RNA, 62 nt, Homo Sapiens
gaauuuggcccagagagguuccaauauucuauuuugcagauaucaacucugugagguggaua

SEQ ID NO: 64225 - RNA, 62 nt, Homo Sapiens
ugcacaaggagagaacucaguucuguucucauuuugcagaguccuccacggcccacuucauu

SEQ ID NO: 64226 - RNA, 62 nt, Homo Sapiens
ccuuauucuguguguuuuuugcuggucaaauuuuugcagagcgagaaugcaacacuauaaaa

SEQ ID NO: 64227 - RNA, 62 nt, Homo Sapiens
uuauauccauuccaguccucacauguuuuuguuuugcagacaauuaguagauggcucacuag

SEQ ID NO: 64228 - RNA, 62 nt, Homo Sapiens
guuucuuccaugucuuugaccagacugugggauuugcagaguuuccuuuccaagccgucgaa

SEQ ID NO: 64229 - RNA, 62 nt, Homo Sapiens
ccugcacaguuuucuggcugcccccucuaccauuugcagaguguuccacugagcuccaugug

SEQ ID NO: 64230 - RNA, 62 nt, Homo Sapiens
ccaccacuuagagaaucaaauucaagcuccauuuugcagagaauugguauguaaaagauuuc

SEQ ID NO: 64231 - RNA, 62 nt, Homo Sapiens
gugcugguaaagaauugagcuuaggaaguuuuuuugcagagaaaaauaaagaggagaaaggc

SEQ ID NO: 64232 - RNA, 62 nt, Homo Sapiens
gagcacugauuuuugauagacuaaguggaaaauuugcagagaaaugaugguuguaaguggac

SEQ ID NO: 64233 - RNA, 62 nt, Homo Sapiens
gaaaagccuauuagauguuuuacaaauuuaauuuugcagauuauuuuagucugucauccaga

SEQ ID NO: 64234 - RNA, 62 nt, Homo Sapiens
aauuuuggcacgaugaauuauuuuuguuucucuuugcagagagccaaauauggggcugaugg

SEQ ID NO: 64235 - RNA, 62 nt, Homo Sapiens
uuaagagaagagcagaucaugcuauugugacauuugcagagauauacacacacuuuuuguac

SEQ ID NO: 64236 - RNA, 62 nt, Homo Sapiens
agugauuggaacccacguuugcacaaaacauuuuugcagaaggaaagucaacacuucuugcu

SEQ ID NO: 64237 - RNA, 62 nt, Homo Sapiens
gucuuggagagauggggaaggcuuucagcugauuugcagaaguugcccaugugggccccagc

SEQ ID NO: 64238 - RNA, 62 nt, Homo Sapiens
ggucugugacuauaguuaaacuucacuaagaauuugcagaauuguuuugagaugugugaaua

SEQ ID NO: 64239 - RNA, 62 nt, Homo Sapiens
uuuucuaaaauugaggagaaggaaguuauauauuugcagaauguuuuaaagugaauuguugu

SEQ ID NO: 64240 - RNA, 62 nt, Homo Sapiens
auuuagaauaaauuaguuuucugcuuucuaauuuugcagaucuuuacauuuuuauugcuuuu

SEQ ID NO: 64241 - RNA, 62 nt, Homo Sapiens
cuacugagaagugaccuggaagugagaaguucuuugcagauuuggggcgaggggugauuugg

SEQ ID NO: 64242 - RNA, 62 nt, Homo Sapiens
cgauauuaguccuacaccaauugaagugaaauuuugcagaugugccuaugagcacaaacuuc

SEQ ID NO: 64243 - RNA, 62 nt, Homo Sapiens
uccaagcugcuuuucauuuacggccucuuucuuuugcagaaaugugaguuccuccucuugaa

SEQ ID NO: 64244 - RNA, 62 nt, Homo Sapiens
ucaucccugacucagcuuuuaccuuaauuuuauuugcagaggauucuuuucucaaaaugcuc

SEQ ID NO: 64245 - RNA, 62 nt, Homo Sapiens
ggccugcaggugucuagggucucagcuuuucauuugcagaggacauguucaacuuccucucu

SEQ ID NO: 64246 - RNA, 62 nt, Homo Sapiens
cucauuguuugauuucuugugaccauagagcauuugcagagccacuuggguggagaccaguu

SEQ ID NO: 64247 - RNA, 62 nt, Homo Sapiens
aauuacacuaucuuaugucuguccacuggguguuugcagaaucuaugggugacacaagagcu

SEQ ID NO: 64248 - RNA, 62 nt, Homo Sapiens
ugugcacauauauuccgcuuaaauuugcacucuuugcagacuuaaagcauuuaccauauccu

SEQ ID NO: 64249 - RNA, 62 nt, Homo Sapiens
gcacauucaguagccuuauuuaaaugagcucuuuugcagauaacuuuuaggucaguuccuau

SEQ ID NO: 64250 - RNA, 62 nt, Homo Sapiens
cacuaauaaaaacaaauauucacgcagcugcuuuugcagaagccaaagaguaugguuaacuu

SEQ ID NO: 64251 - RNA, 62 nt, Homo Sapiens
ucuggaguguuuuaaagucaagccuauugggcuuugcagauauccuuuuuucuccuuccccu

SEQ ID NO: 64252 - RNA, 62 nt, Homo Sapiens
cacaagaaaucuggcuuggcgcucacauauuguuugcagacaggaggcauuggugauguucg

SEQ ID NO: 64253 - RNA, 62 nt, Homo Sapiens
cguaggaaugaggcuggacacauccaagagacuuugcagaggcucuaucaaucaguaguuag

SEQ ID NO: 64254 - RNA, 62 nt, Homo Sapiens
aggaaggaagagcaagcuguaucucccucccauuugcagaccgccccuugcugcuggcuccc

SEQ ID NO: 64255 - RNA, 62 nt, Homo Sapiens
gcuuugagcucugugggggagagaugaaaggcuuugcagaaacacugccuacuugcugcagg

SEQ ID NO: 64256 - RNA, 62 nt, Homo Sapiens
uccaacucacacagauacuuuuaaaguggucauuugcagaucacucuaugcuagauuugaga

SEQ ID NO: 64257 - RNA, 62 nt, Homo Sapiens
cuggcaauaagccuuccaaauuuaaacuugauuuugcagacuguauuaaaaccucucuuacu

SEQ ID NO: 64258 - RNA, 62 nt, Homo Sapiens
cauaauggacccgcacaaaaauauugaguuauuuugcagaauauauuugugguuuagaaggc

SEQ ID NO: 64259 - RNA, 62 nt, Homo Sapiens
uuauuguucaugccuuagagguguauauauuguuugcagacauuguuuuaaauauguauuau

SEQ ID NO: 64260 - RNA, 62 nt, Homo Sapiens
acccagguggagugaaaauuuuuacuugaaauuuugcagaaugaaaauaucagaaucugagu

SEQ ID NO: 64261 - RNA, 62 nt, Homo Sapiens
guaaacugauugaauaaauaacaaugaccaccuuugcagaaauagguuuaagaugaccaaug

SEQ ID NO: 64262 - RNA, 62 nt, Homo Sapiens
agugggcacaauguuuacaagccaaaugaacguuugcagagcugaugugugaacugcuaagg

SEQ ID NO: 64263 - RNA, 62 nt, Homo Sapiens
acacaaggucauuucccaguuccucuuguguauuugcagaaucccucaagaauagcuucaga

SEQ ID NO: 64264 - RNA, 62 nt, Homo Sapiens
cugucacuuacccugaaacaacugagucuugguuugcagaagaaaaauccuuuauaaucagg

SEQ ID NO: 64265 - RNA, 62 nt, Homo Sapiens
caaaagauggaaauuuuucuccucucaugacauuugcagauagaaaaaugccuuucuguucc

SEQ ID NO: 64266 - RNA, 62 nt, Homo Sapiens
agugucagcuuugcucagugugguggaaacauuuugcagaacuguuguagaaagcugccuua

SEQ ID NO: 64267 - RNA, 62 nt, Homo Sapiens
caccccacaggaggguaauuuucuaacucuaguuugcagaggagcaaauugagguucagcaa

SEQ ID NO: 64268 - RNA, 62 nt, Homo Sapiens
ccggggauucuuccacuccugaaaugaguugauuugcagauaacucacaacuucuuaagcua

SEQ ID NO: 64269 - RNA, 62 nt, Homo Sapiens
aauauaccgaaauauuuccauuguuucccuuuuuugcagagcauguggaaguuaaaccugcu

SEQ ID NO: 64270 - RNA, 62 nt, Homo Sapiens
augaggccacaaccccuaggccccucaggagcuuugcagagaggaggacguguacuccaggc

SEQ ID NO: 64271 - RNA, 62 nt, Homo Sapiens
ucugcaaggacauuucucaagggccaugugguuuugcagacaacccuguccucaggccugaa

SEQ ID NO: 64272 - RNA, 62 nt, Homo Sapiens
gaagauggauugguguaaaaggaugggucugguuugcagagcuugaacacagucucacccag

SEQ ID NO: 64273 - RNA, 62 nt, Homo Sapiens
cagagcagcuacuucuaagccauaucgacuguuuugcagaggauuugugugugcugccucag

SEQ ID NO: 64274 - RNA, 62 nt, Homo Sapiens
ugcugagccaguacagccacaaacaguacuauuuugcagaugcucauguaagcagcuuuucg

SEQ ID NO: 64275 - RNA, 62 nt, Homo Sapiens
uucaccaaagaacagaccaauuaacauacuuauuugcagaagugguguaguucuauaaaacg

SEQ ID NO: 64276 - RNA, 62 nt, Homo Sapiens
gacgguccgggcgggcacccucagccgggcucuuugcagaagcagcaccgcugacugugggc

SEQ ID NO: 64277 - RNA, 62 nt, Homo Sapiens
aauuaguuuuuuaaaccuucuguuaguggcuuuuugcagaagcaaaacagauuaaguagaua

SEQ ID NO: 64278 - RNA, 62 nt, Homo Sapiens
ucuugaauucuuauuuugguuugccuggauguuuugcagaucccaaucuuucuuuuaagcuu

SEQ ID NO: 64279 - RNA, 62 nt, Homo Sapiens
uugaugaagugccuggguauuuucccgucccauuugcagagcucuacuacuucauuuccaca

SEQ ID NO: 64280 - RNA, 62 nt, Homo Sapiens
acguccuugauuaaaucaccccaauaugccccuuugcagaaaguauuggcuuuucccugaau

SEQ ID NO: 64281 - RNA, 62 nt, Homo Sapiens
aggcucucugggcagaggcuggcccacuguaguuugcagacaugcucuccagaugguuuuac

SEQ ID NO: 64282 - RNA, 62 nt, Homo Sapiens
acacaguuuuguauauagaagaaguaaaacuauuugcagaugguauccagauaggaaaagaa

SEQ ID NO: 64283 - RNA, 62 nt, Homo Sapiens
agguagacucuuuggcacuuacagguaccagcuuugcagagguaaaaauacugacauuucac

SEQ ID NO: 64284 - RNA, 62 nt, Homo Sapiens
guucaaggaaguauucugugucugcaccuacuuuugcagaauaaugaagaaguaauucuguc

SEQ ID NO: 64285 - RNA, 62 nt, Homo Sapiens
gacuuggugguguuuuuuguauuagcuaacuuuuugcagauggaguuauuuuaaccucaaaa

SEQ ID NO: 64286 - RNA, 62 nt, Homo Sapiens
ucuucaguaucuauauuugauuugauuaaaauuuugcagagguuaacaaacugaaaggagau

SEQ ID NO: 64287 - RNA, 62 nt, Homo Sapiens
cucacauagcaaguucauaacuuuugaaccaauuugcagaaguuaucaacuccuuaaaugug

SEQ ID NO: 64288 - RNA, 62 nt, Homo Sapiens
acaaaaauucaacucagacuagaacuuuuugguuugcagaugcucuuacugcaaaugucauc

SEQ ID NO: 64289 - RNA, 62 nt, Homo Sapiens
uuugcuuuucauuccuggacaaccuucagcauuuugcagagcaagcaucguuauacuucuaa

SEQ ID NO: 64290 - RNA, 62 nt, Homo Sapiens
gaccgucauauucuaauagcucaaauauuccauuugcagacauaucacaugucucauucucc

SEQ ID NO: 64291 - RNA, 62 nt, Homo Sapiens
ugagguaagacuucaucuuaggcagucuucauuuugcagaggguucucugccaauuacuaua

SEQ ID NO: 64292 - RNA, 62 nt, Homo Sapiens
uuggggaguggucuauguggaguaggcaguguuuugcagacucugucacuguaagccugccc

SEQ ID NO: 64293 - RNA, 62 nt, Homo Sapiens
uagauuagcuggugaagaaauggcaaaacauauuugcagaugaaaggggucuaaaaagauuu

SEQ ID NO: 64294 - RNA, 62 nt, Homo Sapiens
auugucuaggauuucagcaacaucauggccccuuugcagaaaagcucuuuugcuuggauucc

SEQ ID NO: 64295 - RNA, 62 nt, Homo Sapiens
augucacccuaucuagcuuuccuauucuaagauuugcagaauacaaaaaguauuugcccauu

SEQ ID NO: 64296 - RNA, 54 nt, Homo Sapiens
caaaugccuacuauuuuauaugccuuugcagaauguuuaauucaaguagucuag

SEQ ID NO: 64297 - RNA, 62 nt, Homo Sapiens
ccugcccuaaaugauuauaguuggaaaaaaaguuugcagacauaaauauacuuuggcacuuu

SEQ ID NO: 64298 - RNA, 62 nt, Homo Sapiens
gcugaaagguacaaaggccuucaguucuucauuuugcagaugaugccuaucaaaauuugaau

SEQ ID NO: 64299 - RNA, 62 nt, Homo Sapiens
gcagauuaaagaccaucagacauaagaucucauuugcagaaaaccaaagauuaaauccuuga

SEQ ID NO: 64300 - RNA, 62 nt, Homo Sapiens
ucuagcagcuucagacauuuacuuauccccucuuugcagaugaaaaucaguaggaaaucuaa

SEQ ID NO: 64301 - RNA, 62 nt, Homo Sapiens
cuuaaaauguguacucguuacauuuugcuagcuuugcagaauguucagaaggcaagcaucuu

SEQ ID NO: 64302 - RNA, 62 nt, Homo Sapiens
ggcggggggugaggcuuagccugagaccaggcuuugcagagguuugugggcuccuuguuagc

SEQ ID NO: 64303 - RNA, 62 nt, Homo Sapiens
auggaggaguaacccuacaaucggggaaauaguuugcagauacuaaguuauauguguuagug

SEQ ID NO: 64304 - RNA, 62 nt, Homo Sapiens
auuacaguuauguacugcaugauuugacugguuuugcagaaguuauuuuuguggcaugguua

SEQ ID NO: 64305 - RNA, 62 nt, Homo Sapiens
caaaacaagauuuauuaaauuauaguggcuccuuugcagagcgcuccaguuaaaugcuuuga

SEQ ID NO: 64306 - RNA, 62 nt, Homo Sapiens
acaaaauagccuauccuuaaugaaaggagagcuuugcagauaucaugagacauuaggguaga

SEQ ID NO: 64307 - RNA, 62 nt, Homo Sapiens
cucuaggcccucaccucaaaaaauauauacacuuugcagaagguuccaaauaugacucccua

SEQ ID NO: 64308 - RNA, 62 nt, Homo Sapiens
gcagacagcuagagauaacuaaacucaggaaguuugcagagagcuauugggaaagaacuucc

SEQ ID NO: 64309 - RNA, 62 nt, Homo Sapiens
uuuaaugcaaauuuauuuuuuucauugcauauuuugcagauuuuauccacagugucauuuuu

SEQ ID NO: 64310 - RNA, 62 nt, Homo Sapiens
uggaaaauauaaugaucagcaaaaagacuggauuugcagaaguuuuuuuuuuuuuuuucuuc

SEQ ID NO: 64311 - RNA, 62 nt, Homo Sapiens
aaaccaugccaaacuacugcuuuaaugucaaguuugcagaauugucucugaaaauaaaaacc

SEQ ID NO: 64312 - RNA, 62 nt, Homo Sapiens
uauuguacuguuuuucauuucacuugcaaaauuuugcagaauuccuccuuucuacccauaaa

SEQ ID NO: 64313 - RNA, 62 nt, Homo Sapiens
ugccacuggcugaugaagaguugagaggucucuuugcagaaugaucuuuuuguuucguuuug

SEQ ID NO: 64314 - RNA, 62 nt, Homo Sapiens
uucagaguuccagucauuauuguuacaucauguuugcagaaaccuugucuuauuuagugucu

SEQ ID NO: 64315 - RNA, 62 nt, Homo Sapiens
guagcagaaaucagugguuugaaaagucauacuuugcagauaugaaccugaaaaucaaagug

SEQ ID NO: 64316 - RNA, 62 nt, Homo Sapiens
uuaaagggaacuguacuacucgcagugauagguuugcagagugugugcuuggcuguggcagc

SEQ ID NO: 64317 - RNA, 62 nt, Homo Sapiens
aacaaaaaugaaauguucuaguuuugguuccuuuugcagagugaaaugccucccaggaaaaa

SEQ ID NO: 64318 - RNA, 62 nt, Homo Sapiens
uuucacaaauuuuguauugcuuuuuuuccaguuuugcagaaaauuuacauucuaguucucuu

SEQ ID NO: 64319 - RNA, 62 nt, Homo Sapiens
caagcuccucuccuaggucuucaugcugagaauuugcagauguuguuuuuuggauggugaau

SEQ ID NO: 64320 - RNA, 62 nt, Homo Sapiens
uuuuccgacacacaugucugacuguaccaagcuuugcagaucgguucucuuuacacauuaac

SEQ ID NO: 64321 - RNA, 62 nt, Homo Sapiens
ucagcaauaugauagggaacuccuuucuggaguuugcagagugaaguuuggaaaagaaaccu

SEQ ID NO: 64322 - RNA, 62 nt, Homo Sapiens
caguguuucuacuugcacuaggaaauucagcuuuugcagaaggaguguaagugcuucauuug

SEQ ID NO: 64323 - RNA, 62 nt, Homo Sapiens
aucuuacuaacugaccuauuguguguaggcuuuuugcagaaguacugaugugcuugacugaa

SEQ ID NO: 64324 - RNA, 62 nt, Homo Sapiens
uucucuagucauuuguuaaugaagauagaagguuugcagauauccugauucauauuuaauuu

SEQ ID NO: 64325 - RNA, 62 nt, Homo Sapiens
ccaugguagccaacagaaccuuaaaauggugguuugcagaaacauauaagcauggugguauc

SEQ ID NO: 64326 - RNA, 62 nt, Homo Sapiens
aaauuauuuuauaaggcuguauaaaauugaauuuugcagacuggugauaaguuacuucaauu

SEQ ID NO: 64327 - RNA, 62 nt, Homo Sapiens
cuaaagccuuuuuaagaaauaacgauaaugcuuuugcagaaagacacaggguguauaucuag

SEQ ID NO: 64328 - RNA, 62 nt, Homo Sapiens
ggacugacgcuccuccccuuauaucuaaagaguuugcagagcugggaagagaugaugguggc

SEQ ID NO: 64329 - RNA, 62 nt, Homo Sapiens
uaacugcacaauuuugcauauuuuccuaaugauuugcagagaugauuuuuaaccuuucaaca

SEQ ID NO: 64330 - RNA, 62 nt, Homo Sapiens
gcuaugacuuguggcaaucagcaggauccauuuuugcagauacacagaugagucuuucagag

SEQ ID NO: 64331 - RNA, 50 nt, Homo Sapiens
auucaguuauaggggugauuuuugcagauugauuacaacucauuuuguaa

SEQ ID NO: 64332 - RNA, 62 nt, Homo Sapiens
guagagggagauuuuguaacuucuauugguuuuuugcagacagguaauauaauguauggguu

SEQ ID NO: 64333 - RNA, 62 nt, Homo Sapiens
uuuuccuaauuuuguuuaucgaacuaaauaauuuugcagaauauuuuaguaauuuccuuggg

SEQ ID NO: 64334 - RNA, 62 nt, Homo Sapiens
gcuaagacuauagacaaauuagagcccugaauuuugcagaccgcgguauacucagaauggug

SEQ ID NO: 64335 - RNA, 62 nt, Homo Sapiens
ggucaggccggagcccguccuaagacacacgcuuugcagagcugugcaugcgcagucugcua

SEQ ID NO: 64336 - RNA, 62 nt, Homo Sapiens
uuaaauaagguaaaucuuuuuuaguuuauauauuugcagacuauacauguuggauuaaaugg

SEQ ID NO: 64337 - RNA, 62 nt, Homo Sapiens
cacuguuuaggacaauuuuucuuuaaaauaguuuugcagauuaaaauugcuuaaauaagugg

SEQ ID NO: 64338 - RNA, 62 nt, Homo Sapiens
gagagacucucuuugauacauuaaaaaaacuguuugcagaagcaguucuguggaagagacug

SEQ ID NO: 64339 - RNA, 62 nt, Homo Sapiens
uaaucaaugaauuuguucuuucugauuuuaaguuugcagauuuauuuagugaaggcaagugc

SEQ ID NO: 64340 - RNA, 62 nt, Homo Sapiens
aaauauaugugauauuugcauuauuaaaccccuuugcagaucuaaagucucaggguuccacu

SEQ ID NO: 64341 - RNA, 62 nt, Homo Sapiens
ccgugacuguuacuuuauacagcaaaggaaacuuugcagaugugauuaaagcuaaggaccuu

SEQ ID NO: 64342 - RNA, 62 nt, Homo Sapiens
acaguucaacugaaacuucgaaagcaucauuauuugcagagacaggaccugacuauugaagu

SEQ ID NO: 64343 - RNA, 60 nt, Homo Sapiens
ccacugggccugauacuuagcugacauggauuugcagaccccagggugggcagaugucuc

SEQ ID NO: 64344 - RNA, 62 nt, Homo Sapiens
caguugaucucagguuuuucacuguacauuacuuugcagauauggacagccuuuacaaaaau

SEQ ID NO: 64345 - RNA, 62 nt, Homo Sapiens
aauaauuuuagguucuuuuguuauucaguaguuuugcagacuuaaaaguguaaauuuagaau

SEQ ID NO: 64346 - RNA, 62 nt, Homo Sapiens
ugggagcugagggcccuggaggauggggaagguuugcagagagaggaagaagagggcagggu

SEQ ID NO: 64347 - RNA, 62 nt, Homo Sapiens
auguucuagacuggugaucuugaauuagccacuuugcagaauauuaaaagaaaaauauaaug

SEQ ID NO: 64348 - RNA, 62 nt, Homo Sapiens
agacgaaggcagagugguguuuugcagauguauuugcagagaggccagaaaugaagaagaag

SEQ ID NO: 64349 - RNA, 62 nt, Homo Sapiens
uauuugcagagaagacgaagaugaagaagaaguuugcagauggcauggaugauuggccagaa

SEQ ID NO: 64350 - RNA, 62 nt, Homo Sapiens
cacauacuaaugguuuaauuacaaguucucuuuuugcagauuaaacuguagaagagucuaaa

SEQ ID NO: 64351 - RNA, 62 nt, Homo Sapiens
ggugcauugauucuuaaauuuuuucagacaauuuugcagaaaagauaccuguuuuaaaaggu

SEQ ID NO: 64352 - RNA, 62 nt, Homo Sapiens
uggagucucacuguugcccauauuuuuuauuuuuugcagagaccaccauacccaacuaauuu

SEQ ID NO: 64353 - RNA, 62 nt, Homo Sapiens
uauaaggauaaauuaguuuuaaaaugcuaauuuuugcagagaugaaguuucguuggauguuc

SEQ ID NO: 64354 - RNA, 62 nt, Homo Sapiens
aaugcccguaaugcuuagagguguagaggguguuugcagagccucuucuaccauuugaauuu

SEQ ID NO: 64355 - RNA, 62 nt, Homo Sapiens
uuaagaaauuauguuuugugaaacauuagaaauuugcagaauuuguaggaaaccaagauuag

SEQ ID NO: 64356 - RNA, 62 nt, Homo Sapiens
guauuaaacauuuuuaagcuacuaaauuuagguuugcagaaaaagaauauuaaccuuucuaa

SEQ ID NO: 64357 - RNA, 62 nt, Homo Sapiens
uucuaaaaggcguauaacugacuauggcuuuauuugcagagccauauuagucaucauuugua

SEQ ID NO: 64358 - RNA, 62 nt, Homo Sapiens
uaucaauuuggguuuuuguagaaguuuaagauuuugcagauuaauauuuaucaauggauuaa

SEQ ID NO: 64359 - RNA, 62 nt, Homo Sapiens
aaaaaaaaaaaaaaaaaaaaugugcaaaggacuuugcagauuuccaaaccaguugggagacu

SEQ ID NO: 64360 - RNA, 62 nt, Homo Sapiens
uggaaguuaacacauuugcuccaucaaaauucuuugcagaaucaucagauuuggaaguuuug

SEQ ID NO: 64361 - RNA, 62 nt, Homo Sapiens
acccaagagcgagcaaacaucucugcuauuuguuugcagaacacaggcuuuuuugcuuuggg

SEQ ID NO: 64362 - RNA, 62 nt, Homo Sapiens
cauuugugcccggcguuugguacuuccaucuguuugcagacaauuugggccagugcacuguu

SEQ ID NO: 64363 - RNA, 62 nt, Homo Sapiens
cuuuuaccccugcacaguuuccaguucacuucuuugcagagcagcaacuugcuucuaaaugc

SEQ ID NO: 64364 - RNA, 62 nt, Homo Sapiens
auagaaagaguuucauuuuugguaauuacagauuugcagacuggaguuggagcagggggaug

SEQ ID NO: 64365 - RNA, 62 nt, Homo Sapiens
aauacuacuuuauagacaguuuugguuuucuguuugcagauaugauugauguauuucaccaa

SEQ ID NO: 64366 - RNA, 62 nt, Homo Sapiens
gucuugugaggcccuuauauaauuacucccauuuugcagaugaaguaacugaggcuuagaaa

SEQ ID NO: 64367 - RNA, 62 nt, Homo Sapiens
uuaaaagcacugauucaauugcuaggaauauuuuugcagauuuuucuuuacaguauuccaua

SEQ ID NO: 64368 - RNA, 62 nt, Homo Sapiens
ccguuagcccagauucaaaaggugaacaucuguuugcagaaucugauucaugagaaggugag

SEQ ID NO: 64369 - RNA, 62 nt, Homo Sapiens
ugugccaucuuuaaaauuuuuacuauuggucauuugcagaacaguaaauucuguguguuggu

SEQ ID NO: 64370 - RNA, 62 nt, Homo Sapiens
ggaggaagugaucagagggaacgagcuguagguuugcagaaaugugugaaaccaaaaugauc

SEQ ID NO: 64371 - RNA, 62 nt, Homo Sapiens
ggacggccugcuaucuacagcacagugugucauuugcagauuugugguuaccuauaccacgc

SEQ ID NO: 64372 - RNA, 62 nt, Homo Sapiens
aggcuuucaagaguugguaccuuuuagcuauauuugcagauucucugggauuuuaaggaacu

SEQ ID NO: 64373 - RNA, 62 nt, Homo Sapiens
aauaugguauagaguuuauuaauauacuauuguuugcagauaaaggccuuaacuuuaaacau

SEQ ID NO: 64374 - RNA, 62 nt, Homo Sapiens
gugcuggguguguucguguaaaucagauucuguuugcagauggaucuguuuggucuuuucua

SEQ ID NO: 64375 - RNA, 62 nt, Homo Sapiens
gaugcagguucagguccccuggaaucaucuccuuugcagaauuauauuucacccaucucuca

SEQ ID NO: 64376 - RNA, 62 nt, Homo Sapiens
uuggcgggccccgaggcuccaggagccuccuguuugcagacgaggaagaacgcacagagggc

SEQ ID NO: 64377 - RNA, 62 nt, Homo Sapiens
acaaacaagaaagcuauuccgccaccuagcuuuuugcagauaugaaauuugauacuaaaaag

SEQ ID NO: 64378 - RNA, 62 nt, Homo Sapiens
ccuuccugggggauacuccuacaauuuuuuccuuugcagauguuugccuuggaaucaugauu

SEQ ID NO: 64379 - RNA, 62 nt, Homo Sapiens
ccgccacccagcaggggccucuucucuagccguuugcagaggggcacgugcccacaccccca

SEQ ID NO: 64380 - RNA, 62 nt, Homo Sapiens
gcauggaggugggaccagauguucaggguugcuuugcagaagcugaacccacccuccccagg

SEQ ID NO: 64381 - RNA, 62 nt, Homo Sapiens
ccauuaagcaguuacauauucaguuccaaacauuugcagaaagguuucaaauucugggaaac

SEQ ID NO: 64382 - RNA, 62 nt, Homo Sapiens
ucuuuacauauuucaauacagcuagguacuaauuugcagauguauaaauguaugucuucauu

SEQ ID NO: 64383 - RNA, 62 nt, Homo Sapiens
cgaaagcaagcuuuugccaaaggcagagcccuuuugcagauauucccuccgagccuguggaa

SEQ ID NO: 64384 - RNA, 62 nt, Homo Sapiens
gaaaugauggaauuuuucugagucuuuuucauuuugcagaagugcagcuguugagaaaacga

SEQ ID NO: 64385 - RNA, 62 nt, Homo Sapiens
ucugcuaucacugaauuacagagcuuucaaauuuugcagagcuccccacuacacagagaggu

SEQ ID NO: 64386 - RNA, 62 nt, Homo Sapiens
uggccauaaaauauuauuuaaucauauuucauuuugcagauguuauaucgacaaugaagaug

SEQ ID NO: 64387 - RNA, 62 nt, Homo Sapiens
uucccaaagugaaagggaaaguuaaagcuuacuuugcagagcuagaaguuuuugcuuugcua

SEQ ID NO: 64388 - RNA, 62 nt, Homo Sapiens
cuuguguguucguaucuuuauuuauucccuaguuugcagaacugucugaauaaaggauacaa

SEQ ID NO: 64389 - RNA, 62 nt, Homo Sapiens
aguaagagagagagagagccaaagcuguccguuuugcagauggacaggaaggagccaggaca

SEQ ID NO: 64390 - RNA, 62 nt, Homo Sapiens
ugagaauguuuggacucuaacucaccgauugcuuugcagacaaaggucuuuuauuucuccug

SEQ ID NO: 64391 - RNA, 62 nt, Homo Sapiens
uaggguuugaaauugauaaugcuuucacaacauuugcagauguuuuagaaggaaaaaaguuc

SEQ ID NO: 64392 - RNA, 62 nt, Homo Sapiens
aaaacaucagagaguucauacuaaaauauauuuuugcagaugcaguaaauaugaaaaauauu

SEQ ID NO: 64393 - RNA, 62 nt, Homo Sapiens
gauuuaaccagcauuuuucaacccugggaaaauuugcagaaucuaaguugauuguaaugauu

SEQ ID NO: 64394 - RNA, 62 nt, Homo Sapiens
augggggugcuauuuggcuuuuauucccugccuuugcagaacugaugucaccccagaugucc

SEQ ID NO: 64395 - RNA, 62 nt, Homo Sapiens
uugaaaaucaaucaaguagugaaugugaucucuuugcagagcuauagauagaaacagcugga

SEQ ID NO: 64396 - RNA, 62 nt, Homo Sapiens
guuuucuagucuacuucaaaauuuuuuacacguuugcagaggugcaaucaaauggaauuaag

SEQ ID NO: 64397 - RNA, 62 nt, Homo Sapiens
cugcaaacuaauugcucauuuacauuuaaauguuugcagauuuuaauaaauacuucugacac

SEQ ID NO: 64398 - RNA, 62 nt, Homo Sapiens
agaguguagaaaucccagugagaaaggaaggguuugcagagguacuucucagagcacugaaa

SEQ ID NO: 64399 - RNA, 62 nt, Homo Sapiens
auucuggaccagagacuuggcaggauaauauauuugcagauacuaucuggggagcuccuggc

SEQ ID NO: 64400 - RNA, 62 nt, Homo Sapiens
gggcaacaugauauuuggguccucuucaaguauuugcagauggcauucaauugguaacuauu

SEQ ID NO: 64401 - RNA, 62 nt, Homo Sapiens
aaaauaaagguguuuuugguaagagcuucuucuuugcagauguuauccuggaaaaagaagaa

SEQ ID NO: 64402 - RNA, 62 nt, Homo Sapiens
uuuugcauacuuauuucuacaguauguuuuguuuugcagacuaucuacuuaaacauguuuaa

SEQ ID NO: 64403 - RNA, 62 nt, Homo Sapiens
cuauuuaaguuucaacucuggcuagcauuagguuugcagaaauuuaguaaaggagcugagaa

SEQ ID NO: 64404 - RNA, 62 nt, Homo Sapiens
acaagaugugucuuaugagucuggguguuuuauuugcagagacccagugguuucagaaaugu

SEQ ID NO: 64405 - RNA, 62 nt, Homo Sapiens
caaauaacugaaauaaaaaaacaucaaguucauuugcagaaauuaucaguagguacauggau

SEQ ID NO: 64406 - RNA, 62 nt, Homo Sapiens
ugauuaauuuaaaauguuauuugcaaaagaauuuugcagaagugugaauauguuaugccaca

SEQ ID NO: 64407 - RNA, 62 nt, Homo Sapiens
auuuuuauauuacuauucuuguuguccuacaguuugcagauagagauauagucauauuuaaa

SEQ ID NO: 64408 - RNA, 62 nt, Homo Sapiens
ucagcugguuggauuucucaacugaauuaucuuuugcagauaguagauaggauaaucuauug

SEQ ID NO: 64409 - RNA, 61 nt, Homo Sapiens
gaaggaagaccuugaucgacuaucacacagcuuugcagaagacgaagaagaagaaggcuga

SEQ ID NO: 64410 - RNA, 62 nt, Homo Sapiens
gggaucauaaggagcccuuaauagcagugguauuugcagacuuaauacugccuguuauuggu

SEQ ID NO: 64411 - RNA, 62 nt, Homo Sapiens
uaucuuauuaaaaaaaaauaccgagagcugucuuugcagaaucuacagacaucuuucuuaag

SEQ ID NO: 64412 - RNA, 62 nt, Homo Sapiens
cacucaauuuuaagugcugugcccacagcuaguuugcagaacgagcaaaggauuaaacagag

SEQ ID NO: 64413 - RNA, 62 nt, Homo Sapiens
gaaagagauuuuuguuuucucaccauuggaauuuugcagacauaggaagaggcgauucaaca

SEQ ID NO: 64414 - RNA, 62 nt, Homo Sapiens
uggggagggugucuggggacggcgaagggugguuugcagaugcccuagcggcugcuccuuca

SEQ ID NO: 64415 - RNA, 62 nt, Homo Sapiens
cagcgucagaccuauuguaucauauuagagaauuugcagacuaagaauuuaugagaaaauau

SEQ ID NO: 64416 - RNA, 62 nt, Homo Sapiens
ccuaugggaaauggcugugcucccaacauagcuuugcagaugauguggguuuuuuuuuuuuu

SEQ ID NO: 64417 - RNA, 62 nt, Homo Sapiens
cagugaaaaauuauuuuuccacauugaaacacuuugcagacacaaauaucuaugaaaagaug

SEQ ID NO: 64418 - RNA, 62 nt, Homo Sapiens
ccgugaaugggaccuuguuuggaaauagggucuuugcagauauagucaagaugaggucacau

SEQ ID NO: 64419 - RNA, 62 nt, Homo Sapiens
gaaacgccccgggcaaagggucuuuugcagcuuuugcagacgggcaagaagcugcuucugcc

SEQ ID NO: 64420 - RNA, 62 nt, Homo Sapiens
gggcacaaacuucacuuagggcaucgcagauguuugcagaaugguuggccuaaugauuaugc

SEQ ID NO: 64421 - RNA, 62 nt, Homo Sapiens
acccaaccuuggucauaagugugccuggcugguuugcagauauuuguucugcuuuguaaaaa

SEQ ID NO: 64422 - RNA, 62 nt, Homo Sapiens
acccgacucucagauggggucagucccgucgcuuugcagacugacccuggaaaucuacaaaa

SEQ ID NO: 64423 - RNA, 62 nt, Homo Sapiens
aauaaaaacacuaugacagacagguuugccaguuugcagaaacuaacucuuuucucacauca

SEQ ID NO: 64424 - RNA, 62 nt, Homo Sapiens
cuugcauggauggcagcauuguucugaagggguuugcagaaaaaaaagauuuucuuuacaua

SEQ ID NO: 64425 - RNA, 62 nt, Homo Sapiens
caccuugguugaauguuucucacucauuaaacuuugcagaagugauucauauucaguacugu

SEQ ID NO: 64426 - RNA, 62 nt, Homo Sapiens
auuaucuugccuuauccaggaauaauugccccuuugcagagaaaaaaaaaaacuuaaaaaaa

SEQ ID NO: 64427 - RNA, 62 nt, Homo Sapiens
guccucuacugcuaaauaaguuaauuuugcauuuugcagaaagaaacauugauugcuaaauc

SEQ ID NO: 64428 - RNA, 62 nt, Homo Sapiens
acccuauuuuguguacuucuugugaauuauaauuugcagacuauuucagaaaagaaauuauc

SEQ ID NO: 64429 - RNA, 62 nt, Homo Sapiens
ccauuacaguuauuguugcuagauccaccucauuugcagauguccaaacuuaaauucaucug

SEQ ID NO: 64430 - RNA, 62 nt, Homo Sapiens
caagugggcggagcugagggcagcagcuugacuuugcagacaucugagcaauaguucuguua

SEQ ID NO: 64431 - RNA, 62 nt, Homo Sapiens
uuguagcucucauucauuguuuuuuaucuuaguuugcagaaagguguugaaaugcuucucua

SEQ ID NO: 64432 - RNA, 62 nt, Homo Sapiens
cuucuaggagcucaagggcuccuucuccccacuuugcagagcuucucccccuccucuccuga

SEQ ID NO: 64433 - RNA, 62 nt, Homo Sapiens
caguauuuugcugaauacuuguaaaaucuuucuuugcagagacauauuuuuucagcugaagg

SEQ ID NO: 64434 - RNA, 62 nt, Homo Sapiens
aacacuguuguaguuuagaaauguguuuuaguuuugcagaaguuuaccuguuugacuuuaua

SEQ ID NO: 64435 - RNA, 62 nt, Homo Sapiens
aaaaacauucauuugaacacuacuaaugacauuuugcagauucguguuuauagaaaggacau

SEQ ID NO: 64436 - RNA, 62 nt, Homo Sapiens
aggcagcagcaauaacuuguaaaaaguauauuuuugcagaaccucauuuaauuuuaggaugu

SEQ ID NO: 64437 - RNA, 62 nt, Homo Sapiens
uguucaaauuggacuggacuauuggggauaucuuugcagauauuuucuaccaaucacuaugu

SEQ ID NO: 64438 - RNA, 62 nt, Homo Sapiens
accuuuuuuguuuuauucuuaacuuuuuuuucuuugcagagauauacugaguacccuaggcc

SEQ ID NO: 64439 - RNA, 62 nt, Homo Sapiens
gaugcaaagugauuggguuugguggggaauuuuuugcagaaaugcauuuauaugguugauug

SEQ ID NO: 64440 - RNA, 62 nt, Homo Sapiens
acaccaaacaaaaaugccauuuuccucaguacuuugcagaaaaaagcucacuuuacaaaaua

SEQ ID NO: 64441 - RNA, 62 nt, Homo Sapiens
ggugcccugaauggaacuacagaaggucuggguuugcagaugaacaaaagcuguguccuggc

SEQ ID NO: 64442 - RNA, 62 nt, Homo Sapiens
aggaagucacgaaaugaggaguucuugccacauuugcagagucccuccuugauaagguuugg

SEQ ID NO: 64443 - RNA, 62 nt, Homo Sapiens
aaaguuauucaaaguauuuuuaaagcauuugauuugcagaugggugauucguaauaaauaaa

SEQ ID NO: 64444 - RNA, 62 nt, Homo Sapiens
gucuuuuacaaaacaaggacagcagaggaggguuugcagagaccucccucugaaaaacacaa

SEQ ID NO: 64445 - RNA, 62 nt, Homo Sapiens
augauuuauaaacagacaauaugugagugccuuuugcagaagaggguguguuugaaaucauc

SEQ ID NO: 64446 - RNA, 62 nt, Homo Sapiens
ccauugcagaauagcugagccaagugagugaguuugcagaaagcagguggugagcuccugcc

SEQ ID NO: 64447 - RNA, 62 nt, Homo Sapiens
gcgaguuuagccuuuaaguuucuguguauugauuugcagauuaaguaaugcugggaggaaua

SEQ ID NO: 64448 - RNA, 62 nt, Homo Sapiens
cuuguuugacaucucaugcugacccccuggccuuugcagaagcugaugguuacagagcuagu

SEQ ID NO: 64449 - RNA, 62 nt, Homo Sapiens
uccuagccaacacuauccuugggagaaagaaauuugcagaaacugcuaagaccaagugugga

SEQ ID NO: 64450 - RNA, 62 nt, Homo Sapiens
gcugcucugaggacucaggaacaccuucgagcuuugcagaccugcggucagcccuccaugcg

SEQ ID NO: 64451 - RNA, 62 nt, Homo Sapiens
gccaggccugggucuagaauucuugcugcugcuuugcagagucaacagcccaucagcccaug

SEQ ID NO: 64452 - RNA, 62 nt, Homo Sapiens
ccguguacaaugaggagcuggggccuccucaauuugcagaucccccaaguacaggcgcuaau

SEQ ID NO: 64453 - RNA, 62 nt, Homo Sapiens
ucauagaggcuauccuggaguaauguggcaaguuugcagaugguuuuaggaacuuuaacuuu

SEQ ID NO: 64454 - RNA, 62 nt, Homo Sapiens
acugacuggguauauauaggucuuaggacuucuuugcagacauggcugggcauucagugaag

SEQ ID NO: 64455 - RNA, 62 nt, Homo Sapiens
gauuuagcacaguacucaucuuaguuugucaguuugcagauaguuacaauuacagaaacuga

SEQ ID NO: 64456 - RNA, 62 nt, Homo Sapiens
augacuuuuauaugugugggguauacaaaguauuugcagagcauaccccacaaggacagugu

SEQ ID NO: 64457 - RNA, 62 nt, Homo Sapiens
gggugagguggagcccugcuccagugggcuuguuugcagacucaaucacaagagcccgccgg

SEQ ID NO: 64458 - RNA, 62 nt, Homo Sapiens
cccaagccacugggaccccucuccuaagggacuuugcagacagcacauagcuucucuccaua

SEQ ID NO: 64459 - RNA, 62 nt, Homo Sapiens
ggacagcagaggcuccagacggcuauucccauuuugcagacagaugacccuggacagagcgg

SEQ ID NO: 64460 - RNA, 62 nt, Homo Sapiens
ggacaacagacuuucugaccaccacuccuucauuugcagaggggaacaauuucaagguccuc

SEQ ID NO: 64461 - RNA, 62 nt, Homo Sapiens
uuggauaccccauuaaaucucaaauaauuggcuuugcagauauuuauggcauuuaguaccuu

SEQ ID NO: 64462 - RNA, 62 nt, Homo Sapiens
gugaugaccuuacaccacaacuggcuaaaugcuuugcagaaacugccaccugacaccgcuga

SEQ ID NO: 64463 - RNA, 62 nt, Homo Sapiens
ccgauuuggagucucuaggugauccagcaguauuugcagauuucuugauucuagugacaaag

SEQ ID NO: 64464 - RNA, 62 nt, Homo Sapiens
cugggaaggaccaagccucaagugccagggcauuugcagaaguacccucugaauuggagggc

SEQ ID NO: 64465 - RNA, 62 nt, Homo Sapiens
caccugagaaucgauggcucuugagaacuuuauuugcagagauugguaaaggcacagauguu

SEQ ID NO: 64466 - RNA, 62 nt, Homo Sapiens
uauauauuaauauacaucuuuccccugucacuuuugcagauauucuucgguuugaauaauua

SEQ ID NO: 64467 - RNA, 62 nt, Homo Sapiens
ugauuguuaaaauucucccaacugguucgaccuuugcagauacccauaaccuauguugagcc

SEQ ID NO: 64468 - RNA, 62 nt, Homo Sapiens
uucagaaucauugaagcagucuuaaagggucuuuugcagaugguacaaauuagaacaauuag

SEQ ID NO: 64469 - RNA, 62 nt, Homo Sapiens
caccugaucaagagcagugcuucuccauuuguuuugcagagaaauguuuuucauuucccgug

SEQ ID NO: 64470 - RNA, 62 nt, Homo Sapiens
gagaagaauagccuagauaugaauauauggcauuugcagauuuuuauauuaguugcuuuguu

SEQ ID NO: 64471 - RNA, 62 nt, Homo Sapiens
cugggccugcguugagggggcugucaugguccuuugcagagcugcugcuuuuggcauucaua

SEQ ID NO: 64472 - RNA, 62 nt, Homo Sapiens
ggcagacuggcuaaggaccagcccagggcaauuuugcagaaaugaucauuugcacagaaugg

SEQ ID NO: 64473 - RNA, 62 nt, Homo Sapiens
gaaaaggcccacuuuuuaaaaagugaaacaaguuugcagauacgguucucuuccuggacucc

SEQ ID NO: 64474 - RNA, 62 nt, Homo Sapiens
uuucauuuaauucucauggcaaccaccaugcauuugcagauaggcaagucaggcucacaaaa

SEQ ID NO: 64475 - RNA, 62 nt, Homo Sapiens
gaguguacuauauacuauuaccuuugaauguguuugcagagcuaguggauguguuugucuac

SEQ ID NO: 64476 - RNA, 62 nt, Homo Sapiens
uggaaaauauuugacccccuuggcugaauucuuuugcagaacuacugugugucuguucacua

SEQ ID NO: 64477 - RNA, 62 nt, Homo Sapiens
uauuuuugcaugaauuaagacguuuuaauuucuuugcagacaaggucuagaugcggagucag

SEQ ID NO: 64478 - RNA, 62 nt, Homo Sapiens
aaaaauauagcauucugaccuaaaaaaguuauuuugcagaugaauguguuuucaacucagga

SEQ ID NO: 64479 - RNA, 62 nt, Homo Sapiens
gaaggacacuuccugccuaagggagagugguauuugcagacuagaauucuagugcugcugaa

SEQ ID NO: 64480 - RNA, 62 nt, Homo Sapiens
cacguaauuucauuuacugugacacuugcuucuuugcagauuuugcauugacuuguguguac

SEQ ID NO: 64481 - RNA, 62 nt, Homo Sapiens
cucugggcagcucccaucccagucuggggccauuugcagacucaggaaaggauuucuacagu

SEQ ID NO: 64482 - RNA, 62 nt, Homo Sapiens
caaccuuccuucugcuucucccacacccaguauuugcagaagggcaaagcugcuuaagagag

SEQ ID NO: 64483 - RNA, 62 nt, Homo Sapiens
uuuuuucaagagaucauguuuuuaaagugucuuuugcagaguuuuaaguuguucugucugaa

SEQ ID NO: 64484 - RNA, 62 nt, Homo Sapiens
ggagguugucuucaagcuguggacuucugggauuugcagauuuugcaacgugguacuacuuu

SEQ ID NO: 64485 - RNA, 62 nt, Homo Sapiens
agcccgcugcuuuuucuauccucccagucaccuuugcagacaaagaccaggggcagcucccg

SEQ ID NO: 64486 - RNA, 62 nt, Homo Sapiens
cauacuuaugggaaauuugacuuaauuuaaucuuugcagauaaugagagcgagcaaauaaaa

SEQ ID NO: 64487 - RNA, 62 nt, Homo Sapiens
ugugcagccaucaccacuguguuuuuaguauuuuugcagaauaauauacauacaauucagug

SEQ ID NO: 64488 - RNA, 62 nt, Homo Sapiens
caaaaucugcaaugguuauuaugugacggauuuuugcagauucuuaaucugucccaacagca

SEQ ID NO: 64489 - RNA, 62 nt, Homo Sapiens
auuuuuguauaaucauguccaaauuguaauaauuugcagauuaggcuuugugacauucauuu

SEQ ID NO: 64490 - RNA, 62 nt, Homo Sapiens
guaagugauuucuccagcaguuuuacuccugauuugcagaauaaugaagaaguggauuucuc

SEQ ID NO: 64491 - RNA, 62 nt, Homo Sapiens
uuggucucucaggcuguuuguuaaaauuuccauuugcagaauaaaaauguauucagugggcu

SEQ ID NO: 64492 - RNA, 62 nt, Homo Sapiens
uauauuuuuuaaauggcacuagaaaaggucucuuugcagauaugaaaggcaggugaggaaac

SEQ ID NO: 64493 - RNA, 62 nt, Homo Sapiens
accuugucuccuuagaaaugaaguuuccaggcuuugcagaagaccacaggccaucaaaauau

SEQ ID NO: 64494 - RNA, 62 nt, Homo Sapiens
agguguaggacuauuuaagucuauuacuaguguuugcagaauuccagucaggcauuauuuuc

SEQ ID NO: 64495 - RNA, 62 nt, Homo Sapiens
gaagccuugaggucugucacuuugcccucagcuuugcagaauugaaggagucugggccaagg

SEQ ID NO: 64496 - RNA, 62 nt, Homo Sapiens
cggcacagcaaacauuuugcugcacuaagugcuuugcagacauuuuuuuuuucuuucuccuu

SEQ ID NO: 64497 - RNA, 62 nt, Homo Sapiens
cccaccuggaaaaugggcugagcccccucaacuuugcagaugacagcagagagacccaccgg

SEQ ID NO: 64498 - RNA, 62 nt, Homo Sapiens
uuggagucccugaauaauaaagagggaauauauuugcagaaagucgcauaggguuuuuuaau

SEQ ID NO: 64499 - RNA, 62 nt, Homo Sapiens
acuaaagauaaauaaggagaaaacauuuaggauuugcagauaagucaacagaaagugccugc

SEQ ID NO: 64500 - RNA, 62 nt, Homo Sapiens
gaaucaccagcacauucacugacaugauauuauuugcagauugacaaguaggaaguggggaa

SEQ ID NO: 64501 - RNA, 62 nt, Homo Sapiens
ccuggcuuauuccauaccauuucccuugcagauuugcagaaacauggcaucuuucacugcau

SEQ ID NO: 64502 - RNA, 62 nt, Homo Sapiens
uaauacggcaauaagguagcaaaggcaggugcuuugcagaaagaaugcuuggaaacuugagu

SEQ ID NO: 64503 - RNA, 62 nt, Homo Sapiens
augcugcaccuucagccagcucugcucugaucuuugcagaucuuuaaguugucacuguuucu

SEQ ID NO: 64504 - RNA, 62 nt, Homo Sapiens
ugaaaaaauuuuaaagauaaaauaggacauauuuugcagauauauauauauauauacacaaa

SEQ ID NO: 64505 - RNA, 62 nt, Homo Sapiens
aaagaaguuuccagaaacuuugacuugaaauguuugcagaucaacuauaagcacaaagaaga

SEQ ID NO: 64506 - RNA, 62 nt, Homo Sapiens
cauaaagcaaguuuuaccucucuguacauguuuuugcagacauacuugaaaagcucacuuaa

SEQ ID NO: 64507 - RNA, 62 nt, Homo Sapiens
auaucugcccguguacccucaacugccuccuuuuugcagagaacgauccccacaggaacugg

SEQ ID NO: 64508 - RNA, 62 nt, Homo Sapiens
aagggaaauacucuuaauucaugaauaaaaacuuugcagaaaauuagacaguguuuaauuuu

SEQ ID NO: 64509 - RNA, 62 nt, Homo Sapiens
auucauuauugcgcccuccagguccccuccuuuuugcagaagguguaaaagagcugcccuug

SEQ ID NO: 64510 - RNA, 62 nt, Homo Sapiens
ugggucucugcucugcucuggggagggugugauuugcagaccucaaaggaggaacucguggg

SEQ ID NO: 64511 - RNA, 62 nt, Homo Sapiens
ccuguaucuccuccauagauauucaagucaaauuugcagaacuaaaaaaauuuuuuaauuaa

SEQ ID NO: 64512 - RNA, 62 nt, Homo Sapiens
gguguggaguaaguaaaguguauuaugagcauuuugcagaaacacaauguagacaggagguu

SEQ ID NO: 64513 - RNA, 62 nt, Homo Sapiens
gaggaauuucuugauuaaugcauaggcugacuuuugcagaugaucuuggcuguauuuaaugg

SEQ ID NO: 64514 - RNA, 62 nt, Homo Sapiens
ccccacugcaugaaggccugaggcugcccugcuuugcagaaggaggugccucccuaucuggu

SEQ ID NO: 64515 - RNA, 62 nt, Homo Sapiens
ggaucucccuguuuccuaggaccacuguauuuuuugcagacaugggacuacaggugugaguc

SEQ ID NO: 64516 - RNA, 62 nt, Homo Sapiens
cuuugagaaccaugcguauagccgccguuauauuugcagaagaaccaaagaccaaauguuag

SEQ ID NO: 64517 - RNA, 62 nt, Homo Sapiens
uuaaucuacaaguuguauuauaagaaaucaaauuugcagaauuuuuuuuuuuuuuccuuggu

SEQ ID NO: 64518 - RNA, 62 nt, Homo Sapiens
gcuaaggaaaaucuuccaaauuaaucagucaauuugcagauaguuccugcauuuaccauaau

SEQ ID NO: 64519 - RNA, 62 nt, Homo Sapiens
aaauaaaucagaguuuacaauaaucauuuauuuuugcagaucauuuggauuucuccauagaa

SEQ ID NO: 64520 - RNA, 62 nt, Homo Sapiens
uaauuaguuaaguuaaggugcuuaccagggucuuugcagaugcagguacccaugaaugugag

SEQ ID NO: 64521 - RNA, 62 nt, Homo Sapiens
cuuauucaguucuuacacauaauauuccacuauuugcagaggcuccgugaaaauauguuugg

SEQ ID NO: 64522 - RNA, 62 nt, Homo Sapiens
uguaaguaaagccaaucugcuugggaaaaacguuugcagaaauuacuugguauauuuuuauu

SEQ ID NO: 64523 - RNA, 62 nt, Homo Sapiens
ugauggaaugcaucccaccugaaaagcaggccuuugcagauauaagcugaaccaccaacaga

SEQ ID NO: 64524 - RNA, 62 nt, Homo Sapiens
cuuauguguuaauaccuuuugaguugcuucaauuugcagauguacuguuccaagaaaaccag

SEQ ID NO: 64525 - RNA, 62 nt, Homo Sapiens
ggaaucauuaaguaauuuaaagucuaugcucauuugcagacugaucuauaacaacagagcaa

SEQ ID NO: 64526 - RNA, 62 nt, Homo Sapiens
ugcaaaacugcagcugaaauuguguguguguguuugcagacaugugugugugugugugugug

SEQ ID NO: 64527 - RNA, 62 nt, Homo Sapiens
gugcucccaccagcccccaccucauccgucuguuugcagagccucaucuacagguccccacg

SEQ ID NO: 64528 - RNA, 62 nt, Homo Sapiens
cugaugguauauuucuauccuaacagugucccuuugcagaucaagcuuuauucugaagaaua

SEQ ID NO: 64529 - RNA, 62 nt, Homo Sapiens
aaauagaugugauugguugccauuuguguucuuuugcagaacucugauaagaaaaguguuca

SEQ ID NO: 64530 - RNA, 62 nt, Homo Sapiens
uauaauuuuucuauuuuuguuuuugguuuuaauuugcagagauuugcugccaggaaucaauu

SEQ ID NO: 64531 - RNA, 62 nt, Homo Sapiens
aaagguuuguuguaguugucuuaugugcugaauuugcagaugaucagaugcugugcagaauu

SEQ ID NO: 64532 - RNA, 62 nt, Homo Sapiens
acaggaaaucccagugucuagcaaugguuugguuugcagagaacacagccugauacuuaauu

SEQ ID NO: 64533 - RNA, 62 nt, Homo Sapiens
gcagcucaggcuacugcuaaggccugagaguuuuugcagaaauggggcagagggacacccuu

SEQ ID NO: 64534 - RNA, 62 nt, Homo Sapiens
aggggcauagucaggguggggaguguuugaaguuugcagaugagaagguuugacaaaaagac

SEQ ID NO: 64535 - RNA, 62 nt, Homo Sapiens
ugagacuuggguuuucuuaaugccagugugaauuugcagauguuuucagaaaaucaagucac

SEQ ID NO: 64536 - RNA, 62 nt, Homo Sapiens
ggacucaagcaacuauuauuauauuucuccuuuuugcagauacaggguaagugacuuaacca

SEQ ID NO: 64537 - RNA, 62 nt, Homo Sapiens
caguugccaguucccauuaucgauacucuuucuuugcagaauaccuuagaaccguuauuucc

SEQ ID NO: 64538 - RNA, 62 nt, Homo Sapiens
caaauagugucuacuaucucaacccuccaaaauuugcagaguguugggacugucauuuguga

SEQ ID NO: 64539 - RNA, 62 nt, Homo Sapiens
cagucggucaagaggaggauuuuguuuuguaguuugcagaugagcauuucuaaagcauuuuc

SEQ ID NO: 64540 - RNA, 62 nt, Homo Sapiens
cuguugaaugaacaacugugccuuguggaauuuuugcagaaguguuuaugcuuuguuagcau

SEQ ID NO: 64541 - RNA, 62 nt, Homo Sapiens
cuuuuccuaguuacggaugauuuggggaugcuuuugcagaaauguguucauagaugaugcug

SEQ ID NO: 64542 - RNA, 62 nt, Homo Sapiens
aauugaggaagcaguuaaauugugcgcuguauuuugcagauuauggggauucaaauucuagu

SEQ ID NO: 64543 - RNA, 62 nt, Homo Sapiens
ucuuauugucuaaauugagacagccucagauauuugcagauauuuacuuuuugucugauauc

SEQ ID NO: 64544 - RNA, 62 nt, Homo Sapiens
uuccuguccaugcaagcaaguagccacuggauuuugcagauuaaagacaugucaucuugugc

SEQ ID NO: 64545 - RNA, 62 nt, Homo Sapiens
cugggguuccaggagccuggcugcagaacuccuuugcagaaagaaaacugucauuuagcugg

SEQ ID NO: 64546 - RNA, 62 nt, Homo Sapiens
auaugcuauauauuaggcaauaacucauaauuuuugcagaaacaucuucauuaaaguauauu

SEQ ID NO: 64547 - RNA, 62 nt, Homo Sapiens
caaaaauccaugagugaauauuuagauguaguuuugcagagacacaugcaucagaaccauga

SEQ ID NO: 64548 - RNA, 62 nt, Homo Sapiens
ucauuuauucagcaaauauuucauaaaccuguuuugcagaacgugauucacccaccuuggcc

SEQ ID NO: 64549 - RNA, 62 nt, Homo Sapiens
agcaccugccgaccucguccaauuguccccaguuugcagaaaggauccauguagcaggacug

SEQ ID NO: 64550 - RNA, 62 nt, Homo Sapiens
uggggaagccgggcagaagaagaaauggcuucuuugcagagcacacgcaucacagccauuug

SEQ ID NO: 64551 - RNA, 62 nt, Homo Sapiens
uauuuggguaccucauuuugcuuuuucaucuauuugcagagcaacccucaagaguucuaauu

SEQ ID NO: 64552 - RNA, 62 nt, Homo Sapiens
uaggcuguggcuaugguggcgcccaaguggaguuugcagacaagaaagaaaagagagcucag

SEQ ID NO: 64553 - RNA, 62 nt, Homo Sapiens
uagaagcugaaacauggguuuaccuugcucauuuugcagauucaccuaaaaaugugcuacug

SEQ ID NO: 64554 - RNA, 62 nt, Homo Sapiens
aauuuucuuuauaaaauugaaaggggaugugguuugcagaagauaccuagucuuguuacaua

SEQ ID NO: 64555 - RNA, 62 nt, Homo Sapiens
uaacccgugaguuaauguuagcuaugaaaucauuugcagaauguugugcuagccaaaguaau

SEQ ID NO: 64556 - RNA, 62 nt, Homo Sapiens
acucauaaaggagcauauaacuucauauaugcuuugcagagaugggaccugcuucauucaag

SEQ ID NO: 64557 - RNA, 62 nt, Homo Sapiens
caaaacgugauuuaaaagcuuugucucccaaauuugcagaaacauuccaguaagaacucaau

SEQ ID NO: 64558 - RNA, 62 nt, Homo Sapiens
ggucccugcccucaucucucccugggcucgucuuugcagagugagggggcucgcugcugcgc

SEQ ID NO: 64559 - RNA, 62 nt, Homo Sapiens
ugggcacaugugcccagggguuggccacugucuuugcagagcauggaagacuugucuucaac

SEQ ID NO: 64560 - RNA, 62 nt, Homo Sapiens
gcgccugggagaaccccuacacugcccuggccuuugcagaguaugcccgacugugcuuucaa

SEQ ID NO: 64561 - RNA, 62 nt, Homo Sapiens
cccuggauggcaauuugcuugauagcaucugauuugcagacucauaauuugauuuuuaauua

SEQ ID NO: 64562 - RNA, 62 nt, Homo Sapiens
aaguaagaaagaaacuaaagacccugaaugaauuugcagauuacccaugugcacagugggga

SEQ ID NO: 64563 - RNA, 62 nt, Homo Sapiens
ccuucauggcuuccgaucagauggcaagggucuuugcagaugugcauuccagagccagccgg

SEQ ID NO: 64564 - RNA, 62 nt, Homo Sapiens
auuccucuuuccuucacuauuuagccuaugauuuugcagaggugucacacuguauuaggauc

SEQ ID NO: 64565 - RNA, 62 nt, Homo Sapiens
agaugaagccauguugcauccacauguucccguuugcagaaaccucacaggacaguacgaau

SEQ ID NO: 64566 - RNA, 60 nt, Homo Sapiens
gaagagucccccuccuggcagaaugucugggcuuugcagagcaggccccgggggugaagu

SEQ ID NO: 64567 - RNA, 62 nt, Homo Sapiens
guaaaagguaaugauaauuauaacauauuucuuuugcagaaucucgccaugcuucuuuacuu

SEQ ID NO: 64568 - RNA, 62 nt, Homo Sapiens
acagaacuuagccaaaccuaccuuuacuugccuuugcagaaauacugaacacuuggaaguca

SEQ ID NO: 64569 - RNA, 62 nt, Homo Sapiens
auaaggcuuuuuauacucuugauacgauuuacuuugcagaucuugggaugaaauuuaaacca

SEQ ID NO: 64570 - RNA, 62 nt, Homo Sapiens
ucugaucagauagucccuucagcuaagucugcuuugcagauagcacaaugacuguaggacua

SEQ ID NO: 64571 - RNA, 62 nt, Homo Sapiens
aagugugcugccuuagucuaacucucuggcccuuugcagaaauccacaagccuaacuuauuc

SEQ ID NO: 64572 - RNA, 62 nt, Homo Sapiens
acagaacaaauguguuggggauaaagugcuuauuugcagauaugaugcugaacuauuuggua

SEQ ID NO: 64573 - RNA, 62 nt, Homo Sapiens
caagugcucagggaaaugaacucucacgguuuuuugcagaagaccguccucacuuuuccuuc

SEQ ID NO: 64574 - RNA, 62 nt, Homo Sapiens
ucuguucucucaagcagaacuacuauuugaacuuugcagauccagccucgccucccuguuug

SEQ ID NO: 64575 - RNA, 62 nt, Homo Sapiens
ucacaauuuuccuguggaauuuugcagcugcuuuugcagaaacuuucugcuaugugugguac

SEQ ID NO: 64576 - RNA, 62 nt, Homo Sapiens
accaugugguugaagguuuuuuucaaugaagcuuugcagaucaagaagagaacguuugucuu

SEQ ID NO: 64577 - RNA, 62 nt, Homo Sapiens
acucauuuuugcauaaaaagguuccuaauccuuuugcagaauaaguuuuguuuacucuuuau

SEQ ID NO: 64578 - RNA, 62 nt, Homo Sapiens
gguauuuuguagcauuccuugucaaguucuccuuugcagaauaccugucuccacauuccuag

SEQ ID NO: 64579 - RNA, 62 nt, Homo Sapiens
ucuuguaaauauuaaaacgacuccccaauuauuuugcagaauugcacuuaauauugaaaugu

SEQ ID NO: 64580 - RNA, 62 nt, Homo Sapiens
accagcaacugggccuugagaacuuccauuuuuuugcagauugucugcagaaacucagacag

SEQ ID NO: 64581 - RNA, 62 nt, Homo Sapiens
caaaugugaauucuuuugagaaaguaugaaguuuugcagaaauugacugugaaaugucagag

SEQ ID NO: 64582 - RNA, 62 nt, Homo Sapiens
uucauaugcagauuuuauucucaccugggccauuugcagaugagacuguaguuugcagauga

SEQ ID NO: 64583 - RNA, 62 nt, Homo Sapiens
cucaccugggccauuugcagaugagacuguaguuugcagaugagacuguaguuugcagaugg

SEQ ID NO: 64584 - RNA, 62 nt, Homo Sapiens
gaugagacuguaguuugcagaugagacuguaguuugcagauggcguggaagcauucaucagg

SEQ ID NO: 64585 - RNA, 62 nt, Homo Sapiens
uggaguuuuaaaauuauguguuaauauuuuuauuugcagauuucguuuccgucaacuuaaac

SEQ ID NO: 64586 - RNA, 62 nt, Homo Sapiens
uuaaaaauaguugaaugcugguggaaaguuacuuugcagauggguguaaggacucauggccc

SEQ ID NO: 64587 - RNA, 62 nt, Homo Sapiens
ugaaguuuuucuguuauuaagauguacuguacuuugcagaaguuuaccccauuuucaagaag

SEQ ID NO: 64588 - RNA, 62 nt, Homo Sapiens
gccauggucaugucauucugucugcuucuugcuuugcagagucaggaauugcccucaagaac

SEQ ID NO: 64589 - RNA, 62 nt, Homo Sapiens
acucugccuccaaaugcaggaaaacuaucaucuuugcagauuuagguaacaggacauaugua

SEQ ID NO: 64590 - RNA, 62 nt, Homo Sapiens
cguuaucauacuccauuuacuacagaauuuacuuugcagaagguaaaaccugcccaggaacu

SEQ ID NO: 64591 - RNA, 62 nt, Homo Sapiens
cauaauuuagcaaccauuuauaugggauuacuuuugcagaauaauuuaccuagaugucuauu

SEQ ID NO: 64592 - RNA, 62 nt, Homo Sapiens
aguaggcaucucaagguaacuucucacuagacuuugcagagcaguugauagaggcuguggug

SEQ ID NO: 64593 - RNA, 62 nt, Homo Sapiens
auuuaaauaccucagauuuuugaguuuccauguuugcagaguuccuuugaggaagguagaag

SEQ ID NO: 64594 - RNA, 62 nt, Homo Sapiens
agcuaauuagcucucgccucuucuuggaucuuuuugcagacuugucuaaaguuagggcauuu

SEQ ID NO: 64595 - RNA, 62 nt, Homo Sapiens
aaaaaaaaaucacauuucuguauuguuauugcuuugcagaaauguagaaaaaaagugcuuaa

SEQ ID NO: 64596 - RNA, 62 nt, Homo Sapiens
uauuguggguauagguauuuccugugggagauuuugcagacccaagaaagggagaagaggug

SEQ ID NO: 64597 - RNA, 62 nt, Homo Sapiens
gcauggcauguuuuguuacagguuguagaguauuugcagaaggaaaccauuucugguuauuu

SEQ ID NO: 64598 - RNA, 62 nt, Homo Sapiens
augaaguaucuuguacauauaaauuuauuucuuuugcagagcauuauauuacuggauguuua

SEQ ID NO: 64599 - RNA, 62 nt, Homo Sapiens
ugucugcacaaggagugaccuucucaugcugauuugcagacggggcaccccuguggaggggc

SEQ ID NO: 64600 - RNA, 62 nt, Homo Sapiens
aagaaaaaagaguccucuucuuuucccagccuuuugcagaacacaguagacagaacugccac

SEQ ID NO: 64601 - RNA, 62 nt, Homo Sapiens
auguuaguuuuauauacagcaaaacuugauuuuuugcagauggaaagguauuuuguuucuau

SEQ ID NO: 64602 - RNA, 62 nt, Homo Sapiens
ggacaguguuauaaaucagaauuuuacgacaguuugcagaacacugauuugaaagcuuccua

SEQ ID NO: 64603 - RNA, 62 nt, Homo Sapiens
ucuguaccugaggaaaccaggcccugggugacuuugcagaucugcucacccucggugagcaa

SEQ ID NO: 64604 - RNA, 62 nt, Homo Sapiens
uuggacuacuuguuucguaaagauaaccaguuuuugcagagaaacguguacccauauauaau

SEQ ID NO: 64605 - RNA, 62 nt, Homo Sapiens
augccaggggacuacguuucgcaagggggaaguuugcagagcucauguaaagcaaucgcaaa

SEQ ID NO: 64606 - RNA, 62 nt, Homo Sapiens
aggagccggggaccagcuugacggguuccugcuuugcagagaaugauuugucugcuaagaag

SEQ ID NO: 64607 - RNA, 62 nt, Homo Sapiens
cgaagucucacugcaccagucuccccgggguuuuugcagacugaguggcccugccuccuguc

SEQ ID NO: 64608 - RNA, 62 nt, Homo Sapiens
guacuguuacauuaagugcaauguaaccuauuuuugcagaagucauugcauuucugaguauu

SEQ ID NO: 64609 - RNA, 62 nt, Homo Sapiens
aaaagcggggaaaaaaaaaauuaguuccucauuuugcagaugcucuguaguuuucccagauu

SEQ ID NO: 64610 - RNA, 62 nt, Homo Sapiens
uaucccacaucagaaucacugggaaauuuaaguuugcagaucccacacucacccugaauccu

SEQ ID NO: 64611 - RNA, 62 nt, Homo Sapiens
guuucaaagaaaaggugucauuggagcaguguuuugcagaaugagccagaguucaccaagca

SEQ ID NO: 64612 - RNA, 62 nt, Homo Sapiens
ggaauccagacccggcugcgugguugaugaucuuugcagacaggcaagcaccuccugccucg

SEQ ID NO: 64613 - RNA, 62 nt, Homo Sapiens
uauaaaagaugauaguaauuuaccaagugacauuugcagagaaacagguguacaguuaucgu

SEQ ID NO: 64614 - RNA, 62 nt, Homo Sapiens
ccccuuucuuccgggcccugcugucaggcagcuuugcagaagcccagauggaccuggugccc

SEQ ID NO: 64615 - RNA, 62 nt, Homo Sapiens
ugagucaccuagggguucauagaaaaaggaaguuugcagaugcaauaaaugugaggaaguau

SEQ ID NO: 64616 - RNA, 62 nt, Homo Sapiens
caagacugcaucuagaaucgcucaaacaccuguuugcagaccccaugcaccagcuggagggg

SEQ ID NO: 64617 - RNA, 62 nt, Homo Sapiens
ucggcuuuuucauuuacccucauuuagagccauuugcagagauuuagaaagauuuacaguaa

SEQ ID NO: 64618 - RNA, 62 nt, Homo Sapiens
gaaaugaaguacccuuuuguaaauagcauuuuuuugcagaaggugaaaauuccacucucuac

SEQ ID NO: 64619 - RNA, 62 nt, Homo Sapiens
gucugcaagauaaauuagaucgcccugugggguuugcagaauuagugaaggguccaggacga

SEQ ID NO: 64620 - RNA, 62 nt, Homo Sapiens
ggaucuggcugaugucugucagcuuugguguguuugcagaugaagccacgccuguugaauaa

SEQ ID NO: 64621 - RNA, 62 nt, Homo Sapiens
cauagcugcucugcagggcgauuccaguccccuuugcagaucggagcccggggcucugcagc

SEQ ID NO: 64622 - RNA, 62 nt, Homo Sapiens
gaaggccagcauuuacgaugccaaaaucauaauuugcagaagcucugcauggguuggauuuu

SEQ ID NO: 64623 - RNA, 62 nt, Homo Sapiens
cagauguaaaugcaugggacugaauuguacaguuugcagaugcagugaggauaagcacagau

SEQ ID NO: 64624 - RNA, 62 nt, Homo Sapiens
gaacagugaaaagcuuucagcgaaccucuuucuuugcagaccgcgaguggagcaggggcagg

SEQ ID NO: 64625 - RNA, 62 nt, Homo Sapiens
aaggcaucgucaugcacaguguauuuauugguuuugcagaagauauuuuaaaauuuguucuu

SEQ ID NO: 64626 - RNA, 62 nt, Homo Sapiens
acuauucuaauugaacaauguuuauaaauauuuuugcagaacguagcaguaucuugagaagu

SEQ ID NO: 64627 - RNA, 62 nt, Homo Sapiens
gggugcuuagcagacagagucucugagaucuguuugcagaguaccuccucuggauuuguuca

SEQ ID NO: 64628 - RNA, 62 nt, Homo Sapiens
acacuuguaugguagacuguaaauucauuuuauuugcagaguagccuuuaguuuuuaaagua

SEQ ID NO: 64629 - RNA, 62 nt, Homo Sapiens
uaaaccaauaaauccacaccucuacuuuaagguuugcagagaacaccuggcccuugcaaucu

SEQ ID NO: 64630 - RNA, 62 nt, Homo Sapiens
gauuucauuggauggauacuuuuaaggguuucuuugcagacucugugcaaugaaaaauagcc

SEQ ID NO: 64631 - RNA, 62 nt, Homo Sapiens
ugaugaaaauacaaccucuuaagcuuugaccuuuugcagaucuuccuuuugucuuuugcugu

SEQ ID NO: 64632 - RNA, 62 nt, Homo Sapiens
ggaaacucagccguagggugucugccuuaggguuugcagagucaacccugugggcuuauguc

SEQ ID NO: 64633 - RNA, 62 nt, Homo Sapiens
uccaaaugauauucaugaugauguauauagucuuugcagagggagcguguacguuaauguga

SEQ ID NO: 64634 - RNA, 62 nt, Homo Sapiens
aaacaaaaaaacuacaaacauucuuccaaacuuuugcagaaacccaccgcagcuacuccccu

SEQ ID NO: 64635 - RNA, 62 nt, Homo Sapiens
agcgucaggccuaccucaaguucuuggaccaguuugcagagugaaagaucaagaaaugucuc

SEQ ID NO: 64636 - RNA, 62 nt, Homo Sapiens
gaacuccugugcuuggugcccacaguauagauuuugcagaggcuguaaaauugauugugggg

SEQ ID NO: 64637 - RNA, 62 nt, Homo Sapiens
uccaacaaagaagccaugaccaguuaaagauauuugcagaguuacaccuuggucauaagucc

SEQ ID NO: 64638 - RNA, 62 nt, Homo Sapiens
acaggugcgugucaccaugcuuggcuaauuuuuuugcagaaacgaggccucacuauauuguc

SEQ ID NO: 64639 - RNA, 62 nt, Homo Sapiens
aaccaaaaagaaaggaagucgaaguaucucuguuugcagacgauaugauucuauaucuagaa

SEQ ID NO: 64640 - RNA, 62 nt, Homo Sapiens
uuucucugcaaagacuagauccuuuuuuacgcuuugcagaccgcauagucacugucucaacu

SEQ ID NO: 64641 - RNA, 62 nt, Homo Sapiens
aggaguuugaggguuugggaugggagaaguauuuugcagagcuaucaauguccaaauaauuu

SEQ ID NO: 64642 - RNA, 62 nt, Homo Sapiens
cauauuuuguuuaguacaguuucauauuugaguuugcagaauuaucuaauagucuuuuuuug

SEQ ID NO: 64643 - RNA, 62 nt, Homo Sapiens
gcuaggccagugcuuuuuccucuuaggguuucuuugcagaaagaaaccuccagcaagggaag

SEQ ID NO: 64644 - RNA, 62 nt, Homo Sapiens
aaagaugaaugcaauaguaggacugcugacauuuugcagaaaauacauuuuauuuaaaaucu

SEQ ID NO: 64645 - RNA, 62 nt, Homo Sapiens
aagguuggaacugcugccaugauuuuggccacuuugcagaccugggacuuuagggcuaacca

SEQ ID NO: 64646 - RNA, 62 nt, Homo Sapiens
gaugggauagacuggggagacgaugcuguugcuuugcagaucacagugcuggaagcaggaac

SEQ ID NO: 64647 - RNA, 62 nt, Homo Sapiens
aagagagagaagagaaaaugaaagcagcugguuuugcagaagugugugucgcaugcgccagu

SEQ ID NO: 64648 - RNA, 62 nt, Homo Sapiens
ucuggugcacagguuuguuuuuucaagaaaauuuugcagaagcuauguuuuuaaaguguaca

SEQ ID NO: 64649 - RNA, 62 nt, Homo Sapiens
agcucauuccuuacccugguuaggucacuacuuuugcagauuuugcuggcacugaucuggag

SEQ ID NO: 64650 - RNA, 62 nt, Homo Sapiens
gcaggugcugacucccgcacucccuggcauuuuuugcagacaagggcuugggauggacccuc

SEQ ID NO: 64651 - RNA, 62 nt, Homo Sapiens
caggugcagcuuuggagaaccuuguguaaacguuugcagacacauguucuccauucaagggu

SEQ ID NO: 64652 - RNA, 62 nt, Homo Sapiens
augagcugcaguccaguuuaugcauuuuacucuuugcagagauauccaaucugccugugaca

SEQ ID NO: 64653 - RNA, 62 nt, Homo Sapiens
cuuugcuagauccucucauaacauuaaucauuuuugcagagaaaguccggaugggaauauuc

SEQ ID NO: 64654 - RNA, 51 nt, Homo Sapiens
uuauggcuuucaguaauagccuuugcagauuccuguuggggagcaggauga

SEQ ID NO: 64655 - RNA, 62 nt, Homo Sapiens
acauucaagguuucaaagcgugaugcucaguauuugcagaaugaaauggaagaaagugaacu

SEQ ID NO: 64656 - RNA, 62 nt, Homo Sapiens
uucucaaaaaucaguuuguggaagaaaagauuuuugcagaauuaacagaagggaaaaggaaa

SEQ ID NO: 64657 - RNA, 62 nt, Homo Sapiens
uugguguuaauagaccaaauuagagguuguuuuuugcagaucgaguuuucuuaucuuguguu

SEQ ID NO: 64658 - RNA, 62 nt, Homo Sapiens
gccugaaagaaaaaaaauacuaaaaaauucauuuugcagaaaaaucuuuuuuuuguuguuuu

SEQ ID NO: 64659 - RNA, 62 nt, Homo Sapiens
cuggaagacggcagccgccgcucuuccuucacuuugcagaggcaagcgcuuggccucuccuu

SEQ ID NO: 64660 - RNA, 62 nt, Homo Sapiens
aguggugggaggaauagaggcuggaaauagcuuuugcagagguuuaggguuggcgagcaucu

SEQ ID NO: 64661 - RNA, 62 nt, Homo Sapiens
cuuuugagggucguugcaagggaaaugugcauuuugcagaaagcuggguuagggcagggccu

SEQ ID NO: 64662 - RNA, 62 nt, Homo Sapiens
gccagugucacggugaaggcaacaguuggcacuuugcagauguaaucacgugcucgaugaag

SEQ ID NO: 64663 - RNA, 62 nt, Homo Sapiens
acuuaucaaaauuugguagcuauucuaaggcuuuugcagaaaaauaaguguucaauguuugu

SEQ ID NO: 64664 - RNA, 62 nt, Homo Sapiens
gguauuugauguauuuaauugugaaaggagacuuugcagauaaaugaggccagaauggcaug

SEQ ID NO: 64665 - RNA, 62 nt, Homo Sapiens
ugcacuccagacggcuuucucaguuccaagauuuugcagagagaaggagcaaaccuuuucau

SEQ ID NO: 64666 - RNA, 62 nt, Homo Sapiens
cugcuugcacuuuugcauuugccuaacagacuuuugcagaggcgauggcagagagcagcugc

SEQ ID NO: 64667 - RNA, 62 nt, Homo Sapiens
ucgauuuacuuccuaauuauaaaagcugcuuuuuugcagaacauuccuugaaaauauaaggu

SEQ ID NO: 64668 - RNA, 62 nt, Homo Sapiens
ccacgcugcuuucuucccaaaggacauguauauuugcagagcuccacauacagaaacacauu

SEQ ID NO: 64669 - RNA, 62 nt, Homo Sapiens
uuugcagagcuccacauacagaaacacauuauuuugcagaaauagguguuuuuaagaaguuu

SEQ ID NO: 64670 - RNA, 62 nt, Homo Sapiens
uuggugcucagacaauauuuuagauccuugcuuuugcagaauacuucuaaaauucggaauuc

SEQ ID NO: 64671 - RNA, 62 nt, Homo Sapiens
aaaauaaaaagaaaagaaaagaauggacaguguuugcagagaguugcucacgaguuucccuc

SEQ ID NO: 64672 - RNA, 62 nt, Homo Sapiens
gggucuggggccucccuccgucugcgcccaccuuugcagaauaaacucucuccugggguuug

SEQ ID NO: 64673 - RNA, 62 nt, Homo Sapiens
uuggccaugauugaugacgugacugcuuccauuuugcagaugaggaaacuaaggcucagaga

SEQ ID NO: 64674 - RNA, 62 nt, Homo Sapiens
agggccggguccacuuccauuguuagcaguuguuugcagaauuuucucuuuuaccauuccuc

SEQ ID NO: 64675 - RNA, 62 nt, Homo Sapiens
uugcccaaagauccuuugcugaguguucuguuuuugcagaauaaaagcaaaggaugcagacu

SEQ ID NO: 64676 - RNA, 62 nt, Homo Sapiens
ugcagugacuuucugacccauccaccuguuuuuuugcagauugucaugaauaaaacggugcu

SEQ ID NO: 64677 - RNA, 62 nt, Homo Sapiens
uuguauagaacuuuaagaggaucagaagguuuuuugcagaguuauaauuacauucaaaguau

SEQ ID NO: 64678 - RNA, 62 nt, Homo Sapiens
aaaacaccaaaguguucauacuaaaauauauuuuugcagauacauuaaauaugaaagauauu

SEQ ID NO: 64679 - RNA, 62 nt, Homo Sapiens
uuucuaaauacuugcucuugguaucuauaacuuuugcagagaccagaagcaaacaauuugug

SEQ ID NO: 64680 - RNA, 62 nt, Homo Sapiens
cuuuguaaaguuuguauuuauuccccuuuagguuugcagaggggguaggggcagagucaggg

SEQ ID NO: 64681 - RNA, 62 nt, Homo Sapiens
acuaaauaacuucugcacagcaaaagaagcuauuugcagacuacagaaugggagaaaauguu

SEQ ID NO: 64682 - RNA, 62 nt, Homo Sapiens
uucucccauuucugaguugucucuucauucuguuugcagaagcuguuuagaagccacaccuu

SEQ ID NO: 64683 - RNA, 62 nt, Homo Sapiens
uggcacccgagugcacacacguggaaaauaccuuugcagacguagacuucagugaccacacu

SEQ ID NO: 64684 - RNA, 62 nt, Homo Sapiens
gacuugggucuugcuggcccugcuggagcugcuuugcagaauuucacuccggcaggcagacc

SEQ ID NO: 64685 - RNA, 62 nt, Homo Sapiens
uuccuucaccccugacuucucgcaccuuuaacuuugcagaccccccuucugacucuggaaac

SEQ ID NO: 64686 - RNA, 62 nt, Homo Sapiens
cagccccuccccuacuuuuuucuauuuauuaauuugcagaccaggaaggucuuacccccucu

SEQ ID NO: 64687 - RNA, 62 nt, Homo Sapiens
caguauauauuuaaaacauucugagauauauuuuugcagaugacaacaccagaggguucaua

SEQ ID NO: 64688 - RNA, 62 nt, Homo Sapiens
caggaaaaauuuuuuaaaaacuaaaacauauuuuugcagauaaaaacaccagagaguucaua

SEQ ID NO: 64689 - RNA, 62 nt, Homo Sapiens
uaacugacagcugacaccauuuuggcaguuaauuugcagaagugauucuguucuucuccauu

SEQ ID NO: 64690 - RNA, 62 nt, Homo Sapiens
uucucaggaccucagaccuccaggauucaggguuugcagaaacucccuugaauguggcugug

SEQ ID NO: 64691 - RNA, 62 nt, Homo Sapiens
ggaaacugcccugacucaugcuaucacuauauuuugcagaauguuguauugcccaguaggag

SEQ ID NO: 64692 - RNA, 62 nt, Homo Sapiens
agaugguuucuauaaagaguauugccuguguguuugcagagaauagaaaugaacacagagau

SEQ ID NO: 64693 - RNA, 62 nt, Homo Sapiens; identical to SEQ ID NO: 64692

SEQ ID NO: 64694 - RNA, 62 nt, Homo Sapiens
ucguggacaaguguuuaucagauuuucccauuuuugcagaucauaaguuagucauauggccu

SEQ ID NO: 64695 - RNA, 62 nt, Homo Sapiens
ccacacacacuguugcuggagcagccccaggcuuugcagaaagggggugcagaacccugcag

SEQ ID NO: 64696 - RNA, 62 nt, Homo Sapiens
ggaggagggaaguugaaggaugagcuccccgguuugcagaaucugcccuccgccgcuccgcc

SEQ ID NO: 64697 - RNA, 62 nt, Homo Sapiens
gcaggcugggggcaagggauucugcucauguguuugcagaccggcugggauagccuccccac

SEQ ID NO: 64698 - RNA, 62 nt, Homo Sapiens
uuucuguucucauaaggauacugcugagugucuuugcagauucagccuaaaagcaaagaaaa

SEQ ID NO: 64699 - RNA, 62 nt, Homo Sapiens
ccaaagagucuagcaaaacaauauaguauuuuuuugcagaggcaugaaaaauuaagacgcuu

SEQ ID NO: 64700 - RNA, 62 nt, Homo Sapiens
gaacuguuccccugaggagaagcgguggccucuuugcagaucaaccaacuuaaucugguuga

SEQ ID NO: 64701 - RNA, 62 nt, Homo Sapiens
auaagcaaaaaguaccucuucuuaaagugcacuuugcagacguuucacuccuuuuccaauaa

SEQ ID NO: 64702 - RNA, 62 nt, Homo Sapiens
accaacuuccuuagauuuuuuuuuuuaagcuguuugcagaaaacugggugguagcgugucug

SEQ ID NO: 64703 - RNA, 62 nt, Homo Sapiens
acagugacccugcgaggcaaggguuugcccaguuugcagaugagaaacccaaagcugagaga

SEQ ID NO: 64704 - RNA, 62 nt, Homo Sapiens
gcaacaaccgacaucugaacaccuacauuuccuuugcagacaaauugaagaacuggugggau

SEQ ID NO: 64705 - RNA, 62 nt, Homo Sapiens
ccuccaggaacugucauggauguccaaauggcuuugcagaaaggaaaugagaugacaguauu

SEQ ID NO: 64706 - RNA, 62 nt, Homo Sapiens
guuacauguaugccugcccaguucccuuuuuauuugcagaagcugugaguuuuguucacaau

SEQ ID NO: 64707 - RNA, 62 nt, Homo Sapiens
ugagccccgugcuguauuuuguaauaaagucuuuugcagauugcuucccgagcuuccuuugu

SEQ ID NO: 64708 - RNA, 62 nt, Homo Sapiens
ucucauuagggaacuuuuacaguucaaauuaauuugcagaaguugccauaaauguuugcaua

SEQ ID NO: 64709 - RNA, 62 nt, Homo Sapiens
ugggcaguugaggaaaggaccuccacagaauguuugcagagcccaucucuucuccaccuucu

SEQ ID NO: 64710 - RNA, 62 nt, Homo Sapiens
guuaggaauggguagauagcuuggaagaagaguuugcagaaguccgggaaguuguggaauug

SEQ ID NO: 64711 - RNA, 62 nt, Homo Sapiens
gauauuuuguguacacagaaccaccagugccuuuugcagagaggccuuccugcugccccccu

SEQ ID NO: 64712 - RNA, 62 nt, Homo Sapiens
ugcuuuuguauuaaauuuaauuugacucaccauuugcagauguaccugggagauuucaccag

SEQ ID NO: 64713 - RNA, 62 nt, Homo Sapiens
aagggaucauugaggcuucuggcacauuacacuuugcagaguugagugauugacaucuuuuu

SEQ ID NO: 64714 - RNA, 62 nt, Homo Sapiens
acgccuuuuuguaacgagcaacuuuuuauauauuugcagauuacacaggaggacgccugggg

SEQ ID NO: 64715 - RNA, 62 nt, Homo Sapiens
cgcccuuguccccgcccuccagcugugagagcuuugcagaaaagaagccgaggagcagaagg

SEQ ID NO: 64716 - RNA, 62 nt, Homo Sapiens
gugagaacuucucugugccuauuggauuggauuuugcagaggugguuuucugagaagauagg

SEQ ID NO: 64717 - RNA, 62 nt, Homo Sapiens
uccuugaaagacccacccuaccccaccagggcuuugcagaugagccucuggcccaggccccu

SEQ ID NO: 64718 - RNA, 62 nt, Homo Sapiens
ccauuucagaugcaaucacuuuuggacaugcuuuugcagacaguccuuaaugcugaaaacac

SEQ ID NO: 64719 - RNA, 62 nt, Homo Sapiens
gagacccagagugcacgugaaggcagggcagguuugcagagaaguugcauauucccagacug

SEQ ID NO: 64720 - RNA, 62 nt, Homo Sapiens
aucuaguugagaugaggucaggaaauagagucuuugcagaugccuucaaugugaccuaauug

SEQ ID NO: 64721 - RNA, 62 nt, Homo Sapiens
cucgccaaggcagagcgcaaauggucaggaaguuugcagauagauggcugcaagcgcacuug

SEQ ID NO: 64722 - RNA, 62 nt, Homo Sapiens
ugccuccgcaccucagcaguuuucugaccugcuuugcagacguuugggguauggggggagug

SEQ ID NO: 64723 - RNA, 62 nt, Homo Sapiens
cugugaggugacucgugaaaguaggugauuccuuugcagaacuucagggacugggagcagag

SEQ ID NO: 64724 - RNA, 62 nt, Homo Sapiens
gacggacuuccucucccuucggacucacagccuuugcagagucaagcuccacuugaagcuca

SEQ ID NO: 64725 - RNA, 62 nt, Homo Sapiens
uaggaugugauuuggcucuuuaggaaacugaauuugcagaacuuaagaauauugauuuauaa

SEQ ID NO: 64726 - RNA, 62 nt, Homo Sapiens
cagugaucuggagaggcugcaggggccacgaguuugcagaugcuguacuucagcaauaaccu

SEQ ID NO: 64727 - RNA, 62 nt, Homo Sapiens
agccuucagagaugauccagcccaaaccccauuuugcagagaggaaaacugaggccuagaag

SEQ ID NO: 64728 - RNA, 62 nt, Homo Sapiens
uccccugggcuguacugagccgagcccagggguuugcagaggguggggguccaucucuccag

SEQ ID NO: 64729 - RNA, 62 nt, Homo Sapiens
auggaggucaaaaaccacucgguuuaggccacuuugcagaggaggagugggcaccccauaag

SEQ ID NO: 64730 - RNA, 62 nt, Homo Sapiens
uucaaauuggcuauuccucuguuuuucuuaaauuugcagaacagcccacccuccaccccgcu

SEQ ID NO: 64731 - RNA, 62 nt, Homo Sapiens
gggauguguuuugggggcaguuuguuauuccuuuugcagauuaaccaaaugauauuugaguu

SEQ ID NO: 64732 - RNA, 62 nt, Homo Sapiens
ugggcuuucuaaagcaagugagguccucagaguuugcagaucugagcucccccacccccucc

SEQ ID NO: 64733 - RNA, 62 nt, Homo Sapiens
aagauggcaucugugcuuuagggcugaauuguuuugcagagguggggagggagggaggggga

SEQ ID NO: 64734 - RNA, 62 nt, Homo Sapiens
guggaaggaucugcaguuuuagaaggaacugguuugcagacucucccagaggaaaacacugc

SEQ ID NO: 64735 - RNA, 62 nt, Homo Sapiens
guuuugcuacuuuuucauauaguccagauaguuuugcagauucacaucucaggcggcaguga

SEQ ID NO: 64736 - RNA, 62 nt, Homo Sapiens
caccugggccccuuucuguccacuccgucgccuuugcagaacgugggcgggcgggccugggg

SEQ ID NO: 64737 - RNA, 62 nt, Homo Sapiens
cucccuuagugauuucauguugccggguggguuuugcagaagguagacaccguuccucaugc

SEQ ID NO: 64738 - RNA, 62 nt, Homo Sapiens
augggacaccuguaauguaacccacacagcgguuugcagagaauguuagccaugacuugggc

SEQ ID NO: 64739 - RNA, 62 nt, Homo Sapiens
gaaguugugaaacugcuucaaguaaauagugguuugcagaacacuguaggagcaucugucac

SEQ ID NO: 64740 - RNA, 62 nt, Homo Sapiens
agcucucugauggguucgagaaaacuuauguuuuugcagauuacccagcuuuguucuuguua

SEQ ID NO: 64741 - RNA, 62 nt, Homo Sapiens
cagaaaauuuacaguguaacauugugucaacauuugcagauugacuguauaugaccuuaauc

SEQ ID NO: 64742 - RNA, 62 nt, Homo Sapiens
guuauacgcgugccauccaaauuaauccugcauuugcagaugcacauagcaaucuggcuucc

SEQ ID NO: 64743 - RNA, 62 nt, Homo Sapiens
uuguaaaaaaauaaaauuaaaauuaaaaaaaguuugcagaaccgcauauacaguaucagccc

SEQ ID NO: 64744 - RNA, 62 nt, Homo Sapiens
aaucuauugggauuuucuacaaguauucugccuuugcagaaacagauuuggugaauuugaau

SEQ ID NO: 64745 - RNA, 62 nt, Homo Sapiens
ucaaaccaagcaagcuuuaucaaaauggcuuauuugcagaauaguuccaaugauauaaaugc

SEQ ID NO: 64746 - RNA, 62 nt, Homo Sapiens
cuuaguauuuuauaucagcaaaauaacucaauuuugcagauugcaaacaaauauaaaagcug

SEQ ID NO: 64747 - RNA, 62 nt, Homo Sapiens
gucuccaaauaaaagaagcuuauuguaguauguuugcagaaaaauucuaaacaaaaauuaua

SEQ ID NO: 64748 - RNA, 62 nt, Homo Sapiens
aaaucagccagcuccaugcccaaaccuuccuguuugcagaacuuuuuaaugucuuuucuuuu

SEQ ID NO: 64749 - RNA, 62 nt, Homo Sapiens
cagccucucucaugucuaaaaaggcacagaauuuugcagaucugaggaagagggaugcauua

SEQ ID NO: 64750 - RNA, 62 nt, Homo Sapiens
uuugccuuuucuuaaucaaacauguuuaaaucuuugcagagaaaaaaaucccaacuauugag

SEQ ID NO: 64751 - RNA, 62 nt, Homo Sapiens
uaaaguuuuaaaauaaaacuuucuugauuggcuuugcagaaaacacuuuuuccuuccaacac

SEQ ID NO: 64752 - RNA, 62 nt, Homo Sapiens
agaaagauuauguuagaaguauguagaauauuuuugcagagcuguuuugaucauaugcaugu

SEQ ID NO: 64753 - RNA, 62 nt, Homo Sapiens
cuugcaaccuccuccugagccucccuccaacuuuugcagauucuguuuguucuccuggggcg

SEQ ID NO: 64754 - RNA, 62 nt, Homo Sapiens
gaacacugcacacagaaaugagaaaugugcaguuugcagauagauacagcucaucauucugu

SEQ ID NO: 64755 - RNA, 62 nt, Homo Sapiens
cuaugggaagagggugauaaaugggcagucauuuugcagagggcuugcccuaggcuuaaugg

SEQ ID NO: 64756 - RNA, 62 nt, Homo Sapiens
gagauggauauaguagccucccugccaugugguuugcagaaagccauuuaccuucuaauaac

SEQ ID NO: 64757 - RNA, 62 nt, Homo Sapiens
ccagaggcauaucgcggcuuaagcgggaccgcuuugcagagacugugguggucucccugucc

SEQ ID NO: 64758 - RNA, 62 nt, Homo Sapiens
ucaaagaaucugcagagggucaacgcgcuugguuugcagaugaaugggacggaauccaccca

SEQ ID NO: 64759 - RNA, 62 nt, Homo Sapiens
uuaguaacugcagcucaccugugugcuuuucauuugcagaagguuuuuauuugauuuuaguu

SEQ ID NO: 64760 - RNA, 62 nt, Homo Sapiens
acagucucugcuucuaaaaacugagguugguuuuugcagaaaauguaaacacaaauguaugc

SEQ ID NO: 64761 - RNA, 62 nt, Homo Sapiens
uaugcuucugguccaacuugcucuaagcaguauuugcagaaaauuggccucuuuggguggga

SEQ ID NO: 64762 - RNA, 62 nt, Homo Sapiens
guucauuucaggagcuucuccucagccuucuguuugcagaacuggacaugccuggaagaccc

SEQ ID NO: 64763 - RNA, 62 nt, Homo Sapiens
aaaacccugagucacagauuucuuauccccauuuugcagaugugacaucuuuagggcaggau

SEQ ID NO: 64764 - RNA, 62 nt, Homo Sapiens
agccagggagagauccagagaguuuucaaguuuuugcagauguaggugguuccagcuuuucu

SEQ ID NO: 64765 - RNA, 62 nt, Homo Sapiens
aaggcaguagucugcauuaggacuguuugaguuuugcagacuugggguugggagaacaucuu

SEQ ID NO: 64766 - RNA, 62 nt, Homo Sapiens
gaccacgcauugucacagcuaccaaagugugguuugcagaugaucugggcuuguuucuggca

SEQ ID NO: 64767 - RNA, 64 nt, Homo Sapiens
uuguucugaaguuacccucugaaaaauauuuugucucucugacuugauuucuauaaaugcuuuu

SEQ ID NO: 64768 - RNA, 64 nt, Homo Sapiens
auucuuuuuuaaauuauuuuuuaaaagucuuucucucucugauucagcuuaaauuuuuuuaucg

SEQ ID NO: 64769 - RNA, 64 nt, Homo Sapiens
acccuagcagaacugauaccuuggggcccucggucucucugaagcaucuuugaguagcacuguu

SEQ ID NO: 64770 - RNA, 64 nt, Homo Sapiens
cccagcuauggggaacaucucacaacacguuuuccucucugagucagugucugaucaugugaaa

SEQ ID NO: 64771 - RNA, 64 nt, Homo Sapiens
aagacuccgucucaaaaaaagggcaauaaaugcccucucugaauguuugaacugccaagaaaag

SEQ ID NO: 64772 - RNA, 64 nt, Homo Sapiens
ugggaggcuggucucccuccagcuggaauugcugcucucugagggagaggcugugguggcuguc

SEQ ID NO: 64773 - RNA, 64 nt, Homo Sapiens
uagccaccacuacagggcuguuucauguacuucucucucugacucugucuuguccgacucucuu

SEQ ID NO: 64774 - RNA, 64 nt, Homo Sapiens
uacuauuuuugguugugugauagaguuauuuaaccucucugagccucaguucccucguauguaa

SEQ ID NO: 64775 - RNA, 64 nt, Homo Sapiens
agucagaauagggacacugcgggucacaagcucacucucugacaggauacccaccaucuuucaa

SEQ ID NO: 64776 - RNA, 64 nt, Homo Sapiens
ggaaguugugaauguuugcaugacaucugccagccucucugaauuccgggguuuuucuuccauc

SEQ ID NO: 64777 - RNA, 64 nt, Homo Sapiens
cucuuuauuuuucaaucucugaauauuuuagucucucucugagucucauuuuuuaaaaugcucu

SEQ ID NO: 64778 - RNA, 64 nt, Homo Sapiens
accuacuauaauaugacugucugaaacuuauuuucucucugagaaauaaauguucuaaugggca

SEQ ID NO: 64779 - RNA, 64 nt, Homo Sapiens
ugauuuuuugaguuuuguuuccaaggccacgcugcucucugaauguguuggguguggguggucu

SEQ ID NO: 64780 - RNA, 64 nt, Homo Sapiens
uguaugacacccagcuuuaaauguauacuuuaugcucucugaaagaacuccugucucugugaga

SEQ ID NO: 64781 - RNA, 64 nt, Homo Sapiens
ccugggggucaggacagggccugauuugagccuccucucugaagaugauuuggccgagcggaag

SEQ ID NO: 64782 - RNA, 64 nt, Homo Sapiens
uuuggacaggaggugcugaggcuggcugcaccugcucucugaagacgccuuccucucuagguuc

SEQ ID NO: 64783 - RNA, 64 nt, Homo Sapiens
gguguccucggccccccugaccuucuuccucugacucucugagugaccguggccucccgaaucg

SEQ ID NO: 64784 - RNA, 64 nt, Homo Sapiens
cucugucucugcuucugaaccagcauggcuccgccucucugagcccucgcuguguuuccucagg

SEQ ID NO: 64785 - RNA, 64 nt, Homo Sapiens
ucuuguugccugaaauuguuauuguuuguuauuucucucugauguuuuuuguaagacauuguau

SEQ ID NO: 64786 - RNA, 64 nt, Homo Sapiens
aucagcuuaauaacaacacuuauugcaccugucucucucugagaacacggugugucucgacacg

SEQ ID NO: 64787 - RNA, 64 nt, Homo Sapiens
gcccugggcaggccgcuccugagcugcugucucccucucugaccuaugccuaccuucucuuucu

SEQ ID NO: 64788 - RNA, 64 nt, Homo Sapiens
ugccagggucccuaagaacagguuugcagcuacccucucugaccuuuuccccauaucuugugcu

SEQ ID NO: 64789 - RNA, 64 nt, Homo Sapiens
uaugcuaacccccaaauacugcaagugugcuggccucucugacaacacugcacagaagacagca

SEQ ID NO: 64790 - RNA, 64 nt, Homo Sapiens
gugauggggcugagcaggagacacacauacagagcucucugaggcagcgcgcacacgcacgcac

SEQ ID NO: 64791 - RNA, 64 nt, Homo Sapiens
uuuaccaaaguaggauuuugagggugggggugcucucucugagggggugggggugccgcugucu

SEQ ID NO: 64792 - RNA, 64 nt, Homo Sapiens
ggugccgcugucucugaggggugggggugccgcucucucugagggggugggggugccgcuuucu

SEQ ID NO: 64793 - RNA, 64 nt, Homo Sapiens
gugccgcuuucucugagggggugggggugccgcucucucugagggggugggggugcugcucucu

SEQ ID NO: 64794 - RNA, 64 nt, Homo Sapiens
ccuacauuccgucaguuuccgcuuugcugcuuugcucucugaaagccucuugucuuucuucccu

SEQ ID NO: 64795 - RNA, 64 nt, Homo Sapiens
gccccgaaccuugcaucaaguucguguugggcuucucucugaacuuggccuacacagagaaccg

SEQ ID NO: 64796 - RNA, 64 nt, Homo Sapiens
gagaaggugcacgaaggagacaccacuuggggaccucucugagcaggcucucgugaaucagcuc

SEQ ID NO: 64797 - RNA, 64 nt, Homo Sapiens
ucuguggagucaaggucccccucucccaggcaggcucucugagggcauucuguagucccaggcc

SEQ ID NO: 64798 - RNA, 64 nt, Homo Sapiens
guguccuggccagcccuggauccucuucacuagccucucugaagaaauucacccuacauuccuc

SEQ ID NO: 64799 - RNA, 64 nt, Homo Sapiens
augucaaaucgugguuuagauuaucuacuucucucucucugaagccaaccuggaauggagacuu

SEQ ID NO: 64800 - RNA, 64 nt, Homo Sapiens
uuccccacggcccuugccacugucuccuggcccucucucugaucaugccagguuugcaccagcc

SEQ ID NO: 64801 - RNA, 64 nt, Homo Sapiens
uuguaguacauucuccaagaugcagcccaggagccucucugaaggaccagucugguuacgaugg

SEQ ID NO: 64802 - RNA, 64 nt, Homo Sapiens
uggugccugcuggagggaggagugggccuggggccucucugacgcugggucuccucccgggcuc

SEQ ID NO: 64803 - RNA, 64 nt, Homo Sapiens
aguccaucaccugcaacuuauuccacugauuacucucucugacggguggguuacacugaucuug

SEQ ID NO: 64804 - RNA, 64 nt, Homo Sapiens
caccauggcuccccuuccuugucuggggccuggacacacugaggacaaugcggcuauagcagau

SEQ ID NO: 64805 - RNA, 64 nt, Homo Sapiens
ucuugccauugagccuugaagcugccuuuggugacacacugagugaaagggacugggccagcuc

SEQ ID NO: 64806 - RNA, 64 nt, Homo Sapiens
auggucagggcauuggucagguaaaccucucuggcacacugagcaaucauggcauuacugagga

SEQ ID NO: 64807 - RNA, 64 nt, Homo Sapiens
cugaacugggugaacucuguugcaaucauacaugcacacugacuucauacacaauucauacaca

SEQ ID NO: 64808 - RNA, 64 nt, Homo Sapiens
ucacucaacaaugccagaugaauggaagagggaacacacugagaugacuuagacucugguccac

SEQ ID NO: 64809 - RNA, 64 nt, Homo Sapiens
acugucuuccaaacaugagacaaagcugacuguucacacugauugcccagcacauaccgucuug

SEQ ID NO: 64810 - RNA, 64 nt, Homo Sapiens
aacggagaccugugaccacaccggaguccccguucacacugaggggcggguggcacgcugcagc

SEQ ID NO: 64811 - RNA, 64 nt, Homo Sapiens
gggggaccuagugaauggucauacuggguaugcucacacugacguuucgugucaauucucuagc

SEQ ID NO: 64812 - RNA, 64 nt, Homo Sapiens
ccacacacauccucaccccacagaaacugcuggacacacugaagaaacugaauaaaacagauga

SEQ ID NO: 64813 - RNA, 64 nt, Homo Sapiens
gaaucauagagaugucuguguucuuggaguauuucacacugaggacuaaucugcuaucuucauu

SEQ ID NO: 64814 - RNA, 64 nt, Homo Sapiens
ucucguccaucucuguugccucugcacaucagcacacacugacuccaccugggcuggcuccugc

SEQ ID NO: 64815 - RNA, 64 nt, Homo Sapiens
cagcaacagucucaucucccagauuaccucugugcacacugacacguggucccguccauccuga

SEQ ID NO: 64816 - RNA, 64 nt, Homo Sapiens
uuucaaauucauuuuguuuuucugcacccacaaucacacugauucagucccuguucauaccauc

SEQ ID NO: 64817 - RNA, 64 nt, Homo Sapiens
gucaacacaggucaaaaccauuguccacuaaaaacacacugauguuuuucuuuuuuuuuuuuuu

SEQ ID NO: 64818 - RNA, 64 nt, Homo Sapiens
ccuggagguaggaagggacuugcccccaaggccgcacacugaguuaacagcagaauugagacug

SEQ ID NO: 64819 - RNA, 64 nt, Homo Sapiens
ugguccguauaacacauuuuaccaacagcuccuucacacugaauccuuuaacuuggccaaagga

SEQ ID NO: 64820 - RNA, 51 nt, Homo Sapiens
uacugaccacugagcucugagggccuguagcuggaauacgcaucucuccag

SEQ ID NO: 64821 - RNA, 64 nt, Homo Sapiens
uaaaagagaucucuaaaacuuccccaucccuuugggccuguacaaagaaauucuggauguuaaa

SEQ ID NO: 64822 - RNA, 64 nt, Homo Sapiens
cacucagcaaacacauuggguaucuugugcccaaggccuguauuuguggagcugauguucuagu

SEQ ID NO: 64823 - RNA, 64 nt, Homo Sapiens
aaguggagauguuggggccaggcacaguggcccaggccuguaaucccaucacuuugggaggugc

SEQ ID NO: 64824 - RNA, 64 nt, Homo Sapiens
acccagaggaccgaggacaggcgggcagcuggggggcugagagccagaaauugaggacagcgau

SEQ ID NO: 64825 - RNA, 64 nt, Homo Sapiens
gggccaggccaagggccggguccucuggcuauuuggcugagaagccuccugggacagggcuggg

SEQ ID NO: 64826 - RNA, 64 nt, Homo Sapiens
agugcugggagugguggacaagcggaguggauaaggcugagaugaccccucagucccuacguca

SEQ ID NO: 64827 - RNA, 64 nt, Homo Sapiens
guuucuggaaggggcuggccucucccugcaugcaggcugagauuccgaggagacuaacuugcuu

SEQ ID NO: 64828 - RNA, 64 nt, Homo Sapiens
auggggaaaagaaucaagagccacugagaaguugggcugagagugcaggccugccagccccucu

SEQ ID NO: 64829 - RNA, 64 nt, Homo Sapiens
ccaccaaccuuccccaccccugagaauggcugauggcugagagcugaguuuuucacguguaaga

SEQ ID NO: 64830 - RNA, 64 nt, Homo Sapiens
caggagauccaagcuccaguggaagcuucuaggaggcugagaaguuccuuuuguauuccauugu

SEQ ID NO: 64831 - RNA, 64 nt, Homo Sapiens
ggagaauggcgugaaucgggccagcuacuuggaaggcugagacagguggcgggcgccuguaguc

SEQ ID NO: 64832 - RNA, 64 nt, Homo Sapiens
gguagacagcuacccaugaugugcagaggauggaggcugagaaagggcagggugucaugcaugg

SEQ ID NO: 64833 - RNA, 64 nt, Homo Sapiens
gcucucgaggaguggugcuccguccacccucaggggcugagacaaccccuguagcagagccucc

SEQ ID NO: 64834 - RNA, 64 nt, Homo Sapiens
cccaggccccuguggcuuuccaaaugcccugugaggcugagagacccgcggacuuccuagugcc

SEQ ID NO: 64835 - RNA, 64 nt, Homo Sapiens
cauguggaccgugagucgcaaacacucuggagaaggcugagaugccaccauucccacggggacu

SEQ ID NO: 64836 - RNA, 64 nt, Homo Sapiens
ucaucccgaaguggaagggggucuaaacagaacaggcugagagaggcgggacugggucaagugg

SEQ ID NO: 64837 - RNA, 64 nt, Homo Sapiens
ucaugucacaaacacaaucuauucuacaugaggaggcugagaaaggggaagagaaaaacaaacc

SEQ ID NO: 64838 - RNA, 64 nt, Homo Sapiens
cugaggauuucuagccagaggucccagaugccugggcugagaacccagcgauaagggggcguuc

SEQ ID NO: 64839 - RNA, 64 nt, Homo Sapiens
uauccacaugcagaaacaucuggcaaccccacauggcugagaugaccugguccuaggacacccu

SEQ ID NO: 64840 - RNA, 64 nt, Homo Sapiens
auagaccagccccuggaaaggcugcuuuggucaaggcugagagcagcuuugcucaaggaaauua

SEQ ID NO: 64841 - RNA, 64 nt, Homo Sapiens
gagcagcccgcugaguggacuggaguggagcauuggcugagagaccaggagggcacuggagcug

SEQ ID NO: 64842 - RNA, 64 nt, Homo Sapiens
acaggucccucacccacccacaauccuauucucgggcugagaacccugcguggggacagggcuc

SEQ ID NO: 64843 - RNA, 64 nt, Homo Sapiens
ccuuggcacuacuacaaugcccuccauucuucagggcugagaauugacgagaagccagcucacc

SEQ ID NO: 64844 - RNA, 64 nt, Homo Sapiens
gaagagacaauucagggcaguugaugaauaucagggcugagauguggugagacuuccguuuuua

SEQ ID NO: 64845 - RNA, 64 nt, Homo Sapiens
ugcuggaccucgacguccugcggggccaccccccggcugagacuuugcccugaacuuguccggg

SEQ ID NO: 64846 - RNA, 64 nt, Homo Sapiens
cuagcucacggguagugggauucugcauuaguggggcugagagaugugggggccccuccagccc

SEQ ID NO: 64847 - RNA, 64 nt, Homo Sapiens
gggucuggguuaucuccuucucucugcuggcuggggcugagagaauuguuagaaaccaaagucu

SEQ ID NO: 64848 - RNA, 64 nt, Homo Sapiens
gaccuggcauagaugguuuggaguuuggcacggaggcugagaauccuagccaagaucauaugaa

SEQ ID NO: 64849 - RNA, 64 nt, Homo Sapiens
ucauccccugaauaacuuuuuguacaggcugagaggcugagaaacccgggcccucagccucucu

SEQ ID NO: 64850 - RNA, 64 nt, Homo Sapiens
cugagaaaucauccccugaagccucucuuguacaggcugagagggugagggccccgggcccuca

SEQ ID NO: 64851 - RNA, 64 nt, Homo Sapiens
caaggaucacuugagcccagccagcuacaggggaggcugagacguguggcacacaacugugguc

SEQ ID NO: 64852 - RNA, 64 nt, Homo Sapiens
ggaggaucacuugaggccaacuagcacuuugggaggcugagaugggaggcucgugcauguaauc

SEQ ID NO: 64853 - RNA, 64 nt, Homo Sapiens
agagaauuguuugaaccuggccagcucuucaggaggcugagaaaaguggugugcaccuguaguc

SEQ ID NO: 64854 - RNA, 64 nt, Homo Sapiens
uugagccugcagugagcuaucaaggauugcuugaggcugagagacuacuuaggaggcugagggg

SEQ ID NO: 64855 - RNA, 64 nt, Homo Sapiens
uguuggagggguggagggauguuccccugagccaggcugagacuagaaccccaucuucccugag

SEQ ID NO: 64856 - RNA, 64 nt, Homo Sapiens
aggcugagacuagaaccccaucuucccugagccaggcugagacuagaaccccaucuuccccacc

SEQ ID NO: 64857 - RNA, 62 nt, Homo Sapiens
gaggcccuguucuuagagccccugacaaaggcagcacuuauuuccugggcuggugcgcccca

SEQ ID NO: 64858 - RNA, 62 nt, Homo Sapiens
agcaugacaaaauggucaaaaaauaagucaucagcacuuaagaaaugaaagcaacuuuugaa

SEQ ID NO: 64859 - RNA, 62 nt, Homo Sapiens
agauuuaaaaucuuaaaauguuucuuauuuucagcacuuacaucauuugguacacaggguca

SEQ ID NO: 64860 - RNA, 62 nt, Homo Sapiens
agccaguuucaucaaacaguucaacagagagcagcacuuaauacccuuuauacagcccauuu

SEQ ID NO: 64861 - RNA, 62 nt, Homo Sapiens
agucaaaaaacuugauuucagguccuagcucuagcacuuacagcugugugaucuugggcaag

SEQ ID NO: 64862 - RNA, 62 nt, Homo Sapiens
auuuugauuuuacccagcuuaaucuguaaaguagcacuuaaauauaucugauagcaacacuu

SEQ ID NO: 64863 - RNA, 62 nt, Homo Sapiens
ugaggaugaggaauaauaaacucuuuuuggcaagcacuuaaauguucugaaauuuguauaag

SEQ ID NO: 64864 - RNA, 62 nt, Homo Sapiens
gguaaguuuuauaagggaguacauuuugacugagcacuuagggcaucaggaacagugcuacu

SEQ ID NO: 64865 - RNA, 62 nt, Homo Sapiens
uggcauaccaaucugugcggggcaguguccuaagcacuuagacuacaucagggaagaacaca

SEQ ID NO: 64866 - RNA, 62 nt, Homo Sapiens
aaauaucuuaaaauaucuaaaacauuuuuuaaagcacuuagauugucuuacguaugugcaua

SEQ ID NO: 64867 - RNA, 62 nt, Homo Sapiens
aaacugucugucuaauggucacagagcacuguagcacuuaacagauugccauggacaccagu

SEQ ID NO: 64868 - RNA, 62 nt, Homo Sapiens
aggcaccgccacgucccagccgcacacagcugagcacuuagcggcccucuuucccugcgaga

SEQ ID NO: 64869 - RNA, 62 nt, Homo Sapiens
uguuuacaaagcccuuucacccuuguguggucagcacuuaacauaaucaguauaauaauuug

SEQ ID NO: 64870 - RNA, 62 nt, Homo Sapiens
auucagcuugucucauccccagagugacugagagcacuuaaccaccuguggccccuaaaccc

SEQ ID NO: 64871 - RNA, 62 nt, Homo Sapiens
caguuagucauggagaguaauauuccauuuuaagcacuuacagguuauguagaaaagcaauu

SEQ ID NO: 64872 - RNA, 62 nt, Homo Sapiens
cccccugagcagcgagccugcuacuggagcccagcacuuacucucagugggccugugggagc

SEQ ID NO: 64873 - RNA, 62 nt, Homo Sapiens
aggcucuugggaugcagcaauacuaggaaaggagcacuuagguuucuucuaccacccaauuc

SEQ ID NO: 64874 - RNA, 62 nt, Homo Sapiens
acaguauaugaaauaaugggaaaugaauguaaagcacuuaguuugugaggauuaaaaugagg

SEQ ID NO: 64875 - RNA, 62 nt, Homo Sapiens
uccaugacagggucuaaaauuuaguuuaccugagcacuuauucugggggugaaagaaaaaua

SEQ ID NO: 64876 - RNA, 62 nt, Homo Sapiens
ugaagucaguggccuggaucauguuaaaauagagcacuuaccaaauagaaucuuauaucugu

SEQ ID NO: 64877 - RNA, 62 nt, Homo Sapiens
auuguaugucuccucaaaugugacaaaaaaugagcacuuacaacauaauggugucuuaaaau

SEQ ID NO: 64878 - RNA, 62 nt, Homo Sapiens
acaaagccuagcacaaaguauucuguguccccagcacuuacagggcaggauugucuuuuuuu

SEQ ID NO: 64879 - RNA, 62 nt, Homo Sapiens
uuacugguguccagcugaguuuuucaaugaauagcacuuaugucagcgcucuugcuuugcuc

SEQ ID NO: 64880 - RNA, 62 nt, Homo Sapiens
guaauguauuauaccuaaauuuguaucuaaauagcacuuacuauauauaguauguuuuaagu

SEQ ID NO: 64881 - RNA, 62 nt, Homo Sapiens
ggagcagagaugcagccaguccaaauucauugagcacuuaaauuuuucuuuccucccuuacc

SEQ ID NO: 64882 - RNA, 62 nt, Homo Sapiens
aaucagccuaacauaagaucacugcccaaagcagcacuuauacauuguaaacaaacugugua

SEQ ID NO: 64883 - RNA, 62 nt, Homo Sapiens
cuguaaauugaauaauuuaucagauagcaguuagcacuuaauguuuuaaauuaauuuuuuag

SEQ ID NO: 64884 - RNA, 62 nt, Homo Sapiens
aaauaaagguacuuuacagcaacugucgcugaagcacuuaagaaucaauuaguaauggcgga

SEQ ID NO: 64885 - RNA, 62 nt, Homo Sapiens
ucuucccauuucaaaagguaguuuggcuggggagcacuuaauaagguggcuuuugcuuuaua

SEQ ID NO: 64886 - RNA, 62 nt, Homo Sapiens
uguggagauacuguaaccugcacuauauucuaagcacuuacaucuauucuuauuauucacug

SEQ ID NO: 64887 - RNA, 62 nt, Homo Sapiens
ugaguaaauaaugcagcucaucacccauccuaagcacuuacguuuccugucuuucccgucca

SEQ ID NO: 64888 - RNA, 62 nt, Homo Sapiens
cccacguucucaagggcagagccggugugaugagcacuuacacucccucgagaaacagugcc

SEQ ID NO: 64889 - RNA, 62 nt, Homo Sapiens
aucuuggcugucaagaguaucaaaugccaugcagcacuuaaacuugugauaaggaagaugaa

SEQ ID NO: 64890 - RNA, 62 nt, Homo Sapiens
cauuuaauuagcugcauaucaccuuaggguacagcacuuaacgcaaucugccucaauuucuu

SEQ ID NO: 64891 - RNA, 62 nt, Homo Sapiens
ggcugagugcaguggcucaugccuguaaucccagcacuuagggugccaauguggauuaccug

SEQ ID NO: 64892 - RNA, 62 nt, Homo Sapiens
uuuuagaccucuuacuuccacugcuaguagcuagcacuuacugagcaccugcgaugagguaa

SEQ ID NO: 64893 - RNA, 62 nt, Homo Sapiens
ggauuucagauaugaacgguguaaauuugagaagcacuuaugcauacaugugggugaaaaac

SEQ ID NO: 64894 - RNA, 62 nt, Homo Sapiens
guucuuguuuuuauuuuugaaaguacucacacagcacuuacuaugcuccaaacacuccucua

SEQ ID NO: 64895 - RNA, 62 nt, Homo Sapiens
uuugccucaacaacguaaacuuccuaaugauuagcacuuaauaauugcauauaaaaugcuuu

SEQ ID NO: 64896 - RNA, 62 nt, Homo Sapiens
ugggacaauuguuuuaaucugaaauucuaaagagcacuuacuguaaccuguugcuguguuua

SEQ ID NO: 64897 - RNA, 62 nt, Homo Sapiens
gguaggaccaagcaucuuggucacacaccuguagcacuuacucugcggguggggcuuggggc

SEQ ID NO: 64898 - RNA, 62 nt, Homo Sapiens
cgaccccaaggugccagagaagggcaguagagagcacuuaccagauaaaggcagcuaaaacg

SEQ ID NO: 64899 - RNA, 62 nt, Homo Sapiens
uguuagaucuaacguguucccugcccuuucaaagcacuuaagaauuccuuggggauuuuuua

SEQ ID NO: 64900 - RNA, 62 nt, Homo Sapiens
gacuucauuuguucaagaauugaaauuuaaugagcacuuaguacagaggcauauauuuaaaa

SEQ ID NO: 64901 - RNA, 62 nt, Homo Sapiens
ucuuccuuaaaugacuuuuccacuccacuugaagcacuuaagacauuuuuuagucuguaaua

SEQ ID NO: 64902 - RNA, 62 nt, Homo Sapiens
aggggagcacaucuuguaauaugggccaucccagcacuuauauccuaaacaagagaauaaaa

SEQ ID NO: 64903 - RNA, 62 nt, Homo Sapiens
guaagaaguaaaaguagugcaucagcgauaucagcacuuacacuuucuugugaaaguuuuca

SEQ ID NO: 64904 - RNA, 62 nt, Homo Sapiens
cacugugugugauuuuguuucuuuuguuaagcagcacuuauguagacugcauuuccaaaugu

SEQ ID NO: 64905 - RNA, 62 nt, Homo Sapiens
uaguacagaagauucuuuguuuuucuccacugagcacuuaacaauugcuuucucucuggccu

SEQ ID NO: 64906 - RNA, 62 nt, Homo Sapiens
gauauacaaaguguaccaacauaaguguugguagcacuuaagacuuauacuugccuucugau

SEQ ID NO: 64907 - RNA, 62 nt, Homo Sapiens
aagcuaaaacaacccauuugcuacccauccaaagcacuuacaguuuagcaaauauuaaagag

SEQ ID NO: 64908 - RNA, 62 nt, Homo Sapiens
auaaaagagaaaaaaauucggaaagugaucagagcacuuauucaaaauacagugauagaagu

SEQ ID NO: 64909 - RNA, 62 nt, Homo Sapiens
caagauauauaucuggaaccucuuauaaauggagcacuuagaaauuuguuguucugcacuua

SEQ ID NO: 64910 - RNA, 62 nt, Homo Sapiens
cauuagcucagugacuuguccacacucgucuuagcacuuacguuucaaaagcuugucacaaa

SEQ ID NO: 64911 - RNA, 62 nt, Homo Sapiens
acugaugucucagugaaucagucuguuuauuaagcacuuaucagggcuuccacacacuuauu

SEQ ID NO: 64912 - RNA, 62 nt, Homo Sapiens
guggagggcugcaaucugucuugauuucuccaagcacuuaacuuucuuugacugcacugaga

SEQ ID NO: 64913 - RNA, 62 nt, Homo Sapiens
ucaggucuuugcucauucacucaguaauacugagcacuuaccauguaccagaauuuuacuag

SEQ ID NO: 64914 - RNA, 62 nt, Homo Sapiens
uuuaaauaauguaaacgcaaacaggguuugauagcacuuaaacuaguucauuucaaaauuaa

SEQ ID NO: 64915 - RNA, 62 nt, Homo Sapiens
aaugaguaaaauaauuaaugaaacauauuuagagcacuuaauggucucuguuuucaauauaa

SEQ ID NO: 64916 - RNA, 62 nt, Homo Sapiens
aaugauuagugucaguauuuuucuucugaaauagcacuuaaaacuuagaaacauugcgcaua

SEQ ID NO: 64917 - RNA, 62 nt, Homo Sapiens
agccuucugacuuaggguuugucccagcccugagcacuuaggucaaaaggcccagagucuga

SEQ ID NO: 64918 - RNA, 62 nt, Homo Sapiens
aguuacauguuguaaucaagauucuauuuuaaagcacuuauguuuuaagucagggaugcuuu

SEQ ID NO: 64919 - RNA, 62 nt, Homo Sapiens
uuaauccaguagagacuugcgcuugugaauauagcacuuauucuuuguuauaauucauauag

SEQ ID NO: 64920 - RNA, 62 nt, Homo Sapiens
ggaaauguaaaguagaaaaaauucaaacaaacagcacuuacauaaccucacacauuaacuuu

SEQ ID NO: 64921 - RNA, 62 nt, Homo Sapiens
auuuucccucuucacuugguuuuaaguuucacagcacuuacaaaugggaaaaaacaccagga

SEQ ID NO: 64922 - RNA, 62 nt, Homo Sapiens
uccuuuuccacuuuaaauuuuauuccugguguagcacuuaacaugguuucauguaacauaca

SEQ ID NO: 64923 - RNA, 62 nt, Homo Sapiens
agagugcauagcauacacuguaauagaugcauagcacuuaaccugaugaggaaaagauuaac

SEQ ID NO: 64924 - RNA, 62 nt, Homo Sapiens
agaauauuuuaaguauugcauuauugagaaagagcacuuaagagacacggaucugagaaucu

SEQ ID NO: 64925 - RNA, 62 nt, Homo Sapiens
uauugauguuuucauagagaauauaaaaauaaagcacuuauagaaaaaacucguuugauuuu

SEQ ID NO: 64926 - RNA, 62 nt, Homo Sapiens
gcauuugucauacguuucuacuuaaauuauuaagcacuuacgauuuagauguaauaauuaua

SEQ ID NO: 64927 - RNA, 62 nt, Homo Sapiens
uacuuuugugggaguauuucuauuauauaaccagcacuuacuaccuguacucaaaauucagc

SEQ ID NO: 64928 - RNA, 62 nt, Homo Sapiens
augaaauaaaaaaaaacuuuauaagaugggacagcacuuauaaugaggaagaagacaauugg

SEQ ID NO: 64929 - RNA, 62 nt, Homo Sapiens
agacuggugacaacuggcugaguuaacccuguagcacuuacuauuucagucaguccagaggc

SEQ ID NO: 64930 - RNA, 62 nt, Homo Sapiens
uuucccaauuuauuaaauugucuuuguuguuuagcacuuaaaaugaaucaccugaguacaau

SEQ ID NO: 64931 - RNA, 62 nt, Homo Sapiens
gauaggccuucuugugaucuaccuuaucuuaaagcacuuacaacauugcagucugcuucugc

SEQ ID NO: 64932 - RNA, 62 nt, Homo Sapiens
aggguuauggaaucuaguaauaaaauuucaacagcacuuaaacugaaguuuggguugcucau

SEQ ID NO: 64933 - RNA, 62 nt, Homo Sapiens
cacacaugccuauauuaucauaagaauuuuucagcacuuaacuacuuuguuggcauugaucc

SEQ ID NO: 64934 - RNA, 62 nt, Homo Sapiens
caagggaaaauacucaaagaaagaaaaguggcagcacuuauauuaguuuuauaacaggauaa

SEQ ID NO: 64935 - RNA, 62 nt, Homo Sapiens
gcuuacauuacauguccaguccacauuuaaagagcacuuacuguggaacaagccuucagcca

SEQ ID NO: 64936 - RNA, 62 nt, Homo Sapiens
uuugaauucuuuagauuuuuaaauuggagaaaagcacuuaaaguuuuuuauauaugaauauu

SEQ ID NO: 64937 - RNA, 62 nt, Homo Sapiens
auugugcacuaugggaggccgcugcugcguggagcacuuaaaguccagccuccaggaccgga

SEQ ID NO: 64938 - RNA, 62 nt, Homo Sapiens
uccagagagcuuuauggaagcgggagaggaggagcacuuacucauguuguauuuguuaaugg

SEQ ID NO: 64939 - RNA, 62 nt, Homo Sapiens
augaguucauuuuuaggugauguuuauuaguuagcacuuagacacuggggauguuauuuacu

SEQ ID NO: 64940 - RNA, 62 nt, Homo Sapiens
uaaccagaugauaaugaacugcaaauacagugagcacuuaugauauuuuaggauuauuuuug

SEQ ID NO: 64941 - RNA, 62 nt, Homo Sapiens
cucugugacaguauugugugaaguggcauggcagcacuuauggcugugaguagaauauguaa

SEQ ID NO: 64942 - RNA, 62 nt, Homo Sapiens
caguuuggucaccuguaaaaggaaauaacaagagcacuuacuuuauaagauugaugugagua

SEQ ID NO: 64943 - RNA, 62 nt, Homo Sapiens
cucuaaaagcacugaccucaaaaaaccuuauaagcacuuagauuuaauugcauuuuccauag

SEQ ID NO: 64944 - RNA, 62 nt, Homo Sapiens
cugauaaugaaaauuaugauaaggaugauaaaagcacuuacuucguguccgacucuucugag

SEQ ID NO: 64945 - RNA, 62 nt, Homo Sapiens
agucuccaaauaauaauagccgacguuuauugagcacuuacuaugugcccaacccuguuaug

SEQ ID NO: 64946 - RNA, 62 nt, Homo Sapiens
aguuuccugaccuaugaaacagagaaaauaaaagcacuuauuuauuguuguuggaggcugca

SEQ ID NO: 64947 - RNA, 62 nt, Homo Sapiens
auaaccucaccccaaauacaauaaagggacgaagcacuuauagauaccacagacacaugugu

SEQ ID NO: 64948 - RNA, 62 nt, Homo Sapiens
accugaccuugugcgcugggaggcgcaucugcagcacuuacaggugagggauggggagaugg

SEQ ID NO: 64949 - RNA, 62 nt, Homo Sapiens
aaggagacacaugccaccccagcaguacacaaagcacuuaccuugacuggugaagucagcca

SEQ ID NO: 64950 - RNA, 62 nt, Homo Sapiens
agcuuucauuuacauagugcuuacauuuauauagcacuuacuaugugcgauguacuaauuua

SEQ ID NO: 64951 - RNA, 62 nt, Homo Sapiens
uuuuacaauagauaaaugcuugugcuaccuaaagcacuuagcacacaguuaaauuauauuua

SEQ ID NO: 64952 - RNA, 62 nt, Homo Sapiens
uaaaucacuauacugauauuuugauacaagcaagcacuuacaugguaaucacuauauagauc

SEQ ID NO: 64953 - RNA, 62 nt, Homo Sapiens
ugucaucucauauugaucagguauuuuaaucuagcacuuacauauuguugauaaaugaaagc

SEQ ID NO: 64954 - RNA, 62 nt, Homo Sapiens
agagacuguuaauggccccuuacccugggugaagcacuuacccuuggaacagaacucuaaaa

SEQ ID NO: 64955 - RNA, 62 nt, Homo Sapiens
auauuauuuucuucuccuuuauauguaaugaaagcacuuauaaagaaacaggaaucauuaga

SEQ ID NO: 64956 - RNA, 62 nt, Homo Sapiens
guuagucucauuuagaaaaaucgaaagugcacagcacuuaaagggaauauaugagguuuuuu

SEQ ID NO: 64957 - RNA, 62 nt, Homo Sapiens
aaccugauccucaugcugauagaaugacagcuagcacuuauuuccuaagugcaacuguuuua

SEQ ID NO: 64958 - RNA, 62 nt, Homo Sapiens
ccccuccaaagauggaguguagaaaugaugacagcacuuaguaaguucaaagaugacauuca

SEQ ID NO: 64959 - RNA, 62 nt, Homo Sapiens
agcugggcacgguggcucacgccuguaaucccagcacuuacuuugggaggccaaggugggca

SEQ ID NO: 64960 - RNA, 62 nt, Homo Sapiens
ugcgguucucuuugacccccaaagacaagacaagcacuuauuuuuauuuucagaagacaaaa

SEQ ID NO: 64961 - RNA, 62 nt, Homo Sapiens
auuuucagcuuuuuaaagcauuguggccuuccagcacuuacugggaagacacauguuaaguu

SEQ ID NO: 64962 - RNA, 62 nt, Homo Sapiens
ugagguggggguguucaccuguguggggguuaagcacuuauuauugguaaaggaaagagcag

SEQ ID NO: 64963 - RNA, 62 nt, Homo Sapiens
aagaccgggcauugggcuggaaguauucacugagcacuuagguuagggccggucaggcccua

SEQ ID NO: 64964 - RNA, 62 nt, Homo Sapiens
uacuccugauucuuaacauuuuuguaaccacuagcacuuaagaaaaacugaagagaacaaaa

SEQ ID NO: 64965 - RNA, 62 nt, Homo Sapiens
uuauauaaagggcuguuugucaacauuuauccagcacuuaccgcuuauuuuauuauaguagc

SEQ ID NO: 64966 - RNA, 62 nt, Homo Sapiens
cuccuggggagacgugacucugguggacgcagagcacuuaguuacccuggacgcuccccaca

SEQ ID NO: 64967 - RNA, 62 nt, Homo Sapiens
uuucuuaauuauuauaaaaauauuaagacaauagcacuuaaauuccucaacaguguuuucag

SEQ ID NO: 64968 - RNA, 62 nt, Homo Sapiens
aacaaaaauuuuucuuucuuuacugcaugcauagcacuuaauaaaauggauuuuuaaaaaau

SEQ ID NO: 64969 - RNA, 62 nt, Homo Sapiens
aaaaagugucucugccuugagucaucuauucaagcacuuacagcucuggccacaacagggca

SEQ ID NO: 64970 - RNA, 62 nt, Homo Sapiens
ccucagugccuguccauaacugugaaguauuaagcacuuagggccagaugcacuguaaacau

SEQ ID NO: 64971 - RNA, 62 nt, Homo Sapiens
ucuacucaucuuuagagaugaaucaucuauuaagcacuuaccaaaacauaucauuaaacuga

SEQ ID NO: 64972 - RNA, 62 nt, Homo Sapiens
uauuauaauuaguuuugugaauagaaaaauaaagcacuuauguuuaaauuuguuacagugac

SEQ ID NO: 64973 - RNA, 62 nt, Homo Sapiens
aagugagguguggaacuccaggcaacgacccaagcacuuauuuuuuaagagggaaaggacuu

SEQ ID NO: 64974 - RNA, 62 nt, Homo Sapiens
auuaucgaucuaugagacaucuugauauguaaagcacuuaauauuaaaggcauaaaagugaa

SEQ ID NO: 64975 - RNA, 62 nt, Homo Sapiens
ucaucucccuguccucugagauaauaugagugagcacuuagguaucauaucagaugcucaag

SEQ ID NO: 64976 - RNA, 62 nt, Homo Sapiens
uuucuagcauauggacaccuggccucugcuugagcacuuaggugacaggaacuuccgcaccu

SEQ ID NO: 64977 - RNA, 62 nt, Homo Sapiens
gcuucauagaaagcaaugccuauagauggagcagcacuuaguaacugaaaauaggagcuauu

SEQ ID NO: 64978 - RNA, 62 nt, Homo Sapiens
augugccaggcccuuugcagaauucuacaccaagcacuuaccaaugguaguggaauuauuug

SEQ ID NO: 64979 - RNA, 62 nt, Homo Sapiens
cagaagcagaggcuaauucaaacgguuaagaaagcacuuaaaaucgacuuagccugagucau

SEQ ID NO: 64980 - RNA, 62 nt, Homo Sapiens
uuuuuuggaaguuauuuauucuuccaaacaaaagcacuuacuuuauauucuuauguuaucac

SEQ ID NO: 64981 - RNA, 62 nt, Homo Sapiens
uuuuccuguugagaugggggaaccuccccaacagcacuuaggaguuagagcggucgucggcc

SEQ ID NO: 64982 - RNA, 62 nt, Homo Sapiens
guuggccucugauugcugucgagagggucagaagcacuuagcgcuaguaaccggcugugagg

SEQ ID NO: 64983 - RNA, 62 nt, Homo Sapiens
cuuuagcauaaaaaauguugauuuaccucuuuagcacuuauagguauuuccuaucgacguuu

SEQ ID NO: 64984 - RNA, 62 nt, Homo Sapiens
uuucgaaccuaaaguuuagaacaguguaaggcagcacuuaaauagugaucaaacugccauuc

SEQ ID NO: 64985 - RNA, 62 nt, Homo Sapiens
cagaguagacacaauuaaagaugcuuuauuuaagcacuuagguguguauuuugcuuaaugga

SEQ ID NO: 64986 - RNA, 62 nt, Homo Sapiens
uuuucaacuccaaaucaauucuaaaaacuucaagcacuuaauggaaagguaaauggucagau

SEQ ID NO: 64987 - RNA, 62 nt, Homo Sapiens
accagaugcugaaggcaaggggagggagcagaagcacuuauguuuacggauauuuuaaacuc

SEQ ID NO: 64988 - RNA, 62 nt, Homo Sapiens
ccccucuugaaagagauuuacucaucuauccaagcacuuaauuuggaaauuuuauuguccua

SEQ ID NO: 64989 - RNA, 62 nt, Homo Sapiens
cugaccuugacacuucccccuuuagcuauaaaagcacuuaccagccgaacguggaacaguau

SEQ ID NO: 64990 - RNA, 62 nt, Homo Sapiens
gaacgagagcaucuuguucaguuguugcacaaagcacuuaaaauuucggcaucgacacggac

SEQ ID NO: 64991 - RNA, 62 nt, Homo Sapiens
gcaacaauuguaagucgacucacagugagcugagcacuuacacccccucaauagccagcacc

SEQ ID NO: 64992 - RNA, 62 nt, Homo Sapiens
accauuugagcuugugggucuacaaguugcuaagcacuuagguucuccauuuuauuagaaaa

SEQ ID NO: 64993 - RNA, 62 nt, Homo Sapiens
aggcugugguagaaucauacuuuaagguuuggagcacuuacagguguaguaauuguggguac

SEQ ID NO: 64994 - RNA, 62 nt, Homo Sapiens
cauuccaaguacuuuuuuuugaaaaaaaggguagcacuuauuauauuuuuaugccuacuuag

SEQ ID NO: 64995 - RNA, 56 nt, Homo Sapiens; identical to SEQ ID NO: 61369

SEQ ID NO: 64996 - RNA, 62 nt, Homo Sapiens
aucucaauaacuguggaagucaauaugaugagagcacuuaagacaggaauuauaaauaacuu

SEQ ID NO: 64997 - RNA, 62 nt, Homo Sapiens
ucucucuaugcuguucuacauccuuggcaucuagcacuuacauuacugguuugccaaagcca

SEQ ID NO: 64998 - RNA, 62 nt, Homo Sapiens
gcuccaacuuuuuugaaugauccucagucgccagcacuuacaagcgaggaauuaacccugug

SEQ ID NO: 64999 - RNA, 62 nt, Homo Sapiens
gugcuguuccuguggaaaaaacuccagaaagaagcacuuagccgauucagugucacaaaaua

SEQ ID NO: 65000 - RNA, 62 nt, Homo Sapiens
auguuuuuaauuuucucaacaagcauuuagccagcacuuauccagugaaacaauuugauaag

SEQ ID NO: 65001 - RNA, 62 nt, Homo Sapiens
caggagacuugagaaguagagugacaaaaacaagcacuuaauuaaauuauaaaauuuaacuu

SEQ ID NO: 65002 - RNA, 62 nt, Homo Sapiens
aaguggucuuugaccacaguugauugaaccagagcacuuauugcuuaaagaauaacagaguu

SEQ ID NO: 65003 - RNA, 62 nt, Homo Sapiens
ugcauccaaggcagguguuguuaaucuaucauagcacuuaaaaaaaaaaaaaaaaagagacc

SEQ ID NO: 65004 - RNA, 62 nt, Homo Sapiens
ugaucugcacaauuuaauuaugugguuauucgagcacuuaauuucacucaagguucauuggg

SEQ ID NO: 65005 - RNA, 62 nt, Homo Sapiens
ggccaggcacgguggcucacgccuauaaucccagcacuuagggaggccaaggcgggcagauc

SEQ ID NO: 65006 - RNA, 62 nt, Homo Sapiens
gcaagucuuugagauacguuuacauguaauaaagcacuuaauaggcacaguucuauguuuuu

SEQ ID NO: 65007 - RNA, 62 nt, Homo Sapiens
aucacuaauucccuuaagguaccagcaauugcagcacuuacacugaagaaagaagauaauag

SEQ ID NO: 65008 - RNA, 62 nt, Homo Sapiens
aaauaauuccaggguucccuuguacaugcuguagcacuuaaaagcuugugggccaguguccu

SEQ ID NO: 65009 - RNA, 62 nt, Homo Sapiens
uggauauaaaugcagcaacuuggcuuuugucaagcacuuagauucaggaguaaaucuaaaug

SEQ ID NO: 65010 - RNA, 62 nt, Homo Sapiens
cuaugcaggggggucuuucugacgaucgauauagcacuuagggguucuuaaggcacauccgg

SEQ ID NO: 65011 - RNA, 62 nt, Homo Sapiens
aaacucagagcaucugaguaaccgucaaaaccagcacuuaccaauaaaaacugacuagaaau

SEQ ID NO: 65012 - RNA, 62 nt, Homo Sapiens
gcugaagccaucagcaucuguaacuucacgguagcacuuacaccaucugcaccugaauccuc

SEQ ID NO: 65013 - RNA, 62 nt, Homo Sapiens
gaccagaguggcccaggccaggcugguagccaagcacuuaugcauccucccagggucuggcu

SEQ ID NO: 65014 - RNA, 62 nt, Homo Sapiens
auguaucguaaguuaauacuaaaagaagagaaagcacuuaaguuucacagaagccguuaugu

SEQ ID NO: 65015 - RNA, 62 nt, Homo Sapiens
agcuuuugugaaauagaaucagugaccaguauagcacuuagaucccuucuaacucauauaau

SEQ ID NO: 65016 - RNA, 62 nt, Homo Sapiens
gcugcuccuauauuuuuuaagaaauauaauaaagcacuuagggcaggggaaaucaucucggu

SEQ ID NO: 65017 - RNA, 62 nt, Homo Sapiens
ucuaggauuaacugagagauuaaaggaacagcagcacuuaggcucaaaaucgccccuacaaa

SEQ ID NO: 65018 - RNA, 62 nt, Homo Sapiens
gcagaaucagguccccacgggucucacaguagagcacuuagcuagcaaugacaaccugugau

SEQ ID NO: 65019 - RNA, 62 nt, Homo Sapiens
auagugucugagacacaagauaacauuuucaaagcacuuagagcuuugaggucuaaaugagu

SEQ ID NO: 65020 - RNA, 62 nt, Homo Sapiens
acagacuagaaaguguucuauaacacuuguuaagcacuuacugcugcuacugcaacaaccgc

SEQ ID NO: 65021 - RNA, 62 nt, Homo Sapiens
ugaauuauugaucuuccuaagcuguuucauacagcacuuagaauaaagcaacuuuuguagau

SEQ ID NO: 65022 - RNA, 62 nt, Homo Sapiens
gaaaacacaaagagaaaauaugaacaauauaaagcacuuaaaggaagaggaugauuucuucc

SEQ ID NO: 65023 - RNA, 62 nt, Homo Sapiens
ggaaagcaugauauguauauugcugaguugaaagcacuuauuggaaaauauuaaaaggcuaa

SEQ ID NO: 65024 - RNA, 62 nt, Homo Sapiens
gugagccucccagagccccaggacugggccagagcacuuagguuucuuuuuccaugguuucc

SEQ ID NO: 65025 - RNA, 62 nt, Homo Sapiens
cgggaaagcugccccacagccucagcaucuucagcacuuaccgauccagagccucccggccu

SEQ ID NO: 65026 - RNA, 62 nt, Homo Sapiens
uuuauguuucuuuuuagauguguaccuucccaagcacuuauuuaugcagugaccuggucacc

SEQ ID NO: 65027 - RNA, 62 nt, Homo Sapiens
uauuuuucuaugagaagcacuucauagggagaagcacuuaugacaaggcuauuuuuuaaacc

SEQ ID NO: 65028 - RNA, 62 nt, Homo Sapiens
uaaugggagcuuugccugggaccugaaccuggagcacuuaccgcauuaggaagaaaggagcu

SEQ ID NO: 65029 - RNA, 62 nt, Homo Sapiens
gugggcagcaugcccagguuccuugcugacucagcacuuauuucuguaguuuuaaaaaagaa

SEQ ID NO: 65030 - RNA, 62 nt, Homo Sapiens
agagauaauugcaguuucacuauacucacuucagcacuuaucaugcaauugcauauuauguu

SEQ ID NO: 65031 - RNA, 62 nt, Homo Sapiens
gauuaagaccuugcauauguaucuauuuguugagcacuuauuaccucuugcaccaaaucaau

SEQ ID NO: 65032 - RNA, 62 nt, Homo Sapiens
ucgcugcuucugagacuucugccaaaugaguaagcacuuaauauauaacucacugggacauu

SEQ ID NO: 65033 - RNA, 62 nt, Homo Sapiens
acacuaucuaaccuaauaugauggauuggagaagcacuuauuaaugauaguagguauguauu

SEQ ID NO: 65034 - RNA, 62 nt, Homo Sapiens
ccaguuugacugugcuagcuccaccuugccaaagcacuuacacagauaugauggaaugcauc

SEQ ID NO: 65035 - RNA, 62 nt, Homo Sapiens
ggaacagucugugagauugauucugcagaggaagcacuuaugagagggcuagagaaagcauc

SEQ ID NO: 65036 - RNA, 62 nt, Homo Sapiens
ugcuccuuuccaccagugauuuguauuaagacagcacuuauauuguacaauacuucagacug

SEQ ID NO: 65037 - RNA, 62 nt, Homo Sapiens
uuuaaccugaucuguagagcagagagguugaaagcacuuaacucuuguuuaguauccucauu

SEQ ID NO: 65038 - RNA, 62 nt, Homo Sapiens
gugugguucagggccagugcauauuaguggacagcacuuaguagcugugaaggaaggugcag

SEQ ID NO: 65039 - RNA, 62 nt, Homo Sapiens
acaguaguaauuaagguacaucucuaaaguggagcacuuacaccaggcucuaagauucacuu

SEQ ID NO: 65040 - RNA, 62 nt, Homo Sapiens
aaugagggaaguccuaggauggauagaaaaaaagcacuuacauuggggcacacaggaaaucc

SEQ ID NO: 65041 - RNA, 62 nt, Homo Sapiens
uuaggaguagauauugauuacuaucauaauucagcacuuaacuaugagccaggcaucauacu

SEQ ID NO: 65042 - RNA, 62 nt, Homo Sapiens
ugcucaauaacucuacucauuuguaucuuuucagcacuuaauuuuaauguaagaaaguuguu

SEQ ID NO: 65043 - RNA, 62 nt, Homo Sapiens
ggauggugguuagcaacaguggcccgugccaaagcacuuaccaaagugaugaugacuaaggu

SEQ ID NO: 65044 - RNA, 62 nt, Homo Sapiens
aaauuuggcuuuagugugacgggauuugauuaagcacuuaguauagucuuuugaacacggaa

SEQ ID NO: 65045 - RNA, 62 nt, Homo Sapiens
auacaaagucuauauuauugaucucauuuucuagcacuuaaacacccaaacugauaacauuu

SEQ ID NO: 65046 - RNA, 62 nt, Homo Sapiens
caggacuuucaugacccaauaaggacagacauagcacuuagaagaaaacaauuguggggauc

SEQ ID NO: 65047 - RNA, 62 nt, Homo Sapiens
uuacacauauuuuaauccugcugguaauaagaagcacuuaauuuuaucugugucaaguauuu

SEQ ID NO: 65048 - RNA, 62 nt, Homo Sapiens
uuguugcaaguacugcuguaucauacuuauauagcacuuacucuuaugguaauaaaaauggc

SEQ ID NO: 65049 - RNA, 62 nt, Homo Sapiens
uaggguaagcauucuuaacaggggcgcugucuagcacuuaacgagccuuguuuuucuaaagg

SEQ ID NO: 65050 - RNA, 62 nt, Homo Sapiens
uauguauaaauguacauaaaagacuuuuaccuagcacuuaaaguaguacuggaaauuuuaca

SEQ ID NO: 65051 - RNA, 62 nt, Homo Sapiens
gaagaguauccuaaugaaaagggaaugaauaaagcacuuacagccaguaaucaaaacagacu

SEQ ID NO: 65052 - RNA, 62 nt, Homo Sapiens
acauaaaagguuaaagaacaggcaacacaaugagcacuuaaguuuuuaacauguggggaaua

SEQ ID NO: 65053 - RNA, 62 nt, Homo Sapiens
cucaguucagcaacuguuuauucuguuuauugagcacuuacuuggaccaagcacuguggucu

SEQ ID NO: 65054 - RNA, 62 nt, Homo Sapiens
gcagguaguguuuaguuaucuacugcauuaugagcacuuaaaguacugcuagcuguagaacu

SEQ ID NO: 65055 - RNA, 62 nt, Homo Sapiens
acuuucuauuuuuagccuauauuuggaaagaaagcacuuaacauuuuaggaauucuuuuuaa

SEQ ID NO: 65056 - RNA, 62 nt, Homo Sapiens
cggguuguaaggacaaaggauuuuaaaaucugagcacuuaggugaagggacaagcagguuua

SEQ ID NO: 65057 - RNA, 62 nt, Homo Sapiens
aaagucuaccaaaggaauuugcauccagcagcagcacuuagaccugccagccacugucaccg

SEQ ID NO: 65058 - RNA, 62 nt, Homo Sapiens
gcauuuguuauaaauguaguaaggcagguccaagcacuuacaaguuuuuuguaguuguuacc

SEQ ID NO: 65059 - RNA, 62 nt, Homo Sapiens
cacauuuaggaaaagacauauauuuuauccauagcacuuauugcuguuauuuucuacauuug

SEQ ID NO: 65060 - RNA, 62 nt, Homo Sapiens
uuguuuauauccauuuuuuccaguuuagaaagagcacuuauuauauuuuugaaaauuuagua

SEQ ID NO: 65061 - RNA, 62 nt, Homo Sapiens
acuguguagaaacuauuuuucuguucuuauguagcacuuaaccaucugaaggggauucugau

SEQ ID NO: 65062 - RNA, 62 nt, Homo Sapiens
uugugccagguuccacucaauucaauuucuaaagcacuuacgaaaacauuuuacuuggcuua

SEQ ID NO: 65063 - RNA, 62 nt, Homo Sapiens
uuuuuacaguuagcacuucaccucgucgugaaagcacuuaauaucagugggaauuaagaaag

SEQ ID NO: 65064 - RNA, 62 nt, Homo Sapiens
uuucaucuauguuuaucacauuuuaauaccacagcacuuauaaugaugucacuacauauaga

SEQ ID NO: 65065 - RNA, 62 nt, Homo Sapiens
uuaaguacuuacuacaugcuaagagcuuuuuaagcacuuauuuaauccucauuaacaaauuc

SEQ ID NO: 65066 - RNA, 62 nt, Homo Sapiens
auuuuuagcauuaaaaacuaaggaauauacuuagcacuuacuuaaucuuuucaguuuuccag

SEQ ID NO: 65067 - RNA, 62 nt, Homo Sapiens
aauucccugggcacagguugcaccugggugugagcacuuaaucacucaacgcuuuguuuucu

SEQ ID NO: 65068 - RNA, 62 nt, Homo Sapiens
uauacacuuuuucuguacuuucuguaauuuucagcacuuauggcuuauucauugaauauuuu

SEQ ID NO: 65069 - RNA, 62 nt, Homo Sapiens
aucagauucaagagaauauaaaugagagguuuagcacuuaagaaaaaagaauuuuuaaugcu

SEQ ID NO: 65070 - RNA, 62 nt, Homo Sapiens
uucugaacuagucuggggacaggggaggagagagcacuuagucauuugccaacaccuuuuua

SEQ ID NO: 65071 - RNA, 62 nt, Homo Sapiens
guuuucagagcacccauauccccccuuuuuaaagcacuuacuucuaaccguaacacguccca

SEQ ID NO: 65072 - RNA, 62 nt, Homo Sapiens
cauuugcuaacucccagaauuggaaggaggggagcacuuagaugcuuuucucuccuuaugug

SEQ ID NO: 65073 - RNA, 62 nt, Homo Sapiens
agaaaagaggcuuucuaagcacacacagccguagcacuuagaguauuuuuacaaacacauaa

SEQ ID NO: 65074 - RNA, 62 nt, Homo Sapiens
gagggaagcggguguuggcuguuuccaaagagagcacuuaauuuaauuuuuccuuuaaauga

SEQ ID NO: 65075 - RNA, 62 nt, Homo Sapiens
uauuuaguuuugcuuucucguggauaauauuaagcacuuacucugcaguuuccuggaaguug

SEQ ID NO: 65076 - RNA, 62 nt, Homo Sapiens
aaugguaaguaguugcuacuggccaacugucuagcacuuaccugaaaacuuaguauggagcu

SEQ ID NO: 65077 - RNA, 62 nt, Homo Sapiens
aacagugcuugccacagagcggggacucgguaagcacuuaaugaaugaaugaauucuaaguc

SEQ ID NO: 65078 - RNA, 62 nt, Homo Sapiens
gucuauugcaaacaauucucucaguuacguucagcacuuaagaacggcuaauggcaauagga

SEQ ID NO: 65079 - RNA, 62 nt, Homo Sapiens
aagugccaagcauuauuuuaugccgguuacugagcacuuacuucaaugccaacaagagcauc

SEQ ID NO: 65080 - RNA, 62 nt, Homo Sapiens
aauaccacagacacaguuaaguaguuaaauacagcacuuaaauauuugacuguaauaguaua

SEQ ID NO: 65081 - RNA, 62 nt, Homo Sapiens
caguggguuaucucuaggaugaucaguaguucagcacuuaaaaacugcagagaaaacugaaa

SEQ ID NO: 65082 - RNA, 62 nt, Homo Sapiens
cagggguuucccuggcgcagcgaaagucucugagcacuuaccgggcgugaccguuucuuagg

SEQ ID NO: 65083 - RNA, 62 nt, Homo Sapiens
guuuacacagacaaagugacaucagaaggcugagcacuuaucuggaucauuuggucaguuug

SEQ ID NO: 65084 - RNA, 62 nt, Homo Sapiens
ugggaaucuaucccuaaggaauaaaaagcgccagcacuuaagauuauauguuuacuaaugua

SEQ ID NO: 65085 - RNA, 62 nt, Homo Sapiens
ugguuggggguaagacuaggcuuucuccuuuaagcacuuacauccucuuuuuggguuuucuu

SEQ ID NO: 65086 - RNA, 62 nt, Homo Sapiens
uuggcuacuaaugaagcucuacaaaacccacaagcacuuaucaaaaaaaaaaaaaaaaaaac

SEQ ID NO: 65087 - RNA, 60 nt, Homo Sapiens
ccacaaguucccugacuacgagggggucugagcacuuagcauccaggcaaagugcuguga

SEQ ID NO: 65088 - RNA, 62 nt, Homo Sapiens
cuaguguucccagcacugugccugcucucaagagcacuuacugccucgcaaauaauaaaaau

SEQ ID NO: 65089 - RNA, 62 nt, Homo Sapiens
ccagaaccuaggaggaugccuaacagagaguaagcacuuaaaaaauauuugucauaugaaug

SEQ ID NO: 65090 - RNA, 62 nt, Homo Sapiens
gagauuuaucuugaagcugaauuugcaaagcaagcacuuauaaaaauuagauuguguguuac

SEQ ID NO: 65091 - RNA, 62 nt, Homo Sapiens
acauuuguuaauaguuacgucucuccugauguagcacuuaagcuucauuuaguuauuauuuc

SEQ ID NO: 65092 - RNA, 62 nt, Homo Sapiens
cgaccucaucaucugggagaucgaggugccaaagcacuuagucggucggcuaauuggcaagc

SEQ ID NO: 65093 - RNA, 62 nt, Homo Sapiens
guucaugucucguccauguccauguucguguuagcacuuacgugggaacaaauaccaauuug

SEQ ID NO: 65094 - RNA, 51 nt, Homo Sapiens
ugacgguugauguggccugaaagcacuuagcgggcgcgcugggaugucaca

SEQ ID NO: 65095 - RNA, 62 nt, Homo Sapiens
ucccugugaauacuucagaguaagauucuaaaagcacuuauauuuaugcucuuucuggcaaa

SEQ ID NO: 65096 - RNA, 62 nt, Homo Sapiens
aaaaaaaaaucuuaagaguuaauuccuuacagagcacuuauuuucuccuuagguccucacac

SEQ ID NO: 65097 - RNA, 62 nt, Homo Sapiens
gacaacgaacaaauucuucaauuauuucuucaagcacuuaugucaguuccauucaugaacga

SEQ ID NO: 65098 - RNA, 62 nt, Homo Sapiens
guagcggcacugucuuggcuaggccccacggcagcacuuaugcgacguccuuuagcccuccc

SEQ ID NO: 65099 - RNA, 62 nt, Homo Sapiens
ccaccugggaaccccuccgucaguccuuaggaagcacuuacauaccccaagaccccagaggg

SEQ ID NO: 65100 - RNA, 62 nt, Homo Sapiens
guuugcaagaacagaauacaucucuuguuguuagcacuuauucauacaagcaucagaagagc

SEQ ID NO: 65101 - RNA, 62 nt, Homo Sapiens
gaucucccagcuggguuaggugccaagcaggcagcacuuaggugccuuggcaccgucacaga

SEQ ID NO: 65102 - RNA, 62 nt, Homo Sapiens
uuucuuggccaaaguggcuuccucaagaaagcagcacuuaccuuugaaaaaugcugggaaca

SEQ ID NO: 65103 - RNA, 62 nt, Homo Sapiens
ccaagggccauuucuucucagcuugguggagcagcacuuacuuacuacuggaaaugaaaaaa

SEQ ID NO: 65104 - RNA, 62 nt, Homo Sapiens
aagucuucaucuaugcauguaagacuguuauuagcacuuaguugcaggaauauaaauaauaa

SEQ ID NO: 65105 - RNA, 62 nt, Homo Sapiens
uaaaacauuuguuucccccauacuggaaauguagcacuuacguuuugaugccaggugcaauc

SEQ ID NO: 65106 - RNA, 62 nt, Homo Sapiens
ugcuaaggaaaccugaauuggaguauaucugaagcacuuauuuccaauucaggagcccuugc

SEQ ID NO: 65107 - RNA, 62 nt, Homo Sapiens
gcagcaauuccuccauuuuuaugaaucuugugagcacuuacgcuaggagaaauuucuuuuac

SEQ ID NO: 65108 - RNA, 62 nt, Homo Sapiens
uccuuugcaggagggcugggaauccucuuuagagcacuuaauccuauuuauccccuggaaug

SEQ ID NO: 65109 - RNA, 62 nt, Homo Sapiens
auaugauauauucaaaugauagaauaguauacagcacuuaaaagcagugaaccagauccaua

SEQ ID NO: 65110 - RNA, 62 nt, Homo Sapiens
ggcuuuucugaggauuaaauaaauaaaugugaagcacuuagaacugauggccagcacaugag

SEQ ID NO: 65111 - RNA, 62 nt, Homo Sapiens
uuccaaacauacaagaggcucccucuuaacgcagcacuuagacacguguuguuccaccuucc

SEQ ID NO: 65112 - RNA, 62 nt, Homo Sapiens
uuccaaacauacaagaggcugccucuuaacacagcacuuagacacgugcuguuccaccuccc

SEQ ID NO: 65113 - RNA, 62 nt, Homo Sapiens
ggccgggcacggugccucacaccuguaaucccagcacuuagguaggccaagguggguggauc

SEQ ID NO: 65114 - RNA, 62 nt, Homo Sapiens
uuguaccuaaaaauucagagaaaaccugguauagcacuuauuauuuauguagagcauguagg

SEQ ID NO: 65115 - RNA, 62 nt, Homo Sapiens
gugggcaaauugcuugaccugccuguaaucccagcacuuaggggcugggcacaguggcucac

SEQ ID NO: 65116 - RNA, 62 nt, Homo Sapiens
ucuucuuggaaaaggacccacccgcuaagacuagcacuuagccaggacugguuuccuagccu

SEQ ID NO: 65117 - RNA, 62 nt, Homo Sapiens
agcauuucugaagguuggucuaauauuacuguagcacuuacuuuuuaaacucaauauaaugu

SEQ ID NO: 65118 - RNA, 62 nt, Homo Sapiens
auuguggauccccugagaucuggcuucccaagagcacuuauugacccuuccucaggccuccc

SEQ ID NO: 65119 - RNA, 62 nt, Homo Sapiens
cucaagcacauugguauuguauaaagguauagagcacuuagcuuacaaucuuuaaagguuuc

SEQ ID NO: 65120 - RNA, 62 nt, Homo Sapiens
uaaaugcaaaugcaacauuucugaccaacaucagcacuuaaaagacauggcuggaugcgcug

SEQ ID NO: 65121 - RNA, 62 nt, Homo Sapiens
gagugaccguuugaauccauaaaaugugccccagcacuuaaucguuuauagccuugccugua

SEQ ID NO: 65122 - RNA, 62 nt, Homo Sapiens
cuccugccguccugacgccaccccgccccaucagcacuuaagccacaugacacaaagucugu

SEQ ID NO: 65123 - RNA, 62 nt, Homo Sapiens
ccuagguguuucacugguccucuaugaaucccagcacuuauaaucccagucuuuuaucacuc

SEQ ID NO: 65124 - RNA, 62 nt, Homo Sapiens
uaggaagcaaccuuucgccugugcagcgguccagcacuuaacucuaauacaucagcaugcgu

SEQ ID NO: 65125 - RNA, 62 nt, Homo Sapiens
aaguauuccccccugcgacauauacagugcuuagcacuuaauggauuaagugaaccaauaca

SEQ ID NO: 65126 - RNA, 62 nt, Homo Sapiens
gccggggggggugucugccugaaacauccuuaagcacuuaagggaaaacagacucccuucgg

SEQ ID NO: 65127 - RNA, 62 nt, Homo Sapiens
cagccuagcuuuuuuuuuuuuuuuuuuuuuuuagcacuuaguauuuagcauuuauuaacagg

SEQ ID NO: 65128 - RNA, 62 nt, Homo Sapiens
agcuggaaccaagaucuagauaguccguagauagcacuuaggacaagaaugugcauugaugg

SEQ ID NO: 65129 - RNA, 62 nt, Homo Sapiens
aagucguuccaucauaaucuaugaucuuguacagcacuuauagaaauaagcuguucuuuuga

SEQ ID NO: 65130 - RNA, 62 nt, Homo Sapiens
uuaaacaauccguuuauauucaguuuauguuaagcacuuagcuuguuaguuauagggaugga

SEQ ID NO: 65131 - RNA, 62 nt, Homo Sapiens
gcuuucugacagaauuauagagcaaaaugaaaagcacuuauuugguuacacauauggaagua

SEQ ID NO: 65132 - RNA, 62 nt, Homo Sapiens
acaggagccuagagcccccugagcccuuucccagcacuuaaacagcccauaauugggaccca

SEQ ID NO: 65133 - RNA, 62 nt, Homo Sapiens
auguuugugugggaaaaaaaguuuacauauacagcacuuaaaucuuccuucuguagagggcu

SEQ ID NO: 65134 - RNA, 62 nt, Homo Sapiens
auuauuccuugauuuauucaagggaacagggaagcacuuacacuuggagaaauggcuaggac

SEQ ID NO: 65135 - RNA, 62 nt, Homo Sapiens
uaaugccgauauacucuagauauuguuucggcagcacuuauuguuacuguaauuccucaacg

SEQ ID NO: 65136 - RNA, 63 nt, Homo Sapiens
ggaggcccuguucuuagagccccugacaaaggcagcacuuauuuccugggcuggugcgcccca

SEQ ID NO: 65137 - RNA, 63 nt, Homo Sapiens
cagcaugacaaaauggucaaaaaauaagucaucagcacuuaagaaaugaaagcaacuuuugaa

SEQ ID NO: 65138 - RNA, 63 nt, Homo Sapiens
gagauuuaaaaucuuaaaauguuucuuauuuucagcacuuacaucauuugguacacaggguca

SEQ ID NO: 65139 - RNA, 63 nt, Homo Sapiens
aagccaguuucaucaaacaguucaacagagagcagcacuuaauacccuuuauacagcccauuu

SEQ ID NO: 65140 - RNA, 63 nt, Homo Sapiens
gagucaaaaaacuugauuucagguccuagcucuagcacuuacagcugugugaucuugggcaag

SEQ ID NO: 65141 - RNA, 63 nt, Homo Sapiens
uauuuugauuuuacccagcuuaaucuguaaaguagcacuuaaauauaucugauagcaacacuu

SEQ ID NO: 65142 - RNA, 63 nt, Homo Sapiens
augaggaugaggaauaauaaacucuuuuuggcaagcacuuaaauguucugaaauuuguauaag

SEQ ID NO: 65143 - RNA, 63 nt, Homo Sapiens
agguaaguuuuauaagggaguacauuuugacugagcacuuagggcaucaggaacagugcuacu

SEQ ID NO: 65144 - RNA, 63 nt, Homo Sapiens
auggcauaccaaucugugcggggcaguguccuaagcacuuagacuacaucagggaagaacaca

SEQ ID NO: 65145 - RNA, 63 nt, Homo Sapiens
uaaauaucuuaaaauaucuaaaacauuuuuuaaagcacuuagauugucuuacguaugugcaua

SEQ ID NO: 65146 - RNA, 63 nt, Homo Sapiens
gaaacugucugucuaauggucacagagcacuguagcacuuaacagauugccauggacaccagu

SEQ ID NO: 65147 - RNA, 63 nt, Homo Sapiens
aggcaccgccacgucccagcacgcacacagcugagcacuuagcgggcccucuuucccugcgag

SEQ ID NO: 65148 - RNA, 63 nt, Homo Sapiens
uguuuacaaagcccuuucacgccuuguguggucagcacuuaacgauaaucaguauaauaauuu

SEQ ID NO: 65149 - RNA, 63 nt, Homo Sapiens
auucagcuugucucaucccccagagugacugagagcacuuaacccaccuguggccccuaaacc

SEQ ID NO: 65150 - RNA, 63 nt, Homo Sapiens
caguuagucauggagaguaauuauuccauuuuaagcacuuacaggguuauguagaaaagcaau

SEQ ID NO: 65151 - RNA, 63 nt, Homo Sapiens
cccccugagcagcgagccugccuacuggagcccagcacuuacuccucagugggccugugggag

SEQ ID NO: 65152 - RNA, 63 nt, Homo Sapiens
aggcucuugggaugcagcaacuacuaggaaaggagcacuuaggguuucuucuaccacccaauu

SEQ ID NO: 65153 - RNA, 63 nt, Homo Sapiens
acaguauaugaaauaauggggaaaugaauguaaagcacuuaguguugugaggauuaaaaugag

SEQ ID NO: 65154 - RNA, 63 nt, Homo Sapiens
uccaugacagggucuaaaauauuaguuuaccugagcacuuauuucugggggugaaagaaaaau

SEQ ID NO: 65155 - RNA, 63 nt, Homo Sapiens
ugaagucaguggccuggaucuauguuaaaauagagcacuuacccaaauagaaucuuauaucug

SEQ ID NO: 65156 - RNA, 63 nt, Homo Sapiens
auuguaugucuccucaaauguugacaaaaaaugagcacuuacacacauaauggugucuuaaaa

SEQ ID NO: 65157 - RNA, 63 nt, Homo Sapiens
acaaagccuagcacaaaguauuucuguguccccagcacuuacaagggcaggauugucuuuuuu

SEQ ID NO: 65158 - RNA, 63 nt, Homo Sapiens
uuacugguguccagcugagucuuuucaaugaauagcacuuauggucagcgcucuugcuuugcu

SEQ ID NO: 65159 - RNA, 63 nt, Homo Sapiens
guaauguauuauaccuaaauuuuguaucuaaauagcacuuacuaauauauaguauguuuuaag

SEQ ID NO: 65160 - RNA, 63 nt, Homo Sapiens
ggagcagagaugcagccagucccaaauucauugagcacuuaaauuuuuucuuuccucccuuac

SEQ ID NO: 65161 - RNA, 63 nt, Homo Sapiens
aaucagccuaacauaagaucaacugcccaaagcagcacuuauaucauuguaaacaaacugugu

SEQ ID NO: 65162 - RNA, 63 nt, Homo Sapiens
cuguaaauugaauaauuuaugcagauagcaguuagcacuuaauuguuuuaaauuaauuuuuua

SEQ ID NO: 65163 - RNA, 63 nt, Homo Sapiens
aaauaaagguacuuuacagcaaacugucgcugaagcacuuaaguaaucaauuaguaauggcgg

SEQ ID NO: 65164 - RNA, 63 nt, Homo Sapiens
ucuucccauuucaaaagguaaguuuggcuggggagcacuuaaugaagguggcuuuugcuuuau

SEQ ID NO: 65165 - RNA, 63 nt, Homo Sapiens
uguggagauacuguaaccuggcacuauauucuaagcacuuacacucuauucuuauuauucacu

SEQ ID NO: 65166 - RNA, 63 nt, Homo Sapiens
ugaguaaauaaugcagcucaaucacccauccuaagcacuuacgauuuccugucuuucccgucc

SEQ ID NO: 65167 - RNA, 63 nt, Homo Sapiens
cccacguucucaagggcagacgccggugugaugagcacuuacaccucccucgagaaacagugc

SEQ ID NO: 65168 - RNA, 63 nt, Homo Sapiens
uaucuuggcugucaagaguaucaaaugccaugcagcacuuaaacuugugauaaggaagaugaa

SEQ ID NO: 65169 - RNA, 63 nt, Homo Sapiens
ccauuuaauuagcugcauaucaccuuaggguacagcacuuaacgcaaucugccucaauuucuu

SEQ ID NO: 65170 - RNA, 63 nt, Homo Sapiens
gggcugagugcaguggcucaugccuguaaucccagcacuuagggugccaauguggauuaccug

SEQ ID NO: 65171 - RNA, 63 nt, Homo Sapiens
cuuuuagaccucuuacuuccacugcuaguagcuagcacuuacugagcaccugcgaugagguaa

SEQ ID NO: 65172 - RNA, 63 nt, Homo Sapiens
gggauuucagauaugaacgguguaaauuugagaagcacuuaugcauacaugugggugaaaaac

SEQ ID NO: 65173 - RNA, 63 nt, Homo Sapiens
aguucuuguuuuuauuuuugaaaguacucacacagcacuuacuaugcuccaaacacuccucua

SEQ ID NO: 65174 - RNA, 63 nt, Homo Sapiens
auuugccucaacaacguaaacuuccuaaugauuagcacuuaauaauugcauauaaaaugcuuu

SEQ ID NO: 65175 - RNA, 63 nt, Homo Sapiens
uugggacaauuguuuuaaucugaaauucuaaagagcacuuacuguaaccuguugcuguguuua

SEQ ID NO: 65176 - RNA, 63 nt, Homo Sapiens
gguaggaccaagcaucuuggcucacacaccuguagcacuuacuccugcggguggggcuugggg

SEQ ID NO: 65177 - RNA, 63 nt, Homo Sapiens
cgaccccaaggugccagagagagggcaguagagagcacuuaccgagauaaaggcagcuaaaac

SEQ ID NO: 65178 - RNA, 63 nt, Homo Sapiens
uguuagaucuaacguguuccacugcccuuucaaagcacuuaaggaauuccuuggggauuuuuu

SEQ ID NO: 65179 - RNA, 63 nt, Homo Sapiens
gacuucauuuguucaagaauaugaaauuuaaugagcacuuaguaacagaggcauauauuuaaa

SEQ ID NO: 65180 - RNA, 63 nt, Homo Sapiens
ucuuccuuaaaugacuuuucacacuccacuugaagcacuuaagaacauuuuuuagucuguaau

SEQ ID NO: 65181 - RNA, 63 nt, Homo Sapiens
aggggagcacaucuuguaauaaugggccaucccagcacuuauacuccuaaacaagagaauaaa

SEQ ID NO: 65182 - RNA, 63 nt, Homo Sapiens
guaagaaguaaaaguagugcaaucagcgauaucagcacuuacaccuuucuugugaaaguuuuc

SEQ ID NO: 65183 - RNA, 63 nt, Homo Sapiens
acacugugugugauuuuguuucuuuuguuaagcagcacuuauguagacugcauuuccaaaugu

SEQ ID NO: 65184 - RNA, 63 nt, Homo Sapiens
auaguacagaagauucuuuguuuuucuccacugagcacuuaacaauugcuuucucucuggccu

SEQ ID NO: 65185 - RNA, 63 nt, Homo Sapiens
ugauauacaaaguguaccaacauaaguguugguagcacuuaagacuuauacuugccuucugau

SEQ ID NO: 65186 - RNA, 63 nt, Homo Sapiens
aaagcuaaaacaacccauuugcuacccauccaaagcacuuacaguuuagcaaauauuaaagag

SEQ ID NO: 65187 - RNA, 63 nt, Homo Sapiens
cauaaaagagaaaaaaauucggaaagugaucagagcacuuauucaaaauacagugauagaagu

SEQ ID NO: 65188 - RNA, 63 nt, Homo Sapiens
ucaagauauauaucuggaaccucuuauaaauggagcacuuagaaauuuguuguucugcacuua

SEQ ID NO: 65189 - RNA, 63 nt, Homo Sapiens
ucauuagcucagugacuuguccacacucgucuuagcacuuacguuucaaaagcuugucacaaa

SEQ ID NO: 65190 - RNA, 63 nt, Homo Sapiens
uacugaugucucagugaaucagucuguuuauuaagcacuuaucagggcuuccacacacuuauu

SEQ ID NO: 65191 - RNA, 63 nt, Homo Sapiens
uguggagggcugcaaucugucuugauuucuccaagcacuuaacuuucuuugacugcacugaga

SEQ ID NO: 65192 - RNA, 63 nt, Homo Sapiens
uucaggucuuugcucauucacucaguaauacugagcacuuaccauguaccagaauuuuacuag

SEQ ID NO: 65193 - RNA, 63 nt, Homo Sapiens
auuuaaauaauguaaacgcaaacaggguuugauagcacuuaaacuaguucauuucaaaauuaa

SEQ ID NO: 65194 - RNA, 63 nt, Homo Sapiens
aaaugaguaaaauaauuaaugaaacauauuuagagcacuuaauggucucuguuuucaauauaa

SEQ ID NO: 65195 - RNA, 63 nt, Homo Sapiens
aaugauuagugucaguauuuauucuucugaaauagcacuuaaaaacuuagaaacauugcgcau

SEQ ID NO: 65196 - RNA, 63 nt, Homo Sapiens
agccuucugacuuaggguuuagucccagcccugagcacuuagggucaaaaggcccagagucug

SEQ ID NO: 65197 - RNA, 63 nt, Homo Sapiens
aguuacauguuguaaucaaguauucuauuuuaaagcacuuaugcuuuuaagucagggaugcuu

SEQ ID NO: 65198 - RNA, 63 nt, Homo Sapiens
uuaauccaguagagacuugcggcuugugaauauagcacuuauuucuuuguuauaauucauaua

SEQ ID NO: 65199 - RNA, 63 nt, Homo Sapiens
ggaaauguaaaguagaaaaauauucaaacaaacagcacuuacaguaaccucacacauuaacuu

SEQ ID NO: 65200 - RNA, 63 nt, Homo Sapiens
auuuucccucuucacuugguauuuaaguuucacagcacuuacacaaugggaaaaaacaccagg

SEQ ID NO: 65201 - RNA, 63 nt, Homo Sapiens
uccuuuuccacuuuaaauuuauauuccugguguagcacuuaacuaugguuucauguaacauac

SEQ ID NO: 65202 - RNA, 63 nt, Homo Sapiens
agagugcauagcauacacugcuaauagaugcauagcacuuaacucugaugaggaaaagauuaa

SEQ ID NO: 65203 - RNA, 63 nt, Homo Sapiens
agaauauuuuaaguauugcauuuauugagaaagagcacuuaagcagacacggaucugagaauc

SEQ ID NO: 65204 - RNA, 63 nt, Homo Sapiens
uuauugauguuuucauagagaauauaaaaauaaagcacuuauagaaaaaacucguuugauuuu

SEQ ID NO: 65205 - RNA, 63 nt, Homo Sapiens
ugcauuugucauacguuucuacuuaaauuauuaagcacuuacgauuuagauguaauaauuaua

SEQ ID NO: 65206 - RNA, 63 nt, Homo Sapiens
cuacuuuugugggaguauuucuauuauauaaccagcacuuacuaccuguacucaaaauucagc

SEQ ID NO: 65207 - RNA, 63 nt, Homo Sapiens
augaaauaaaaaaaaacuuugauaagaugggacagcacuuauagaugaggaagaagacaauug

SEQ ID NO: 65208 - RNA, 63 nt, Homo Sapiens
agacuggugacaacuggcugcaguuaacccuguagcacuuacuuauuucagucaguccagagg

SEQ ID NO: 65209 - RNA, 63 nt, Homo Sapiens
uuucccaauuuauuaaauuguucuuuguuguuuagcacuuaaauaugaaucaccugaguacaa

SEQ ID NO: 65210 - RNA, 63 nt, Homo Sapiens
gauaggccuucuugugaucucaccuuaucuuaaagcacuuacagacauugcagucugcuucug

SEQ ID NO: 65211 - RNA, 63 nt, Homo Sapiens
uaggguuauggaaucuaguaauaaaauuucaacagcacuuaaacugaaguuuggguugcucau

SEQ ID NO: 65212 - RNA, 63 nt, Homo Sapiens
ucacacaugccuauauuaucauaagaauuuuucagcacuuaacuacuuuguuggcauugaucc

SEQ ID NO: 65213 - RNA, 63 nt, Homo Sapiens
ucaagggaaaauacucaaagaaagaaaaguggcagcacuuauauuaguuuuauaacaggauaa

SEQ ID NO: 65214 - RNA, 63 nt, Homo Sapiens
agcuuacauuacauguccaguccacauuuaaagagcacuuacuguggaacaagccuucagcca

SEQ ID NO: 65215 - RNA, 63 nt, Homo Sapiens
uuuugaauucuuuagauuuuuaaauuggagaaaagcacuuaaaguuuuuuauauaugaauauu

SEQ ID NO: 65216 - RNA, 63 nt, Homo Sapiens
cauugugcacuaugggaggccgcugcugcguggagcacuuaaaguccagccuccaggaccgga

SEQ ID NO: 65217 - RNA, 63 nt, Homo Sapiens
guccagagagcuuuauggaagcgggagaggaggagcacuuacucauguuguauuuguuaaugg

SEQ ID NO: 65218 - RNA, 63 nt, Homo Sapiens
augaguucauuuuuaggugauuguuuauuaguuagcacuuagaacacuggggauguuauuuac

SEQ ID NO: 65219 - RNA, 63 nt, Homo Sapiens
uaaccagaugauaaugaacuggcaaauacagugagcacuuaugcauauuuuaggauuauuuuu

SEQ ID NO: 65220 - RNA, 63 nt, Homo Sapiens
cucugugacaguauugugugaaaguggcauggcagcacuuaugggcugugaguagaauaugua

SEQ ID NO: 65221 - RNA, 63 nt, Homo Sapiens
ucaguuuggucaccuguaaaaggaaauaacaagagcacuuacuuuauaagauugaugugagua

SEQ ID NO: 65222 - RNA, 63 nt, Homo Sapiens
acucuaaaagcacugaccucaaaaaaccuuauaagcacuuagauuuaauugcauuuuccauag

SEQ ID NO: 65223 - RNA, 63 nt, Homo Sapiens
ucugauaaugaaaauuaugauaaggaugauaaaagcacuuacuucguguccgacucuucugag

SEQ ID NO: 65224 - RNA, 63 nt, Homo Sapiens
gagucuccaaauaauaauagccgacguuuauugagcacuuacuaugugcccaacccuguuaug

SEQ ID NO: 65225 - RNA, 63 nt, Homo Sapiens
caguuuccugaccuaugaaacagagaaaauaaaagcacuuauuuauuguuguuggaggcugca

SEQ ID NO: 65226 - RNA, 63 nt, Homo Sapiens
aauaaccucaccccaaauacaauaaagggacgaagcacuuauagauaccacagacacaugugu

SEQ ID NO: 65227 - RNA, 63 nt, Homo Sapiens
uaccugaccuugugcgcugggaggcgcaucugcagcacuuacaggugagggauggggagaugg

SEQ ID NO: 65228 - RNA, 63 nt, Homo Sapiens
caaggagacacaugccaccccagcaguacacaaagcacuuaccuugacuggugaagucagcca

SEQ ID NO: 65229 - RNA, 63 nt, Homo Sapiens
uagcuuucauuuacauagugcuuacauuuauauagcacuuacuaugugcgauguacuaauuua

SEQ ID NO: 65230 - RNA, 63 nt, Homo Sapiens
auuuuacaauagauaaaugcuugugcuaccuaaagcacuuagcacacaguuaaauuauauuua

SEQ ID NO: 65231 - RNA, 63 nt, Homo Sapiens
auaaaucacuauacugauauuuugauacaagcaagcacuuacaugguaaucacuauauagauc

SEQ ID NO: 65232 - RNA, 63 nt, Homo Sapiens
uugucaucucauauugaucagguauuuuaaucuagcacuuacauauuguugauaaaugaaagc

SEQ ID NO: 65233 - RNA, 63 nt, Homo Sapiens
cagagacuguuaauggccccuuacccugggugaagcacuuacccuuggaacagaacucuaaaa

SEQ ID NO: 65234 - RNA, 63 nt, Homo Sapiens
uauauuauuuucuucuccuuuauauguaaugaaagcacuuauaaagaaacaggaaucauuaga

SEQ ID NO: 65235 - RNA, 63 nt, Homo Sapiens
gguuagucucauuuagaaaaaucgaaagugcacagcacuuaaagggaauauaugagguuuuuu

SEQ ID NO: 65236 - RNA, 63 nt, Homo Sapiens
caaccugauccucaugcugauagaaugacagcuagcacuuauuuccuaagugcaacuguuuua

SEQ ID NO: 65237 - RNA, 63 nt, Homo Sapiens
cccccuccaaagauggaguguagaaaugaugacagcacuuaguaaguucaaagaugacauuca

SEQ ID NO: 65238 - RNA, 63 nt, Homo Sapiens
cagcugggcacgguggcucacgccuguaaucccagcacuuacuuugggaggccaaggugggca

SEQ ID NO: 65239 - RNA, 63 nt, Homo Sapiens
gugcgguucucuuugacccccaaagacaagacaagcacuuauuuuuauuuucagaagacaaaa

SEQ ID NO: 65240 - RNA, 63 nt, Homo Sapiens
auuuucagcuuuuuaaagcauuuguggccuuccagcacuuacuugggaagacacauguuaagu

SEQ ID NO: 65241 - RNA, 63 nt, Homo Sapiens
ugagguggggguguucaccugguguggggguuaagcacuuauuaauugguaaaggaaagagca

SEQ ID NO: 65242 - RNA, 63 nt, Homo Sapiens
aagaccgggcauugggcuggaaaguauucacugagcacuuagguuuagggccggucaggcccu

SEQ ID NO: 65243 - RNA, 63 nt, Homo Sapiens
uacuccugauucuuaacauuauuuguaaccacuagcacuuaaggaaaaacugaagagaacaaa

SEQ ID NO: 65244 - RNA, 63 nt, Homo Sapiens
uuauauaaagggcuguuuguccaacauuuauccagcacuuaccggcuuauuuuauuauaguag

SEQ ID NO: 65245 - RNA, 63 nt, Homo Sapiens
ccuccuggggagacgugacucugguggacgcagagcacuuaguuacccuggacgcuccccaca

SEQ ID NO: 65246 - RNA, 63 nt, Homo Sapiens
auuucuuaauuauuauaaaaauauuaagacaauagcacuuaaauuccucaacaguguuuucag

SEQ ID NO: 65247 - RNA, 63 nt, Homo Sapiens
aaacaaaaauuuuucuuucuuuacugcaugcauagcacuuaauaaaauggauuuuuaaaaaau

SEQ ID NO: 65248 - RNA, 63 nt, Homo Sapiens
caaaaagugucucugccuugagucaucuauucaagcacuuacagcucuggccacaacagggca

SEQ ID NO: 65249 - RNA, 63 nt, Homo Sapiens
uccucagugccuguccauaacugugaaguauuaagcacuuagggccagaugcacuguaaacau

SEQ ID NO: 65250 - RNA, 63 nt, Homo Sapiens
cucuacucaucuuuagagaugaaucaucuauuaagcacuuaccaaaacauaucauuaaacuga

SEQ ID NO: 65251 - RNA, 63 nt, Homo Sapiens
guauuauaauuaguuuugugaauagaaaaauaaagcacuuauguuuaaauuuguuacagugac

SEQ ID NO: 65252 - RNA, 63 nt, Homo Sapiens
aaagugagguguggaacuccaggcaacgacccaagcacuuauuuuuuaagagggaaaggacuu

SEQ ID NO: 65253 - RNA, 63 nt, Homo Sapiens
gauuaucgaucuaugagacaucuugauauguaaagcacuuaauauuaaaggcauaaaagugaa

SEQ ID NO: 65254 - RNA, 63 nt, Homo Sapiens
cucaucucccuguccucugagauaauaugagugagcacuuagguaucauaucagaugcucaag

SEQ ID NO: 65255 - RNA, 63 nt, Homo Sapiens
auuucuagcauauggacaccuggccucugcuugagcacuuaggugacaggaacuuccgcaccu

SEQ ID NO: 65256 - RNA, 63 nt, Homo Sapiens
gcuucauagaaagcaaugccuuauagauggagcagcacuuaguaaacugaaaauaggagcuau

SEQ ID NO: 65257 - RNA, 63 nt, Homo Sapiens
augugccaggcccuuugcaggaauucuacaccaagcacuuaccaaaugguaguggaauuauuu

SEQ ID NO: 65258 - RNA, 63 nt, Homo Sapiens
cagaagcagaggcuaauucauaacgguuaagaaagcacuuaaacaucgacuuagccugaguca

SEQ ID NO: 65259 - RNA, 63 nt, Homo Sapiens
uuuuuuggaaguuauuuauuccuuccaaacaaaagcacuuacuuuuauauucuuauguuauca

SEQ ID NO: 65260 - RNA, 63 nt, Homo Sapiens
uuuuccuguugagaugggggcaaccuccccaacagcacuuaggcaguuagagcggucgucggc

SEQ ID NO: 65261 - RNA, 63 nt, Homo Sapiens
guuggccucugauugcugucggagagggucagaagcacuuagcagcuaguaaccggcugugag

SEQ ID NO: 65262 - RNA, 63 nt, Homo Sapiens
cuuuagcauaaaaaauguuguauuuaccucuuuagcacuuauacgguauuuccuaucgacguu

SEQ ID NO: 65263 - RNA, 63 nt, Homo Sapiens
uuucgaaccuaaaguuuagacacaguguaaggcagcacuuaaauuagugaucaaacugccauu

SEQ ID NO: 65264 - RNA, 63 nt, Homo Sapiens
cagaguagacacaauuaaagaaugcuuuauuuaagcacuuaggauguguauuuugcuuaaugg

SEQ ID NO: 65265 - RNA, 63 nt, Homo Sapiens
guuuucaacuccaaaucaauucuaaaaacuucaagcacuuaauggaaagguaaauggucagau

SEQ ID NO: 65266 - RNA, 63 nt, Homo Sapiens
uaccagaugcugaaggcaaggggagggagcagaagcacuuauguuuacggauauuuuaaacuc

SEQ ID NO: 65267 - RNA, 63 nt, Homo Sapiens
accccucuugaaagagauuuacucaucuauccaagcacuuaauuuggaaauuuuauuguccua

SEQ ID NO: 65268 - RNA, 63 nt, Homo Sapiens
ccugaccuugacacuucccccuuuagcuauaaaagcacuuaccagccgaacguggaacaguau

SEQ ID NO: 65269 - RNA, 63 nt, Homo Sapiens
gaacgagagcaucuuguucacguuguugcacaaagcacuuaaagauuucggcaucgacacgga

SEQ ID NO: 65270 - RNA, 63 nt, Homo Sapiens
gcaacaauuguaagucgacuccacagugagcugagcacuuacaacccccucaauagccagcac

SEQ ID NO: 65271 - RNA, 63 nt, Homo Sapiens
accauuugagcuugugggucauacaaguugcuaagcacuuaggguucuccauuuuauuagaaa

SEQ ID NO: 65272 - RNA, 63 nt, Homo Sapiens
aggcugugguagaaucauaccuuuaagguuuggagcacuuacaagguguaguaauugugggua

SEQ ID NO: 65273 - RNA, 63 nt, Homo Sapiens
cauuccaaguacuuuuuuuuggaaaaaaaggguagcacuuauuaauauuuuuaugccuacuua

SEQ ID NO: 65274 - RNA, 56 nt, Homo Sapiens; identical to SEQ ID NO: 61369

SEQ ID NO: 65275 - RNA, 63 nt, Homo Sapiens
aucucaauaacuguggaaguucaauaugaugagagcacuuaagaacaggaauuauaaauaacu

SEQ ID NO: 65276 - RNA, 63 nt, Homo Sapiens
ucucucuaugcuguucuacaauccuuggcaucuagcacuuacacuuacugguuugccaaagcc

SEQ ID NO: 65277 - RNA, 63 nt, Homo Sapiens
gcuccaacuuuuuugaaugaguccucagucgccagcacuuacacagcgaggaauuaacccugu

SEQ ID NO: 65278 - RNA, 63 nt, Homo Sapiens
gugcuguuccuguggaaaaaaacuccagaaagaagcacuuagcgcgauucagugucacaaaau

SEQ ID NO: 65279 - RNA, 63 nt, Homo Sapiens
cauguuuuuaauuuucucaacaagcauuuagccagcacuuauccagugaaacaauuugauaag

SEQ ID NO: 65280 - RNA, 63 nt, Homo Sapiens
gcaggagacuugagaaguagagugacaaaaacaagcacuuaauuaaauuauaaaauuuaacuu

SEQ ID NO: 65281 - RNA, 63 nt, Homo Sapiens
gaaguggucuuugaccacaguugauugaaccagagcacuuauugcuuaaagaauaacagaguu

SEQ ID NO: 65282 - RNA, 63 nt, Homo Sapiens
cugcauccaaggcagguguuguuaaucuaucauagcacuuaaaaaaaaaaaaaaaaagagacc

SEQ ID NO: 65283 - RNA, 63 nt, Homo Sapiens
cugaucugcacaauuuaauuaugugguuauucgagcacuuaauuucacucaagguucauuggg

SEQ ID NO: 65284 - RNA, 63 nt, Homo Sapiens
aggccaggcacgguggcucacgccuauaaucccagcacuuagggaggccaaggcgggcagauc

SEQ ID NO: 65285 - RNA, 63 nt, Homo Sapiens
gcaagucuuugagauacguuuuacauguaauaaagcacuuaaugaggcacaguucuauguuuu

SEQ ID NO: 65286 - RNA, 63 nt, Homo Sapiens
aucacuaauucccuuaaggugaccagcaauugcagcacuuacaacugaagaaagaagauaaua

SEQ ID NO: 65287 - RNA, 63 nt, Homo Sapiens
aaauaauuccaggguucccuuuguacaugcuguagcacuuaaaaagcuugugggccagugucc

SEQ ID NO: 65288 - RNA, 63 nt, Homo Sapiens
uggauauaaaugcagcaacuguggcuuuugucaagcacuuagauuucaggaguaaaucuaaau

SEQ ID NO: 65289 - RNA, 63 nt, Homo Sapiens
cuaugcaggggggucuuucuggacgaucgauauagcacuuaggcgguucuuaaggcacauccg

SEQ ID NO: 65290 - RNA, 63 nt, Homo Sapiens
aaacucagagcaucugaguauaccgucaaaaccagcacuuaccgaauaaaaacugacuagaaa

SEQ ID NO: 65291 - RNA, 63 nt, Homo Sapiens
gcugaagccaucagcaucugcuaacuucacgguagcacuuacacccaucugcaccugaauccu

SEQ ID NO: 65292 - RNA, 63 nt, Homo Sapiens
gaccagaguggcccaggccauggcugguagccaagcacuuauggcauccucccagggucuggc

SEQ ID NO: 65293 - RNA, 63 nt, Homo Sapiens
cauguaucguaaguuaauacuaaaagaagagaaagcacuuaaguuucacagaagccguuaugu

SEQ ID NO: 65294 - RNA, 63 nt, Homo Sapiens
uagcuuuugugaaauagaaucagugaccaguauagcacuuagaucccuucuaacucauauaau

SEQ ID NO: 65295 - RNA, 63 nt, Homo Sapiens
ugcugcuccuauauuuuuuaagaaauauaauaaagcacuuagggcaggggaaaucaucucggu

SEQ ID NO: 65296 - RNA, 63 nt, Homo Sapiens
uucuaggauuaacugagagauuaaaggaacagcagcacuuaggcucaaaaucgccccuacaaa

SEQ ID NO: 65297 - RNA, 63 nt, Homo Sapiens
gcagaaucagguccccacggugucucacaguagagcacuuagccuagcaaugacaaccuguga

SEQ ID NO: 65298 - RNA, 63 nt, Homo Sapiens
auagugucugagacacaagauuaacauuuucaaagcacuuagaugcuuugaggucuaaaugag

SEQ ID NO: 65299 - RNA, 63 nt, Homo Sapiens
acagacuagaaaguguucuacuaacacuuguuaagcacuuacuagcugcuacugcaacaaccg

SEQ ID NO: 65300 - RNA, 63 nt, Homo Sapiens
ugaauuauugaucuuccuaaugcuguuucauacagcacuuagaaauaaagcaacuuuuguaga

SEQ ID NO: 65301 - RNA, 63 nt, Homo Sapiens
agaaaacacaaagagaaaauaugaacaauauaaagcacuuaaaggaagaggaugauuucuucc

SEQ ID NO: 65302 - RNA, 63 nt, Homo Sapiens
aggaaagcaugauauguauauugcugaguugaaagcacuuauuggaaaauauuaaaaggcuaa

SEQ ID NO: 65303 - RNA, 63 nt, Homo Sapiens
cgugagccucccagagccccaggacugggccagagcacuuagguuucuuuuuccaugguuucc

SEQ ID NO: 65304 - RNA, 63 nt, Homo Sapiens
ccgggaaagcugccccacagccucagcaucuucagcacuuaccgauccagagccucccggccu

SEQ ID NO: 65305 - RNA, 63 nt, Homo Sapiens
auuuauguuucuuuuuagauguguaccuucccaagcacuuauuuaugcagugaccuggucacc

SEQ ID NO: 65306 - RNA, 63 nt, Homo Sapiens
auauuuuucuaugagaagcacuucauagggagaagcacuuaugacaaggcuauuuuuuaaacc

SEQ ID NO: 65307 - RNA, 63 nt, Homo Sapiens
uuaaugggagcuuugccugggaccugaaccuggagcacuuaccgcauuaggaagaaaggagcu

SEQ ID NO: 65308 - RNA, 63 nt, Homo Sapiens
ugugggcagcaugcccagguuccuugcugacucagcacuuauuucuguaguuuuaaaaaagaa

SEQ ID NO: 65309 - RNA, 63 nt, Homo Sapiens
agagauaauugcaguuucacuuauacucacuucagcacuuauccaugcaauugcauauuaugu

SEQ ID NO: 65310 - RNA, 63 nt, Homo Sapiens
gauuaagaccuugcauauguuaucuauuuguugagcacuuauucaccucuugcaccaaaucaa

SEQ ID NO: 65311 - RNA, 63 nt, Homo Sapiens
ucgcugcuucugagacuucuugccaaaugaguaagcacuuaauuauauaacucacugggacau

SEQ ID NO: 65312 - RNA, 63 nt, Homo Sapiens
acacuaucuaaccuaauauguauggauuggagaagcacuuauuuaaugauaguagguauguau

SEQ ID NO: 65313 - RNA, 63 nt, Homo Sapiens
ccaguuugacugugcuagcucccaccuugccaaagcacuuacagcagauaugauggaaugcau

SEQ ID NO: 65314 - RNA, 63 nt, Homo Sapiens
ggaacagucugugagauugacuucugcagaggaagcacuuaugcagagggcuagagaaagcau

SEQ ID NO: 65315 - RNA, 63 nt, Homo Sapiens
cugcuccuuuccaccagugauuuguauuaagacagcacuuauauuguacaauacuucagacug

SEQ ID NO: 65316 - RNA, 63 nt, Homo Sapiens
uuuuaaccugaucuguagagcagagagguugaaagcacuuaacucuuguuuaguauccucauu

SEQ ID NO: 65317 - RNA, 63 nt, Homo Sapiens
agugugguucagggccagugcauauuaguggacagcacuuaguagcugugaaggaaggugcag

SEQ ID NO: 65318 - RNA, 63 nt, Homo Sapiens
uacaguaguaauuaagguacaucucuaaaguggagcacuuacaccaggcucuaagauucacuu

SEQ ID NO: 65319 - RNA, 63 nt, Homo Sapiens
uaaugagggaaguccuaggauggauagaaaaaaagcacuuacauuggggcacacaggaaaucc

SEQ ID NO: 65320 - RNA, 63 nt, Homo Sapiens
guuaggaguagauauugauuacuaucauaauucagcacuuaacuaugagccaggcaucauacu

SEQ ID NO: 65321 - RNA, 63 nt, Homo Sapiens
uugcucaauaacucuacucauuuguaucuuuucagcacuuaauuuuaauguaagaaaguuguu

SEQ ID NO: 65322 - RNA, 63 nt, Homo Sapiens
aggauggugguuagcaacaguggcccgugccaaagcacuuaccaaagugaugaugacuaaggu

SEQ ID NO: 65323 - RNA, 63 nt, Homo Sapiens
uaaauuuggcuuuagugugacgggauuugauuaagcacuuaguauagucuuuugaacacggaa

SEQ ID NO: 65324 - RNA, 63 nt, Homo Sapiens
auacaaagucuauauuauuguaucucauuuucuagcacuuaaaucacccaaacugauaacauu

SEQ ID NO: 65325 - RNA, 63 nt, Homo Sapiens
caggacuuucaugacccaaucaaggacagacauagcacuuagacagaaaacaauuguggggau

SEQ ID NO: 65326 - RNA, 63 nt, Homo Sapiens
uuacacauauuuuaauccugucugguaauaagaagcacuuaauguuuaucugugucaaguauu

SEQ ID NO: 65327 - RNA, 63 nt, Homo Sapiens
uuguugcaaguacugcuguacucauacuuauauagcacuuacugcuuaugguaauaaaaaugg

SEQ ID NO: 65328 - RNA, 63 nt, Homo Sapiens
uaggguaagcauucuuaacagggggcgcugucuagcacuuaacggagccuuguuuuucuaaag

SEQ ID NO: 65329 - RNA, 63 nt, Homo Sapiens
uauguauaaauguacauaaaaagacuuuuaccuagcacuuaaagguaguacuggaaauuuuac

SEQ ID NO: 65330 - RNA, 63 nt, Homo Sapiens
gaagaguauccuaaugaaaaugggaaugaauaaagcacuuacaagccaguaaucaaaacagac

SEQ ID NO: 65331 - RNA, 63 nt, Homo Sapiens
gacauaaaagguuaaagaacaggcaacacaaugagcacuuaaguuuuuaacauguggggaaua

SEQ ID NO: 65332 - RNA, 63 nt, Homo Sapiens
acucaguucagcaacuguuuauucuguuuauugagcacuuacuuggaccaagcacuguggucu

SEQ ID NO: 65333 - RNA, 63 nt, Homo Sapiens
ugcagguaguguuuaguuaucuacugcauuaugagcacuuaaaguacugcuagcuguagaacu

SEQ ID NO: 65334 - RNA, 63 nt, Homo Sapiens
aacuuucuauuuuuagccuauauuuggaaagaaagcacuuaacauuuuaggaauucuuuuuaa

SEQ ID NO: 65335 - RNA, 63 nt, Homo Sapiens
acggguuguaaggacaaaggauuuuaaaaucugagcacuuaggugaagggacaagcagguuua

SEQ ID NO: 65336 - RNA, 63 nt, Homo Sapiens
aaaagucuaccaaaggaauuugcauccagcagcagcacuuagaccugccagccacugucaccg

SEQ ID NO: 65337 - RNA, 63 nt, Homo Sapiens
cgcauuuguuauaaauguaguaaggcagguccaagcacuuacaaguuuuuuguaguuguuacc

SEQ ID NO: 65338 - RNA, 63 nt, Homo Sapiens
cacauuuaggaaaagacauaguauuuuauccauagcacuuauuugcuguuauuuucuacauuu

SEQ ID NO: 65339 - RNA, 63 nt, Homo Sapiens
uuguuuauauccauuuuuucacaguuuagaaagagcacuuauuaauauuuuugaaaauuuagu

SEQ ID NO: 65340 - RNA, 63 nt, Homo Sapiens
acuguguagaaacuauuuuuucuguucuuauguagcacuuaacccaucugaaggggauucuga

SEQ ID NO: 65341 - RNA, 63 nt, Homo Sapiens
uugugccagguuccacucaaauucaauuucuaaagcacuuacguaaaacauuuuacuuggcuu

SEQ ID NO: 65342 - RNA, 63 nt, Homo Sapiens
uuuuuacaguuagcacuucagccucgucgugaaagcacuuaauaaucagugggaauuaagaaa

SEQ ID NO: 65343 - RNA, 63 nt, Homo Sapiens
cuuucaucuauguuuaucacauuuuaauaccacagcacuuauaaugaugucacuacauauaga

SEQ ID NO: 65344 - RNA, 63 nt, Homo Sapiens
auuaaguacuuacuacaugcuaagagcuuuuuaagcacuuauuuaauccucauuaacaaauuc

SEQ ID NO: 65345 - RNA, 63 nt, Homo Sapiens
gauuuuuagcauuaaaaacuaaggaauauacuuagcacuuacuuaaucuuuucaguuuuccag

SEQ ID NO: 65346 - RNA, 63 nt, Homo Sapiens
aaauucccugggcacagguugcaccugggugugagcacuuaaucacucaacgcuuuguuuucu

SEQ ID NO: 65347 - RNA, 63 nt, Homo Sapiens
uauacacuuuuucuguacuuuucuguaauuuucagcacuuaugugcuuauucauugaauauuu

SEQ ID NO: 65348 - RNA, 63 nt, Homo Sapiens
aucagauucaagagaauauauaaugagagguuuagcacuuaaguaaaaaagaauuuuuaaugc

SEQ ID NO: 65349 - RNA, 63 nt, Homo Sapiens
uucugaacuagucuggggacaaggggaggagagagcacuuagugcauuugccaacaccuuuuu

SEQ ID NO: 65350 - RNA, 63 nt, Homo Sapiens
guuuucagagcacccauaucacccccuuuuuaaagcacuuacucucuaaccguaacacguccc

SEQ ID NO: 65351 - RNA, 63 nt, Homo Sapiens
cauuugcuaacucccagaauguggaaggaggggagcacuuagaaugcuuuucucuccuuaugu

SEQ ID NO: 65352 - RNA, 63 nt, Homo Sapiens
agaaaagaggcuuucuaagcaacacacagccguagcacuuagauguauuuuuacaaacacaua

SEQ ID NO: 65353 - RNA, 63 nt, Homo Sapiens
ggagggaagcggguguuggcuguuuccaaagagagcacuuaauuuaauuuuuccuuuaaauga

SEQ ID NO: 65354 - RNA, 63 nt, Homo Sapiens
auauuuaguuuugcuuucucguggauaauauuaagcacuuacucugcaguuuccuggaaguug

SEQ ID NO: 65355 - RNA, 63 nt, Homo Sapiens
uaaugguaaguaguugcuacuggccaacugucuagcacuuaccugaaaacuuaguauggagcu

SEQ ID NO: 65356 - RNA, 63 nt, Homo Sapiens
gaacagugcuugccacagagcggggacucgguaagcacuuaaugaaugaaugaauucuaaguc

SEQ ID NO: 65357 - RNA, 63 nt, Homo Sapiens
ugucuauugcaaacaauucucucaguuacguucagcacuuaagaacggcuaauggcaauagga

SEQ ID NO: 65358 - RNA, 63 nt, Homo Sapiens
aagugccaagcauuauuuuacugccgguuacugagcacuuacuaucaaugccaacaagagcau

SEQ ID NO: 65359 - RNA, 63 nt, Homo Sapiens
aauaccacagacacaguuaaaguaguuaaauacagcacuuaaaguauuugacuguaauaguau

SEQ ID NO: 65360 - RNA, 63 nt, Homo Sapiens
ucaguggguuaucucuaggaugaucaguaguucagcacuuaaaaacugcagagaaaacugaaa

SEQ ID NO: 65361 - RNA, 63 nt, Homo Sapiens
gcagggguuucccuggcgcagcgaaagucucugagcacuuaccgggcgugaccguuucuuagg

SEQ ID NO: 65362 - RNA, 63 nt, Homo Sapiens
cguuuacacagacaaagugacaucagaaggcugagcacuuaucuggaucauuuggucaguuug

SEQ ID NO: 65363 - RNA, 63 nt, Homo Sapiens
cugggaaucuaucccuaaggaauaaaaagcgccagcacuuaagauuauauguuuacuaaugua

SEQ ID NO: 65364 - RNA, 63 nt, Homo Sapiens
ugguuggggguaagacuaggucuuucuccuuuaagcacuuacauuccucuuuuuggguuuucu

SEQ ID NO: 65365 - RNA, 63 nt, Homo Sapiens
uuggcuacuaaugaagcucucacaaaacccacaagcacuuaucaaaaaaaaaaaaaaaaaaaa

SEQ ID NO: 65366 - RNA, 60 nt, Homo Sapiens; identical to SEQ ID NO: 65087

SEQ ID NO: 65367 - RNA, 63 nt, Homo Sapiens
ccuaguguucccagcacugugccugcucucaagagcacuuacugccucgcaaauaauaaaaau

SEQ ID NO: 65368 - RNA, 63 nt, Homo Sapiens
uccagaaccuaggaggaugccuaacagagaguaagcacuuaaaaaauauuugucauaugaaug

SEQ ID NO: 65369 - RNA, 63 nt, Homo Sapiens
ggagauuuaucuugaagcugaauuugcaaagcaagcacuuauaaaaauuagauuguguguuac

SEQ ID NO: 65370 - RNA, 63 nt, Homo Sapiens
aacauuuguuaauaguuacgucucuccugauguagcacuuaagcuucauuuaguuauuauuuc

SEQ ID NO: 65371 - RNA, 63 nt, Homo Sapiens
ucgaccucaucaucugggagaucgaggugccaaagcacuuagucggucggcuaauuggcaagc

SEQ ID NO: 65372 - RNA, 63 nt, Homo Sapiens
aguucaugucucguccauguccauguucguguuagcacuuacgugggaacaaauaccaauuug

SEQ ID NO: 65373 - RNA, 51 nt, Homo Sapiens; identical to SEQ ID NO: 65094

SEQ ID NO: 65374 - RNA, 63 nt, Homo Sapiens
ucccugugaauacuucagagauaagauucuaaaagcacuuauauuuuaugcucuuucuggcaa

SEQ ID NO: 65375 - RNA, 63 nt, Homo Sapiens
aaaaaaaaaucuuaagaguucaauuccuuacagagcacuuauuuuucuccuuagguccucaca

SEQ ID NO: 65376 - RNA, 63 nt, Homo Sapiens
gacaacgaacaaauucuucaaauuauuucuucaagcacuuauguucaguuccauucaugaacg

SEQ ID NO: 65377 - RNA, 63 nt, Homo Sapiens
guagcggcacugucuuggcucaggccccacggcagcacuuaugccgacguccuuuagcccucc

SEQ ID NO: 65378 - RNA, 63 nt, Homo Sapiens
ccaccugggaaccccuccgugcaguccuuaggaagcacuuacaauaccccaagaccccagagg

SEQ ID NO: 65379 - RNA, 63 nt, Homo Sapiens
guuugcaagaacagaauacacucucuuguuguuagcacuuauuccauacaagcaucagaagag

SEQ ID NO: 65380 - RNA, 63 nt, Homo Sapiens
gaucucccagcuggguuaggaugccaagcaggcagcacuuaggcugccuuggcaccgucacag

SEQ ID NO: 65381 - RNA, 63 nt, Homo Sapiens
auuucuuggccaaaguggcuuccucaagaaagcagcacuuaccuuugaaaaaugcugggaaca

SEQ ID NO: 65382 - RNA, 63 nt, Homo Sapiens
gccaagggccauuucuucucagcuugguggagcagcacuuacuuacuacuggaaaugaaaaaa

SEQ ID NO: 65383 - RNA, 63 nt, Homo Sapiens
aagucuucaucuaugcauguaaagacuguuauuagcacuuaguuugcaggaauauaaauaaua

SEQ ID NO: 65384 - RNA, 63 nt, Homo Sapiens
uaaaacauuuguuucccccacuacuggaaauguagcacuuacgcuuuugaugccaggugcaau

SEQ ID NO: 65385 - RNA, 63 nt, Homo Sapiens
ugcuaaggaaaccugaauugcgaguauaucugaagcacuuauucuccaauucaggagcccuug

SEQ ID NO: 65386 - RNA, 63 nt, Homo Sapiens
ugcagcaauuccuccauuuuuaugaaucuugugagcacuuacgcuaggagaaauuucuuuuac

SEQ ID NO: 65387 - RNA, 63 nt, Homo Sapiens
cuccuuugcaggagggcugggaauccucuuuagagcacuuaauccuauuuauccccuggaaug

SEQ ID NO: 65388 - RNA, 63 nt, Homo Sapiens
aauaugauauauucaaaugauagaauaguauacagcacuuaaaagcagugaaccagauccaua

SEQ ID NO: 65389 - RNA, 63 nt, Homo Sapiens
gggcuuuucugaggauuaaauaaauaaaugugaagcacuuagaacugauggccagcacaugag

SEQ ID NO: 65390 - RNA, 63 nt, Homo Sapiens
auuccaaacauacaagaggcucccucuuaacgcagcacuuagacacguguuguuccaccuucc

SEQ ID NO: 65391 - RNA, 63 nt, Homo Sapiens
auuccaaacauacaagaggcugccucuuaacacagcacuuagacacgugcuguuccaccuccc

SEQ ID NO: 65392 - RNA, 63 nt, Homo Sapiens
gggccgggcacggugccucacaccuguaaucccagcacuuagguaggccaagguggguggauc

SEQ ID NO: 65393 - RNA, 63 nt, Homo Sapiens
uuguaccuaaaaauucagaggaaaaccugguauagcacuuauuuauuuauguagagcauguag

SEQ ID NO: 65394 - RNA, 63 nt, Homo Sapiens
gugggcaaauugcuugaccucgccuguaaucccagcacuuaggaggcugggcacaguggcuca

SEQ ID NO: 65395 - RNA, 63 nt, Homo Sapiens
ucuucuuggaaaaggacccaucccgcuaagacuagcacuuagcccaggacugguuuccuagcc

SEQ ID NO: 65396 - RNA, 63 nt, Homo Sapiens
agcauuucugaagguuggucuuaauauuacuguagcacuuacucuuuuaaacucaauauaaug

SEQ ID NO: 65397 - RNA, 63 nt, Homo Sapiens
gauuguggauccccugagaucuggcuucccaagagcacuuauugacccuuccucaggccuccc

SEQ ID NO: 65398 - RNA, 63 nt, Homo Sapiens
acucaagcacauugguauuguauaaagguauagagcacuuagcuuacaaucuuuaaagguuuc

SEQ ID NO: 65399 - RNA, 63 nt, Homo Sapiens
uaaaugcaaaugcaacauuugcugaccaacaucagcacuuaaaaagacauggcuggaugcgcu

SEQ ID NO: 65400 - RNA, 63 nt, Homo Sapiens
gagugaccguuugaauccauaaaaaugugccccagcacuuaauacguuuauagccuugccugu

SEQ ID NO: 65401 - RNA, 63 nt, Homo Sapiens
gcuccugccguccugacgccaccccgccccaucagcacuuaagccacaugacacaaagucugu

SEQ ID NO: 65402 - RNA, 63 nt, Homo Sapiens
gccuagguguuucacugguccucuaugaaucccagcacuuauaaucccagucuuuuaucacuc

SEQ ID NO: 65403 - RNA, 63 nt, Homo Sapiens
cuaggaagcaaccuuucgccugugcagcgguccagcacuuaacucuaauacaucagcaugcgu

SEQ ID NO: 65404 - RNA, 63 nt, Homo Sapiens
aaguauuccccccugcgacaauauacagugcuuagcacuuaauaggauuaagugaaccaauac

SEQ ID NO: 65405 - RNA, 63 nt, Homo Sapiens
gccggggggggugucugccuggaaacauccuuaagcacuuaaggggaaaacagacucccuucg

SEQ ID NO: 65406 - RNA, 63 nt, Homo Sapiens
ccagccuagcuuuuuuuuuuuuuuuuuuuuuuuagcacuuaguauuuagcauuuauuaacagg

SEQ ID NO: 65407 - RNA, 63 nt, Homo Sapiens
gagcuggaaccaagaucuagauaguccguagauagcacuuaggacaagaaugugcauugaugg

SEQ ID NO: 65408 - RNA, 63 nt, Homo Sapiens
gaagucguuccaucauaaucuaugaucuuguacagcacuuauagaaauaagcuguucuuuuga

SEQ ID NO: 65409 - RNA, 63 nt, Homo Sapiens
uuaaacaauccguuuauauuacaguuuauguuaagcacuuagcuuuguuaguuauagggaugg

SEQ ID NO: 65410 - RNA, 63 nt, Homo Sapiens
gcuuucugacagaauuauagaagcaaaaugaaaagcacuuauucugguuacacauauggaagu

SEQ ID NO: 65411 - RNA, 63 nt, Homo Sapiens
acaggagccuagagcccccuagagcccuuucccagcacuuaaaccagcccauaauugggaccc

SEQ ID NO: 65412 - RNA, 63 nt, Homo Sapiens
auguuugugugggaaaaaaauguuuacauauacagcacuuaaagucuuccuucuguagagggc

SEQ ID NO: 65413 - RNA, 63 nt, Homo Sapiens
auuauuccuugauuuauucacagggaacagggaagcacuuacagcuuggagaaauggcuagga

SEQ ID NO: 65414 - RNA, 63 nt, Homo Sapiens
uaaugccgauauacucuagaguauuguuucggcagcacuuauuuguuacuguaauuccucaac

SEQ ID NO: 65415 - RNA, 64 nt, Homo Sapiens
aggaggcccuguucuuagagccccugacaaaggcagcacuuauuuccugggcuggugcgcccca

SEQ ID NO: 65416 - RNA, 64 nt, Homo Sapiens
ccagcaugacaaaauggucaaaaaauaagucaucagcacuuaagaaaugaaagcaacuuuugaa

SEQ ID NO: 65417 - RNA, 64 nt, Homo Sapiens
ugagauuuaaaaucuuaaaauguuucuuauuuucagcacuuacaucauuugguacacaggguca

SEQ ID NO: 65418 - RNA, 64 nt, Homo Sapiens
aaagccaguuucaucaaacaguucaacagagagcagcacuuaauacccuuuauacagcccauuu

SEQ ID NO: 65419 - RNA, 64 nt, Homo Sapiens; identical to SEQ ID NO: 61352

SEQ ID NO: 65420 - RNA, 64 nt, Homo Sapiens; identical to SEQ ID NO: 61353

SEQ ID NO: 65421 - RNA, 64 nt, Homo Sapiens
aaugaggaugaggaauaauaaacucuuuuuggcaagcacuuaaauguucugaaauuuguauaag

SEQ ID NO: 65422 - RNA, 64 nt, Homo Sapiens
uagguaaguuuuauaagggaguacauuuugacugagcacuuagggcaucaggaacagugcuacu

SEQ ID NO: 65423 - RNA, 64 nt, Homo Sapiens
uauggcauaccaaucugugcggggcaguguccuaagcacuuagacuacaucagggaagaacaca

SEQ ID NO: 65424 - RNA, 64 nt, Homo Sapiens
uuaaauaucuuaaaauaucuaaaacauuuuuuaaagcacuuagauugucuuacguaugugcaua

SEQ ID NO: 65425 - RNA, 64 nt, Homo Sapiens
ggaaacugucugucuaauggucacagagcacuguagcacuuaacagauugccauggacaccagu

SEQ ID NO: 65426 - RNA, 64 nt, Homo Sapiens
aggcaccgccacgucccagcgacgcacacagcugagcacuuagcugggcccucuuucccugcga

SEQ ID NO: 65427 - RNA, 64 nt, Homo Sapiens; identical to SEQ ID NO: 61354

SEQ ID NO: 65428 - RNA, 64 nt, Homo Sapiens; identical to SEQ ID NO: 61355

SEQ ID NO: 65429 - RNA, 64 nt, Homo Sapiens
caguuagucauggagaguaauuuauuccauuuuaagcacuuacagggguuauguagaaaagcaa

SEQ ID NO: 65430 - RNA, 64 nt, Homo Sapiens
cccccugagcagcgagccuggccuacuggagcccagcacuuacugccucagugggccuguggga

SEQ ID NO: 65431 - RNA, 64 nt, Homo Sapiens
aggcucuugggaugcagcaaucuacuaggaaaggagcacuuagggguuucuucuaccacccaau

SEQ ID NO: 65432 - RNA, 64 nt, Homo Sapiens
acaguauaugaaauaaugggggaaaugaauguaaagcacuuaguuguugugaggauuaaaauga

SEQ ID NO: 65433 - RNA, 64 nt, Homo Sapiens
uccaugacagggucuaaaauuauuaguuuaccugagcacuuauuuucugggggugaaagaaaaa

SEQ ID NO: 65434 - RNA, 64 nt, Homo Sapiens
ugaagucaguggccuggaucguauguuaaaauagagcacuuaccucaaauagaaucuuauaucu

SEQ ID NO: 65435 - RNA, 64 nt, Homo Sapiens
auuguaugucuccucaaaugauugacaaaaaaugagcacuuacaacacauaauggugucuuaaa

SEQ ID NO: 65436 - RNA, 64 nt, Homo Sapiens
acaaagccuagcacaaaguauuuucuguguccccagcacuuacagagggcaggauugucuuuuu

SEQ ID NO: 65437 - RNA, 64 nt, Homo Sapiens
uuacugguguccagcugaguucuuuucaaugaauagcacuuaugggucagcgcucuugcuuugc

SEQ ID NO: 65438 - RNA, 64 nt, Homo Sapiens
guaauguauuauaccuaaauguuuguaucuaaauagcacuuacuaaauauauaguauguuuuaa

SEQ ID NO: 65439 - RNA, 64 nt, Homo Sapiens
ggagcagagaugcagccaguccccaaauucauugagcacuuaaacuuuuuucuuuccucccuua

SEQ ID NO: 65440 - RNA, 64 nt, Homo Sapiens
aaucagccuaacauaagaucuaacugcccaaagcagcacuuauacucauuguaaacaaacugug

SEQ ID NO: 65441 - RNA, 64 nt, Homo Sapiens; identical to SEQ ID NO: 61356

SEQ ID NO: 65442 - RNA, 64 nt, Homo Sapiens; identical to SEQ ID NO: 61357

SEQ ID NO: 65443 - RNA, 64 nt, Homo Sapiens
ucuucccauuucaaaagguauaguuuggcuggggagcacuuaauugaagguggcuuuugcuuua

SEQ ID NO: 65444 - RNA, 64 nt, Homo Sapiens
uguggagauacuguaaccugugcacuauauucuaagcacuuacaucucuauucuuauuauucac

SEQ ID NO: 65445 - RNA, 64 nt, Homo Sapiens
ugaguaaauaaugcagcucacaucacccauccuaagcacuuacgcauuuccugucuuucccguc

SEQ ID NO: 65446 - RNA, 64 nt, Homo Sapiens
cccacguucucaagggcagaccgccggugugaugagcacuuacauccucccucgagaaacagug

SEQ ID NO: 65447 - RNA, 64 nt, Homo Sapiens
guaucuuggcugucaagaguaucaaaugccaugcagcacuuaaacuugugauaaggaagaugaa

SEQ ID NO: 65448 - RNA, 64 nt, Homo Sapiens
gccauuuaauuagcugcauaucaccuuaggguacagcacuuaacgcaaucugccucaauuucuu

SEQ ID NO: 65449 - RNA, 64 nt, Homo Sapiens
ggggcugagugcaguggcucaugccuguaaucccagcacuuagggugccaauguggauuaccug

SEQ ID NO: 65450 - RNA, 64 nt, Homo Sapiens
gcuuuuagaccucuuacuuccacugcuaguagcuagcacuuacugagcaccugcgaugagguaa

SEQ ID NO: 65451 - RNA, 64 nt, Homo Sapiens
ugggauuucagauaugaacgguguaaauuugagaagcacuuaugcauacaugugggugaaaaac

SEQ ID NO: 65452 - RNA, 64 nt, Homo Sapiens
aaguucuuguuuuuauuuuugaaaguacucacacagcacuuacuaugcuccaaacacuccucua

SEQ ID NO: 65453 - RNA, 64 nt, Homo Sapiens
gauuugccucaacaacguaaacuuccuaaugauuagcacuuaauaauugcauauaaaaugcuuu

SEQ ID NO: 65454 - RNA, 64 nt, Homo Sapiens
uuugggacaauuguuuuaaucugaaauucuaaagagcacuuacuguaaccuguugcuguguuua

SEQ ID NO: 65455 - RNA, 64 nt, Homo Sapiens
gguaggaccaagcaucuugggcucacacaccuguagcacuuacuuccugcggguggggcuuggg

SEQ ID NO: 65456 - RNA, 64 nt, Homo Sapiens
cgaccccaaggugccagagacgagggcaguagagagcacuuacccgagauaaaggcagcuaaaa

SEQ ID NO: 65457 - RNA, 64 nt, Homo Sapiens
uguuagaucuaacguguuccuacugcccuuucaaagcacuuaagugaauuccuuggggauuuuu

SEQ ID NO: 65458 - RNA, 64 nt, Homo Sapiens
gacuucauuuguucaagaauaaugaaauuuaaugagcacuuaguuaacagaggcauauauuuaa

SEQ ID NO: 65459 - RNA, 64 nt, Homo Sapiens
ucuuccuuaaaugacuuuucuacacuccacuugaagcacuuaagaaacauuuuuuagucuguaa

SEQ ID NO: 65460 - RNA, 64 nt, Homo Sapiens
aggggagcacaucuuguaauaaaugggccaucccagcacuuauagcuccuaaacaagagaauaa

SEQ ID NO: 65461 - RNA, 64 nt, Homo Sapiens
guaagaaguaaaaguagugccaaucagcgauaucagcacuuacagccuuucuugugaaaguuuu

SEQ ID NO: 65462 - RNA, 64 nt, Homo Sapiens
cacacugugugugauuuuguuucuuuuguuaagcagcacuuauguagacugcauuuccaaaugu

SEQ ID NO: 65463 - RNA, 64 nt, Homo Sapiens
cauaguacagaagauucuuuguuuuucuccacugagcacuuaacaauugcuuucucucuggccu

SEQ ID NO: 65464 - RNA, 64 nt, Homo Sapiens
gugauauacaaaguguaccaacauaaguguugguagcacuuaagacuuauacuugccuucugau

SEQ ID NO: 65465 - RNA, 64 nt, Homo Sapiens; identical to SEQ ID NO: 61358

SEQ ID NO: 65466 - RNA, 64 nt, Homo Sapiens; identical to SEQ ID NO: 61359

SEQ ID NO: 65467 - RNA, 64 nt, Homo Sapiens
aucaagauauauaucuggaaccucuuauaaauggagcacuuagaaauuuguuguucugcacuua

SEQ ID NO: 65468 - RNA, 64 nt, Homo Sapiens
uucauuagcucagugacuuguccacacucgucuuagcacuuacguuucaaaagcuugucacaaa

SEQ ID NO: 65469 - RNA, 64 nt, Homo Sapiens
guacugaugucucagugaaucagucuguuuauuaagcacuuaucagggcuuccacacacuuauu

SEQ ID NO: 65470 - RNA, 64 nt, Homo Sapiens
auguggagggcugcaaucugucuugauuucuccaagcacuuaacuuucuuugacugcacugaga

SEQ ID NO: 65471 - RNA, 64 nt, Homo Sapiens
uuucaggucuuugcucauucacucaguaauacugagcacuuaccauguaccagaauuuuacuag

SEQ ID NO: 65472 - RNA, 64 nt, Homo Sapiens
aauuuaaauaauguaaacgcaaacaggguuugauagcacuuaaacuaguucauuucaaaauuaa

SEQ ID NO: 65473 - RNA, 64 nt, Homo Sapiens
aaaaugaguaaaauaauuaaugaaacauauuuagagcacuuaauggucucuguuuucaauauaa

SEQ ID NO: 65474 - RNA, 64 nt, Homo Sapiens
aaugauuagugucaguauuuuauucuucugaaauagcacuuaaauaacuuagaaacauugcgca

SEQ ID NO: 65475 - RNA, 64 nt, Homo Sapiens
agccuucugacuuaggguuugagucccagcccugagcacuuaggagucaaaaggcccagagucu

SEQ ID NO: 65476 - RNA, 64 nt, Homo Sapiens
aguuacauguuguaaucaaguuauucuauuuuaaagcacuuaugccuuuuaagucagggaugcu

SEQ ID NO: 65477 - RNA, 64 nt, Homo Sapiens
uuaauccaguagagacuugcaggcuugugaauauagcacuuauugucuuuguuauaauucauau

SEQ ID NO: 65478 - RNA, 64 nt, Homo Sapiens
ggaaauguaaaguagaaaaauuauucaaacaaacagcacuuacacguaaccucacacauuaacu

SEQ ID NO: 65479 - RNA, 64 nt, Homo Sapiens
auuuucccucuucacuuggugauuuaaguuucacagcacuuacaucaaugggaaaaaacaccag

SEQ ID NO: 65480 - RNA, 64 nt, Homo Sapiens
uccuuuuccacuuuaaauuucauauuccugguguagcacuuaacuuaugguuucauguaacaua

SEQ ID NO: 65481 - RNA, 64 nt, Homo Sapiens
agagugcauagcauacacugacuaauagaugcauagcacuuaacgucugaugaggaaaagauua

SEQ ID NO: 65482 - RNA, 64 nt, Homo Sapiens
agaauauuuuaaguauugcacuuuauugagaaagagcacuuaaggcagacacggaucugagaau

SEQ ID NO: 65483 - RNA, 64 nt, Homo Sapiens
auuauugauguuuucauagagaauauaaaaauaaagcacuuauagaaaaaacucguuugauuuu

SEQ ID NO: 65484 - RNA, 64 nt, Homo Sapiens
augcauuugucauacguuucuacuuaaauuauuaagcacuuacgauuuagauguaauaauuaua

SEQ ID NO: 65485 - RNA, 64 nt, Homo Sapiens
gcuacuuuugugggaguauuucuauuauauaaccagcacuuacuaccuguacucaaaauucagc

SEQ ID NO: 65486 - RNA, 64 nt, Homo Sapiens
augaaauaaaaaaaaacuuuggauaagaugggacagcacuuauaugaugaggaagaagacaauu

SEQ ID NO: 65487 - RNA, 64 nt, Homo Sapiens
agacuggugacaacuggcuggcaguuaacccuguagcacuuacuauauuucagucaguccagag

SEQ ID NO: 65488 - RNA, 64 nt, Homo Sapiens
uuucccaauuuauuaaauugauucuuuguuguuuagcacuuaaauuaugaaucaccugaguaca

SEQ ID NO: 65489 - RNA, 64 nt, Homo Sapiens
gauaggccuucuugugaucugcaccuuaucuuaaagcacuuacacgacauugcagucugcuucu

SEQ ID NO: 65490 - RNA, 64 nt, Homo Sapiens
guaggguuauggaaucuaguaauaaaauuucaacagcacuuaaacugaaguuuggguugcucau

SEQ ID NO: 65491 - RNA, 64 nt, Homo Sapiens
uucacacaugccuauauuaucauaagaauuuuucagcacuuaacuacuuuguuggcauugaucc

SEQ ID NO: 65492 - RNA, 64 nt, Homo Sapiens
cucaagggaaaauacucaaagaaagaaaaguggcagcacuuauauuaguuuuauaacaggauaa

SEQ ID NO: 65493 - RNA, 64 nt, Homo Sapiens
aagcuuacauuacauguccaguccacauuuaaagagcacuuacuguggaacaagccuucagcca

SEQ ID NO: 65494 - RNA, 64 nt, Homo Sapiens
uuuuugaauucuuuagauuuuuaaauuggagaaaagcacuuaaaguuuuuuauauaugaauauu

SEQ ID NO: 65495 - RNA, 64 nt, Homo Sapiens
ccauugugcacuaugggaggccgcugcugcguggagcacuuaaaguccagccuccaggaccgga

SEQ ID NO: 65496 - RNA, 64 nt, Homo Sapiens
gguccagagagcuuuauggaagcgggagaggaggagcacuuacucauguuguauuuguuaaugg

SEQ ID NO: 65497 - RNA, 64 nt, Homo Sapiens
augaguucauuuuuaggugacuuguuuauuaguuagcacuuagauacacuggggauguuauuua

SEQ ID NO: 65498 - RNA, 64 nt, Homo Sapiens
uaaccagaugauaaugaacuuggcaaauacagugagcacuuaugucauauuuuaggauuauuuu

SEQ ID NO: 65499 - RNA, 64 nt, Homo Sapiens
cucugugacaguauugugugaaaaguggcauggcagcacuuauguggcugugaguagaauaugu

SEQ ID NO: 65500 - RNA, 64 nt, Homo Sapiens
cucaguuuggucaccuguaaaaggaaauaacaagagcacuuacuuuauaagauugaugugagua

SEQ ID NO: 65501 - RNA, 64 nt, Homo Sapiens
cacucuaaaagcacugaccucaaaaaaccuuauaagcacuuagauuuaauugcauuuuccauag

SEQ ID NO: 65502 - RNA, 64 nt, Homo Sapiens
uucugauaaugaaaauuaugauaaggaugauaaaagcacuuacuucguguccgacucuucugag

SEQ ID NO: 65503 - RNA, 64 nt, Homo Sapiens
ugagucuccaaauaauaauagccgacguuuauugagcacuuacuaugugcccaacccuguuaug

SEQ ID NO: 65504 - RNA, 64 nt, Homo Sapiens
ucaguuuccugaccuaugaaacagagaaaauaaaagcacuuauuuauuguuguuggaggcugca

SEQ ID NO: 65505 - RNA, 64 nt, Homo Sapiens
aaauaaccucaccccaaauacaauaaagggacgaagcacuuauagauaccacagacacaugugu

SEQ ID NO: 65506 - RNA, 64 nt, Homo Sapiens
cuaccugaccuugugcgcugggaggcgcaucugcagcacuuacaggugagggauggggagaugg

SEQ ID NO: 65507 - RNA, 64 nt, Homo Sapiens
gcaaggagacacaugccaccccagcaguacacaaagcacuuaccuugacuggugaagucagcca

SEQ ID NO: 65508 - RNA, 64 nt, Homo Sapiens
auagcuuucauuuacauagugcuuacauuuauauagcacuuacuaugugcgauguacuaauuua

SEQ ID NO: 65509 - RNA, 64 nt, Homo Sapiens; identical to SEQ ID NO: 61360

SEQ ID NO: 65510 - RNA, 64 nt, Homo Sapiens; identical to SEQ ID NO: 61361

SEQ ID NO: 65511 - RNA, 64 nt, Homo Sapiens
auugucaucucauauugaucagguauuuuaaucuagcacuuacauauuguugauaaaugaaagc

SEQ ID NO: 65512 - RNA, 64 nt, Homo Sapiens
gcagagacuguuaauggccccuuacccugggugaagcacuuacccuuggaacagaacucuaaaa

SEQ ID NO: 65513 - RNA, 64 nt, Homo Sapiens
auauauuauuuucuucuccuuuauauguaaugaaagcacuuauaaagaaacaggaaucauuaga

SEQ ID NO: 65514 - RNA, 64 nt, Homo Sapiens
agguuagucucauuuagaaaaaucgaaagugcacagcacuuaaagggaauauaugagguuuuuu

SEQ ID NO: 65515 - RNA, 64 nt, Homo Sapiens
ucaaccugauccucaugcugauagaaugacagcuagcacuuauuuccuaagugcaacuguuuua

SEQ ID NO: 65516 - RNA, 64 nt, Homo Sapiens
acccccuccaaagauggaguguagaaaugaugacagcacuuaguaaguucaaagaugacauuca

SEQ ID NO: 65517 - RNA, 64 nt, Homo Sapiens
ccagcugggcacgguggcucacgccuguaaucccagcacuuacuuugggaggccaaggugggca

SEQ ID NO: 65518 - RNA, 64 nt, Homo Sapiens
agugcgguucucuuugacccccaaagacaagacaagcacuuauuuuuauuuucagaagacaaaa

SEQ ID NO: 65519 - RNA, 64 nt, Homo Sapiens
auuuucagcuuuuuaaagcauuuuguggccuuccagcacuuacuaugggaagacacauguuaag

SEQ ID NO: 65520 - RNA, 64 nt, Homo Sapiens
ugagguggggguguucaccuagguguggggguuaagcacuuauucaauugguaaaggaaagagc

SEQ ID NO: 65521 - RNA, 64 nt, Homo Sapiens
aagaccgggcauugggcugguaaaguauucacugagcacuuaggcuuuagggccggucaggccc

SEQ ID NO: 65522 - RNA, 64 nt, Homo Sapiens
uacuccugauucuuaacauuaauuuguaaccacuagcacuuaagugaaaaacugaagagaacaa

SEQ ID NO: 65523 - RNA, 64 nt, Homo Sapiens
uuauauaaagggcuguuugugccaacauuuauccagcacuuaccaggcuuauuuuauuauagua

SEQ ID NO: 65524 - RNA, 64 nt, Homo Sapiens
cccuccuggggagacgugacucugguggacgcagagcacuuaguuacccuggacgcuccccaca

SEQ ID NO: 65525 - RNA, 64 nt, Homo Sapiens
uauuucuuaauuauuauaaaaauauuaagacaauagcacuuaaauuccucaacaguguuuucag

SEQ ID NO: 65526 - RNA, 64 nt, Homo Sapiens
uaaacaaaaauuuuucuuucuuuacugcaugcauagcacuuaauaaaauggauuuuuaaaaaau

SEQ ID NO: 65527 - RNA, 64 nt, Homo Sapiens
acaaaaagugucucugccuugagucaucuauucaagcacuuacagcucuggccacaacagggca

SEQ ID NO: 65528 - RNA, 64 nt, Homo Sapiens
uuccucagugccuguccauaacugugaaguauuaagcacuuagggccagaugcacuguaaacau

SEQ ID NO: 65529 - RNA, 64 nt, Homo Sapiens; identical to SEQ ID NO: 61362

SEQ ID NO: 65530 - RNA, 64 nt, Homo Sapiens; identical to SEQ ID NO: 61363

SEQ ID NO: 65531 - RNA, 64 nt, Homo Sapiens; identical to SEQ ID NO: 61364

SEQ ID NO: 65532 - RNA, 64 nt, Homo Sapiens; identical to SEQ ID NO: 61365

SEQ ID NO: 65533 - RNA, 64 nt, Homo Sapiens
ccucaucucccuguccucugagauaauaugagugagcacuuagguaucauaucagaugcucaag

SEQ ID NO: 65534 - RNA, 64 nt, Homo Sapiens
cauuucuagcauauggacaccuggccucugcuugagcacuuaggugacaggaacuuccgcaccu

SEQ ID NO: 65535 - RNA, 64 nt, Homo Sapiens
gcuucauagaaagcaaugccuuuauagauggagcagcacuuagucaaacugaaaauaggagcua

SEQ ID NO: 65536 - RNA, 64 nt, Homo Sapiens
augugccaggcccuuugcagugaauucuacaccaagcacuuaccgaaaugguaguggaauuauu

SEQ ID NO: 65537 - RNA, 64 nt, Homo Sapiens
cagaagcagaggcuaauucaauaacgguuaagaaagcacuuaaaucaucgacuuagccugaguc

SEQ ID NO: 65538 - RNA, 64 nt, Homo Sapiens
uuuuuuggaaguuauuuauuaccuuccaaacaaaagcacuuacuguuuauauucuuauguuauc

SEQ ID NO: 65539 - RNA, 64 nt, Homo Sapiens
uuuuccuguugagaugggggccaaccuccccaacagcacuuagggcaguuagagcggucgucgg

SEQ ID NO: 65540 - RNA, 64 nt, Homo Sapiens
guuggccucugauugcugucgggagagggucagaagcacuuagccagcuaguaaccggcuguga

SEQ ID NO: 65541 - RNA, 64 nt, Homo Sapiens
cuuuagcauaaaaaauguuguuauuuaccucuuuagcacuuauaucgguauuuccuaucgacgu

SEQ ID NO: 65542 - RNA, 64 nt, Homo Sapiens
uuucgaaccuaaaguuuagaucacaguguaaggcagcacuuaaauuuagugaucaaacugccau

SEQ ID NO: 65543 - RNA, 64 nt, Homo Sapiens
cagaguagacacaauuaaaggaaugcuuuauuuaagcacuuaggcauguguauuuugcuuaaug

SEQ ID NO: 65544 - RNA, 64 nt, Homo Sapiens
uguuuucaacuccaaaucaauucuaaaaacuucaagcacuuaauggaaagguaaauggucagau

SEQ ID NO: 65545 - RNA, 64 nt, Homo Sapiens
uuaccagaugcugaaggcaaggggagggagcagaagcacuuauguuuacggauauuuuaaacuc

SEQ ID NO: 65546 - RNA, 64 nt, Homo Sapiens
uaccccucuugaaagagauuuacucaucuauccaagcacuuaauuuggaaauuuuauuguccua

SEQ ID NO: 65547 - RNA, 64 nt, Homo Sapiens
cccugaccuugacacuucccccuuuagcuauaaaagcacuuaccagccgaacguggaacaguau

SEQ ID NO: 65548 - RNA, 64 nt, Homo Sapiens; identical to SEQ ID NO: 61366

SEQ ID NO: 65549 - RNA, 64 nt, Homo Sapiens; identical to SEQ ID NO: 61367

SEQ ID NO: 65550 - RNA, 64 nt, Homo Sapiens
accauuugagcuugugggucaauacaaguugcuaagcacuuaggaguucuccauuuuauuagaa

SEQ ID NO: 65551 - RNA, 64 nt, Homo Sapiens
aggcugugguagaaucauacacuuuaagguuuggagcacuuacacagguguaguaauugugggu

SEQ ID NO: 65552 - RNA, 64 nt, Homo Sapiens; identical to SEQ ID NO: 61368

SEQ ID NO: 65553 - RNA, 56 nt, Homo Sapiens; identical to SEQ ID NO: 61369

SEQ ID NO: 65554 - RNA, 64 nt, Homo Sapiens
aucucaauaacuguggaaguuucaauaugaugagagcacuuaaguaacaggaauuauaaauaac

SEQ ID NO: 65555 - RNA, 64 nt, Homo Sapiens
ucucucuaugcuguucuacacauccuuggcaucuagcacuuacaccuuacugguuugccaaagc

SEQ ID NO: 65556 - RNA, 64 nt, Homo Sapiens
gcuccaacuuuuuugaaugauguccucagucgccagcacuuacagcagcgaggaauuaacccug

SEQ ID NO: 65557 - RNA, 64 nt, Homo Sapiens
gugcuguuccuguggaaaaauaacuccagaaagaagcacuuagcggcgauucagugucacaaaa

SEQ ID NO: 65558 - RNA, 64 nt, Homo Sapiens
acauguuuuuaauuuucucaacaagcauuuagccagcacuuauccagugaaacaauuugauaag

SEQ ID NO: 65559 - RNA, 64 nt, Homo Sapiens
agcaggagacuugagaaguagagugacaaaaacaagcacuuaauuaaauuauaaaauuuaacuu

SEQ ID NO: 65560 - RNA, 64 nt, Homo Sapiens
ugaaguggucuuugaccacaguugauugaaccagagcacuuauugcuuaaagaauaacagaguu

SEQ ID NO: 65561 - RNA, 64 nt, Homo Sapiens
ccugcauccaaggcagguguuguuaaucuaucauagcacuuaaaaaaaaaaaaaaaaagagacc

SEQ ID NO: 65562 - RNA, 64 nt, Homo Sapiens
gcugaucugcacaauuuaauuaugugguuauucgagcacuuaauuucacucaagguucauuggg

SEQ ID NO: 65563 - RNA, 64 nt, Homo Sapiens
caggccaggcacgguggcucacgccuauaaucccagcacuuagggaggccaaggcgggcagauc

SEQ ID NO: 65564 - RNA, 64 nt, Homo Sapiens
gcaagucuuugagauacguuuuuacauguaauaaagcacuuaaucgaggcacaguucuauguuu

SEQ ID NO: 65565 - RNA, 64 nt, Homo Sapiens
aucacuaauucccuuaagguagaccagcaauugcagcacuuacaaacugaagaaagaagauaau

SEQ ID NO: 65566 - RNA, 64 nt, Homo Sapiens
aaauaauuccaggguucccucuuguacaugcuguagcacuuaaacaagcuugugggccaguguc

SEQ ID NO: 65567 - RNA, 64 nt, Homo Sapiens
uggauauaaaugcagcaacuuguggcuuuugucaagcacuuagaguuucaggaguaaaucuaaa

SEQ ID NO: 65568 - RNA, 64 nt, Homo Sapiens
cuaugcaggggggucuuucugggacgaucgauauagcacuuaggacgguucuuaaggcacaucc

SEQ ID NO: 65569 - RNA, 64 nt, Homo Sapiens
aaacucagagcaucugaguaauaccgucaaaaccagcacuuaccagaauaaaaacugacuagaa

SEQ ID NO: 65570 - RNA, 64 nt, Homo Sapiens
gcugaagccaucagcaucugucuaacuucacgguagcacuuacaccccaucugcaccugaaucc

SEQ ID NO: 65571 - RNA, 64 nt, Homo Sapiens
gaccagaguggcccaggccacuggcugguagccaagcacuuaugggcauccucccagggucugg

SEQ ID NO: 65572 - RNA, 64 nt, Homo Sapiens
ucauguaucguaaguuaauacuaaaagaagagaaagcacuuaaguuucacagaagccguuaugu

SEQ ID NO: 65573 - RNA, 64 nt, Homo Sapiens
guagcuuuugugaaauagaaucagugaccaguauagcacuuagaucccuucuaacucauauaau

SEQ ID NO: 65574 - RNA, 64 nt, Homo Sapiens; identical to SEQ ID NO: 61370

SEQ ID NO: 65575 - RNA, 64 nt, Homo Sapiens; identical to SEQ ID NO: 61371

SEQ ID NO: 65576 - RNA, 64 nt, Homo Sapiens
gcagaaucagguccccacggaugucucacaguagagcacuuagcucuagcaaugacaaccugug

SEQ ID NO: 65577 - RNA, 64 nt, Homo Sapiens
auagugucugagacacaagaguuaacauuuucaaagcacuuagauugcuuugaggucuaaauga

SEQ ID NO: 65578 - RNA, 64 nt, Homo Sapiens
acagacuagaaaguguucuagcuaacacuuguuaagcacuuacucagcugcuacugcaacaacc

SEQ ID NO: 65579 - RNA, 64 nt, Homo Sapiens
ugaauuauugaucuuccuaaaugcuguuucauacagcacuuagagaauaaagcaacuuuuguag

SEQ ID NO: 65580 - RNA, 64 nt, Homo Sapiens
aagaaaacacaaagagaaaauaugaacaauauaaagcacuuaaaggaagaggaugauuucuucc

SEQ ID NO: 65581 - RNA, 64 nt, Homo Sapiens
gaggaaagcaugauauguauauugcugaguugaaagcacuuauuggaaaauauuaaaaggcuaa

SEQ ID NO: 65582 - RNA, 64 nt, Homo Sapiens
gcgugagccucccagagccccaggacugggccagagcacuuagguuucuuuuuccaugguuucc

SEQ ID NO: 65583 - RNA, 64 nt, Homo Sapiens
cccgggaaagcugccccacagccucagcaucuucagcacuuaccgauccagagccucccggccu

SEQ ID NO: 65584 - RNA, 64 nt, Homo Sapiens
uauuuauguuucuuuuuagauguguaccuucccaagcacuuauuuaugcagugaccuggucacc

SEQ ID NO: 65585 - RNA, 64 nt, Homo Sapiens
uauauuuuucuaugagaagcacuucauagggagaagcacuuaugacaaggcuauuuuuuaaacc

SEQ ID NO: 65586 - RNA, 64 nt, Homo Sapiens
cuuaaugggagcuuugccugggaccugaaccuggagcacuuaccgcauuaggaagaaaggagcu

SEQ ID NO: 65587 - RNA, 64 nt, Homo Sapiens
augugggcagcaugcccagguuccuugcugacucagcacuuauuucuguaguuuuaaaaaagaa

SEQ ID NO: 65588 - RNA, 64 nt, Homo Sapiens
agagauaauugcaguuucacuuuauacucacuucagcacuuaucucaugcaauugcauauuaug

SEQ ID NO: 65589 - RNA, 64 nt, Homo Sapiens
gauuaagaccuugcauauguauaucuauuuguugagcacuuauuccaccucuugcaccaaauca

SEQ ID NO: 65590 - RNA, 64 nt, Homo Sapiens
ucgcugcuucugagacuucuuugccaaaugaguaagcacuuaauuuauauaacucacugggaca

SEQ ID NO: 65591 - RNA, 64 nt, Homo Sapiens
acacuaucuaaccuaauauguuauggauuggagaagcacuuauuauaaugauaguagguaugua

SEQ ID NO: 65592 - RNA, 64 nt, Homo Sapiens
ccaguuugacugugcuagcuucccaccuugccaaagcacuuacaugcagauaugauggaaugca

SEQ ID NO: 65593 - RNA, 64 nt, Homo Sapiens
ggaacagucugugagauugaucuucugcagaggaagcacuuaugacagagggcuagagaaagca

SEQ ID NO: 65594 - RNA, 64 nt, Homo Sapiens
ccugcuccuuuccaccagugauuuguauuaagacagcacuuauauuguacaauacuucagacug

SEQ ID NO: 65595 - RNA, 64 nt, Homo Sapiens
uuuuuaaccugaucuguagagcagagagguugaaagcacuuaacucuuguuuaguauccucauu

SEQ ID NO: 65596 - RNA, 64 nt, Homo Sapiens
aagugugguucagggccagugcauauuaguggacagcacuuaguagcugugaaggaaggugcag

SEQ ID NO: 65597 - RNA, 64 nt, Homo Sapiens
auacaguaguaauuaagguacaucucuaaaguggagcacuuacaccaggcucuaagauucacuu

SEQ ID NO: 65598 - RNA, 64 nt, Homo Sapiens
guaaugagggaaguccuaggauggauagaaaaaaagcacuuacauuggggcacacaggaaaucc

SEQ ID NO: 65599 - RNA, 64 nt, Homo Sapiens
gguuaggaguagauauugauuacuaucauaauucagcacuuaacuaugagccaggcaucauacu

SEQ ID NO: 65600 - RNA, 64 nt, Homo Sapiens
uuugcucaauaacucuacucauuuguaucuuuucagcacuuaauuuuaauguaagaaaguuguu

SEQ ID NO: 65601 - RNA, 64 nt, Homo Sapiens
caggauggugguuagcaacaguggcccgugccaaagcacuuaccaaagugaugaugacuaaggu

SEQ ID NO: 65602 - RNA, 64 nt, Homo Sapiens
cuaaauuuggcuuuagugugacgggauuugauuaagcacuuaguauagucuuuugaacacggaa

SEQ ID NO: 65603 - RNA, 64 nt, Homo Sapiens
auacaaagucuauauuauuguuaucucauuuucuagcacuuaaauucacccaaacugauaacau

SEQ ID NO: 65604 - RNA, 64 nt, Homo Sapiens
caggacuuucaugacccaauucaaggacagacauagcacuuagaccagaaaacaauugugggga

SEQ ID NO: 65605 - RNA, 64 nt, Homo Sapiens
uuacacauauuuuaauccuguucugguaauaagaagcacuuaauuguuuaucugugucaaguau

SEQ ID NO: 65606 - RNA, 64 nt, Homo Sapiens
uuguugcaaguacugcuguagcucauacuuauauagcacuuacuugcuuaugguaauaaaaaug

SEQ ID NO: 65607 - RNA, 64 nt, Homo Sapiens
uaggguaagcauucuuaacaggggggcgcugucuagcacuuaaccggagccuuguuuuucuaaa

SEQ ID NO: 65608 - RNA, 64 nt, Homo Sapiens
uauguauaaauguacauaaacaagacuuuuaccuagcacuuaaaugguaguacuggaaauuuua

SEQ ID NO: 65609 - RNA, 64 nt, Homo Sapiens
gaagaguauccuaaugaaaacugggaaugaauaaagcacuuacacagccaguaaucaaaacaga

SEQ ID NO: 65610 - RNA, 64 nt, Homo Sapiens
ugacauaaaagguuaaagaacaggcaacacaaugagcacuuaaguuuuuaacauguggggaaua

SEQ ID NO: 65611 - RNA, 64 nt, Homo Sapiens
gacucaguucagcaacuguuuauucuguuuauugagcacuuacuuggaccaagcacuguggucu

SEQ ID NO: 65612 - RNA, 64 nt, Homo Sapiens; identical to SEQ ID NO: 61372

SEQ ID NO: 65613 - RNA, 64 nt, Homo Sapiens; identical to SEQ ID NO: 61373

SEQ ID NO: 65614 - RNA, 64 nt, Homo Sapiens
cacggguuguaaggacaaaggauuuuaaaaucugagcacuuaggugaagggacaagcagguuua

SEQ ID NO: 65615 - RNA, 64 nt, Homo Sapiens
aaaaagucuaccaaaggaauuugcauccagcagcagcacuuagaccugccagccacugucaccg

SEQ ID NO: 65616 - RNA, 64 nt, Homo Sapiens
ucgcauuuguuauaaauguaguaaggcagguccaagcacuuacaaguuuuuuguaguuguuacc

SEQ ID NO: 65617 - RNA, 64 nt, Homo Sapiens; identical to SEQ ID NO: 61374

SEQ ID NO: 65618 - RNA, 64 nt, Homo Sapiens; identical to SEQ ID NO: 61375

SEQ ID NO: 65619 - RNA, 64 nt, Homo Sapiens
acuguguagaaacuauuuuuaucuguucuuauguagcacuuaacgccaucugaaggggauucug

SEQ ID NO: 65620 - RNA, 64 nt, Homo Sapiens
uugugccagguuccacucaauauucaauuucuaaagcacuuacguuaaaacauuuuacuuggcu

SEQ ID NO: 65621 - RNA, 64 nt, Homo Sapiens
uuuuuacaguuagcacuucaagccucgucgugaaagcacuuaauaaaucagugggaauuaagaa

SEQ ID NO: 65622 - RNA, 64 nt, Homo Sapiens
gcuuucaucuauguuuaucacauuuuaauaccacagcacuuauaaugaugucacuacauauaga

SEQ ID NO: 65623 - RNA, 64 nt, Homo Sapiens
uauuaaguacuuacuacaugcuaagagcuuuuuaagcacuuauuuaauccucauuaacaaauuc

SEQ ID NO: 65624 - RNA, 64 nt, Homo Sapiens
cgauuuuuagcauuaaaaacuaaggaauauacuuagcacuuacuuaaucuuuucaguuuuccag

SEQ ID NO: 65625 - RNA, 64 nt, Homo Sapiens
aaaauucccugggcacagguugcaccugggugugagcacuuaaucacucaacgcuuuguuuucu

SEQ ID NO: 65626 - RNA, 64 nt, Homo Sapiens
uauacacuuuuucuguacuuuuucuguaauuuucagcacuuauguugcuuauucauugaauauu

SEQ ID NO: 65627 - RNA, 64 nt, Homo Sapiens
aucagauucaagagaauauacuaaugagagguuuagcacuuaagauaaaaaagaauuuuuaaug

SEQ ID NO: 65628 - RNA, 64 nt, Homo Sapiens
uucugaacuagucuggggacuaaggggaggagagagcacuuaguugcauuugccaacaccuuuu

SEQ ID NO: 65629 - RNA, 64 nt, Homo Sapiens
guuuucagagcacccauauccacccccuuuuuaaagcacuuacugcucuaaccguaacacgucc

SEQ ID NO: 65630 - RNA, 64 nt, Homo Sapiens
cauuugcuaacucccagaauuguggaaggaggggagcacuuagaaaugcuuuucucuccuuaug

SEQ ID NO: 65631 - RNA, 64 nt, Homo Sapiens
agaaaagaggcuuucuaagcaaacacacagccguagcacuuagauuguauuuuuacaaacacau

SEQ ID NO: 65632 - RNA, 64 nt, Homo Sapiens
gggagggaagcggguguuggcuguuuccaaagagagcacuuaauuuaauuuuuccuuuaaauga

SEQ ID NO: 65633 - RNA, 64 nt, Homo Sapiens
aauauuuaguuuugcuuucucguggauaauauuaagcacuuacucugcaguuuccuggaaguug

SEQ ID NO: 65634 - RNA, 64 nt, Homo Sapiens
auaaugguaaguaguugcuacuggccaacugucuagcacuuaccugaaaacuuaguauggagcu

SEQ ID NO: 65635 - RNA, 64 nt, Homo Sapiens
agaacagugcuugccacagagcggggacucgguaagcacuuaaugaaugaaugaauucuaaguc

SEQ ID NO: 65636 - RNA, 64 nt, Homo Sapiens
augucuauugcaaacaauucucucaguuacguucagcacuuaagaacggcuaauggcaauagga

SEQ ID NO: 65637 - RNA, 64 nt, Homo Sapiens
aagugccaagcauuauuuuaucugccgguuacugagcacuuacucaucaaugccaacaagagca

SEQ ID NO: 65638 - RNA, 64 nt, Homo Sapiens
aauaccacagacacaguuaauaguaguuaaauacagcacuuaaaaguauuugacuguaauagua

SEQ ID NO: 65639 - RNA, 64 nt, Homo Sapiens
uucaguggguuaucucuaggaugaucaguaguucagcacuuaaaaacugcagagaaaacugaaa

SEQ ID NO: 65640 - RNA, 64 nt, Homo Sapiens
ugcagggguuucccuggcgcagcgaaagucucugagcacuuaccgggcgugaccguuucuuagg

SEQ ID NO: 65641 - RNA, 64 nt, Homo Sapiens
ccguuuacacagacaaagugacaucagaaggcugagcacuuaucuggaucauuuggucaguuug

SEQ ID NO: 65642 - RNA, 64 nt, Homo Sapiens
ccugggaaucuaucccuaaggaauaaaaagcgccagcacuuaagauuauauguuuacuaaugua

SEQ ID NO: 65643 - RNA, 64 nt, Homo Sapiens
ugguuggggguaagacuagguucuuucuccuuuaagcacuuacacuuccucuuuuuggguuuuc

SEQ ID NO: 65644 - RNA, 64 nt, Homo Sapiens
uuggcuacuaaugaagcucuacacaaaacccacaagcacuuaucaaaaaaaaaaaaaaaaaaaa

SEQ ID NO: 65645 - RNA, 60 nt, Homo Sapiens; identical to SEQ ID NO: 65087

SEQ ID NO: 65646 - RNA, 64 nt, Homo Sapiens
gccuaguguucccagcacugugccugcucucaagagcacuuacugccucgcaaauaauaaaaau

SEQ ID NO: 65647 - RNA, 64 nt, Homo Sapiens
uuccagaaccuaggaggaugccuaacagagaguaagcacuuaaaaaauauuugucauaugaaug

SEQ ID NO: 65648 - RNA, 64 nt, Homo Sapiens
gggagauuuaucuugaagcugaauuugcaaagcaagcacuuauaaaaauuagauuguguguuac

SEQ ID NO: 65649 - RNA, 64 nt, Homo Sapiens
caacauuuguuaauaguuacgucucuccugauguagcacuuaagcuucauuuaguuauuauuuc

SEQ ID NO: 65650 - RNA, 64 nt, Homo Sapiens
gucgaccucaucaucugggagaucgaggugccaaagcacuuagucggucggcuaauuggcaagc

SEQ ID NO: 65651 - RNA, 64 nt, Homo Sapiens
caguucaugucucguccauguccauguucguguuagcacuuacgugggaacaaauaccaauuug

SEQ ID NO: 65652 - RNA, 51 nt, Homo Sapiens; identical to SEQ ID NO: 65094

SEQ ID NO: 65653 - RNA, 64 nt, Homo Sapiens
ucccugugaauacuucagagaauaagauucuaaaagcacuuauaauuuuaugcucuuucuggca

SEQ ID NO: 65654 - RNA, 64 nt, Homo Sapiens
aaaaaaaaaucuuaagaguuacaauuccuuacagagcacuuauucuuucuccuuagguccucac

SEQ ID NO: 65655 - RNA, 64 nt, Homo Sapiens
gacaacgaacaaauucuucagaauuauuucuucaagcacuuauguuucaguuccauucaugaac

SEQ ID NO: 65656 - RNA, 64 nt, Homo Sapiens
guagcggcacugucuuggcuccaggccccacggcagcacuuaugaccgacguccuuuagcccuc

SEQ ID NO: 65657 - RNA, 64 nt, Homo Sapiens
ccaccugggaaccccuccguggcaguccuuaggaagcacuuacaaauaccccaagaccccagag

SEQ ID NO: 65658 - RNA, 64 nt, Homo Sapiens
guuugcaagaacagaauacagcucucuuguuguuagcacuuauuaccauacaagcaucagaaga

SEQ ID NO: 65659 - RNA, 64 nt, Homo Sapiens
gaucucccagcuggguuagggaugccaagcaggcagcacuuaggccugccuuggcaccgucaca

SEQ ID NO: 65660 - RNA, 64 nt, Homo Sapiens
cauuucuuggccaaaguggcuuccucaagaaagcagcacuuaccuuugaaaaaugcugggaaca

SEQ ID NO: 65661 - RNA, 64 nt, Homo Sapiens
agccaagggccauuucuucucagcuugguggagcagcacuuacuuacuacuggaaaugaaaaaa

SEQ ID NO: 65662 - RNA, 64 nt, Homo Sapiens
aagucuucaucuaugcauguaaaagacuguuauuagcacuuaguauugcaggaauauaaauaau

SEQ ID NO: 65663 - RNA, 64 nt, Homo Sapiens
uaaaacauuuguuucccccaucuacuggaaauguagcacuuacggcuuuugaugccaggugcaa

SEQ ID NO: 65664 - RNA, 64 nt, Homo Sapiens
ugcuaaggaaaccugaauuggcgaguauaucugaagcacuuauuacuccaauucaggagcccuu

SEQ ID NO: 65665 - RNA, 64 nt, Homo Sapiens
cugcagcaauuccuccauuuuuaugaaucuugugagcacuuacgcuaggagaaauuucuuuuac

SEQ ID NO: 65666 - RNA, 64 nt, Homo Sapiens
ccuccuuugcaggagggcugggaauccucuuuagagcacuuaauccuauuuauccccuggaaug

SEQ ID NO: 65667 - RNA, 64 nt, Homo Sapiens
aaauaugauauauucaaaugauagaauaguauacagcacuuaaaagcagugaaccagauccaua

SEQ ID NO: 65668 - RNA, 64 nt, Homo Sapiens
agggcuuuucugaggauuaaauaaauaaaugugaagcacuuagaacugauggccagcacaugag

SEQ ID NO: 65669 - RNA, 64 nt, Homo Sapiens
aauuccaaacauacaagaggcucccucuuaacgcagcacuuagacacguguuguuccaccuucc

SEQ ID NO: 65670 - RNA, 64 nt, Homo Sapiens
aauuccaaacauacaagaggcugccucuuaacacagcacuuagacacgugcuguuccaccuccc

SEQ ID NO: 65671 - RNA, 64 nt, Homo Sapiens
ggggccgggcacggugccucacaccuguaaucccagcacuuagguaggccaagguggguggauc

SEQ ID NO: 65672 - RNA, 64 nt, Homo Sapiens
uuguaccuaaaaauucagagggaaaaccugguauagcacuuauuuuauuuauguagagcaugua

SEQ ID NO: 65673 - RNA, 64 nt, Homo Sapiens
gugggcaaauugcuugaccuacgccuguaaucccagcacuuagggaggcugggcacaguggcuc

SEQ ID NO: 65674 - RNA, 64 nt, Homo Sapiens
ucuucuuggaaaaggacccacucccgcuaagacuagcacuuagcuccaggacugguuuccuagc

SEQ ID NO: 65675 - RNA, 64 nt, Homo Sapiens
agcauuucugaagguuggucguuaauauuacuguagcacuuacuucuuuuaaacucaauauaau

SEQ ID NO: 65676 - RNA, 64 nt, Homo Sapiens
ugauuguggauccccugagaucuggcuucccaagagcacuuauugacccuuccucaggccuccc

SEQ ID NO: 65677 - RNA, 64 nt, Homo Sapiens
gacucaagcacauugguauuguauaaagguauagagcacuuagcuuacaaucuuuaaagguuuc

SEQ ID NO: 65678 - RNA, 64 nt, Homo Sapiens
uaaaugcaaaugcaacauuuugcugaccaacaucagcacuuaaaaaagacauggcuggaugcgc

SEQ ID NO: 65679 - RNA, 64 nt, Homo Sapiens
gagugaccguuugaauccauuaaaaaugugccccagcacuuaauaacguuuauagccuugccug

SEQ ID NO: 65680 - RNA, 64 nt, Homo Sapiens
ggcuccugccguccugacgccaccccgccccaucagcacuuaagccacaugacacaaagucugu

SEQ ID NO: 65681 - RNA, 64 nt, Homo Sapiens
agccuagguguuucacugguccucuaugaaucccagcacuuauaaucccagucuuuuaucacuc

SEQ ID NO: 65682 - RNA, 64 nt, Homo Sapiens
gcuaggaagcaaccuuucgccugugcagcgguccagcacuuaacucuaauacaucagcaugcgu

SEQ ID NO: 65683 - RNA, 64 nt, Homo Sapiens
aaguauuccccccugcgacacauauacagugcuuagcacuuaaugaggauuaagugaaccaaua

SEQ ID NO: 65684 - RNA, 64 nt, Homo Sapiens
gccggggggggugucugccugggaaacauccuuaagcacuuaagagggaaaacagacucccuuc

SEQ ID NO: 65685 - RNA, 64 nt, Homo Sapiens
gccagccuagcuuuuuuuuuuuuuuuuuuuuuuuagcacuuaguauuuagcauuuauuaacagg

SEQ ID NO: 65686 - RNA, 64 nt, Homo Sapiens
agagcuggaaccaagaucuagauaguccguagauagcacuuaggacaagaaugugcauugaugg

SEQ ID NO: 65687 - RNA, 64 nt, Homo Sapiens
ugaagucguuccaucauaaucuaugaucuuguacagcacuuauagaaauaagcuguucuuuuga

SEQ ID NO: 65688 - RNA, 64 nt, Homo Sapiens
uuaaacaauccguuuauauugacaguuuauguuaagcacuuagccuuuguuaguuauagggaug

SEQ ID NO: 65689 - RNA, 64 nt, Homo Sapiens
gcuuucugacagaauuauaguaagcaaaaugaaaagcacuuauuucugguuacacauauggaag

SEQ ID NO: 65690 - RNA, 64 nt, Homo Sapiens
acaggagccuagagcccccucagagcccuuucccagcacuuaaacccagcccauaauugggacc

SEQ ID NO: 65691 - RNA, 64 nt, Homo Sapiens
auguuugugugggaaaaaaacuguuuacauauacagcacuuaaaagucuuccuucuguagaggg

SEQ ID NO: 65692 - RNA, 64 nt, Homo Sapiens
auuauuccuugauuuauucaacagggaacagggaagcacuuacaggcuuggagaaauggcuagg

SEQ ID NO: 65693 - RNA, 64 nt, Homo Sapiens
uaaugccgauauacucuagacguauuguuucggcagcacuuauuguguuacuguaauuccucaa

SEQ ID NO: 65694 - RNA, 65 nt, Homo Sapiens
caggaggcccuguucuuagagccccugacaaaggcagcacuuauuuccugggcuggugcgcccca

SEQ ID NO: 65695 - RNA, 65 nt, Homo Sapiens
accagcaugacaaaauggucaaaaaauaagucaucagcacuuaagaaaugaaagcaacuuuugaa

SEQ ID NO: 65696 - RNA, 65 nt, Homo Sapiens
augagauuuaaaaucuuaaaauguuucuuauuuucagcacuuacaucauuugguacacaggguca

SEQ ID NO: 65697 - RNA, 65 nt, Homo Sapiens
uaaagccaguuucaucaaacaguucaacagagagcagcacuuaauacccuuuauacagcccauuu

SEQ ID NO: 65698 - RNA, 65 nt, Homo Sapiens
aggagucaaaaaacuugauuucagguccuagcucuagcacuuacagcugugugaucuugggcaag

SEQ ID NO: 65699 - RNA, 65 nt, Homo Sapiens
uauauuuugauuuuacccagcuuaaucuguaaaguagcacuuaaauauaucugauagcaacacuu

SEQ ID NO: 65700 - RNA, 65 nt, Homo Sapiens
aaaugaggaugaggaauaauaaacucuuuuuggcaagcacuuaaauguucugaaauuuguauaag

SEQ ID NO: 65701 - RNA, 65 nt, Homo Sapiens
auagguaaguuuuauaagggaguacauuuugacugagcacuuagggcaucaggaacagugcuacu

SEQ ID NO: 65702 - RNA, 65 nt, Homo Sapiens
guauggcauaccaaucugugcggggcaguguccuaagcacuuagacuacaucagggaagaacaca

SEQ ID NO: 65703 - RNA, 65 nt, Homo Sapiens
guuaaauaucuuaaaauaucuaaaacauuuuuuaaagcacuuagauugucuuacguaugugcaua

SEQ ID NO: 65704 - RNA, 65 nt, Homo Sapiens
aggaaacugucugucuaauggucacagagcacuguagcacuuaacagauugccauggacaccagu

SEQ ID NO: 65705 - RNA, 65 nt, Homo Sapiens
aggcaccgccacgucccagcagacgcacacagcugagcacuuagccugggcccucuuucccugcg

SEQ ID NO: 65706 - RNA, 65 nt, Homo Sapiens
uguuuacaaagcccuuucacuugccuuguguggucagcacuuaacaugauaaucaguauaauaau

SEQ ID NO: 65707 - RNA, 65 nt, Homo Sapiens
auucagcuugucucaucccccccagagugacugagagcacuuaacucccaccuguggccccuaaa

SEQ ID NO: 65708 - RNA, 65 nt, Homo Sapiens
caguuagucauggagaguaaauuuauuccauuuuaagcacuuacaugggguuauguagaaaagca

SEQ ID NO: 65709 - RNA, 65 nt, Homo Sapiens
cccccugagcagcgagccugagccuacuggagcccagcacuuacuugccucagugggccuguggg

SEQ ID NO: 65710 - RNA, 65 nt, Homo Sapiens
aggcucuugggaugcagcaauucuacuaggaaaggagcacuuaggugguuucuucuaccacccaa

SEQ ID NO: 65711 - RNA, 65 nt, Homo Sapiens
acaguauaugaaauaaugggaggaaaugaauguaaagcacuuaguuuguugugaggauuaaaaug

SEQ ID NO: 65712 - RNA, 65 nt, Homo Sapiens
uccaugacagggucuaaaauauauuaguuuaccugagcacuuauuguucugggggugaaagaaaa

SEQ ID NO: 65713 - RNA, 65 nt, Homo Sapiens
ugaagucaguggccuggaucuguauguuaaaauagagcacuuaccaucaaauagaaucuuauauc

SEQ ID NO: 65714 - RNA, 65 nt, Homo Sapiens
auuguaugucuccucaaaugaauugacaaaaaaugagcacuuacauacacauaauggugucuuaa

SEQ ID NO: 65715 - RNA, 65 nt, Homo Sapiens
acaaagccuagcacaaaguauuuuucuguguccccagcacuuacacgagggcaggauugucuuuu

SEQ ID NO: 65716 - RNA, 65 nt, Homo Sapiens
uuacugguguccagcugagucucuuuucaaugaauagcacuuauggggucagcgcucuugcuuug

SEQ ID NO: 65717 - RNA, 65 nt, Homo Sapiens
guaauguauuauaccuaaauaguuuguaucuaaauagcacuuacuaaaauauauaguauguuuua

SEQ ID NO: 65718 - RNA, 65 nt, Homo Sapiens
ggagcagagaugcagccaguaccccaaauucauugagcacuuaaagcuuuuuucuuuccucccuu

SEQ ID NO: 65719 - RNA, 65 nt, Homo Sapiens
aaucagccuaacauaagaucguaacugcccaaagcagcacuuauaccucauuguaaacaaacugu

SEQ ID NO: 65720 - RNA, 65 nt, Homo Sapiens
cuguaaauugaauaauuuauuagcagauagcaguuagcacuuaauauuguuuuaaauuaauuuuu

SEQ ID NO: 65721 - RNA, 65 nt, Homo Sapiens
aaauaaagguacuuuacagcggaaacugucgcugaagcacuuaaguuuaaucaauuaguaauggc

SEQ ID NO: 65722 - RNA, 65 nt, Homo Sapiens
ucuucccauuucaaaagguaauaguuuggcuggggagcacuuaaugugaagguggcuuuugcuuu

SEQ ID NO: 65723 - RNA, 65 nt, Homo Sapiens
uguggagauacuguaaccugcugcacuauauucuaagcacuuacauucucuauucuuauuauuca

SEQ ID NO: 65724 - RNA, 65 nt, Homo Sapiens
ugaguaaauaaugcagcucaccaucacccauccuaagcacuuacgccauuuccugucuuucccgu

SEQ ID NO: 65725 - RNA, 65 nt, Homo Sapiens
cccacguucucaagggcagagccgccggugugaugagcacuuacaguccucccucgagaaacagu

SEQ ID NO: 65726 - RNA, 65 nt, Homo Sapiens
uguaucuuggcugucaagaguaucaaaugccaugcagcacuuaaacuugugauaaggaagaugaa

SEQ ID NO: 65727 - RNA, 65 nt, Homo Sapiens
ugccauuuaauuagcugcauaucaccuuaggguacagcacuuaacgcaaucugccucaauuucuu

SEQ ID NO: 65728 - RNA, 65 nt, Homo Sapiens
uggggcugagugcaguggcucaugccuguaaucccagcacuuagggugccaauguggauuaccug

SEQ ID NO: 65729 - RNA, 65 nt, Homo Sapiens
agcuuuuagaccucuuacuuccacugcuaguagcuagcacuuacugagcaccugcgaugagguaa

SEQ ID NO: 65730 - RNA, 65 nt, Homo Sapiens
gugggauuucagauaugaacgguguaaauuugagaagcacuuaugcauacaugugggugaaaaac

SEQ ID NO: 65731 - RNA, 65 nt, Homo Sapiens
caaguucuuguuuuuauuuuugaaaguacucacacagcacuuacuaugcuccaaacacuccucua

SEQ ID NO: 65732 - RNA, 65 nt, Homo Sapiens
ugauuugccucaacaacguaaacuuccuaaugauuagcacuuaauaauugcauauaaaaugcuuu

SEQ ID NO: 65733 - RNA, 65 nt, Homo Sapiens
uuuugggacaauuguuuuaaucugaaauucuaaagagcacuuacuguaaccuguugcuguguuua

SEQ ID NO: 65734 - RNA, 65 nt, Homo Sapiens
gguaggaccaagcaucuuggggcucacacaccuguagcacuuacuauccugcggguggggcuugg

SEQ ID NO: 65735 - RNA, 65 nt, Homo Sapiens
cgaccccaaggugccagagaacgagggcaguagagagcacuuaccacgagauaaaggcagcuaaa

SEQ ID NO: 65736 - RNA, 65 nt, Homo Sapiens
uguuagaucuaacguguuccuuacugcccuuucaaagcacuuaaguugaauuccuuggggauuuu

SEQ ID NO: 65737 - RNA, 65 nt, Homo Sapiens
gacuucauuuguucaagaauaaaugaaauuuaaugagcacuuaguuuaacagaggcauauauuua

SEQ ID NO: 65738 - RNA, 65 nt, Homo Sapiens
ucuuccuuaaaugacuuuucauacacuccacuugaagcacuuaagaaaacauuuuuuagucugua

SEQ ID NO: 65739 - RNA, 65 nt, Homo Sapiens
aggggagcacaucuuguaauaaaaugggccaucccagcacuuauaagcuccuaaacaagagaaua

SEQ ID NO: 65740 - RNA, 65 nt, Homo Sapiens
guaagaaguaaaaguagugcucaaucagcgauaucagcacuuacaugccuuucuugugaaaguuu

SEQ ID NO: 65741 - RNA, 65 nt, Homo Sapiens
ucacacugugugugauuuuguuucuuuuguuaagcagcacuuauguagacugcauuuccaaaugu

SEQ ID NO: 65742 - RNA, 65 nt, Homo Sapiens
acauaguacagaagauucuuuguuuuucuccacugagcacuuaacaauugcuuucucucuggccu

SEQ ID NO: 65743 - RNA, 65 nt, Homo Sapiens
ugugauauacaaaguguaccaacauaaguguugguagcacuuaagacuuauacuugccuucugau

SEQ ID NO: 65744 - RNA, 65 nt, Homo Sapiens
ugaaagcuaaaacaacccauuugcuacccauccaaagcacuuacaguuuagcaaauauuaaagag

SEQ ID NO: 65745 - RNA, 65 nt, Homo Sapiens
accauaaaagagaaaaaaauucggaaagugaucagagcacuuauucaaaauacagugauagaagu

SEQ ID NO: 65746 - RNA, 65 nt, Homo Sapiens
aaucaagauauauaucuggaaccucuuauaaauggagcacuuagaaauuuguuguucugcacuua

SEQ ID NO: 65747 - RNA, 65 nt, Homo Sapiens
cuucauuagcucagugacuuguccacacucgucuuagcacuuacguuucaaaagcuugucacaaa

SEQ ID NO: 65748 - RNA, 65 nt, Homo Sapiens
uguacugaugucucagugaaucagucuguuuauuaagcacuuaucagggcuuccacacacuuauu

SEQ ID NO: 65749 - RNA, 65 nt, Homo Sapiens
gauguggagggcugcaaucugucuugauuucuccaagcacuuaacuuucuuugacugcacugaga

SEQ ID NO: 65750 - RNA, 65 nt, Homo Sapiens
auuucaggucuuugcucauucacucaguaauacugagcacuuaccauguaccagaauuuuacuag

SEQ ID NO: 65751 - RNA, 65 nt, Homo Sapiens
uaauuuaaauaauguaaacgcaaacaggguuugauagcacuuaaacuaguucauuucaaaauuaa

SEQ ID NO: 65752 - RNA, 65 nt, Homo Sapiens
aaaaaugaguaaaauaauuaaugaaacauauuuagagcacuuaauggucucuguuuucaauauaa

SEQ ID NO: 65753 - RNA, 65 nt, Homo Sapiens
aaugauuagugucaguauuuauauucuucugaaauagcacuuaaaauaacuuagaaacauugcgc

SEQ ID NO: 65754 - RNA, 65 nt, Homo Sapiens
agccuucugacuuaggguuuugagucccagcccugagcacuuagggagucaaaaggcccagaguc

SEQ ID NO: 65755 - RNA, 65 nt, Homo Sapiens
aguuacauguuguaaucaaguuuauucuauuuuaaagcacuuaugcccuuuuaagucagggaugc

SEQ ID NO: 65756 - RNA, 65 nt, Homo Sapiens
uuaauccaguagagacuugcuaggcuugugaauauagcacuuauuggucuuuguuauaauucaua

SEQ ID NO: 65757 - RNA, 65 nt, Homo Sapiens
ggaaauguaaaguagaaaaauuuauucaaacaaacagcacuuacaccguaaccucacacauuaac

SEQ ID NO: 65758 - RNA, 65 nt, Homo Sapiens
auuuucccucuucacuugguggauuuaaguuucacagcacuuacagucaaugggaaaaaacacca

SEQ ID NO: 65759 - RNA, 65 nt, Homo Sapiens
uccuuuuccacuuuaaauuuacauauuccugguguagcacuuaacuuuaugguuucauguaacau

SEQ ID NO: 65760 - RNA, 65 nt, Homo Sapiens
agagugcauagcauacacugaacuaauagaugcauagcacuuaacagucugaugaggaaaagauu

SEQ ID NO: 65761 - RNA, 65 nt, Homo Sapiens
agaauauuuuaaguauugcaucuuuauugagaaagagcacuuaagggcagacacggaucugagaa

SEQ ID NO: 65762 - RNA, 65 nt, Homo Sapiens
aauuauugauguuuucauagagaauauaaaaauaaagcacuuauagaaaaaacucguuugauuuu

SEQ ID NO: 65763 - RNA, 65 nt, Homo Sapiens
gaugcauuugucauacguuucuacuuaaauuauuaagcacuuacgauuuagauguaauaauuaua

SEQ ID NO: 65764 - RNA, 65 nt, Homo Sapiens
agcuacuuuugugggaguauuucuauuauauaaccagcacuuacuaccuguacucaaaauucagc

SEQ ID NO: 65765 - RNA, 65 nt, Homo Sapiens
augaaauaaaaaaaaacuuuuggauaagaugggacagcacuuauauugaugaggaagaagacaau

SEQ ID NO: 65766 - RNA, 65 nt, Homo Sapiens
agacuggugacaacuggcugggcaguuaacccuguagcacuuacucauauuucagucaguccaga

SEQ ID NO: 65767 - RNA, 65 nt, Homo Sapiens
uuucccaauuuauuaaauugaauucuuuguuguuuagcacuuaaacuuaugaaucaccugaguac

SEQ ID NO: 65768 - RNA, 65 nt, Homo Sapiens
gauaggccuucuugugaucuugcaccuuaucuuaaagcacuuacagcgacauugcagucugcuuc

SEQ ID NO: 65769 - RNA, 65 nt, Homo Sapiens
uguaggguuauggaaucuaguaauaaaauuucaacagcacuuaaacugaaguuuggguugcucau

SEQ ID NO: 65770 - RNA, 65 nt, Homo Sapiens
auucacacaugccuauauuaucauaagaauuuuucagcacuuaacuacuuuguuggcauugaucc

SEQ ID NO: 65771 - RNA, 65 nt, Homo Sapiens
ucucaagggaaaauacucaaagaaagaaaaguggcagcacuuauauuaguuuuauaacaggauaa

SEQ ID NO: 65772 - RNA, 65 nt, Homo Sapiens
gaagcuuacauuacauguccaguccacauuuaaagagcacuuacuguggaacaagccuucagcca

SEQ ID NO: 65773 - RNA, 65 nt, Homo Sapiens
auuuuugaauucuuuagauuuuuaaauuggagaaaagcacuuaaaguuuuuuauauaugaauauu

SEQ ID NO: 65774 - RNA, 65 nt, Homo Sapiens
accauugugcacuaugggaggccgcugcugcguggagcacuuaaaguccagccuccaggaccgga

SEQ ID NO: 65775 - RNA, 65 nt, Homo Sapiens
agguccagagagcuuuauggaagcgggagaggaggagcacuuacucauguuguauuuguuaaugg

SEQ ID NO: 65776 - RNA, 65 nt, Homo Sapiens
augaguucauuuuuaggugaacuuguuuauuaguuagcacuuagauuacacuggggauguuauuu

SEQ ID NO: 65777 - RNA, 65 nt, Homo Sapiens
uaaccagaugauaaugaacuuuggcaaauacagugagcacuuaugaucauauuuuaggauuauuu

SEQ ID NO: 65778 - RNA, 65 nt, Homo Sapiens
cucugugacaguauuguguguaaaaguggcauggcagcacuuauguuggcugugaguagaauaug

SEQ ID NO: 65779 - RNA, 65 nt, Homo Sapiens
ccucaguuuggucaccuguaaaaggaaauaacaagagcacuuacuuuauaagauugaugugagua

SEQ ID NO: 65780 - RNA, 65 nt, Homo Sapiens
ucacucuaaaagcacugaccucaaaaaaccuuauaagcacuuagauuuaauugcauuuuccauag

SEQ ID NO: 65781 - RNA, 65 nt, Homo Sapiens
guucugauaaugaaaauuaugauaaggaugauaaaagcacuuacuucguguccgacucuucugag

SEQ ID NO: 65782 - RNA, 65 nt, Homo Sapiens
cugagucuccaaauaauaauagccgacguuuauugagcacuuacuaugugcccaacccuguuaug

SEQ ID NO: 65783 - RNA, 65 nt, Homo Sapiens
cucaguuuccugaccuaugaaacagagaaaauaaaagcacuuauuuauuguuguuggaggcugca

SEQ ID NO: 65784 - RNA, 65 nt, Homo Sapiens
aaaauaaccucaccccaaauacaauaaagggacgaagcacuuauagauaccacagacacaugugu

SEQ ID NO: 65785 - RNA, 65 nt, Homo Sapiens
ccuaccugaccuugugcgcugggaggcgcaucugcagcacuuacaggugagggauggggagaugg

SEQ ID NO: 65786 - RNA, 65 nt, Homo Sapiens
ugcaaggagacacaugccaccccagcaguacacaaagcacuuaccuugacuggugaagucagcca

SEQ ID NO: 65787 - RNA, 65 nt, Homo Sapiens
aauagcuuucauuuacauagugcuuacauuuauauagcacuuacuaugugcgauguacuaauuua

SEQ ID NO: 65788 - RNA, 65 nt, Homo Sapiens
ucauuuuacaauagauaaaugcuugugcuaccuaaagcacuuagcacacaguuaaauuauauuua

SEQ ID NO: 65789 - RNA, 65 nt, Homo Sapiens
gaauaaaucacuauacugauauuuugauacaagcaagcacuuacaugguaaucacuauauagauc

SEQ ID NO: 65790 - RNA, 65 nt, Homo Sapiens
cauugucaucucauauugaucagguauuuuaaucuagcacuuacauauuguugauaaaugaaagc

SEQ ID NO: 65791 - RNA, 65 nt, Homo Sapiens
agcagagacuguuaauggccccuuacccugggugaagcacuuacccuuggaacagaacucuaaaa

SEQ ID NO: 65792 - RNA, 65 nt, Homo Sapiens
uauauauuauuuucuucuccuuuauauguaaugaaagcacuuauaaagaaacaggaaucauuaga

SEQ ID NO: 65793 - RNA, 65 nt, Homo Sapiens
aagguuagucucauuuagaaaaaucgaaagugcacagcacuuaaagggaauauaugagguuuuuu

SEQ ID NO: 65794 - RNA, 65 nt, Homo Sapiens
aucaaccugauccucaugcugauagaaugacagcuagcacuuauuuccuaagugcaacuguuuua

SEQ ID NO: 65795 - RNA, 65 nt, Homo Sapiens
cacccccuccaaagauggaguguagaaaugaugacagcacuuaguaaguucaaagaugacauuca

SEQ ID NO: 65796 - RNA, 65 nt, Homo Sapiens
accagcugggcacgguggcucacgccuguaaucccagcacuuacuuugggaggccaaggugggca

SEQ ID NO: 65797 - RNA, 65 nt, Homo Sapiens
uagugcgguucucuuugacccccaaagacaagacaagcacuuauuuuuauuuucagaagacaaaa

SEQ ID NO: 65798 - RNA, 65 nt, Homo Sapiens
auuuucagcuuuuuaaagcaguuuuguggccuuccagcacuuacugaugggaagacacauguuaa

SEQ ID NO: 65799 - RNA, 65 nt, Homo Sapiens
ugagguggggguguucaccucagguguggggguuaagcacuuauugcaauugguaaaggaaagag

SEQ ID NO: 65800 - RNA, 65 nt, Homo Sapiens
aagaccgggcauugggcuggcuaaaguauucacugagcacuuaggacuuuagggccggucaggcc

SEQ ID NO: 65801 - RNA, 65 nt, Homo Sapiens
uacuccugauucuuaacauuaaauuuguaaccacuagcacuuaagaugaaaaacugaagagaaca

SEQ ID NO: 65802 - RNA, 65 nt, Homo Sapiens
uuauauaaagggcuguuuguagccaacauuuauccagcacuuaccgaggcuuauuuuauuauagu

SEQ ID NO: 65803 - RNA, 65 nt, Homo Sapiens
gcccuccuggggagacgugacucugguggacgcagagcacuuaguuacccuggacgcuccccaca

SEQ ID NO: 65804 - RNA, 65 nt, Homo Sapiens
uuauuucuuaauuauuauaaaaauauuaagacaauagcacuuaaauuccucaacaguguuuucag

SEQ ID NO: 65805 - RNA, 65 nt, Homo Sapiens
guaaacaaaaauuuuucuuucuuuacugcaugcauagcacuuaauaaaauggauuuuuaaaaaau

SEQ ID NO: 65806 - RNA, 65 nt, Homo Sapiens
cacaaaaagugucucugccuugagucaucuauucaagcacuuacagcucuggccacaacagggca

SEQ ID NO: 65807 - RNA, 65 nt, Homo Sapiens
auuccucagugccuguccauaacugugaaguauuaagcacuuagggccagaugcacuguaaacau

SEQ ID NO: 65808 - RNA, 65 nt, Homo Sapiens
aacucuacucaucuuuagagaugaaucaucuauuaagcacuuaccaaaacauaucauuaaacuga

SEQ ID NO: 65809 - RNA, 65 nt, Homo Sapiens
guguauuauaauuaguuuugugaauagaaaaauaaagcacuuauguuuaaauuuguuacagugac

SEQ ID NO: 65810 - RNA, 65 nt, Homo Sapiens
gaaaagugagguguggaacuccaggcaacgacccaagcacuuauuuuuuaagagggaaaggacuu

SEQ ID NO: 65811 - RNA, 65 nt, Homo Sapiens
gagauuaucgaucuaugagacaucuugauauguaaagcacuuaauauuaaaggcauaaaagugaa

SEQ ID NO: 65812 - RNA, 65 nt, Homo Sapiens
uccucaucucccuguccucugagauaauaugagugagcacuuagguaucauaucagaugcucaag

SEQ ID NO: 65813 - RNA, 65 nt, Homo Sapiens
ccauuucuagcauauggacaccuggccucugcuugagcacuuaggugacaggaacuuccgcaccu

SEQ ID NO: 65814 - RNA, 65 nt, Homo Sapiens
gcuucauagaaagcaaugccauuuauagauggagcagcacuuaguccaaacugaaaauaggagcu

SEQ ID NO: 65815 - RNA, 65 nt, Homo Sapiens
augugccaggcccuuugcaguugaauucuacaccaagcacuuaccugaaaugguaguggaauuau

SEQ ID NO: 65816 - RNA, 65 nt, Homo Sapiens
cagaagcagaggcuaauucacauaacgguuaagaaagcacuuaaauucaucgacuuagccugagu

SEQ ID NO: 65817 - RNA, 65 nt, Homo Sapiens
uuuuuuggaaguuauuuauucaccuuccaaacaaaagcacuuacugguuuauauucuuauguuau

SEQ ID NO: 65818 - RNA, 65 nt, Homo Sapiens
uuuuccuguugagauggggggccaaccuccccaacagcacuuaggagcaguuagagcggucgucg

SEQ ID NO: 65819 - RNA, 65 nt, Homo Sapiens
guuggccucugauugcugucagggagagggucagaagcacuuagcacagcuaguaaccggcugug

SEQ ID NO: 65820 - RNA, 65 nt, Homo Sapiens
cuuuagcauaaaaaauguuguuuauuuaccucuuuagcacuuauauucgguauuuccuaucgacg

SEQ ID NO: 65821 - RNA, 65 nt, Homo Sapiens
uuucgaaccuaaaguuuagauucacaguguaaggcagcacuuaaaauuuagugaucaaacugcca

SEQ ID NO: 65822 - RNA, 65 nt, Homo Sapiens
cagaguagacacaauuaaagggaaugcuuuauuuaagcacuuaggccauguguauuuugcuuaau

SEQ ID NO: 65823 - RNA, 65 nt, Homo Sapiens
auguuuucaacuccaaaucaauucuaaaaacuucaagcacuuaauggaaagguaaauggucagau

SEQ ID NO: 65824 - RNA, 65 nt, Homo Sapiens
uuuaccagaugcugaaggcaaggggagggagcagaagcacuuauguuuacggauauuuuaaacuc

SEQ ID NO: 65825 - RNA, 65 nt, Homo Sapiens
auaccccucuugaaagagauuuacucaucuauccaagcacuuaauuuggaaauuuuauuguccua

SEQ ID NO: 65826 - RNA, 65 nt, Homo Sapiens
ucccugaccuugacacuucccccuuuagcuauaaaagcacuuaccagccgaacguggaacaguau

SEQ ID NO: 65827 - RNA, 65 nt, Homo Sapiens
gaacgagagcaucuuguucagacguuguugcacaaagcacuuaaaaagauuucggcaucgacacg

SEQ ID NO: 65828 - RNA, 65 nt, Homo Sapiens
gcaacaauuguaagucgacuacccacagugagcugagcacuuacagcacccccucaauagccagc

SEQ ID NO: 65829 - RNA, 65 nt, Homo Sapiens
accauuugagcuugugggucaaauacaaguugcuaagcacuuaggcaguucuccauuuuauuaga

SEQ ID NO: 65830 - RNA, 65 nt, Homo Sapiens
aggcugugguagaaucauacuacuuuaagguuuggagcacuuacaacagguguaguaauuguggg

SEQ ID NO: 65831 - RNA, 65 nt, Homo Sapiens
cauuccaaguacuuuuuuuuuaggaaaaaaaggguagcacuuauuaaaauauuuuuaugccuacu

SEQ ID NO: 65832 - RNA, 56 nt, Homo Sapiens; identical to SEQ ID NO: 61369

SEQ ID NO: 65833 - RNA, 65 nt, Homo Sapiens
aucucaauaacuguggaagucuucaauaugaugagagcacuuaaguuaacaggaauuauaaauaa

SEQ ID NO: 65834 - RNA, 65 nt, Homo Sapiens
ucucucuaugcuguucuacaccauccuuggcaucuagcacuuacagccuuacugguuugccaaag

SEQ ID NO: 65835 - RNA, 65 nt, Homo Sapiens
gcuccaacuuuuuugaaugaguguccucagucgccagcacuuacaagcagcgaggaauuaacccu

SEQ ID NO: 65836 - RNA, 65 nt, Homo Sapiens
gugcuguuccuguggaaaaaauaacuccagaaagaagcacuuagcuggcgauucagugucacaaa

SEQ ID NO: 65837 - RNA, 65 nt, Homo Sapiens
aacauguuuuuaauuuucucaacaagcauuuagccagcacuuauccagugaaacaauuugauaag

SEQ ID NO: 65838 - RNA, 65 nt, Homo Sapiens
uagcaggagacuugagaaguagagugacaaaaacaagcacuuaauuaaauuauaaaauuuaacuu

SEQ ID NO: 65839 - RNA, 65 nt, Homo Sapiens
augaaguggucuuugaccacaguugauugaaccagagcacuuauugcuuaaagaauaacagaguu

SEQ ID NO: 65840 - RNA, 65 nt, Homo Sapiens
uccugcauccaaggcagguguuguuaaucuaucauagcacuuaaaaaaaaaaaaaaaaagagacc

SEQ ID NO: 65841 - RNA, 65 nt, Homo Sapiens
ugcugaucugcacaauuuaauuaugugguuauucgagcacuuaauuucacucaagguucauuggg

SEQ ID NO: 65842 - RNA, 65 nt, Homo Sapiens
gcaggccaggcacgguggcucacgccuauaaucccagcacuuagggaggccaaggcgggcagauc

SEQ ID NO: 65843 - RNA, 65 nt, Homo Sapiens
gcaagucuuugagauacguuuuuuacauguaauaaagcacuuaaugcgaggcacaguucuauguu

SEQ ID NO: 65844 - RNA, 65 nt, Homo Sapiens
aucacuaauucccuuaagguuagaccagcaauugcagcacuuacaaaacugaagaaagaagauaa

SEQ ID NO: 65845 - RNA, 65 nt, Homo Sapiens
aaauaauuccaggguucccuccuuguacaugcuguagcacuuaaagcaagcuugugggccagugu

SEQ ID NO: 65846 - RNA, 65 nt, Homo Sapiens
uggauauaaaugcagcaacuauguggcuuuugucaagcacuuagaaguuucaggaguaaaucuaa

SEQ ID NO: 65847 - RNA, 65 nt, Homo Sapiens
cuaugcaggggggucuuucucgggacgaucgauauagcacuuaggcacgguucuuaaggcacauc

SEQ ID NO: 65848 - RNA, 65 nt, Homo Sapiens
aaacucagagcaucugaguaaauaccgucaaaaccagcacuuacccagaauaaaaacugacuaga

SEQ ID NO: 65849 - RNA, 65 nt, Homo Sapiens
gcugaagccaucagcaucugcucuaacuucacgguagcacuuacaaccccaucugcaccugaauc

SEQ ID NO: 65850 - RNA, 65 nt, Homo Sapiens
gaccagaguggcccaggccagcuggcugguagccaagcacuuauggggcauccucccagggucug

SEQ ID NO: 65851 - RNA, 65 nt, Homo Sapiens
cucauguaucguaaguuaauacuaaaagaagagaaagcacuuaaguuucacagaagccguuaugu

SEQ ID NO: 65852 - RNA, 65 nt, Homo Sapiens
gguagcuuuugugaaauagaaucagugaccaguauagcacuuagaucccuucuaacucauauaau

SEQ ID NO: 65853 - RNA, 65 nt, Homo Sapiens
gcugcugcuccuauauuuuuuaagaaauauaauaaagcacuuagggcaggggaaaucaucucggu

SEQ ID NO: 65854 - RNA, 65 nt, Homo Sapiens
auuucuaggauuaacugagagauuaaaggaacagcagcacuuaggcucaaaaucgccccuacaaa

SEQ ID NO: 65855 - RNA, 65 nt, Homo Sapiens
gcagaaucagguccccacgggaugucucacaguagagcacuuagccucuagcaaugacaaccugu

SEQ ID NO: 65856 - RNA, 65 nt, Homo Sapiens
auagugucugagacacaagaaguuaacauuuucaaagcacuuagaauugcuuugaggucuaaaug

SEQ ID NO: 65857 - RNA, 65 nt, Homo Sapiens
acagacuagaaaguguucuacgcuaacacuuguuaagcacuuacugcagcugcuacugcaacaac

SEQ ID NO: 65858 - RNA, 65 nt, Homo Sapiens
ugaauuauugaucuuccuaagaugcuguuucauacagcacuuagaugaauaaagcaacuuuugua

SEQ ID NO: 65859 - RNA, 65 nt, Homo Sapiens
aaagaaaacacaaagagaaaauaugaacaauauaaagcacuuaaaggaagaggaugauuucuucc

SEQ ID NO: 65860 - RNA, 65 nt, Homo Sapiens
ugaggaaagcaugauauguauauugcugaguugaaagcacuuauuggaaaauauuaaaaggcuaa

SEQ ID NO: 65861 - RNA, 65 nt, Homo Sapiens
agcgugagccucccagagccccaggacugggccagagcacuuagguuucuuuuuccaugguuucc

SEQ ID NO: 65862 - RNA, 65 nt, Homo Sapiens
ucccgggaaagcugccccacagccucagcaucuucagcacuuaccgauccagagccucccggccu

SEQ ID NO: 65863 - RNA, 65 nt, Homo Sapiens
guauuuauguuucuuuuuagauguguaccuucccaagcacuuauuuaugcagugaccuggucacc

SEQ ID NO: 65864 - RNA, 65 nt, Homo Sapiens
guauauuuuucuaugagaagcacuucauagggagaagcacuuaugacaaggcuauuuuuuaaacc

SEQ ID NO: 65865 - RNA, 65 nt, Homo Sapiens
gcuuaaugggagcuuugccugggaccugaaccuggagcacuuaccgcauuaggaagaaaggagcu

SEQ ID NO: 65866 - RNA, 65 nt, Homo Sapiens
caugugggcagcaugcccagguuccuugcugacucagcacuuauuucuguaguuuuaaaaaagaa

SEQ ID NO: 65867 - RNA, 65 nt, Homo Sapiens
agagauaauugcaguuucacguuuauacucacuucagcacuuaucaucaugcaauugcauauuau

SEQ ID NO: 65868 - RNA, 65 nt, Homo Sapiens
gauuaagaccuugcauauguaauaucuauuuguugagcacuuauuuccaccucuugcaccaaauc

SEQ ID NO: 65869 - RNA, 65 nt, Homo Sapiens
ucgcugcuucugagacuucuauugccaaaugaguaagcacuuaauuuuauauaacucacugggac

SEQ ID NO: 65870 - RNA, 65 nt, Homo Sapiens
acacuaucuaaccuaauaugauuauggauuggagaagcacuuauuaauaaugauaguagguaugu

SEQ ID NO: 65871 - RNA, 65 nt, Homo Sapiens
ccaguuugacugugcuagcuaucccaccuugccaaagcacuuacauugcagauaugauggaaugc

SEQ ID NO: 65872 - RNA, 65 nt, Homo Sapiens
ggaacagucugugagauugaaucuucugcagaggaagcacuuaugaacagagggcuagagaaagc

SEQ ID NO: 65873 - RNA, 65 nt, Homo Sapiens
uccugcuccuuuccaccagugauuuguauuaagacagcacuuauauuguacaauacuucagacug

SEQ ID NO: 65874 - RNA, 65 nt, Homo Sapiens
guuuuuaaccugaucuguagagcagagagguugaaagcacuuaacucuuguuuaguauccucauu

SEQ ID NO: 65875 - RNA, 65 nt, Homo Sapiens
gaagugugguucagggccagugcauauuaguggacagcacuuaguagcugugaaggaaggugcag

SEQ ID NO: 65876 - RNA, 65 nt, Homo Sapiens
aauacaguaguaauuaagguacaucucuaaaguggagcacuuacaccaggcucuaagauucacuu

SEQ ID NO: 65877 - RNA, 65 nt, Homo Sapiens
cguaaugagggaaguccuaggauggauagaaaaaaagcacuuacauuggggcacacaggaaaucc

SEQ ID NO: 65878 - RNA, 65 nt, Homo Sapiens
agguuaggaguagauauugauuacuaucauaauucagcacuuaacuaugagccaggcaucauacu

SEQ ID NO: 65879 - RNA, 65 nt, Homo Sapiens
auuugcucaauaacucuacucauuuguaucuuuucagcacuuaauuuuaauguaagaaaguuguu

SEQ ID NO: 65880 - RNA, 65 nt, Homo Sapiens
ccaggauggugguuagcaacaguggcccgugccaaagcacuuaccaaagugaugaugacuaaggu

SEQ ID NO: 65881 - RNA, 65 nt, Homo Sapiens
acuaaauuuggcuuuagugugacgggauuugauuaagcacuuaguauagucuuuugaacacggaa

SEQ ID NO: 65882 - RNA, 65 nt, Homo Sapiens
auacaaagucuauauuauuguuuaucucauuuucuagcacuuaaauuucacccaaacugauaaca

SEQ ID NO: 65883 - RNA, 65 nt, Homo Sapiens
caggacuuucaugacccaauaucaaggacagacauagcacuuagaaccagaaaacaauugugggg

SEQ ID NO: 65884 - RNA, 65 nt, Homo Sapiens
uuacacauauuuuaauccuguuucugguaauaagaagcacuuaauguguuuaucugugucaagua

SEQ ID NO: 65885 - RNA, 65 nt, Homo Sapiens
uuguugcaaguacugcuguaggcucauacuuauauagcacuuacuuugcuuaugguaauaaaaau

SEQ ID NO: 65886 - RNA, 65 nt, Homo Sapiens
uaggguaagcauucuuaacaaggggggcgcugucuagcacuuaacccggagccuuguuuuucuaa

SEQ ID NO: 65887 - RNA, 65 nt, Homo Sapiens
uauguauaaauguacauaaaacaagacuuuuaccuagcacuuaaaaugguaguacuggaaauuuu

SEQ ID NO: 65888 - RNA, 65 nt, Homo Sapiens
gaagaguauccuaaugaaaaacugggaaugaauaaagcacuuacaucagccaguaaucaaaacag

SEQ ID NO: 65889 - RNA, 65 nt, Homo Sapiens
augacauaaaagguuaaagaacaggcaacacaaugagcacuuaaguuuuuaacauguggggaaua

SEQ ID NO: 65890 - RNA, 65 nt, Homo Sapiens
agacucaguucagcaacuguuuauucuguuuauugagcacuuacuuggaccaagcacuguggucu

SEQ ID NO: 65891 - RNA, 65 nt, Homo Sapiens
agugcagguaguguuuaguuaucuacugcauuaugagcacuuaaaguacugcuagcuguagaacu

SEQ ID NO: 65892 - RNA, 65 nt, Homo Sapiens
acaacuuucuauuuuuagccuauauuuggaaagaaagcacuuaacauuuuaggaauucuuuuuaa

SEQ ID NO: 65893 - RNA, 65 nt, Homo Sapiens
acacggguuguaaggacaaaggauuuuaaaaucugagcacuuaggugaagggacaagcagguuua

SEQ ID NO: 65894 - RNA, 65 nt, Homo Sapiens
aaaaaagucuaccaaaggaauuugcauccagcagcagcacuuagaccugccagccacugucaccg

SEQ ID NO: 65895 - RNA, 65 nt, Homo Sapiens
gucgcauuuguuauaaauguaguaaggcagguccaagcacuuacaaguuuuuuguaguuguuacc

SEQ ID NO: 65896 - RNA, 65 nt, Homo Sapiens
cacauuuaggaaaagacauauuguauuuuauccauagcacuuauugcugcuguuauuuucuacau

SEQ ID NO: 65897 - RNA, 65 nt, Homo Sapiens
uuguuuauauccauuuuuucguacaguuuagaaagagcacuuauuacaauauuuuugaaaauuua

SEQ ID NO: 65898 - RNA, 65 nt, Homo Sapiens
acuguguagaaacuauuuuugaucuguucuuauguagcacuuaacugccaucugaaggggauucu

SEQ ID NO: 65899 - RNA, 65 nt, Homo Sapiens
uugugccagguuccacucaauuauucaauuucuaaagcacuuacgcuuaaaacauuuuacuuggc

SEQ ID NO: 65900 - RNA, 65 nt, Homo Sapiens
uuuuuacaguuagcacuucaaagccucgucgugaaagcacuuaauaaaaucagugggaauuaaga

SEQ ID NO: 65901 - RNA, 65 nt, Homo Sapiens
ugcuuucaucuauguuuaucacauuuuaauaccacagcacuuauaaugaugucacuacauauaga

SEQ ID NO: 65902 - RNA, 65 nt, Homo Sapiens
uuauuaaguacuuacuacaugcuaagagcuuuuuaagcacuuauuuaauccucauuaacaaauuc

SEQ ID NO: 65903 - RNA, 65 nt, Homo Sapiens
ccgauuuuuagcauuaaaaacuaaggaauauacuuagcacuuacuuaaucuuuucaguuuuccag

SEQ ID NO: 65904 - RNA, 65 nt, Homo Sapiens
uaaaauucccugggcacagguugcaccugggugugagcacuuaaucacucaacgcuuuguuuucu

SEQ ID NO: 65905 - RNA, 65 nt, Homo Sapiens
uauacacuuuuucuguacuuuuuucuguaauuuucagcacuuauguuugcuuauucauugaauau

SEQ ID NO: 65906 - RNA, 65 nt, Homo Sapiens
aucagauucaagagaauauagcuaaugagagguuuagcacuuaaguauaaaaaagaauuuuuaau

SEQ ID NO: 65907 - RNA, 65 nt, Homo Sapiens
uucugaacuagucuggggacuuaaggggaggagagagcacuuagucugcauuugccaacaccuuu

SEQ ID NO: 65908 - RNA, 65 nt, Homo Sapiens
guuuucagagcacccauaucccacccccuuuuuaaagcacuuacuagcucuaaccguaacacguc

SEQ ID NO: 65909 - RNA, 65 nt, Homo Sapiens
cauuugcuaacucccagaauguguggaaggaggggagcacuuagagaaugcuuuucucuccuuau

SEQ ID NO: 65910 - RNA, 65 nt, Homo Sapiens
agaaaagaggcuuucuaagcuaaacacacagccguagcacuuagauuuguauuuuuacaaacaca

SEQ ID NO: 65911 - RNA, 65 nt, Homo Sapiens
ggggagggaagcggguguuggcuguuuccaaagagagcacuuaauuuaauuuuuccuuuaaauga

SEQ ID NO: 65912 - RNA, 65 nt, Homo Sapiens
uaauauuuaguuuugcuuucucguggauaauauuaagcacuuacucugcaguuuccuggaaguug

SEQ ID NO: 65913 - RNA, 65 nt, Homo Sapiens
gauaaugguaaguaguugcuacuggccaacugucuagcacuuaccugaaaacuuaguauggagcu

SEQ ID NO: 65914 - RNA, 65 nt, Homo Sapiens
uagaacagugcuugccacagagcggggacucgguaagcacuuaaugaaugaaugaauucuaaguc

SEQ ID NO: 65915 - RNA, 65 nt, Homo Sapiens
caugucuauugcaaacaauucucucaguuacguucagcacuuaagaacggcuaauggcaauagga

SEQ ID NO: 65916 - RNA, 65 nt, Homo Sapiens
aagugccaagcauuauuuuaaucugccgguuacugagcacuuacuacaucaaugccaacaagagc

SEQ ID NO: 65917 - RNA, 65 nt, Homo Sapiens
aauaccacagacacaguuaaauaguaguuaaauacagcacuuaaacaguauuugacuguaauagu

SEQ ID NO: 65918 - RNA, 65 nt, Homo Sapiens
uuucaguggguuaucucuaggaugaucaguaguucagcacuuaaaaacugcagagaaaacugaaa

SEQ ID NO: 65919 - RNA, 65 nt, Homo Sapiens
cugcagggguuucccuggcgcagcgaaagucucugagcacuuaccgggcgugaccguuucuuagg

SEQ ID NO: 65920 - RNA, 65 nt, Homo Sapiens
uccguuuacacagacaaagugacaucagaaggcugagcacuuaucuggaucauuuggucaguuug

SEQ ID NO: 65921 - RNA, 65 nt, Homo Sapiens
uccugggaaucuaucccuaaggaauaaaaagcgccagcacuuaagauuauauguuuacuaaugua

SEQ ID NO: 65922 - RNA, 65 nt, Homo Sapiens
ugguuggggguaagacuaggcuucuuucuccuuuaagcacuuacaccuuccucuuuuuggguuuu

SEQ ID NO: 65923 - RNA, 65 nt, Homo Sapiens
uuggcuacuaaugaagcucuaacacaaaacccacaagcacuuaucuaaaaaaaaaaaaaaaaaaa

SEQ ID NO: 65924 - RNA, 60 nt, Homo Sapiens; identical to SEQ ID NO: 65087

SEQ ID NO: 65925 - RNA, 65 nt, Homo Sapiens
ggccuaguguucccagcacugugccugcucucaagagcacuuacugccucgcaaauaauaaaaau

SEQ ID NO: 65926 - RNA, 65 nt, Homo Sapiens
cuuccagaaccuaggaggaugccuaacagagaguaagcacuuaaaaaauauuugucauaugaaug

SEQ ID NO: 65927 - RNA, 65 nt, Homo Sapiens
agggagauuuaucuugaagcugaauuugcaaagcaagcacuuauaaaaauuagauuguguguuac

SEQ ID NO: 65928 - RNA, 65 nt, Homo Sapiens
ccaacauuuguuaauaguuacgucucuccugauguagcacuuaagcuucauuuaguuauuauuuc

SEQ ID NO: 65929 - RNA, 65 nt, Homo Sapiens
ggucgaccucaucaucugggagaucgaggugccaaagcacuuagucggucggcuaauuggcaagc

SEQ ID NO: 65930 - RNA, 65 nt, Homo Sapiens
gcaguucaugucucguccauguccauguucguguuagcacuuacgugggaacaaauaccaauuug

SEQ ID NO: 65931 - RNA, 51 nt, Homo Sapiens; identical to SEQ ID NO: 65094

SEQ ID NO: 65932 - RNA, 65 nt, Homo Sapiens
ucccugugaauacuucagagaaauaagauucuaaaagcacuuauaaauuuuaugcucuuucuggc

SEQ ID NO: 65933 - RNA, 65 nt, Homo Sapiens
aaaaaaaaaucuuaagaguucacaauuccuuacagagcacuuauuucuuucuccuuagguccuca

SEQ ID NO: 65934 - RNA, 65 nt, Homo Sapiens
gacaacgaacaaauucuucacgaauuauuucuucaagcacuuaugcuuucaguuccauucaugaa

SEQ ID NO: 65935 - RNA, 65 nt, Homo Sapiens
guagcggcacugucuuggcucccaggccccacggcagcacuuauggaccgacguccuuuagcccu

SEQ ID NO: 65936 - RNA, 65 nt, Homo Sapiens
ccaccugggaaccccuccgugggcaguccuuaggaagcacuuacacaauaccccaagaccccaga

SEQ ID NO: 65937 - RNA, 65 nt, Homo Sapiens
guuugcaagaacagaauacaagcucucuuguuguuagcacuuauucaccauacaagcaucagaag

SEQ ID NO: 65938 - RNA, 65 nt, Homo Sapiens
gaucucccagcuggguuaggagaugccaagcaggcagcacuuaggcccugccuuggcaccgucac

SEQ ID NO: 65939 - RNA, 65 nt, Homo Sapiens
gcauuucuuggccaaaguggcuuccucaagaaagcagcacuuaccuuugaaaaaugcugggaaca

SEQ ID NO: 65940 - RNA, 65 nt, Homo Sapiens
cagccaagggccauuucuucucagcuugguggagcagcacuuacuuacuacuggaaaugaaaaaa

SEQ ID NO: 65941 - RNA, 65 nt, Homo Sapiens
aagucuucaucuaugcauguuaaaagacuguuauuagcacuuaguuauugcaggaauauaaauaa

SEQ ID NO: 65942 - RNA, 65 nt, Homo Sapiens
uaaaacauuuguuucccccaaucuacuggaaauguagcacuuacgagcuuuugaugccaggugca

SEQ ID NO: 65943 - RNA, 65 nt, Homo Sapiens
ugcuaaggaaaccugaauugugcgaguauaucugaagcacuuauuaacuccaauucaggagcccu

SEQ ID NO: 65944 - RNA, 65 nt, Homo Sapiens
ccugcagcaauuccuccauuuuuaugaaucuugugagcacuuacgcuaggagaaauuucuuuuac

SEQ ID NO: 65945 - RNA, 65 nt, Homo Sapiens
accuccuuugcaggagggcugggaauccucuuuagagcacuuaauccuauuuauccccuggaaug

SEQ ID NO: 65946 - RNA, 65 nt, Homo Sapiens
aaaauaugauauauucaaaugauagaauaguauacagcacuuaaaagcagugaaccagauccaua

SEQ ID NO: 65947 - RNA, 65 nt, Homo Sapiens
gagggcuuuucugaggauuaaauaaauaaaugugaagcacuuagaacugauggccagcacaugag

SEQ ID NO: 65948 - RNA, 65 nt, Homo Sapiens
caauuccaaacauacaagaggcucccucuuaacgcagcacuuagacacguguuguuccaccuucc

SEQ ID NO: 65949 - RNA, 65 nt, Homo Sapiens
caauuccaaacauacaagaggcugccucuuaacacagcacuuagacacgugcuguuccaccuccc

SEQ ID NO: 65950 - RNA, 65 nt, Homo Sapiens
aggggccgggcacggugccucacaccuguaaucccagcacuuagguaggccaagguggguggauc

SEQ ID NO: 65951 - RNA, 65 nt, Homo Sapiens
uuguaccuaaaaauucagagaggaaaaccugguauagcacuuauuguuauuuauguagagcaugu

SEQ ID NO: 65952 - RNA, 65 nt, Homo Sapiens
gugggcaaauugcuugaccucacgccuguaaucccagcacuuaggugaggcugggcacaguggcu

SEQ ID NO: 65953 - RNA, 65 nt, Homo Sapiens
ucuucuuggaaaaggacccaccucccgcuaagacuagcacuuagccuccaggacugguuuccuag

SEQ ID NO: 65954 - RNA, 65 nt, Homo Sapiens
agcauuucugaagguuggucuguuaauauuacuguagcacuuacuuucuuuuaaacucaauauaa

SEQ ID NO: 65955 - RNA, 65 nt, Homo Sapiens
augauuguggauccccugagaucuggcuucccaagagcacuuauugacccuuccucaggccuccc

SEQ ID NO: 65956 - RNA, 65 nt, Homo Sapiens
agacucaagcacauugguauuguauaaagguauagagcacuuagcuuacaaucuuuaaagguuuc

SEQ ID NO: 65957 - RNA, 65 nt, Homo Sapiens
uaaaugcaaaugcaacauuucugcugaccaacaucagcacuuaaauaaagacauggcuggaugcg

SEQ ID NO: 65958 - RNA, 65 nt, Homo Sapiens
gagugaccguuugaauccauguaaaaaugugccccagcacuuaaugaacguuuauagccuugccu

SEQ ID NO: 65959 - RNA, 65 nt, Homo Sapiens
gggcuccugccguccugacgccaccccgccccaucagcacuuaagccacaugacacaaagucugu

SEQ ID NO: 65960 - RNA, 65 nt, Homo Sapiens
cagccuagguguuucacugguccucuaugaaucccagcacuuauaaucccagucuuuuaucacuc

SEQ ID NO: 65961 - RNA, 65 nt, Homo Sapiens
agcuaggaagcaaccuuucgccugugcagcgguccagcacuuaacucuaauacaucagcaugcgu

SEQ ID NO: 65962 - RNA, 65 nt, Homo Sapiens
aaguauuccccccugcgacaacauauacagugcuuagcacuuaauugaggauuaagugaaccaau

SEQ ID NO: 65963 - RNA, 65 nt, Homo Sapiens
gccggggggggugucugccucgggaaacauccuuaagcacuuaagaagggaaaacagacucccuu

SEQ ID NO: 65964 - RNA, 65 nt, Homo Sapiens
ugccagccuagcuuuuuuuuuuuuuuuuuuuuuuuagcacuuaguauuuagcauuuauuaacagg

SEQ ID NO: 65965 - RNA, 65 nt, Homo Sapiens
cagagcuggaaccaagaucuagauaguccguagauagcacuuaggacaagaaugugcauugaugg

SEQ ID NO: 65966 - RNA, 65 nt, Homo Sapiens
augaagucguuccaucauaaucuaugaucuuguacagcacuuauagaaauaagcuguucuuuuga

SEQ ID NO: 65967 - RNA, 65 nt, Homo Sapiens
uuaaacaauccguuuauauuggacaguuuauguuaagcacuuagcucuuuguuaguuauagggau

SEQ ID NO: 65968 - RNA, 65 nt, Homo Sapiens
gcuuucugacagaauuauagguaagcaaaaugaaaagcacuuauuaucugguuacacauauggaa

SEQ ID NO: 65969 - RNA, 65 nt, Homo Sapiens
acaggagccuagagcccccuccagagcccuuucccagcacuuaaaccccagcccauaauugggac

SEQ ID NO: 65970 - RNA, 65 nt, Homo Sapiens
auguuugugugggaaaaaaagcuguuuacauauacagcacuuaaacagucuuccuucuguagagg

SEQ ID NO: 65971 - RNA, 65 nt, Homo Sapiens
auuauuccuugauuuauucagacagggaacagggaagcacuuacaaggcuuggagaaauggcuag

SEQ ID NO: 65972 - RNA, 65 nt, Homo Sapiens
uaaugccgauauacucuagaacguauuguuucggcagcacuuauugguguuacuguaauuccuca

SEQ ID NO: 65973 - RNA, 62 nt, Homo Sapiens
auaguuaauacagguauaucuauuuuuauuuacuuuguaagaaacaagcucaaggagcuucc

SEQ ID NO: 65974 - RNA, 62 nt, Homo Sapiens
guuaauaauaaaugcuguaaauaagcaucucacuuuguaaaaauaaaauauugugguuuugu

SEQ ID NO: 65975 - RNA, 62 nt, Homo Sapiens
gcccugccccuggcuccuuaaaugccccgucucuuuguaaacugauauucagccagcaaugc

SEQ ID NO: 65976 - RNA, 62 nt, Homo Sapiens
ccggccgccuucuccccucucccagggaugcucuuuguaaauaucggaugggugugggagug

SEQ ID NO: 65977 - RNA, 62 nt, Homo Sapiens
gggucccuuuucaucccuucucugacagauugcuuuguaaacuuucuuaggccuucccccca

SEQ ID NO: 65978 - RNA, 62 nt, Homo Sapiens
aggucaauuauacuuuuguuguucauuagcaucuuuguaaacuauaagacguaguuuuaauu

SEQ ID NO: 65979 - RNA, 62 nt, Homo Sapiens
agguuugcaugcugguaaugcaaccuuugaaacuuuguaaaggaaacauauauguauauauu

SEQ ID NO: 65980 - RNA, 62 nt, Homo Sapiens
aauguauuauuuuggugacaaaaaugaaggagcuuuguaaauuuuuuuuaaaauuaugaauc

SEQ ID NO: 65981 - RNA, 62 nt, Homo Sapiens
guggggaggcauaagcugauguuuguaaagcgcuuuguaaauaaacgugcucucugaaugcc

SEQ ID NO: 65982 - RNA, 62 nt, Homo Sapiens
uuuugagauacuauuuucauuuuugugagccucuuuguaauaaaaugguacauuucuauauc

SEQ ID NO: 65983 - RNA, 62 nt, Homo Sapiens
ccacccacaaugcaugagagugccuauuaaaucuuuguaaguguuaucaaauguuuugaucu

SEQ ID NO: 65984 - RNA, 62 nt, Homo Sapiens
uccucuggcagccaauaaaaucaucauaagcccuuuguaauaaaaagcuaguuuccugagug

SEQ ID NO: 65985 - RNA, 62 nt, Homo Sapiens
guauauucuauacaaagguacuuguccuuucccuuuguaaacuacauuugacauggauuaaa

SEQ ID NO: 65986 - RNA, 62 nt, Homo Sapiens
gcauuauagaggaauguaguaugucauaaguacuuuguaaagauuugacauucaacuguagu

SEQ ID NO: 65987 - RNA, 62 nt, Homo Sapiens
uaauuucucauauggugcuggaaaugguugggcuuuguaacauuugaaguguuuccauggua

SEQ ID NO: 65988 - RNA, 62 nt, Homo Sapiens
guaaagugcaauuucauuggauagcuaaauaucuuuguaagauagagauuguugaaaauucu

SEQ ID NO: 65989 - RNA, 62 nt, Homo Sapiens
uggcauguugauuucuauggccaacuuucucucuuuguaaaacaaagauugauugauuuucu

SEQ ID NO: 65990 - RNA, 62 nt, Homo Sapiens
uuaauacagcagagcauggcaugaccaagcaucuuuguaaaguguuagauggaaaaugcugu

SEQ ID NO: 65991 - RNA, 62 nt, Homo Sapiens
auaaugacauaauuuaguuucauguaaugaaacuuuguaaacagaauacauacauguguaua

SEQ ID NO: 65992 - RNA, 62 nt, Homo Sapiens
uuuacuguuaugagguagaauaaaaaagaauacuuuguaauagccacaaguucuuguuuaga

SEQ ID NO: 65993 - RNA, 62 nt, Homo Sapiens
uguguccaguuauauuauuuaaaaaaguguuacuuuguaaaaauuguauauaaagaacugua

SEQ ID NO: 65994 - RNA, 62 nt, Homo Sapiens
gaugaacacauuaauccguuaaguaaaauggacuuuguaauuguacagcauaccuaagaaac

SEQ ID NO: 65995 - RNA, 62 nt, Homo Sapiens
caucuaaaguguauuaacagugcaugcuuuuacuuuguaaauguggugccaaaucccuguuu

SEQ ID NO: 65996 - RNA, 62 nt, Homo Sapiens
ugacuucugguuuccacuguaucaguauguaccuuuguaauuguuauuuuuaugucuuuuau

SEQ ID NO: 65997 - RNA, 62 nt, Homo Sapiens
ggcucugugucagggaaaaccuucuggguggacuuuguaagaauccaguuuccaagguuaga

SEQ ID NO: 65998 - RNA, 62 nt, Homo Sapiens
gauucucauagacaacuggguaacuuauauuucuuuguaaucaagacuugagauaucgaagu

SEQ ID NO: 65999 - RNA, 62 nt, Homo Sapiens
acaagccuuggaaauaaaucucuauuaaaccgcuuuguaaccaagcucugguacccucuguc

SEQ ID NO: 66000 - RNA, 62 nt, Homo Sapiens
acacaucgugaugaugacguccucucaacucucuuuguaaaaauuuuguuauuuuugcuugu

SEQ ID NO: 66001 - RNA, 62 nt, Homo Sapiens
caauuuugugcuaaugagcauugagacugaugcuuuguaagucacaccacaacaaauauuga

SEQ ID NO: 66002 - RNA, 62 nt, Homo Sapiens
uauuuuauuuuucuauaaugaucauauauuaccuuuguaauaaaacauuauaaccaaaacau

SEQ ID NO: 66003 - RNA, 62 nt, Homo Sapiens
agccucucgagggugaggccuagccuucuugucuuuguaacccacagcagcugguacugugc

SEQ ID NO: 66004 - RNA, 62 nt, Homo Sapiens
aggguuuucaauaggguguagaccuccaguaccuuuguaacuaaagucugucuagucauugu

SEQ ID NO: 66005 - RNA, 62 nt, Homo Sapiens
aauuuuaucucuuauucaguaaaaaacaacuucuuuguaaucguuauguguguauauguaug

SEQ ID NO: 66006 - RNA, 62 nt, Homo Sapiens
auguguagccucuccuggucauagaccagucucuuuguaaguuauuguggcaguucacacag

SEQ ID NO: 66007 - RNA, 62 nt, Homo Sapiens
gagaaauauaguucacaaugaaauuauauuuucuuuguaaagaaaguggcuugaaaucuuuu

SEQ ID NO: 66008 - RNA, 62 nt, Homo Sapiens
gugaucuugaaccauuguuuuauauuuuucaccuuuguaaccucauggaaagaggcuuuaca

SEQ ID NO: 66009 - RNA, 62 nt, Homo Sapiens
aaaguugaaggccuuauucuacauuucaccuacuuuguaagugagagagacaagaagcaaau

SEQ ID NO: 66010 - RNA, 62 nt, Homo Sapiens
acucagcuacacucucugauuuugugcuacuccuuuguaaagucacugccuuaagggggcug

SEQ ID NO: 66011 - RNA, 62 nt, Homo Sapiens
ugaauuuuugcugguuaaccuuuaucauuuaucuuuguaaugugaacaugcuucagagugua

SEQ ID NO: 66012 - RNA, 62 nt, Homo Sapiens
aaaaaaaaaaucacuuggcgcaggagggagaacuuuguaagaagcugcccucuguuuuuuuu

SEQ ID NO: 66013 - RNA, 62 nt, Homo Sapiens
ucucgccaacagcuagcugcuagccgaucaggcuuuguaagaccuaaaccaggaagcugcgu

SEQ ID NO: 66014 - RNA, 62 nt, Homo Sapiens
ucaguguuuauaugaauaugcuuuucccuguacuuuguaauguuguuuccuucucccuuccc

SEQ ID NO: 66015 - RNA, 62 nt, Homo Sapiens
uuaauuuuauuacacauaacgaguggaaaagccuuuguaaauaaaaaaggaaucaaauccac

SEQ ID NO: 66016 - RNA, 62 nt, Homo Sapiens
cgaauguucccuggauguugacauagaacauucuuuguaacccgggcucaucuguaccaagg

SEQ ID NO: 66017 - RNA, 62 nt, Homo Sapiens
uguuuguaugaguaaagaaaguuguuugaaaccuuuguaacucuuagccuaaagaaugaucu

SEQ ID NO: 66018 - RNA, 62 nt, Homo Sapiens
acuaaagaagaucuguaauuaagucuuuaggucuuuguaagacaagccugguaggaaagggc

SEQ ID NO: 66019 - RNA, 62 nt, Homo Sapiens
agaaacauuucugcauaaaaacuuuuuucuaccuuuguaaauaccacuaucuugcacugcua

SEQ ID NO: 66020 - RNA, 62 nt, Homo Sapiens
aaaaggaaaaacuccggguauuugguuuacugcuuuguaaauuauuuauguucacacaggaa

SEQ ID NO: 66021 - RNA, 62 nt, Homo Sapiens
uauuucuuguuuguuuguuuacagcuucaugccuuuguaaguaagcugauuacugucaauaa

SEQ ID NO: 66022 - RNA, 62 nt, Homo Sapiens
uuggaacagcagcacuauaccagacagcuuuacuuuguaaggaauuuuuggaauuugggaag

SEQ ID NO: 66023 - RNA, 62 nt, Homo Sapiens
aggauuuuuagaauuaaaaaaauguaagcauacuuuguaaauaugcaugucuuuuaaaaugc

SEQ ID NO: 66024 - RNA, 62 nt, Homo Sapiens
auuuacacuuuaacuuucucuugcaugucagucuuuguaauugaauaauguaagguaaagag

SEQ ID NO: 66025 - RNA, 62 nt, Homo Sapiens
auuuguucugcagaaggcugaaauagauuuuucuuuguaacaauguuuaaucaauugcaagc

SEQ ID NO: 66026 - RNA, 62 nt, Homo Sapiens
gacuugcgguuaauuaugcaacuaacaaaaugcuuuguaacacuccugcauuuguugauacc

SEQ ID NO: 66027 - RNA, 62 nt, Homo Sapiens
aagguaauuagaaugguaugggcuuuaguuaucuuuguaaauuaugaauuggaagugauguu

SEQ ID NO: 66028 - RNA, 62 nt, Homo Sapiens
acgaaacauuuuugcuuucugaggccguuuaucuuuguaaacgguuuugaucucuggguaaa

SEQ ID NO: 66029 - RNA, 62 nt, Homo Sapiens
uacucuuuuuaaaucccuuugggcuucuuauucuuuguaaugauucucagauagauguuaca

SEQ ID NO: 66030 - RNA, 62 nt, Homo Sapiens
gaagaauccaagagaaguuuaugguagagaaacuuuguaaaacuuuuaaaacguauguuugu

SEQ ID NO: 66031 - RNA, 62 nt, Homo Sapiens
aaaaccuguuuccuauuuugggcugaaguguucuuuguaagggagaugccuuugacauuuug

SEQ ID NO: 66032 - RNA, 62 nt, Homo Sapiens
augcuucuugauauuuuacugcuauagaacugcuuuguaaaguuccccuuuaaaaggaauua

SEQ ID NO: 66033 - RNA, 62 nt, Homo Sapiens
uucucccucaccccacccugucaucuuguauucuuuguaaaaccaaccagcccaaaauuauu

SEQ ID NO: 66034 - RNA, 62 nt, Homo Sapiens
aaauggcguggucuuuguugucccacacuggccuuuguaaaucccucccugccucccccagc

SEQ ID NO: 66035 - RNA, 62 nt, Homo Sapiens
gauugaugugaacacuuuuuacagcacauagucuuuguaagguauaggaagaagcaaagucu

SEQ ID NO: 66036 - RNA, 62 nt, Homo Sapiens
ggaauaaaacaguaccuuagguugagauggagcuuuguaauguuccaugaaucauuguggug

SEQ ID NO: 66037 - RNA, 62 nt, Homo Sapiens
auguauuuacucugccagguaaacuuaaaacacuuuguaaccggucacuauauaaagcaaau

SEQ ID NO: 66038 - RNA, 62 nt, Homo Sapiens
gggcucuggauuuuugguuuuaaugagaaacccuuuguaaguuuagcaaccugucuuggccc

SEQ ID NO: 66039 - RNA, 62 nt, Homo Sapiens
augucuguuuucuuuuuuguacugccuuugcucuuuguaacuauagcuagagaaacaauauu

SEQ ID NO: 66040 - RNA, 62 nt, Homo Sapiens
caugaauaaaacacauuuuaagauaauaaagacuuuguaaaaggguugugcauccccaaucc

SEQ ID NO: 66041 - RNA, 62 nt, Homo Sapiens
acuuccguugcugccaucgucgcagucacuuucuuuguaacacggcugagcuccagccaccc

SEQ ID NO: 66042 - RNA, 62 nt, Homo Sapiens
cuugauuugggagcauuuacauuaauuagcagcuuuguaauauggcuaauuuucaguugcua

SEQ ID NO: 66043 - RNA, 62 nt, Homo Sapiens
cauuuguauauuguggauguuuaauucuucaccuuuguaagaguucuguuuggcacuuguau

SEQ ID NO: 66044 - RNA, 62 nt, Homo Sapiens
gucgggagauugaaagauguuuuuguuucuuucuuuguaaaggccuuggauauugaaaaaau

SEQ ID NO: 66045 - RNA, 62 nt, Homo Sapiens
gggaaagaggucaacugagauuuggaaaucaucuuuguaauauuugcaaauuauacuuguuc

SEQ ID NO: 66046 - RNA, 62 nt, Homo Sapiens
cagaaaaccacaguguguuuucauauuuggaacuuuguaauagcgggaguagcaguagucca

SEQ ID NO: 66047 - RNA, 62 nt, Homo Sapiens
aguguauuucuuucuugaauuucagucugcugcuuuguaaaaaauaacuguaauugauauuu

SEQ ID NO: 66048 - RNA, 62 nt, Homo Sapiens
cagaccagaauuuucuuugucccaugaggugucuuuguaagucagcaugcucuugcuugaac

SEQ ID NO: 66049 - RNA, 62 nt, Homo Sapiens
uuuuccugaaauacauuugcaaaauaaggcugcuuuguaaucaaggaauauuuuuauugauu

SEQ ID NO: 66050 - RNA, 58 nt, Homo Sapiens
uuggagauaccacuguuuaaggaaauaccuuuguaaaccugcagaacauuuuacuuaa

SEQ ID NO: 66051 - RNA, 62 nt, Homo Sapiens
uccauuuguacaugguuuacauguuguggaugcuuuguaaacauuuuccuguauguuuaaau

SEQ ID NO: 66052 - RNA, 62 nt, Homo Sapiens
ucuggguuaaguguuuaucauauauauggguacuuuguaauaucuaaaaacuuagaaacgga

SEQ ID NO: 66053 - RNA, 62 nt, Homo Sapiens
acauuguuaccaaccauuaauuggcucaggaccuuuguaauuuuuauuuaacuauaugaguu

SEQ ID NO: 66054 - RNA, 62 nt, Homo Sapiens
aaacuucagugucccaccuugaccaaaaucagcuuuguaacuguuuucaaggaggugcuuag

SEQ ID NO: 66055 - RNA, 62 nt, Homo Sapiens
aaacaagaagaccucaugagagagguaaacaccuuuguaaagaaucuguaaccaauaccaug

SEQ ID NO: 66056 - RNA, 62 nt, Homo Sapiens
acacagcuuuugcauacuuacaguuucuguuccuuuguaauaacuuuaacuugcaccuuuga

SEQ ID NO: 66057 - RNA, 62 nt, Homo Sapiens
caaaccauaccacacacauuaucauuguuaaacuuuguaaaguauuuaagguacauggaaca

SEQ ID NO: 66058 - RNA, 62 nt, Homo Sapiens
ucuaaauuucuguaguagagagagccguagcccuuuguaaaggcuuucguucguccaaacaa

SEQ ID NO: 66059 - RNA, 62 nt, Homo Sapiens
gagcugugagauggauuuauuuuuaaaugcuacuuuguaaaggugaccuuuaaaaaauaaaa

SEQ ID NO: 66060 - RNA, 62 nt, Homo Sapiens
aucuuuacaccuccugugugguuacaaguuaacuuuguaaguagcguaccuuccuuccuuaa

SEQ ID NO: 66061 - RNA, 62 nt, Homo Sapiens
uagaacaaauaagguauauuuuuuagaaucaacuuuguaagcacuauaaaaucuuuaauaag

SEQ ID NO: 66062 - RNA, 62 nt, Homo Sapiens
caagcucgaauuauuccucauuguauagccugcuuuguaaacuaguuuacaauuugcaggcu

SEQ ID NO: 66063 - RNA, 62 nt, Homo Sapiens
ccucuuccuccuccacuucccacuuauugucacuuuguaauauucagagagcacuuggauua

SEQ ID NO: 66064 - RNA, 62 nt, Homo Sapiens
cuauaauagaaaauagcagacaacauaaacaucuuuguaaauaucaaaccuaauacauuucu

SEQ ID NO: 66065 - RNA, 62 nt, Homo Sapiens
auaucaaaaggaagauucuuccauuaaauugccuuuguaauaugagaauguauuaguacaaa

SEQ ID NO: 66066 - RNA, 62 nt, Homo Sapiens
augccuaauacucacacgcaacauuucuuguacuuuguaagucguuugcgagaaugcagacc

SEQ ID NO: 66067 - RNA, 62 nt, Homo Sapiens
uuaacuuauugcuuuguaucuugggaaaaaaacuuuguaaauaaguuauaaaguuucuuuga

SEQ ID NO: 66068 - RNA, 62 nt, Homo Sapiens
cacacuagcauagagaauguguugaaauuuaacuuuguaagcuuguaugugguuguugaucu

SEQ ID NO: 66069 - RNA, 62 nt, Homo Sapiens
ggcgccuccucucuacuuucauggacuuguuccuuuguaauagugcaauuugguuuuguuuu

SEQ ID NO: 66070 - RNA, 62 nt, Homo Sapiens
ucacuagauuucuacguagugaucugcuuuuacuuuguaauuuguaguucucaaaagacuuu

SEQ ID NO: 66071 - RNA, 62 nt, Homo Sapiens
ucuauguugaauccuuuuauaaaccaguaucacuuuguaauauaaacaccuauuuguacuua

SEQ ID NO: 66072 - RNA, 62 nt, Homo Sapiens
accagccagaccucaggucuucacucuuucuucuuuguaaacuaugucauguggaaagauuu

SEQ ID NO: 66073 - RNA, 62 nt, Homo Sapiens
gauuuauuccuuuguuacuucucuaauucuuccuuuguaaaaaaaaaaaaaagcaacacuuu

SEQ ID NO: 66074 - RNA, 62 nt, Homo Sapiens
uuaaauucaggcuacugcuucaaucucaauugcuuuguaagugaaaaacaugacccagagga

SEQ ID NO: 66075 - RNA, 62 nt, Homo Sapiens
ccauuaaaaguuggggcuccuacucuccuuugcuuuguaaauucaaaaguugggggugggua

SEQ ID NO: 66076 - RNA, 62 nt, Homo Sapiens
uuguaccggcacgggauauggaacgaaaacugcuuuguaaugcaguuugugacauuaauagu

SEQ ID NO: 66077 - RNA, 62 nt, Homo Sapiens
uuuggaucucauuguugauauaccugaauuuacuuuguaagagauuuuaacuucacuucaug

SEQ ID NO: 66078 - RNA, 62 nt, Homo Sapiens
uuauuugaucagaauauuuuagauuaucuuuccuuuguaagauagaggauagccuugaggcu

SEQ ID NO: 66079 - RNA, 62 nt, Homo Sapiens
agaagcuucagaacucacuaagccucuguggucuuuguaauuagaagcauggcucaccagcc

SEQ ID NO: 66080 - RNA, 62 nt, Homo Sapiens
auugcauacccauauuuuaacauuuacuauggcuuuguaacauaaaaguacauuuuauaaac

SEQ ID NO: 66081 - RNA, 62 nt, Homo Sapiens
guagggucgccaugaugcagguuuugaaaugucuuuguaagaauguaacuuaauuacugcua

SEQ ID NO: 66082 - RNA, 62 nt, Homo Sapiens
aaagcaaaaugagaauuucaugcuauggcuagcuuuguaaccggagcuuuguauucugugac

SEQ ID NO: 66083 - RNA, 62 nt, Homo Sapiens
uauuguggcaugagauaagaugucuucaguuacuuuguaauuguacaaaagcugcaguaacc

SEQ ID NO: 66084 - RNA, 62 nt, Homo Sapiens
aaauggaaaaggucaauaaaaguuuuuaacugcuuuguaagaagcaugcaaggguaagaaug

SEQ ID NO: 66085 - RNA, 62 nt, Homo Sapiens
uguaagaccaaauucauacuuaaauuagaauacuuuguaauuaaucuaaauauggaauuugg

SEQ ID NO: 66086 - RNA, 62 nt, Homo Sapiens
auuuguacuauuuuaaaugaaagugaaauguucuuuguaaacuauaagcagcugugaaauuu

SEQ ID NO: 66087 - RNA, 62 nt, Homo Sapiens
aggagccauugcauuuauuauucauucugcuacuuuguaacuugcacagggcuuauagcugc

SEQ ID NO: 66088 - RNA, 62 nt, Homo Sapiens
cugcauauggaccuguaaucucuucacuugaacuuuguaaaaugauggcaucccuacagucu

SEQ ID NO: 66089 - RNA, 62 nt, Homo Sapiens
uccacccccugcccacaaaaauugagaaugugcuuuguaagauuuguaauauucucuccgcc

SEQ ID NO: 66090 - RNA, 62 nt, Homo Sapiens
uucuccccacccaccccacgcuugagaaggugcuuuguaauagacaauacaccuuccccacc

SEQ ID NO: 66091 - RNA, 62 nt, Homo Sapiens
acaauuguuggagagccccuugacuuuuuauacuuuguaaagcauguuccugggaucacuga

SEQ ID NO: 66092 - RNA, 62 nt, Homo Sapiens
ugucuuuuuuuuucugcuucagcucaauaauucuuuguaaaucagacucugaugaugauuag

SEQ ID NO: 66093 - RNA, 62 nt, Homo Sapiens
guggaaccaacacuaacauaaauguuuacacucuuuguaagagagccuuguaauucuaaaug

SEQ ID NO: 66094 - RNA, 62 nt, Homo Sapiens
guauuauugaauuuucaauuuuccugaauugucuuuguaaaaugauaccaugacaaaaaucu

SEQ ID NO: 66095 - RNA, 62 nt, Homo Sapiens
ugguuuuaaaagccuuauauaauaaagaaagccuuuguaaggaaggaaaaaguaagaugaga

SEQ ID NO: 66096 - RNA, 62 nt, Homo Sapiens
agcuguucagaagaauaaaaugauugagauuacuuuguaaguuacaugauuuauaauuucac

SEQ ID NO: 66097 - RNA, 62 nt, Homo Sapiens
uaggaaagacaaaggucugaggccauuugagucuuuguaaccguaacauaauggugaugguu

SEQ ID NO: 66098 - RNA, 62 nt, Homo Sapiens
uuuuuucuacaaaugucuaacgaauccuacagcuuuguaauuauggcaagucuagaacucuc

SEQ ID NO: 66099 - RNA, 62 nt, Homo Sapiens
gauucuuuucaucaaaaagcauggauuuuugacuuuguaaugcugauucaauuauaauugua

SEQ ID NO: 66100 - RNA, 62 nt, Homo Sapiens
cccgucuccuuucauucagauuuccaaagcuccuuuguaaaccuaguugucuguguauaaua

SEQ ID NO: 66101 - RNA, 62 nt, Homo Sapiens
uagccagacaauaaagaaaaagacaucugcaucuuuguaagugguaggguagagacuacccu

SEQ ID NO: 66102 - RNA, 62 nt, Homo Sapiens
acaaguuuauguuugagcaagaaucuuauccacuuuguaagacuuuauauuugucuuauuuu

SEQ ID NO: 66103 - RNA, 62 nt, Homo Sapiens
cuucagaauugauuauuuuucucaaaauuuuacuuuguaauuuguuaguagacagugguguc

SEQ ID NO: 66104 - RNA, 62 nt, Homo Sapiens
guuugggggcagacucuuaauucucucaaccccuuuguaauguuuugguuucugcuucucuc

SEQ ID NO: 66105 - RNA, 62 nt, Homo Sapiens
cuugcaugcuucuuagaccaguaucuggaaugcuuuguaauacacuguuccucugucauacu

SEQ ID NO: 66106 - RNA, 62 nt, Homo Sapiens
aauuucuauauaaaaauauuauguuguaaaaucuuuguaaaaguaugacauaaugauuugcu

SEQ ID NO: 66107 - RNA, 62 nt, Homo Sapiens
accagguucuaggaaauguuuuauuucuucagcuuuguaaaucuuugcccaauaaccacauu

SEQ ID NO: 66108 - RNA, 62 nt, Homo Sapiens
ucuuaacauuuuuauauugcuauuuuguacagcuuuguaaaucuaauuuuuaaauuuuaagu

SEQ ID NO: 66109 - RNA, 62 nt, Homo Sapiens
aaaaauaauaauaauuugaaacagguuuauuucuuuguaaaacuguagugcagugauccuuu

SEQ ID NO: 66110 - RNA, 62 nt, Homo Sapiens
uuaagugccuugagcuggaaagccacugccuucuuuguaauaugaggcccaucucuccagcc

SEQ ID NO: 66111 - RNA, 62 nt, Homo Sapiens
acuaacgaaaaugcaaagcaguuuaaaaagaccuuuguaauugccgucucaaggcauuuacg

SEQ ID NO: 66112 - RNA, 62 nt, Homo Sapiens
aaaacaggauuuugaaugcauuugaauuaguucuuuguaaaugguguguuucugagaauuug

SEQ ID NO: 66113 - RNA, 62 nt, Homo Sapiens
caaaacugaaguaucuguguacucaaccacuucuuuguaagacagggaauaaaagcuuuuca

SEQ ID NO: 66114 - RNA, 62 nt, Homo Sapiens
cacuagguuuucaucguaaagaggugaaaucucuuuguaaucggguuuucuguuuuuugaug

SEQ ID NO: 66115 - RNA, 62 nt, Homo Sapiens
ccagacagugaagcaaaauggucacaagaaagcuuuguaaaauagacucuuuuauaccuguu

SEQ ID NO: 66116 - RNA, 62 nt, Homo Sapiens
agucaaucauuuaauuuuugggaccucaguuucuuuguaaguaaaauaacaccugcuuguuc

SEQ ID NO: 66117 - RNA, 62 nt, Homo Sapiens
ggacugggucacuauugugguuuuuacuauaacuuuguaaauuaacuuaauuuugcugacuu

SEQ ID NO: 66118 - RNA, 62 nt, Homo Sapiens
gcuuugaaucaacuuaagggaaaaccuuuugucuuuguaaaaauaaaagccuguagcuaagg

SEQ ID NO: 66119 - RNA, 62 nt, Homo Sapiens
gaauaugcccgacuccccaugacaagacagaacuuuguaacaaacaguaccaauuuauuuug

SEQ ID NO: 66120 - RNA, 62 nt, Homo Sapiens
uuguuccugccccacccuaacugaucaauguacuuuguaaucucccccacccuuaagaaggu

SEQ ID NO: 66121 - RNA, 62 nt, Homo Sapiens
acuuuguaaucucccccacccuuaagaagguacuuuguaaucuuccccacccuuaagaaggu

SEQ ID NO: 66122 - RNA, 62 nt, Homo Sapiens
acuuuguaaucuuccccacccuuaagaagguucuuuguaauucuccccacccuugagaaugu

SEQ ID NO: 66123 - RNA, 62 nt, Homo Sapiens
aacguguucuuuuagaccaguuuucuaauaagcuuuguaaaauguacuauccaaauuagaag

SEQ ID NO: 66124 - RNA, 62 nt, Homo Sapiens
ggagaacauuaggacaaaaagucaccaacuuacuuuguaacauuuuaauaaugacuuaaggg

SEQ ID NO: 66125 - RNA, 62 nt, Homo Sapiens
cccauacaaguauucauuuuuucuacccuuuccuuuguaaguuccugggcaaccuuuuugau

SEQ ID NO: 66126 - RNA, 62 nt, Homo Sapiens
ggugugugugugucuauguguguguuucagcacuuuguaaauagcaagaagcuguacagauu

SEQ ID NO: 66127 - RNA, 62 nt, Homo Sapiens
ggugaaggguacccaggaccacucuguaccaucuuuguaacuuccugugaauuuauaauaau

SEQ ID NO: 66128 - RNA, 62 nt, Homo Sapiens
aaaauaauugcuuugacauugucuauaugguacuuuguaaagucaugcuuaaguacaaauuc

SEQ ID NO: 66129 - RNA, 62 nt, Homo Sapiens
uuguuugaaagccuccauauaguuagauugugcuuuguaauuuuguuguuguugcucuaucu

SEQ ID NO: 66130 - RNA, 62 nt, Homo Sapiens
aaaaguguguuugaaaaauauuaucuuggguucuuuguaaaauuuauuuuuuacaugcugaa

SEQ ID NO: 66131 - RNA, 62 nt, Homo Sapiens
gggaauaaaaagcugugaaauuguucaaccuacuuuguaaccaaagaagcaaagcuguguaa

SEQ ID NO: 66132 - RNA, 62 nt, Homo Sapiens
aaugacuagcuuuuaaaaauacaguacaaagacuuuguaaaugugauucagggcccccagca

SEQ ID NO: 66133 - RNA, 62 nt, Homo Sapiens
ggguccuccaggcaucagcuguuguguccucucuuuguaacaguggacaggacagaccaccc

SEQ ID NO: 66134 - RNA, 50 nt, Homo Sapiens
uuuuacaacaauuauacugacuuuguaaggaauauggaauugcuaagaua

SEQ ID NO: 66135 - RNA, 62 nt, Homo Sapiens
cuacauuuuaaaagcaauuguauuaguaagaacuuuguaaauaaauaccuaaaacccaagug

SEQ ID NO: 66136 - RNA, 62 nt, Homo Sapiens
auccgugcuuugucggccagcguuucugcagucuuuguaaaggccccacgagagcgggccag

SEQ ID NO: 66137 - RNA, 62 nt, Homo Sapiens
caguaagauaucucaaugaaccauaaauucaacuuuguaaaaaucuuuugaagcauagauaa

SEQ ID NO: 66138 - RNA, 62 nt, Homo Sapiens
gcauauacuucuugggauauaguaucuaagaccuuuguaaacugccauuuuguuagguaugg

SEQ ID NO: 66139 - RNA, 62 nt, Homo Sapiens
gcagugccaccugaguuccaaauuuuaccauucuuuguaaacaguuggauggauuaugauaa

SEQ ID NO: 66140 - RNA, 62 nt, Homo Sapiens
uugaauuaggcagugguuucauaggcauagaucuuuguaaccauaaaaucuuagaaagaaac

SEQ ID NO: 66141 - RNA, 62 nt, Homo Sapiens
uacuguccagcugaaagcacugaucggagaugcuuuguaaucauugaucaucugccuuaacg

SEQ ID NO: 66142 - RNA, 62 nt, Homo Sapiens
gccgcggggcccccauacagccuaugacaacacuuuguaaaagcugcugccaagcacauauc

SEQ ID NO: 66143 - RNA, 62 nt, Homo Sapiens
gcagggaccauauaagccuucuagacuguaagcuuuguaagguuacugcuuauugaucacug

SEQ ID NO: 66144 - RNA, 62 nt, Homo Sapiens
acaguuuaaguucuccugcaaucacaggaagacuuuguaagguuuagccucuacaugcuagg

SEQ ID NO: 66145 - RNA, 62 nt, Homo Sapiens
agagagaugcuuauguuauuuacguuuuguaccuuuguaaccggacuggagggagacuuuua

SEQ ID NO: 66146 - RNA, 62 nt, Homo Sapiens
uaucgugugugugauuccuuaaagucaagaaacuuuguaaaaggaaaaacaacagcgacaaa

SEQ ID NO: 66147 - RNA, 62 nt, Homo Sapiens
caggugggggcaucucacaggcucaggcuucacuuuguaaacagggaucugggguggucagg

SEQ ID NO: 66148 - RNA, 62 nt, Homo Sapiens
caguauguuuuuacauaauggagacacauuggcuuuguaaaugguauauacaaauuaaaacu

SEQ ID NO: 66149 - RNA, 62 nt, Homo Sapiens
uucccuugaagacagaauuuacucuuuuuuaacuuuguaacccuuuuuuuauauaaugaacc

SEQ ID NO: 66150 - RNA, 62 nt, Homo Sapiens
uuucuuaguauauagucagcucuucauuuucacuuuguaauuuucauuuaccgaaugagaau

SEQ ID NO: 66151 - RNA, 62 nt, Homo Sapiens
uauuugaaaguaguguuaaauacauuaacuuccuuuguaauuauccacauccaccuucggaa

SEQ ID NO: 66152 - RNA, 62 nt, Homo Sapiens
gcucucugugguuugacuuauuggugcuuagucuuuguaaggagccacaaacaguucaucau

SEQ ID NO: 66153 - RNA, 62 nt, Homo Sapiens
guuuaauucaaucuguaauaaucagagaaugucuuuguaacuagaccucuaugaaugaaugu

SEQ ID NO: 66154 - RNA, 62 nt, Homo Sapiens
auuacccuguaauauuauauaaaaaaacauaacuuuguaaaucaagguacuuuuuuauuuaa

SEQ ID NO: 66155 - RNA, 62 nt, Homo Sapiens
ugggagacaucugaaauauuacagauugauaacuuuguaagagcacacacggaguggcuuug

SEQ ID NO: 66156 - RNA, 62 nt, Homo Sapiens
caggauucuuauuugugcuguaaugugguuuccuuuguaaacgggaaaaaaaaaauccuugc

SEQ ID NO: 66157 - RNA, 62 nt, Homo Sapiens
cagcauaaaaaugaaaaguuuuuaugugaggacuuuguaaguguugauuaaaucuauaaguu

SEQ ID NO: 66158 - RNA, 62 nt, Homo Sapiens
agaauuuaccaguaacugugaaaauccauuuccuuuguaacaauauucaaauuccguauacc

SEQ ID NO: 66159 - RNA, 62 nt, Homo Sapiens
cauuagucaguugcucauuugagacugaggggcuuuguaaaaaauccuccacucucuggaag

SEQ ID NO: 66160 - RNA, 62 nt, Homo Sapiens
acaggaaaaaauaaacucuuauagaucaaaagcuuuguaaccagaaccucacuugguaccau

SEQ ID NO: 66161 - RNA, 62 nt, Homo Sapiens
ggaacugccucuuuccuguugaauuuuaagugcuuuguaaugggaauauuccccuaucucua

SEQ ID NO: 66162 - RNA, 60 nt, Homo Sapiens
gccaaaacaaccaaacuauuuucuaaauaaaccuuuguaaucuaauguugggugccgcag

SEQ ID NO: 66163 - RNA, 62 nt, Homo Sapiens
auuuuauguugaauuauuuuuggagcugaaaucuuuguaauauuaaagcaacuaguuucuaa

SEQ ID NO: 66164 - RNA, 62 nt, Homo Sapiens
uuauguuuugccacaguuaacccauugugcuucuuuguaaucaaacaguuugugggagaaug

SEQ ID NO: 66165 - RNA, 62 nt, Homo Sapiens
uuaggaugugggcugguuugcuuuucuaccaccuuuguaauuuuauguaucccaucuccuuu

SEQ ID NO: 66166 - RNA, 62 nt, Homo Sapiens
gcaauuuuuuucaggaugcaaaggcaauuauucuuuguaagcgggacauuuagaauauauuu

SEQ ID NO: 66167 - RNA, 62 nt, Homo Sapiens
cuuaaaaaagcuaaucccuaaaauaguuagaucuuuguaaaugcauauuaaauaauaaagua

SEQ ID NO: 66168 - RNA, 62 nt, Homo Sapiens
aaugcaguuuuuaaaaaccuguaucugacccacuuuguaauuuuugcuccaauauccauucu

SEQ ID NO: 66169 - RNA, 62 nt, Homo Sapiens
uacugcaucaucuguuuguaaucauuaucucacuuuguaaauaaaaacacaccuuaaaacau

SEQ ID NO: 66170 - RNA, 62 nt, Homo Sapiens
uaugaauugaguccacaaaggaacacaaaacucuuuguaauucuguuaaaucuuuuauguag

SEQ ID NO: 66171 - RNA, 62 nt, Homo Sapiens
acuuauuagaaacccaaauugggacaacagugcuuuguaaauuguguugucuucagcaguca

SEQ ID NO: 66172 - RNA, 62 nt, Homo Sapiens
uucuugcucaguuguuucaggcaagcccaagacuuuguaauuuuuaaagggcccaagauuuu

SEQ ID NO: 66173 - RNA, 62 nt, Homo Sapiens
auuuaaaaagguuguauuacauauuguuuaaacuuuguaaguagaaauauaucuguuauaau

SEQ ID NO: 66174 - RNA, 62 nt, Homo Sapiens
uauuacuguuucacauguacagcuuucuacuucuuuguaagaacaccaaccaaccaagguuu

SEQ ID NO: 66175 - RNA, 62 nt, Homo Sapiens
aggcugcuuuggaaauaauucccauauccuugcuuuguaaguugguaauaucacuaugcauu

SEQ ID NO: 66176 - RNA, 62 nt, Homo Sapiens
agucccgugguugucuguacguuugcaccgcacuuuguaaucuggcgcucaugggcccuggu

SEQ ID NO: 66177 - RNA, 62 nt, Homo Sapiens
acucccauuuuuacuuaacauacaaaguuuuccuuuguaaucgucagauuuuuaaaguuuug

SEQ ID NO: 66178 - RNA, 62 nt, Homo Sapiens
acaugugagguauagccacccucuaaagaacgcuuuguaaauguaaccuuaaagacagaccc

SEQ ID NO: 66179 - RNA, 62 nt, Homo Sapiens
ggaaauugaaaaugaccugguauuugcuaagucuuuguaaacucuuuuggauuuuuuuaagg

SEQ ID NO: 66180 - RNA, 62 nt, Homo Sapiens
acuccagggcaaaaacgaaccaccuagugaaacuuuguaagaauagcagaaaaaccuagacc

SEQ ID NO: 66181 - RNA, 62 nt, Homo Sapiens
agcacugagauuuauuuuaaaaugauucugcacuuuguaaacaaaugucgcuucuucaagug

SEQ ID NO: 66182 - RNA, 62 nt, Homo Sapiens
acuugugauguuuuaaaauauggaauauuugucuuuguaauuugaaaaacaguuuguauagu

SEQ ID NO: 66183 - RNA, 62 nt, Homo Sapiens
ucuacaaauaauuuaccuuaauggauggcuaacuuuguaaucuauaguaaaagugcaaucau

SEQ ID NO: 66184 - RNA, 62 nt, Homo Sapiens
cagacaagauaugcacuugaucuccauucuaucuuuguaaaagcucguuagcauggaagacu

SEQ ID NO: 66185 - RNA, 62 nt, Homo Sapiens
auaacacaaugaguaauucugauuaguagaagcuuuguaaucaaggaagacauaaguguugu

SEQ ID NO: 66186 - RNA, 62 nt, Homo Sapiens
ggaaacuauaugggaugaacaagguuauuccucuuuguaauauguguguguguaguuacuua

SEQ ID NO: 66187 - RNA, 62 nt, Homo Sapiens
uaugcuuucauauauccuuggauaaccuuuuucuuuguaauuauuuuaaguucuagccccau

SEQ ID NO: 66188 - RNA, 62 nt, Homo Sapiens
ugcaaagagguuggaucaaguuagcuguuuaacuuuguaagagccuucuuauuuuacuucuu

SEQ ID NO: 66189 - RNA, 62 nt, Homo Sapiens
aaauauuuuuugauuuugcgaagcccuuuaaacuuuguaaggcuaaauaauaauaaaaaaaa

SEQ ID NO: 66190 - RNA, 62 nt, Homo Sapiens
ugacuucugacauguuggcacuaaagccuugccuuuguaauucccaaguaauucacuacagc

SEQ ID NO: 66191 - RNA, 62 nt, Homo Sapiens
ucuucugaaaucauuguaaaguauauuaaucucuuuguaaucgcaagagucugauucuuuaa

SEQ ID NO: 66192 - RNA, 62 nt, Homo Sapiens
uaggaaaaauguauaauaagugcagcuauugacuuuguaauugcuuuguagcagaauauauu

SEQ ID NO: 66193 - RNA, 62 nt, Homo Sapiens
aaacauuuuuaaaaauugucuuuuaaaagaagcuuuguaauaaguuaaugugcugagcauuu

SEQ ID NO: 66194 - RNA, 62 nt, Homo Sapiens
auugaaugcaagcguggaaaauaauuuguaggcuuuguaaugggcagguuagaagucauugu

SEQ ID NO: 66195 - RNA, 51 nt, Homo Sapiens
aaccaaagucaggggccuucacuuuguaaacaucacaauaaacaggauuga

SEQ ID NO: 66196 - RNA, 62 nt, Homo Sapiens
uuuucuccuagauuuucccuggcauuuacagucuuuguaagcguuucucucaccuucuugaa

SEQ ID NO: 66197 - RNA, 62 nt, Homo Sapiens
uaaucagaaugaaaaauaaucacagcucauuucuuuguaauaggaaaacagugccaaaccuc

SEQ ID NO: 66198 - RNA, 62 nt, Homo Sapiens
cuuccauaagcaaaaugacacacgagaacaaacuuuguaaauugcuacuauaauaaguuuuu

SEQ ID NO: 66199 - RNA, 62 nt, Homo Sapiens
ucccauaaauugucuuugaaacuuuguaguugcuuuguaauuucuuggauuuauuaugaaga

SEQ ID NO: 66200 - RNA, 62 nt, Homo Sapiens
caaaagcaacuuugggugagcaacguacaacucuuuguaaaagauuuuagaaauaagauaau

SEQ ID NO: 66201 - RNA, 62 nt, Homo Sapiens
cuugaagcuuuccaauggcgcuucucuauggacuuuguaaauaaguuauaucuuuguaauuu

SEQ ID NO: 66202 - RNA, 62 nt, Homo Sapiens
gcuucucuauggacuuuguaaauaaguuauaucuuuguaauuuuccugcuacuuuaucauuu

SEQ ID NO: 66203 - RNA, 62 nt, Homo Sapiens
aaaguuauaugcuguaguuuuuaguauuuugucuuuguaauuuacagaaguuauuggagaaa

SEQ ID NO: 66204 - RNA, 62 nt, Homo Sapiens
aaguccucaucuguuauauaaaauccuuucugcuuuguaaguuuucucuuuuugggauuuuc

SEQ ID NO: 66205 - RNA, 62 nt, Homo Sapiens
uccccucccauguugucgcacugaucacacugcuuuguaauuauuuucuuuauuguugguaa

SEQ ID NO: 66206 - RNA, 62 nt, Homo Sapiens
aauguuuuguugggcuguguugaacauuauuucuuuguaaaugaauguuguaggaaugagga

SEQ ID NO: 66207 - RNA, 62 nt, Homo Sapiens
uaacaugugauuauaauuuuucuuagcauuuucuuuguaaagaacuacaauauaaacuaguu

SEQ ID NO: 66208 - RNA, 62 nt, Homo Sapiens
uacaguauguaacugcgggaaacccacugccccuuuguaagcuguggaacccaaacuguaug

SEQ ID NO: 66209 - RNA, 62 nt, Homo Sapiens
uuaauaauuuugauugaaacccuuuaacaacucuuuguaaauuuuaacucauuuuaguugau

SEQ ID NO: 66210 - RNA, 62 nt, Homo Sapiens
ccaauuuguacauuuuaauuauucaauuucuacuuuguaaaaauagggaaauuauuugaagu

SEQ ID NO: 66211 - RNA, 62 nt, Homo Sapiens
gaauagcaaaugagaaaauguauauaaaagcacuuuguaaauuguaaaaguaguacagaugu

SEQ ID NO: 66212 - RNA, 62 nt, Homo Sapiens
ucuacguauaaacacucuugaauagacuuccacuuuguaauuagaaaauuuuauggacagua

SEQ ID NO: 66213 - RNA, 62 nt, Homo Sapiens
uuuugugaacacuuuugaaaauguacauguuccuuuguaauugacacuauauauuucuuaau

SEQ ID NO: 66214 - RNA, 62 nt, Homo Sapiens
acuccaaugccuguacugugucuacugcaccacuuuguaaacacuucaauuuacuaucuuug

SEQ ID NO: 66215 - RNA, 62 nt, Homo Sapiens
aucccugagcuuucccaguagccuccaguuuccuuuguaagacccagggaucacuuagccau

SEQ ID NO: 66216 - RNA, 62 nt, Homo Sapiens
cugagagccagccugacauuagacagaauacccuuuguaauacauuggaaauuuuuacucau

SEQ ID NO: 66217 - RNA, 62 nt, Homo Sapiens
gauucauucauuauucuaguccugcuuuaguccuuuguaauuugugguaauuaugcuuuucu

SEQ ID NO: 66218 - RNA, 62 nt, Homo Sapiens
aauauuuuaauuacuauuuaaauaucucuuuacuuuguaauccuaugcauuuuacgcauuaa

SEQ ID NO: 66219 - RNA, 62 nt, Homo Sapiens
cugguuuauguucuaggaacucuucaugagcacuuuguaaacacccucuugcuuaauccucc

SEQ ID NO: 66220 - RNA, 62 nt, Homo Sapiens
uaauaugaagaagauauaucauugugcaaccgcuuuguaaauccuuuacaauuaaacuaaau

SEQ ID NO: 66221 - RNA, 62 nt, Homo Sapiens
uucauuccaaaaaugcccggagccucuucaggcuuuguaauuaacgugaauauuuauacagu

SEQ ID NO: 66222 - RNA, 62 nt, Homo Sapiens
agcagauuuuuuuguucucacaggaaaguauacuuuguaagggauauauauuuuuuuuaaug

SEQ ID NO: 66223 - RNA, 62 nt, Homo Sapiens
ugcaaagaaaaguuucaccuacaguuaucacacuuuguaauugcacauuccaaacuuuagca

SEQ ID NO: 66224 - RNA, 62 nt, Homo Sapiens
uagaauucaugaguguuuacuucaaaauuagucuuuguaacaaaagaccaguaacuuuguuu

SEQ ID NO: 66225 - RNA, 62 nt, Homo Sapiens
cacauucuuagcauauaacuaauuuugcuaaacuuuguaaugaacuugcuucccuuuucacu

SEQ ID NO: 66226 - RNA, 62 nt, Homo Sapiens
uaagcaauaguuuauguccuucucuuucuaagcuuuguaagcaaaauauccaaggaucagag

SEQ ID NO: 66227 - RNA, 62 nt, Homo Sapiens
auauaaccccaaacuaagaugcacagggucaucuuuguaauuuuuggaaggucugaaaacuu

SEQ ID NO: 66228 - RNA, 62 nt, Homo Sapiens
gguagaaauauuacagaauauuaaauaucagacuuuguaacauaaaagaguuuauacaggcc

SEQ ID NO: 66229 - RNA, 62 nt, Homo Sapiens
ucauauugaguaaaugaaugaauauguaggcacuuuguaaauggcugcaaguggaagcggau

SEQ ID NO: 66230 - RNA, 62 nt, Homo Sapiens
auauuuugggcauucucagcauaaaaacucuucuuuguaaucugcauucugaggcugaacua

SEQ ID NO: 66231 - RNA, 62 nt, Homo Sapiens
uuuguaaacacugccagaauacuuucuagcugcuuuguaauuuuuuaagaguguuauuuugu

SEQ ID NO: 66232 - RNA, 62 nt, Homo Sapiens
cagaauucugaguuaaagaaacaaaguauuugcuuuguaaaaggccaaaauucuauuuccua

SEQ ID NO: 66233 - RNA, 62 nt, Homo Sapiens
cauuucugcuucagcucuuugcugcuucacuucuuuguaaaguuguaaccugaugguaauua

SEQ ID NO: 66234 - RNA, 62 nt, Homo Sapiens
agguuuugguaauuguagaccuguuucauaagcuuuguaauucagaaauccuuguauuuagu

SEQ ID NO: 66235 - RNA, 62 nt, Homo Sapiens
cagaaucaguuacaaacaucacaguucccaugcuuuguaauaacaccuggugaaaaaguuag

SEQ ID NO: 66236 - RNA, 62 nt, Homo Sapiens
uaguggguggauagcaaguauauucuaaaaaacuuuguaaauaaaguuuuguggcuaaaaug

SEQ ID NO: 66237 - RNA, 62 nt, Homo Sapiens
auugauagucacuagaguaauguauucuuaaccuuuguaagaacugaucucagcauguauuc

SEQ ID NO: 66238 - RNA, 62 nt, Homo Sapiens
aacaacaacaaagggcaguaaauuaaaguacucuuuguaagguacaguuaccgauuaaucua

SEQ ID NO: 66239 - RNA, 62 nt, Homo Sapiens
ugaaauuacuguaccuagucuuuuuugcauuacuuuguaaccuuuuucuaugcaagagucuu

SEQ ID NO: 66240 - RNA, 62 nt, Homo Sapiens
ucuuuugguucuguucacugagcuaaauuuaucuuuguaaaucuuuuugagucuggggggug

SEQ ID NO: 66241 - RNA, 62 nt, Homo Sapiens
aagagcuucugggacagagacugcuuggccagcuuuguaaguaaguggcugccuccaaugug

SEQ ID NO: 66242 - RNA, 62 nt, Homo Sapiens
ugaugguuuugugauuuagcuggguaaacuaucuuuguaacagauaaguuauuuauaaaaau

SEQ ID NO: 66243 - RNA, 62 nt, Homo Sapiens
ugggaacagccaaagggauuccaaggcuaaaucuuuguaacagcucucuuucccccuugcua

SEQ ID NO: 66244 - RNA, 62 nt, Homo Sapiens
uagcgcuaaauaauuugaacgaacuuaaaccucuuuguaaaacuugauucagauauuuaugu

SEQ ID NO: 66245 - RNA, 62 nt, Homo Sapiens
acugcuauuguaauaaguguuguauuuugugacuuuguaacaaccaacugcugagauuuuua

SEQ ID NO: 66246 - RNA, 62 nt, Homo Sapiens
uuccaagucauucucaccuacccucacugggacuuuguaaacaucuccuuguuguucuuuaa

SEQ ID NO: 66247 - RNA, 62 nt, Homo Sapiens
gccguacaauaaacaaauuaauugucuguuuucuuuguaaauuuauucuuucuacugagggc

SEQ ID NO: 66248 - RNA, 62 nt, Homo Sapiens
guuugugauacuugaaacaugugauuauauugcuuuguaaugagcaguaagggggaaggagg

SEQ ID NO: 66249 - RNA, 62 nt, Homo Sapiens
aacuuuuuaaaaauuaauuguuauacagucaacuuuguaaugauggauuauguuuuagcauu

SEQ ID NO: 66250 - RNA, 62 nt, Homo Sapiens
acaacuuucacuauaaugugaaugaauaaugccuuuguaacccccauggaaaaaugccauca

SEQ ID NO: 66251 - RNA, 62 nt, Homo Sapiens
acuuugauaugcuguuaucagaagagggaguacuuuguaaccuuugucacuggaugcuacuu

SEQ ID NO: 66252 - RNA, 62 nt, Homo Sapiens
gacuguaaauauauuuuugguccauuuguaaucuuuguaauaaauacagucaccuagacacu

SEQ ID NO: 66253 - RNA, 62 nt, Homo Sapiens
cuuguaaauuuuauuuauaccuguaaauguuccuuuguaaaaacaaauaacagaaacaaaau

SEQ ID NO: 66254 - RNA, 62 nt, Homo Sapiens
agauuuaugguaacugguuucauuacauuuaucuuuguaaaauuuuuaaaaguaguaagcca

SEQ ID NO: 66255 - RNA, 62 nt, Homo Sapiens
ccagaacucuaauuggacaccacucccuuccacuuuguaauaugauacauaauuuaaaagca

SEQ ID NO: 66256 - RNA, 62 nt, Homo Sapiens
aauguaauuucuuuccuuuuuuuguguaucugcuuuguaauaaauuuguacauauuuuagaa

SEQ ID NO: 66257 - RNA, 62 nt, Homo Sapiens
ugacaaucauguagaaaccugaaauuuguuaucuuuguaaaauuuaagacauuuaaaaacgu

SEQ ID NO: 66258 - RNA, 62 nt, Homo Sapiens
ugugaaacuuuauuaauguacuaguauaauuucuuuguaauauagcacauauaugcaagcac

SEQ ID NO: 66259 - RNA, 62 nt, Homo Sapiens
ccaauaaucauaguuauggaaguguucauuuacuuuguaauucacugcuauuagacaauuga

SEQ ID NO: 66260 - RNA, 62 nt, Homo Sapiens
acuugcuuguuuuccuuauucaagaaaguauccuuuguaaaauuuucauuguguguauuucc

SEQ ID NO: 66261 - RNA, 62 nt, Homo Sapiens
gccaauaacugguuuaauguauuuuugacugacuuuguaaaaaagaguaauguauuaccuca

SEQ ID NO: 66262 - RNA, 62 nt, Homo Sapiens
cauguuugagauggguggccuuuauguuccugcuuuguaauuaguuauguuuacacaucauu

SEQ ID NO: 66263 - RNA, 62 nt, Homo Sapiens
gggaagccuuugcaagaaaauugcauacaaggcuuuguaacgaucaagugcuaaucgaugga

SEQ ID NO: 66264 - RNA, 62 nt, Homo Sapiens
aauaccagcuggggagacacuagggaagggagcuuuguaagccuugauugcgaaaguccaaa

SEQ ID NO: 66265 - RNA, 62 nt, Homo Sapiens
uaggauucucucuaaauuauuuauugaagaggcuuuguaaauagugcaccagugacaggugc

SEQ ID NO: 66266 - RNA, 62 nt, Homo Sapiens
ccguaguuuauuuuaaaauauauuuuuaaaagcuuuguaaaaauuaugucauucucagaauu

SEQ ID NO: 66267 - RNA, 62 nt, Homo Sapiens
gugcccuguaaccugacugguuaacagcaguccuuuguaaacaguguuuuaaacucuccuag

SEQ ID NO: 66268 - RNA, 62 nt, Homo Sapiens
uauacuuguagcaaauuguuuuaauucuguagcuuuguaauauguuuuaaaaucagaaacua

SEQ ID NO: 66269 - RNA, 62 nt, Homo Sapiens
ccuaugucuguuacaaaacauaguuuauguagcuuuguaacauuccucagugccuguccaua

SEQ ID NO: 66270 - RNA, 62 nt, Homo Sapiens
auucauaucuguuucauuuggaggauuuucuucuuuguaauguaaagaaauucaaaguuauc

SEQ ID NO: 66271 - RNA, 62 nt, Homo Sapiens
uaaacauuaacuuuccuauaagaauauuuuggcuuuguaaucuauagccucaaauugguauu

SEQ ID NO: 66272 - RNA, 62 nt, Homo Sapiens
acacucuuacaccuguuauggaaaaugucaaccuuuguaagaaaaccaaaauaaaaauugaa

SEQ ID NO: 66273 - RNA, 62 nt, Homo Sapiens
accucacagcagcuucgugcuuuuguacagaccuuuguaacaaguguacagaaaacucauuu

SEQ ID NO: 66274 - RNA, 62 nt, Homo Sapiens
gcuacguuuauugccucgucuuauucacugaccuuuguaaugauacacagugaauucuuuuu

SEQ ID NO: 66275 - RNA, 62 nt, Homo Sapiens
auuuuuuuaauguacccuaccuucaguauucucuuuguaaguuggugacuugcaucuguggc

SEQ ID NO: 66276 - RNA, 62 nt, Homo Sapiens
uucuaauuaauagccaaagauuucauaucuaacuuuguaaccagaauuauacaguaaguuga

SEQ ID NO: 66277 - RNA, 62 nt, Homo Sapiens
ugcccaggggcccacagggaacccugcuugcacuuuguaacauguuuacuuuucagggcauc

SEQ ID NO: 66278 - RNA, 62 nt, Homo Sapiens
ucugcugcccuccaccauuuauuuuuacagugcuuuguaauuuuuuucaucaguuccuuaaa

SEQ ID NO: 66279 - RNA, 62 nt, Homo Sapiens
ccugggcuggaagucaaagcggggggacauuccuuuguaaaaccccagacauccugcaaccu

SEQ ID NO: 66280 - RNA, 62 nt, Homo Sapiens
aacuuuggucucccuacauuuaauaaaugauccuuuguaaauuuuuguuuuuaaaauguguu

SEQ ID NO: 66281 - RNA, 62 nt, Homo Sapiens
uugaaauaaguaauacuuucaucaauaagaugcuuuguaaagaauaguauggaucuuuuuaa

SEQ ID NO: 66282 - RNA, 62 nt, Homo Sapiens
uauaucugaaccuaaugguuauaaaaaagaaccuuuguaaaauaaauaccaaaagagggaaa

SEQ ID NO: 66283 - RNA, 62 nt, Homo Sapiens
gggauauggacaaguaaguaucugugacuuaacuuuguaaagugccccucuuccuucuuccu

SEQ ID NO: 66284 - RNA, 62 nt, Homo Sapiens
uuuuuuuuuugcuuuuaccuuguuauguuaugcuuuguaaaugaguauaaaaagaaccccaa

SEQ ID NO: 66285 - RNA, 62 nt, Homo Sapiens
guuuagcaaaauaacugauuacagcaguuugacuuuguaaaaaaacauacaguuuauuccac

SEQ ID NO: 66286 - RNA, 62 nt, Homo Sapiens
guguagaagcauuccuucuucuuucuaguggucuuuguaagauagcuuuuuaauuguuguuu

SEQ ID NO: 66287 - RNA, 62 nt, Homo Sapiens
aaacugcaauuuuauaaauuggagaucgguaucuuuguaauagggggagggggagagagcaa

SEQ ID NO: 66288 - RNA, 62 nt, Homo Sapiens
aaauguaucaauauguuauaaugugugaguuucuuuguaauaauaaauaggacaaaucauuu

SEQ ID NO: 66289 - RNA, 62 nt, Homo Sapiens
caucacaagccauagugguagcuucaguuuuucuuuguaagcagcauuuuucuuaaggcuau

SEQ ID NO: 66290 - RNA, 62 nt, Homo Sapiens
uaagguccuugugcaucuuaaugccggaugaccuuuguaaguuggagacccaccacgucucu

SEQ ID NO: 66291 - RNA, 62 nt, Homo Sapiens
uguuagcuucaauuaauuagguuuuagcauuucuuuguaaaaucuugccuuucuucccugcu

SEQ ID NO: 66292 - RNA, 62 nt, Homo Sapiens
uuuauauuccaaauauugcuuauuauaauaugcuuuguaaauuagguuaaguauuauuuagg

SEQ ID NO: 66293 - RNA, 62 nt, Homo Sapiens
aucuguccccaguucuuccaagccucucugaacuuuguaaaaacagaaugaaagggcaucuc

SEQ ID NO: 66294 - RNA, 62 nt, Homo Sapiens
aaaaccacauuggagauguuugaaacauguuucuuuguaauguauauuaugaagcuuuuaug

SEQ ID NO: 66295 - RNA, 62 nt, Homo Sapiens
aaaauuauuuguauuuuuaauggauuucaaaucuuuguaauaucuuaguucagacucauaua

SEQ ID NO: 66296 - RNA, 62 nt, Homo Sapiens
acaguaaaauaauccaccgugagacccagccucuuuguaaguaugcuguuuaagugcaggcu

SEQ ID NO: 66297 - RNA, 62 nt, Homo Sapiens
gcaaaagccucagaaagggagguguguuguaucuuuguaagacguguguccuuugguacuau

SEQ ID NO: 66298 - RNA, 62 nt, Homo Sapiens
aaaauuuagguaagcaggcucauauguaacuccuuuguaaccuuucugaaacuccauuauaa

SEQ ID NO: 66299 - RNA, 62 nt, Homo Sapiens
uaaauuggagcuuuuagcuuaggaaaguauagcuuuguaauuaacuauguguaaauauauua

SEQ ID NO: 66300 - RNA, 62 nt, Homo Sapiens
aaucacuaaacucuaguacauuauagcaggugcuuuguaaucuggaauggagaagagguagg

SEQ ID NO: 66301 - RNA, 62 nt, Homo Sapiens
ugugccuggcugguuugcagauauuuguucugcuuuguaaaaauuggccauuagugcauuua

SEQ ID NO: 66302 - RNA, 62 nt, Homo Sapiens
gaggaaacuaauggaguuucauuguaacuguccuuuguaauuuauauaaauguauuauuuuc

SEQ ID NO: 66303 - RNA, 62 nt, Homo Sapiens
uaugaaaauguccucuucuucaaagguauaggcuuuguaaugaauuagauuuucugccaaua

SEQ ID NO: 66304 - RNA, 62 nt, Homo Sapiens
gaggaauuauacaaaauuaauauauaugaguccuuuguaauuuauuuuuuuuugagacagga

SEQ ID NO: 66305 - RNA, 62 nt, Homo Sapiens
cucuaaacuagccuugaaguuuacagacaugacuuuguaaauguauuguuuuucuuuguugu

SEQ ID NO: 66306 - RNA, 62 nt, Homo Sapiens
ucaauuucaguucagcuaacauauauuaauaccuuuguaacucuuugcuauggcuuuuguua

SEQ ID NO: 66307 - RNA, 62 nt, Homo Sapiens
gaacaaacauauuuaugaucaugaauaaugugcuuuguaaaaagauuucaaguuauuaggaa

SEQ ID NO: 66308 - RNA, 62 nt, Homo Sapiens
gggguucuaauuacugucugugagaguuacuacuuuguaacuuaugguuucugcuucaguau

SEQ ID NO: 66309 - RNA, 62 nt, Homo Sapiens
guguaauucuauuguaauaaacuggcagguaucuuuguaacuauaaauagugcaugcucagc

SEQ ID NO: 66310 - RNA, 62 nt, Homo Sapiens
uauuuaguugauuuuaauuaugcucuucuugucuuuguaaucaccaggagauuacaauuuuu

SEQ ID NO: 66311 - RNA, 62 nt, Homo Sapiens
uucuucaccacagacaccuuaagauuuauaaccuuuguaaugaaaacucucagggcccuauu

SEQ ID NO: 66312 - RNA, 62 nt, Homo Sapiens
aguauuuugccacaccuguaugcaguugcuuucuuuguaauaggcuuaccccucucuagggu

SEQ ID NO: 66313 - RNA, 62 nt, Homo Sapiens
uauacaaauaaucuaacacaaaucauaugguccuuuguaaaauaaaugugguaggaaauaua

SEQ ID NO: 66314 - RNA, 62 nt, Homo Sapiens
aguauuuuuauacuucauccauaccuccuucccuuuguaaauugucuacgguuaagcaacag

SEQ ID NO: 66315 - RNA, 62 nt, Homo Sapiens
uuuugcacuauuguuuuggcaagagauuguugcuuuguaacuagccuauacugcauuagccc

SEQ ID NO: 66316 - RNA, 62 nt, Homo Sapiens
gagucuguaauaggauuuccagaacaguauugcuuuguaauaccaaaucauuucaacugaaa

SEQ ID NO: 66317 - RNA, 62 nt, Homo Sapiens
uucgguuuaagguuucagggcuuagucuuuaacuuuguaaggccuuuuccuucugaccaaca

SEQ ID NO: 66318 - RNA, 62 nt, Homo Sapiens
cuuaaauauuuuauucuauuuagugucguacgcuuuguaagaagugguauccuauauuacuu

SEQ ID NO: 66319 - RNA, 62 nt, Homo Sapiens
uuaauuccaugaaagucuuaucauuggaaguucuuuguaauucuuucuuccauauauguggu

SEQ ID NO: 66320 - RNA, 62 nt, Homo Sapiens
cagaaugauuccguuuuugcgugccuaauuuacuuuguaaaccuuugugauagguuuguacu

SEQ ID NO: 66321 - RNA, 62 nt, Homo Sapiens
ucaaagcaguaauaucuucuagcuguuuuucccuuuguaauagugcuuuucagagacgccau

SEQ ID NO: 66322 - RNA, 62 nt, Homo Sapiens
ugucuuagauaauaaaacuauacuuguuauuucuuuguaaaaaggggaaacuguguaagcug

SEQ ID NO: 66323 - RNA, 62 nt, Homo Sapiens
aguuaaagauuugaaagagaagugcucugcuccuuuguaaaauuucccaccauuucccuuua

SEQ ID NO: 66324 - RNA, 62 nt, Homo Sapiens
guaugauguaaauuuucaguuaugaaaagaaacuuuguaaaauuuguaaagaaguauauuuu

SEQ ID NO: 66325 - RNA, 62 nt, Homo Sapiens
acuauccaugaagggaaagcuaauacuuaaggcuuuguaaaaguauguccucauagaacuuu

SEQ ID NO: 66326 - RNA, 62 nt, Homo Sapiens
acuggugcuguucauucauacuaauuuacaaacuuuguaaagcaggagacugaaaguucaua

SEQ ID NO: 66327 - RNA, 62 nt, Homo Sapiens
uuucugauugauaggauuagacacaaaaaauccuuuguaaaaauaaccacacacagauaacc

SEQ ID NO: 66328 - RNA, 62 nt, Homo Sapiens
uuuuaaaugcauaaaggggguuuuuuacaagucuuuguaaaaggugccaaauuccauuuaac

SEQ ID NO: 66329 - RNA, 62 nt, Homo Sapiens
gugagggaaucuaauuaagauuucaugcuguucuuuguaaugauaaauguuuccggacuaaa

SEQ ID NO: 66330 - RNA, 62 nt, Homo Sapiens
uagauguuggaacuaccuuuuuacuccccauacuuuguaaguaaugcuuccagauuaaccug

SEQ ID NO: 66331 - RNA, 62 nt, Homo Sapiens
ccauaugugaauguaagcucuuaacuaugucucuuuguaauguguaauuucuuucugaaaua

SEQ ID NO: 66332 - RNA, 62 nt, Homo Sapiens
gugaaauucuagaaaaaaauauuaccaccucucuuuguaauuuacuuuacuuguaugaauuu

SEQ ID NO: 66333 - RNA, 62 nt, Homo Sapiens
ccugcacugugucaucuuuucaaggcauuugucuuuguaauauuuuccauaaauuuggacug

SEQ ID NO: 66334 - RNA, 62 nt, Homo Sapiens
aaauuacccuauccuuuguucucuacuguuuucuuuguaauguaugacuacgagagugauac

SEQ ID NO: 66335 - RNA, 62 nt, Homo Sapiens
uuuuuuucuuuuuuugacucguugacaagugucuuuguaauauguuuuuaguucccuuuuuu

SEQ ID NO: 66336 - RNA, 62 nt, Homo Sapiens
acagcauuuuuacuuucuguacaacaaaaaagcuuuguaaauaaaaucuuaacauuuugggu

SEQ ID NO: 66337 - RNA, 62 nt, Homo Sapiens
auguuucuugcauuaugaaggcuacaucugugcuuuguaaguaccacuucaaaaaauaguuc

SEQ ID NO: 66338 - RNA, 62 nt, Homo Sapiens
uuagagcuuugugcuuuucucucauuccaucacuuuguaaugaugauacuuaacaugagcag

SEQ ID NO: 66339 - RNA, 62 nt, Homo Sapiens
gggcuuuaucuaugaaaaaguaguaaauaguucuuuguaaccugugugaagcagcagccagc

SEQ ID NO: 66340 - RNA, 62 nt, Homo Sapiens
cauugaggguuuguuuguguuuucaucaaugucuuuguaaagcacaaauuaucugccuuaaa

SEQ ID NO: 66341 - RNA, 62 nt, Homo Sapiens
uggagucguuuugagaugagcauuagccccagcuuuguaaccaaugaggaacacuuacuuau

SEQ ID NO: 66342 - RNA, 62 nt, Homo Sapiens
caguguugagauggggauaaauuaguaaaugucuuuguaaguaguuaagagaaacuuuauac

SEQ ID NO: 66343 - RNA, 62 nt, Homo Sapiens
uguaauuacaguuuuuguaacugccuguuuuucuuuguaauuggaugucaauacaagauugu

SEQ ID NO: 66344 - RNA, 62 nt, Homo Sapiens
uauauauauacuuguuuuucuuauuaguuaaacuuuguaaaaugucaauuugcucuaguguc

SEQ ID NO: 66345 - RNA, 62 nt, Homo Sapiens
acccaucgggaagagacuuuuccaucuccccgcuuuguaaauaacacugguuaauuucacac

SEQ ID NO: 66346 - RNA, 62 nt, Homo Sapiens
cucuuuuguaacuaucgacagcccuugagacacuuuguaaugaguuccugaccuuccucuga

SEQ ID NO: 66347 - RNA, 62 nt, Homo Sapiens
acucuuuggcauggguaaauaggcugcaaguacuuuguaaucauuaagugcccaauauugaa

SEQ ID NO: 66348 - RNA, 62 nt, Homo Sapiens
uaauauacucaucauagaaaaauuuucguagucuuuguaaaauuaccaguauaucagaggaa

SEQ ID NO: 66349 - RNA, 62 nt, Homo Sapiens
aauggaauuauucauuuuucguggacagagaccuuuguaaccaacgguuucuccuguggaua

SEQ ID NO: 66350 - RNA, 62 nt, Homo Sapiens
aaauuauuuuaaagugacugaaaccaccccugcuuuguaacauaggccguggugaaguugau

SEQ ID NO: 66351 - RNA, 62 nt, Homo Sapiens
gucuuauuuguguaauaaaguuucaugucgugcuuuguaaauugucuguuuuguuacauacc

SEQ ID NO: 66352 - RNA, 62 nt, Homo Sapiens
gaaguucuuucaguaagaugggggcuggaaaucuuuguaaaguuaaacauuagagcuggagu

SEQ ID NO: 66353 - RNA, 62 nt, Homo Sapiens
auugaaguguguaauaaagcauuuaacuuuaacuuuguaaauuaauacaauagagacuuuuc

SEQ ID NO: 66354 - RNA, 62 nt, Homo Sapiens
aaacuguuuggaaccacaccaaugauauuuuucuuuguaauacuugaaauuuauuuuuuuau

SEQ ID NO: 66355 - RNA, 62 nt, Homo Sapiens
gagaucauugguagccagggguugcuaccaaacuuuguaaccucaaggacaaaaugaggaag

SEQ ID NO: 66356 - RNA, 62 nt, Homo Sapiens
auaaagaagacaugaauuguuuuaagucuacacuuuguaauuagcuaaguugugcaguauuu

SEQ ID NO: 66357 - RNA, 62 nt, Homo Sapiens
aaucuagaccaaagaaugguauuuucacuuuucuuuguaacauugaaugguuugaaguacuc

SEQ ID NO: 66358 - RNA, 62 nt, Homo Sapiens
uucaauagaaauuuuuauuucauuuucaauuacuuuguaaauucguguguauuuaguacacu

SEQ ID NO: 66359 - RNA, 62 nt, Homo Sapiens
uaccugagacuuucaguucguuuguauucuaccuuuguaaaacagccuauagaugaugaugu

SEQ ID NO: 66360 - RNA, 62 nt, Homo Sapiens
guaucuuuugguuguuugauuuuucuuucuuucuuuguaaauaguucugaguucugucaaau

SEQ ID NO: 66361 - RNA, 62 nt, Homo Sapiens
cuuuuguacuagcccaguauuuauuuacauugcuuuguaauauaaaucuguuuuagaacugc

SEQ ID NO: 66362 - RNA, 62 nt, Homo Sapiens
ccucugccccucccccagccaugccagcuggccuuuguaagugcaggaaaccgaguagaaaa

SEQ ID NO: 66363 - RNA, 62 nt, Homo Sapiens
gaguuauauaaggcuacuucaugacaagacugcuuuguaauauuucacuuuguuuuacuaca

SEQ ID NO: 66364 - RNA, 62 nt, Homo Sapiens
gauucuugccucuagcaaugcugcccuuucaucuuuguaagaauuaaaaaaagcacuggguu

SEQ ID NO: 66365 - RNA, 62 nt, Homo Sapiens
cacuugacuuugcuaauggccuuucuaaugggcuuuguaaacuacagcucagauacugaucu

SEQ ID NO: 66366 - RNA, 62 nt, Homo Sapiens
uacuugaugaguuuauaucuuauuuuuguuuccuuuguaauucuauguaauuuuguccuugu

SEQ ID NO: 66367 - RNA, 62 nt, Homo Sapiens
ucuuauucugggagaacauaggauuuccaggacuuuguaaguagguggcuggagagagcuga

SEQ ID NO: 66368 - RNA, 62 nt, Homo Sapiens
uuauuauuccagagaguauauuuguuuuaaaucuuuguaaagaaaaggcuuuuaaaauuuug

SEQ ID NO: 66369 - RNA, 62 nt, Homo Sapiens
ucaaaacauuucccaugagcccaacaucuauacuuuguaaaguauacauuuuucuuaauguu

SEQ ID NO: 66370 - RNA, 62 nt, Homo Sapiens
ggcuucuaacagaauucaacgugcuacugucccuuuguaauugaaaguggcuuugacaccaa

SEQ ID NO: 66371 - RNA, 62 nt, Homo Sapiens
ucaguagccguccugcaggccucccagaaggccuuuguaaaaccaggugagcccuggauugg

SEQ ID NO: 66372 - RNA, 62 nt, Homo Sapiens
cccauauuuuuaacucuuccuggccaacuucacuuuguaagauuccucaggcuucucaccug

SEQ ID NO: 66373 - RNA, 62 nt, Homo Sapiens
aaguuuaccuuuugacuggagcuaacacuuuucuuuguaaagucuuuccagagcuuauaguu

SEQ ID NO: 66374 - RNA, 62 nt, Homo Sapiens
cuguacugugggccgggcgcagcuacaccuuucuuuguaaaauuauuccuuuccuuuccugg

SEQ ID NO: 66375 - RNA, 62 nt, Homo Sapiens
aaauugauugaagauuuuaaccuuaugauguacuuuguaaaauccucccaaggguucuggca

SEQ ID NO: 66376 - RNA, 62 nt, Homo Sapiens
cuagacacuagauuguaguuuuucauuuuauucuuuguaauuuacuagcgagaaaucuuuga

SEQ ID NO: 66377 - RNA, 62 nt, Homo Sapiens
uuuguucuauaugaauaaaacuguaugaaugacuuuguaaauucaguaaaaaaacacaaaaa

SEQ ID NO: 66378 - RNA, 62 nt, Homo Sapiens
gcauggcuuaaccuggugauaauuucuaacuacuuuguaacuuaacucuaacacccuucaga

SEQ ID NO: 66379 - RNA, 62 nt, Homo Sapiens
uuuaaagucuuaaacuuuucgggcgaauacuacuuuguaacuguuaaugguuaauauaggca

SEQ ID NO: 66380 - RNA, 62 nt, Homo Sapiens
acacaucuuuaauaauguuauauaucuaggaacuuuguaacacuauuuguuuuguacaugua

SEQ ID NO: 66381 - RNA, 62 nt, Homo Sapiens
uuguuacuaaagugucuaguugaagcuaaaaccuuuguaauauuuucauuuucaguuauuuu

SEQ ID NO: 66382 - RNA, 62 nt, Homo Sapiens
agaaaaauauggccuugaugguuuccuaacagcuuuguaauaauaaauugguuccugagagg

SEQ ID NO: 66383 - RNA, 62 nt, Homo Sapiens
aauuugugaauuguguauaaagauuggcaauucuuuguaaagacuacuacaaaauuggaaaa

SEQ ID NO: 66384 - RNA, 62 nt, Homo Sapiens
uaacuaaauaauguaauggcaccugccguuugcuuuguaacguaauagaacaacguuuauga

SEQ ID NO: 66385 - RNA, 62 nt, Homo Sapiens
gauucuggacauaugcaucagaaucggauggucuuuguaacuuagaugaacuaagagaaaaa

SEQ ID NO: 66386 - RNA, 62 nt, Homo Sapiens
uauuguaguuagaaauuguacaugaaaugaaacuuuguaacuucacugcuuaacuucaucuu

SEQ ID NO: 66387 - RNA, 62 nt, Homo Sapiens
uugacuuaaguagaaguaauaugcucucauuucuuuguaaucuagauuuuccuauguugaau

SEQ ID NO: 66388 - RNA, 62 nt, Homo Sapiens
uaguacacaaaacuaagaaucuuuagacuuaucuuuguaacuaauuaggguggaaguuauga

SEQ ID NO: 66389 - RNA, 62 nt, Homo Sapiens
caauaaacauguuuucauguaauacuggcuuacuuuguaauuuacaucuguaacuuucauau

SEQ ID NO: 66390 - RNA, 62 nt, Homo Sapiens
acauguaacuucucucacaagaguacucuuuacuuuguaaucauauacaaugucaacuuuuu

SEQ ID NO: 66391 - RNA, 62 nt, Homo Sapiens
uguugagaugaguuugcuguacugacgcugcacuuuguaaacagauuaccaguuuuuuacuu

SEQ ID NO: 66392 - RNA, 62 nt, Homo Sapiens
uacacuguguuuuaaauuacuuuaaaaauaaacuuuguaagcagauuuuaauuuagucuuug

SEQ ID NO: 66393 - RNA, 62 nt, Homo Sapiens
aagagcugcugcuauaacuuccaguuuuacaucuuuguaaaauuguaucucaaaggcagaaa

SEQ ID NO: 66394 - RNA, 62 nt, Homo Sapiens
aauaugcuguuuccauuaugacacagcagcuccuuuguaaguaccaggucauguccaucccu

SEQ ID NO: 66395 - RNA, 62 nt, Homo Sapiens
agagagaacagggugguauucuaaguauguuucuuuguaacaucuuuagcaguaggacagag

SEQ ID NO: 66396 - RNA, 62 nt, Homo Sapiens
uuauuauuauuauuuuuugagauggagucucacuuuguaacccaggcuggaaugcaauggca

SEQ ID NO: 66397 - RNA, 62 nt, Homo Sapiens
aagacuuuauuguucuaauuauccagauguaccuuuguaaaauagcucuuuuaugaauuagc

SEQ ID NO: 66398 - RNA, 62 nt, Homo Sapiens
gcuuugaacaauuguguuuucgucacaggagucuuuguaaugcuuguacaguugaugucgau

SEQ ID NO: 66399 - RNA, 62 nt, Homo Sapiens
uauggagcccauuguaccuuuaauuuuuuguacuuuguaaaaauuuuucuuuguauaugaaa

SEQ ID NO: 66400 - RNA, 62 nt, Homo Sapiens
acauauagaacuguuacaauaggaauaacacccuuuguaacuugaaaggugucaucaucacu

SEQ ID NO: 66401 - RNA, 62 nt, Homo Sapiens
uuacacaucucgugaaaacuccuaucguggggcuuuguaaugugaagaguugaucccuuugu

SEQ ID NO: 66402 - RNA, 62 nt, Homo Sapiens
auuuuuaauauguaaggaauugaaaauauuaucuuuguaauuuagauuuguuuuguguuguu

SEQ ID NO: 66403 - RNA, 62 nt, Homo Sapiens
ggaaggauuguacugaaggcuccugaagcagccuuuguaagucagcccuuuuaucucugcuu

SEQ ID NO: 66404 - RNA, 62 nt, Homo Sapiens
gcucuuagcacacucacagauguauaaaauaccuuuguaacgcuagcugacucagcauagau

SEQ ID NO: 66405 - RNA, 62 nt, Homo Sapiens
gucuucagagcagcccuacugugauuccaauucuuuguaauuuaagauaaccacuugauuuu

SEQ ID NO: 66406 - RNA, 62 nt, Homo Sapiens
ugaagaguagaauuccaagacucaauuuaaggcuuuguaaaauugucaugugauuuuugagu

SEQ ID NO: 66407 - RNA, 62 nt, Homo Sapiens
gcuuggugccucuuaggacuuugucaccuagccuuuguaaccgucggaccuugugauuugga

SEQ ID NO: 66408 - RNA, 62 nt, Homo Sapiens
auuuaaaaauguaaaaacgauauuuauaugaccuuuguaaccggaggauauuauuauguggg

SEQ ID NO: 66409 - RNA, 62 nt, Homo Sapiens
ccagaguuucggacagcccacucuggcggggucuuuguaagagaggacagaagggacuaggg

SEQ ID NO: 66410 - RNA, 62 nt, Homo Sapiens
uuuugugacugucaccugagccagcuuugauccuuuguaagauaaauaaggggaggguuguu

SEQ ID NO: 66411 - RNA, 62 nt, Homo Sapiens
cugcuccucuccacugcccaccuucagccucccuuuguaaugccgguucccugagggaugag

SEQ ID NO: 66412 - RNA, 62 nt, Homo Sapiens
uguuuucugagagcacagggaccucacggagacuuuguaauuuaauggaagcaagacuucca

SEQ ID NO: 66413 - RNA, 62 nt, Homo Sapiens
aaguuuuuuuucuggguucaauacuuguauaacuuuguaaauccauagaaaauugggugugu

SEQ ID NO: 66414 - RNA, 62 nt, Homo Sapiens
uccacccaacacguuuuugcaaagcaagaagucuuuguaagacaccuuaaacaaaguccuuc

SEQ ID NO: 66415 - RNA, 62 nt, Homo Sapiens
ccugauggucauuuuucuaaacagaggcccugcuuuguaauauguggccaaggagauaauuu

SEQ ID NO: 66416 - RNA, 62 nt, Homo Sapiens
cauguuuuucuguagcacugggcccaaauauucuuuguaaagaaaaucgcugcagcaaaaac

SEQ ID NO: 66417 - RNA, 62 nt, Homo Sapiens
uuuaagucggcagcuuucuaauuuaaucuuagcuuuguaauucauguuuugcuuuuguggac

SEQ ID NO: 66418 - RNA, 62 nt, Homo Sapiens
accaaauaaucuuaccucuagucuacuuacaacuuuguaaggguuucuaagcuaugcccauu

SEQ ID NO: 66419 - RNA, 62 nt, Homo Sapiens
gaaaaucaaaugaugcaaaauauauacaagcacuuuguaaauuguaaaaugauacaaaauuu

SEQ ID NO: 66420 - RNA, 62 nt, Homo Sapiens
ugugugaagcucuuggcuuuuuuccaacguuacuuuguaacuaaugaggguggauguucauu

SEQ ID NO: 66421 - RNA, 62 nt, Homo Sapiens
guuauuguugacucucucccaagugccuugaucuuuguaauaucuccuguuguuucuaugau

SEQ ID NO: 66422 - RNA, 62 nt, Homo Sapiens
auacaagaaacaaccuuggaaaaguuauuucccuuuguaauaccuuuaaaaauccagaguau

SEQ ID NO: 66423 - RNA, 62 nt, Homo Sapiens
auaaccuuaaaaaggacuauauuaaucaccuucuuuguaaucccuucacagucccagguuua

SEQ ID NO: 66424 - RNA, 62 nt, Homo Sapiens
auuuaaggaaacuagacaaguaaaauuauccucuuuguaauuuaaugaaaagguacaacaga

SEQ ID NO: 66425 - RNA, 56 nt, Homo Sapiens
gguaugaaauucaguuauaguuuaaucuuuguaaucucacuaauuuucaugauaaa

SEQ ID NO: 66426 - RNA, 62 nt, Homo Sapiens
ccaaagaucauuuuuuuauauagacuucagcccuuuguaaauauuguaacuggggaguauag

SEQ ID NO: 66427 - RNA, 62 nt, Homo Sapiens
caacaauuaaaucuugccuuuacacacccaaacuuuguaauuuuagucuuggugaaauauaa

SEQ ID NO: 66428 - RNA, 62 nt, Homo Sapiens
agggugcuuuuauauauaagagcagcagccgccuuuguaaagugugaucuaugagaauugga

SEQ ID NO: 66429 - RNA, 62 nt, Homo Sapiens
ucaguagaacuuacacauccuaggaaaucuuucuuuguaaguaauucuuuuggucucaagug

SEQ ID NO: 66430 - RNA, 62 nt, Homo Sapiens
acugucaccuugauggacaaguuucaauaaaacuuuguaaaaauaauuggacaugugccugg

SEQ ID NO: 66431 - RNA, 62 nt, Homo Sapiens
ggccauggagcuggcccagaggccccucagcccuuuguaaagucugaugaaggcaggggugg

SEQ ID NO: 66432 - RNA, 62 nt, Homo Sapiens
gauagaaaggaacaagacuaaaauuguaaauacuuuguaaacaucagcauuuguacuugaau

SEQ ID NO: 66433 - RNA, 62 nt, Homo Sapiens
ugaggauaucaucuagaucaaggucaccuuaucuuuguaagaaaccucucacaagcuggggc

SEQ ID NO: 66434 - RNA, 62 nt, Homo Sapiens
caugcaucuuuucuccauaagggucuccaaaacuuuguaaauaggguaggccucagaccagg

SEQ ID NO: 66435 - RNA, 62 nt, Homo Sapiens
agguguguugaauuuguuuugcucuggaaucccuuuguaaauuccucagccucgaaaagugg

SEQ ID NO: 66436 - RNA, 62 nt, Homo Sapiens
caaagaauuguuuaaaaugggucuaccucccucuuuguaaauuaagguugggaggcuaacga

SEQ ID NO: 66437 - RNA, 62 nt, Homo Sapiens
caccugacagaaaaaaaagauucauuuuuuuucuuuguaauguccuuuucuuuuucuuuccu

SEQ ID NO: 66438 - RNA, 62 nt, Homo Sapiens
aguagcauccuuauauaauagcacagaaaauacuuuguaaaaaaacauugugaucuauaaau

SEQ ID NO: 66439 - RNA, 62 nt, Homo Sapiens
augcccauuacuuuuuuaacuauauuguuuaacuuuguaagauuuucugcuuuguauauuuc

SEQ ID NO: 66440 - RNA, 62 nt, Homo Sapiens
cacuaguguuugucauuuauaacuccagccaccuuuguaaagguugauuuuagaagauggag

SEQ ID NO: 66441 - RNA, 62 nt, Homo Sapiens
ucaccaccuucccagcucucacaugcauuugucuuuguaaugaugcuguugccucaucuaua

SEQ ID NO: 66442 - RNA, 62 nt, Homo Sapiens
aaggggguaggggacacagccaggcauugacacuuuguaagaccugucuuucucauccaggu

SEQ ID NO: 66443 - RNA, 62 nt, Homo Sapiens
aagugaaaaacuauacuuuuuaucauuaauuucuuuguaaccgguuucugcaucaauuagaa

SEQ ID NO: 66444 - RNA, 62 nt, Homo Sapiens
cauggcugaaaguagcuuuucagcuuuaagcacuuuguaagauuuauuuaaagucuucuguc

SEQ ID NO: 66445 - RNA, 62 nt, Homo Sapiens
uuaaauauguaagugcuauaauguugcuuuggcuuuguaaaugucagucaaaccccuuuaaa

SEQ ID NO: 66446 - RNA, 62 nt, Homo Sapiens
auuuuugcuuguguugucgcacuaugccuuaccuuuguaaauuuuucucuuuauguaguuug

SEQ ID NO: 66447 - RNA, 62 nt, Homo Sapiens
uugagcuauuggacuucacuuuacauuccguacuuuguaaacuaaaugaaauggggagauau

SEQ ID NO: 66448 - RNA, 62 nt, Homo Sapiens
aaaaaacacauagcaaggagcugguggaaagucuuuguaaggcuuacauuguaacaaucuua

SEQ ID NO: 66449 - RNA, 62 nt, Homo Sapiens
ggcugguuaguaaauuauugccagcaaacuuucuuuguaaaagguuuuugauagaacagagg

SEQ ID NO: 66450 - RNA, 62 nt, Homo Sapiens
auugacuucagccccuaagaacaucugaaaugcuuuguaauuacugaagagcucaaugauug

SEQ ID NO: 66451 - RNA, 62 nt, Homo Sapiens
aauuaaccuagcaauaaaaagacuauuauuaucuuuguaauaaacuguaacuaaguucaaca

SEQ ID NO: 66452 - RNA, 62 nt, Homo Sapiens
cuagauuggugguguuuuaugucaaacacaaucuuuguaaagucucugcucucauuuaaccc

SEQ ID NO: 66453 - RNA, 62 nt, Homo Sapiens
cagcacuuccucuugcccucugcuugcugggucuuuguaacccuagagagggucgucuggcc

SEQ ID NO: 66454 - RNA, 62 nt, Homo Sapiens
gcagaugaagaggguaggaacuaaauaaaggacuuuguaagccaaagugguugggcugcuuu

SEQ ID NO: 66455 - RNA, 62 nt, Homo Sapiens
cccaccccagaucccagggacucauccugugacuuuguaaccacacucauuccuuucaaaca

SEQ ID NO: 66456 - RNA, 62 nt, Homo Sapiens
uuuuaaauguacagacauauuuaacuggugcacuuuguaaauucccuggggaaaacuugcag

SEQ ID NO: 66457 - RNA, 62 nt, Homo Sapiens
cacuggauucuaaguaguugccaucuugaauccuuuguaauaaagccauacuuuugugugug

SEQ ID NO: 66458 - RNA, 62 nt, Homo Sapiens
aaccugcucauuaaaucaucucucuauuaguucuuuguaaaucacuuaguacauuagagcua

SEQ ID NO: 66459 - RNA, 62 nt, Homo Sapiens
augaauauuuacauauuuugucaauuauguagcuuuguaacuaaaugauauggcauguacuu

SEQ ID NO: 66460 - RNA, 62 nt, Homo Sapiens
auaauuuuuuccuuauuuaugggaaagacuggcuuuguaauuuggcuuuuuguuuccccaag

SEQ ID NO: 66461 - RNA, 62 nt, Homo Sapiens
uucuuauauaauuaauuagugaccauaaucaacuuuguaauauauauuacuuuuauuuuuag

SEQ ID NO: 66462 - RNA, 62 nt, Homo Sapiens
auuugaacauuguuuuaaucuugaugaaguaacuuuguaauuagaauauucuucuaaguauu

SEQ ID NO: 66463 - RNA, 62 nt, Homo Sapiens
uuuggggaaaaaagcacauaaaaaagaaguuacuuuguaauuagguugaacuuugccaaaaa

SEQ ID NO: 66464 - RNA, 62 nt, Homo Sapiens
agcaguucacauuuuuccacaaaauaaaauuacuuuguaaauaguuaauuuguucuuaccaa

SEQ ID NO: 66465 - RNA, 62 nt, Homo Sapiens
uaaugaauaggucugaaaacauucuuuggguucuuuguaauucuucuacuggacaucacaga

SEQ ID NO: 66466 - RNA, 62 nt, Homo Sapiens
cugaaugaccauaauagaaaauaggcuuaauucuuuguaaauuauuggguuugcuuuauuuc

SEQ ID NO: 66467 - RNA, 62 nt, Homo Sapiens
uaacaugggcaaauaucugaauauuuauauaacuuuguaauauuaaaagcuuugcaaccuau

SEQ ID NO: 66468 - RNA, 62 nt, Homo Sapiens
ccccccagguacgauagggagggugguauuugcuuuguaacuuuuugggaauaggcaucaau

SEQ ID NO: 66469 - RNA, 62 nt, Homo Sapiens
augggggaaacacagcaguucuugguaaaguccuuuguaauaauaguuugauuuuuuuauuu

SEQ ID NO: 66470 - RNA, 62 nt, Homo Sapiens
uggaauguucuuauuuagcuuaucauaaucuacuuuguaaaacaugcugaaaccucacugug

SEQ ID NO: 66471 - RNA, 62 nt, Homo Sapiens
gaauucagaaagguuacccccuuccucugugucuuuguaaggauacauuuggaagaacauac

SEQ ID NO: 66472 - RNA, 62 nt, Homo Sapiens
ucauugaagucugcuugauuaaaccauaauaucuuuguaauaauuggauuuaaaaugcuaug

SEQ ID NO: 66473 - RNA, 62 nt, Homo Sapiens
uuauuaauuuaaaauagaacgcuugagaggcacuuuguaaagauuuguuaaacuggaaacgu

SEQ ID NO: 66474 - RNA, 62 nt, Homo Sapiens
auuccauauuguauccacaauuuaugauaucacuuuguaacccauacauuuauacaauuaua

SEQ ID NO: 66475 - RNA, 62 nt, Homo Sapiens
cugcuuagauuuagaaaucuacucuugcuggucuuuguaaguugcaugaauauuugacuuug

SEQ ID NO: 66476 - RNA, 62 nt, Homo Sapiens
ucucucagcaaaauaaaacugugaugugucuucuuuguaaaaguuuagguauaaaaugcuau

SEQ ID NO: 66477 - RNA, 62 nt, Homo Sapiens
aaaagaccauuaacuuaaagugguguuaaaugcuuuguaaagcugagaucuaaauggggaca

SEQ ID NO: 66478 - RNA, 62 nt, Homo Sapiens
ccugggcagccaaccaggcaacaccaaggacucuuuguaaacgauagcugaucgugugcacg

SEQ ID NO: 66479 - RNA, 62 nt, Homo Sapiens
gaugagauugcuuccuaccuaaauuugcagcacuuuguaaauaucagcaacauaaauuuauc

SEQ ID NO: 66480 - RNA, 62 nt, Homo Sapiens
uuaguuuauugcuuuaccauuaucuaugaaaccuuuguaaauuuuuaaacuugugauaggca

SEQ ID NO: 66481 - RNA, 62 nt, Homo Sapiens
uagcuuccuaugaaaauguguacauguauuuucuuuguaaagguuuguauuuucaacuggag

SEQ ID NO: 66482 - RNA, 62 nt, Homo Sapiens
ggacauugaacaaacaaacuugaagaaagagucuuuguaaauagauucaccaggcacuggca

SEQ ID NO: 66483 - RNA, 62 nt, Homo Sapiens
ugaaauuguaaagaaaauacguuuaaugugcucuuuguaaaaucauaauucauaaaauuuua

SEQ ID NO: 66484 - RNA, 62 nt, Homo Sapiens
uguuuccuuauauugguaauauaguaaugaaacuuuguaaagacaaagaggaaaucaucuuc

SEQ ID NO: 66485 - RNA, 62 nt, Homo Sapiens
acaaucagccauaacaaguuaggaccuuguggcuuuguaacagagggcuuacagccucagca

SEQ ID NO: 66486 - RNA, 62 nt, Homo Sapiens
cuuagauaauagagccuagcauauuuuaaacucuuuguaaaaauaguuacauuucacaaaag

SEQ ID NO: 66487 - RNA, 62 nt, Homo Sapiens
uuuguacugcuuuggagagugacuuuugacuucuuuguaagucuggagaaugggaguguuaa

SEQ ID NO: 66488 - RNA, 62 nt, Homo Sapiens
ggucaggauaaaaaccaaauuaugggggaacacuuuguaaauaacccuaaugaugcaaguca

SEQ ID NO: 66489 - RNA, 62 nt, Homo Sapiens
uacuuaucuccaaaaaacuuaucacauuaucccuuuguaagcaauuuuuuuacccauaagac

SEQ ID NO: 66490 - RNA, 62 nt, Homo Sapiens
uuguauaugaaucaaaacaagggcaggaaauacuuuguaacuucauuuucguuaagaauuug

SEQ ID NO: 66491 - RNA, 62 nt, Homo Sapiens
aauuauugaauugugagaacguaagucucagucuuuguaauucugguuuuuacuuuuuuaau

SEQ ID NO: 66492 - RNA, 62 nt, Homo Sapiens
ugugguuugccccaagugugcacuauuuaauacuuuguaauaugccaccaagaguacugaca

SEQ ID NO: 66493 - RNA, 62 nt, Homo Sapiens
uccuaugcaguuuagccaccuucucauuaauucuuuguaacagcaaauccuaggcucagagg

SEQ ID NO: 66494 - RNA, 62 nt, Homo Sapiens
aggaggaucucuaaagcaguagccaaacaccacuuuguaaaaggacucuuccaucagagaug

SEQ ID NO: 66495 - RNA, 62 nt, Homo Sapiens
aaaauagcuuaaaaguuuguaaaaaaaugaaucuuuguaauuacuuaauauguuaguuaaga

SEQ ID NO: 66496 - RNA, 62 nt, Homo Sapiens
aucuaugaauguuuuucuuaaaauuuacaaagcuuuguaaauuagauuuucuuuaauaaaau

SEQ ID NO: 66497 - RNA, 62 nt, Homo Sapiens
ucuaauucacaaauuaauuucuggaaauuaaacuuuguaaauuaaguuuuugccuauaagaa

SEQ ID NO: 66498 - RNA, 62 nt, Homo Sapiens
aagaugucaauaagcuugcauuaagccaccugcuuuguaaguggauugauuaauaaauaacu

SEQ ID NO: 66499 - RNA, 62 nt, Homo Sapiens
aaauuaaauguuauuugaaaauguuauaagagcuuuguaaauauuucagaaaauaugggaua

SEQ ID NO: 66500 - RNA, 62 nt, Homo Sapiens
guguuuacaggaugcccuucugaaggguaguccuuuguaaagcuguacagacuuugcaguuu

SEQ ID NO: 66501 - RNA, 62 nt, Homo Sapiens
gugguuugcccucaauugagcacuguuuauuacuuuguaauaugccacugugaguacugaca

SEQ ID NO: 66502 - RNA, 62 nt, Homo Sapiens
uguaaggcugggcugcugcgacacaggcagcgcuuuguaaacugugaagccauauacgugaa

SEQ ID NO: 66503 - RNA, 62 nt, Homo Sapiens
agggcaauucccaucucauccaucacucaggucuuuguaaagggugcagccaagcucugcag

SEQ ID NO: 66504 - RNA, 62 nt, Homo Sapiens
uagugauugucagacugguauggaggugacugcuuuguaagguuuugucguuucuaauacag

SEQ ID NO: 66505 - RNA, 62 nt, Homo Sapiens
guugugcucaacuucuaggggaugacucagcucuuuguaaauucuuauuuuccuucuuccua

SEQ ID NO: 66506 - RNA, 62 nt, Homo Sapiens
ugccaccaagaguacugacacacuauuuaauacuuuguaauaugugguuugccccaagugug

SEQ ID NO: 66507 - RNA, 62 nt, Homo Sapiens
ugccacugugaguacugacacacuguuuauuacuuuguaauagcgguuugcccucaagugug

SEQ ID NO: 66508 - RNA, 62 nt, Homo Sapiens
uauggcuccaugcugugugaccugccgugguccuuuguaaacuuuuaguggccuguccuuga

SEQ ID NO: 66509 - RNA, 62 nt, Homo Sapiens
cauccaugcuguuguguguaucaccauaaugccuuuguaauuuugagacuggccucuuuuac

SEQ ID NO: 66510 - RNA, 62 nt, Homo Sapiens
cuuuaaucaauaaaauuaauugaaaaguagaacuuuguaauaauacauuguacaugaaaaaa

SEQ ID NO: 66511 - RNA, 62 nt, Homo Sapiens
auuucuuuaagauucagccuaauuuguugcagcuuuguaaauaagcauccgguucuaaaauu

SEQ ID NO: 66512 - RNA, 62 nt, Homo Sapiens
uguuauacaaucagaaggugaagcaaaaaguacuuuguaaaggaaguuccagacagaugaga

SEQ ID NO: 66513 - RNA, 62 nt, Homo Sapiens
uaaaaggaaaaacuggaaauuuguguuggaaacuuuguaaugacugggguauuguuggcuuc

SEQ ID NO: 66514 - RNA, 62 nt, Homo Sapiens
uguaaagcgcugugcacacgguaugugaaacacuuuguaaccugaggaauugaugagaugau

SEQ ID NO: 66515 - RNA, 62 nt, Homo Sapiens
gaguuuuacgacuuagaguccucagucauuuccuuuguaacacaaagacucgaauucauuuu

SEQ ID NO: 66516 - RNA, 62 nt, Homo Sapiens
cauugacauuuuauuuuccaaaacuaugaacacuuuguaaaacauagaggugauaaguaaua

SEQ ID NO: 66517 - RNA, 62 nt, Homo Sapiens
gcgccuacuucacggaaacuugugccuuuaaacuuuguaaacuuaaacacagccgagaaguu

SEQ ID NO: 66518 - RNA, 62 nt, Homo Sapiens
uuaaauuauucagugcuaaucauuguuuuuuccuuuguaaauguugauucagaaaaggaaag

SEQ ID NO: 66519 - RNA, 62 nt, Homo Sapiens
auguuacugccccacccuaacugaucaauguacuuuguaauccucccacccuuaagaagguu

SEQ ID NO: 66520 - RNA, 62 nt, Homo Sapiens
ccuggauuauucaaaaugauguauguugaagccuuuguaaauugucagaugcugugcaaaug

SEQ ID NO: 66521 - RNA, 62 nt, Homo Sapiens
uagauuuaaaaagugaaagaaacugcaggcgccuuuguaaaaugcaaaauauuuaauuaaaa

SEQ ID NO: 66522 - RNA, 62 nt, Homo Sapiens
ccccugucucucaccuccaccaaccccacucacuuuguaacuucaucacugacccggccaau

SEQ ID NO: 66523 - RNA, 62 nt, Homo Sapiens
acguugaucuccugguagcaugaccuuuuggccuuuguaagacacacagccuuucuguauca

SEQ ID NO: 66524 - RNA, 62 nt, Homo Sapiens
aacacguagcauuugcaccccuccaaagccaucuuuguaaaggaaaacguauuuguaauuga

SEQ ID NO: 66525 - RNA, 62 nt, Homo Sapiens
acuacagauugacacguuuuuaauuagcuguccuuuguaagaagucaggaaaucugaugcug

SEQ ID NO: 66526 - RNA, 62 nt, Homo Sapiens
cuuagaaugcgaaucuguguuaagaaucuagucuuuguaauagaaguuucccaguggcauuc

SEQ ID NO: 66527 - RNA, 62 nt, Homo Sapiens
aggaacuucagaggcuuuguuuaaacgcaaagcuuuguaaaagccacaaggucugagcugaa

SEQ ID NO: 66528 - RNA, 62 nt, Homo Sapiens
cagccaccaccaaaaagcaagaagacacugcucuuuguaaccauacugcuaccuucagggca

SEQ ID NO: 66529 - RNA, 62 nt, Homo Sapiens
aaacaaaauaaaguuuguacaggccaccgugccuuuguaaagguggggagaaaaaaaccaag

SEQ ID NO: 66530 - RNA, 62 nt, Homo Sapiens
uucucuaaacgucaggccuggauccuggccgccuuuguaaccgagcuuuuuggaaauacuca

SEQ ID NO: 66531 - RNA, 62 nt, Homo Sapiens
gauguggacauaauugccuaauuuggcaauagcuuuguaaguaacucugcuuccuuggacag

SEQ ID NO: 66532 - RNA, 62 nt, Homo Sapiens
uauaaaacuaaggaaaacucaugcuguacugacuuuguaaaacuguguuagaaguguugcaa

SEQ ID NO: 66533 - RNA, 62 nt, Homo Sapiens
cuuucuaugugacauuucucaauuuaauccuucuuuguaauauaguguuuggacagcugaua

SEQ ID NO: 66534 - RNA, 62 nt, Homo Sapiens
uaaacuuugaccaagaaauugccacucauguucuuuguaacugaagagucaucugauucgag

SEQ ID NO: 66535 - RNA, 62 nt, Homo Sapiens
uuaugggacaaaaaucaauuuagucgaaucagcuuuguaaugggcuguuuucuucuggggcu

SEQ ID NO: 66536 - RNA, 62 nt, Homo Sapiens
aauucuugcucuucuaggggcuguuuuaauaacuuuguaagggucaccuauaugggauuugc

SEQ ID NO: 66537 - RNA, 62 nt, Homo Sapiens
agcaacucauuuauuucauuuuggucuuaaugcuuuguaaacaggucaaaaaauacugucau

SEQ ID NO: 66538 - RNA, 62 nt, Homo Sapiens
uccaucccuauucccuccucugaaaugcaccccuuuguaauugaggacaaggugguucugug

SEQ ID NO: 66539 - RNA, 62 nt, Homo Sapiens
guuuaugucagagcuuuguuguaagccucucacuuuguaaggaaauucuuauuggguagguu

SEQ ID NO: 66540 - RNA, 62 nt, Homo Sapiens
uuuuuuugcauuuaugaacggcuguuuuucuacuuuguaauugugagacauuuucuugggga

SEQ ID NO: 66541 - RNA, 62 nt, Homo Sapiens
cuguuaugccuuuuauuuguuugcaaggaugucuuuguaauguguuucaugaauagaauauc

SEQ ID NO: 66542 - RNA, 62 nt, Homo Sapiens
ucacauaggaauuguucagcaacagaaagauacuuuguaaugagaagguacaaauuugagua

SEQ ID NO: 66543 - RNA, 62 nt, Homo Sapiens
uuugagaaaaaucugggucuuucuaaaaacugcuuuguaaguuacuuuuucuuuaugacuuc

SEQ ID NO: 66544 - RNA, 62 nt, Homo Sapiens
cccugcauccccccuccucugccugagugugucuuuguaaugucagcuggcaucauacaaag

SEQ ID NO: 66545 - RNA, 62 nt, Homo Sapiens
cagggacugugagagacaaccagcagcauccucuuuguaaucacagggcagggaucagaguu

SEQ ID NO: 66546 - RNA, 62 nt, Homo Sapiens
caggccugaaccccucccgugcuguaauaaaucuuuguaaauaacugcugagacuccucuuu

SEQ ID NO: 66547 - RNA, 62 nt, Homo Sapiens
cgaacccacacugcaacaggaacugugagagucuuuguaaguaaacugcccugucuagguca

SEQ ID NO: 66548 - RNA, 62 nt, Homo Sapiens
gcagaccugggacuuuagggcuaaccaguucucuuuguaaggacuugugccucuugggagac

SEQ ID NO: 66549 - RNA, 62 nt, Homo Sapiens
gacucuacauugggcagccuuuaaauaugauucuuuguaaugcuaaauagccuuuuuuucuc

SEQ ID NO: 66550 - RNA, 62 nt, Homo Sapiens
auauauacuuuuucauauauaauuagaucuuucuuuguaauuucauauguaguucuucauag

SEQ ID NO: 66551 - RNA, 62 nt, Homo Sapiens
cuugguugauaacugucuugauacuuuucauucuuuguaagaggccaaaucgucuaaggacg

SEQ ID NO: 66552 - RNA, 62 nt, Homo Sapiens
aucagugugcuaaaucucucugccuguuuggacuuuguaauuauuuuuuuagcaguaauuaa

SEQ ID NO: 66553 - RNA, 62 nt, Homo Sapiens
ugaaaacuaccuguggguuaaggauguaguuccuuuguaagggugggcaggccucguaagaa

SEQ ID NO: 66554 - RNA, 62 nt, Homo Sapiens
ccagcccccugucgccuguccggugcuaauuccuuuguaauuaaggacccgcuuccuguugu

SEQ ID NO: 66555 - RNA, 62 nt, Homo Sapiens
uuuuggacauugaaagaugucauucauauaaacuuuguaacuggcugcaucuuuauauguua

SEQ ID NO: 66556 - RNA, 62 nt, Homo Sapiens
aaauauguuuuguaguaacauuguauuuagugcuuuguaauaugagucugggauuauccgca

SEQ ID NO: 66557 - RNA, 62 nt, Homo Sapiens
gauuuuuuguaaagucauugaugcagucacuucuuuguaaauuggcacaaauauuuuaucau

SEQ ID NO: 66558 - RNA, 62 nt, Homo Sapiens
gaagaugcucuuccagagaccaaaguaacgaccuuuguaaguaucaccaugacaucucucuc

SEQ ID NO: 66559 - RNA, 62 nt, Homo Sapiens
aaugcugcauacuuucuggauguaucucuuggcuuuguaauacuccuuugcccugggacauc

SEQ ID NO: 66560 - RNA, 62 nt, Homo Sapiens
uauggaguauugugcacaacugucuggauuaacuuuguaauucgcccugcugcauuugcucu

SEQ ID NO: 66561 - RNA, 62 nt, Homo Sapiens
aaucaaaauuaccuuauaucggucauguuggucuuuguaacaauucagucacaagucauuuu

SEQ ID NO: 66562 - RNA, 62 nt, Homo Sapiens
uauuggccuuuuagugaguaagacuuauuuuccuuuguaauguuagacuuuuuuuuauaaau

SEQ ID NO: 66563 - RNA, 62 nt, Homo Sapiens
aaacucucggagaaauaaaagagcucaauucacuuuguaagauuacaucaagcuaauugugc

SEQ ID NO: 66564 - RNA, 62 nt, Homo Sapiens
ugaggguggaggugggaauaccucaauuuccacuuuguaaaauacacaauucuccuucggga

SEQ ID NO: 66565 - RNA, 62 nt, Homo Sapiens
uccacagggacuguucuauauguaaaauagggcuuuguaaacuacugaggaccaaagauaca

SEQ ID NO: 66566 - RNA, 62 nt, Homo Sapiens
aauaaaguuuggggugaugauuguagagaacucuuuguaagcuugguacugcagagucuggg

SEQ ID NO: 66567 - RNA, 62 nt, Homo Sapiens
ucuugcaguuuuguaagccccuauuguaaggucuuuguaaaaaccuccccuuuucuauguug

SEQ ID NO: 66568 - RNA, 62 nt, Homo Sapiens
accaagguaccgauuucugcuugaacgugcuucuuuguaauggcaauugucuuuuuuuuccu

SEQ ID NO: 66569 - RNA, 62 nt, Homo Sapiens
aguuuccccucccccaccccaauauuaguugccuuuguaaacguacucuccacauuauuuua

SEQ ID NO: 66570 - RNA, 62 nt, Homo Sapiens
auggacaucacuuuuuuuuuagauuuguucaacuuuguaaauccguuucuuaaguauugcgc

SEQ ID NO: 66571 - RNA, 62 nt, Homo Sapiens
uaaggaaauaacaauguaguaugggaagaguucuuuguaauguaguacaugggaaaaacagu

SEQ ID NO: 66572 - RNA, 62 nt, Homo Sapiens
aauuggcuaaaagaaucaucgaauuauucuaccuuuguaaacaaaaaaaauaaaauuauuuu

SEQ ID NO: 66573 - RNA, 62 nt, Homo Sapiens
aaaaauaaaauuauuuugaaccuguacuugcucuuuguaaaaauacaugaucuugaacagcu

SEQ ID NO: 66574 - RNA, 62 nt, Homo Sapiens
uaccaagguucccguuaacauuuuguuaaacccuuuguaaaacagaaauaugaauaaauagu

SEQ ID NO: 66575 - RNA, 62 nt, Homo Sapiens
uugauacuuuccuaagaauuagguguaugauacuuuguaaagaaauucauguuuacuuuucu

SEQ ID NO: 66576 - RNA, 62 nt, Homo Sapiens
acuuauaacaugguguaucuaaaugguuguaacuuuguaaguauggaaaauguuaaggaagc

SEQ ID NO: 66577 - RNA, 62 nt, Homo Sapiens
aagcacaucggaaccagaggaauaaucaggugcuuuguaaccggugguuuuucguucucuua

SEQ ID NO: 66578 - RNA, 62 nt, Homo Sapiens
uaucuggaagggaaagcacauccgugcucuggcuuuguaacuucaaagaugagggccuggcu

SEQ ID NO: 66579 - RNA, 62 nt, Homo Sapiens
uacuguggauuguacauuuaacuuuggaauggcuuuguaauaaucagucuuaagaaaauguu

SEQ ID NO: 66580 - RNA, 62 nt, Homo Sapiens
ugcuuuacugccauugcuguaugcuuuacugucuuuguaaaaaucccccucuccccuuuucu

SEQ ID NO: 66581 - RNA, 62 nt, Homo Sapiens
uauccaugauauucaguacaacucugucauuucuuuguaauauuuaaaaaauauuaguaaag

SEQ ID NO: 66582 - RNA, 62 nt, Homo Sapiens
aaauguuuugaauuuauaaaauuaauguuuuucuuuguaacauuuauauauauuuuuuaaca

SEQ ID NO: 66583 - RNA, 62 nt, Homo Sapiens
uuuugauuuguauucaaguacucuucaaguaucuuuguaaugaagguuuggcuacuuguaua

SEQ ID NO: 66584 - RNA, 62 nt, Homo Sapiens
gaucaguauuccuccucuaucaccuuuuuagacuuuguaagguaaauauuuggacuaacuuu

SEQ ID NO: 66585 - RNA, 62 nt, Homo Sapiens
auugcugggccauaugaaaaaucaauaguuagcuuuguaagaaacagucaaacuguuuucca

SEQ ID NO: 66586 - RNA, 62 nt, Homo Sapiens
uaucuaucauacucccaaauuccuucuugcaucuuuguaauuucucacucuuccuucucccu

SEQ ID NO: 66587 - RNA, 62 nt, Homo Sapiens
uuggagauauuuuccaacagcaagaaaaacaacuuuguaaauguucuguauuuuuaaauugc

SEQ ID NO: 66588 - RNA, 62 nt, Homo Sapiens
augaacaaacaugagacuguaaauauucacugcuuuguaaaaaccuuauaaaaacagguucc

SEQ ID NO: 66589 - RNA, 62 nt, Homo Sapiens
aaauugguuucuguaaauccaguuggucaagacuuuguaaagacugggauagucagguaaac

SEQ ID NO: 66590 - RNA, 62 nt, Homo Sapiens
agaaaaaaaaauuuuuucugacuuauacauaacuuuguaaaaaguauuugguggucccuaug

SEQ ID NO: 66591 - RNA, 62 nt, Homo Sapiens
uugcauucuauuuauugugaugcugccaucaacuuuguaagaaagcacccaucuucacuugg

SEQ ID NO: 66592 - RNA, 62 nt, Homo Sapiens
acggagaggaacaaaccaucggggcucauugucuuuguaauuauguaggauacuuuuuauuu

SEQ ID NO: 66593 - RNA, 62 nt, Homo Sapiens
agauucaaauuagauagucacauuuuucuucucuuuguaaguucauugcuuuacauacuaga

SEQ ID NO: 66594 - RNA, 62 nt, Homo Sapiens
uuuuacaaauuguuuaauacaagcuaaauuuucuuuguaaguaucugccuaauuuuucuuga

SEQ ID NO: 66595 - RNA, 62 nt, Homo Sapiens
uuguugagggcccucuuguugaugaucugcuccuuuguaacgcaggagcaagagaccagaag

SEQ ID NO: 66596 - RNA, 62 nt, Homo Sapiens
acuuggggaguaaggacauuuguacuuucucccuuuguaaaggugugaaaucuaagcaguaa

SEQ ID NO: 66597 - RNA, 62 nt, Homo Sapiens
acaucuuauuggauauuagcaauugcacgcugcuuuguaagccacuuuuuaguacucugaca

SEQ ID NO: 66598 - RNA, 62 nt, Homo Sapiens
cgacuuccucugccaguuauugacacagcucucuuuguaagagaggaaagaaacuaaaccca

SEQ ID NO: 66599 - RNA, 62 nt, Homo Sapiens
caggugucccggucugcauaagccucgugugccuuuguaaaguccaccuacacuuuugacca

SEQ ID NO: 66600 - RNA, 61 nt, Homo Sapiens
aucagugauacugaugagaauaaacuaaacgccuuuguaacagccuugccgcaugcucguu

SEQ ID NO: 66601 - RNA, 62 nt, Homo Sapiens
cgcugggcucgcuggugaccgccacagccccgcuuuguaaccagggaauacacagucauuuc

SEQ ID NO: 66602 - RNA, 62 nt, Homo Sapiens
cuugaaccccgaccacuaccccagguuucuaacuuuguaacuugcuucugaugugggucccu

SEQ ID NO: 66603 - RNA, 62 nt, Homo Sapiens
gagaggacagguccucaacaaauggcaugugacuuuguaaguguagaauugcugugagguau

SEQ ID NO: 66604 - RNA, 62 nt, Homo Sapiens
cccgccccagggcaauguuggacccccuuuuacuuuguaaaguuuguauuuauuccccuuua

SEQ ID NO: 66605 - RNA, 62 nt, Homo Sapiens
gcccguccuaggaauggauguggggauggucgcuuuguaaugugcugguucucuuuuuuuuu

SEQ ID NO: 66606 - RNA, 62 nt, Homo Sapiens
ggaaaauucaccaccucuagcuccucacuguucuuuguaauuaacacgcuguugguaaucuu

SEQ ID NO: 66607 - RNA, 62 nt, Homo Sapiens
cccgccccaaacguccgcuuuccuuuucucuacuuuguaauuuauugaucaguuucuguugg

SEQ ID NO: 66608 - RNA, 62 nt, Homo Sapiens
ccugcccucuaauuugggggcagcaguuugugcuuuguaagcuucagucuuauuuauagugu

SEQ ID NO: 66609 - RNA, 62 nt, Homo Sapiens
auaugugggaggcuuucaugagguguguugcacuuuguaacugucuagagcucuugauggaa

SEQ ID NO: 66610 - RNA, 62 nt, Homo Sapiens
gaacggguacuacacuuuaugaagucuuggcacuuuguaacgaaaggcaaccaaccacauua

SEQ ID NO: 66611 - RNA, 62 nt, Homo Sapiens
uuugacgagaaaguugguuguuucacaugguacuuuguaaauguugucuuaaugccauuuca

SEQ ID NO: 66612 - RNA, 62 nt, Homo Sapiens
uucagaauauuucuagaaugauguaacccauucuuuguaagguuccaggucaguacguaaag

SEQ ID NO: 66613 - RNA, 62 nt, Homo Sapiens
ugacacauuugaaaucauugacaaucugcuuucuuuguaacaauauuugcacaaguacagua

SEQ ID NO: 66614 - RNA, 62 nt, Homo Sapiens
aauguuaaagccagaaguugcucugcucuuaucuuuguaauaaagaaguguaacucaccagc

SEQ ID NO: 66615 - RNA, 62 nt, Homo Sapiens
aaguaucuuucaguuuuauauuauguauuucacuuuguaacaauaauacauauguuguacuu

SEQ ID NO: 66616 - RNA, 62 nt, Homo Sapiens
accuaaaaaguacaguguguuuaucacgagagcuuuguaagguacuucacuuccacuuuaaa

SEQ ID NO: 66617 - RNA, 62 nt, Homo Sapiens
uucuacaaaaaaauguuguuaauaaaugucugcuuuguaaaagcaguuuugcaauuuuuuaa

SEQ ID NO: 66618 - RNA, 62 nt, Homo Sapiens
ugugguugcugugacaguuucguuuucugaaucuuuguaaugcucuuccacccugcucgugc

SEQ ID NO: 66619 - RNA, 62 nt, Homo Sapiens
aucugaacuaacuugcuuuuagaagucuuuuucuuuguaagcauuguaaaugcuaauaaauc

SEQ ID NO: 66620 - RNA, 62 nt, Homo Sapiens
guguccccuguccugccccaccgguuugcuggcuuuguaauaacauaagaccauugugguug

SEQ ID NO: 66621 - RNA, 62 nt, Homo Sapiens
cucuugaagcuuuuucugccuccugauucucucuuuguaaacuauuuucaaauuguuuuuca

SEQ ID NO: 66622 - RNA, 62 nt, Homo Sapiens
uacaguauuuuccaugguucugccugcacuuacuuuguaaugccacgguugagauugagaga

SEQ ID NO: 66623 - RNA, 61 nt, Homo Sapiens
gaugugaaucuuacauuccuuuucaucauuuccuuuguaaaaaugacgagugcuggguuuu

SEQ ID NO: 66624 - RNA, 62 nt, Homo Sapiens
uuucguuuuaaauuuuagauuuuauuuuagugcuuuguaauuaauugggguuuauauugaua

SEQ ID NO: 66625 - RNA, 62 nt, Homo Sapiens
aauggcuucaaaauaagucacgaacacaaauucuuuguaaauuauguaaauuccuguuuaua

SEQ ID NO: 66626 - RNA, 62 nt, Homo Sapiens
cuuccccacccagcucuccccugcgccccugucuuuguaaauugacccuucuggaguggggg

SEQ ID NO: 66627 - RNA, 60 nt, Homo Sapiens
ccuaauaaacaccugcucacuggcuggguauucuuuguaaccaguguuucuggcuccugc

SEQ ID NO: 66628 - RNA, 62 nt, Homo Sapiens
auguauccagaguaguuggacaagugcuguuucuuuguaaaacauuagaaacauugagaguu

SEQ ID NO: 66629 - RNA, 62 nt, Homo Sapiens
cuguauuuuacccuugagcuagccuaaagaugcuuuguaaagaagcacguuugggaaggaac

SEQ ID NO: 66630 - RNA, 62 nt, Homo Sapiens
aauuuucauucucauuaggaagugacucuagucuuuguaagcugcuucacagaauaauggga

SEQ ID NO: 66631 - RNA, 62 nt, Homo Sapiens
ucugauuucuuuucaccauuacaccaaucuuacuuuguaaauaauugugugaacuuggaagc

SEQ ID NO: 66632 - RNA, 62 nt, Homo Sapiens
acagugaauaaccucuuggaaaucuucuagcacuuuguaaacagagaaaaguacaagacaga

SEQ ID NO: 66633 - RNA, 62 nt, Homo Sapiens
ggggccuugcccccaccuccacuguuuaaacccuuuguaaccgucauaggacuggcaaagca

SEQ ID NO: 66634 - RNA, 62 nt, Homo Sapiens
accacucaaauaaaagucucuauugcaacaaucuuuguaagauaucaaacaaaugacuuuca

SEQ ID NO: 66635 - RNA, 62 nt, Homo Sapiens
acuauguguucugguguguccuguaaaaguuucuuuguaaauuaucuuuucaauuaauguau

SEQ ID NO: 66636 - RNA, 62 nt, Homo Sapiens
agggaccaccucccuggggcgcuccuccuugucuuuguaaaagaacugcagggaacuucucu

SEQ ID NO: 66637 - RNA, 62 nt, Homo Sapiens
cagugcauuuuucagauuuguaugguaaaagccuuuguaaaagagacuggcagcagugggua

SEQ ID NO: 66638 - RNA, 62 nt, Homo Sapiens
uguugaaguuaauuugaauuggcuucauaguucuuuguaauauccaacaguggccuucuccg

SEQ ID NO: 66639 - RNA, 62 nt, Homo Sapiens
auggaaauaugguguccacgaguccagucugucuuuguaagcacugcccaaccccaggucua

SEQ ID NO: 66640 - RNA, 62 nt, Homo Sapiens
ugugucuggacuaaguuaaaagaauuaaaauacuuuguaauguccugggcuuugggaaaugu

SEQ ID NO: 66641 - RNA, 62 nt, Homo Sapiens
uuaguuuaauuuucuucaaaaugaaaauacugcuuuguaauuacaaaaugagacacaccuau

SEQ ID NO: 66642 - RNA, 62 nt, Homo Sapiens
uauaucccggaauauuucccuccggcuuucgccuuuguaacucccaucuguggacccaucgu

SEQ ID NO: 66643 - RNA, 62 nt, Homo Sapiens
guuuggaaacuuucuuuuacaacuuuagauugcuuuguaaauuccuaaaaucagguuuacuu

SEQ ID NO: 66644 - RNA, 62 nt, Homo Sapiens
ugauuugauuauacuguaaacuggucaucuaacuuuguaauuaagaacugaagaugagaaua

SEQ ID NO: 66645 - RNA, 62 nt, Homo Sapiens
uaaggcaagcccucucucagucauuucucagacuuuguaauacgaggcuaacgauguagguu

SEQ ID NO: 66646 - RNA, 62 nt, Homo Sapiens
ucagugcuggggacugaggcaaaaaauucucccuuuguaaccagccacaggccuaagucauu

SEQ ID NO: 66647 - RNA, 62 nt, Homo Sapiens
ccucucucauuggccuauacaucucuuaggaccuuuguaaugguguccaugcaccuuuagag

SEQ ID NO: 66648 - RNA, 62 nt, Homo Sapiens
gccaggcggcauccuuuucuaugaaguguugacuuuguaaaucugcccacacccagcuggcc

SEQ ID NO: 66649 - RNA, 62 nt, Homo Sapiens
guggggaagguuggagaagaguuagguuugugcuuuguaaucuuggcauccauguuuugugc

SEQ ID NO: 66650 - RNA, 62 nt, Homo Sapiens
aaguguuacuugugccgggaaaauuuugcugucuuuguaauuuuaaaacuuuaaaauaaauu

SEQ ID NO: 66651 - RNA, 62 nt, Homo Sapiens
uguuuaucaucagcuccucugaaaugugaucccuuuguaacugugcucaucacuucgccagu

SEQ ID NO: 66652 - RNA, 62 nt, Homo Sapiens
cgcagucacacauuaggguuugauacagagcucuuuguaaaccuacugaaagcuaucccagg

SEQ ID NO: 66653 - RNA, 62 nt, Homo Sapiens
uaaaaaacugaaaaaaaaaaagcuuuuuauuacuuuguaauuuuuuuuuaauuaaagagcaa

SEQ ID NO: 66654 - RNA, 62 nt, Homo Sapiens
uauuuuauaugaccuauaaaagucaucugucucuuuguaaaugacugccaaauaauauuuga

SEQ ID NO: 66655 - RNA, 62 nt, Homo Sapiens
accuaaucugagaccgugcucucccccucgcccuuuguaauauagacuccugggaugcccuc

SEQ ID NO: 66656 - RNA, 62 nt, Homo Sapiens
acucaaggccaacugucacagaacugcucugucuuuguaacucuuagaauucugagaggcag

SEQ ID NO: 66657 - RNA, 62 nt, Homo Sapiens
cggcuggaccacgucucccucugcauccaaggcuuuguaaaccaguguucuugggggugggg

SEQ ID NO: 66658 - RNA, 62 nt, Homo Sapiens
caaagaccaguuuguaccgaugaaacgcgcaacuuuguaaucccaacacuuucuauuuucua

SEQ ID NO: 66659 - RNA, 62 nt, Homo Sapiens
gccuucuuauuuuacuucuuuuagcuguuuaacuuuguaagaugcaaagagguuggaucaag

SEQ ID NO: 66660 - RNA, 62 nt, Homo Sapiens
gucuuucauagccaaacuuguauauuuaaauucuuuguaauaauaauauccaaaucaucauc

SEQ ID NO: 66661 - RNA, 62 nt, Homo Sapiens
acauaccgugagaaguuacguaacauuuacuccuuuguaaauguuucccuaucaucagacaa

SEQ ID NO: 66662 - RNA, 62 nt, Homo Sapiens
auacuuauauagaggaauuuauguaaccaugacuuuguaauuuugagaauuccucccaguga

SEQ ID NO: 66663 - RNA, 62 nt, Homo Sapiens
aauuaauaaaacaaagucauacaacacauuuucuuuguaauugagaacuagauaacauggua

SEQ ID NO: 66664 - RNA, 62 nt, Homo Sapiens
cacccccaaugaggucuuaggcagauucuuuacuuuguaauucaaaaggccuguuaaccuuu

SEQ ID NO: 66665 - RNA, 62 nt, Homo Sapiens
uggaaaaaaaauacuagccuagcuggucauuucuuuguaagguaguuagcaauuuuaagucu

SEQ ID NO: 66666 - RNA, 62 nt, Homo Sapiens
aaugagauuuuguacauggaguugacauaauacuuuguaaauugaauuuuuuaaagaaauag

SEQ ID NO: 66667 - RNA, 62 nt, Homo Sapiens
gaaucguucaacugucaaucagccucuugauucuuuguaaauugccaggguggguggguaca

SEQ ID NO: 66668 - RNA, 62 nt, Homo Sapiens
cacucugcuuccuuggacaauaucaguaauagcuuuguaagugauguggacguaauugccua

SEQ ID NO: 66669 - RNA, 62 nt, Homo Sapiens
uugcccucccaucccguuuagaguuauuuaggcuuuguaacgauugggggauaaaaagaugu

SEQ ID NO: 66670 - RNA, 62 nt, Homo Sapiens
uaaaacacuaacggaaacccauggaguuuguccuuuguaaaaauuuuaaacacagugucuug

SEQ ID NO: 66671 - RNA, 62 nt, Homo Sapiens
acuccaaugguguacaaugucuuuugcacaaacuuuguaacuuuuguuacugugaauucaaa

SEQ ID NO: 66672 - RNA, 62 nt, Homo Sapiens
guuuuuaauauaaagguguuaagcuuauuuugcuuuguaaguaaagaauguguauauuguga

SEQ ID NO: 66673 - RNA, 62 nt, Homo Sapiens
cuguuuuguuuuguguuguugaauuugaaagccuuuguaaauaucaauauaauguaccaaug

SEQ ID NO: 66674 - RNA, 62 nt, Homo Sapiens
aaagcuauauacuugugcuaucuaaagcacuacuuuguaaagaugacuacccaagauuguaa

SEQ ID NO: 66675 - RNA, 62 nt, Homo Sapiens
guuuucaaugaauuaagaaagauuaaauauaucuuuguaaauuauuuuaugucauaguuuaa

SEQ ID NO: 66676 - RNA, 62 nt, Homo Sapiens
aagaaaaauguauauagcugauauuuaagagacuuuguaaaaguguuuugccagccugaacu

SEQ ID NO: 66677 - RNA, 62 nt, Homo Sapiens
auaaacaccgaggcuuacuggcuauaugccuccuuuguaaaaauaagauuuugguucuacuu

SEQ ID NO: 66678 - RNA, 62 nt, Homo Sapiens
auuugcaucuguuuagaaacuggcuuucaucgcuuuguaaaauaguauuccugagcaaaacg

SEQ ID NO: 66679 - RNA, 62 nt, Homo Sapiens
ugguuuuguaggcaggcuguauacuaggaaggcuuuguaaacccucucagaagcacaagugc

SEQ ID NO: 66680 - RNA, 62 nt, Homo Sapiens
gugcagauauuuugaaaggcauuuccuuauuucuuuguaauuugcuuuuagcagauaugaag

SEQ ID NO: 66681 - RNA, 62 nt, Homo Sapiens
uauuuaaaacugcuauuuuccugaaaagccaacuuuguaacaucucaaaaagcuuauuaagc

SEQ ID NO: 66682 - RNA, 62 nt, Homo Sapiens
gagaugccaguaguguucaauucacaaaaauacuuuguaaaugcaaagccaauggagaguau

SEQ ID NO: 66683 - RNA, 62 nt, Homo Sapiens
augauguguggaggcuauucaucuacuuugaacuuuguaaaaaugaaaagcacauaaaugua

SEQ ID NO: 66684 - RNA, 62 nt, Homo Sapiens
aaaugcaaucggugugccuuauuucuucucuacuuuguaaccuacuuuuggacuugaaaauu

SEQ ID NO: 66685 - RNA, 62 nt, Homo Sapiens
uucacaaccgcuguccauugcuaucaaaaugucuuuguaauuauaauuugaauaauuuugag

SEQ ID NO: 66686 - RNA, 62 nt, Homo Sapiens
caaacucaagaaaacugguacgucucuuugugcuuuguaaagguaccccaaugcaaaaccuu

SEQ ID NO: 66687 - RNA, 62 nt, Homo Sapiens
ugaccugcgaauuacccuaagauauuacaguucuuuguaaaagccguuuggaaguguucuuu

SEQ ID NO: 66688 - RNA, 62 nt, Homo Sapiens
cuaauaaugcacucaguuuaaggagauacaaacuuuguaauuaauccaugguuaucugagau

SEQ ID NO: 66689 - RNA, 62 nt, Homo Sapiens
gccaaauuucuccuuccacuauauuccugugucuuuguaaugccugccccucacuucuuaac

SEQ ID NO: 66690 - RNA, 62 nt, Homo Sapiens
uccacuuagccuacuacaggagcuacuacugccuuuguaacuauaacgagagggggaaaaaa

SEQ ID NO: 66691 - RNA, 62 nt, Homo Sapiens
guauucugccagccugaacuauauuuaagaaacuuuguaaaaaauaaaaauguauauagcug

SEQ ID NO: 66692 - RNA, 63 nt, Homo Sapiens
cauaguuaauacagguauaucuauuuuuauuuacuuuguaagaaacaagcucaaggagcuucc

SEQ ID NO: 66693 - RNA, 63 nt, Homo Sapiens
aguuaauaauaaaugcuguaaauaagcaucucacuuuguaaaaauaaaauauugugguuuugu

SEQ ID NO: 66694 - RNA, 63 nt, Homo Sapiens
ggcccugccccuggcuccuuaaaugccccgucucuuuguaaacugauauucagccagcaaugc

SEQ ID NO: 66695 - RNA, 63 nt, Homo Sapiens
gccggccgccuucuccccucucccagggaugcucuuuguaaauaucggaugggugugggagug

SEQ ID NO: 66696 - RNA, 63 nt, Homo Sapiens
ggggucccuuuucaucccuucucugacagauugcuuuguaaacuuucuuaggccuucccccca

SEQ ID NO: 66697 - RNA, 63 nt, Homo Sapiens
aaggucaauuauacuuuuguuguucauuagcaucuuuguaaacuauaagacguaguuuuaauu

SEQ ID NO: 66698 - RNA, 63 nt, Homo Sapiens
gagguuugcaugcugguaaugcaaccuuugaaacuuuguaaaggaaacauauauguauauauu

SEQ ID NO: 66699 - RNA, 63 nt, Homo Sapiens
aaauguauuauuuuggugacaaaaaugaaggagcuuuguaaauuuuuuuuaaaauuaugaauc

SEQ ID NO: 66700 - RNA, 63 nt, Homo Sapiens
uguggggaggcauaagcugauguuuguaaagcgcuuuguaaauaaacgugcucucugaaugcc

SEQ ID NO: 66701 - RNA, 63 nt, Homo Sapiens
uuuuugagauacuauuuucauuuuugugagccucuuuguaauaaaaugguacauuucuauauc

SEQ ID NO: 66702 - RNA, 63 nt, Homo Sapiens
cccacccacaaugcaugagagugccuauuaaaucuuuguaaguguuaucaaauguuuugaucu

SEQ ID NO: 66703 - RNA, 63 nt, Homo Sapiens
uuccucuggcagccaauaaaaucaucauaagcccuuuguaauaaaaagcuaguuuccugagug

SEQ ID NO: 66704 - RNA, 63 nt, Homo Sapiens
uguauauucuauacaaagguacuuguccuuucccuuuguaaacuacauuugacauggauuaaa

SEQ ID NO: 66705 - RNA, 63 nt, Homo Sapiens
ugcauuauagaggaauguaguaugucauaaguacuuuguaaagauuugacauucaacuguagu

SEQ ID NO: 66706 - RNA, 63 nt, Homo Sapiens
guaauuucucauauggugcuggaaaugguugggcuuuguaacauuugaaguguuuccauggua

SEQ ID NO: 66707 - RNA, 63 nt, Homo Sapiens
aguaaagugcaauuucauuggauagcuaaauaucuuuguaagauagagauuguugaaaauucu

SEQ ID NO: 66708 - RNA, 63 nt, Homo Sapiens
guggcauguugauuucuauggccaacuuucucucuuuguaaaacaaagauugauugauuuucu

SEQ ID NO: 66709 - RNA, 63 nt, Homo Sapiens
uuuaauacagcagagcauggcaugaccaagcaucuuuguaaaguguuagauggaaaaugcugu

SEQ ID NO: 66710 - RNA, 63 nt, Homo Sapiens
cauaaugacauaauuuaguuucauguaaugaaacuuuguaaacagaauacauacauguguaua

SEQ ID NO: 66711 - RNA, 63 nt, Homo Sapiens
guuuacuguuaugagguagaauaaaaaagaauacuuuguaauagccacaaguucuuguuuaga

SEQ ID NO: 66712 - RNA, 63 nt, Homo Sapiens
uuguguccaguuauauuauuuaaaaaaguguuacuuuguaaaaauuguauauaaagaacugua

SEQ ID NO: 66713 - RNA, 63 nt, Homo Sapiens
ugaugaacacauuaauccguuaaguaaaauggacuuuguaauuguacagcauaccuaagaaac

SEQ ID NO: 66714 - RNA, 63 nt, Homo Sapiens
acaucuaaaguguauuaacagugcaugcuuuuacuuuguaaauguggugccaaaucccuguuu

SEQ ID NO: 66715 - RNA, 63 nt, Homo Sapiens
cugacuucugguuuccacuguaucaguauguaccuuuguaauuguuauuuuuaugucuuuuau

SEQ ID NO: 66716 - RNA, 63 nt, Homo Sapiens
gggcucugugucagggaaaaccuucuggguggacuuuguaagaauccaguuuccaagguuaga

SEQ ID NO: 66717 - RNA, 63 nt, Homo Sapiens
ggauucucauagacaacuggguaacuuauauuucuuuguaaucaagacuugagauaucgaagu

SEQ ID NO: 66718 - RNA, 63 nt, Homo Sapiens
aacaagccuuggaaauaaaucucuauuaaaccgcuuuguaaccaagcucugguacccucuguc

SEQ ID NO: 66719 - RNA, 63 nt, Homo Sapiens
aacacaucgugaugaugacguccucucaacucucuuuguaaaaauuuuguuauuuuugcuugu

SEQ ID NO: 66720 - RNA, 63 nt, Homo Sapiens
ccaauuuugugcuaaugagcauugagacugaugcuuuguaagucacaccacaacaaauauuga

SEQ ID NO: 66721 - RNA, 63 nt, Homo Sapiens
cuauuuuauuuuucuauaaugaucauauauuaccuuuguaauaaaacauuauaaccaaaacau

SEQ ID NO: 66722 - RNA, 63 nt, Homo Sapiens
aagccucucgagggugaggccuagccuucuugucuuuguaacccacagcagcugguacugugc

SEQ ID NO: 66723 - RNA, 63 nt, Homo Sapiens
aaggguuuucaauaggguguagaccuccaguaccuuuguaacuaaagucugucuagucauugu

SEQ ID NO: 66724 - RNA, 63 nt, Homo Sapiens
aaauuuuaucucuuauucaguaaaaaacaacuucuuuguaaucguuauguguguauauguaug

SEQ ID NO: 66725 - RNA, 63 nt, Homo Sapiens
cauguguagccucuccuggucauagaccagucucuuuguaaguuauuguggcaguucacacag

SEQ ID NO: 66726 - RNA, 63 nt, Homo Sapiens
agagaaauauaguucacaaugaaauuauauuuucuuuguaaagaaaguggcuugaaaucuuuu

SEQ ID NO: 66727 - RNA, 63 nt, Homo Sapiens
agugaucuugaaccauuguuuuauauuuuucaccuuuguaaccucauggaaagaggcuuuaca

SEQ ID NO: 66728 - RNA, 63 nt, Homo Sapiens
aaaaguugaaggccuuauucuacauuucaccuacuuuguaagugagagagacaagaagcaaau

SEQ ID NO: 66729 - RNA, 63 nt, Homo Sapiens
aacucagcuacacucucugauuuugugcuacuccuuuguaaagucacugccuuaagggggcug

SEQ ID NO: 66730 - RNA, 63 nt, Homo Sapiens
uugaauuuuugcugguuaaccuuuaucauuuaucuuuguaaugugaacaugcuucagagugua

SEQ ID NO: 66731 - RNA, 63 nt, Homo Sapiens
aaaaaaaaaaaucacuuggcgcaggagggagaacuuuguaagaagcugcccucuguuuuuuuu

SEQ ID NO: 66732 - RNA, 63 nt, Homo Sapiens
ucucgccaacagcuagcugcuuagccgaucaggcuuuguaagauccuaaaccaggaagcugcg

SEQ ID NO: 66733 - RNA, 63 nt, Homo Sapiens
ucaguguuuauaugaauaugccuuuucccuguacuuuguaauguuuguuuccuucucccuucc

SEQ ID NO: 66734 - RNA, 63 nt, Homo Sapiens
uuaauuuuauuacacauaaccgaguggaaaagccuuuguaaaucaaaaaaggaaucaaaucca

SEQ ID NO: 66735 - RNA, 63 nt, Homo Sapiens
cgaauguucccuggauguuggacauagaacauucuuuguaaccccgggcucaucuguaccaag

SEQ ID NO: 66736 - RNA, 63 nt, Homo Sapiens
uguuuguaugaguaaagaaauguuguuugaaaccuuuguaacuccuuagccuaaagaaugauc

SEQ ID NO: 66737 - RNA, 63 nt, Homo Sapiens
acuaaagaagaucuguaauucaagucuuuaggucuuuguaagaacaagccugguaggaaaggg

SEQ ID NO: 66738 - RNA, 63 nt, Homo Sapiens
agaaacauuucugcauaaaaaacuuuuuucuaccuuuguaaauaaccacuaucuugcacugcu

SEQ ID NO: 66739 - RNA, 63 nt, Homo Sapiens
aaaaggaaaaacuccggguaauuugguuuacugcuuuguaaauauauuuauguucacacagga

SEQ ID NO: 66740 - RNA, 63 nt, Homo Sapiens
uauuucuuguuuguuuguuuaacagcuucaugccuuuguaaguaaagcugauuacugucaaua

SEQ ID NO: 66741 - RNA, 63 nt, Homo Sapiens
uuggaacagcagcacuauacgcagacagcuuuacuuuguaagguaauuuuuggaauuugggaa

SEQ ID NO: 66742 - RNA, 63 nt, Homo Sapiens
aggauuuuuagaauuaaaaacaauguaagcauacuuuguaaaugaugcaugucuuuuaaaaug

SEQ ID NO: 66743 - RNA, 63 nt, Homo Sapiens
auuuacacuuuaacuuucucguugcaugucagucuuuguaauuugaauaauguaagguaaaga

SEQ ID NO: 66744 - RNA, 63 nt, Homo Sapiens
auuuguucugcagaaggcugcaaauagauuuuucuuuguaacauauguuuaaucaauugcaag

SEQ ID NO: 66745 - RNA, 63 nt, Homo Sapiens
gacuugcgguuaauuaugcacacuaacaaaaugcuuuguaacaccuccugcauuuguugauac

SEQ ID NO: 66746 - RNA, 63 nt, Homo Sapiens
aagguaauuagaaugguauguggcuuuaguuaucuuuguaaauuuaugaauuggaagugaugu

SEQ ID NO: 66747 - RNA, 63 nt, Homo Sapiens
acgaaacauuuuugcuuucuagaggccguuuaucuuuguaaacagguuuugaucucuggguaa

SEQ ID NO: 66748 - RNA, 63 nt, Homo Sapiens
uacucuuuuuaaaucccuuuagggcuucuuauucuuuguaauguauucucagauagauguuac

SEQ ID NO: 66749 - RNA, 63 nt, Homo Sapiens
gaagaauccaagagaaguuuuaugguagagaaacuuuguaaaagcuuuuaaaacguauguuug

SEQ ID NO: 66750 - RNA, 63 nt, Homo Sapiens
aaaaccuguuuccuauuuuggggcugaaguguucuuuguaaggcgagaugccuuugacauuuu

SEQ ID NO: 66751 - RNA, 63 nt, Homo Sapiens
augcuucuugauauuuuacuagcuauagaacugcuuuguaaaguuuccccuuuaaaaggaauu

SEQ ID NO: 66752 - RNA, 63 nt, Homo Sapiens
uucucccucaccccacccuguucaucuuguauucuuuguaaaagccaaccagcccaaaauuau

SEQ ID NO: 66753 - RNA, 63 nt, Homo Sapiens
aaauggcguggucuuuguugcucccacacuggccuuuguaaauucccucccugccucccccag

SEQ ID NO: 66754 - RNA, 63 nt, Homo Sapiens
gauugaugugaacacuuuuuuacagcacauagucuuuguaaggguauaggaagaagcaaaguc

SEQ ID NO: 66755 - RNA, 63 nt, Homo Sapiens
ggaauaaaacaguaccuuaggguugagauggagcuuuguaauguuuccaugaaucauuguggu

SEQ ID NO: 66756 - RNA, 63 nt, Homo Sapiens
auguauuuacucugccagguuaaacuuaaaacacuuuguaacccggucacuauauaaagcaaa

SEQ ID NO: 66757 - RNA, 63 nt, Homo Sapiens
gggcucuggauuuuugguuucuaaugagaaacccuuuguaaguuuuagcaaccugucuuggcc

SEQ ID NO: 66758 - RNA, 63 nt, Homo Sapiens
augucuguuuucuuuuuuguuacugccuuugcucuuuguaacuuauagcuagagaaacaauau

SEQ ID NO: 66759 - RNA, 63 nt, Homo Sapiens
caugaauaaaacacauuuuacagauaauaaagacuuuguaaaauggguugugcauccccaauc

SEQ ID NO: 66760 - RNA, 63 nt, Homo Sapiens
acuuccguugcugccaucguccgcagucacuuucuuuguaacagcggcugagcuccagccacc

SEQ ID NO: 66761 - RNA, 63 nt, Homo Sapiens
cuugauuugggagcauuuacaauuaauuagcagcuuuguaauaauggcuaauuuucaguugcu

SEQ ID NO: 66762 - RNA, 63 nt, Homo Sapiens
cauuuguauauuguggauguuuuaauucuucaccuuuguaagauguucuguuuggcacuugua

SEQ ID NO: 66763 - RNA, 63 nt, Homo Sapiens
ugucgggagauugaaagauguuuuuguuucuuucuuuguaaaggccuuggauauugaaaaaau

SEQ ID NO: 66764 - RNA, 63 nt, Homo Sapiens
ugggaaagaggucaacugagauuuggaaaucaucuuuguaauauuugcaaauuauacuuguuc

SEQ ID NO: 66765 - RNA, 63 nt, Homo Sapiens
ucagaaaaccacaguguguuuucauauuuggaacuuuguaauagcgggaguagcaguagucca

SEQ ID NO: 66766 - RNA, 63 nt, Homo Sapiens
uaguguauuucuuucuugaauuucagucugcugcuuuguaaaaaauaacuguaauugauauuu

SEQ ID NO: 66767 - RNA, 63 nt, Homo Sapiens
ucagaccagaauuuucuuugucccaugaggugucuuuguaagucagcaugcucuugcuugaac

SEQ ID NO: 66768 - RNA, 63 nt, Homo Sapiens
auuuuccugaaauacauuugcaaaauaaggcugcuuuguaaucaaggaauauuuuuauugauu

SEQ ID NO: 66769 - RNA, 58 nt, Homo Sapiens; identical to SEQ ID NO: 66050

SEQ ID NO: 66770 - RNA, 63 nt, Homo Sapiens
auccauuuguacaugguuuacauguuguggaugcuuuguaaacauuuuccuguauguuuaaau

SEQ ID NO: 66771 - RNA, 63 nt, Homo Sapiens
aucuggguuaaguguuuaucauauauauggguacuuuguaauaucuaaaaacuuagaaacgga

SEQ ID NO: 66772 - RNA, 63 nt, Homo Sapiens
gacauuguuaccaaccauuaauuggcucaggaccuuuguaauuuuuauuuaacuauaugaguu

SEQ ID NO: 66773 - RNA, 63 nt, Homo Sapiens
uaaacuucagugucccaccuugaccaaaaucagcuuuguaacuguuuucaaggaggugcuuag

SEQ ID NO: 66774 - RNA, 63 nt, Homo Sapiens
caaacaagaagaccucaugagagagguaaacaccuuuguaaagaaucuguaaccaauaccaug

SEQ ID NO: 66775 - RNA, 63 nt, Homo Sapiens
uacacagcuuuugcauacuuacaguuucuguuccuuuguaauaacuuuaacuugcaccuuuga

SEQ ID NO: 66776 - RNA, 63 nt, Homo Sapiens
ccaaaccauaccacacacauuaucauuguuaaacuuuguaaaguauuuaagguacauggaaca

SEQ ID NO: 66777 - RNA, 63 nt, Homo Sapiens
aucuaaauuucuguaguagagagagccguagcccuuuguaaaggcuuucguucguccaaacaa

SEQ ID NO: 66778 - RNA, 63 nt, Homo Sapiens
ugagcugugagauggauuuauuuuuaaaugcuacuuuguaaaggugaccuuuaaaaaauaaaa

SEQ ID NO: 66779 - RNA, 63 nt, Homo Sapiens
aaucuuuacaccuccugugugguuacaaguuaacuuuguaaguagcguaccuuccuuccuuaa

SEQ ID NO: 66780 - RNA, 63 nt, Homo Sapiens
uuagaacaaauaagguauauuuuuuagaaucaacuuuguaagcacuauaaaaucuuuaauaag

SEQ ID NO: 66781 - RNA, 63 nt, Homo Sapiens
acaagcucgaauuauuccucauuguauagccugcuuuguaaacuaguuuacaauuugcaggcu

SEQ ID NO: 66782 - RNA, 63 nt, Homo Sapiens
uccucuuccuccuccacuucccacuuauugucacuuuguaauauucagagagcacuuggauua

SEQ ID NO: 66783 - RNA, 63 nt, Homo Sapiens
ccuauaauagaaaauagcagacaacauaaacaucuuuguaaauaucaaaccuaauacauuucu

SEQ ID NO: 66784 - RNA, 63 nt, Homo Sapiens
aauaucaaaaggaagauucuuccauuaaauugccuuuguaauaugagaauguauuaguacaaa

SEQ ID NO: 66785 - RNA, 63 nt, Homo Sapiens
uaugccuaauacucacacgcaacauuucuuguacuuuguaagucguuugcgagaaugcagacc

SEQ ID NO: 66786 - RNA, 63 nt, Homo Sapiens
guuaacuuauugcuuuguaucuugggaaaaaaacuuuguaaauaaguuauaaaguuucuuuga

SEQ ID NO: 66787 - RNA, 63 nt, Homo Sapiens
ucacacuagcauagagaauguguugaaauuuaacuuuguaagcuuguaugugguuguugaucu

SEQ ID NO: 66788 - RNA, 63 nt, Homo Sapiens
uggcgccuccucucuacuuucauggacuuguuccuuuguaauagugcaauuugguuuuguuuu

SEQ ID NO: 66789 - RNA, 63 nt, Homo Sapiens
uucacuagauuucuacguagugaucugcuuuuacuuuguaauuuguaguucucaaaagacuuu

SEQ ID NO: 66790 - RNA, 63 nt, Homo Sapiens
aucuauguugaauccuuuuauaaaccaguaucacuuuguaauauaaacaccuauuuguacuua

SEQ ID NO: 66791 - RNA, 63 nt, Homo Sapiens
gaccagccagaccucaggucuucacucuuucuucuuuguaaacuaugucauguggaaagauuu

SEQ ID NO: 66792 - RNA, 63 nt, Homo Sapiens
agauuuauuccuuuguuacuucucuaauucuuccuuuguaaaaaaaaaaaaaagcaacacuuu

SEQ ID NO: 66793 - RNA, 63 nt, Homo Sapiens
uuuaaauucaggcuacugcuucaaucucaauugcuuuguaagugaaaaacaugacccagagga

SEQ ID NO: 66794 - RNA, 63 nt, Homo Sapiens
accauuaaaaguuggggcuccuacucuccuuugcuuuguaaauucaaaaguugggggugggua

SEQ ID NO: 66795 - RNA, 63 nt, Homo Sapiens
uuuguaccggcacgggauauggaacgaaaacugcuuuguaaugcaguuugugacauuaauagu

SEQ ID NO: 66796 - RNA, 63 nt, Homo Sapiens
uuuuggaucucauuguugauauaccugaauuuacuuuguaagagauuuuaacuucacuucaug

SEQ ID NO: 66797 - RNA, 63 nt, Homo Sapiens
uuauuugaucagaauauuuuuagauuaucuuuccuuuguaagauuagaggauagccuugaggc

SEQ ID NO: 66798 - RNA, 63 nt, Homo Sapiens
agaagcuucagaacucacuacagccucuguggucuuuguaauugagaagcauggcucaccagc

SEQ ID NO: 66799 - RNA, 63 nt, Homo Sapiens
auugcauacccauauuuuaaccauuuacuauggcuuuguaacaauaaaaguacauuuuauaaa

SEQ ID NO: 66800 - RNA, 63 nt, Homo Sapiens
guagggucgccaugaugcagaguuuugaaaugucuuuguaagacauguaacuuaauuacugcu

SEQ ID NO: 66801 - RNA, 63 nt, Homo Sapiens
aaagcaaaaugagaauuucacugcuauggcuagcuuuguaaccuggagcuuuguauucuguga

SEQ ID NO: 66802 - RNA, 63 nt, Homo Sapiens
uauuguggcaugagauaagacugucuucaguuacuuuguaauuuguacaaaagcugcaguaac

SEQ ID NO: 66803 - RNA, 63 nt, Homo Sapiens
aaauggaaaaggucaauaaagaguuuuuaacugcuuuguaagauagcaugcaaggguaagaau

SEQ ID NO: 66804 - RNA, 63 nt, Homo Sapiens
uguaagaccaaauucauacuguaaauuagaauacuuuguaauucaaucuaaauauggaauuug

SEQ ID NO: 66805 - RNA, 63 nt, Homo Sapiens
auuuguacuauuuuaaaugauaagugaaauguucuuuguaaacuuauaagcagcugugaaauu

SEQ ID NO: 66806 - RNA, 63 nt, Homo Sapiens
aggagccauugcauuuauuacuucauucugcuacuuuguaacucugcacagggcuuauagcug

SEQ ID NO: 66807 - RNA, 63 nt, Homo Sapiens
cugcauauggaccuguaaucuucuucacuugaacuuuguaaaauugauggcaucccuacaguc

SEQ ID NO: 66808 - RNA, 63 nt, Homo Sapiens
uccacccccugcccacaaaacauugagaaugugcuuuguaagauuuuguaauauucucuccgc

SEQ ID NO: 66809 - RNA, 63 nt, Homo Sapiens
uucuccccacccaccccacgccuugagaaggugcuuuguaauaugacaauacaccuuccccac

SEQ ID NO: 66810 - RNA, 63 nt, Homo Sapiens
acaauuguuggagagccccuaugacuuuuuauacuuuguaaagacauguuccugggaucacug

SEQ ID NO: 66811 - RNA, 62 nt, Homo Sapiens; identical to SEQ ID NO: 66092

SEQ ID NO: 66812 - RNA, 63 nt, Homo Sapiens
guggaaccaacacuaacauagaauguuuacacucuuuguaagaugagccuuguaauucuaaau

SEQ ID NO: 66813 - RNA, 63 nt, Homo Sapiens
guauuauugaauuuucaauuuuuccugaauugucuuuguaaaaaugauaccaugacaaaaauc

SEQ ID NO: 66814 - RNA, 63 nt, Homo Sapiens
ugguuuuaaaagccuuauauaaauaaagaaagccuuuguaagggaaggaaaaaguaagaugag

SEQ ID NO: 66815 - RNA, 63 nt, Homo Sapiens
agcuguucagaagaauaaaacugauugagauuacuuuguaaguuuacaugauuuauaauuuca

SEQ ID NO: 66816 - RNA, 63 nt, Homo Sapiens
uaggaaagacaaaggucugauggccauuugagucuuuguaaccgguaacauaauggugauggu

SEQ ID NO: 66817 - RNA, 63 nt, Homo Sapiens
uuuuuucuacaaaugucuaaccgaauccuacagcuuuguaauuaauggcaagucuagaacucu

SEQ ID NO: 66818 - RNA, 63 nt, Homo Sapiens
gauucuuuucaucaaaaagcaauggauuuuugacuuuguaaugacugauucaauuauaauugu

SEQ ID NO: 66819 - RNA, 63 nt, Homo Sapiens
cccgucuccuuucauucagaauuuccaaagcuccuuuguaaacucuaguugucuguguauaau

SEQ ID NO: 66820 - RNA, 63 nt, Homo Sapiens
uagccagacaauaaagaaaauagacaucugcaucuuuguaaguugguaggguagagacuaccc

SEQ ID NO: 66821 - RNA, 63 nt, Homo Sapiens
acaaguuuauguuugagcaaugaaucuuauccacuuuguaagaucuuuauauuugucuuauuu

SEQ ID NO: 66822 - RNA, 63 nt, Homo Sapiens
cuucagaauugauuauuuuuccucaaaauuuuacuuuguaauuuuguuaguagacaguggugu

SEQ ID NO: 66823 - RNA, 63 nt, Homo Sapiens
guuugggggcagacucuuaacuucucucaaccccuuuguaaugcuuuugguuucugcuucucu

SEQ ID NO: 66824 - RNA, 63 nt, Homo Sapiens
cuugcaugcuucuuagaccauguaucuggaaugcuuuguaauaucacuguuccucugucauac

SEQ ID NO: 66825 - RNA, 63 nt, Homo Sapiens
aauuucuauauaaaaauauuuauguuguaaaaucuuuguaaaaaguaugacauaaugauuugc

SEQ ID NO: 66826 - RNA, 63 nt, Homo Sapiens
accagguucuaggaaauguuuuuauuucuucagcuuuguaaauucuuugcccaauaaccacau

SEQ ID NO: 66827 - RNA, 63 nt, Homo Sapiens
ucuuaacauuuuuauauugcuuauuuuguacagcuuuguaaauucuaauuuuuaaauuuuaag

SEQ ID NO: 66828 - RNA, 63 nt, Homo Sapiens
aaaaauaauaauaauuugaauacagguuuauuucuuuguaaaaacuguagugcagugauccuu

SEQ ID NO: 66829 - RNA, 63 nt, Homo Sapiens
uuaagugccuugagcuggaacagccacugccuucuuuguaauauugaggcccaucucuccagc

SEQ ID NO: 66830 - RNA, 63 nt, Homo Sapiens
acuaacgaaaaugcaaagcagguuuaaaaagaccuuuguaauuugccgucucaaggcauuuac

SEQ ID NO: 66831 - RNA, 63 nt, Homo Sapiens
aaaacaggauuuugaaugcaguuugaauuaguucuuuguaaauagguguguuucugagaauuu

SEQ ID NO: 66832 - RNA, 63 nt, Homo Sapiens
caaaacugaaguaucuguguaacucaaccacuucuuuguaagaacagggaauaaaagcuuuuc

SEQ ID NO: 66833 - RNA, 63 nt, Homo Sapiens
cacuagguuuucaucguaaaggaggugaaaucucuuuguaaucaggguuuucuguuuuuugau

SEQ ID NO: 66834 - RNA, 63 nt, Homo Sapiens
ccagacagugaagcaaaaugugucacaagaaagcuuuguaaaaguagacucuuuuauaccugu

SEQ ID NO: 66835 - RNA, 63 nt, Homo Sapiens
aagucaaucauuuaauuuuugggaccucaguuucuuuguaaguaaaauaacaccugcuuguuc

SEQ ID NO: 66836 - RNA, 63 nt, Homo Sapiens
gggacugggucacuauugugguuuuuacuauaacuuuguaaauuaacuuaauuuugcugacuu

SEQ ID NO: 66837 - RNA, 63 nt, Homo Sapiens
ggcuuugaaucaacuuaagggaaaaccuuuugucuuuguaaaaauaaaagccuguagcuaagg

SEQ ID NO: 66838 - RNA, 63 nt, Homo Sapiens
agaauaugcccgacuccccaugacaagacagaacuuuguaacaaacaguaccaauuuauuuug

SEQ ID NO: 66839 - RNA, 63 nt, Homo Sapiens
uuuguuccugccccacccuaacugaucaauguacuuuguaaucucccccacccuuaagaaggu

SEQ ID NO: 66840 - RNA, 63 nt, Homo Sapiens
uacuuuguaaucucccccacccuuaagaagguacuuuguaaucuuccccacccuuaagaaggu

SEQ ID NO: 66841 - RNA, 63 nt, Homo Sapiens
uacuuuguaaucuuccccacccuuaagaagguucuuuguaauucuccccacccuugagaaugu

SEQ ID NO: 66842 - RNA, 63 nt, Homo Sapiens
aaacguguucuuuuagaccaguuuucuaauaagcuuuguaaaauguacuauccaaauuagaag

SEQ ID NO: 66843 - RNA, 63 nt, Homo Sapiens
uggagaacauuaggacaaaaagucaccaacuuacuuuguaacauuuuaauaaugacuuaaggg

SEQ ID NO: 66844 - RNA, 63 nt, Homo Sapiens
gcccauacaaguauucauuuuuucuacccuuuccuuuguaaguuccugggcaaccuuuuugau

SEQ ID NO: 66845 - RNA, 63 nt, Homo Sapiens
aggugugugugugucuauguguguguuucagcacuuuguaaauagcaagaagcuguacagauu

SEQ ID NO: 66846 - RNA, 63 nt, Homo Sapiens
gggugaaggguacccaggaccacucuguaccaucuuuguaacuuccugugaauuuauaauaau

SEQ ID NO: 66847 - RNA, 63 nt, Homo Sapiens
aaaaauaauugcuuugacauugucuauaugguacuuuguaaagucaugcuuaaguacaaauuc

SEQ ID NO: 66848 - RNA, 63 nt, Homo Sapiens
auuguuugaaagccuccauauaguuagauugugcuuuguaauuuuguuguuguugcucuaucu

SEQ ID NO: 66849 - RNA, 63 nt, Homo Sapiens
uaaaaguguguuugaaaaauauuaucuuggguucuuuguaaaauuuauuuuuuacaugcugaa

SEQ ID NO: 66850 - RNA, 63 nt, Homo Sapiens
ugggaauaaaaagcugugaaauuguucaaccuacuuuguaaccaaagaagcaaagcuguguaa

SEQ ID NO: 66851 - RNA, 63 nt, Homo Sapiens
uaaugacuagcuuuuaaaaauacaguacaaagacuuuguaaaugugauucagggcccccagca

SEQ ID NO: 66852 - RNA, 63 nt, Homo Sapiens
aggguccuccaggcaucagcuguuguguccucucuuuguaacaguggacaggacagaccaccc

SEQ ID NO: 66853 - RNA, 50 nt, Homo Sapiens; identical to SEQ ID NO: 66134

SEQ ID NO: 66854 - RNA, 63 nt, Homo Sapiens
gcuacauuuuaaaagcaauuguauuaguaagaacuuuguaaauaaauaccuaaaacccaagug

SEQ ID NO: 66855 - RNA, 63 nt, Homo Sapiens
gauccgugcuuugucggccagcguuucugcagucuuuguaaaggccccacgagagcgggccag

SEQ ID NO: 66856 - RNA, 63 nt, Homo Sapiens
acaguaagauaucucaaugaaccauaaauucaacuuuguaaaaaucuuuugaagcauagauaa

SEQ ID NO: 66857 - RNA, 63 nt, Homo Sapiens
ugcauauacuucuugggauauaguaucuaagaccuuuguaaacugccauuuuguuagguaugg

SEQ ID NO: 66858 - RNA, 63 nt, Homo Sapiens
ugcagugccaccugaguuccaaauuuuaccauucuuuguaaacaguuggauggauuaugauaa

SEQ ID NO: 66859 - RNA, 63 nt, Homo Sapiens
uugaauuaggcagugguuuccauaggcauagaucuuuguaaccuauaaaaucuuagaaagaaa

SEQ ID NO: 66860 - RNA, 63 nt, Homo Sapiens
uacuguccagcugaaagcacgugaucggagaugcuuuguaaucgauugaucaucugccuuaac

SEQ ID NO: 66861 - RNA, 63 nt, Homo Sapiens
gccgcggggcccccauacagcccuaugacaacacuuuguaaaaagcugcugccaagcacauau

SEQ ID NO: 66862 - RNA, 63 nt, Homo Sapiens
gcagggaccauauaagccuugcuagacuguaagcuuuguaaggguuacugcuuauugaucacu

SEQ ID NO: 66863 - RNA, 63 nt, Homo Sapiens
acaguuuaaguucuccugcagaucacaggaagacuuuguaagguuuuagccucuacaugcuag

SEQ ID NO: 66864 - RNA, 63 nt, Homo Sapiens
agagagaugcuuauguuauuauacguuuuguaccuuuguaaccgggacuggagggagacuuuu

SEQ ID NO: 66865 - RNA, 63 nt, Homo Sapiens
uaucgugugugugauuccuuaaaagucaagaaacuuuguaaaauggaaaaacaacagcgacaa

SEQ ID NO: 66866 - RNA, 63 nt, Homo Sapiens
caggugggggcaucucacagggcucaggcuucacuuuguaaaccagggaucugggguggucag

SEQ ID NO: 66867 - RNA, 63 nt, Homo Sapiens
caguauguuuuuacauaaugugagacacauuggcuuuguaaauggguauauacaaauuaaaac

SEQ ID NO: 66868 - RNA, 63 nt, Homo Sapiens
uucccuugaagacagaauuucacucuuuuuuaacuuuguaaccucuuuuuuuauauaaugaac

SEQ ID NO: 66869 - RNA, 63 nt, Homo Sapiens
uuucuuaguauauagucagcuucuucauuuucacuuuguaauuuuucauuuaccgaaugagaa

SEQ ID NO: 66870 - RNA, 63 nt, Homo Sapiens
uauuugaaaguaguguuaaaauacauuaacuuccuuuguaauucauccacauccaccuucgga

SEQ ID NO: 66871 - RNA, 63 nt, Homo Sapiens
gcucucugugguuugacuuauuuggugcuuagucuuuguaaggaagccacaaacaguucauca

SEQ ID NO: 66872 - RNA, 63 nt, Homo Sapiens
guuuaauucaaucuguaauauaucagagaaugucuuuguaacuaagaccucuaugaaugaaug

SEQ ID NO: 66873 - RNA, 63 nt, Homo Sapiens
auuacccuguaauauuauauaaaaaaaacauaacuuuguaaauccaagguacuuuuuuauuua

SEQ ID NO: 66874 - RNA, 63 nt, Homo Sapiens
ugggagacaucugaaauauugacagauugauaacuuuguaagaggcacacacggaguggcuuu

SEQ ID NO: 66875 - RNA, 63 nt, Homo Sapiens
caggauucuuauuugugcugcuaaugugguuuccuuuguaaacugggaaaaaaaaaauccuug

SEQ ID NO: 66876 - RNA, 63 nt, Homo Sapiens
cagcauaaaaaugaaaaguuuuuuaugugaggacuuuguaagugguugauuaaaucuauaagu

SEQ ID NO: 66877 - RNA, 63 nt, Homo Sapiens
agaauuuaccaguaacugugcaaaauccauuuccuuuguaacacauauucaaauuccguauac

SEQ ID NO: 66878 - RNA, 63 nt, Homo Sapiens
cauuagucaguugcucauuuggagacugaggggcuuuguaaaaaaauccuccacucucuggaa

SEQ ID NO: 66879 - RNA, 63 nt, Homo Sapiens
acaggaaaaaauaaacucuuuauagaucaaaagcuuuguaacccagaaccucacuugguacca

SEQ ID NO: 66880 - RNA, 63 nt, Homo Sapiens
ggaacugccucuuuccuguuagaauuuuaagugcuuuguaauguggaauauuccccuaucucu

SEQ ID NO: 66881 - RNA, 61 nt, Homo Sapiens
agccaaaacaaccaaacuauuuucuaaauaaaccuuuguaaucuaauguugggugccgcag

SEQ ID NO: 66882 - RNA, 63 nt, Homo Sapiens
uauuuuauguugaauuauuuuuggagcugaaaucuuuguaauauuaaagcaacuaguuucuaa

SEQ ID NO: 66883 - RNA, 63 nt, Homo Sapiens
cuuauguuuugccacaguuaacccauugugcuucuuuguaaucaaacaguuugugggagaaug

SEQ ID NO: 66884 - RNA, 63 nt, Homo Sapiens
auuaggaugugggcugguuugcuuuucuaccaccuuuguaauuuuauguaucccaucuccuuu

SEQ ID NO: 66885 - RNA, 63 nt, Homo Sapiens
ugcaauuuuuuucaggaugcaaaggcaauuauucuuuguaagcgggacauuuagaauauauuu

SEQ ID NO: 66886 - RNA, 63 nt, Homo Sapiens
gcuuaaaaaagcuaaucccuaaaauaguuagaucuuuguaaaugcauauuaaauaauaaagua

SEQ ID NO: 66887 - RNA, 63 nt, Homo Sapiens
uaaugcaguuuuuaaaaaccuguaucugacccacuuuguaauuuuugcuccaauauccauucu

SEQ ID NO: 66888 - RNA, 63 nt, Homo Sapiens
uuacugcaucaucuguuuguaaucauuaucucacuuuguaaauaaaaacacaccuuaaaacau

SEQ ID NO: 66889 - RNA, 63 nt, Homo Sapiens
uuaugaauugaguccacaaaggaacacaaaacucuuuguaauucuguuaaaucuuuuauguag

SEQ ID NO: 66890 - RNA, 63 nt, Homo Sapiens
aacuuauuagaaacccaaauugggacaacagugcuuuguaaauuguguugucuucagcaguca

SEQ ID NO: 66891 - RNA, 63 nt, Homo Sapiens
uuucuugcucaguuguuucaggcaagcccaagacuuuguaauuuuuaaagggcccaagauuuu

SEQ ID NO: 66892 - RNA, 63 nt, Homo Sapiens
gauuuaaaaagguuguauuacauauuguuuaaacuuuguaaguagaaauauaucuguuauaau

SEQ ID NO: 66893 - RNA, 63 nt, Homo Sapiens
auauuacuguuucacauguacagcuuucuacuucuuuguaagaacaccaaccaaccaagguuu

SEQ ID NO: 66894 - RNA, 63 nt, Homo Sapiens
uaggcugcuuuggaaauaauucccauauccuugcuuuguaaguugguaauaucacuaugcauu

SEQ ID NO: 66895 - RNA, 63 nt, Homo Sapiens
agucccgugguugucuguacuguuugcaccgcacuuuguaauccuggcgcucaugggcccugg

SEQ ID NO: 66896 - RNA, 63 nt, Homo Sapiens
acucccauuuuuacuuaacaguacaaaguuuuccuuuguaaucagucagauuuuuaaaguuuu

SEQ ID NO: 66897 - RNA, 63 nt, Homo Sapiens
acaugugagguauagccaccccucuaaagaacgcuuuguaaaugguaaccuuaaagacagacc

SEQ ID NO: 66898 - RNA, 63 nt, Homo Sapiens
ggaaauugaaaaugaccuggguauuugcuaagucuuuguaaaccucuuuuggauuuuuuuaag

SEQ ID NO: 66899 - RNA, 63 nt, Homo Sapiens
acuccagggcaaaaacgaacccaccuagugaaacuuuguaagacauagcagaaaaaccuagac

SEQ ID NO: 66900 - RNA, 63 nt, Homo Sapiens
agcacugagauuuauuuuaagaaugauucugcacuuuguaaacuaaaugucgcuucuucaagu

SEQ ID NO: 66901 - RNA, 63 nt, Homo Sapiens
acuugugauguuuuaaaauauuggaauauuugucuuuguaauugugaaaaacaguuuguauag

SEQ ID NO: 66902 - RNA, 63 nt, Homo Sapiens
ucuacaaauaauuuaccuuauauggauggcuaacuuuguaaucuuauaguaaaagugcaauca

SEQ ID NO: 66903 - RNA, 63 nt, Homo Sapiens
cagacaagauaugcacuugauucuccauucuaucuuuguaaaaugcucguuagcauggaagac

SEQ ID NO: 66904 - RNA, 63 nt, Homo Sapiens
auaacacaaugaguaauucuugauuaguagaagcuuuguaaucaaaggaagacauaaguguug

SEQ ID NO: 66905 - RNA, 63 nt, Homo Sapiens
ggaaacuauaugggaugaacaaagguuauuccucuuuguaauaauguguguguguaguuacuu

SEQ ID NO: 66906 - RNA, 63 nt, Homo Sapiens
uaugcuuucauauauccuugugauaaccuuuuucuuuguaauuaauuuuaaguucuagcccca

SEQ ID NO: 66907 - RNA, 63 nt, Homo Sapiens
ugcaaagagguuggaucaaguuuagcuguuuaacuuuguaagaugccuucuuauuuuacuucu

SEQ ID NO: 66908 - RNA, 63 nt, Homo Sapiens
aaauauuuuuugauuuugcgaaagcccuuuaaacuuuguaaggccuaaauaauaauaaaaaaa

SEQ ID NO: 66909 - RNA, 63 nt, Homo Sapiens
ugacuucugacauguuggcaccuaaagccuugccuuuguaauugcccaaguaauucacuacag

SEQ ID NO: 66910 - RNA, 63 nt, Homo Sapiens
ucuucugaaaucauuguaaaaguauauuaaucucuuuguaaucugcaagagucugauucuuua

SEQ ID NO: 66911 - RNA, 63 nt, Homo Sapiens
uaggaaaaauguauaauaaguugcagcuauugacuuuguaauuagcuuuguagcagaauauau

SEQ ID NO: 66912 - RNA, 63 nt, Homo Sapiens
aaacauuuuuaaaaauugucuuuuuaaaagaagcuuuguaauagaguuaaugugcugagcauu

SEQ ID NO: 66913 - RNA, 63 nt, Homo Sapiens
auugaaugcaagcguggaaauauaauuuguaggcuuuguaauggggcagguuagaagucauug

SEQ ID NO: 66914 - RNA, 51 nt, Homo Sapiens; identical to SEQ ID NO: 66195

SEQ ID NO: 66915 - RNA, 63 nt, Homo Sapiens
uuuucuccuagauuuucccuaggcauuuacagucuuuguaagcaguuucucucaccuucuuga

SEQ ID NO: 66916 - RNA, 63 nt, Homo Sapiens
uaaucagaaugaaaaauaauccacagcucauuucuuuguaauauggaaaacagugccaaaccu

SEQ ID NO: 66917 - RNA, 63 nt, Homo Sapiens
cuuccauaagcaaaaugacaucacgagaacaaacuuuguaaaugugcuacuauaauaaguuuu

SEQ ID NO: 66918 - RNA, 63 nt, Homo Sapiens
ucccauaaauugucuuugaaaacuuuguaguugcuuuguaauuaucuuggauuuauuaugaag

SEQ ID NO: 66919 - RNA, 63 nt, Homo Sapiens
caaaagcaacuuugggugagucaacguacaacucuuuguaaaaugauuuuagaaauaagauaa

SEQ ID NO: 66920 - RNA, 63 nt, Homo Sapiens
acuugaagcuuuccaauggcgcuucucuauggacuuuguaaauaaguuauaucuuuguaauuu

SEQ ID NO: 66921 - RNA, 63 nt, Homo Sapiens
cgcuucucuauggacuuuguaaauaaguuauaucuuuguaauuuuccugcuacuuuaucauuu

SEQ ID NO: 66922 - RNA, 63 nt, Homo Sapiens
aaaaguuauaugcuguaguuuuuaguauuuugucuuuguaauuuacagaaguuauuggagaaa

SEQ ID NO: 66923 - RNA, 63 nt, Homo Sapiens
caaguccucaucuguuauauaaaauccuuucugcuuuguaaguuuucucuuuuugggauuuuc

SEQ ID NO: 66924 - RNA, 63 nt, Homo Sapiens
uuccccucccauguugucgcacugaucacacugcuuuguaauuauuuucuuuauuguugguaa

SEQ ID NO: 66925 - RNA, 63 nt, Homo Sapiens
gaauguuuuguugggcuguguugaacauuauuucuuuguaaaugaauguuguaggaaugagga

SEQ ID NO: 66926 - RNA, 63 nt, Homo Sapiens
auaacaugugauuauaauuuuucuuagcauuuucuuuguaaagaacuacaauauaaacuaguu

SEQ ID NO: 66927 - RNA, 63 nt, Homo Sapiens
guacaguauguaacugcgggaaacccacugccccuuuguaagcuguggaacccaaacuguaug

SEQ ID NO: 66928 - RNA, 63 nt, Homo Sapiens
uuuaauaauuuugauugaaacccuuuaacaacucuuuguaaauuuuaacucauuuuaguugau

SEQ ID NO: 66929 - RNA, 63 nt, Homo Sapiens
accaauuuguacauuuuaauuauucaauuucuacuuuguaaaaauagggaaauuauuugaagu

SEQ ID NO: 66930 - RNA, 63 nt, Homo Sapiens
ugaauagcaaaugagaaaauguauauaaaagcacuuuguaaauuguaaaaguaguacagaugu

SEQ ID NO: 66931 - RNA, 63 nt, Homo Sapiens
uucuacguauaaacacucuugaauagacuuccacuuuguaauuagaaaauuuuauggacagua

SEQ ID NO: 66932 - RNA, 63 nt, Homo Sapiens
auuuugugaacacuuuugaaaauguacauguuccuuuguaauugacacuauauauuucuuaau

SEQ ID NO: 66933 - RNA, 63 nt, Homo Sapiens
gacuccaaugccuguacugugucuacugcaccacuuuguaaacacuucaauuuacuaucuuug

SEQ ID NO: 66934 - RNA, 63 nt, Homo Sapiens
gaucccugagcuuucccaguagccuccaguuuccuuuguaagacccagggaucacuuagccau

SEQ ID NO: 66935 - RNA, 63 nt, Homo Sapiens
ccugagagccagccugacauuagacagaauacccuuuguaauacauuggaaauuuuuacucau

SEQ ID NO: 66936 - RNA, 63 nt, Homo Sapiens
ugauucauucauuauucuaguccugcuuuaguccuuuguaauuugugguaauuaugcuuuucu

SEQ ID NO: 66937 - RNA, 63 nt, Homo Sapiens
aaauauuuuaauuacuauuuaaauaucucuuuacuuuguaauccuaugcauuuuacgcauuaa

SEQ ID NO: 66938 - RNA, 63 nt, Homo Sapiens
gcugguuuauguucuaggaacucuucaugagcacuuuguaaacacccucuugcuuaauccucc

SEQ ID NO: 66939 - RNA, 63 nt, Homo Sapiens
uaauaugaagaagauauaucuauugugcaaccgcuuuguaaauaccuuuacaauuaaacuaaa

SEQ ID NO: 66940 - RNA, 63 nt, Homo Sapiens
uucauuccaaaaaugcccgguagccucuucaggcuuuguaauuuaacgugaauauuuauacag

SEQ ID NO: 66941 - RNA, 63 nt, Homo Sapiens
agcagauuuuuuuguucucagcaggaaaguauacuuuguaaggugauauauauuuuuuuuaau

SEQ ID NO: 66942 - RNA, 63 nt, Homo Sapiens
ugcaaagaaaaguuucaccuaacaguuaucacacuuuguaauuagcacauuccaaacuuuagc

SEQ ID NO: 66943 - RNA, 63 nt, Homo Sapiens
uagaauucaugaguguuuacuuucaaaauuagucuuuguaacaaaaagaccaguaacuuuguu

SEQ ID NO: 66944 - RNA, 63 nt, Homo Sapiens
cacauucuuagcauauaacuuaauuuugcuaaacuuuguaauggaacuugcuucccuuuucac

SEQ ID NO: 66945 - RNA, 63 nt, Homo Sapiens
uaagcaauaguuuauguccugucucuuucuaagcuuuguaagcaaaaauauccaaggaucaga

SEQ ID NO: 66946 - RNA, 63 nt, Homo Sapiens
auauaaccccaaacuaagauugcacagggucaucuuuguaauuuuuuggaaggucugaaaacu

SEQ ID NO: 66947 - RNA, 63 nt, Homo Sapiens
gguagaaauauuacagaauacuuaaauaucagacuuuguaacaguaaaagaguuuauacaggc

SEQ ID NO: 66948 - RNA, 63 nt, Homo Sapiens
ucauauugaguaaaugaauguaauauguaggcacuuuguaaauuggcugcaaguggaagcgga

SEQ ID NO: 66949 - RNA, 63 nt, Homo Sapiens
auauuuugggcauucucagcaauaaaaacucuucuuuguaaucuugcauucugaggcugaacu

SEQ ID NO: 66950 - RNA, 63 nt, Homo Sapiens
auuuguaaacacugccagaauacuuucuagcugcuuuguaauuuuuuaagaguguuauuuugu

SEQ ID NO: 66951 - RNA, 63 nt, Homo Sapiens
ccagaauucugaguuaaagaaacaaaguauuugcuuuguaaaaggccaaaauucuauuuccua

SEQ ID NO: 66952 - RNA, 63 nt, Homo Sapiens
ucauuucugcuucagcucuuugcugcuucacuucuuuguaaaguuguaaccugaugguaauua

SEQ ID NO: 66953 - RNA, 63 nt, Homo Sapiens
gagguuuugguaauuguagaccuguuucauaagcuuuguaauucagaaauccuuguauuuagu

SEQ ID NO: 66954 - RNA, 63 nt, Homo Sapiens
gcagaaucaguuacaaacaucacaguucccaugcuuuguaauaacaccuggugaaaaaguuag

SEQ ID NO: 66955 - RNA, 63 nt, Homo Sapiens
auaguggguggauagcaaguauauucuaaaaaacuuuguaaauaaaguuuuguggcuaaaaug

SEQ ID NO: 66956 - RNA, 63 nt, Homo Sapiens
uauugauagucacuagaguaauguauucuuaaccuuuguaagaacugaucucagcauguauuc

SEQ ID NO: 66957 - RNA, 63 nt, Homo Sapiens
uaacaacaacaaagggcaguaaauuaaaguacucuuuguaagguacaguuaccgauuaaucua

SEQ ID NO: 66958 - RNA, 63 nt, Homo Sapiens
uugaaauuacuguaccuagucuuuuuugcauuacuuuguaaccuuuuucuaugcaagagucuu

SEQ ID NO: 66959 - RNA, 63 nt, Homo Sapiens
aucuuuugguucuguucacugagcuaaauuuaucuuuguaaaucuuuuugagucuggggggug

SEQ ID NO: 66960 - RNA, 63 nt, Homo Sapiens
caagagcuucugggacagagacugcuuggccagcuuuguaaguaaguggcugccuccaaugug

SEQ ID NO: 66961 - RNA, 63 nt, Homo Sapiens
uugaugguuuugugauuuagcuggguaaacuaucuuuguaacagauaaguuauuuauaaaaau

SEQ ID NO: 66962 - RNA, 63 nt, Homo Sapiens
uugggaacagccaaagggauuccaaggcuaaaucuuuguaacagcucucuuucccccuugcua

SEQ ID NO: 66963 - RNA, 63 nt, Homo Sapiens
uagcgcuaaauaauuugaacugaacuuaaaccucuuuguaaaaccuugauucagauauuuaug

SEQ ID NO: 66964 - RNA, 63 nt, Homo Sapiens
acugcuauuguaauaaguguauguauuuugugacuuuguaacauaccaacugcugagauuuuu

SEQ ID NO: 66965 - RNA, 63 nt, Homo Sapiens
uuccaagucauucucaccuaacccucacugggacuuuguaaacaaucuccuuguuguucuuua

SEQ ID NO: 66966 - RNA, 63 nt, Homo Sapiens
gccguacaauaaacaaauuacauugucuguuuucuuuguaaauuuuauucuuucuacugaggg

SEQ ID NO: 66967 - RNA, 63 nt, Homo Sapiens
guuugugauacuugaaacauggugauuauauugcuuuguaaugaagcaguaagggggaaggag

SEQ ID NO: 66968 - RNA, 63 nt, Homo Sapiens
aacuuuuuaaaaauuaauuguuuauacagucaacuuuguaauguauggauuauguuuuagcau

SEQ ID NO: 66969 - RNA, 63 nt, Homo Sapiens
acaacuuucacuauaaugugaaaugaauaaugccuuuguaaccacccauggaaaaaugccauc

SEQ ID NO: 66970 - RNA, 63 nt, Homo Sapiens
acuuugauaugcuguuaucaugaagagggaguacuuuguaacccuuugucacuggaugcuacu

SEQ ID NO: 66971 - RNA, 63 nt, Homo Sapiens
gacuguaaauauauuuuugguuccauuuguaaucuuuguaauauaauacagucaccuagacac

SEQ ID NO: 66972 - RNA, 63 nt, Homo Sapiens
cuuguaaauuuuauuuauacucuguaaauguuccuuuguaaaaaacaaauaacagaaacaaaa

SEQ ID NO: 66973 - RNA, 63 nt, Homo Sapiens
agauuuaugguaacugguuuacauuacauuuaucuuuguaaaaauuuuuaaaaguaguaagcc

SEQ ID NO: 66974 - RNA, 63 nt, Homo Sapiens
ccagaacucuaauuggacacacacucccuuccacuuuguaauacugauacauaauuuaaaagc

SEQ ID NO: 66975 - RNA, 63 nt, Homo Sapiens
aauguaauuucuuuccuuuuauuuguguaucugcuuuguaauauaauuuguacauauuuuaga

SEQ ID NO: 66976 - RNA, 63 nt, Homo Sapiens
ugacaaucauguagaaaccuugaaauuuguuaucuuuguaaaauuuuaagacauuuaaaaacg

SEQ ID NO: 66977 - RNA, 63 nt, Homo Sapiens
ugugaaacuuuauuaauguaccuaguauaauuucuuuguaauacuagcacauauaugcaagca

SEQ ID NO: 66978 - RNA, 63 nt, Homo Sapiens
ccaauaaucauaguuauggaaaguguucauuuacuuuguaauuucacugcuauuagacaauug

SEQ ID NO: 66979 - RNA, 63 nt, Homo Sapiens
acuugcuuguuuuccuuauuccaagaaaguauccuuuguaaaauuuuucauuguguguauuuc

SEQ ID NO: 66980 - RNA, 63 nt, Homo Sapiens
gccaauaacugguuuaauguaauuuuugacugacuuuguaaaaaaagaguaauguauuaccuc

SEQ ID NO: 66981 - RNA, 63 nt, Homo Sapiens
cauguuugagauggguggccuuuuauguuccugcuuuguaauucaguuauguuuacacaucau

SEQ ID NO: 66982 - RNA, 63 nt, Homo Sapiens
ggggaagccuuugcaagaaaauugcauacaaggcuuuguaacgaucaagugcuaaucgaugga

SEQ ID NO: 66983 - RNA, 63 nt, Homo Sapiens
gaauaccagcuggggagacacuagggaagggagcuuuguaagccuugauugcgaaaguccaaa

SEQ ID NO: 66984 - RNA, 63 nt, Homo Sapiens
guaggauucucucuaaauuauuuauugaagaggcuuuguaaauagugcaccagugacaggugc

SEQ ID NO: 66985 - RNA, 63 nt, Homo Sapiens
gccguaguuuauuuuaaaauauauuuuuaaaagcuuuguaaaaauuaugucauucucagaauu

SEQ ID NO: 66986 - RNA, 63 nt, Homo Sapiens
ugugcccuguaaccugacugguuaacagcaguccuuuguaaacaguguuuuaaacucuccuag

SEQ ID NO: 66987 - RNA, 63 nt, Homo Sapiens
uuauacuuguagcaaauuguuuuaauucuguagcuuuguaauauguuuuaaaaucagaaacua

SEQ ID NO: 66988 - RNA, 63 nt, Homo Sapiens
uccuaugucuguuacaaaacauaguuuauguagcuuuguaacauuccucagugccuguccaua

SEQ ID NO: 66989 - RNA, 63 nt, Homo Sapiens
uauucauaucuguuucauuuggaggauuuucuucuuuguaauguaaagaaauucaaaguuauc

SEQ ID NO: 66990 - RNA, 63 nt, Homo Sapiens
auaaacauuaacuuuccuauaagaauauuuuggcuuuguaaucuauagccucaaauugguauu

SEQ ID NO: 66991 - RNA, 63 nt, Homo Sapiens
aacacucuuacaccuguuauggaaaaugucaaccuuuguaagaaaaccaaaauaaaaauugaa

SEQ ID NO: 66992 - RNA, 63 nt, Homo Sapiens
caccucacagcagcuucgugcuuuuguacagaccuuuguaacaaguguacagaaaacucauuu

SEQ ID NO: 66993 - RNA, 63 nt, Homo Sapiens
cgcuacguuuauugccucgucuuauucacugaccuuuguaaugauacacagugaauucuuuuu

SEQ ID NO: 66994 - RNA, 63 nt, Homo Sapiens
uauuuuuuuaauguacccuaccuucaguauucucuuuguaaguuggugacuugcaucuguggc

SEQ ID NO: 66995 - RNA, 63 nt, Homo Sapiens
uuucuaauuaauagccaaagauuucauaucuaacuuuguaaccagaauuauacaguaaguuga

SEQ ID NO: 66996 - RNA, 63 nt, Homo Sapiens
gugcccaggggcccacagggaacccugcuugcacuuuguaacauguuuacuuuucagggcauc

SEQ ID NO: 66997 - RNA, 63 nt, Homo Sapiens
uucugcugcccuccaccauuuauuuuuacagugcuuuguaauuuuuuucaucaguuccuuaaa

SEQ ID NO: 66998 - RNA, 63 nt, Homo Sapiens
ccugggcuggaagucaaagcuggggggacauuccuuuguaaaaaccccagacauccugcaacc

SEQ ID NO: 66999 - RNA, 63 nt, Homo Sapiens
aacuuuggucucccuacauuuuaauaaaugauccuuuguaaauauuuuguuuuuaaaaugugu

SEQ ID NO: 67000 - RNA, 63 nt, Homo Sapiens
uugaaauaaguaauacuuucaaucaauaagaugcuuuguaaagcaauaguauggaucuuuuua

SEQ ID NO: 67001 - RNA, 63 nt, Homo Sapiens
uauaucugaaccuaaugguuaauaaaaaagaaccuuuguaaaauuaaauaccaaaagagggaa

SEQ ID NO: 67002 - RNA, 63 nt, Homo Sapiens
gggauauggacaaguaaguauucugugacuuaacuuuguaaagcugccccucuuccuucuucc

SEQ ID NO: 67003 - RNA, 63 nt, Homo Sapiens
uuuuuuuuuugcuuuuaccuauguuauguuaugcuuuguaaauugaguauaaaaagaacccca

SEQ ID NO: 67004 - RNA, 63 nt, Homo Sapiens
guuuagcaaaauaacugauucacagcaguuugacuuuguaaaaaaaacauacaguuuauucca

SEQ ID NO: 67005 - RNA, 63 nt, Homo Sapiens
guguagaagcauuccuucuuucuuucuaguggucuuuguaagauuagcuuuuuaauuguuguu

SEQ ID NO: 67006 - RNA, 63 nt, Homo Sapiens
aaacugcaauuuuauaaauuaggagaucgguaucuuuguaauaagggggagggggagagagca

SEQ ID NO: 67007 - RNA, 63 nt, Homo Sapiens
aaauguaucaauauguuauauaugugugaguuucuuuguaauagauaaauaggacaaaucauu

SEQ ID NO: 67008 - RNA, 63 nt, Homo Sapiens
caucacaagccauagugguaugcuucaguuuuucuuuguaagccagcauuuuucuuaaggcua

SEQ ID NO: 67009 - RNA, 63 nt, Homo Sapiens
uaagguccuugugcaucuuauaugccggaugaccuuuguaaguauggagacccaccacgucuc

SEQ ID NO: 67010 - RNA, 63 nt, Homo Sapiens
uguuagcuucaauuaauuaguguuuuagcauuucuuuguaaaagucuugccuuucuucccugc

SEQ ID NO: 67011 - RNA, 63 nt, Homo Sapiens
uuuauauuccaaauauugcuguauuauaauaugcuuuguaaauuuagguuaaguauuauuuag

SEQ ID NO: 67012 - RNA, 63 nt, Homo Sapiens
aucuguccccaguucuuccacagccucucugaacuuuguaaaacacagaaugaaagggcaucu

SEQ ID NO: 67013 - RNA, 63 nt, Homo Sapiens
aaaaccacauuggagauguugugaaacauguuucuuuguaauguuauauuaugaagcuuuuau

SEQ ID NO: 67014 - RNA, 63 nt, Homo Sapiens
aaaauuauuuguauuuuuaaauggauuucaaaucuuuguaauagucuuaguucagacucauau

SEQ ID NO: 67015 - RNA, 63 nt, Homo Sapiens
acaguaaaauaauccaccguugagacccagccucuuuguaagucaugcuguuuaagugcaggc

SEQ ID NO: 67016 - RNA, 63 nt, Homo Sapiens
gcaaaagccucagaaagggaugguguguuguaucuuuguaagaacguguguccuuugguacua

SEQ ID NO: 67017 - RNA, 63 nt, Homo Sapiens
aaaauuuagguaagcaggcuacauauguaacuccuuuguaaccauuucugaaacuccauuaua

SEQ ID NO: 67018 - RNA, 63 nt, Homo Sapiens
uaaauuggagcuuuuagcuuaaggaaaguauagcuuuguaauuaaacuauguguaaauauauu

SEQ ID NO: 67019 - RNA, 63 nt, Homo Sapiens
aaaucacuaaacucuaguacauuauagcaggugcuuuguaaucuggaauggagaagagguagg

SEQ ID NO: 67020 - RNA, 63 nt, Homo Sapiens
gugugccuggcugguuugcagauauuuguucugcuuuguaaaaauuggccauuagugcauuua

SEQ ID NO: 67021 - RNA, 63 nt, Homo Sapiens
agaggaaacuaauggaguuucauuguaacuguccuuuguaauuuauauaaauguauuauuuuc

SEQ ID NO: 67022 - RNA, 63 nt, Homo Sapiens
guaugaaaauguccucuucuucaaagguauaggcuuuguaaugaauuagauuuucugccaaua

SEQ ID NO: 67023 - RNA, 63 nt, Homo Sapiens
agaggaauuauacaaaauuaauauauaugaguccuuuguaauuuauuuuuuuuugagacagga

SEQ ID NO: 67024 - RNA, 63 nt, Homo Sapiens
gcucuaaacuagccuugaaguuuacagacaugacuuuguaaauguauuguuuuucuuuguugu

SEQ ID NO: 67025 - RNA, 63 nt, Homo Sapiens
gucaauuucaguucagcuaacauauauuaauaccuuuguaacucuuugcuauggcuuuuguua

SEQ ID NO: 67026 - RNA, 63 nt, Homo Sapiens
agaacaaacauauuuaugaucaugaauaaugugcuuuguaaaaagauuucaaguuauuaggaa

SEQ ID NO: 67027 - RNA, 63 nt, Homo Sapiens
agggguucuaauuacugucugugagaguuacuacuuuguaacuuaugguuucugcuucaguau

SEQ ID NO: 67028 - RNA, 63 nt, Homo Sapiens
uguguaauucuauuguaauaaacuggcagguaucuuuguaacuauaaauagugcaugcucagc

SEQ ID NO: 67029 - RNA, 63 nt, Homo Sapiens
uauuuaguugauuuuaauuauugcucuucuugucuuuguaauccaccaggagauuacaauuuu

SEQ ID NO: 67030 - RNA, 63 nt, Homo Sapiens
uucuucaccacagacaccuuuaagauuuauaaccuuuguaaugaaaaacucucagggcccuau

SEQ ID NO: 67031 - RNA, 63 nt, Homo Sapiens
aguauuuugccacaccuguauugcaguugcuuucuuuguaauaaggcuuaccccucucuaggg

SEQ ID NO: 67032 - RNA, 63 nt, Homo Sapiens
uauacaaauaaucuaacacaaaaucauaugguccuuuguaaaaguaaaugugguaggaaauau

SEQ ID NO: 67033 - RNA, 63 nt, Homo Sapiens
aguauuuuuauacuucauccgauaccuccuucccuuuguaaaugugucuacgguuaagcaaca

SEQ ID NO: 67034 - RNA, 63 nt, Homo Sapiens
uuuugcacuauuguuuuggccaagagauuguugcuuuguaacuuagccuauacugcauuagcc

SEQ ID NO: 67035 - RNA, 63 nt, Homo Sapiens
gagucuguaauaggauuuccaagaacaguauugcuuuguaauagccaaaucauuucaacugaa

SEQ ID NO: 67036 - RNA, 63 nt, Homo Sapiens
uucgguuuaagguuucagggacuuagucuuuaacuuuguaagguccuuuuccuucugaccaac

SEQ ID NO: 67037 - RNA, 63 nt, Homo Sapiens
cuuaaauauuuuauucuauuuuagugucguacgcuuuguaagauagugguauccuauauuacu

SEQ ID NO: 67038 - RNA, 63 nt, Homo Sapiens
uuaauuccaugaaagucuuauucauuggaaguucuuuguaauuacuuucuuccauauaugugg

SEQ ID NO: 67039 - RNA, 63 nt, Homo Sapiens
cagaaugauuccguuuuugcugugccuaauuuacuuuguaaacacuuugugauagguuuguac

SEQ ID NO: 67040 - RNA, 63 nt, Homo Sapiens
ucaaagcaguaauaucuucuuagcuguuuuucccuuuguaauaugugcuuuucagagacgcca

SEQ ID NO: 67041 - RNA, 63 nt, Homo Sapiens
ugucuuagauaauaaaacuaguacuuguuauuucuuuguaaaacaggggaaacuguguaagcu

SEQ ID NO: 67042 - RNA, 63 nt, Homo Sapiens
aguuaaagauuugaaagagaaagugcucugcuccuuuguaaaaguuucccaccauuucccuuu

SEQ ID NO: 67043 - RNA, 63 nt, Homo Sapiens
guaugauguaaauuuucaguuuaugaaaagaaacuuuguaaaauuuuguaaagaaguauauuu

SEQ ID NO: 67044 - RNA, 63 nt, Homo Sapiens
acuauccaugaagggaaagcuuaauacuuaaggcuuuguaaaaaguauguccucauagaacuu

SEQ ID NO: 67045 - RNA, 63 nt, Homo Sapiens
acuggugcuguucauucauaacuaauuuacaaacuuuguaaagucaggagacugaaaguucau

SEQ ID NO: 67046 - RNA, 63 nt, Homo Sapiens
uuucugauugauaggauuagcacacaaaaaauccuuuguaaaaaauaaccacacacagauaac

SEQ ID NO: 67047 - RNA, 63 nt, Homo Sapiens
uuuuaaaugcauaaagggggcuuuuuuacaagucuuuguaaaaaggugccaaauuccauuuaa

SEQ ID NO: 67048 - RNA, 63 nt, Homo Sapiens
agugagggaaucuaauuaagauuucaugcuguucuuuguaaugauaaauguuuccggacuaaa

SEQ ID NO: 67049 - RNA, 63 nt, Homo Sapiens
auagauguuggaacuaccuuuuuacuccccauacuuuguaaguaaugcuuccagauuaaccug

SEQ ID NO: 67050 - RNA, 63 nt, Homo Sapiens
uccauaugugaauguaagcucuuaacuaugucucuuuguaauguguaauuucuuucugaaaua

SEQ ID NO: 67051 - RNA, 63 nt, Homo Sapiens
ugugaaauucuagaaaaaaauauuaccaccucucuuuguaauuuacuuuacuuguaugaauuu

SEQ ID NO: 67052 - RNA, 63 nt, Homo Sapiens
cccugcacugugucaucuuuucaaggcauuugucuuuguaauauuuuccauaaauuuggacug

SEQ ID NO: 67053 - RNA, 63 nt, Homo Sapiens
uaaauuacccuauccuuuguucucuacuguuuucuuuguaauguaugacuacgagagugauac

SEQ ID NO: 67054 - RNA, 63 nt, Homo Sapiens
cuuuuuuucuuuuuuugacucguugacaagugucuuuguaauauguuuuuaguucccuuuuuu

SEQ ID NO: 67055 - RNA, 63 nt, Homo Sapiens
aacagcauuuuuacuuucuguacaacaaaaaagcuuuguaaauaaaaucuuaacauuuugggu

SEQ ID NO: 67056 - RNA, 63 nt, Homo Sapiens
uauguuucuugcauuaugaaggcuacaucugugcuuuguaaguaccacuucaaaaaauaguuc

SEQ ID NO: 67057 - RNA, 63 nt, Homo Sapiens
uuuagagcuuugugcuuuucucucauuccaucacuuuguaaugaugauacuuaacaugagcag

SEQ ID NO: 67058 - RNA, 63 nt, Homo Sapiens
ggggcuuuaucuaugaaaaaguaguaaauaguucuuuguaaccugugugaagcagcagccagc

SEQ ID NO: 67059 - RNA, 63 nt, Homo Sapiens
ucauugaggguuuguuuguguuuucaucaaugucuuuguaaagcacaaauuaucugccuuaaa

SEQ ID NO: 67060 - RNA, 63 nt, Homo Sapiens
uuggagucguuuugagaugagcauuagccccagcuuuguaaccaaugaggaacacuuacuuau

SEQ ID NO: 67061 - RNA, 63 nt, Homo Sapiens
caguguugagauggggauaacauuaguaaaugucuuuguaaguaaguuaagagaaacuuuaua

SEQ ID NO: 67062 - RNA, 63 nt, Homo Sapiens
uguaauuacaguuuuuguaaucugccuguuuuucuuuguaauuaggaugucaauacaagauug

SEQ ID NO: 67063 - RNA, 63 nt, Homo Sapiens
uauauauauacuuguuuuuccuuauuaguuaaacuuuguaaaacugucaauuugcucuagugu

SEQ ID NO: 67064 - RNA, 63 nt, Homo Sapiens
acccaucgggaagagacuuucuccaucuccccgcuuuguaaaucaacacugguuaauuucaca

SEQ ID NO: 67065 - RNA, 63 nt, Homo Sapiens
cucuuuuguaacuaucgacaagcccuugagacacuuuguaaugcaguuccugaccuuccucug

SEQ ID NO: 67066 - RNA, 63 nt, Homo Sapiens
acucuuuggcauggguaaauaaggcugcaaguacuuuguaaucaauuaagugcccaauauuga

SEQ ID NO: 67067 - RNA, 63 nt, Homo Sapiens
uaauauacucaucauagaaaaaauuuucguagucuuuguaaaaauuaccaguauaucagagga

SEQ ID NO: 67068 - RNA, 63 nt, Homo Sapiens
aauggaauuauucauuuuucaguggacagagaccuuuguaaccaaacgguuucuccuguggau

SEQ ID NO: 67069 - RNA, 63 nt, Homo Sapiens
aaauuauuuuaaagugacuguaaaccaccccugcuuuguaacauuaggccguggugaaguuga

SEQ ID NO: 67070 - RNA, 63 nt, Homo Sapiens
gucuuauuuguguaauaaagcuuucaugucgugcuuuguaaauaugucuguuuuguuacauac

SEQ ID NO: 67071 - RNA, 63 nt, Homo Sapiens
gaaguucuuucaguaagauguggggcuggaaaucuuuguaaaguuuaaacauuagagcuggag

SEQ ID NO: 67072 - RNA, 63 nt, Homo Sapiens
auugaaguguguaauaaagccauuuaacuuuaacuuuguaaauuuaauacaauagagacuuuu

SEQ ID NO: 67073 - RNA, 63 nt, Homo Sapiens
aaaacuguuuggaaccacaccaaugauauuuuucuuuguaauacuugaaauuuauuuuuuuau

SEQ ID NO: 67074 - RNA, 63 nt, Homo Sapiens
ugagaucauugguagccagggguugcuaccaaacuuuguaaccucaaggacaaaaugaggaag

SEQ ID NO: 67075 - RNA, 63 nt, Homo Sapiens
aauaaagaagacaugaauuguuuuaagucuacacuuuguaauuagcuaaguugugcaguauuu

SEQ ID NO: 67076 - RNA, 63 nt, Homo Sapiens
uaaucuagaccaaagaaugguauuuucacuuuucuuuguaacauugaaugguuugaaguacuc

SEQ ID NO: 67077 - RNA, 63 nt, Homo Sapiens
uuucaauagaaauuuuuauuucauuuucaauuacuuuguaaauucguguguauuuaguacacu

SEQ ID NO: 67078 - RNA, 63 nt, Homo Sapiens
uuaccugagacuuucaguucguuuguauucuaccuuuguaaaacagccuauagaugaugaugu

SEQ ID NO: 67079 - RNA, 63 nt, Homo Sapiens
uguaucuuuugguuguuugauuuuucuuucuuucuuuguaaauaguucugaguucugucaaau

SEQ ID NO: 67080 - RNA, 63 nt, Homo Sapiens
gcuuuuguacuagcccaguauuuauuuacauugcuuuguaauauaaaucuguuuuagaacugc

SEQ ID NO: 67081 - RNA, 63 nt, Homo Sapiens
cccucugccccucccccagccaugccagcuggccuuuguaagugcaggaaaccgaguagaaaa

SEQ ID NO: 67082 - RNA, 63 nt, Homo Sapiens
ugaguuauauaaggcuacuucaugacaagacugcuuuguaauauuucacuuuguuuuacuaca

SEQ ID NO: 67083 - RNA, 63 nt, Homo Sapiens
gauucuugccucuagcaaugucugcccuuucaucuuuguaagacauuaaaaaaagcacugggu

SEQ ID NO: 67084 - RNA, 63 nt, Homo Sapiens
cacuugacuuugcuaauggcucuuucuaaugggcuuuguaaaccuacagcucagauacugauc

SEQ ID NO: 67085 - RNA, 63 nt, Homo Sapiens
uacuugaugaguuuauaucuuuauuuuuguuuccuuuguaauuacuauguaauuuuguccuug

SEQ ID NO: 67086 - RNA, 63 nt, Homo Sapiens
ucuuauucugggagaacauaaggauuuccaggacuuuguaaguaagguggcuggagagagcug

SEQ ID NO: 67087 - RNA, 63 nt, Homo Sapiens
uuauuauuccagagaguauaguuuguuuuaaaucuuuguaaagaaaaaggcuuuuaaaauuuu

SEQ ID NO: 67088 - RNA, 63 nt, Homo Sapiens
ucaaaacauuucccaugagcuccaacaucuauacuuuguaaagauauacauuuuucuuaaugu

SEQ ID NO: 67089 - RNA, 63 nt, Homo Sapiens
ggcuucuaacagaauucaacagugcuacugucccuuuguaauuagaaaguggcuuugacacca

SEQ ID NO: 67090 - RNA, 63 nt, Homo Sapiens
ucaguagccguccugcaggcgcucccagaaggccuuuguaaaacccaggugagcccuggauug

SEQ ID NO: 67091 - RNA, 63 nt, Homo Sapiens
cccauauuuuuaacucuuccguggccaacuucacuuuguaagacuuccucaggcuucucaccu

SEQ ID NO: 67092 - RNA, 63 nt, Homo Sapiens
aaguuuaccuuuugacuggaugcuaacacuuuucuuuguaaaggucuuuccagagcuuauagu

SEQ ID NO: 67093 - RNA, 63 nt, Homo Sapiens
cuguacugugggccgggcgcgagcuacaccuuucuuuguaaaaguuauuccuuuccuuuccug

SEQ ID NO: 67094 - RNA, 63 nt, Homo Sapiens
aaauugauugaagauuuuaaaccuuaugauguacuuuguaaaauuccucccaaggguucuggc

SEQ ID NO: 67095 - RNA, 63 nt, Homo Sapiens
cuagacacuagauuguaguuauuucauuuuauucuuuguaauuuuacuagcgagaaaucuuug

SEQ ID NO: 67096 - RNA, 63 nt, Homo Sapiens
uuuguucuauaugaauaaaaacuguaugaaugacuuuguaaaugucaguaaaaaaacacaaaa

SEQ ID NO: 67097 - RNA, 63 nt, Homo Sapiens
gcauggcuuaaccuggugauaaauuucuaacuacuuuguaacuuuaacucuaacacccuucag

SEQ ID NO: 67098 - RNA, 63 nt, Homo Sapiens
uuuaaagucuuaaacuuuucagggcgaauacuacuuuguaacuuguuaaugguuaauauaggc

SEQ ID NO: 67099 - RNA, 63 nt, Homo Sapiens
acacaucuuuaauaauguuaauauaucuaggaacuuuguaacaucuauuuguuuuguacaugu

SEQ ID NO: 67100 - RNA, 63 nt, Homo Sapiens
uuguuacuaaagugucuaguuugaagcuaaaaccuuuguaauauuuuucauuuucaguuauuu

SEQ ID NO: 67101 - RNA, 63 nt, Homo Sapiens
agaaaaauauggccuugauggguuuccuaacagcuuuguaauauauaaauugguuccugagag

SEQ ID NO: 67102 - RNA, 63 nt, Homo Sapiens
aauuugugaauuguguauaaaagauuggcaauucuuuguaaaggacuacuacaaaauuggaaa

SEQ ID NO: 67103 - RNA, 63 nt, Homo Sapiens
uaacuaaauaauguaauggcaaccugccguuugcuuuguaacgauaauagaacaacguuuaug

SEQ ID NO: 67104 - RNA, 63 nt, Homo Sapiens
gauucuggacauaugcaucaagaaucggauggucuuuguaacuauagaugaacuaagagaaaa

SEQ ID NO: 67105 - RNA, 63 nt, Homo Sapiens
uauuguaguuagaaauuguaucaugaaaugaaacuuuguaacuaucacugcuuaacuucaucu

SEQ ID NO: 67106 - RNA, 63 nt, Homo Sapiens
uuugacuuaaguagaaguaauaugcucucauuucuuuguaaucuagauuuuccuauguugaau

SEQ ID NO: 67107 - RNA, 63 nt, Homo Sapiens
uuaguacacaaaacuaagaaucuuuagacuuaucuuuguaacuaauuaggguggaaguuauga

SEQ ID NO: 67108 - RNA, 63 nt, Homo Sapiens
gcaauaaacauguuuucauguaauacuggcuuacuuuguaauuuacaucuguaacuuucauau

SEQ ID NO: 67109 - RNA, 63 nt, Homo Sapiens
aacauguaacuucucucacaagaguacucuuuacuuuguaaucauauacaaugucaacuuuuu

SEQ ID NO: 67110 - RNA, 63 nt, Homo Sapiens
uuguugagaugaguuugcuguacugacgcugcacuuuguaaacagauuaccaguuuuuuacuu

SEQ ID NO: 67111 - RNA, 63 nt, Homo Sapiens
uuacacuguguuuuaaauuacuuuaaaaauaaacuuuguaagcagauuuuaauuuagucuuug

SEQ ID NO: 67112 - RNA, 63 nt, Homo Sapiens
caagagcugcugcuauaacuuccaguuuuacaucuuuguaaaauuguaucucaaaggcagaaa

SEQ ID NO: 67113 - RNA, 63 nt, Homo Sapiens
uaauaugcuguuuccauuaugacacagcagcuccuuuguaaguaccaggucauguccaucccu

SEQ ID NO: 67114 - RNA, 63 nt, Homo Sapiens
aagagagaacagggugguauucuaaguauguuucuuuguaacaucuuuagcaguaggacagag

SEQ ID NO: 67115 - RNA, 63 nt, Homo Sapiens
auuauuauuauuauuuuuugagauggagucucacuuuguaacccaggcuggaaugcaauggca

SEQ ID NO: 67116 - RNA, 63 nt, Homo Sapiens
aaagacuuuauuguucuaauuauccagauguaccuuuguaaaauagcucuuuuaugaauuagc

SEQ ID NO: 67117 - RNA, 63 nt, Homo Sapiens
agcuuugaacaauuguguuuucgucacaggagucuuuguaaugcuuguacaguugaugucgau

SEQ ID NO: 67118 - RNA, 63 nt, Homo Sapiens
uauggagcccauuguaccuuauaauuuuuuguacuuuguaaaauauuuuucuuuguauaugaa

SEQ ID NO: 67119 - RNA, 63 nt, Homo Sapiens
acauauagaacuguuacaauuaggaauaacacccuuuguaacuaugaaaggugucaucaucac

SEQ ID NO: 67120 - RNA, 63 nt, Homo Sapiens
uuacacaucucgugaaaacuuccuaucguggggcuuuguaaugcugaagaguugaucccuuug

SEQ ID NO: 67121 - RNA, 63 nt, Homo Sapiens
auuuuuaauauguaaggaauuugaaaauauuaucuuuguaauuguagauuuguuuuguguugu

SEQ ID NO: 67122 - RNA, 63 nt, Homo Sapiens
ggaaggauuguacugaaggcuuccugaagcagccuuuguaaguacagcccuuuuaucucugcu

SEQ ID NO: 67123 - RNA, 63 nt, Homo Sapiens
gcucuuagcacacucacagauuguauaaaauaccuuuguaacgccuagcugacucagcauaga

SEQ ID NO: 67124 - RNA, 63 nt, Homo Sapiens
gucuucagagcagcccuacuugugauuccaauucuuuguaauuauaagauaaccacuugauuu

SEQ ID NO: 67125 - RNA, 63 nt, Homo Sapiens
ugaagaguagaauuccaagaucucaauuuaaggcuuuguaaaauuugucaugugauuuuugag

SEQ ID NO: 67126 - RNA, 63 nt, Homo Sapiens
gcuuggugccucuuaggacuauugucaccuagccuuuguaacccgucggaccuugugauuugg

SEQ ID NO: 67127 - RNA, 63 nt, Homo Sapiens
auuuaaaaauguaaaaacgaguauuuauaugaccuuuguaaccuggaggauauuauuaugugg

SEQ ID NO: 67128 - RNA, 63 nt, Homo Sapiens
ccagaguuucggacagcccagcucuggcggggucuuuguaagaugaggacagaagggacuagg

SEQ ID NO: 67129 - RNA, 63 nt, Homo Sapiens
uuuugugacugucaccugaguccagcuuugauccuuuguaagauuaaauaaggggaggguugu

SEQ ID NO: 67130 - RNA, 63 nt, Homo Sapiens
cugcuccucuccacugcccagccuucagccucccuuuguaauguccgguucccugagggauga

SEQ ID NO: 67131 - RNA, 63 nt, Homo Sapiens
uguuuucugagagcacagggaaccucacggagacuuuguaauuauaauggaagcaagacuucc

SEQ ID NO: 67132 - RNA, 63 nt, Homo Sapiens
aaguuuuuuuucuggguucauauacuuguauaacuuuguaaaucccauagaaaauugggugug

SEQ ID NO: 67133 - RNA, 63 nt, Homo Sapiens
cuccacccaacacguuuuugcaaagcaagaagucuuuguaagacaccuuaaacaaaguccuuc

SEQ ID NO: 67134 - RNA, 63 nt, Homo Sapiens
cccugauggucauuuuucuaaacagaggcccugcuuuguaauauguggccaaggagauaauuu

SEQ ID NO: 67135 - RNA, 63 nt, Homo Sapiens
ucauguuuuucuguagcacugggcccaaauauucuuuguaaagaaaaucgcugcagcaaaaac

SEQ ID NO: 67136 - RNA, 63 nt, Homo Sapiens
auuuaagucggcagcuuucuaauuuaaucuuagcuuuguaauucauguuuugcuuuuguggac

SEQ ID NO: 67137 - RNA, 63 nt, Homo Sapiens
caccaaauaaucuuaccucuagucuacuuacaacuuuguaaggguuucuaagcuaugcccauu

SEQ ID NO: 67138 - RNA, 63 nt, Homo Sapiens
ugaaaaucaaaugaugcaaaauauauacaagcacuuuguaaauuguaaaaugauacaaaauuu

SEQ ID NO: 67139 - RNA, 63 nt, Homo Sapiens
uugugugaagcucuuggcuuuuuuccaacguuacuuuguaacuaaugaggguggauguucauu

SEQ ID NO: 67140 - RNA, 63 nt, Homo Sapiens
uguuauuguugacucucucccaagugccuugaucuuuguaauaucuccuguuguuucuaugau

SEQ ID NO: 67141 - RNA, 63 nt, Homo Sapiens
gauacaagaaacaaccuuggaaaaguuauuucccuuuguaauaccuuuaaaaauccagaguau

SEQ ID NO: 67142 - RNA, 63 nt, Homo Sapiens
cauaaccuuaaaaaggacuauauuaaucaccuucuuuguaaucccuucacagucccagguuua

SEQ ID NO: 67143 - RNA, 63 nt, Homo Sapiens
cauuuaaggaaacuagacaaguaaaauuauccucuuuguaauuuaaugaaaagguacaacaga

SEQ ID NO: 67144 - RNA, 56 nt, Homo Sapiens; identical to SEQ ID NO: 66425

SEQ ID NO: 67145 - RNA, 63 nt, Homo Sapiens
gccaaagaucauuuuuuuauauagacuucagcccuuuguaaauauuguaacuggggaguauag

SEQ ID NO: 67146 - RNA, 63 nt, Homo Sapiens
ccaacaauuaaaucuugccuuuacacacccaaacuuuguaauuuuagucuuggugaaauauaa

SEQ ID NO: 67147 - RNA, 63 nt, Homo Sapiens
cagggugcuuuuauauauaagagcagcagccgccuuuguaaagugugaucuaugagaauugga

SEQ ID NO: 67148 - RNA, 63 nt, Homo Sapiens
aucaguagaacuuacacauccuaggaaaucuuucuuuguaaguaauucuuuuggucucaagug

SEQ ID NO: 67149 - RNA, 63 nt, Homo Sapiens
uacugucaccuugauggacaaguuucaauaaaacuuuguaaaaauaauuggacaugugccugg

SEQ ID NO: 67150 - RNA, 63 nt, Homo Sapiens
gggccauggagcuggcccagaggccccucagcccuuuguaaagucugaugaaggcaggggugg

SEQ ID NO: 67151 - RNA, 63 nt, Homo Sapiens
agauagaaaggaacaagacuaaaauuguaaauacuuuguaaacaucagcauuuguacuugaau

SEQ ID NO: 67152 - RNA, 63 nt, Homo Sapiens
ugaggauaucaucuagaucacaggucaccuuaucuuuguaagagaaccucucacaagcugggg

SEQ ID NO: 67153 - RNA, 63 nt, Homo Sapiens
caugcaucuuuucuccauaaggggucuccaaaacuuuguaaaugaggguaggccucagaccag

SEQ ID NO: 67154 - RNA, 63 nt, Homo Sapiens
agguguguugaauuuguuuuggcucuggaaucccuuuguaaauuuccucagccucgaaaagug

SEQ ID NO: 67155 - RNA, 63 nt, Homo Sapiens
caaagaauuguuuaaaauggagucuaccucccucuuuguaaaucuaagguugggaggcuaacg

SEQ ID NO: 67156 - RNA, 63 nt, Homo Sapiens
caccugacagaaaaaaaagauuucauuuuuuuucuuuguaauguuccuuuucuuuuucuuucc

SEQ ID NO: 67157 - RNA, 63 nt, Homo Sapiens
aguagcauccuuauauaauaugcacagaaaauacuuuguaaaacaaacauugugaucuauaaa

SEQ ID NO: 67158 - RNA, 63 nt, Homo Sapiens
augcccauuacuuuuuuaaccuauauuguuuaacuuuguaagaauuuucugcuuuguauauuu

SEQ ID NO: 67159 - RNA, 63 nt, Homo Sapiens
cacuaguguuugucauuuaugaacuccagccaccuuuguaaaguguugauuuuagaagaugga

SEQ ID NO: 67160 - RNA, 63 nt, Homo Sapiens
ucaccaccuucccagcucucaacaugcauuugucuuuguaaugaaugcuguugccucaucuau

SEQ ID NO: 67161 - RNA, 63 nt, Homo Sapiens
aaggggguaggggacacagcucaggcauugacacuuuguaagauccugucuuucucauccagg

SEQ ID NO: 67162 - RNA, 63 nt, Homo Sapiens
aagugaaaaacuauacuuuuauaucauuaauuucuuuguaaccggguuucugcaucaauuaga

SEQ ID NO: 67163 - RNA, 63 nt, Homo Sapiens
cauggcugaaaguagcuuuuccagcuuuaagcacuuuguaagacuuuauuuaaagucuucugu

SEQ ID NO: 67164 - RNA, 63 nt, Homo Sapiens
uuaaauauguaagugcuauaaauguugcuuuggcuuuguaaaucgucagucaaaccccuuuaa

SEQ ID NO: 67165 - RNA, 63 nt, Homo Sapiens
auuuuugcuuguguugucgcgacuaugccuuaccuuuguaaauuuuuucucuuuauguaguuu

SEQ ID NO: 67166 - RNA, 63 nt, Homo Sapiens
uugagcuauuggacuucacuuuuacauuccguacuuuguaaacuuaaaugaaauggggagaua

SEQ ID NO: 67167 - RNA, 63 nt, Homo Sapiens
aaaaaacacauagcaaggagacugguggaaagucuuuguaaggccuuacauuguaacaaucuu

SEQ ID NO: 67168 - RNA, 63 nt, Homo Sapiens
ggcugguuaguaaauuauuggccagcaaacuuucuuuguaaaaugguuuuugauagaacagag

SEQ ID NO: 67169 - RNA, 63 nt, Homo Sapiens
auugacuucagccccuaagagacaucugaaaugcuuuguaauuuacugaagagcucaaugauu

SEQ ID NO: 67170 - RNA, 63 nt, Homo Sapiens
aauuaaccuagcaauaaaaaagacuauuauuaucuuuguaauauaacuguaacuaaguucaac

SEQ ID NO: 67171 - RNA, 63 nt, Homo Sapiens
cuagauuggugguguuuuaucgucaaacacaaucuuuguaaaguucucugcucucauuuaacc

SEQ ID NO: 67172 - RNA, 63 nt, Homo Sapiens
cagcacuuccucuugcccuccugcuugcugggucuuuguaaccucuagagagggucgucuggc

SEQ ID NO: 67173 - RNA, 63 nt, Homo Sapiens
ugcagaugaagaggguaggaacuaaauaaaggacuuuguaagccaaagugguugggcugcuuu

SEQ ID NO: 67174 - RNA, 63 nt, Homo Sapiens
ucccaccccagaucccagggacucauccugugacuuuguaaccacacucauuccuuucaaaca

SEQ ID NO: 67175 - RNA, 63 nt, Homo Sapiens
guuuuaaauguacagacauauuuaacuggugcacuuuguaaauucccuggggaaaacuugcag

SEQ ID NO: 67176 - RNA, 63 nt, Homo Sapiens
gcacuggauucuaaguaguugccaucuugaauccuuuguaauaaagccauacuuuugugugug

SEQ ID NO: 67177 - RNA, 63 nt, Homo Sapiens
caaccugcucauuaaaucaucucucuauuaguucuuuguaaaucacuuaguacauuagagcua

SEQ ID NO: 67178 - RNA, 63 nt, Homo Sapiens
augaauauuuacauauuuuguucaauuauguagcuuuguaacuuaaaugauauggcauguacu

SEQ ID NO: 67179 - RNA, 63 nt, Homo Sapiens
auaauuuuuuccuuauuuauggggaaagacuggcuuuguaauuguggcuuuuuguuuccccaa

SEQ ID NO: 67180 - RNA, 63 nt, Homo Sapiens
uucuuauauaauuaauuaguggaccauaaucaacuuuguaauaguauauuacuuuuauuuuua

SEQ ID NO: 67181 - RNA, 63 nt, Homo Sapiens
auuugaacauuguuuuaaucuuugaugaaguaacuuuguaauucagaauauucuucuaaguau

SEQ ID NO: 67182 - RNA, 63 nt, Homo Sapiens
uuuggggaaaaaagcacauaaaaaaagaaguuacuuuguaauuaagguugaacuuugccaaaa

SEQ ID NO: 67183 - RNA, 63 nt, Homo Sapiens
agcaguucacauuuuuccacaaaaauaaaauuacuuuguaaauuaguuaauuuguucuuacca

SEQ ID NO: 67184 - RNA, 63 nt, Homo Sapiens
uaaugaauaggucugaaaacaauucuuuggguucuuuguaauuacuucuacuggacaucacag

SEQ ID NO: 67185 - RNA, 63 nt, Homo Sapiens
cugaaugaccauaauagaaacauaggcuuaauucuuuguaaauauauuggguuugcuuuauuu

SEQ ID NO: 67186 - RNA, 63 nt, Homo Sapiens
uaacaugggcaaauaucugauauauuuauauaacuuuguaauauuuaaaagcuuugcaaccua

SEQ ID NO: 67187 - RNA, 63 nt, Homo Sapiens
ccccccagguacgauagggaugggugguauuugcuuuguaacuguuuugggaauaggcaucaa

SEQ ID NO: 67188 - RNA, 63 nt, Homo Sapiens
gaugggggaaacacagcaguucuugguaaaguccuuuguaauaauaguuugauuuuuuuauuu

SEQ ID NO: 67189 - RNA, 63 nt, Homo Sapiens
auggaauguucuuauuuagcuuaucauaaucuacuuuguaaaacaugcugaaaccucacugug

SEQ ID NO: 67190 - RNA, 63 nt, Homo Sapiens
ggaauucagaaagguuacccccuuccucugugucuuuguaaggauacauuuggaagaacauac

SEQ ID NO: 67191 - RNA, 63 nt, Homo Sapiens
gucauugaagucugcuugauuaaaccauaauaucuuuguaauaauuggauuuaaaaugcuaug

SEQ ID NO: 67192 - RNA, 63 nt, Homo Sapiens
uuuauuaauuuaaaauagaacgcuugagaggcacuuuguaaagauuuguuaaacuggaaacgu

SEQ ID NO: 67193 - RNA, 63 nt, Homo Sapiens
uauuccauauuguauccacaauuuaugauaucacuuuguaacccauacauuuauacaauuaua

SEQ ID NO: 67194 - RNA, 63 nt, Homo Sapiens
gcugcuuagauuuagaaaucuacucuugcuggucuuuguaaguugcaugaauauuugacuuug

SEQ ID NO: 67195 - RNA, 63 nt, Homo Sapiens
cucucucagcaaaauaaaacugugaugugucuucuuuguaaaaguuuagguauaaaaugcuau

SEQ ID NO: 67196 - RNA, 63 nt, Homo Sapiens
aaaaagaccauuaacuuaaagugguguuaaaugcuuuguaaagcugagaucuaaauggggaca

SEQ ID NO: 67197 - RNA, 63 nt, Homo Sapiens
uccugggcagccaaccaggcaacaccaaggacucuuuguaaacgauagcugaucgugugcacg

SEQ ID NO: 67198 - RNA, 63 nt, Homo Sapiens
gaugagauugcuuccuaccucaaauuugcagcacuuuguaaauuaucagcaacauaaauuuau

SEQ ID NO: 67199 - RNA, 63 nt, Homo Sapiens
uuaguuuauugcuuuaccauauaucuaugaaaccuuuguaaauauuuuaaacuugugauaggc

SEQ ID NO: 67200 - RNA, 63 nt, Homo Sapiens
uagcuuccuaugaaaaugugguacauguauuuucuuuguaaaguguuuguauuuucaacugga

SEQ ID NO: 67201 - RNA, 63 nt, Homo Sapiens
ggacauugaacaaacaaacuaugaagaaagagucuuuguaaauaagauucaccaggcacuggc

SEQ ID NO: 67202 - RNA, 63 nt, Homo Sapiens
ugaaauuguaaagaaaauacaguuuaaugugcucuuuguaaaagucauaauucauaaaauuuu

SEQ ID NO: 67203 - RNA, 63 nt, Homo Sapiens
uguuuccuuauauugguaaucauaguaaugaaacuuuguaaagaacaaagaggaaaucaucuu

SEQ ID NO: 67204 - RNA, 63 nt, Homo Sapiens
acaaucagccauaacaaguuaaggaccuuguggcuuuguaacaagagggcuuacagccucagc

SEQ ID NO: 67205 - RNA, 63 nt, Homo Sapiens
cuuagauaauagagccuagcgauauuuuaaacucuuuguaaaaaauaguuacauuucacaaaa

SEQ ID NO: 67206 - RNA, 63 nt, Homo Sapiens
uuuguacugcuuuggagaguagacuuuugacuucuuuguaaguccuggagaaugggaguguua

SEQ ID NO: 67207 - RNA, 63 nt, Homo Sapiens
ggucaggauaaaaaccaaauauaugggggaacacuuuguaaauuaacccuaaugaugcaaguc

SEQ ID NO: 67208 - RNA, 63 nt, Homo Sapiens
uacuuaucuccaaaaaacuucaucacauuaucccuuuguaagcuaauuuuuuuacccauaaga

SEQ ID NO: 67209 - RNA, 63 nt, Homo Sapiens
uuguauaugaaucaaaacaaggggcaggaaauacuuuguaacuuucauuuucguuaagaauuu

SEQ ID NO: 67210 - RNA, 63 nt, Homo Sapiens
aauuauugaauugugagaacuguaagucucagucuuuguaauuucugguuuuuacuuuuuuaa

SEQ ID NO: 67211 - RNA, 63 nt, Homo Sapiens
augugguuugccccaagugugcacuauuuaauacuuuguaauaugccaccaagaguacugaca

SEQ ID NO: 67212 - RNA, 63 nt, Homo Sapiens
uuccuaugcaguuuagccaccuucucauuaauucuuuguaacagcaaauccuaggcucagagg

SEQ ID NO: 67213 - RNA, 63 nt, Homo Sapiens
caggaggaucucuaaagcaguagccaaacaccacuuuguaaaaggacucuuccaucagagaug

SEQ ID NO: 67214 - RNA, 63 nt, Homo Sapiens
uaaaauagcuuaaaaguuuguaaaaaaaugaaucuuuguaauuacuuaauauguuaguuaaga

SEQ ID NO: 67215 - RNA, 63 nt, Homo Sapiens
gaucuaugaauguuuuucuuaaaauuuacaaagcuuuguaaauuagauuuucuuuaauaaaau

SEQ ID NO: 67216 - RNA, 63 nt, Homo Sapiens
aucuaauucacaaauuaauuucuggaaauuaaacuuuguaaauuaaguuuuugccuauaagaa

SEQ ID NO: 67217 - RNA, 63 nt, Homo Sapiens
gaagaugucaauaagcuugcauuaagccaccugcuuuguaaguggauugauuaauaaauaacu

SEQ ID NO: 67218 - RNA, 63 nt, Homo Sapiens
uaaauuaaauguuauuugaaaauguuauaagagcuuuguaaauauuucagaaaauaugggaua

SEQ ID NO: 67219 - RNA, 63 nt, Homo Sapiens
aguguuuacaggaugcccuucugaaggguaguccuuuguaaagcuguacagacuuugcaguuu

SEQ ID NO: 67220 - RNA, 63 nt, Homo Sapiens
ugugguuugcccucaauugagcacuguuuauuacuuuguaauaugccacugugaguacugaca

SEQ ID NO: 67221 - RNA, 63 nt, Homo Sapiens
cuguaaggcugggcugcugcgacacaggcagcgcuuuguaaacugugaagccauauacgugaa

SEQ ID NO: 67222 - RNA, 63 nt, Homo Sapiens
aagggcaauucccaucucauccaucacucaggucuuuguaaagggugcagccaagcucugcag

SEQ ID NO: 67223 - RNA, 63 nt, Homo Sapiens
cuagugauugucagacugguauggaggugacugcuuuguaagguuuugucguuucuaauacag

SEQ ID NO: 67224 - RNA, 63 nt, Homo Sapiens
guugugcucaacuucuagggagaugacucagcucuuuguaaaugucuuauuuuccuucuuccu

SEQ ID NO: 67225 - RNA, 63 nt, Homo Sapiens
ugccaccaagaguacugacagcacuauuuaauacuuuguaauaaugugguuugccccaagugu

SEQ ID NO: 67226 - RNA, 63 nt, Homo Sapiens
ugccacugugaguacugacagcacuguuuauuacuuuguaauaugcgguuugcccucaagugu

SEQ ID NO: 67227 - RNA, 63 nt, Homo Sapiens
uauggcuccaugcugugugaaccugccgugguccuuuguaaacguuuuaguggccuguccuug

SEQ ID NO: 67228 - RNA, 63 nt, Homo Sapiens
cauccaugcuguuguguguacucaccauaaugccuuuguaauuuuugagacuggccucuuuua

SEQ ID NO: 67229 - RNA, 63 nt, Homo Sapiens
cuuuaaucaauaaaauuaauaugaaaaguagaacuuuguaauaaauacauuguacaugaaaaa

SEQ ID NO: 67230 - RNA, 63 nt, Homo Sapiens
auuucuuuaagauucagccuuaauuuguugcagcuuuguaaauaaagcauccgguucuaaaau

SEQ ID NO: 67231 - RNA, 63 nt, Homo Sapiens
uguuauacaaucagaaggugaaagcaaaaaguacuuuguaaagagaaguuccagacagaugag

SEQ ID NO: 67232 - RNA, 63 nt, Homo Sapiens
uaaaaggaaaaacuggaaaucuuguguuggaaacuuuguaaugcacugggguauuguuggcuu

SEQ ID NO: 67233 - RNA, 63 nt, Homo Sapiens
uguaaagcgcugugcacacguguaugugaaacacuuuguaaccgugaggaauugaugagauga

SEQ ID NO: 67234 - RNA, 63 nt, Homo Sapiens
gaguuuuacgacuuagagucucucagucauuuccuuuguaacaucaaagacucgaauucauuu

SEQ ID NO: 67235 - RNA, 63 nt, Homo Sapiens
cauugacauuuuauuuuccaaaaacuaugaacacuuuguaaaaacauagaggugauaaguaau

SEQ ID NO: 67236 - RNA, 63 nt, Homo Sapiens
agcgccuacuucacggaaacuugugccuuuaaacuuuguaaacuuaaacacagccgagaaguu

SEQ ID NO: 67237 - RNA, 63 nt, Homo Sapiens
uuuaaauuauucagugcuaaucauuguuuuuuccuuuguaaauguugauucagaaaaggaaag

SEQ ID NO: 67238 - RNA, 63 nt, Homo Sapiens
uauguuacugccccacccuaacugaucaauguacuuuguaauccucccacccuuaagaagguu

SEQ ID NO: 67239 - RNA, 63 nt, Homo Sapiens
uccuggauuauucaaaaugauguauguugaagccuuuguaaauugucagaugcugugcaaaug

SEQ ID NO: 67240 - RNA, 63 nt, Homo Sapiens
uuagauuuaaaaagugaaagaaacugcaggcgccuuuguaaaaugcaaaauauuuaauuaaaa

SEQ ID NO: 67241 - RNA, 63 nt, Homo Sapiens
accccugucucucaccuccaccaaccccacucacuuuguaacuucaucacugacccggccaau

SEQ ID NO: 67242 - RNA, 63 nt, Homo Sapiens
gacguugaucuccugguagcaugaccuuuuggccuuuguaagacacacagccuuucuguauca

SEQ ID NO: 67243 - RNA, 63 nt, Homo Sapiens
aaacacguagcauuugcaccccuccaaagccaucuuuguaaaggaaaacguauuuguaauuga

SEQ ID NO: 67244 - RNA, 63 nt, Homo Sapiens
uacuacagauugacacguuuuuaauuagcuguccuuuguaagaagucaggaaaucugaugcug

SEQ ID NO: 67245 - RNA, 63 nt, Homo Sapiens
ucuuagaaugcgaaucuguguuaagaaucuagucuuuguaauagaaguuucccaguggcauuc

SEQ ID NO: 67246 - RNA, 63 nt, Homo Sapiens
uaggaacuucagaggcuuuguuuaaacgcaaagcuuuguaaaagccacaaggucugagcugaa

SEQ ID NO: 67247 - RNA, 63 nt, Homo Sapiens
cagccaccaccaaaaagcaaagaagacacugcucuuuguaaccaauacugcuaccuucagggc

SEQ ID NO: 67248 - RNA, 63 nt, Homo Sapiens
aaacaaaauaaaguuuguacgaggccaccgugccuuuguaaagaguggggagaaaaaaaccaa

SEQ ID NO: 67249 - RNA, 63 nt, Homo Sapiens
uucucuaaacgucaggccugagauccuggccgccuuuguaaccagagcuuuuuggaaauacuc

SEQ ID NO: 67250 - RNA, 63 nt, Homo Sapiens
gauguggacauaauugccuagauuuggcaauagcuuuguaaguaaacucugcuuccuuggaca

SEQ ID NO: 67251 - RNA, 63 nt, Homo Sapiens
uauaaaacuaaggaaaacucaaugcuguacugacuuuguaaaaucuguguuagaaguguugca

SEQ ID NO: 67252 - RNA, 63 nt, Homo Sapiens
cuuucuaugugacauuucucaaauuuaauccuucuuuguaauaauaguguuuggacagcugau

SEQ ID NO: 67253 - RNA, 63 nt, Homo Sapiens
uaaacuuugaccaagaaauuggccacucauguucuuuguaacuugaagagucaucugauucga

SEQ ID NO: 67254 - RNA, 63 nt, Homo Sapiens
uuaugggacaaaaaucaauuuuagucgaaucagcuuuguaauguggcuguuuucuucuggggc

SEQ ID NO: 67255 - RNA, 63 nt, Homo Sapiens
aauucuugcucuucuaggggccuguuuuaauaacuuuguaaggugucaccuauaugggauuug

SEQ ID NO: 67256 - RNA, 63 nt, Homo Sapiens
uagcaacucauuuauuucauuuuggucuuaaugcuuuguaaacaggucaaaaaauacugucau

SEQ ID NO: 67257 - RNA, 63 nt, Homo Sapiens
cuccaucccuauucccuccucugaaaugcaccccuuuguaauugaggacaaggugguucugug

SEQ ID NO: 67258 - RNA, 63 nt, Homo Sapiens
uguuuaugucagagcuuuguuguaagccucucacuuuguaaggaaauucuuauuggguagguu

SEQ ID NO: 67259 - RNA, 63 nt, Homo Sapiens
auuuuuuugcauuuaugaacggcuguuuuucuacuuuguaauugugagacauuuucuugggga

SEQ ID NO: 67260 - RNA, 63 nt, Homo Sapiens
acuguuaugccuuuuauuuguuugcaaggaugucuuuguaauguguuucaugaauagaauauc

SEQ ID NO: 67261 - RNA, 63 nt, Homo Sapiens
gucacauaggaauuguucagcaacagaaagauacuuuguaaugagaagguacaaauuugagua

SEQ ID NO: 67262 - RNA, 63 nt, Homo Sapiens
auuugagaaaaaucugggucuuucuaaaaacugcuuuguaaguuacuuuuucuuuaugacuuc

SEQ ID NO: 67263 - RNA, 63 nt, Homo Sapiens
gcccugcauccccccuccucugccugagugugucuuuguaaugucagcuggcaucauacaaag

SEQ ID NO: 67264 - RNA, 63 nt, Homo Sapiens
gcagggacugugagagacaaccagcagcauccucuuuguaaucacagggcagggaucagaguu

SEQ ID NO: 67265 - RNA, 63 nt, Homo Sapiens
ccaggccugaaccccucccgugcuguaauaaaucuuuguaaauaacugcugagacuccucuuu

SEQ ID NO: 67266 - RNA, 63 nt, Homo Sapiens
ucgaacccacacugcaacaggaacugugagagucuuuguaaguaaacugcccugucuagguca

SEQ ID NO: 67267 - RNA, 63 nt, Homo Sapiens
ugcagaccugggacuuuagggcuaaccaguucucuuuguaaggacuugugccucuugggagac

SEQ ID NO: 67268 - RNA, 63 nt, Homo Sapiens
agacucuacauugggcagccuuuaaauaugauucuuuguaaugcuaaauagccuuuuuuucuc

SEQ ID NO: 67269 - RNA, 63 nt, Homo Sapiens
uauauauacuuuuucauauauaauuagaucuuucuuuguaauuucauauguaguucuucauag

SEQ ID NO: 67270 - RNA, 63 nt, Homo Sapiens
ccuugguugauaacugucuugauacuuuucauucuuuguaagaggccaaaucgucuaaggacg

SEQ ID NO: 67271 - RNA, 63 nt, Homo Sapiens
gaucagugugcuaaaucucucugccuguuuggacuuuguaauuauuuuuuuagcaguaauuaa

SEQ ID NO: 67272 - RNA, 63 nt, Homo Sapiens
cugaaaacuaccuguggguuaaggauguaguuccuuuguaagggugggcaggccucguaagaa

SEQ ID NO: 67273 - RNA, 63 nt, Homo Sapiens
ccagcccccugucgccugucucggugcuaauuccuuuguaauugaaggacccgcuuccuguug

SEQ ID NO: 67274 - RNA, 63 nt, Homo Sapiens
uuuuggacauugaaagauguacauucauauaaacuuuguaacuaggcugcaucuuuauauguu

SEQ ID NO: 67275 - RNA, 63 nt, Homo Sapiens
aaauauguuuuguaguaacaauuguauuuagugcuuuguaauauugagucugggauuauccgc

SEQ ID NO: 67276 - RNA, 63 nt, Homo Sapiens
gauuuuuuguaaagucauuguaugcagucacuucuuuguaaauuuggcacaaauauuuuauca

SEQ ID NO: 67277 - RNA, 63 nt, Homo Sapiens
gaagaugcucuuccagagacccaaaguaacgaccuuuguaagucaucaccaugacaucucucu

SEQ ID NO: 67278 - RNA, 63 nt, Homo Sapiens
aaugcugcauacuuucuggacuguaucucuuggcuuuguaauaccuccuuugcccugggacau

SEQ ID NO: 67279 - RNA, 63 nt, Homo Sapiens
uauggaguauugugcacaacuugucuggauuaacuuuguaauuucgcccugcugcauuugcuc

SEQ ID NO: 67280 - RNA, 63 nt, Homo Sapiens
aaucaaaauuaccuuauaucuggucauguuggucuuuguaacauauucagucacaagucauuu

SEQ ID NO: 67281 - RNA, 63 nt, Homo Sapiens
uauuggccuuuuagugaguauagacuuauuuuccuuuguaauguuuagacuuuuuuuuauaaa

SEQ ID NO: 67282 - RNA, 63 nt, Homo Sapiens
aaacucucggagaaauaaaacgagcucaauucacuuuguaagaauuacaucaagcuaauugug

SEQ ID NO: 67283 - RNA, 63 nt, Homo Sapiens
ugaggguggaggugggaauaaccucaauuuccacuuuguaaaacuacacaauucuccuucggg

SEQ ID NO: 67284 - RNA, 63 nt, Homo Sapiens
uccacagggacuguucuauaauguaaaauagggcuuuguaaacuuacugaggaccaaagauac

SEQ ID NO: 67285 - RNA, 63 nt, Homo Sapiens
aauaaaguuuggggugaugaguuguagagaacucuuuguaagccuugguacugcagagucugg

SEQ ID NO: 67286 - RNA, 63 nt, Homo Sapiens
ucuugcaguuuuguaagcccgcuauuguaaggucuuuguaaaauaccuccccuuuucuauguu

SEQ ID NO: 67287 - RNA, 63 nt, Homo Sapiens
accaagguaccgauuucugcuuugaacgugcuucuuuguaaugugcaauugucuuuuuuuucc

SEQ ID NO: 67288 - RNA, 63 nt, Homo Sapiens
aguuuccccucccccaccccaaauauuaguugccuuuguaaacuguacucuccacauuauuuu

SEQ ID NO: 67289 - RNA, 63 nt, Homo Sapiens
auggacaucacuuuuuuuuucagauuuguucaacuuuguaaauuccguuucuuaaguauugcg

SEQ ID NO: 67290 - RNA, 63 nt, Homo Sapiens
uaaggaaauaacaauguaguuaugggaagaguucuuuguaaugguaguacaugggaaaaacag

SEQ ID NO: 67291 - RNA, 63 nt, Homo Sapiens
aauuggcuaaaagaaucaucugaauuauucuaccuuuguaaacaaaaaaaaauaaaauuauuu

SEQ ID NO: 67292 - RNA, 63 nt, Homo Sapiens
aaaaauaaaauuauuuugaauccuguacuugcucuuuguaaaaaauacaugaucuugaacagc

SEQ ID NO: 67293 - RNA, 63 nt, Homo Sapiens
uaccaagguucccguuaacauuuuuguuaaacccuuuguaaaaucagaaauaugaauaaauag

SEQ ID NO: 67294 - RNA, 63 nt, Homo Sapiens
uugauacuuuccuaagaauuuagguguaugauacuuuguaaaggaaauucauguuuacuuuuc

SEQ ID NO: 67295 - RNA, 63 nt, Homo Sapiens
acuuauaacaugguguaucucaaaugguuguaacuuuguaagucauggaaaauguuaaggaag

SEQ ID NO: 67296 - RNA, 63 nt, Homo Sapiens
aagcacaucggaaccagaggaaauaaucaggugcuuuguaaccuggugguuuuucguucucuu

SEQ ID NO: 67297 - RNA, 63 nt, Homo Sapiens
uaucuggaagggaaagcacauuccgugcucuggcuuuguaacuuucaaagaugagggccuggc

SEQ ID NO: 67298 - RNA, 63 nt, Homo Sapiens
guacuguggauuguacauuuaacuuuggaauggcuuuguaauaaucagucuuaagaaaauguu

SEQ ID NO: 67299 - RNA, 63 nt, Homo Sapiens
augcuuuacugccauugcuguaugcuuuacugucuuuguaaaaaucccccucuccccuuuucu

SEQ ID NO: 67300 - RNA, 63 nt, Homo Sapiens
uuauccaugauauucaguacaacucugucauuucuuuguaauauuuaaaaaauauuaguaaag

SEQ ID NO: 67301 - RNA, 63 nt, Homo Sapiens
aaaauguuuugaauuuauaaaauuaauguuuuucuuuguaacauuuauauauauuuuuuaaca

SEQ ID NO: 67302 - RNA, 63 nt, Homo Sapiens
auuuugauuuguauucaaguacucuucaaguaucuuuguaaugaagguuuggcuacuuguaua

SEQ ID NO: 67303 - RNA, 63 nt, Homo Sapiens
ugaucaguauuccuccucuaucaccuuuuuagacuuuguaagguaaauauuuggacuaacuuu

SEQ ID NO: 67304 - RNA, 63 nt, Homo Sapiens
aauugcugggccauaugaaaaaucaauaguuagcuuuguaagaaacagucaaacuguuuucca

SEQ ID NO: 67305 - RNA, 63 nt, Homo Sapiens
cuaucuaucauacucccaaauuccuucuugcaucuuuguaauuucucacucuuccuucucccu

SEQ ID NO: 67306 - RNA, 63 nt, Homo Sapiens
uuggagauauuuuccaacagccaagaaaaacaacuuuguaaauuguucuguauuuuuaaauug

SEQ ID NO: 67307 - RNA, 63 nt, Homo Sapiens
augaacaaacaugagacugucaaauauucacugcuuuguaaaaaaccuuauaaaaacagguuc

SEQ ID NO: 67308 - RNA, 63 nt, Homo Sapiens
aaauugguuucuguaaaucccaguuggucaagacuuuguaaaguacugggauagucagguaaa

SEQ ID NO: 67309 - RNA, 63 nt, Homo Sapiens
agaaaaaaaaauuuuuucuggacuuauacauaacuuuguaaaacaguauuugguggucccuau

SEQ ID NO: 67310 - RNA, 63 nt, Homo Sapiens
uugcauucuauuuauugugagugcugccaucaacuuuguaagagaagcacccaucuucacuug

SEQ ID NO: 67311 - RNA, 63 nt, Homo Sapiens
acggagaggaacaaaccaucuggggcucauugucuuuguaauuaauguaggauacuuuuuauu

SEQ ID NO: 67312 - RNA, 63 nt, Homo Sapiens
agauucaaauuagauagucaacauuuuucuucucuuuguaaguuucauugcuuuacauacuag

SEQ ID NO: 67313 - RNA, 63 nt, Homo Sapiens
uuuuacaaauuguuuaauacaaagcuaaauuuucuuuguaaguaaucugccuaauuuuucuug

SEQ ID NO: 67314 - RNA, 63 nt, Homo Sapiens
uuguugagggcccucuuguuggaugaucugcuccuuuguaacgccaggagcaagagaccagaa

SEQ ID NO: 67315 - RNA, 63 nt, Homo Sapiens
acuuggggaguaaggacauuauguacuuucucccuuuguaaagugugugaaaucuaagcagua

SEQ ID NO: 67316 - RNA, 63 nt, Homo Sapiens
gacaucuuauuggauauuagcaauugcacgcugcuuuguaagccacuuuuuaguacucugaca

SEQ ID NO: 67317 - RNA, 63 nt, Homo Sapiens
ccgacuuccucugccaguuauugacacagcucucuuuguaagagaggaaagaaacuaaaccca

SEQ ID NO: 67318 - RNA, 63 nt, Homo Sapiens
gcaggugucccggucugcauaagccucgugugccuuuguaaaguccaccuacacuuuugacca

SEQ ID NO: 67319 - RNA, 62 nt, Homo Sapiens
uaucagugauacugaugagaauaaacuaaacgccuuuguaacagccuugccgcaugcucguu

SEQ ID NO: 67320 - RNA, 63 nt, Homo Sapiens
ccgcugggcucgcuggugaccgccacagccccgcuuuguaaccagggaauacacagucauuuc

SEQ ID NO: 67321 - RNA, 63 nt, Homo Sapiens
ucuugaaccccgaccacuaccccagguuucuaacuuuguaacuugcuucugaugugggucccu

SEQ ID NO: 67322 - RNA, 63 nt, Homo Sapiens
agagaggacagguccucaacaaauggcaugugacuuuguaaguguagaauugcugugagguau

SEQ ID NO: 67323 - RNA, 63 nt, Homo Sapiens
ccccgccccagggcaauguuggacccccuuuuacuuuguaaaguuuguauuuauuccccuuua

SEQ ID NO: 67324 - RNA, 63 nt, Homo Sapiens
ggcccguccuaggaauggauguggggauggucgcuuuguaaugugcugguucucuuuuuuuuu

SEQ ID NO: 67325 - RNA, 63 nt, Homo Sapiens
uggaaaauucaccaccucuagcuccucacuguucuuuguaauuaacacgcuguugguaaucuu

SEQ ID NO: 67326 - RNA, 63 nt, Homo Sapiens
ucccgccccaaacguccgcuuuccuuuucucuacuuuguaauuuauugaucaguuucuguugg

SEQ ID NO: 67327 - RNA, 63 nt, Homo Sapiens
uccugcccucuaauuugggggcagcaguuugugcuuuguaagcuucagucuuauuuauagugu

SEQ ID NO: 67328 - RNA, 63 nt, Homo Sapiens
cauaugugggaggcuuucaugagguguguugcacuuuguaacugucuagagcucuugauggaa

SEQ ID NO: 67329 - RNA, 63 nt, Homo Sapiens
gaacggguacuacacuuuauagaagucuuggcacuuuguaacgaaaaggcaaccaaccacauu

SEQ ID NO: 67330 - RNA, 63 nt, Homo Sapiens
uuugacgagaaaguugguugauuucacaugguacuuuguaaauuguugucuuaaugccauuuc

SEQ ID NO: 67331 - RNA, 63 nt, Homo Sapiens
uucagaauauuucuagaauggauguaacccauucuuuguaagguuuccaggucaguacguaaa

SEQ ID NO: 67332 - RNA, 63 nt, Homo Sapiens
ugacacauuugaaaucauugaacaaucugcuuucuuuguaacacauauuugcacaaguacagu

SEQ ID NO: 67333 - RNA, 63 nt, Homo Sapiens
aauguuaaagccagaaguugccucugcucuuaucuuuguaauagaagaaguguaacucaccag

SEQ ID NO: 67334 - RNA, 63 nt, Homo Sapiens
aaguaucuuucaguuuuauauuuauguauuucacuuuguaacauauaauacauauguuguacu

SEQ ID NO: 67335 - RNA, 63 nt, Homo Sapiens
aaccuaaaaaguacaguguguuuaucacgagagcuuuguaagguacuucacuuccacuuuaaa

SEQ ID NO: 67336 - RNA, 63 nt, Homo Sapiens
auucuacaaaaaaauguuguuaauaaaugucugcuuuguaaaagcaguuuugcaauuuuuuaa

SEQ ID NO: 67337 - RNA, 63 nt, Homo Sapiens
cugugguugcugugacaguuucguuuucugaaucuuuguaaugcucuuccacccugcucgugc

SEQ ID NO: 67338 - RNA, 63 nt, Homo Sapiens
aaucugaacuaacuugcuuuuagaagucuuuuucuuuguaagcauuguaaaugcuaauaaauc

SEQ ID NO: 67339 - RNA, 63 nt, Homo Sapiens
uguguccccuguccugccccaccgguuugcuggcuuuguaauaacauaagaccauugugguug

SEQ ID NO: 67340 - RNA, 63 nt, Homo Sapiens
ccucuugaagcuuuuucugccuccugauucucucuuuguaaacuauuuucaaauuguuuuuca

SEQ ID NO: 67341 - RNA, 63 nt, Homo Sapiens
auacaguauuuuccaugguucugccugcacuuacuuuguaaugccacgguugagauugagaga

SEQ ID NO: 67342 - RNA, 62 nt, Homo Sapiens
ggaugugaaucuuacauuccuuuucaucauuuccuuuguaaaaaugacgagugcuggguuuu

SEQ ID NO: 67343 - RNA, 63 nt, Homo Sapiens
uuuucguuuuaaauuuuagauuuuauuuuagugcuuuguaauuaauugggguuuauauugaua

SEQ ID NO: 67344 - RNA, 63 nt, Homo Sapiens
gaauggcuucaaaauaagucacgaacacaaauucuuuguaaauuauguaaauuccuguuuaua

SEQ ID NO: 67345 - RNA, 63 nt, Homo Sapiens
ucuuccccacccagcucuccccugcgccccugucuuuguaaauugacccuucuggaguggggg

SEQ ID NO: 67346 - RNA, 61 nt, Homo Sapiens
cccuaauaaacaccugcucacuggcuggguauucuuuguaaccaguguuucuggcuccugc

SEQ ID NO: 67347 - RNA, 63 nt, Homo Sapiens
auguauccagaguaguuggaucaagugcuguuucuuuguaaaagcauuagaaacauugagagu

SEQ ID NO: 67348 - RNA, 63 nt, Homo Sapiens
cuguauuuuacccuugagcucagccuaaagaugcuuuguaaaguaagcacguuugggaaggaa

SEQ ID NO: 67349 - RNA, 63 nt, Homo Sapiens
aauuuucauucucauuaggaaagugacucuagucuuuguaagccugcuucacagaauaauggg

SEQ ID NO: 67350 - RNA, 63 nt, Homo Sapiens
ucugauuucuuuucaccauucacaccaaucuuacuuuguaaauuaauugugugaacuuggaag

SEQ ID NO: 67351 - RNA, 63 nt, Homo Sapiens
acagugaauaaccucuuggaaaaucuucuagcacuuuguaaacaagagaaaaguacaagacag

SEQ ID NO: 67352 - RNA, 63 nt, Homo Sapiens
ggggccuugcccccaccuccaacuguuuaaacccuuuguaaccagucauaggacuggcaaagc

SEQ ID NO: 67353 - RNA, 63 nt, Homo Sapiens
accacucaaauaaaagucucauauugcaacaaucuuuguaagacuaucaaacaaaugacuuuc

SEQ ID NO: 67354 - RNA, 63 nt, Homo Sapiens
acuauguguucuggugugucucuguaaaaguuucuuuguaaauguaucuuuucaauuaaugua

SEQ ID NO: 67355 - RNA, 63 nt, Homo Sapiens
agggaccaccucccuggggcugcuccuccuugucuuuguaaaaggaacugcagggaacuucuc

SEQ ID NO: 67356 - RNA, 63 nt, Homo Sapiens
cagugcauuuuucagauuugauaugguaaaagccuuuguaaaaugagacuggcagcagugggu

SEQ ID NO: 67357 - RNA, 63 nt, Homo Sapiens
uguugaaguuaauuugaauugggcuucauaguucuuuguaauauuccaacaguggccuucucc

SEQ ID NO: 67358 - RNA, 63 nt, Homo Sapiens
auggaaauaugguguccacgaaguccagucugucuuuguaagccacugcccaaccccaggucu

SEQ ID NO: 67359 - RNA, 63 nt, Homo Sapiens
uugugucuggacuaaguuaaaagaauuaaaauacuuuguaauguccugggcuuugggaaaugu

SEQ ID NO: 67360 - RNA, 63 nt, Homo Sapiens
auuaguuuaauuuucuucaaaaugaaaauacugcuuuguaauuacaaaaugagacacaccuau

SEQ ID NO: 67361 - RNA, 63 nt, Homo Sapiens
uuauaucccggaauauuucccuccggcuuucgccuuuguaacucccaucuguggacccaucgu

SEQ ID NO: 67362 - RNA, 63 nt, Homo Sapiens
guuuggaaacuuucuuuuacuaacuuuagauugcuuuguaaauauccuaaaaucagguuuacu

SEQ ID NO: 67363 - RNA, 63 nt, Homo Sapiens
ugauuugauuauacuguaaaacuggucaucuaacuuuguaauuaaagaacugaagaugagaau

SEQ ID NO: 67364 - RNA, 63 nt, Homo Sapiens
uaaggcaagcccucucucaguucauuucucagacuuuguaauaucgaggcuaacgauguaggu

SEQ ID NO: 67365 - RNA, 63 nt, Homo Sapiens
ucagugcuggggacugaggcuaaaaaauucucccuuuguaaccgagccacaggccuaagucau

SEQ ID NO: 67366 - RNA, 63 nt, Homo Sapiens
cccucucucauuggccuauacaucucuuaggaccuuuguaaugguguccaugcaccuuuagag

SEQ ID NO: 67367 - RNA, 63 nt, Homo Sapiens
cgccaggcggcauccuuuucuaugaaguguugacuuuguaaaucugcccacacccagcuggcc

SEQ ID NO: 67368 - RNA, 63 nt, Homo Sapiens
uguggggaagguuggagaagaguuagguuugugcuuuguaaucuuggcauccauguuuugugc

SEQ ID NO: 67369 - RNA, 63 nt, Homo Sapiens
caaguguuacuugugccgggaaaauuuugcugucuuuguaauuuuaaaacuuuaaaauaaauu

SEQ ID NO: 67370 - RNA, 63 nt, Homo Sapiens
cuguuuaucaucagcuccucugaaaugugaucccuuuguaacugugcucaucacuucgccagu

SEQ ID NO: 67371 - RNA, 63 nt, Homo Sapiens
cgcagucacacauuaggguugugauacagagcucuuuguaaacgcuacugaaagcuaucccag

SEQ ID NO: 67372 - RNA, 63 nt, Homo Sapiens
uaaaaaacugaaaaaaaaaaaagcuuuuuauuacuuuguaauuuuuuuuuuaauuaaagagca

SEQ ID NO: 67373 - RNA, 63 nt, Homo Sapiens
uauuuuauaugaccuauaaaaagucaucugucucuuuguaaauugacugccaaauaauauuug

SEQ ID NO: 67374 - RNA, 63 nt, Homo Sapiens
accuaaucugagaccgugcuccucccccucgcccuuuguaauauuagacuccugggaugcccu

SEQ ID NO: 67375 - RNA, 63 nt, Homo Sapiens
acucaaggccaacugucacaggaacugcucugucuuuguaacugcuuagaauucugagaggca

SEQ ID NO: 67376 - RNA, 63 nt, Homo Sapiens
cggcuggaccacgucucccugcugcauccaaggcuuuguaaacgcaguguucuuggggguggg

SEQ ID NO: 67377 - RNA, 63 nt, Homo Sapiens
ucaaagaccaguuuguaccgaugaaacgcgcaacuuuguaaucccaacacuuucuauuuucua

SEQ ID NO: 67378 - RNA, 63 nt, Homo Sapiens
ugccuucuuauuuuacuucuuuuagcuguuuaacuuuguaagaugcaaagagguuggaucaag

SEQ ID NO: 67379 - RNA, 63 nt, Homo Sapiens
ggucuuucauagccaaacuuguauauuuaaauucuuuguaauaauaauauccaaaucaucauc

SEQ ID NO: 67380 - RNA, 63 nt, Homo Sapiens
uacauaccgugagaaguuacguaacauuuacuccuuuguaaauguuucccuaucaucagacaa

SEQ ID NO: 67381 - RNA, 63 nt, Homo Sapiens
cauacuuauauagaggaauuuauguaaccaugacuuuguaauuuugagaauuccucccaguga

SEQ ID NO: 67382 - RNA, 63 nt, Homo Sapiens
gaauuaauaaaacaaagucauacaacacauuuucuuuguaauugagaacuagauaacauggua

SEQ ID NO: 67383 - RNA, 63 nt, Homo Sapiens
ucacccccaaugaggucuuaggcagauucuuuacuuuguaauucaaaaggccuguuaaccuuu

SEQ ID NO: 67384 - RNA, 63 nt, Homo Sapiens
uuggaaaaaaaauacuagccuagcuggucauuucuuuguaagguaguuagcaauuuuaagucu

SEQ ID NO: 67385 - RNA, 63 nt, Homo Sapiens
aaaugagauuuuguacauggaguugacauaauacuuuguaaauugaauuuuuuaaagaaauag

SEQ ID NO: 67386 - RNA, 63 nt, Homo Sapiens
agaaucguucaacugucaaucagccucuugauucuuuguaaauugccaggguggguggguaca

SEQ ID NO: 67387 - RNA, 63 nt, Homo Sapiens
ccacucugcuuccuuggacaauaucaguaauagcuuuguaagugauguggacguaauugccua

SEQ ID NO: 67388 - RNA, 63 nt, Homo Sapiens
uuugcccucccaucccguuuagaguuauuuaggcuuuguaacgauugggggauaaaaagaugu

SEQ ID NO: 67389 - RNA, 63 nt, Homo Sapiens
uuaaaacacuaacggaaacccauggaguuuguccuuuguaaaaauuuuaaacacagugucuug

SEQ ID NO: 67390 - RNA, 63 nt, Homo Sapiens
uacuccaaugguguacaaugucuuuugcacaaacuuuguaacuuuuguuacugugaauucaaa

SEQ ID NO: 67391 - RNA, 63 nt, Homo Sapiens
gguuuuuaauauaaagguguuaagcuuauuuugcuuuguaaguaaagaauguguauauuguga

SEQ ID NO: 67392 - RNA, 63 nt, Homo Sapiens
gcuguuuuguuuuguguuguugaauuugaaagccuuuguaaauaucaauauaauguaccaaug

SEQ ID NO: 67393 - RNA, 63 nt, Homo Sapiens
gaaagcuauauacuugugcuaucuaaagcacuacuuuguaaagaugacuacccaagauuguaa

SEQ ID NO: 67394 - RNA, 63 nt, Homo Sapiens
uguuuucaaugaauuaagaaagauuaaauauaucuuuguaaauuauuuuaugucauaguuuaa

SEQ ID NO: 67395 - RNA, 63 nt, Homo Sapiens
aagaaaaauguauauagcuguauauuuaagagacuuuguaaaagguguuuugccagccugaac

SEQ ID NO: 67396 - RNA, 63 nt, Homo Sapiens
auaaacaccgaggcuuacugugcuauaugccuccuuuguaaaauauaagauuuugguucuacu

SEQ ID NO: 67397 - RNA, 63 nt, Homo Sapiens
auuugcaucuguuuagaaacguggcuuucaucgcuuuguaaaaguaguauuccugagcaaaac

SEQ ID NO: 67398 - RNA, 63 nt, Homo Sapiens
ugguuuuguaggcaggcugucauacuaggaaggcuuuguaaacuccucucagaagcacaagug

SEQ ID NO: 67399 - RNA, 63 nt, Homo Sapiens
gugcagauauuuugaaaggcgauuuccuuauuucuuuguaauuuugcuuuuagcagauaugaa

SEQ ID NO: 67400 - RNA, 63 nt, Homo Sapiens
uauuuaaaacugcuauuuucccugaaaagccaacuuuguaacacucucaaaaagcuuauuaag

SEQ ID NO: 67401 - RNA, 63 nt, Homo Sapiens
gagaugccaguaguguucaauuucacaaaaauacuuuguaaauagcaaagccaauggagagua

SEQ ID NO: 67402 - RNA, 63 nt, Homo Sapiens
augauguguggaggcuauucaaucuacuuugaacuuuguaaaaaaugaaaagcacauaaaugu

SEQ ID NO: 67403 - RNA, 63 nt, Homo Sapiens
aaaugcaaucggugugccuuuauuucuucucuacuuuguaaccauacuuuuggacuugaaaau

SEQ ID NO: 67404 - RNA, 63 nt, Homo Sapiens
uucacaaccgcuguccauuggcuaucaaaaugucuuuguaauuuauaauuugaauaauuuuga

SEQ ID NO: 67405 - RNA, 63 nt, Homo Sapiens
caaacucaagaaaacugguaucgucucuuugugcuuuguaaaguguaccccaaugcaaaaccu

SEQ ID NO: 67406 - RNA, 63 nt, Homo Sapiens
ugaccugcgaauuacccuaaugauauuacaguucuuuguaaaaagccguuuggaaguguucuu

SEQ ID NO: 67407 - RNA, 63 nt, Homo Sapiens
cuaauaaugcacucaguuuauaggagauacaaacuuuguaauuaaauccaugguuaucugaga

SEQ ID NO: 67408 - RNA, 63 nt, Homo Sapiens
gccaaauuucuccuuccacucauauuccugugucuuuguaauguccugccccucacuucuuaa

SEQ ID NO: 67409 - RNA, 63 nt, Homo Sapiens
uccacuuagccuacuacaggaagcuacuacugccuuuguaacugauaacgagagggggaaaaa

SEQ ID NO: 67410 - RNA, 63 nt, Homo Sapiens
gguauucugccagccugaacuauauuuaagaaacuuuguaaaaaauaaaaauguauauagcug

SEQ ID NO: 67411 - RNA, 65 nt, Homo Sapiens
gaauuguugggguuuuuuuuguuguuuuguuuuguuuuguagauggaguuucacuuuuguugccc

SEQ ID NO: 67412 - RNA, 65 nt, Homo Sapiens
uuguuguugucauugauuuuggugacauggacuuguuuguagaggacaggucagcugucuggcuc

SEQ ID NO: 67413 - RNA, 65 nt, Homo Sapiens
uucuacaaaagucacuacagauuuugcuauauugcuuuguagauagauuuuuacuuuugccuaaa

SEQ ID NO: 67414 - RNA, 65 nt, Homo Sapiens
uguuagguaacuuaggggccagaaucuccaugcacuuuguagaccacauuuccuguuaugaaauu

SEQ ID NO: 67415 - RNA, 65 nt, Homo Sapiens
uguggagccuaucagaccccaagugucuugaaauguuuguagaaacccacuaaaaugccccuucu

SEQ ID NO: 67416 - RNA, 65 nt, Homo Sapiens
acugcauuuuaguauuucucuuccauucuccugguuuuguagacccagaagauugaaugagugac

SEQ ID NO: 67417 - RNA, 65 nt, Homo Sapiens
auguugcugugaccuguuuuucuuucucauucacauuuguagauauugugugaacuacaguauau

SEQ ID NO: 67418 - RNA, 65 nt, Homo Sapiens
uuguaguauuugaauacugucaacuugacaguaacuuuguagacuuaaugguauuauuaaaguuc

SEQ ID NO: 67419 - RNA, 65 nt, Homo Sapiens
cuuuuauaagcacuccagggaagauuuuauauuuuuuuguagaguuuuuggaaagauauuuacuc

SEQ ID NO: 67420 - RNA, 65 nt, Homo Sapiens
gacuugcuuacuguauuugcauuguuagaaaacaguuuguagacaaugauucuuuuuuaauaaaa

SEQ ID NO: 67421 - RNA, 65 nt, Homo Sapiens
gaugugaugaggauuaaaugaaucaaaagacuuaauuuguagauucuuuuagaguuaugagcuag

SEQ ID NO: 67422 - RNA, 65 nt, Homo Sapiens
aucagaacagagacuuaauuuuuuaaaucuuaagauuuguagaauguuucuaggauaggauauua

SEQ ID NO: 67423 - RNA, 65 nt, Homo Sapiens
accgccaucaugacgcucauacuggcuuuugccuguuuguagaggaaaaggugggcugguuuuag

SEQ ID NO: 67424 - RNA, 65 nt, Homo Sapiens
uuugucauuuuugauaauuuaaauauugcugcugcuuuguagaugaugagaagaaauguuaaagu

SEQ ID NO: 67425 - RNA, 65 nt, Homo Sapiens
ggaagaggccaugguuuguuggagacaagaucaccuuuguagauuuccucgccuaugauguccuu

SEQ ID NO: 67426 - RNA, 65 nt, Homo Sapiens
uuccauucacaugcucauauguuuauaaacuguguuuuguagaagaaaaagaaucauaacaauac

SEQ ID NO: 67427 - RNA, 65 nt, Homo Sapiens
cuuuacuuucuucugucuuuuacagcucuuugcauuuuguagaccuuaauacucagguuaaauau

SEQ ID NO: 67428 - RNA, 65 nt, Homo Sapiens
cacaugccaccaugcccagcuaaauuuuuaauauuuuuguagagauggggucuugcuguguuacc

SEQ ID NO: 67429 - RNA, 65 nt, Homo Sapiens
caccaccacaccuggcuaauucuucuuaaaauuuuuuuguagagacagggucucacuauguugcc

SEQ ID NO: 67430 - RNA, 65 nt, Homo Sapiens
ccuguccccacacaggucaagacuacagagaaggcuuuguagaaaugugucaccuauguacaccu

SEQ ID NO: 67431 - RNA, 65 nt, Homo Sapiens
auaccucaucuguucuuuuuaauauuuuaucucuguuuguagagagcuaacguuugauaguucua

SEQ ID NO: 67432 - RNA, 65 nt, Homo Sapiens
ccucuuauaacuucugaaguaauuuguaaaaaagauuuguagagucaaucauguguuuaaauuau

SEQ ID NO: 67433 - RNA, 65 nt, Homo Sapiens
acagacagaagcccgaaguggaaagaccuuaugguuuuguagauauggugacuccagucuuuguu

SEQ ID NO: 67434 - RNA, 65 nt, Homo Sapiens
aaacuccaaaccuccuguuagcuguuauuucuauuuuuguagaaguaggaagugaaaauagguau

SEQ ID NO: 67435 - RNA, 65 nt, Homo Sapiens
uauacaguggauuaauuaaaugcagcgaaccaauauuuguagaaggguuauauuuuacuacugug

SEQ ID NO: 67436 - RNA, 65 nt, Homo Sapiens
uuuaauuuuuuugagauuaucggcggcacaaucacuuuguagaaacuguaaaaaauaaaaguauc

SEQ ID NO: 67437 - RNA, 65 nt, Homo Sapiens
agcuucccuguagcccaccuuccccuugcuucauguuuguagaggaaccuugugccggccaggcc

SEQ ID NO: 67438 - RNA, 65 nt, Homo Sapiens
caggugugcaccaacacacccggcuaauuuuuguauuuguagaagaggcgggguuucaccauguu

SEQ ID NO: 67439 - RNA, 65 nt, Homo Sapiens
acagagccuuuucuguccuguagauaaucuacauguuuguagaauuauuuugaauauguuugagg

SEQ ID NO: 67440 - RNA, 65 nt, Homo Sapiens
ucaccucugucgcuuggguuaaacaagagacagguuuuguagaauauugauugguaauaguaaau

SEQ ID NO: 67441 - RNA, 65 nt, Homo Sapiens
ccuauaauccccauaucaaccuuauaaggaagguguuuguagaugaugcaacugagccuuaagag

SEQ ID NO: 67442 - RNA, 65 nt, Homo Sapiens
uacugguuugcauguacccacccaaaaugauuauuuuuguagaaucuaaguuaaacuuacuauuu

SEQ ID NO: 67443 - RNA, 65 nt, Homo Sapiens
agaaauauuuuaguuaaaguuuugauauauggaaauuuguagaacauuaaauucuacagcuuuuu

SEQ ID NO: 67444 - RNA, 65 nt, Homo Sapiens
acugaaguauuugugagccauaauuuccagaugcuuuuguagaugugacucuggcuaaaauuauc

SEQ ID NO: 67445 - RNA, 65 nt, Homo Sapiens
guagacuguggcuagugacaccuggagaggguauuuuuguagaguccuccacacccgugagaaau

SEQ ID NO: 67446 - RNA, 65 nt, Homo Sapiens
uuauuuacuagaagcuuccucuccuauuuuacaaauuuguagaaauccaguuuaaguguagacaa

SEQ ID NO: 67447 - RNA, 65 nt, Homo Sapiens
cugguaggggcuggggcuacuccauccuguaggauuuuguagaugcaggcuggcuagcccuuccc

SEQ ID NO: 67448 - RNA, 65 nt, Homo Sapiens
gaaccacugccccuucauugaaagugaagaauccuuuuguagaauaccacugcaaguccuuuugu

SEQ ID NO: 67449 - RNA, 65 nt, Homo Sapiens
cagggcuucaccauguugccaugcccagcugauuuuuuguagagaaacuacaggcacaugccacc

SEQ ID NO: 67450 - RNA, 65 nt, Homo Sapiens
cgguguuuugccauguuggcaauuuuuguauuauuuuuguagagagugugccaccaugccucacu

SEQ ID NO: 67451 - RNA, 65 nt, Homo Sapiens
uuauauguuuuguaguauucccuuuauauuucugcuuuguagaaaugcuguuuuaaauuauaaaa

SEQ ID NO: 67452 - RNA, 65 nt, Homo Sapiens
uguguuuuuccauguugcccaauuuuuuguauuuguuuguagagagcuuacacccaagaccaguu

SEQ ID NO: 67453 - RNA, 65 nt, Homo Sapiens
uuuauuaaguaaaauccccuaagccuaaaauugaguuuguagaacuuugcuauggcaggauaaga

SEQ ID NO: 67454 - RNA, 65 nt, Homo Sapiens
cuaacauuuauguaucuuuauuuuauuucuacagcuuuguagauuuguguaaugcagaauaauga

SEQ ID NO: 67455 - RNA, 65 nt, Homo Sapiens
uuccuugauuaaagccagacgguugguaaugugacuuuguagauaaaaccaaagaguugccugca

SEQ ID NO: 67456 - RNA, 65 nt, Homo Sapiens
uccuuuauaauauuucaguguuuuccuagaagugguuuguagacuacuuucacagugaagugccu

SEQ ID NO: 67457 - RNA, 65 nt, Homo Sapiens
uuaacaggugaauucccgacguucugccugggcauuuuguagauaccaugacaccugcaaaauaa

SEQ ID NO: 67458 - RNA, 65 nt, Homo Sapiens
ucaguuuccgucguucacuuugcgccuuuuucuaauuuguagauugacaagaauauucaaaauuc

SEQ ID NO: 67459 - RNA, 65 nt, Homo Sapiens
uuuucgguccuauuuuaaugggguggguuuuauauuuuguagaagauuuucaugcaaauaaguaa

SEQ ID NO: 67460 - RNA, 65 nt, Homo Sapiens
ucuuuguuccuucuccauucauugaucacaaccaguuuguagauuugcagugguauuuacaacua

SEQ ID NO: 67461 - RNA, 65 nt, Homo Sapiens
aaaaaacuuucuggggaccuuauccuuucuguuauuuuguagauggcuuggguggugagggugcu

SEQ ID NO: 67462 - RNA, 65 nt, Homo Sapiens
uggaccaacuucaaagcucuaaacacagacauacuuuuguagaaggaagaauaaguaacacuccc

SEQ ID NO: 67463 - RNA, 65 nt, Homo Sapiens
caggguuucgccauguugacuuuuuuuuuuuuuuuuuuguagagaccaugucuggcuaauuuuuu

SEQ ID NO: 67464 - RNA, 65 nt, Homo Sapiens
guaggaacaaggaauuauauguggaaauuuccuuuuuuguagacaucaauuuuaaaacauaaaaa

SEQ ID NO: 67465 - RNA, 65 nt, Homo Sapiens
acaaagaaguauguaauuguuugauuugcucuuauuuuguagaaggaauauucauaugaaaauac

SEQ ID NO: 67466 - RNA, 65 nt, Homo Sapiens
uuaugacuaaauagucuguguuuccuuuuaagcuauuuguagaguuacaacuuguuucucccccu

SEQ ID NO: 67467 - RNA, 65 nt, Homo Sapiens
auaggggagugggaggaaggucccagggaaaacauuuuguagaguguggccuuuucaaggccuag

SEQ ID NO: 67468 - RNA, 65 nt, Homo Sapiens
aaaacauaaaauuuguccaguagccuucaugcaauuuuguagauuugauaggaaguuucucgagu

SEQ ID NO: 67469 - RNA, 65 nt, Homo Sapiens
gggucaccuacuagaagagaguguuugcacugcuuuuuguagagaaacuucagggcuuggaggug

SEQ ID NO: 67470 - RNA, 65 nt, Homo Sapiens
aggagaugagaguuucuaguugcacuacaagacacuuuguagaagccugacugacccuccugaac

SEQ ID NO: 67471 - RNA, 65 nt, Homo Sapiens
gagagcgagagaaaucagagggccucaagcucacauuuguagagauguaauguaaaggguggaaa

SEQ ID NO: 67472 - RNA, 65 nt, Homo Sapiens
ugggguuucgccauguugcccuaauuuuuguauuuuuuguagagagcaggcaccaccauacccag

SEQ ID NO: 67473 - RNA, 65 nt, Homo Sapiens
aucuuuuaaugaacuauuuuuaggcauaacauuguuuuguagauuaaagguguuauuuugacaau

SEQ ID NO: 67474 - RNA, 65 nt, Homo Sapiens
aaaaucuggauuuuuacaaccuuuucuauugauguuuuguagaaauaagacaggguacuaauuuu

SEQ ID NO: 67475 - RNA, 65 nt, Homo Sapiens
auuuucgaugcuuuuauggguauuuuuguaguuucuuuguagagagauaauaaaaaucaaaauau

SEQ ID NO: 67476 - RNA, 65 nt, Homo Sapiens
uauaucuaccauuguauguuaaauaaaucaccauuuuuguagaaaaaauucuaccugagaguaau

SEQ ID NO: 67477 - RNA, 65 nt, Homo Sapiens
guaguuugaaggcggucagauuucuuugagaaaucuuuguagaguuaauuuuauggaaauuaaaa

SEQ ID NO: 67478 - RNA, 65 nt, Homo Sapiens
aagacagguugagccuuaaucauguaacaaaauauuuuguagauuacauauugauuuuucaaaaa

SEQ ID NO: 67479 - RNA, 65 nt, Homo Sapiens
uaugcaccaccaugccuggcuaauuuuuuguauuuuuuguagagaugggguuucgccauguugac

SEQ ID NO: 67480 - RNA, 65 nt, Homo Sapiens
gcuaaauguugguaaauacuaauuaauuuccaucauuuguagacuuguuuugcaaugggauauau

SEQ ID NO: 67481 - RNA, 65 nt, Homo Sapiens
ccuuaauuuaagcuuucuagaaagcuuuggaaguuuuuguagauaguagaaaggggggcaucacc

SEQ ID NO: 67482 - RNA, 65 nt, Homo Sapiens
ucuguaaaguggcugguaacaacagcacuuuacaguuuguagauguaaccaguagcugaucuuaa

SEQ ID NO: 67483 - RNA, 65 nt, Homo Sapiens
gugugugccacuaugccuggcuaauuuuuguauuuuuuguagagacgggguuuugccauguugcc

SEQ ID NO: 67484 - RNA, 65 nt, Homo Sapiens
ucauuucuuguaaaacuuguaaauaaacuaucaucuuuguagauaucuuaaagguguaaaguuug

SEQ ID NO: 67485 - RNA, 65 nt, Homo Sapiens
cuucucuucuucgggauguuguuugcugucugaucuuuguagacuguuccuguuugcugggagcu

SEQ ID NO: 67486 - RNA, 65 nt, Homo Sapiens
ccagguuagaggcuccaagcagacaaagaagaaaguuuguagacacaauauucuaacauugcaca

SEQ ID NO: 67487 - RNA, 65 nt, Homo Sapiens
uuuaugugcaaggugauaggaaaacugaauccaucuuuguagaagagcacugggcuaauuuguau

SEQ ID NO: 67488 - RNA, 65 nt, Homo Sapiens
guggguauacguuuuuaccuuuuuuaaaaaacauuuuuguagaaaaaauaauuaaauccccuuuu

SEQ ID NO: 67489 - RNA, 65 nt, Homo Sapiens
aaaugaauuuuuuuuccccuugauuuaacaggauuuuuguagacuuuagaauuuggacuuaccua

SEQ ID NO: 67490 - RNA, 65 nt, Homo Sapiens
uccugucaugcagaguauaagaaugcuuugaacaauuuguagacuuagugaaauaaaauaagagg

SEQ ID NO: 67491 - RNA, 65 nt, Homo Sapiens
ccccuuuacaaagccgcugaccccugaugugaaacuuuguagagcagcagaguggcugcgugaaa

SEQ ID NO: 67492 - RNA, 65 nt, Homo Sapiens
cuuacuuuuuuccuuugucuuuggcugauuucugcuuuguagauaaauaauaauagcccugagau

SEQ ID NO: 67493 - RNA, 65 nt, Homo Sapiens
uuauuuauccuugucugaauguauuuauguguauauuuguagauuuauccagccgagcuuaggaa

SEQ ID NO: 67494 - RNA, 65 nt, Homo Sapiens
gugcgccaccacaucuggcuaauuuuauuuuuauuuuuguagagacaggagucuugccauguugc

SEQ ID NO: 67495 - RNA, 65 nt, Homo Sapiens
cacugucacguauauaaauugcuucuucauuuuaauuuguagaaguacuuuacaguaggaaacgc

SEQ ID NO: 67496 - RNA, 65 nt, Homo Sapiens
auuuuguuuuuuuuuaauugugucuuacagucaaguuuguagauuuucauaagccacaauuuuaa

SEQ ID NO: 67497 - RNA, 65 nt, Homo Sapiens
uuuucauggugcuauuaauuacaaguuuaguucuuuuuguagaucauauuaaaauugcaaacaaa

SEQ ID NO: 67498 - RNA, 65 nt, Homo Sapiens
gcaucacauuuaacauguuaucuacuuagaaagcauuuguagagcugcugaauuuguuuuguguu

SEQ ID NO: 67499 - RNA, 65 nt, Homo Sapiens
cugugcauuuuuaguauaacaaagaaaccagggaguuuguagagauauuugacuucacugacaga

SEQ ID NO: 67500 - RNA, 65 nt, Homo Sapiens
acaaugaauuguuacccaucgcucauuuuuggauguuuguagauauacuuaguuuuauaaacacu

SEQ ID NO: 67501 - RNA, 65 nt, Homo Sapiens
gucaucugcagugcugcaaacuguguaacuuguucuuuguagauuuuuuauggacugauauuuug

SEQ ID NO: 67502 - RNA, 65 nt, Homo Sapiens
cuuuucuauauauugcuuaguaacaccuaagccuuuuuguagacuagaggaagucaaaauuuauu

SEQ ID NO: 67503 - RNA, 65 nt, Homo Sapiens
ugggguuucgugacauugccugauuuuuguaauuuuuuguagagacaugcgccaccaugcccagc

SEQ ID NO: 67504 - RNA, 65 nt, Homo Sapiens
ccauuugucuuuguagugauauucuaauaaaauaauuuguagaaaguaguucuuuugagucugac

SEQ ID NO: 67505 - RNA, 65 nt, Homo Sapiens
auugcaaauuaaccacacaaauuauauuuuuggguuuuguagaaugcuaccuguaauaagugugg

SEQ ID NO: 67506 - RNA, 65 nt, Homo Sapiens
aaauguuucagugccuagucaaucucuggcaaguuuuuguagaaagaacuauacagcgaagagac

SEQ ID NO: 67507 - RNA, 65 nt, Homo Sapiens
cuauguuuaggauauuuugcacauguuuaucuuuguuuguagaggucucugagugccccucacuu

SEQ ID NO: 67508 - RNA, 65 nt, Homo Sapiens
cccaccaggacuuugcuaacacagcaaauaagaacuuuguagaauguaauguuacacuuuaaagg

SEQ ID NO: 67509 - RNA, 65 nt, Homo Sapiens
agcacuacaaagaucgcauaugcaaucuugcaagauuuguagaccaugguucuaaggaaagccuu

SEQ ID NO: 67510 - RNA, 65 nt, Homo Sapiens
uguaaugcgguucugaguggucccaacaaaucacauuuguagaaaagagacaucuuggcaccuca

SEQ ID NO: 67511 - RNA, 65 nt, Homo Sapiens
aacaacugauaauaagcuuuuaccugaccugucaguuuguagacagaaaacuugcuuuaaagcuu

SEQ ID NO: 67512 - RNA, 65 nt, Homo Sapiens
caguauaaguuauauuaaagauuucuuacaucuaauuuguagaaauacuaugacuaaaugaaauu

SEQ ID NO: 67513 - RNA, 65 nt, Homo Sapiens
cacaugcauacuguccaaaguccuugucccauguguuuguagacaauuauaaacagcucggcuug

SEQ ID NO: 67514 - RNA, 65 nt, Homo Sapiens
cucaguagagaaagucuagcuccaaugcuggucuuuuuguagaaagucgguguauuugguacccc

SEQ ID NO: 67515 - RNA, 65 nt, Homo Sapiens
ugccagcgcucucccagguuggcaggaggaagaauuuuguagagcgguggagggagggagcuacg

SEQ ID NO: 67516 - RNA, 65 nt, Homo Sapiens
uugggcccacguguuuuaugcauuccauucuucuuuuuguagacuacuggucacagccacgugcu

SEQ ID NO: 67517 - RNA, 65 nt, Homo Sapiens
ugguuagucaaauggccagagacggauaugugaaauuuguagaacugguauaugcucaucugagu

SEQ ID NO: 67518 - RNA, 65 nt, Homo Sapiens
caugcucugaaagauuuuuuuuaguuuuuaauuuuuuuguagagauggggucucgcuuuguuggc

SEQ ID NO: 67519 - RNA, 65 nt, Homo Sapiens
uuacuaaggaguuuuuauuguguaaucacuaagucuuuguagauaaagcagauggggaguuacgg

SEQ ID NO: 67520 - RNA, 65 nt, Homo Sapiens
acaugagccaccgagccuggccaauuuuuguguuuuuuguagagacgagguuuugccauguugcc

SEQ ID NO: 67521 - RNA, 65 nt, Homo Sapiens
uuuccaauuuuucauuuuuuguuuguuauuuguuuuuuguagacagcacucugucacccaggcug

SEQ ID NO: 67522 - RNA, 65 nt, Homo Sapiens
caugcaccaccacguccaucuaaauuucuuuauuauuuguagagaugaggucuugccauguuacc

SEQ ID NO: 67523 - RNA, 65 nt, Homo Sapiens
uuuccccauaaaugaaauggguaaauaaugccccauuuguagaagugggcccucaugacugaggu

SEQ ID NO: 67524 - RNA, 65 nt, Homo Sapiens
aagcuugacagauugaaagacaagugucauuuuuuuuuguagagggugauauauaccauguaaau

SEQ ID NO: 67525 - RNA, 65 nt, Homo Sapiens
uuuuuauugcaguaggaggaaauauauuuaaaauauuuguagauuuauagcaaauagagacucgu

SEQ ID NO: 67526 - RNA, 65 nt, Homo Sapiens
uuuaucugcaugacgauaacuaggcauucuauccauuuguagaucagagaaagugaagagauuau

SEQ ID NO: 67527 - RNA, 65 nt, Homo Sapiens
uagcuuuaguauacucaggaaaagaaugaccaucuuuuguagaauguuuauacauuuuugcauau

SEQ ID NO: 67528 - RNA, 65 nt, Homo Sapiens
acaguugagugcagaaaucucugcuucuaaaauuauuuguagagauuacaggaaacaaaugcuuu

SEQ ID NO: 67529 - RNA, 65 nt, Homo Sapiens
acugaaaauucauuuugagaccaagcaggaucaaguuuguagaauaaacacugguuuccuagcca

SEQ ID NO: 67530 - RNA, 65 nt, Homo Sapiens
uacuuuguguuuuuuuaauuucuaagaaguuacuuuuuguagagagagcuguauuaagugacuga

SEQ ID NO: 67531 - RNA, 65 nt, Homo Sapiens
uggucuagccauguugccuaaguuuuugaaguuuuuuuguagagggcacaccuccaaaccugggu

SEQ ID NO: 67532 - RNA, 65 nt, Homo Sapiens
cugcagcaucauguuguaauaguccucauuauuuauuuguagaucgaaaaugugaaacacaauuu

SEQ ID NO: 67533 - RNA, 65 nt, Homo Sapiens
acauuuaauagcuuguuaccuguuauucuuucacuuuuguagauuuaccuuucauuuucucuuua

SEQ ID NO: 67534 - RNA, 65 nt, Homo Sapiens
auuuuuucugaauccuuaugguugauuuugaugccuuuguagaauuacaaugccaguuugcaaua

SEQ ID NO: 67535 - RNA, 65 nt, Homo Sapiens
uuagacaaauauauuucgauaccaguuguucacacuuuguagauacuuuugucugcuuucuuaag

SEQ ID NO: 67536 - RNA, 65 nt, Homo Sapiens
uccaugcuuugcucucaaggaguggaaauccuauuuuuguagaucgucccagcgacauuucucca

SEQ ID NO: 67537 - RNA, 65 nt, Homo Sapiens
caaaacuuuuauuuuuuuuuaauuuuuuauauuuuuuuguagagaugugugccacccugccagcu

SEQ ID NO: 67538 - RNA, 65 nt, Homo Sapiens
caggguuucaccauguugccgcuaauuuuguauuuuuuguagagaggcacaaaccaccaugccca

SEQ ID NO: 67539 - RNA, 65 nt, Homo Sapiens
uacuauuuaauuuauucauaaauuacuugaauauguuuguagagacauaauaacccaaaacaaau

SEQ ID NO: 67540 - RNA, 65 nt, Homo Sapiens
cugcacaugagaguggcaucauuucaauaaaaugauuuguagaucacuguuguguuauuuguuca

SEQ ID NO: 67541 - RNA, 65 nt, Homo Sapiens
aucauaugacuguaauuccagaauuuguaaauauuuuuguagaauuuucaacuuuuucagcuuua

SEQ ID NO: 67542 - RNA, 65 nt, Homo Sapiens
ugaagguacagacuuauacaguaguaaacuuuugcuuuguagauuuggaauuuuaagugcucauu

SEQ ID NO: 67543 - RNA, 65 nt, Homo Sapiens
uacaaaaaguuugguuuagccuaugugcaucuauuuuuguagaaaaggaauacaaguuuguagcu

SEQ ID NO: 67544 - RNA, 65 nt, Homo Sapiens
uaauguugaacaguacuuuuuuccauaaaccuuuguuuguagauucauaaauuugacauucccuc

SEQ ID NO: 67545 - RNA, 65 nt, Homo Sapiens
auaaaacuuacaugaucuguguaauaugggaauguuuuguagauauggauuaugcaacagcauau

SEQ ID NO: 67546 - RNA, 65 nt, Homo Sapiens
aaggaacgaugacaggucgcauacuagggaaccauuuuguagaagcuuuuucugugguaucggcu

SEQ ID NO: 67547 - RNA, 65 nt, Homo Sapiens
auuuuuauuggguguuaacuaguguauuucuuugcuuuguagaguucagcacucaguuauuugca

SEQ ID NO: 67548 - RNA, 65 nt, Homo Sapiens
uguuuccuauaauauuccuguaauuuuuuuugaauuuuguagauauaaaaaauuaucaauaugua

SEQ ID NO: 67549 - RNA, 65 nt, Homo Sapiens
gugagcccuggugggcagggcuaggcccucaggguuuuguagaguggcgaugcauuuacagauuu

SEQ ID NO: 67550 - RNA, 65 nt, Homo Sapiens
guauguccagaaugacuuuagaaaaaugauguauuuuuguagauuuggaucauggacaugagcug

SEQ ID NO: 67551 - RNA, 65 nt, Homo Sapiens
uagcugucauagagugaagaacucuuuuuuuuuuuuuuguagaaguucuuagaaaguacccacau

SEQ ID NO: 67552 - RNA, 65 nt, Homo Sapiens
uuuuuuaauuuacagaucauauuuauuuuacuauuuuuguagaaaauuauuaauuuugauuguau

SEQ ID NO: 67553 - RNA, 65 nt, Homo Sapiens
ucagggaagaagugcuauaucuccuauauuguauuuuuguagaaaauuuguauuuuauguuguug

SEQ ID NO: 67554 - RNA, 65 nt, Homo Sapiens
cauucccagagcuucagucucugugcauacucagcuuuguagaaccaugcugcaaagccauauac

SEQ ID NO: 67555 - RNA, 65 nt, Homo Sapiens
uacuaauguggacauauagauuauucguauuauaguuuguagaacuaccuaguucagaaucuuga

SEQ ID NO: 67556 - RNA, 65 nt, Homo Sapiens
uaaucuugcagcaccaugccgagcuaauuuuauuuuuuguagagaugagcucucacuaugucacc

SEQ ID NO: 67557 - RNA, 65 nt, Homo Sapiens
augcaugcuuuucuucuguaaauauauaauaaauuuuuguagauagucuugaugugugaucuuua

SEQ ID NO: 67558 - RNA, 65 nt, Homo Sapiens
uaguaaccuuuaaaaauguauaaugacuuuuaaaauuuguagaauugaaaagacgcuaauaaaaa

SEQ ID NO: 67559 - RNA, 65 nt, Homo Sapiens
agaaucuccagaacaaccuagagagugaaugcuaauuuguagagcgaacuuccauuuggcccauu

SEQ ID NO: 67560 - RNA, 65 nt, Homo Sapiens
gcaaauauaaguaugccugguuaagauaucuucccuuuguagaaauguuacauugggauggauag

SEQ ID NO: 67561 - RNA, 65 nt, Homo Sapiens
ucccaauuaauuuaccaauucaucauuuuuuuuuuuuuguagaacucccauaaacaucaccuuac

SEQ ID NO: 67562 - RNA, 65 nt, Homo Sapiens
gcgcucacugcaaaaauacaauggccuacauuggauuuguagaggagaaaggagcccuguauugu

SEQ ID NO: 67563 - RNA, 65 nt, Homo Sapiens
cacuaucuuuuuguuuaugauuuuaguuuuuacuuuuuguagaugugggaugaaguggacucugu

SEQ ID NO: 67564 - RNA, 65 nt, Homo Sapiens
auccuuaacaacucugauauucugagauucucucauuuguagaaugcccgcugaugcauuguuua

SEQ ID NO: 67565 - RNA, 65 nt, Homo Sapiens
auaggaauacuucaguuuuuccuuuuggagguuuguuuguagaaaaacuaauuugaacuauaaga

SEQ ID NO: 67566 - RNA, 65 nt, Homo Sapiens
auuucuaccuuuacuacaucuuuucaacaaguaacuuuguagaaaugagccagaagccaaggccc

SEQ ID NO: 67567 - RNA, 65 nt, Homo Sapiens
ccacgccugguuaauuguuuuuuuuuaauuuaucuuuuguagagaugggaucucacuauguugcu

SEQ ID NO: 67568 - RNA, 65 nt, Homo Sapiens
guaaucugcagauuacuucaaaugggaaaaaucuuuuuguagacucuauaguacccucucuauuc

SEQ ID NO: 67569 - RNA, 65 nt, Homo Sapiens
ggcacccgccaccacgcccagcuaauuuuuguauuuuuguagagaugggguuucacgauguuggc

SEQ ID NO: 67570 - RNA, 65 nt, Homo Sapiens
ugaagcauuggauauaaauaugguguccugcuuuuuuuguagaaaauguaauuugaggaugaauu

SEQ ID NO: 67571 - RNA, 65 nt, Homo Sapiens
caguuacuguuuacaagacugcuuuuaccuuaaacuuuguagauguuuacaucuuuuuguugugu

SEQ ID NO: 67572 - RNA, 65 nt, Homo Sapiens
ggccuguaccgucaugccuggcuaauuuuuguauuuuuguagagacaggguuucaccauguugcc

SEQ ID NO: 67573 - RNA, 65 nt, Homo Sapiens
ugaggucuuauuauauugucuuuuuuuaauguuuuuuuguagagagugcaaccauguuuggcuaa

SEQ ID NO: 67574 - RNA, 65 nt, Homo Sapiens
caaaguccaggcuggucuugcuaauuuuuaauuguuuuguagaaagugugugccaccaugcccag

SEQ ID NO: 67575 - RNA, 65 nt, Homo Sapiens
auugguccauacagagaaacuaaggcacaguugauuuuguagaguaauuuaaaauaagcaauaau

SEQ ID NO: 67576 - RNA, 65 nt, Homo Sapiens
guaguuuauugauuaguucauuuuacaaaaaccuuuuuguagacuauuaucagaaaugaaugcau

SEQ ID NO: 67577 - RNA, 65 nt, Homo Sapiens
cgggguuucaccauguuagcuaauuuuuuguauuuuuuguagagacgcccgccaccacacccggc

SEQ ID NO: 67578 - RNA, 65 nt, Homo Sapiens
acaauucacuuuuuaguuuuucgugacuuuaaacuuuuguagaccaauaaaagguuaucuuauag

SEQ ID NO: 67579 - RNA, 65 nt, Homo Sapiens
cacaaaaugcguuuuccauacauuuccgcuuacaauuuguagaaaauaaauauguacucaaaagg

SEQ ID NO: 67580 - RNA, 65 nt, Homo Sapiens
gauauaguagagauuguugucugugaaauuucucuuuuguagauuuugaguuuucccuuguagug

SEQ ID NO: 67581 - RNA, 65 nt, Homo Sapiens
ccaaaagaaaugccucauaguucuuaaccucaacuuuuguagaaguauuuuuuucucuguaauau

SEQ ID NO: 67582 - RNA, 65 nt, Homo Sapiens
ccuacaaaauuuucagauuggaaauuacucuuguauuuguagaagauugucucuaaaauuguggu

SEQ ID NO: 67583 - RNA, 65 nt, Homo Sapiens
uacacaugcacucaguguggacugggaagcauuacuuuguagauguauuuucaauaaagaaaaaa

SEQ ID NO: 67584 - RNA, 65 nt, Homo Sapiens
uacaacuuuccaucccccacacaguuggagaauaauuuguagaccauggcaguuaaaaugcuuuu

SEQ ID NO: 67585 - RNA, 65 nt, Homo Sapiens
auucucguaggucaaaagggucuagugauggaaguuuuguagauaaguaccaggcaucucaguaa

SEQ ID NO: 67586 - RNA, 65 nt, Homo Sapiens
acuuuguguauaugauuuaaucuuuuauuuuuauuuuuguagaauggggguaaaacuacaaaucu

SEQ ID NO: 67587 - RNA, 65 nt, Homo Sapiens
agaaugcaaccaagucacacgcuuuugaauuaugcuuuguagaguuuugucauucagagucagcc

SEQ ID NO: 67588 - RNA, 65 nt, Homo Sapiens
cucugggccuuuguuccuaucuguaaaugagaaaguuuguagauauugccaagauuucccaggcu

SEQ ID NO: 67589 - RNA, 65 nt, Homo Sapiens
ugcaauauuuauuuucuuguauuagaaaagauuccuuuguagagaaaaaauguauuuuucauuaa

SEQ ID NO: 67590 - RNA, 65 nt, Homo Sapiens
uuuuguuuuaucagaauggcaacagacagaaguacuuuguagagauugacuuccuaagcuacuua

SEQ ID NO: 67591 - RNA, 65 nt, Homo Sapiens
agucuugauccuugccugauucccaucugcugcucuuuguagaaaagguuuccucuagaacugaa

SEQ ID NO: 67592 - RNA, 65 nt, Homo Sapiens
uuguaagacauucaguauguguaaauguguuuguguuuguagacaaaaggcaaagguauuaugua

SEQ ID NO: 67593 - RNA, 65 nt, Homo Sapiens
gcgugcgccaccaugcccggcuacuucuuguauuuuuuguagagacggaucgucaccauauuucu

SEQ ID NO: 67594 - RNA, 65 nt, Homo Sapiens
uuucucuucucacauuuuuuaaaugguccccuguguuuguagagaacucccuuauacagaguuuu

SEQ ID NO: 67595 - RNA, 65 nt, Homo Sapiens
aaaaaaaauaacacuuaacuaaaaccccuaggucauuuguagauauauauuuccaaauauucuaa

SEQ ID NO: 67596 - RNA, 65 nt, Homo Sapiens
aguauaaugaaaagaaugaccuauaauauagguguuuuguagauucuugugucacugcaaacaau

SEQ ID NO: 67597 - RNA, 65 nt, Homo Sapiens
gaacccccagaugagaaaauaggaaggagcaaucauuuguagaugggugaaaaaagaaugagguu

SEQ ID NO: 67598 - RNA, 65 nt, Homo Sapiens
gcauguaaauaaauguuuucguuuuguaaauccauuuuguagagguguacccuaauaguuacuau

SEQ ID NO: 67599 - RNA, 65 nt, Homo Sapiens
uacuuuuugcuguuaguuauguuuccuaacugugauuuguagauuauuccagaacaaaucauuau

SEQ ID NO: 67600 - RNA, 65 nt, Homo Sapiens
uggagauucacucgacuaaucuaauuuuuguguuuuuuguagagaaugcacaccaccacaccugg

SEQ ID NO: 67601 - RNA, 65 nt, Homo Sapiens
aaaggcaaugaugugggacuguauaaucccugagauuuguagacuaggaaauaaaggaaaaucaa

SEQ ID NO: 67602 - RNA, 65 nt, Homo Sapiens
uugaccacuuaaaauacuaauauucuuuggcauacuuuguagacuauugagguucacagaugaaa

SEQ ID NO: 67603 - RNA, 65 nt, Homo Sapiens
uuacuuuuauuauuaaauguauguaaaacagauuuuuuguagagcaccucuacauuuuguaugau

SEQ ID NO: 67604 - RNA, 65 nt, Homo Sapiens
aauguugccaccuuguuuguguguauauccagagguuuguagauaaaauaccaaaagcuuccuac

SEQ ID NO: 67605 - RNA, 65 nt, Homo Sapiens
uuuuguuuuugaaauguguagauaacuguuuucucuuuguagaagcuccaugcuuugcuaaccaa

SEQ ID NO: 67606 - RNA, 65 nt, Homo Sapiens
uguggucacacuguguugccauuuuuguuuaauuuuuuguagagacacgccacuaugcauggcua

SEQ ID NO: 67607 - RNA, 65 nt, Homo Sapiens
gcaaacaaaauuguucuugguauuaaacuuaaaacuuuguagaaaaguggugauuaccggcauuu

SEQ ID NO: 67608 - RNA, 65 nt, Homo Sapiens
auguuauaauuuaacagucuugaucuuaugaauguuuuguagaaacauuuuaaguaugagaugac

SEQ ID NO: 67609 - RNA, 65 nt, Homo Sapiens
aaauuugauuuggguuaaauuggaaagagguaucauuuguagaaagugaugucuuuuuaacuuuu

SEQ ID NO: 67610 - RNA, 65 nt, Homo Sapiens
uguagguaaaauaaaaaucagaguaaauuuuagaauuuguagacuuuaaaaaaguuaaaucaauu

SEQ ID NO: 67611 - RNA, 65 nt, Homo Sapiens
ucuaaugaagaaaaacgagcaagucaauuuuacaauuuguagaacgccccugaagacgaggugaa

SEQ ID NO: 67612 - RNA, 54 nt, Homo Sapiens
cuguuacuuucccccuccccgcccuuuguagacaguuucauuccuuaccacuag

SEQ ID NO: 67613 - RNA, 65 nt, Homo Sapiens
gggcagaggaaucuagaacagcuggcugugccauguuuguagaugacugaggccuugcaagucaa

SEQ ID NO: 67614 - RNA, 65 nt, Homo Sapiens
auugcaaaaaugaccauaaaugugccaaacaagauuuuguagaaugcauucuugauuaccuacug

SEQ ID NO: 67615 - RNA, 65 nt, Homo Sapiens
cucuucaugcuugacauaccugcucgccccuguuuuuuguagaauugugugauccgguuucuuuu

SEQ ID NO: 67616 - RNA, 65 nt, Homo Sapiens
cgaggucucacuauguugccgcuaauguuuuauuuuuuguagagaggugcgcacgaccauaccca

SEQ ID NO: 67617 - RNA, 65 nt, Homo Sapiens
gaaggaagaagaguaaaauuggcauauuuagguuuuuuguagaagaaagauacaagugaaaauua

SEQ ID NO: 67618 - RNA, 65 nt, Homo Sapiens
cacaccugucuaaaaaguauguauuuuuaaauuuuuuuguagagacaggaucucacuauguucuc

SEQ ID NO: 67619 - RNA, 65 nt, Homo Sapiens
gcacacaccaccacaccuggcuaaguuuuguauuuuuuguagagaugggguuucucuguguugcc

SEQ ID NO: 67620 - RNA, 65 nt, Homo Sapiens
gcauauaccaccaugcccaacuaauuuuuuaauuuuuuguagagaugagugucacuauguugccc

SEQ ID NO: 67621 - RNA, 65 nt, Homo Sapiens
caaaagggaaagaauuucuguaauugccaacccacuuuguagaagaggcaugagcccuugaauuu

SEQ ID NO: 67622 - RNA, 65 nt, Homo Sapiens
acaggcaccaccacacccagcuaauuuuuguauuuuuuguagagacgggguuucgccaaguugac

SEQ ID NO: 67623 - RNA, 65 nt, Homo Sapiens
caugcacaugacacuaugcccagcuaauuuuuuauuuuguagauaauaugcuggucagggcuggu

SEQ ID NO: 67624 - RNA, 65 nt, Homo Sapiens
gugugugccacugugccaagcuaauuuuuuuauuuuuuguagagaugggauuucaccauguuacu

SEQ ID NO: 67625 - RNA, 65 nt, Homo Sapiens
gcgcgugccaccacaccuggcuaauuuuugcauuuuuuguagagacaggguuuugccacguugcu

SEQ ID NO: 67626 - RNA, 65 nt, Homo Sapiens
ugcaccccauauccagcuauuuuuuuucaauuuuuuuuguagagggggggucucccuauguugcc

SEQ ID NO: 67627 - RNA, 65 nt, Homo Sapiens
agaacuuuaauugacaguuucaauugaaggugcuguuuguagacuuaacacccagugaaagccca

SEQ ID NO: 67628 - RNA, 65 nt, Homo Sapiens
caucauugagauugguuugcuuaaaauuaacuuauuuuguagaagacaaaaugaauugcacuuca

SEQ ID NO: 67629 - RNA, 65 nt, Homo Sapiens
aucuugugacuuaguagacugaugaugauauccauuuuguagacucaucaacaugugguuggccu

SEQ ID NO: 67630 - RNA, 65 nt, Homo Sapiens
aaaucagacucuugccuuugcacuuuuuuuuaacuuuuguagauaauuuuuguuaauuuguuuug

SEQ ID NO: 67631 - RNA, 65 nt, Homo Sapiens
aguauauacucuucuuuacauggugaugaguuucauuuguagaaaaauuuuguugccuucuuaaa

SEQ ID NO: 67632 - RNA, 65 nt, Homo Sapiens
uugaguauaaauguauuuuugucuuguggccauucuuuguagauaauuucugcacaucuguauaa

SEQ ID NO: 67633 - RNA, 65 nt, Homo Sapiens
uaaaucaaacaugauugauuuaaaacuucauggaauuuguagaaaauuauggacauuuuugguga

SEQ ID NO: 67634 - RNA, 65 nt, Homo Sapiens
gaacaagagauuguuacgagaguggcagaaacccuuuuguagauugacuuguguuugugccaagc

SEQ ID NO: 67635 - RNA, 65 nt, Homo Sapiens
uaaagguggauuugaccaaaauaaugcugguuaaauuuguagaaauguugaaauuggcuguguuu

SEQ ID NO: 67636 - RNA, 65 nt, Homo Sapiens
agcuuuucuaaucgucucauuguaacauggcuuauuuuguagagguauucaucagccacacacuu

SEQ ID NO: 67637 - RNA, 65 nt, Homo Sapiens
augccaugaagaauacauuagaagaauugagggacuuuguagagaauuuuguggcuuugguccaa

SEQ ID NO: 67638 - RNA, 65 nt, Homo Sapiens
aguauuugcacuuuguacuuuaaauguaaauucacuuuguagaaaugagcuauuuaaacagacug

SEQ ID NO: 67639 - RNA, 65 nt, Homo Sapiens
aaaagcauuaucuaugauugcagaagccauuucucuuuguagauauggaguagacagggaggcug

SEQ ID NO: 67640 - RNA, 65 nt, Homo Sapiens
ucauuguauaauguguauuuguuaaaaagugugucuuuguagauugaaaaucaacaacgcuugaa

SEQ ID NO: 67641 - RNA, 65 nt, Homo Sapiens
uuugucugaugcauuucauuauguauucauguuuguuuguagaugccacgugcuuuuguaugccc

SEQ ID NO: 67642 - RNA, 65 nt, Homo Sapiens
uuuuauauaaaaaugaaauauaaauguuaucuauuuuuguagauagaaauacugucugguuuuug

SEQ ID NO: 67643 - RNA, 65 nt, Homo Sapiens
cucuaugguucugucaaugcgaaggauaaugaauauuuguagaguuguaacuuaaaauuuuuaau

SEQ ID NO: 67644 - RNA, 65 nt, Homo Sapiens
cauuaacucuaaagcacaucuguuuauagaaacuuuuuguagaaaucaugcuagaaauuuucuau

SEQ ID NO: 67645 - RNA, 65 nt, Homo Sapiens
cucggucuugaagucauuugaguuauuuaucuuuuuuuguagauuaauuagucccuguuauaacc

SEQ ID NO: 67646 - RNA, 65 nt, Homo Sapiens
auguauuuugcuugggcaccgcugaguaaguccucuuuguagaugaggcacaagcuggcugccau

SEQ ID NO: 67647 - RNA, 65 nt, Homo Sapiens
uauuuuuacgauuuccaaacaauauauggagcuaauuuguagaauaaaccauacuguagcaacau

SEQ ID NO: 67648 - RNA, 65 nt, Homo Sapiens
uggggucucguuuugucgccuuuguucguuuguauuuuguagagauaaauuucuaugugcugugu

SEQ ID NO: 67649 - RNA, 65 nt, Homo Sapiens
aguguucuuccauccuucaauguuucuuuguguguuuuguagacuuaguacaucuguuaauuuag

SEQ ID NO: 67650 - RNA, 65 nt, Homo Sapiens
uuaaagaaaaauaugaaauuguaagaauuaagacauuuguagauuuguuuuuaguuguuuuaaug

SEQ ID NO: 67651 - RNA, 65 nt, Homo Sapiens
gacauaugcagauuuucucauuaaugacauuacuguuuguagaauuggaaacuaaaaauagaaua

SEQ ID NO: 67652 - RNA, 65 nt, Homo Sapiens
cagugucucacuauguugccuuuuuuuuuuuuuuuuuuguagagauuuuuuuuuuauaauuaauu

SEQ ID NO: 67653 - RNA, 65 nt, Homo Sapiens
uuaaauacuugaauauucaagagguaucauauaacuuuguagaacaacuucuaggaaacauccag

SEQ ID NO: 67654 - RNA, 65 nt, Homo Sapiens
auuuuuuguauguuuuagugcaauuguaaacgauuuuuguagauugcuuuuucuuuagcuaaaau

SEQ ID NO: 67655 - RNA, 65 nt, Homo Sapiens
uacauuguuuaauauuuauuuaagcacauaccuauuuuguagacuuaaaaaaggcuuuucauauu

SEQ ID NO: 67656 - RNA, 65 nt, Homo Sapiens
ggcuuuuucuuuuuccucuuauuucaguugcaguuuuuguagaauaucuaaccuuuuuccccccc

SEQ ID NO: 67657 - RNA, 65 nt, Homo Sapiens
caaauuauaggcagauuaccuugcaaagagcucuauuuguagaagccuguuuuuuuaaaauauua

SEQ ID NO: 67658 - RNA, 65 nt, Homo Sapiens
guuucaaaugacugaacugccuuaaucuuguggauuuuguagaugauauuaaucuuggcaaacug

SEQ ID NO: 67659 - RNA, 65 nt, Homo Sapiens
gagauagucgaagcuaaaacugaagauggugaacuuuuguagaauguaagucuauguuuaaauuu

SEQ ID NO: 67660 - RNA, 65 nt, Homo Sapiens
cagggucucacuguguugccauaaauaaauacuuuuuuguagagacacacuuggguaauuaaaaa

SEQ ID NO: 67661 - RNA, 65 nt, Homo Sapiens
cuguggcuuuguguugcguuacaggagcgaugcacuuuguagaugggcagcggagaucagcgugg

SEQ ID NO: 67662 - RNA, 65 nt, Homo Sapiens
uaauguguauauaacuuuaaaagaaguagaauuuuuuuguagauguauaauuacauucaaauuau

SEQ ID NO: 67663 - RNA, 65 nt, Homo Sapiens
cuuuugaaauagguugucuguacauguucuaauguuuuguagaacacgugugccuguuuaagugu

SEQ ID NO: 67664 - RNA, 65 nt, Homo Sapiens
aggauuuucuucaaagaauaagccacagcaaugguuuuguagaaaacuccugugcuuuugagcaa

SEQ ID NO: 67665 - RNA, 65 nt, Homo Sapiens
uuauauauauuuuuuucugaaauuuccugggagcuuuuguagaagucacauuccugaacaggaua

SEQ ID NO: 67666 - RNA, 65 nt, Homo Sapiens
gcgcacaccaccauccccggcuaauuuuuguauuuuuuguagagacgggguuuugccauguugcc

SEQ ID NO: 67667 - RNA, 65 nt, Homo Sapiens
gcuucugaggaacaacucuaauuaguacacuuguguuuguagauuuacacuuuguauuauguauu

SEQ ID NO: 67668 - RNA, 65 nt, Homo Sapiens
ucuuaaaauuccacauucauccacaaucucaucccuuuguagaaauucuugccugaauucucacc

SEQ ID NO: 67669 - RNA, 65 nt, Homo Sapiens
auauaaauuccccauauuuguguucaguuccagcuuuuguagauggcacuuuagugauugcuuuu

SEQ ID NO: 67670 - RNA, 65 nt, Homo Sapiens
aggcaaaugcaucccgccuugugauguaucagcuauuuguagauaaauaaauugcaggugggggc

SEQ ID NO: 67671 - RNA, 65 nt, Homo Sapiens
uuagaucucccaaugucagugcccgagacccagaguuuguagaguggugggggugacuuuuggca

SEQ ID NO: 67672 - RNA, 65 nt, Homo Sapiens
uuacuauuuuuuguuaaagauuuauacagaaauucuuuguagaaagauuuuuuuacaguuguguu

SEQ ID NO: 67673 - RNA, 65 nt, Homo Sapiens
uuugcuguccagugugguagugugacgauggauauuuuguagacuugcugucuaauagaacuuuc

SEQ ID NO: 67674 - RNA, 65 nt, Homo Sapiens
uggaguuuugccauguggucugcccagcuaauuuuuuuguagagaacuacagguguucgccacca

SEQ ID NO: 67675 - RNA, 65 nt, Homo Sapiens
cauauaauuaccuuuucauggcugccugagcaagauuuguagaauacauuugaguuauacucugu

SEQ ID NO: 67676 - RNA, 65 nt, Homo Sapiens
aaauucuccuuugcuauaaguugucaugcauauuuuuuguagaauuuguauuacauugggaugca

SEQ ID NO: 67677 - RNA, 65 nt, Homo Sapiens
uaaugauuuuguacauuugcuuggaaugauguaucuuuguagaguuuuaaauuuuuucuguaauu

SEQ ID NO: 67678 - RNA, 65 nt, Homo Sapiens
uuuuaaaauaaguuuuaugauuuacacugggaaaguuuguagaaaaugcagcuuuugaggagucu

SEQ ID NO: 67679 - RNA, 65 nt, Homo Sapiens
gucaucuucuagccugggccuugcuaauaaaaguguuuguagauuccaugcugcacuuacuccuu

SEQ ID NO: 67680 - RNA, 65 nt, Homo Sapiens
ggaucuauauuuguaggggucuaaauuaucucuauuuuguagagacaacagcugcuauggggggg

SEQ ID NO: 67681 - RNA, 65 nt, Homo Sapiens
cggggguuuggccauguugcugauuuuuguauuuuuuuguagagacgcgcaccaccacgccuagc

SEQ ID NO: 67682 - RNA, 65 nt, Homo Sapiens
ggauaaucuauugacugaauuagaugaaaaaauuauuuguagauaacaaaauugaccacagugau

SEQ ID NO: 67683 - RNA, 65 nt, Homo Sapiens
uauggauaaggcuugcuaugcacugagaaauucauuuuguagagcauauuuuuaugauauuggca

SEQ ID NO: 67684 - RNA, 65 nt, Homo Sapiens
aucagacuccuacuuaacugagacaaauaaacuauuuuguagaaguuuuucaaccuuuauuaaaa

SEQ ID NO: 67685 - RNA, 65 nt, Homo Sapiens
gugaaagcagcuuuuaguuugauuuggaggccuaauuuguagauuugguuaauauaaaugauuuu

SEQ ID NO: 67686 - RNA, 65 nt, Homo Sapiens
aaaauguucacugcauguagguugauuucuuauguuuuguagacucauuguuauuuuucaauccc

SEQ ID NO: 67687 - RNA, 65 nt, Homo Sapiens
ccgggcgaguuacgcggccucucugugccgcuucauuuguagagggcuguaacagugaccucgca

SEQ ID NO: 67688 - RNA, 65 nt, Homo Sapiens
auuuuuuuuuuacuuucucagaauuaccuaaauguuuuguagaguuuugacuaguaaucaaucaa

SEQ ID NO: 67689 - RNA, 65 nt, Homo Sapiens
caguugggauaugauccauuuuuuuaaacaaguuuuuuguagaucccuuguaaaauaauaauaau

SEQ ID NO: 67690 - RNA, 65 nt, Homo Sapiens
gaauucuaaacauguaaaaugugacagccugcaauuuuguagacagugaaguaauggcugcuauu

SEQ ID NO: 67691 - RNA, 65 nt, Homo Sapiens
gugggcacugccacaccguacuaauuuuuguauuuuuuguagagacgaggucccaccauguugcc

SEQ ID NO: 67692 - RNA, 65 nt, Homo Sapiens
ugcaaauacuguauucaagugaaaaaaauacaguauuuguagauaaccauagcuacuacacaguu

SEQ ID NO: 67693 - RNA, 65 nt, Homo Sapiens
auaagaauguuuugauuuugaucauacaaauaacuuuuguagauuuuuguuuacuuuuggggggg

SEQ ID NO: 67694 - RNA, 65 nt, Homo Sapiens
acuugcuugugucugaacucuagugcacuuaugauuuuguagaccaugugaaauuuaauaagaua

SEQ ID NO: 67695 - RNA, 65 nt, Homo Sapiens
guguacacccccacacaaggcuaaguuuuguauuuuuuguagagacaggguuucaacauauuauc

SEQ ID NO: 67696 - RNA, 65 nt, Homo Sapiens
uacauuuuguauuauacaguaccuuucucagacauuuuguagaauucauuucggcagcucacuag

SEQ ID NO: 67697 - RNA, 65 nt, Homo Sapiens
uucuauaaauuuaagaaaacaaguauauaauuuacuuuguagacuguuucacauugcacucauca

SEQ ID NO: 67698 - RNA, 65 nt, Homo Sapiens
cagguucuugccagguggcuuacuuuuuuguauuuuuuguagagaaggugggcaccaugccuggc

SEQ ID NO: 67699 - RNA, 65 nt, Homo Sapiens
gagagagaagaagaugaagucagguacuuggacuuuuuguagaagagcaggggguugugaauuuc

SEQ ID NO: 67700 - RNA, 65 nt, Homo Sapiens
uuuuuacuaaagaggguaacuuuaagaaauuuaauuuuguagauguucuucauuguucaucaaca

SEQ ID NO: 67701 - RNA, 65 nt, Homo Sapiens
ccauauccccugaaauagcaauccaaaugaaaaauuuuguagauauacuuagcaaauacaaacac

SEQ ID NO: 67702 - RNA, 65 nt, Homo Sapiens
guaacaaaguaaaguaaaacugcaaauaaguugaguuuguagaggcugggaaaugauaggaguau

SEQ ID NO: 67703 - RNA, 65 nt, Homo Sapiens
ucuggacguugaggauucauaaguuuugcuggauuuuuguagaacacugaugaaugaguaaaagu

SEQ ID NO: 67704 - RNA, 65 nt, Homo Sapiens
uaagacuuuuuauuuucuaacuugauuagaccuaauuuguagacuuuuguaaaggauaucaaugc

SEQ ID NO: 67705 - RNA, 65 nt, Homo Sapiens
uuacaccuggaaaaaaagauuaauuuuuuggaauuuuuguagacuaauauguuuucaguguucuc

SEQ ID NO: 67706 - RNA, 65 nt, Homo Sapiens
ccauccauccggcugcuaggaagagauguucgguguuuguagauccguuucuaugagcgcauuuu

SEQ ID NO: 67707 - RNA, 65 nt, Homo Sapiens
cugaacuaagggcuaaugucaauucccaaauuucauuuguagauaugcuaacaucacugucauag

SEQ ID NO: 67708 - RNA, 65 nt, Homo Sapiens
uuuuuccauuugucuauaaaauauuacuagcaaauuuuguagauuaaaguguguauugcugugua

SEQ ID NO: 67709 - RNA, 65 nt, Homo Sapiens
uaaagggaucacauuugaaguaaagccaacagagauuuguagauuuuguuauacugcccaucccc

SEQ ID NO: 67710 - RNA, 65 nt, Homo Sapiens
cauuguaguagucuagcuuauuuuccccacaagcuuuuguagauguauacuucacucuucuuuuu

SEQ ID NO: 67711 - RNA, 65 nt, Homo Sapiens
cagggucucacuguguugccuaccuuuuuauuuuuuuuguagagagaggcacgcaccaccgcgcc

SEQ ID NO: 67712 - RNA, 65 nt, Homo Sapiens
aagugaccuuagugaugcagaguuccugagugguguuuguagaaugaguuuaucauacauucuuu

SEQ ID NO: 67713 - RNA, 65 nt, Homo Sapiens
aucauuuuuucaacuggaauaaaacaccagguuuguuuguagaugucuuaggcaacacucagagc

SEQ ID NO: 67714 - RNA, 65 nt, Homo Sapiens
cccaaaguuuuguaccugguuauuuuucacuuaaguuuguagacgaaaugugccauuauauuagc

SEQ ID NO: 67715 - RNA, 65 nt, Homo Sapiens
aucauuccagaguuauuuucuauuagucaaacuuuuuuguagaaccuucuuucccuuacccuggc

SEQ ID NO: 67716 - RNA, 65 nt, Homo Sapiens
acucugccaaauuuguggaacuaugaaauguauuauuuguagacauaaagacuugauugcuuucc

SEQ ID NO: 67717 - RNA, 65 nt, Homo Sapiens
uauuauacaaauagauggaaagaaaagugaacacguuuguagaacuuucauaagcacacaguugc

SEQ ID NO: 67718 - RNA, 65 nt, Homo Sapiens
uuuguuugagggagacuuccccuuucuggauuguauuuguagaguguuacgaguguaucauguga

SEQ ID NO: 67719 - RNA, 65 nt, Homo Sapiens
aucaaacaguaaucuagguguggcugugaagguauuuuguagaugugauuaacaucuacaaucag

SEQ ID NO: 67720 - RNA, 65 nt, Homo Sapiens
uaagacuuuauacuugggucaaucucucacuuuauuuuguagaaccauuugaaauccuaggaugu

SEQ ID NO: 67721 - RNA, 65 nt, Homo Sapiens
ccccccacacuacugcgucuuuguuucuaucagucuuuguagaagcagguggugguggaaauucc

SEQ ID NO: 67722 - RNA, 65 nt, Homo Sapiens
cuuucccggucuccaagaacggauuaaauauguauuuuguagacuggcugggaauacaauggaaa

SEQ ID NO: 67723 - RNA, 65 nt, Homo Sapiens
ucagucucaagugcuucaaguugcucuuccuggacuuuguagaaaagcacugcacacuggaauca

SEQ ID NO: 67724 - RNA, 65 nt, Homo Sapiens
uuacacauuuuuaugguagaucacuguuuguggguuuuguagaagggauuuaccagacugucuuu

SEQ ID NO: 67725 - RNA, 65 nt, Homo Sapiens
cuauucuuucugaugucuucuuccccacuccuauuuuuguagaugcuccucuuccagagucaccu

SEQ ID NO: 67726 - RNA, 65 nt, Homo Sapiens
aguggugucuccaaugaacuccucacuuuccguccuuuguagagcuuucuguuccuugcaguuca

SEQ ID NO: 67727 - RNA, 65 nt, Homo Sapiens
ugauaacaugaacaugaguaaucauuuuauugcuauuuguagacguguacuuccgauuuacggac

SEQ ID NO: 67728 - RNA, 65 nt, Homo Sapiens
aaaaauguauuaaauauuuuaagaaaugcucauucuuuguagaacuuucacuguuuguaauauuu

SEQ ID NO: 67729 - RNA, 65 nt, Homo Sapiens
cucccugauaguuuaguuuuacucuagcaggaguuuuuguagacuagggucuggaaucugaccuu

SEQ ID NO: 67730 - RNA, 65 nt, Homo Sapiens
auaucugaaagaaauaacauauauuauuuuuucuauuuguagaccacuuuugacaaugcucauua

SEQ ID NO: 67731 - RNA, 65 nt, Homo Sapiens
ccugugguauagaggaguauccuuagaauggccucuuuguagaacucuaucagugacuucugaau

SEQ ID NO: 67732 - RNA, 65 nt, Homo Sapiens
aagcccccaugagaaacagcgagcccaaggggggauuuguagaacaucccuacucaccgaguguu

SEQ ID NO: 67733 - RNA, 65 nt, Homo Sapiens
ugaaugguacuauucaacggcgucugccuguguacuuuguagauguuggucuccacaccuaaaau

SEQ ID NO: 67734 - RNA, 65 nt, Homo Sapiens
cacuuucucauuaagauauauauauagaaccacuuuuuguagauuaguauaagaaaaauauuuac

SEQ ID NO: 67735 - RNA, 65 nt, Homo Sapiens
aauguauuuguuuuuuugugcugugagaauugauguuuguagauuaauaaucauuuuguuuagaa

SEQ ID NO: 67736 - RNA, 65 nt, Homo Sapiens
gcgugcgugaccaagcccagcuaauuuuugcauuuuuuguagagaugggguuuugccauguugcu

SEQ ID NO: 67737 - RNA, 65 nt, Homo Sapiens
cuuuaaaaaauagauuuuuucccuaagaaagaauguuuguagaauuuaaaguggacagaugccug

SEQ ID NO: 67738 - RNA, 65 nt, Homo Sapiens
uuuuauauguucaggggaauuuuaaagucaaaucuuuuguagauaauuuaaaaaaucaguguggu

SEQ ID NO: 67739 - RNA, 65 nt, Homo Sapiens
uucuuguagauguauccuucacguuguaaauauguuuuguagagugaagccaugggaagccaugu

SEQ ID NO: 67740 - RNA, 59 nt, Homo Sapiens
agggaaauuacucugggugaagucagaacuuuguagaacacagaacauaaagggugaga

SEQ ID NO: 67741 - RNA, 65 nt, Homo Sapiens
uuugaaauuacuuccauuuucaaaaaccaucauguuuuguagauacauuuugagaaaaaccauca

SEQ ID NO: 67742 - RNA, 65 nt, Homo Sapiens
guacauagucuuuuauguaauuuacuggcauauguuuuguagacuguuuaaugacuggauaucuu

SEQ ID NO: 67743 - RNA, 65 nt, Homo Sapiens
uaaaaacaaaaaaaaaaauaaugaaacacagugaauuuguagaguggggguauuugacauauuuu

SEQ ID NO: 67744 - RNA, 65 nt, Homo Sapiens
auuuuaucauuuauuagcgcugaagagccaacauauuuguagauuuuuaauaucucaugauucug

SEQ ID NO: 67745 - RNA, 65 nt, Homo Sapiens
caaaagagagaaagagaaaggaaugcugguuuaucuuuguagauuguaaucgaauggagaaauuu

SEQ ID NO: 67746 - RNA, 65 nt, Homo Sapiens
gcucacuuucucccuuuuuauuuuucaccaaaccauuuguagagcuacaaaagguauccuuucuu

SEQ ID NO: 67747 - RNA, 65 nt, Homo Sapiens
aggcccauuaaaaaucuggcccuaaaaguucaacuuuuguagaguuuauuguucagagagguuua

SEQ ID NO: 67748 - RNA, 65 nt, Homo Sapiens
ugauacaguggguaccaagcuccucugcuccccacuuuguagagccuagcaugagguggcaugua

SEQ ID NO: 67749 - RNA, 65 nt, Homo Sapiens
cugaucauguuugguuuucuucuuccuuauuuuauuuuguagaaaccgggugguauuuuauugcu

SEQ ID NO: 67750 - RNA, 65 nt, Homo Sapiens
cgcccagcuaauuuuuguauuucuuuuuuuuuuuuuuuguagagauggaguuucaccauguuggc

SEQ ID NO: 67751 - RNA, 65 nt, Homo Sapiens
ccccagggcacucgccccccuccuuagcauuuucuuuuguagaaguuucucgaaggugcuuggcg

SEQ ID NO: 67752 - RNA, 65 nt, Homo Sapiens
uuaauagagaaguugauuguucugggaaauguauuuuuguagacuuugauuggcuauugaacccu

SEQ ID NO: 67753 - RNA, 65 nt, Homo Sapiens
uuaugugaguaugcaaauaugaagaguccccgauguuuguagaccgcagcauuaaacauauaugu

SEQ ID NO: 67754 - RNA, 65 nt, Homo Sapiens
augacuucuuguuugaauauaaagaaugucagaaauuuguagaaaaaaggagaucagagaaagcc

SEQ ID NO: 67755 - RNA, 65 nt, Homo Sapiens
auucuaaauaacaaaaaccuaauaacaugauugucuuuguagaaauacaacugucuuuguucuca

SEQ ID NO: 67756 - RNA, 65 nt, Homo Sapiens
ccucuggauuuuguauaugcucuuaaaucuaguaauuuguagauuguaaacucaauaaguuuauu

SEQ ID NO: 67757 - RNA, 65 nt, Homo Sapiens
ucauuaauggaucuugugaaccuccuccuuuguauuuuguagauuuuuaauugccuuucuuuucc

SEQ ID NO: 67758 - RNA, 65 nt, Homo Sapiens
ucaucuaacuaaaguaaauuuuucaaagcuuuaaauuuguagaacuagaaguaaaaguaguagcu

SEQ ID NO: 67759 - RNA, 65 nt, Homo Sapiens
uaguucuauaaaaguauuguacucugucgucacauuuuguagaauugauuugucggacugugguu

SEQ ID NO: 67760 - RNA, 65 nt, Homo Sapiens
gagggccacggcugcgugcgcccagaagcaccuccuuuguagacaggaaggauccggaaccagga

SEQ ID NO: 67761 - RNA, 65 nt, Homo Sapiens
uauacuuacguuccuuggaugggaugagaugguuuuuuguagaauguuuggggccugcugcaaug

SEQ ID NO: 67762 - RNA, 65 nt, Homo Sapiens
aaggaauuuucuauguuucacucuaaaaggacuuguuuguagaaucacuggcauauuuagaauau

SEQ ID NO: 67763 - RNA, 65 nt, Homo Sapiens
gaacuucugaagaguaauacguuuuuaaaguuucuuuuguagaccuucccuuggcuuuagcagau

SEQ ID NO: 67764 - RNA, 65 nt, Homo Sapiens
ugcagucuuacuauguugccuuggccuuuuaaaauuuuguagagaacaggcaugaaccacugugc

SEQ ID NO: 67765 - RNA, 65 nt, Homo Sapiens
ucaauugauccccaaccugcugaggcagucaccuauuuguagaacucugggaaaugggcuaggcc

SEQ ID NO: 67766 - RNA, 65 nt, Homo Sapiens
auucauaacauauauaggccuucugaucggucguguuuguagaaauuucuucuucucucucuuuu

SEQ ID NO: 67767 - RNA, 65 nt, Homo Sapiens
cuguuucauacagcacuuaguugaauaaagcaacuuuuguagaugcacgguucccucaaaguuug

SEQ ID NO: 67768 - RNA, 65 nt, Homo Sapiens
uauuuagcuucaggaauacuuuucucagaaaucaguuuguagaaaagaauugauccuguggcugg

SEQ ID NO: 67769 - RNA, 65 nt, Homo Sapiens
gcaaggaaccaauuaugcuuuuuucaagaugguuauuuguagaagguugaaaccugcuuuuauca

SEQ ID NO: 67770 - RNA, 65 nt, Homo Sapiens
aacuuaaucugaauaaagucgacagaacccuacuuuuuguagaggaaugugucagagacacaugg

SEQ ID NO: 67771 - RNA, 65 nt, Homo Sapiens
guaaaaagucauuuuagaugauuuuauuuuauuuuuuuguagaauccguuuggggcuguguccuu

SEQ ID NO: 67772 - RNA, 65 nt, Homo Sapiens
uaccucagaaaucauuuuuggugauuauuuuuuguuuuguagaauugcacuucaguuuauuuucu

SEQ ID NO: 67773 - RNA, 65 nt, Homo Sapiens
cugcugcuucuguccaccuuaauauucuccuucuauuuguagauaugauagacuccuauuuuucu

SEQ ID NO: 67774 - RNA, 65 nt, Homo Sapiens
uccgcagaaagcaaaguuuggggagggcugacgauuuuguagaacacaacagugacaauuuuuuu

SEQ ID NO: 67775 - RNA, 65 nt, Homo Sapiens
uuaacuggagcuccgauuuaacugggaaccccuucuuuguagaacugcccauuuccauggugcaa

SEQ ID NO: 67776 - RNA, 65 nt, Homo Sapiens
aaaauucaagaaaauaaauguagcuggugggagacuuuguagauguugggcuauauguuggggug

SEQ ID NO: 67777 - RNA, 65 nt, Homo Sapiens
aauuuugcugagguuuucuuaauguuguagagcauuuuguagagugguuuaaauaguugaaaaua

SEQ ID NO: 67778 - RNA, 65 nt, Homo Sapiens
agcauaccaccaugccugacuaauuuuuuguguuuuuuguagaggugggguuucaccauauugcc

SEQ ID NO: 67779 - RNA, 65 nt, Homo Sapiens
gaugugggauacuacuguuaguauuauuuaacuauuuuguagauuuaaaagauuucugguuaagg

SEQ ID NO: 67780 - RNA, 65 nt, Homo Sapiens
acauuaucucuagagucugcuuuuuugugggccaguuuguagagauguaacaugaagccauucca

SEQ ID NO: 67781 - RNA, 65 nt, Homo Sapiens
aagccuguuaguauuuucauuggacuuacauggaauuuguagauuuugaaaaaacagauauuuuu

SEQ ID NO: 67782 - RNA, 65 nt, Homo Sapiens
agagccuuugggcccauucagauggaugcgugccguuuguagagauguccuguggcccccugucg

SEQ ID NO: 67783 - RNA, 65 nt, Homo Sapiens
aacccaacaaaucucauaaauaaacuuucagaaaauuuguagagagaagacuugcaucaguugcu

SEQ ID NO: 67784 - RNA, 65 nt, Homo Sapiens
uuugcucuucucaguuuacuaccuucauugcuccauuuguagauuugcuucuucauggaaugcug

SEQ ID NO: 67785 - RNA, 65 nt, Homo Sapiens
aaaaauaaaucagaauuucaaaaaaauaaaaauacuuuguagauuuaaugaaaugguucccuuuu

SEQ ID NO: 67786 - RNA, 65 nt, Homo Sapiens
uaaacuuugaaugugccaaaaauuccaauuuuccauuuguagagugcauauucaaaaggccucgg

SEQ ID NO: 67787 - RNA, 65 nt, Homo Sapiens
cccgcucaggcacagggaggcugaggaggcucggcuuuguagagcaggaagcaggggaaggugac

SEQ ID NO: 67788 - RNA, 65 nt, Homo Sapiens
gaagaaugcuaauguaaagcuaguaggugaaucguuuuguagaguaucuggaggaacaucauaca

SEQ ID NO: 67789 - RNA, 65 nt, Homo Sapiens
ugacacuaaacuacccgaaggaagccaaagcuuacuuuguagaacuugagccucacuggugccag

SEQ ID NO: 67790 - RNA, 65 nt, Homo Sapiens
cuuagagguccucuggagccuggcagcccagagacuuuguagauccauuugugccagaggaaucc

SEQ ID NO: 67791 - RNA, 65 nt, Homo Sapiens
gcgauguguuauagacggugcacugugaccaggcuuuuguagauguucaugaaugugcuggugaa

SEQ ID NO: 67792 - RNA, 65 nt, Homo Sapiens
gaugggguuucgccauguugccuguuuuguuuguuuuuguagagagcuugagccaccgugccagg

SEQ ID NO: 67793 - RNA, 65 nt, Homo Sapiens
aggauuaaaauggauuuaaugcuguuuaugaucuauuuguagauuaaaauuaucaguuauauuuu

SEQ ID NO: 67794 - RNA, 65 nt, Homo Sapiens
guguauuaguuaagacagcuccaccauuuucaagauuuguagauaaauucccuuucucucuaagu

SEQ ID NO: 67795 - RNA, 65 nt, Homo Sapiens
cuuggcaaacuggcuucugauccauaucauauuuauuuguagaagauggcgaaacaguuuagcug

SEQ ID NO: 67796 - RNA, 65 nt, Homo Sapiens
caauuuacacacuugucucagaaagucccucaggguuuguagaggacugcaggggggcauccgcu

SEQ ID NO: 67797 - RNA, 65 nt, Homo Sapiens
uugcuauauccccuaauuuguugguugugcuaaucuuuguagaaagaggucucguauuugcugca

SEQ ID NO: 67798 - RNA, 65 nt, Homo Sapiens
acuagcacaagcccgguugcuccuugucaggagaauuuguagaucauucucacuucaaauuccug

SEQ ID NO: 67799 - RNA, 65 nt, Homo Sapiens
aucugcuaauguaagggacaucuguauuuaacuccuuuguagacaugaauuucuaucaaaauguu

SEQ ID NO: 67800 - RNA, 65 nt, Homo Sapiens
acccuucacaccuggcugauuuuucaaaaaguuuuuuuguagaaacagggucucaccauguuguc

SEQ ID NO: 67801 - RNA, 65 nt, Homo Sapiens
uugaauacauucagaaucaccuccucuccccaaaauuuguagaaauaguuuuugaggaagccaaa

SEQ ID NO: 67802 - RNA, 65 nt, Homo Sapiens
ucgcugcagcaaaaacuguuacuguguuuauuauauuuguagaaguauuagaaaaauauucuauu

SEQ ID NO: 67803 - RNA, 65 nt, Homo Sapiens
uuuuacuucaaauguuauuuaaaguagaaauuuaauuuguagauauaaccuuuaaaaauuuucuc

SEQ ID NO: 67804 - RNA, 65 nt, Homo Sapiens
augaccucaaggaagcuacgggcacaacuggaagcuuuguagaaauuaaacauauucaaggagca

SEQ ID NO: 67805 - RNA, 65 nt, Homo Sapiens
aaaguaugggggaagacagcaaucaaaacuaacuuuuuguagauagccauuucauuucuuuaaac

SEQ ID NO: 67806 - RNA, 65 nt, Homo Sapiens
aaacuuacaccacauacuuggugggugaauccaauuuuguagaauuccuacacaggcaaaauagc

SEQ ID NO: 67807 - RNA, 65 nt, Homo Sapiens
cacuaugcccggcaaauuuuuuguauuuuguauuuuuuguagaaacaggauuucgccauguuggc

SEQ ID NO: 67808 - RNA, 65 nt, Homo Sapiens
cuaccagcuuuagacaaaaccccaauccccgcagguuuguagauaaauuuuuaucaaggagugau

SEQ ID NO: 67809 - RNA, 65 nt, Homo Sapiens
caccaugcccagcuaauuuucuuuuuuuguuuuguuuuguagagauguggucucacuauguuucc

SEQ ID NO: 67810 - RNA, 65 nt, Homo Sapiens
uacagagaacuaacacuauuuuaugcaaauauuuuuuuguagaugaaaaagcauguacaguguuc

SEQ ID NO: 67811 - RNA, 65 nt, Homo Sapiens
ggugcgugccaccaugccuggcuaauuucugguauuuuguagagacaggguuucgccauguuggc

SEQ ID NO: 67812 - RNA, 65 nt, Homo Sapiens
acaggcgugcaccaccaugcauagcuaauuuauuuuuuguagagacagggucucccuguguugac

SEQ ID NO: 67813 - RNA, 65 nt, Homo Sapiens
cuuuuuuuuuuuuuuuuuuuugcuuuuuuuugcuuuuuguagaagagauugagaaugguacucua

SEQ ID NO: 67814 - RNA, 65 nt, Homo Sapiens
caugcgccaccgugaccagcuaauuuuuuuguauuuuuguagagaugggguuucaccauguuggc

SEQ ID NO: 67815 - RNA, 65 nt, Homo Sapiens
ugaguguaaaagcuuucagaaauaaguuacaaaucuuuguagaugaaaauaauggaaggaaugug

SEQ ID NO: 67816 - RNA, 65 nt, Homo Sapiens
caucuuggacuucaggaaaugcaauuaugauaacguuuguagacagucacgucauguuagguguu

SEQ ID NO: 67817 - RNA, 65 nt, Homo Sapiens
cucaguauaguacugucaagggaagccauacacuuuuuguagacauggguaccaaaaauacccaa

SEQ ID NO: 67818 - RNA, 65 nt, Homo Sapiens
cuggguuuugccauguugacuaauuuuugguguuuuuuguagagaugcaugccaccaugccaggc

SEQ ID NO: 67819 - RNA, 65 nt, Homo Sapiens
aacucuucucaacucuguuucuaaagaacauaccuuuuguagauguaagaauagaauuucuuucc

SEQ ID NO: 67820 - RNA, 65 nt, Homo Sapiens
ucauccauauguuuauacauucugucaauaucauauuuguagaaacacuuuacuaaaagcuuauu

SEQ ID NO: 67821 - RNA, 65 nt, Homo Sapiens
uuuuaaagggggagaauucuaacaaaagauuuguuuuuguagagaaugugaacuuugaaugguuu

SEQ ID NO: 67822 - RNA, 65 nt, Homo Sapiens
cuuccagaauauguggggaagaguaucuaauagcuuuuguagaacaauuuuccagaaccaggaau

SEQ ID NO: 67823 - RNA, 65 nt, Homo Sapiens
augacuuuagacauaucacuaaugaaaauauuuacuuuguagaauagaaaaaauaagugauucaa

SEQ ID NO: 67824 - RNA, 65 nt, Homo Sapiens
cagguaaauauauauacuuacccuagaauuuaauauuuguagauguuacauaaguuuuuuuuaac

SEQ ID NO: 67825 - RNA, 65 nt, Homo Sapiens
cuuuuuuuguuccuguucaugaucuguuuacaagguuuguagauauuauguuuauaaaugauaca

SEQ ID NO: 67826 - RNA, 65 nt, Homo Sapiens
guuucuuauuuucauauugauauuacugucagagauuuguagacaaugcauuguauauugcaauu

SEQ ID NO: 67827 - RNA, 65 nt, Homo Sapiens
ccaguaauuuuaagaaccugcaaaaauucaggcaguuuguagacagugaaacuaacuagcaaaga

SEQ ID NO: 67828 - RNA, 65 nt, Homo Sapiens
auauaaaauaaaaacuuaaagggaaaaacuuuuacuuuguagauaugguucaacuuuuaaguuaa

SEQ ID NO: 67829 - RNA, 65 nt, Homo Sapiens
acaaaaaaucguaaaauacaaaaaccaguuaauguuuuguagacccugggaaaagaauuuucagc

SEQ ID NO: 67830 - RNA, 65 nt, Homo Sapiens
gaaggaugaguguuaauuuuaauuaacuuugccguuuuguagagaaaacuauucacaagauaaau

SEQ ID NO: 67831 - RNA, 65 nt, Homo Sapiens
gaaauauuuugaaaaguaauaacauaaaacuaguauuuguagaagauuauguguuguauauaaca

SEQ ID NO: 67832 - RNA, 65 nt, Homo Sapiens
aacaguagcaaaucagauuuuccagaagcacaaacuuuguagaauacaguuuaguauaauuccuc

SEQ ID NO: 67833 - RNA, 65 nt, Homo Sapiens
gagaccaagaauucaagaugguugguggccagauuuuuguagacagagauggugauuuguuuagu

SEQ ID NO: 67834 - RNA, 65 nt, Homo Sapiens
agacuauggacauucaaaucaugggagaaaauaauuuuguagauuauguuccauugcuaaugaau

SEQ ID NO: 67835 - RNA, 65 nt, Homo Sapiens
caaguauauuuuuaaaguuguuuuauaagagagacuuuguagaagugccuagauuuugccagacu

SEQ ID NO: 67836 - RNA, 65 nt, Homo Sapiens
acuaaaagguaaauuaugggaaucacugaaauauuuuuguagauuaauuguuguaacauugucuu

SEQ ID NO: 67837 - RNA, 65 nt, Homo Sapiens
cuauugaaaggugcuuugaugauuuucuccuuugguuuguagaauuaggacugaacuuuugacuc

SEQ ID NO: 67838 - RNA, 65 nt, Homo Sapiens
gauauguugcaaugcaaaguaaucuaguaguacuguuuguagaacagacaaguguguccaauuua

SEQ ID NO: 67839 - RNA, 65 nt, Homo Sapiens
aaugaaagagaaggaaguuaaaaccuauagguuauuuuguagagcugaguguuaauacgggccga

SEQ ID NO: 67840 - RNA, 65 nt, Homo Sapiens
ugggguuucaccauguuggcuaauuuuuuguauuuuuuguagagacaggugccugcccccauggc

SEQ ID NO: 67841 - RNA, 65 nt, Homo Sapiens
gagaaggugcgucuccccugggcgccauggcucauuuuguagauuugacauuugacauuuuaaug

SEQ ID NO: 67842 - RNA, 65 nt, Homo Sapiens
uuguguucauaaguucagauaugggacuugagugguuuguagaauuggaaggagggaauuuaaaa

SEQ ID NO: 67843 - RNA, 65 nt, Homo Sapiens
agaaaagggagaucugcaucggaggccucauaauguuuguagaucuagagaccucuguaguccug

SEQ ID NO: 67844 - RNA, 65 nt, Homo Sapiens
aaaaaaaucauuauguuuagaguauaacagaaauuuuuguagaugaugucuucugcaaauuuucu

SEQ ID NO: 67845 - RNA, 65 nt, Homo Sapiens
agugauuuguaugugguuaagauguuaaccauuauuuuguagaaauuucugugaauuaaggaaua

SEQ ID NO: 67846 - RNA, 65 nt, Homo Sapiens
uuuguguaacuauuuguaccgucugcuacucgcguuuuguagacucugagcuuuacacagcuggg

SEQ ID NO: 67847 - RNA, 65 nt, Homo Sapiens
cuugguuuucuaagcauaguauugcuaguaaaugauuuguagaaagcauuauuuuuauuuaaagu

SEQ ID NO: 67848 - RNA, 65 nt, Homo Sapiens
uuagcuuuugucuaggcaaccauuaaguuuuugauuuuguagaaaugacucucuuaauaaaacug

SEQ ID NO: 67849 - RNA, 65 nt, Homo Sapiens
cugucaggucaaaauauuuauaguggaaaucacuauuuguagaaaguaacagauuccuuuauaug

SEQ ID NO: 67850 - RNA, 65 nt, Homo Sapiens
augcacggccaguagucacaguucuuauagaugauuuuguagaauuuccuuuaggagcuuggccc

SEQ ID NO: 67851 - RNA, 65 nt, Homo Sapiens
ggugauaacuuuaaauaaaacucaaauuuuuacuguuuguagacaggaaugcuguccuagagaac

SEQ ID NO: 67852 - RNA, 65 nt, Homo Sapiens
uuggguccuagaaccuguugaguuucuaaugaauauuuguagaaucucauaaaacaguuuaaaua

SEQ ID NO: 67853 - RNA, 65 nt, Homo Sapiens
uauuuguuaauuaucugcuuaguauuaacacuaaauuuguagaaugacuuucagguuuguugaac

SEQ ID NO: 67854 - RNA, 65 nt, Homo Sapiens
aaagucucauacuaccucaucuuuauuguggcgcuuuuguagaucacugagaagcuuaucuuauu

SEQ ID NO: 67855 - RNA, 53 nt, Homo Sapiens
auacccagcuaauuuuuuaauuuuuuguagagguggggucucauuauguugcc

SEQ ID NO: 67856 - RNA, 65 nt, Homo Sapiens
ggauuuggaagggggguuggguugggcuggauaucuuuguagauguggaccaccaagggguuguu

SEQ ID NO: 67857 - RNA, 65 nt, Homo Sapiens
cacaauaguugcagaucaacaaucaucaccugccuuuuguagaaaagaaaaacaaaaaaaguaaa

SEQ ID NO: 67858 - RNA, 65 nt, Homo Sapiens
cuuugaagacauugugagaucuguaauuuuuuuuuuuuguagaaaaugugaauuuuuugguccuc

SEQ ID NO: 67859 - RNA, 65 nt, Homo Sapiens
ugaagucaaauuuggauuuuccaccaaauucugaauuuguagacauacuuguacgcucacuugcc

SEQ ID NO: 67860 - RNA, 65 nt, Homo Sapiens
gaaaaaugcuuuuccaguucuuagaaaauucuuuuuuuguagacaaauauucuauaaacuagaau

SEQ ID NO: 67861 - RNA, 65 nt, Homo Sapiens
aaggugccauuuuaaauuuuauuuuuauuacuuuuuuuguagaugaacuugagcucuguaacuua

SEQ ID NO: 67862 - RNA, 65 nt, Homo Sapiens
aagcuggaauuauaaugagauggaaaauguucacauuuguagauuguaugguuugagacaacaua

SEQ ID NO: 67863 - RNA, 65 nt, Homo Sapiens
cucguucuauaucucaucaccauguuacaguguuuuuuguagauuagccucugggaaaaaacaaa

SEQ ID NO: 67864 - RNA, 65 nt, Homo Sapiens
guuuuucauaaagaagagauuuaauaguaaguguauuuguagaaagaagugugguuguacuuacg

SEQ ID NO: 67865 - RNA, 65 nt, Homo Sapiens
uuuuucugugcauuguaaguauaaauacuucccuuuuuguagauauuuauuagaaagcuaaaugg

SEQ ID NO: 67866 - RNA, 65 nt, Homo Sapiens
ccgagaaugaucccucagucgaaauuauugguauauuuguagauacucucagucuucauacccca

SEQ ID NO: 67867 - RNA, 65 nt, Homo Sapiens
uggagaugaagaagacaaaugaaauguagaaucacuuuguagauagcccuccaguguuguccaag

SEQ ID NO: 67868 - RNA, 65 nt, Homo Sapiens
uuaaauggguugugcaagcaaaaauagaggcagcuuuuguagauuugcguuuuuaaucagaaaac

SEQ ID NO: 67869 - RNA, 65 nt, Homo Sapiens
acaggcaccaguuggucuucucaaauauuugucuguuuguagaucaaugucauugaagacaaagg

SEQ ID NO: 67870 - RNA, 65 nt, Homo Sapiens
cuagguucuacuuuguuuauuugauaucaaauagguuuguagauguuuauggcauuucuaauugu

SEQ ID NO: 67871 - RNA, 65 nt, Homo Sapiens
uggcuccccuugcccugccacccuuucccuagucuuuuguagauugcacuaauuuacauccuagc

SEQ ID NO: 67872 - RNA, 65 nt, Homo Sapiens
aagcacgaaaaguuaagauaucugcuuacauugauuuuguagacacauuaagucaagauuuggaa

SEQ ID NO: 67873 - RNA, 65 nt, Homo Sapiens
ccaggggguucugcuucacuagguuaaauguagguuuuguagaggagaucugcacuggagcaagu

SEQ ID NO: 67874 - RNA, 65 nt, Homo Sapiens
augaggaacauaaggaagaauuauaauugucauuauuuguagacaauaaaacugccuaccuguaa

SEQ ID NO: 67875 - RNA, 65 nt, Homo Sapiens
cugugcagugacuguaguuacuuaagagaaaaugcuuuguagaacagagcaguagaaaagcagga

SEQ ID NO: 67876 - RNA, 65 nt, Homo Sapiens
acguaaccuucaaguaugugaaaauauugccaccauuuguagaccacagaacuacucucccaagg

SEQ ID NO: 67877 - RNA, 65 nt, Homo Sapiens
acaggcauuuauuaugucuagaguuagacauuguuuuuguagaaaagaagagaucaguccaccca

SEQ ID NO: 67878 - RNA, 65 nt, Homo Sapiens
ugaggucucaccauguugccuuaaaaaaaugguuuuuuguagagauaacaccauacuuggcuaaa

SEQ ID NO: 67879 - RNA, 65 nt, Homo Sapiens
cccugucucuacaaaaauauugaccagccuggucuuuuguagagacccucgaggccaagaguuca

SEQ ID NO: 67880 - RNA, 65 nt, Homo Sapiens
aaauagagcacaaacugugaauaauuuaaacuuuguuuguagauauuuuguauuaggacacaaag

SEQ ID NO: 67881 - RNA, 52 nt, Homo Sapiens
ggauagcauuuuuaugauuucauuuguagauugucauuacaguaguuuguaa

SEQ ID NO: 67882 - RNA, 65 nt, Homo Sapiens
ugccuuaugcaccuuacugcgcagcuauuuauuauuuuguagacccaauauauuuagugcuacuc

SEQ ID NO: 67883 - RNA, 65 nt, Homo Sapiens
gcucuggggacuccuaauuuggggcugggguuuuguuuguagaagcuccgccacacugagucccu

SEQ ID NO: 67884 - RNA, 65 nt, Homo Sapiens
caauaugaaucuuuucauguagcaaagacuuaaauuuuguagauaagaaauauagcauuuauugu

SEQ ID NO: 67885 - RNA, 65 nt, Homo Sapiens
cagcugcuugcucacagccauccaggccugugugcuuuguagagcccgccgcuucacaggcugag

SEQ ID NO: 67886 - RNA, 65 nt, Homo Sapiens
agccaggauggucucacguuuuguuuuuuuaacuuuuuguagagauaggguuucauuacauugcu

SEQ ID NO: 67887 - RNA, 65 nt, Homo Sapiens
uugcuucuuuguacuuuuucuacuuuuccuacuuuuuuguagaaaaaaaagauaaugccucugcu

SEQ ID NO: 67888 - RNA, 65 nt, Homo Sapiens
augcgccaccacuccuggccaauuuuuaaaauuuuuuuguagagauggggaucuccuuauguugu

SEQ ID NO: 67889 - RNA, 65 nt, Homo Sapiens
gaacaugacaaugaagcucuuuuagagaaaagaccuuuguagauucaacaauuaugauaggauuu

SEQ ID NO: 67890 - RNA, 65 nt, Homo Sapiens
uuggggaaauagccuggaggucuuuccugaaucuguuuguagacauaauaaaauuugugugcugu

SEQ ID NO: 67891 - RNA, 65 nt, Homo Sapiens
ugagucaccaagcccaguuaaucuuuaguuuuauuuuuguagagccagggucucacuauguugcc

SEQ ID NO: 67892 - RNA, 65 nt, Homo Sapiens
gaacuaagaauuuuauuuuauuuuauuuuuuauuuuuuguagaaauaggaucucacuauguugcc

SEQ ID NO: 67893 - RNA, 65 nt, Homo Sapiens
gcgccaccacagccggcuaauuuuuuauuuaauuuuuuguagagacgagguuucgccauguugcc

SEQ ID NO: 67894 - RNA, 65 nt, Homo Sapiens
gggauuugggucuaucuaugccuuucuggcugauuuuuguagagacgggguuuugccauguuacc

SEQ ID NO: 67895 - RNA, 65 nt, Homo Sapiens
cugaggggucucagcccaccgcccuuggugccuucuuuguagagcccaccgcuaccucccucucc

SEQ ID NO: 67896 - RNA, 65 nt, Homo Sapiens
aucuuuuauugguaaaauauaaauguauaauuauguuuguagagcuuuaccaaggaguuucccuc

SEQ ID NO: 67897 - RNA, 65 nt, Homo Sapiens
aaaguaugcauucuuaucaccuaguauauaguuaguuuguagagugauuuccccccaguuucuug

SEQ ID NO: 67898 - RNA, 65 nt, Homo Sapiens
ccuucaauuauaguuagucuuggugaaguaagauguuuguagacuuuagaguucuuuaauucuug

SEQ ID NO: 67899 - RNA, 65 nt, Homo Sapiens
aacuguuuauaccaucaucuaaacugccaucaucauuuguagaaauuguugaacagauaaauacg

SEQ ID NO: 67900 - RNA, 65 nt, Homo Sapiens
cugaagccuaauguuacucaccauucagacaaguguuuguagacuuugccuaucgccucucucuc

SEQ ID NO: 67901 - RNA, 65 nt, Homo Sapiens; identical to SEQ ID NO: 67899

SEQ ID NO: 67902 - RNA, 65 nt, Homo Sapiens
uaggaugaccaaggacaacaaaaaaauacaauaaauuuguagagacugucuuacacagcauuuuu

SEQ ID NO: 67903 - RNA, 65 nt, Homo Sapiens
ugucaaguccaguaaaugacauuuuuagagaugcuuuuguagacaagcauauggaauaugugauu

SEQ ID NO: 67904 - RNA, 65 nt, Homo Sapiens
aaauucaugacuugucuuacugaacuacagccugguuuguagacuuccaacaucuacacugcugc

SEQ ID NO: 67905 - RNA, 65 nt, Homo Sapiens
caugcaccaccacgcccagcuaauuuuucuuauuuuuuguagagacagggucucacuguguugcc

SEQ ID NO: 67906 - RNA, 65 nt, Homo Sapiens
ugugucugugaaagugccaagaaccccuccccacauuuguagauccaugacccuuuuuauaagcu

SEQ ID NO: 67907 - RNA, 65 nt, Homo Sapiens
ugugggccuugggguccaugaaccccaugaaauuauuuguagacuuguauguacauuuuucuggg

SEQ ID NO: 67908 - RNA, 65 nt, Homo Sapiens
ucacuaggaauuuuuauucccaguccgucaggaauuuuguagaagggcuucaugugcugguacca

SEQ ID NO: 67909 - RNA, 65 nt, Homo Sapiens
gguaucuuuguggagcuuucuaauuuacaaaaugcuuuguagaccccauugucuuuaaaccauac

SEQ ID NO: 67910 - RNA, 65 nt, Homo Sapiens
cuggccuuguacuugcuuguauuguaaauguggauuuuguagauguuaggguauaaguugcugua

SEQ ID NO: 67911 - RNA, 65 nt, Homo Sapiens
gcguauuuagacuguggccauauaugcuguauuucuuuguagaauaaaugguuucucauuaaacu

SEQ ID NO: 67912 - RNA, 65 nt, Homo Sapiens
guguguaccaucacaccuggcuaauuuuuguauuuuuuguagacacaggguuucgccauguugcc

SEQ ID NO: 67913 - RNA, 65 nt, Homo Sapiens
uacuucacuuuaauaacuguugcuuaguaauuggcuuuguagagaagcuggaaaaaaaugguuuu

SEQ ID NO: 67914 - RNA, 65 nt, Homo Sapiens
ggccuaccgcaguggccccggcugucugcacauuuuuuguagacacauuagagucgguugaggcc

SEQ ID NO: 67915 - RNA, 65 nt, Homo Sapiens
ugauuagauuaccuuguuuauuuuacaaacuacacuuuguagaauuugguuccuagugcuacuug

SEQ ID NO: 67916 - RNA, 65 nt, Homo Sapiens
uuuuucuuaauauuuuuaacggcagcccuccagauuuuguagacagcuuuacccuuugagaaaaa

SEQ ID NO: 67917 - RNA, 65 nt, Homo Sapiens
uggggucucacaguguugccccaacuuuugcauguuuuguagagaguucaugccaccauggccag

SEQ ID NO: 67918 - RNA, 65 nt, Homo Sapiens
cccagccccagcaucuccaaaaagccagaaugugguuuguagaauggcugagccuaucagggcac

SEQ ID NO: 67919 - RNA, 65 nt, Homo Sapiens
ggggcaaagccccaacugcauuuguugaaguacuguuuguagagguaagaauguaaauaaacaug

SEQ ID NO: 67920 - RNA, 65 nt, Homo Sapiens
caggagcaagaguguuuggccccuuucccuuuuucuuuguagaagugccuuauuggagaaaauca

SEQ ID NO: 67921 - RNA, 65 nt, Homo Sapiens
uguaaagauuacuugagguggaacuauguuaugauuuuguagaaagaauaaauguuucuggaaaa

SEQ ID NO: 67922 - RNA, 65 nt, Homo Sapiens
agggcuuguucuccaacacccuugucuuucugugauuuguagaggccauacccccaagacagugu

SEQ ID NO: 67923 - RNA, 65 nt, Homo Sapiens
cuggagcccagccaaggucuagcaucucuuccuccuuuguagaugagauccugggaucugggccc

SEQ ID NO: 67924 - RNA, 65 nt, Homo Sapiens
cuugcuccugcuucuccugacucaguccccuucaauuuguagacucucccccugcuccccuacuu

SEQ ID NO: 67925 - RNA, 65 nt, Homo Sapiens
uuugguuuuuuugucagguugacaugggugucgguuuuguagaucucuaccucaucauuuaaaau

SEQ ID NO: 67926 - RNA, 65 nt, Homo Sapiens
ccauguuguauacaguuuucugauuggugacacuuuuuguagaacucucgcucucguacauaaga

SEQ ID NO: 67927 - RNA, 65 nt, Homo Sapiens
gcuccuugaccauguuuaauaagaaauccugaggcuuuguagaguuggcacagcaguaucccuug

SEQ ID NO: 67928 - RNA, 65 nt, Homo Sapiens
cuuuauaauagaacuugugguuaaauaaaggaaaauuuguagacucaaauucaggguuuuuuuuu

SEQ ID NO: 67929 - RNA, 65 nt, Homo Sapiens
auguucucuaucaguaucguaggcucauugccacuuuuguagagaguaccccgaaucccuccugc

SEQ ID NO: 67930 - RNA, 65 nt, Homo Sapiens
cccaguuuauuuucuaagacaugcuuucuuuuccuuuuguagauuaagaaagagauacauuuugu

SEQ ID NO: 67931 - RNA, 65 nt, Homo Sapiens
ucgcaagucucaaaacgugauaauauuuaagcccauuuguagaagaaaucuuguauauacuauua

SEQ ID NO: 67932 - RNA, 65 nt, Homo Sapiens
uauaaagauuguuuugagugcugauuuguuuacuuuuuguagauuugcuuuauccaugauauuca

SEQ ID NO: 67933 - RNA, 65 nt, Homo Sapiens
guucuuaauauucauuagugagaaucacaaaguauuuuguagaaggcccaaaucacagaauaaag

SEQ ID NO: 67934 - RNA, 65 nt, Homo Sapiens
cugccuuccugacagguucugagauaaguguuauguuuguagauagagugaaauauauuuauaua

SEQ ID NO: 67935 - RNA, 65 nt, Homo Sapiens
guuuuguuuuguuuuugucuugaaaauaauagacauuuguagaauauggagacuaacuccuagga

SEQ ID NO: 67936 - RNA, 65 nt, Homo Sapiens
cccuaaaacuaagcgugcugcuucugcaaaagauuuuuguagaugagcugugugccucagaauug

SEQ ID NO: 67937 - RNA, 65 nt, Homo Sapiens
cagggucuugcuauguugccuuuuuuauuuuccuuuuuguagagaaugccaccacaccuggcuaa

SEQ ID NO: 67938 - RNA, 65 nt, Homo Sapiens
uuaauuuaaaauuuaaauuuucugcauagauuuaguuuguagaaucucaggagaaagaagcuaaa

SEQ ID NO: 67939 - RNA, 65 nt, Homo Sapiens
aagaaaauccuuuuugcuuuaacuugccuugcagguuuguagaaaacucaauuguugaaauuugg

SEQ ID NO: 67940 - RNA, 65 nt, Homo Sapiens
uggggguugagauauggggaugaggaugaagaacuuuuguagaaaucgggguucccucuuucucu

SEQ ID NO: 67941 - RNA, 65 nt, Homo Sapiens
aggguuguagugccuuuacuuguaucacagaucuuuuuguagacauuuucuucuagaggaaaacu

SEQ ID NO: 67942 - RNA, 65 nt, Homo Sapiens
uauuuguauauaauguuaagaggaguaaaagauuuuuuguagaauaauaacuauauucggauuau

SEQ ID NO: 67943 - RNA, 65 nt, Homo Sapiens
aauucagugcccgacagaugcucuggcacagaugcuuuguagaucucuguugagagaaugcauag

SEQ ID NO: 67944 - RNA, 65 nt, Homo Sapiens
gcuaccauacccagcuaauuuaaacaaauuuuuuuuuuguagagauggggucuuggugcccaagc

SEQ ID NO: 67945 - RNA, 65 nt, Homo Sapiens
acaggcaugugccaccacaccuaauuucuauauuuuuuguagagacuagguuucaccauguuguc

SEQ ID NO: 67946 - RNA, 65 nt, Homo Sapiens
gaaagagaaaagguuuggguccacugaacaucauguuuguagacgcugacaggugggguccuaau

SEQ ID NO: 67947 - RNA, 65 nt, Homo Sapiens
uggggucuugcuacguugcccuaacuuuuaaauuuuuuguagagagugugaaucaccaugcccgg

SEQ ID NO: 67948 - RNA, 65 nt, Homo Sapiens
cuguggauucuuuuucucucgggaggguggggcuuuuuguagaaaccagcugaccagggugcuug

SEQ ID NO: 67949 - RNA, 65 nt, Homo Sapiens
gaugauuauuguacugugggcugccauguugugcuuuuguagagagguccuuucacauucuugag

SEQ ID NO: 67950 - RNA, 65 nt, Homo Sapiens
cgugggucucacuaugcugccuaauuuuuguauuuuuuguagagaguguguaccaccacaccggg

SEQ ID NO: 67951 - RNA, 65 nt, Homo Sapiens
caggugucucucuacguugcuuuuuauuuuuauuuuuuguagagacaccaccacaccugguuaau

SEQ ID NO: 67952 - RNA, 65 nt, Homo Sapiens
cgaaguuucaccauguuggcuuuuuuuuuuaauuuuuuguagagacaccacaucuggcugaauuu

SEQ ID NO: 67953 - RNA, 54 nt, Homo Sapiens
cugaagcaguuguuucuguugauuuuuguagagaagcccucgaagccacaauga

SEQ ID NO: 67954 - RNA, 65 nt, Homo Sapiens
ggcuuuuuaacuucugcagaucaucaguauuauuauuuguagaaacaucguuauuauauucauca

SEQ ID NO: 67955 - RNA, 65 nt, Homo Sapiens
uguaguccugugauugucauuaacgucagagaauuuuuguagaaauaacaccuuucuaaccuucu

SEQ ID NO: 67956 - RNA, 65 nt, Homo Sapiens
cuuacuuaaccuuaauggaauuuuuaaaugcuagguuuguagagguuuuuuuuuuuuuuuuuuuu

SEQ ID NO: 67957 - RNA, 65 nt, Homo Sapiens
uggagucucacuauguuucccuaauuuuuguacuuuuuguagaaaaugugagccaccaugccugg

SEQ ID NO: 67958 - RNA, 65 nt, Homo Sapiens
cgaggucuugugauauugccuaauuuuuuuuaauuuuuguagagagccaccaugccuggcccgga

SEQ ID NO: 67959 - RNA, 65 nt, Homo Sapiens
ggucaaacaucaaauguaauuuguaaaaaugaugguuuguagaggcaaaaugaaacaaauacuug

SEQ ID NO: 67960 - RNA, 65 nt, Homo Sapiens
agaaaaacucuugaaaguaauaaaauaugggagaauuuguagaaagauauggaaaacauuuuucg

SEQ ID NO: 67961 - RNA, 65 nt, Homo Sapiens
ucaagguacaaacuucucacucauuuugaucaauguuuguagauuguguauuuauauguuuuuaa

SEQ ID NO: 67962 - RNA, 65 nt, Homo Sapiens
ugaagguagaaacuucucaaucacuuugaucaauguuuguagauucuuauuugcacauguuuuua

SEQ ID NO: 67963 - RNA, 65 nt, Homo Sapiens
caagaacuuuauguuauccaggaaaggauacacacuuuguagaaauccucagaguucucacauau

SEQ ID NO: 67964 - RNA, 65 nt, Homo Sapiens
ugagucucacuauguugcccuucuauuauuuauuuuuuguagagauggccaacucacauuuuucu

SEQ ID NO: 67965 - RNA, 65 nt, Homo Sapiens
gggucucacuguguugcccaggcuaauuauuauuuuuuguagacagggcaugcaucgccacgucu

SEQ ID NO: 67966 - RNA, 65 nt, Homo Sapiens
aucaaggagcaaguuggaguguuucagguguauauuuuguagaacccaaaagauuggagccuuaa

SEQ ID NO: 67967 - RNA, 65 nt, Homo Sapiens
gugugcugaguucuauaauauaagcugccauauauuuuguagacaaguauggcuccuccauaucu

SEQ ID NO: 67968 - RNA, 65 nt, Homo Sapiens
uuuuuaacaccuuuuacucuucuuacuggugcuauuuuguagaauaaggaacaacguugacaagu

SEQ ID NO: 67969 - RNA, 65 nt, Homo Sapiens
agaaucuagggcacuguuuccuccccauccuucucuuuguagagaauagagacguuugucuuguc

SEQ ID NO: 67970 - RNA, 65 nt, Homo Sapiens
ucuuaauacuguccuuuuuuuuuuuuuaacaguguuuuguagauuucagaugacuaugcagaggc

SEQ ID NO: 67971 - RNA, 65 nt, Homo Sapiens
cuaaggaaaugguggcaugaagacccucucccuucuuuguagaauuaagauaacuuugauuuuau

SEQ ID NO: 67972 - RNA, 65 nt, Homo Sapiens
aggugugacuggaaagcaugauauucuaggguugguuuguagauucaaauaauccagaaauauac

SEQ ID NO: 67973 - RNA, 65 nt, Homo Sapiens
ugguuucgacauguaaaauguguuugaaaaccugcuuuguagaugcagagagaagcuauaggaaa

SEQ ID NO: 67974 - RNA, 65 nt, Homo Sapiens
aacacaggcuuguacacagauguuuuacacucacguuuguagaugaaacagaucacugugcuguc

SEQ ID NO: 67975 - RNA, 65 nt, Homo Sapiens
gccugagaugcuggcuguacucagccuuugcaauuuuuguagauguagcuuaggacgugaguuau

SEQ ID NO: 67976 - RNA, 65 nt, Homo Sapiens
agguggcuuuucaguuacagaguccaguggaccauuuuguagaaccaugcagcucccugcggaag

SEQ ID NO: 67977 - RNA, 65 nt, Homo Sapiens
uaacacccagugaaagcccacaauugaaggugcuguuuguagacuagaacuuuaauugacaguuu

SEQ ID NO: 67978 - RNA, 65 nt, Homo Sapiens
caaggucuugcuauguuguccuaauuuuuuuauuuuuuguagagagcaugugccaccaugcccag

SEQ ID NO: 67979 - RNA, 65 nt, Homo Sapiens
ugggauuuugccauguugcccagcuaauguguguuuuuguagagacaaguacacacuaccacgcc

SEQ ID NO: 67980 - RNA, 65 nt, Homo Sapiens
uauuccuuuucaaaaaggaaaaagcuguagaacauuuuguagaugaaacuacuguuuaagauuaa

SEQ ID NO: 67981 - RNA, 65 nt, Homo Sapiens
uucuuagaagcagggugucagcuacugggaauauuuuuguagagcugcauugugaaaaaaagaug

SEQ ID NO: 67982 - RNA, 65 nt, Homo Sapiens
ugugcaccacaaugccuagcuaauuuuuuuuguauuuuguagaaaugggguuucgccauguugcu

SEQ ID NO: 67983 - RNA, 65 nt, Homo Sapiens
acgcagggugcgcuggguugggacguggguccacuuuuguagaccagcuguuuggagagcuguau

SEQ ID NO: 67984 - RNA, 65 nt, Homo Sapiens
uccacagggcuaaugccaccaucuccccucaaaauuuuguagagguucuaaaaagaaagugguau

SEQ ID NO: 67985 - RNA, 65 nt, Homo Sapiens
uguuuccagaggcgucuuagucucacccaaugugauuuguagaagcacgagacgcacuuuuauau

SEQ ID NO: 67986 - RNA, 65 nt, Homo Sapiens
acgugcugcccgugacagcacauugagccacagcauuuguagacaggacagaggggugccugccc

SEQ ID NO: 67987 - RNA, 65 nt, Homo Sapiens
gguggugugauuuuuuuuuccuccugucuuuuucauuuguagaaacuggagacguguaaagaaga

SEQ ID NO: 67988 - RNA, 65 nt, Homo Sapiens
auuuuaaugauaaaaaugacauuaguauucugauauuuguagauuuuuauuaguuaugacaauaa

SEQ ID NO: 67989 - RNA, 65 nt, Homo Sapiens
gggucucccuauguugcccacuaauuuucaaauuuuuuguagacagugagugccaccacacucag

SEQ ID NO: 67990 - RNA, 65 nt, Homo Sapiens
acuuuugggggauauauuuuagcagccugcacucuuuuguagauuuuguccauuccuuuaagggg

SEQ ID NO: 67991 - RNA, 65 nt, Homo Sapiens
aaucagaaaacaauuuacuauucuagacuuuuuuuuuuguagaagcacacuacauucccucuguc

SEQ ID NO: 67992 - RNA, 65 nt, Homo Sapiens
agggauuugcaguuacuugguuggagcaagcacacuuuguagaggaacuucuaguuugcacugcc

SEQ ID NO: 67993 - RNA, 65 nt, Homo Sapiens
auucaccuuuaaaacuaguuaguaauauuugaagauuuguagaaucaaauauugugcauuuuaac

SEQ ID NO: 67994 - RNA, 65 nt, Homo Sapiens
ucuugacagugcuguaauacgugugugauguguguuuuguagauuuuuuacuuguuuuuuuaaga

SEQ ID NO: 67995 - RNA, 65 nt, Homo Sapiens
ucccuauucugcguguauguguuugcacaugaguguuuguagaccauagaccauuaaaaaauacg

SEQ ID NO: 67996 - RNA, 65 nt, Homo Sapiens
uuucaauguguuuuauauuguuuugacugccuuuuuuuguagaaauaaaaauugaccuuagaauu

SEQ ID NO: 67997 - RNA, 65 nt, Homo Sapiens
aucagacacuaaucuagguauuucugugaagguauuuuguagaugugacagaaguccauucccaa

SEQ ID NO: 67998 - RNA, 65 nt, Homo Sapiens
caugccaccacacccagcugauuaucauauuuuuuuuuguagagguggggaagugcagugaugca

SEQ ID NO: 67999 - RNA, 65 nt, Homo Sapiens
caugccaccacacccagcugauuaucauauuuuuuuuuguagaggugggguuuuaccauucccag

SEQ ID NO: 68000 - RNA, 65 nt, Homo Sapiens
cugacuuacagcaagcgaguuaucgucuucuguauuuuguagacuuucuaaauaaagucaaauuc

SEQ ID NO: 68001 - RNA, 65 nt, Homo Sapiens
aaguuauauauuuaacaguuuuuauauguuguauauuuguagaaaauccuauuuaacaauuaacg

SEQ ID NO: 68002 - RNA, 65 nt, Homo Sapiens
gacuuuuucucagcagccaacagugugaaaaagcauuuguagagaggcaggugggagcugugaca

SEQ ID NO: 68003 - RNA, 65 nt, Homo Sapiens
acacuuaauacuauacuaagugguuaaucacaaauuuuguagauagaacacaauuguguguguuu

SEQ ID NO: 68004 - RNA, 65 nt, Homo Sapiens
ucuaaauagaauaaacacuuucuuaaaagcucaaauuuguagacuaugaauauuuugugaaucuu

SEQ ID NO: 68005 - RNA, 65 nt, Homo Sapiens
uuuuuuccuuuccuaagcccuuuugaaauuucccuuuuguagagcgggccccugcugaagcccua

SEQ ID NO: 68006 - RNA, 65 nt, Homo Sapiens
agggcuccccuccucuuguuucacugggaggccccuuuguagaccgagccccaaacuccucggcc

SEQ ID NO: 68007 - RNA, 65 nt, Homo Sapiens
guggaaucauuuuucugcccuuuagucguuuuuguuuuguagaaaguaucucucaaaauauauua

SEQ ID NO: 68008 - RNA, 65 nt, Homo Sapiens
aaguuggccugcccuaacaauacuucuacagaacguuuguagagauauuggccuugaagcagaaa

SEQ ID NO: 68009 - RNA, 65 nt, Homo Sapiens
uuuuuucugccuauuuaaagacaaauuaugggacguuuguagaaccugaguauuuuucuuuuuac

SEQ ID NO: 68010 - RNA, 65 nt, Homo Sapiens
aagaaauguuucuggagcuaguuaugucucacaauuuuguagaaucuuacagcaucuuugauaaa

SEQ ID NO: 68011 - RNA, 65 nt, Homo Sapiens
auuaauucaugaugcuucugauaugaugagucaucuuuguagaguuacuaagcauuagcaaagga

SEQ ID NO: 68012 - RNA, 65 nt, Homo Sapiens
aguggccuuaccccugccuuugggagcaggauuuuuuuguagagagucuuaucugagcugagcca

SEQ ID NO: 68013 - RNA, 65 nt, Homo Sapiens
auauuccuaguagauggaagcaaaauuaaguugucuuuguagaaaaugaagagccuuucuuccag

SEQ ID NO: 68014 - RNA, 65 nt, Homo Sapiens
guaauuuccuaucguaauuauaacauucccauucuuuuguagaugaaacuucuacauauugaacc

SEQ ID NO: 68015 - RNA, 65 nt, Homo Sapiens
acgagucacuuaaaauaucgacgguaaacuacuauuuuguagagaaacucaggaagauuuaaaug

SEQ ID NO: 68016 - RNA, 65 nt, Homo Sapiens
caaacuuuucaaaugaaaauggauauuuaguguauuuuguagaagaucuccaaagaucuuuugug

SEQ ID NO: 68017 - RNA, 65 nt, Homo Sapiens
uguguaucgcaauuacuuaacacuggaauauuuuauuuguagaaaaaacucaggauugauguaag

SEQ ID NO: 68018 - RNA, 65 nt, Homo Sapiens
auagucaauacuuguguaugguguuacaauaaauauuuguagauacuuccuguaguucuauucaa

SEQ ID NO: 68019 - RNA, 65 nt, Homo Sapiens
ugggguuucuccauguugguccacgcccagcuaauuuuguagagagcgauuacaggaaugcacca

SEQ ID NO: 68020 - RNA, 65 nt, Homo Sapiens
guucccauaaaaauauuuuacuuagcaguuuuuguuuuguagacauuuaauuuaaaaguauuucu

SEQ ID NO: 68021 - RNA, 65 nt, Homo Sapiens
caugguuguuuugucucacgguguaaauguauuccuuuguagaauuuuuguauuuauuuucuacu

SEQ ID NO: 68022 - RNA, 65 nt, Homo Sapiens
aauuagaacccauaaccauaucauggcugcuugauuuuguagagauucuaacuuucuuuacucca

SEQ ID NO: 68023 - RNA, 65 nt, Homo Sapiens
caguccuucguguaacaacucaccuaggguaauguuuuguagaaucaguuuuaagauuaugccau

SEQ ID NO: 68024 - RNA, 65 nt, Homo Sapiens
ugcaaaaaauguugccuuucgaaacaaauguauaauuuguagacauaaaauuuggcacaugugug

SEQ ID NO: 68025 - RNA, 65 nt, Homo Sapiens; identical to SEQ ID NO: 68024

SEQ ID NO: 68026 - RNA, 65 nt, Homo Sapiens
cucaguacuuuuccaaugcaaaaauguaaagcuauuuuguagaggaaaucacauucauuuguuua

SEQ ID NO: 68027 - RNA, 65 nt, Homo Sapiens
uuguaaaauaaauguucguauaaguucaacauacuuuuguagaaucacaccuguuuuguuuuucu

SEQ ID NO: 68028 - RNA, 65 nt, Homo Sapiens
uuuuaggcgucuucggauauuuguaaacccauguguuuguagagacuugauuuuaggcuuguuuu

SEQ ID NO: 68029 - RNA, 65 nt, Homo Sapiens
cauucaaaaccauuaauaaggcccccucuccuuuuuuuguagaccaaugaugaggaucucuuuuu

SEQ ID NO: 68030 - RNA, 65 nt, Homo Sapiens
aagugacagagcaggcggguacuucguguccuuccuuuguagagauuuguucuuuuggaagucuu

SEQ ID NO: 68031 - RNA, 65 nt, Homo Sapiens
auuacaaaagccaaaaaagguuucauguugacagauuuguagacauuucuagcccuuuaguucuu

SEQ ID NO: 68032 - RNA, 65 nt, Homo Sapiens
gcacagauaagugguaaauggguaucugguuuuuuuuuguagaaagcagucuuggcccucaucca

SEQ ID NO: 68033 - RNA, 65 nt, Homo Sapiens
acguugcuuuuuuuggauuggaagcucaacauuucuuuguagagauuugagcuagagagcuguag

SEQ ID NO: 68034 - RNA, 65 nt, Homo Sapiens
aaggcaccccugauuuuuguugcgcacugcaguuauuuguagacagcgcggccucuccccgccgc

SEQ ID NO: 68035 - RNA, 65 nt, Homo Sapiens
cucauaguuggacuuucuagguuugccccguucuguuuguagagugaaugguuagaagugaggga

SEQ ID NO: 68036 - RNA, 65 nt, Homo Sapiens; identical to SEQ ID NO: 68015

SEQ ID NO: 68037 - RNA, 64 nt, Homo Sapiens; identical to SEQ ID NO: 48511

SEQ ID NO: 68038 - RNA, 64 nt, Homo Sapiens; identical to SEQ ID NO: 48512

SEQ ID NO: 68039 - RNA, 64 nt, Homo Sapiens; identical to SEQ ID NO: 48513

SEQ ID NO: 68040 - RNA, 64 nt, Homo Sapiens; identical to SEQ ID NO: 48514

SEQ ID NO: 68041 - RNA, 64 nt, Homo Sapiens; identical to SEQ ID NO: 48515

SEQ ID NO: 68042 - RNA, 64 nt, Homo Sapiens; identical to SEQ ID NO: 48516

SEQ ID NO: 68043 - RNA, 64 nt, Homo Sapiens; identical to SEQ ID NO: 48517

SEQ ID NO: 68044 - RNA, 64 nt, Homo Sapiens; identical to SEQ ID NO: 48518

SEQ ID NO: 68045 - RNA, 64 nt, Homo Sapiens; identical to SEQ ID NO: 48519

SEQ ID NO: 68046 - RNA, 64 nt, Homo Sapiens; identical to SEQ ID NO: 48520

SEQ ID NO: 68047 - RNA, 64 nt, Homo Sapiens; identical to SEQ ID NO: 48521

SEQ ID NO: 68048 - RNA, 64 nt, Homo Sapiens; identical to SEQ ID NO: 48522

SEQ ID NO: 68049 - RNA, 64 nt, Homo Sapiens; identical to SEQ ID NO: 48523

SEQ ID NO: 68050 - RNA, 64 nt, Homo Sapiens; identical to SEQ ID NO: 48524

SEQ ID NO: 68051 - RNA, 64 nt, Homo Sapiens; identical to SEQ ID NO: 48525

SEQ ID NO: 68052 - RNA, 64 nt, Homo Sapiens; identical to SEQ ID NO: 48526

SEQ ID NO: 68053 - RNA, 64 nt, Homo Sapiens; identical to SEQ ID NO: 48527

SEQ ID NO: 68054 - RNA, 64 nt, Homo Sapiens; identical to SEQ ID NO: 48528

SEQ ID NO: 68055 - RNA, 63 nt, Homo Sapiens
aagggguggggagauauauaaauaaaucaugaaaucaauacauaugccuggcucagauuccuc

SEQ ID NO: 68056 - RNA, 64 nt, Homo Sapiens
cuucuuguuucucacuuugauauuuaaaagauguucaauacacuguuugaaugugcugguaacu

SEQ ID NO: 68057 - RNA, 64 nt, Homo Sapiens
auuucccaucugcaccccuucucuccuccccaaaucaauacacuaguuguuucuaccccuggcu

SEQ ID NO: 68058 - RNA, 64 nt, Homo Sapiens
ucucauguguucaaauuaacauaaauauuacacgucaauacacuguacauggugguaauagacu

SEQ ID NO: 68059 - RNA, 64 nt, Homo Sapiens
agugagcaucugcuguuagcuagacacuguugaaucaauacagugaaacagacagguaagcagg

SEQ ID NO: 68060 - RNA, 64 nt, Homo Sapiens
ggaaaaggugucuugcuggcuugccucuugcaauucaauacagaucaguuuagcaaaucuacug

SEQ ID NO: 68061 - RNA, 64 nt, Homo Sapiens
ggucuauuuggugucguggaaccucuuacugcuuucaauacacgauuaguaaucaacuguuuug

SEQ ID NO: 68062 - RNA, 64 nt, Homo Sapiens
uuccacaucagaccuuccacuuaaggguaccaauucaauacaaaagagaaaagaagaaccucuc

SEQ ID NO: 68063 - RNA, 64 nt, Homo Sapiens
cagaucaguuaguaggcuuucguugucuucucuuucaauacauguacaucuuuacuguuugaaa

SEQ ID NO: 68064 - RNA, 64 nt, Homo Sapiens
ucaaggucgcuuccaguuuuuggcacacacaccuucaauacacggcaccuccgucggaagcauu

SEQ ID NO: 68065 - RNA, 64 nt, Homo Sapiens
uaagaccgugucccaaggaggauggggagaauggucaauacacaaacauuccgaagagggaaug

SEQ ID NO: 68066 - RNA, 64 nt, Homo Sapiens
aacaaaccuuuuuccuuugaccacuggguuuugaucaauacaauuaagauagaugguguugauu

SEQ ID NO: 68067 - RNA, 64 nt, Homo Sapiens
auuguaagaggauccuuguccugggcugguuuucucaauacaaaccccuuccaccugcugcggg

SEQ ID NO: 68068 - RNA, 64 nt, Homo Sapiens
aaauuagcuccuaaccuaacuauucaaauauugcucaauacagcauaauauucaucgauaccau

SEQ ID NO: 68069 - RNA, 64 nt, Homo Sapiens
aauggaaacuuaaauuuuuuauaaaauucacucuucaauacauggggauuuacuaguaguguaa

SEQ ID NO: 68070 - RNA, 64 nt, Homo Sapiens
uuuaugcaguaagcucuccuauaagaauauauuaucaauacagugaaauugaguauuuucugac

SEQ ID NO: 68071 - RNA, 64 nt, Homo Sapiens
cuguagccucuuuccucguugucuugcauuucccucaauacaagccugcuuucuuuucuccuca

SEQ ID NO: 68072 - RNA, 64 nt, Homo Sapiens
ugugguagggacuuaaaaaaccauacuucuucauucaauacaagauugaauauauuauaaucuu

SEQ ID NO: 68073 - RNA, 64 nt, Homo Sapiens
augaaauuccuuauaaaauaagaggagucauauuucaauacauccauagaaaugaauggcagaa

SEQ ID NO: 68074 - RNA, 64 nt, Homo Sapiens
gcugcaauuucuggauaucaaaaagagcccuuuaucaauacaguaaauucuuucccugguaaug

SEQ ID NO: 68075 - RNA, 64 nt, Homo Sapiens
uuccaggggccccacacuccguggugagccaccaucaauacagaaagugaccuaagauguacca

SEQ ID NO: 68076 - RNA, 64 nt, Homo Sapiens
aauugggggaaaaaacuuuuaaucacaauuuucuucaauacaaggggaaaauauucuugcggau

SEQ ID NO: 68077 - RNA, 64 nt, Homo Sapiens
ccugcagaugccugacucuuguuagccuuacuauucaauacaguccuuagauucacgguaugcc

SEQ ID NO: 68078 - RNA, 64 nt, Homo Sapiens
cacaacaguuagcaagcugacuuuuguaaugugcucaauacaaauacuugugaacuuuuaauau

SEQ ID NO: 68079 - RNA, 64 nt, Homo Sapiens
aguaucuaaaaauuuuaucaccaggggaauaaacucaauacacauucauuaaacuuuuguugua

SEQ ID NO: 68080 - RNA, 64 nt, Homo Sapiens
cucuaacaagaaaaaugucuagauuuacacauugucaauacaguauauuaguucugcaaaugca

SEQ ID NO: 68081 - RNA, 64 nt, Homo Sapiens
agccagagugaaugauacuauuucaaguacaaggucaauacauaugauauuuauggaaaaguac

SEQ ID NO: 68082 - RNA, 64 nt, Homo Sapiens
ccagcaacuaauaaaaccucuuauaaacuuauaaucaauacaaauuucuaauucaguucugaag

SEQ ID NO: 68083 - RNA, 64 nt, Homo Sapiens
gaaagccuuucagaucuuuguuauuuuuauugugucaauacagauuguaauucuucagaauuga

SEQ ID NO: 68084 - RNA, 64 nt, Homo Sapiens
aguuuagguuuaagaugaccauuuuaaauauuuuucaauacaaccaauccucaaguuuuaauug

SEQ ID NO: 68085 - RNA, 64 nt, Homo Sapiens
uaaagauaaauaugugacuauguuuaaaagaaacucaauacagaaucuguuacuguucuaaaaa

SEQ ID NO: 68086 - RNA, 64 nt, Homo Sapiens
ccccaauauuggaaagacuuacauuuuuuagaaaucaauacaugauauuucauuccccaggcag

SEQ ID NO: 68087 - RNA, 64 nt, Homo Sapiens
aauaagauauuggaauuuauuaaaagauuuuuguucaauacauuuuagauuaggauugacaagu

SEQ ID NO: 68088 - RNA, 64 nt, Homo Sapiens
uuccaugacgacauacaugcuacuuuuuuuuaguucaauacagugaaggucuuuguuaugacag

SEQ ID NO: 68089 - RNA, 64 nt, Homo Sapiens
ggcccugggccacccugugcuaucugaaaugaccucaauacacuaaugccaaccucagcgucau

SEQ ID NO: 68090 - RNA, 64 nt, Homo Sapiens
uacaguaacaauagacagcacaacacaaacucucucaauacagauaaacucacacauacuggag

SEQ ID NO: 68091 - RNA, 64 nt, Homo Sapiens
ccaagaguguguugcuauuuguaagccccauggaucaauacauaaacuaugcauaaaaauaaaa

SEQ ID NO: 68092 - RNA, 64 nt, Homo Sapiens
gcguuugugauuaucauuaguggaaaacacugaaucaauacaauagugagcaagcuguguacac

SEQ ID NO: 68093 - RNA, 64 nt, Homo Sapiens
ugugcuguaccuuguaaagugguccuuuuuuucuucaauacaacuacuccuaaaguaagaguug

SEQ ID NO: 68094 - RNA, 64 nt, Homo Sapiens
ugccauuuuagcuaugugguccaugagauguuuaucaauacaacuuuucugucaacuaccaugc

SEQ ID NO: 68095 - RNA, 64 nt, Homo Sapiens
uuuuguuucaaaauguuugacauucauugaagaaucaauacauacaaacuuugaggcgugauuu

SEQ ID NO: 68096 - RNA, 64 nt, Homo Sapiens
gacaaauaugccaguuuauuugaaaggaugacaaucaauacaaugaaaguguauguaaacuacc

SEQ ID NO: 68097 - RNA, 64 nt, Homo Sapiens
cugcuccuuugaaauuugggauaaaacauuaaauucaauacauaugaguuucagauaaaacauu

SEQ ID NO: 68098 - RNA, 64 nt, Homo Sapiens
acuuuaggucuaagucuugcauccacacacugcaucaauacauacaaacuucuuuuaaaacaau

SEQ ID NO: 68099 - RNA, 64 nt, Homo Sapiens
auaaaaaggauagugaaucaauguuuugacgauuucaauacaagcuucaacuuuguguuuuuaa

SEQ ID NO: 68100 - RNA, 64 nt, Homo Sapiens
uaaauaggccaccaguuaauuccacgcuagacacucaauacaggacacccacgaauggcaaauc

SEQ ID NO: 68101 - RNA, 64 nt, Homo Sapiens
aacuuguacacaaauauuuaaauuaaggggcuggucaauacaaauuuugccuuguguaguuaaa

SEQ ID NO: 68102 - RNA, 64 nt, Homo Sapiens
aauaagugcauucuucugcuuuucaccccagcuaucaauacaugcaucuuuaucagcagccaaa

SEQ ID NO: 68103 - RNA, 64 nt, Homo Sapiens
gcauugggguugcaagauaaugcacaguccgagcucaauacaugucuucauguaccuguaugua

SEQ ID NO: 68104 - RNA, 64 nt, Homo Sapiens
aacagugcuuuguaaauuguguugucuucagcagucaauacaaauagauuuuuguuuuuguugu

SEQ ID NO: 68105 - RNA, 64 nt, Homo Sapiens
aggcucaaaacauuacccuaacaaaguaaaguuuucaauacaaauucuuugccuuguggauauc

SEQ ID NO: 68106 - RNA, 64 nt, Homo Sapiens
cauggaggaucaaacacugucagaauugcugaaaucaauacacaaagagauaaaguuuagcuuc

SEQ ID NO: 68107 - RNA, 64 nt, Homo Sapiens
aucaucaaguuaauugguaauucuuuuguauaauucaauacaugucauuacagauaaucaacau

SEQ ID NO: 68108 - RNA, 64 nt, Homo Sapiens
uuuuugaagauaguccauggaguaccagugagacucaauacauacuuuaaaucacgaauguuga

SEQ ID NO: 68109 - RNA, 64 nt, Homo Sapiens
aaaauuauuucugauacuauccauauuaaaugaaucaauacaagcugauugaauauaagcacaa

SEQ ID NO: 68110 - RNA, 64 nt, Homo Sapiens
auuauuuuagaaauaguaggaaguauugcagaagucaauacacaaaugugccaggcagaggugg

SEQ ID NO: 68111 - RNA, 64 nt, Homo Sapiens
gaaaguuuguagauauugccaagauuucccaggcucaauacaguguaauuauuuuauguuuuaa

SEQ ID NO: 68112 - RNA, 64 nt, Homo Sapiens
uuccauagggccauguugccagaaucuguauguaucaauacaggguuuuuccaagccaggaaac

SEQ ID NO: 68113 - RNA, 64 nt, Homo Sapiens
uuacugacaugacaaccuagaagcucaggccuauucaauacaauuuucacaaucacacugagac

SEQ ID NO: 68114 - RNA, 64 nt, Homo Sapiens
agccacuagccacaugugguuacagcuguaguguucaauacauuuauauuuauuucguauuguc

SEQ ID NO: 68115 - RNA, 64 nt, Homo Sapiens
cacacugcagaacccagaaccccacauuccccaaucaauacacauuucggcgaggguuuucuua

SEQ ID NO: 68116 - RNA, 64 nt, Homo Sapiens
uugaaauguuuaacauuuuauuuacaggaauuagucaauacaugugauguugcacuuucuguau

SEQ ID NO: 68117 - RNA, 64 nt, Homo Sapiens
ucauuguuuucauuauuugugaucauguugucuuucaauacaggcauaaaccuuccacucuuga

SEQ ID NO: 68118 - RNA, 64 nt, Homo Sapiens
gagcucuuaaagacagacuaaaaagaguaauaaaucaauacaacaacauuaaaagccagacuag

SEQ ID NO: 68119 - RNA, 64 nt, Homo Sapiens
gauccugaguuuucugggacaauuccagcuuuaaucaauacauuuuguuaaaugugccauaaaa

SEQ ID NO: 68120 - RNA, 64 nt, Homo Sapiens
gacuuguuaaaucuauucccaugccagaaucuuaucaauacauaagaaauuuaggaagauuagg

SEQ ID NO: 68121 - RNA, 64 nt, Homo Sapiens
uaaaagauuuuuaaagagcauauaaauaauuugaucaauacaacaguauagauaaaagaauuau

SEQ ID NO: 68122 - RNA, 64 nt, Homo Sapiens
ucauguagcuucugaaaaacugggaaccauggugucaauacauaggcacacauucuauucaucg

SEQ ID NO: 68123 - RNA, 64 nt, Homo Sapiens
guacuuccucccagcauugcuuagggaauaauauucaauacacaucuccccuccucuauuccuu

SEQ ID NO: 68124 - RNA, 64 nt, Homo Sapiens
auagcucuguugaaauuccuuucacuauugugagucaauacaccgcucaacaagucuggguaua

SEQ ID NO: 68125 - RNA, 64 nt, Homo Sapiens
ccuuugaauuuuuuaucugcuuauuuugccaaaaucaauacaauuccuaaaacaauccugacuu

SEQ ID NO: 68126 - RNA, 64 nt, Homo Sapiens
aacuauaacauucaauagugugucuuuacauauuucaauacagagcuagguacuaauuugcaga

SEQ ID NO: 68127 - RNA, 64 nt, Homo Sapiens
ugugaaucuauacaaagugauaauggccuggggcucaauacagggaggauuugauauauaugcu

SEQ ID NO: 68128 - RNA, 64 nt, Homo Sapiens
ucaaacaauuuaaauauuuuaaaguuuaaaauucucaauacaaauuuuuacaauuuaaugagaa

SEQ ID NO: 68129 - RNA, 64 nt, Homo Sapiens
ugggauuucuacuuucaaagacagaaguucugacucaauacaucgccugugccucggcucacuu

SEQ ID NO: 68130 - RNA, 64 nt, Homo Sapiens
cuaagaucauguuccaagcuaacugaaucccacuucaauacacacucaugaacuccugauggaa

SEQ ID NO: 68131 - RNA, 64 nt, Homo Sapiens
guauugauguaugugcugaaucuucacagacuugucaauacacaggcaguauucuaaaauagca

SEQ ID NO: 68132 - RNA, 64 nt, Homo Sapiens
uuauauagaggcuucuauuucucuuaagucagcaucaauacaacggccggaguuucuguuuuug

SEQ ID NO: 68133 - RNA, 64 nt, Homo Sapiens
guugggugaggguaaagcuuuucuauaaucaagcucaauacaccaaggaaacuggauccagaau

SEQ ID NO: 68134 - RNA, 64 nt, Homo Sapiens
cuccgugccgagggcugcaugcuaccgcacuaagucaauacaugggcuccccgauucgcagcug

SEQ ID NO: 68135 - RNA, 64 nt, Homo Sapiens
gacaaguacaacuccauuagggaagaggagaaacucaauacaaaaggaccaagaaaaccaaaac

SEQ ID NO: 68136 - RNA, 64 nt, Homo Sapiens
auuuaauuuuuuaaguuauccuuuaguaguauguucaauacaucauaaucaaaaaguaaacuuu

SEQ ID NO: 68137 - RNA, 64 nt, Homo Sapiens
ccauaggcucacagaaaaaggaaaaccuaaaguuucaauacaagcccucagcaccacagcucaa

SEQ ID NO: 68138 - RNA, 64 nt, Homo Sapiens
cuuucccacagucuuuuauauaauuaaauauaugucaauacacauuagaaucagauuugaaaaa

SEQ ID NO: 68139 - RNA, 64 nt, Homo Sapiens
uuuuuaaguuuuguuuuuaucuugccuguuggcuucaauacauuugagaauacgcugaagaggg

SEQ ID NO: 68140 - RNA, 64 nt, Homo Sapiens
gaaaaucagugucaacucagaagugacugauuuaucaauacauggacaaaaaguaaaucauuga

SEQ ID NO: 68141 - RNA, 64 nt, Homo Sapiens
guuuuuaacaaaacagaacaacuaaaauuuaaauucaauacaugcauuauguaaugcuugcuuu

SEQ ID NO: 68142 - RNA, 64 nt, Homo Sapiens
ucauauuaauuucuaguacacauucuucuucacgucaauacacucuuccuuccauaugauaaau

SEQ ID NO: 68143 - RNA, 64 nt, Homo Sapiens
gaagcucuuaggauuuucacaacacagaaagcccucaauacauugcacguugcaugacaucugg

SEQ ID NO: 68144 - RNA, 64 nt, Homo Sapiens
guugauggcauugugccauugcuucugauauguuucaauacauuaucuuuaaaacuagauucuu

SEQ ID NO: 68145 - RNA, 64 nt, Homo Sapiens
cuguaauuugacauucugggauagacagcuacugucaauacaugccaaguauugccucucugca

SEQ ID NO: 68146 - RNA, 64 nt, Homo Sapiens
uuugucuucauuuuucaacauuuauuucagaauaucaauacaguuauaguggcagcauaaagug

SEQ ID NO: 68147 - RNA, 64 nt, Homo Sapiens
uuuuauuuuaucacuugccggcccgagguuccugucaauacagggggugcccaggacggucugu

SEQ ID NO: 68148 - RNA, 64 nt, Homo Sapiens
uuauucuuuuauuucccucuguauaacugcaucuucaauacaaguaucaguauauuaaauaggg

SEQ ID NO: 68149 - RNA, 64 nt, Homo Sapiens
auuauugucauaaugcauuauuccauguguggugucaauacauuuuagcggacaaagaagaaac

SEQ ID NO: 68150 - RNA, 64 nt, Homo Sapiens
uauucuuuacaacagcaaccaaagaaaacauaccucaauacacucaaaacugaagacauagagg

SEQ ID NO: 68151 - RNA, 62 nt, Homo Sapiens
gcuaggauucuagagaauugauuauaaaauauuuucaauacauccaacauugcacuucucau

SEQ ID NO: 68152 - RNA, 64 nt, Homo Sapiens
ccuguaacagguguggggacacagcagugaguaaucaauacagacaagguucugcccuuaugga

SEQ ID NO: 68153 - RNA, 64 nt, Homo Sapiens
cuuuugucucccaagggaagaaccggaauuugggucaauacauccugccccuaagcuggggugg

SEQ ID NO: 68154 - RNA, 64 nt, Homo Sapiens
auugucugccuguuuuucuugaugcaagaggaugucaauacaagagaacauugguagguaacaa

SEQ ID NO: 68155 - RNA, 64 nt, Homo Sapiens
auucacucuagaaacaauuacuucuaagagcuguucaauacagugcauguuccauuauacgugu

SEQ ID NO: 68156 - RNA, 64 nt, Homo Sapiens
cagcccaaccaucgguccacauuuuaccaaagcaucaauacaacaggcccagagcgaggaaagg

SEQ ID NO: 68157 - RNA, 64 nt, Homo Sapiens
uaacagugcagggcaaaauauucacugggccaauucaauacaaacaaucucuuaaauuggguuc

SEQ ID NO: 68158 - RNA, 64 nt, Homo Sapiens
guuuaaguaauuugguuuaauaaucagaaaauauucaauacaguguuggauauucugucaugca

SEQ ID NO: 68159 - RNA, 64 nt, Homo Sapiens
uuugaggaauaagucuccuaacugagcauaaaagucaauacauaccgauuucaaaaccagauuc

SEQ ID NO: 68160 - RNA, 64 nt, Homo Sapiens
uauuuuuaaaaaugucuaaucagaaaacucauagucaauacaagucaguguccuccaugccaag

SEQ ID NO: 68161 - RNA, 64 nt, Homo Sapiens
uuuguguucuugguauucuuauacuguuuguguaucaauacaauaaucugacaaaguaauuuac

SEQ ID NO: 68162 - RNA, 64 nt, Homo Sapiens
guuaagcacaagaucuaaagaggugcugaccagcucaauacaaaauaauuguucauaucaauga

SEQ ID NO: 68163 - RNA, 64 nt, Homo Sapiens
uuccaauaaggggugcuucuguaauaagacuucuucaauacauccugugccauaaaauuucagu

SEQ ID NO: 68164 - RNA, 64 nt, Homo Sapiens
uauagauuucuaguacugcccaggaaaucuaauuucaauacauuuauccuagguuucaugaaag

SEQ ID NO: 68165 - RNA, 64 nt, Homo Sapiens
ccccacccccagguuuuugcccauccucccaaucucaauacagccugaauaaaccaagacaaga

SEQ ID NO: 68166 - RNA, 64 nt, Homo Sapiens
gauacuaauucaauguaauuuauaauuuucuaugucaauacaaaaauacaucacagccuucuca

SEQ ID NO: 68167 - RNA, 64 nt, Homo Sapiens
uuucuuuuuaauaaaaaggcaccuauaaaacaggucaauacaguacaggcagcacagagacccc

SEQ ID NO: 68168 - RNA, 64 nt, Homo Sapiens
uucuuuauguuuuuaugaccaaagcaguuucuugucaauacacgggguucaguaugacacagaa

SEQ ID NO: 68169 - RNA, 64 nt, Homo Sapiens
uguucugcuauaggguugguagcccacgugccacucaauacaaaugagaccuuacaaaugacuc

SEQ ID NO: 68170 - RNA, 64 nt, Homo Sapiens
uuauaaagccaagaauugcuuauaggagaacguaucaauacagugaaggaaauugggacuaguu

SEQ ID NO: 68171 - RNA, 64 nt, Homo Sapiens
guguuaauaugugucaucaguuuaugauacuucuucaauacaaaaucuguaaugcccugugauu

SEQ ID NO: 68172 - RNA, 64 nt, Homo Sapiens
gaagauggagaauuuggagcgucucauuguuuggucaauacacugcucucccagcuguccuccu

SEQ ID NO: 68173 - RNA, 64 nt, Homo Sapiens
aaagagcgggaguuaguauagaaacagccagaauucaauacaaccucacaguugagugggggaa

SEQ ID NO: 68174 - RNA, 64 nt, Homo Sapiens
uuacuugaauacauauagucuuuaacuuugaacaucaauacauuuuugcuuuuauuguugauuu

SEQ ID NO: 68175 - RNA, 64 nt, Homo Sapiens
auauuuugaccuuaccauuauaauuuuuaaacucucaauacaauacauuuuuaaaaauugcucu

SEQ ID NO: 68176 - RNA, 64 nt, Homo Sapiens
aucuuauuaaacaaagauccguucuuuauuaaaaucaauacauugagcaauaugaaagggaaau

SEQ ID NO: 68177 - RNA, 64 nt, Homo Sapiens
acuguuaaaaucauuugcaauagacauaauuaauucaauacacuauugagaaaugauggaauaa

SEQ ID NO: 68178 - RNA, 64 nt, Homo Sapiens
aauagaacaaguagccuauuaaauuaauuuuucuucaauacaaucauuuuaaugagucagagaa

SEQ ID NO: 68179 - RNA, 64 nt, Homo Sapiens
cuauguaaaauuuuuacuaauugaaugugugaauucaauacaggcauuacugguaaagccucau

SEQ ID NO: 68180 - RNA, 64 nt, Homo Sapiens
cuaauaacuaagcuucuauuaaguacaaguugccucaauacaugugaagaagacacaagaauca

SEQ ID NO: 68181 - RNA, 64 nt, Homo Sapiens
ccauguacuuggugcuuugguauauguucuaccuucaauacaucuuucccuuucucuucuucau

SEQ ID NO: 68182 - RNA, 64 nt, Homo Sapiens
aaaacugucuauuuuuagcccucuaaaguuaaagucaauacaaguuuccagggacgacuguccc

SEQ ID NO: 68183 - RNA, 64 nt, Homo Sapiens
aaauagauaacuucguaaccaccagggggcagauucaauacaucacagaauggcugaggaagau

SEQ ID NO: 68184 - RNA, 64 nt, Homo Sapiens
uuauuguggaggaggaggaucuaauauauaauauucaauacaauuguaauguagaaauauaaga

SEQ ID NO: 68185 - RNA, 64 nt, Homo Sapiens
acccaucuccccagucagacaagguuuauacguuucaauacauacugcauucugugcuacacaa

SEQ ID NO: 68186 - RNA, 64 nt, Homo Sapiens
aggcuggggugggcccugucauucgugguugauuucaauacacucaagugccauucauccuuua

SEQ ID NO: 68187 - RNA, 64 nt, Homo Sapiens
cugcacuaugauuugcuuuaaaaaauaaggaaauucaauacaaagaauauacuccauugaaagg

SEQ ID NO: 68188 - RNA, 64 nt, Homo Sapiens
uagggguguauuguuucccauucaaagaaacaucucaauacacuauaaaauuaaauauuuuugu

SEQ ID NO: 68189 - RNA, 64 nt, Homo Sapiens
guucaaaauuaaauuguuuagaauuugauguauuucaauacacuuccauuugggggauuuuuaa

SEQ ID NO: 68190 - RNA, 64 nt, Homo Sapiens
aaacaagaaagacgcacuuuggcuuauaauucuuucaauacagauauauuuucuuucucuuccu

SEQ ID NO: 68191 - RNA, 64 nt, Homo Sapiens
aagauagucagugauaaccacugaccagaugcuaucaauacacuauguguccuuuuuagaauaa

SEQ ID NO: 68192 - RNA, 64 nt, Homo Sapiens
guacaugaaaaaaugaaaaggaguuuaguucauuucaauacauuuuuuuauauuauaagugauu

SEQ ID NO: 68193 - RNA, 64 nt, Homo Sapiens
cuccgauccucacucuugaauuugugcccacugcucaauacagcuugaacagcgcucccugugg

SEQ ID NO: 68194 - RNA, 64 nt, Homo Sapiens
cccuccccucucccugccaaaaggcaguuacauaucaauacagagacucaaggucacuagaaau

SEQ ID NO: 68195 - RNA, 64 nt, Homo Sapiens
caacagccagacagggcuccagggcuugucccagucaauacagaguucccucugcugucuggcc

SEQ ID NO: 68196 - RNA, 64 nt, Homo Sapiens
uucuuucaauuucuguuuugcaauaaaagguaccucaauacauguggaacuuacguucuuauac

SEQ ID NO: 68197 - RNA, 64 nt, Homo Sapiens
auagaacacaauuaaaaucucuuaaaaucaaguaucaauacaaaacccagacuagaauaggguu

SEQ ID NO: 68198 - RNA, 64 nt, Homo Sapiens
gugcugcugugugcuuuuuuuuucccuuugugagucaauacauaaguggucaugggccacugcu

SEQ ID NO: 68199 - RNA, 64 nt, Homo Sapiens
cggggaggaaauaccaaaugcauuguuguucugcucaauacaucucacuuguuucuaauaaaga

SEQ ID NO: 68200 - RNA, 64 nt, Homo Sapiens
ccguucaggaucccggcuacauaaucuguggggcucaauacaaaauaaaaauguaggggcuccu

SEQ ID NO: 68201 - RNA, 64 nt, Homo Sapiens
uuuugacauguuauguuguggucaucuuuucaugucaauacauagauuaaucuuuuauuucaaa

SEQ ID NO: 68202 - RNA, 64 nt, Homo Sapiens
augccuggcaaauuaccugacacagagcagacauucaauacauuuuaguuuccuuguuucucug

SEQ ID NO: 68203 - RNA, 64 nt, Homo Sapiens
uucauuaucugaguugcauacccccuccuggcaaucaauacagcuggacccugcuucacccuca

SEQ ID NO: 68204 - RNA, 64 nt, Homo Sapiens
gucauuuuguuagcuugcaaaugggagacucaguucaauacaugauagaguuaaaaacuaaaga

SEQ ID NO: 68205 - RNA, 64 nt, Homo Sapiens
uuaaauaaaaucucuauauuugugcuguaaaaauucaauacagugcguugugacaaacaugcaa

SEQ ID NO: 68206 - RNA, 64 nt, Homo Sapiens
cugcccuugcagucccuauugggggccauccuucucaauacagcgccccaagcucaucacacca

SEQ ID NO: 68207 - RNA, 64 nt, Homo Sapiens
guauucuauguggagaccuugcaccuuguaaucaucaauacauccaccaaaaauauauaaugua

SEQ ID NO: 68208 - RNA, 64 nt, Homo Sapiens
agauuugauuuuuuuaaaaaagccugcgaccuauucaauacauuaugcuuaaauuagcaguuuc

SEQ ID NO: 68209 - RNA, 64 nt, Homo Sapiens
cagauuugaaguaaaauaauucagcucacaggcaucaauacaacguggggagaaauguaaacaa

SEQ ID NO: 68210 - RNA, 64 nt, Homo Sapiens
aauauuuuuuuuuaaucugcugccauauuguagcucaauacaaugugaauuuguuuuucguuuu

SEQ ID NO: 68211 - RNA, 64 nt, Homo Sapiens
uaguggggacuagugaaugacuugaccugugaccucaauacaauaaaugugaucccccacccaa

SEQ ID NO: 68212 - RNA, 64 nt, Homo Sapiens
gugaacucacuuuuuuuuuucaccauguuguagcucaauacaauaaaagcaaaguaaauccugc

SEQ ID NO: 68213 - RNA, 64 nt, Homo Sapiens
cacugauggaaugcuuccuugauacauuacuuguucaauacagcuugggugauuauaucuugau

SEQ ID NO: 68214 - RNA, 64 nt, Homo Sapiens
acgcauuuuggauguuauuauuaagaaccaaaugucaauacagaauucauguugccgguuuccc

SEQ ID NO: 68215 - RNA, 64 nt, Homo Sapiens
auuucuuuucuuuuaguuuagaagacaaaaaauuucaauacagauacuucuuuuagaaguaaau

SEQ ID NO: 68216 - RNA, 64 nt, Homo Sapiens
gggugucguucuuuuccaacuguaauuccccacuucaauacaaaugcagagggugaccacaguc

SEQ ID NO: 68217 - RNA, 64 nt, Homo Sapiens
uguucuaauauuuauuuuuauggcaucucauuuuucaauacaugcucuuuugauuaaagaaacu

SEQ ID NO: 68218 - RNA, 64 nt, Homo Sapiens
gucucauuauuuuuguuuuuauuuaacccuuucuucaauacaaaaagccaacaaaccaagacua

SEQ ID NO: 68219 - RNA, 64 nt, Homo Sapiens
gaauaaccuucguguccaccugugggggacugauucaauacauaugcacguccacagcagagaa

SEQ ID NO: 68220 - RNA, 64 nt, Homo Sapiens
uuuauauuucaagaauaaaguacuaagauugugcucaauacacagaaaaguuucaaaccuacua

SEQ ID NO: 68221 - RNA, 64 nt, Homo Sapiens
uaaaaagauguuacugaggaccuagaagaaaugcucaauacauacuuugaaagcaaaaauacaa

SEQ ID NO: 68222 - RNA, 64 nt, Homo Sapiens
ccaagcccuggagacccauuaccaccguuaacccucaauacagcucugcuaguaagggauucgu

SEQ ID NO: 68223 - RNA, 64 nt, Homo Sapiens
uguucaucuuuugggagggaauaagcuagagccaucaauacaauuccgcuuguggggaaauuua

SEQ ID NO: 68224 - RNA, 64 nt, Homo Sapiens
aacaauugaaauauuuugucuuaaaucacuugguucaauacaugcuuauuuguuuuaaaaccug

SEQ ID NO: 68225 - RNA, 64 nt, Homo Sapiens
uuaaauuauaacguuuuggcuuaagugucuuuuaucaauacaaugauaagacaccuuaauccug

SEQ ID NO: 68226 - RNA, 64 nt, Homo Sapiens
aaggccccucucuacaucugcuuugugcucccacucaauacaaaaagcuuaggagcccuggagc

SEQ ID NO: 68227 - RNA, 64 nt, Homo Sapiens
cacacagacauauauauauaugacauugaauggaucaauacacauugucuggguuccaaaauau

SEQ ID NO: 68228 - RNA, 64 nt, Homo Sapiens
ugaccccaagucccccggccauuucagugggaugucaauacacuaguagcacaccugccccugc

SEQ ID NO: 68229 - RNA, 64 nt, Homo Sapiens
aaaauaaacagugcuuuauauaaaauggacauuuucaauacauaguuuuuauuuugaagacuuu

SEQ ID NO: 68230 - RNA, 64 nt, Homo Sapiens
cuuggagucaaaaggcaaauguuucaggaucagaucaauacaauucaagcauggaacaaagcau

SEQ ID NO: 68231 - RNA, 64 nt, Homo Sapiens
augagggaaaguaaauccucaugaggaaaaguacaaauggaaaucguauuaauuugugaggcag

SEQ ID NO: 68232 - RNA, 64 nt, Homo Sapiens
uuugacauuugcaccuuaggagaggcagauguuaaaauggaauccaaagaccaccuagggcggg

SEQ ID NO: 68233 - RNA, 64 nt, Homo Sapiens
caaacacacaguucgucucugaggaaaguaaaauaaauggaauaagaguaaauuggguaaggag

SEQ ID NO: 68234 - RNA, 64 nt, Homo Sapiens
cccagagacaugcaagucaugggucacaccugacaaauggaaggaguuccucuaacauuugcaa

SEQ ID NO: 68235 - RNA, 64 nt, Homo Sapiens
cugacaaauggaaggaguuccucuaacauuugcaaaauggaaauguaauaauaaugaaugucau

SEQ ID NO: 68236 - RNA, 64 nt, Homo Sapiens
aauuuuaaaaucaggaaagacuugguuuuucucaaaauggaaauaaagguuguuuuaauaucua

SEQ ID NO: 68237 - RNA, 64 nt, Homo Sapiens
uauauacaaaaauauuuuccuuuacuuaauuaagaaauggaauuacucuuaaugaaacuuuaau

SEQ ID NO: 68238 - RNA, 64 nt, Homo Sapiens
uuuaaacuuugcacuccaaaugcaugauaauuuaaaauggaagaauggcuugaaaugcuauguc

SEQ ID NO: 68239 - RNA, 64 nt, Homo Sapiens
auacuucaacuauauuauuauuauaugcacauugaaauggaauuucuuugccuaaauaacaguu

SEQ ID NO: 68240 - RNA, 64 nt, Homo Sapiens
uugaagagaacaccuggacaaaggcugcauggucaaauggaauccaccccaguccuauuugucc

SEQ ID NO: 68241 - RNA, 64 nt, Homo Sapiens
uuuauucgcaacucaaauacaauguagaaaacaaaaauggaacaaggacaggaaaguaacauua

SEQ ID NO: 68242 - RNA, 64 nt, Homo Sapiens
caaauauuaauguuaugguacuguaauuuccacuaaauggaaccagaaauguguuuauaaucua

SEQ ID NO: 68243 - RNA, 64 nt, Homo Sapiens
uacuguucuauuugcaauauaccuagcacauuucaaauggaaacagagaauacugacaucuuca

SEQ ID NO: 68244 - RNA, 64 nt, Homo Sapiens
ugcuguuuuauacauuugcaacaauuucucuuguaaauggaaugguuugggguuuuuaaauaag

SEQ ID NO: 68245 - RNA, 64 nt, Homo Sapiens
aaugcuuuuauguauuucaaaacuuucauauguuaaauggaaauuguuuuaaauguguuugagu

SEQ ID NO: 68246 - RNA, 64 nt, Homo Sapiens
ucccccucaccuucaauaagguuuuucaaaaaggaaauggaaacuuuuuaaccaauuugugaau

SEQ ID NO: 68247 - RNA, 64 nt, Homo Sapiens
uuaaauuauuuuuaauaccaaaagaguucuuuugaaauggaacugauuaaaagggcagaggguc

SEQ ID NO: 68248 - RNA, 64 nt, Homo Sapiens
aaugcuauauuuaaaaacacgaaacaguauuuguaaauggaacuuugguaaaagaacuauuuug

SEQ ID NO: 68249 - RNA, 64 nt, Homo Sapiens
auucugagucacuaggcaauuaucaacacacacaaaauggaauaguuucaccaaagucuguuua

SEQ ID NO: 68250 - RNA, 64 nt, Homo Sapiens
acaaaggauucuuacuaacagaaaggugcuauguaaauggaaauucauuuugaaaaucuuggau

SEQ ID NO: 68251 - RNA, 64 nt, Homo Sapiens
uagagaacuugagcuuacuugcauguuuaaauugaaauggaacugaccaucaauaaaaaagaga

SEQ ID NO: 68252 - RNA, 64 nt, Homo Sapiens
agccuuuguuccuuucuggcacuucugccuugugaaauggaagcgcacuccacuugucagcugg

SEQ ID NO: 68253 - RNA, 64 nt, Homo Sapiens
ccugucgggacuucugggcuaagccauuggaaacaaauggaaaguacuaaagucauguggaaua

SEQ ID NO: 68254 - RNA, 64 nt, Homo Sapiens
ccauuaguguagaugucuguuuugugaggauaauaaauggaaugccaaaguauaacacuaucaa

SEQ ID NO: 68255 - RNA, 64 nt, Homo Sapiens
uugagacaaaaccuuaacaaugcuauccaguuauaaauggaaucugccauuaauccuaauucag

SEQ ID NO: 68256 - RNA, 64 nt, Homo Sapiens
acacagucagcccaggaaaaagagaagcagggccaaauggaaagaacacauaauaaacaagaaa

SEQ ID NO: 68257 - RNA, 64 nt, Homo Sapiens
ggcugagaagagccagaucaaccucauugauaagaaauggaagccccugcaagguguggggaac

SEQ ID NO: 68258 - RNA, 64 nt, Homo Sapiens
auuagguggugguagagaagcaaguaaaaaggcuaaauggaagggcaaguuuccaucaucuaua

SEQ ID NO: 68259 - RNA, 64 nt, Homo Sapiens
uaaaauacauuguauauauguguaugcacaguaaaaauggaaacuauauugaccuaaaugugaa

SEQ ID NO: 68260 - RNA, 64 nt, Homo Sapiens
aauaagacacucaaauaugaguacaaaugccuuaaaauggaauugaaaaacucuuuauuuuccc

SEQ ID NO: 68261 - RNA, 64 nt, Homo Sapiens
uaaaauaaugcugcaaacuuaauguucuuaugcaaaauggaacgcuaaugaaacacagcuuaca

SEQ ID NO: 68262 - RNA, 64 nt, Homo Sapiens
ccauuucuggauucuagucccuuuuucagugaauaaauggaacagaagaaggccuaaucucucu

SEQ ID NO: 68263 - RNA, 64 nt, Homo Sapiens
cugguucauacuguggucccgaguccgagaaggaaaauggaauuaauacuucuuuuuuccccug

SEQ ID NO: 68264 - RNA, 64 nt, Homo Sapiens
auuguuccuuagagcuucuccuucugaugcuuugaaauggaagggaugaauugagcuccuggcc

SEQ ID NO: 68265 - RNA, 64 nt, Homo Sapiens
agugacucuuggauuacagcucuagaagaacaagaaauggaaaucguaagaggcaacagagcca

SEQ ID NO: 68266 - RNA, 64 nt, Homo Sapiens
auaccuaacaggcaggcucuuuaucucaugaguaaaauggaauaugguuuggggcuucauuuau

SEQ ID NO: 68267 - RNA, 64 nt, Homo Sapiens
agagguuauauacaacuacacauccaaauuugauaaauggaaccgacuaauucucuuucuagcc

SEQ ID NO: 68268 - RNA, 64 nt, Homo Sapiens
uccuguuugcaggcccagaggagccaagucauuaaaauggaaguggauucuggauggccgggcu

SEQ ID NO: 68269 - RNA, 64 nt, Homo Sapiens
gcugcaaacauuguacauccaaauuaaaggaaaaaaauggaaaccaucaguuguugcuguguga

SEQ ID NO: 68270 - RNA, 64 nt, Homo Sapiens
ucuuuuagcaauucaguuuaauaaaacuaguuaaaaauggaauuucucuuccuuuacuuagccu

SEQ ID NO: 68271 - RNA, 64 nt, Homo Sapiens
ggaugaaaauaaugggaguaaccucuuccaugaaaaauggaaaguguaauucaggcuugugucu

SEQ ID NO: 68272 - RNA, 64 nt, Homo Sapiens
gccuuggaugucuaucaguguaagugugauuuagaaauggaaugucacugacuugauugaggga

SEQ ID NO: 68273 - RNA, 64 nt, Homo Sapiens
uccuaugaaacuguauuguaaggcacucugaaacaaauggaaagugucuuuuuuuaaaaaguua

SEQ ID NO: 68274 - RNA, 64 nt, Homo Sapiens
uggggaaaacauuuuuuaucauuuucuauuaagaaaauggaaaacuuaaauaugguguuaaaaa

SEQ ID NO: 68275 - RNA, 64 nt, Homo Sapiens
auuaagaaaauggaaaacuuaaauaugguguuaaaaauggaaauauaugugauauuugcauuau

SEQ ID NO: 68276 - RNA, 64 nt, Homo Sapiens
auuuaaaugugaggaaagauaggacuguaggaagaaauggaauaauggaacuaaagauagaagg

SEQ ID NO: 68277 - RNA, 64 nt, Homo Sapiens
aaagauagaaggaggacuguugaaggguuauuuaaaauggaacuagauaaauggguauguagga

SEQ ID NO: 68278 - RNA, 64 nt, Homo Sapiens
ccccggaccaguuacauucguuccuggcaaaagcaaauggaaauggucuccugucuccagccug

SEQ ID NO: 68279 - RNA, 64 nt, Homo Sapiens
aauuugaaauaauuucaccaggcuaaauaaaggaaaauggaaaccaguuaagaggcacagugua

SEQ ID NO: 68280 - RNA, 64 nt, Homo Sapiens
auggcagugguuugaaaaacuaaaacagaaaaaaaaauggaagccaacacaucacucauuuuag

SEQ ID NO: 68281 - RNA, 64 nt, Homo Sapiens
guuuaaaauguuagauguuuuuaauuuuuuaaauaaauggaauacuuuuuuuuuuuuuuuaaag

SEQ ID NO: 68282 - RNA, 64 nt, Homo Sapiens
aauccuugaaaauaguuuuuaaaaccuauuagguaaauggaaauuuuuauaacuuuuaaaugga

SEQ ID NO: 68283 - RNA, 64 nt, Homo Sapiens
accuauuagguaaauggaaaauuuuauaacuuuuaaauggaaaaucuguuuucucuuuuuaaau

SEQ ID NO: 68284 - RNA, 64 nt, Homo Sapiens
uuuuagaaggaacuuugcucgggcuuggaauucuaaauggaagaacagaaauaugaaugucgag

SEQ ID NO: 68285 - RNA, 64 nt, Homo Sapiens
aguuguugaauaguuccccauauaucugcaaacaaaauggaaauauggaaggaaccaccugaau

SEQ ID NO: 68286 - RNA, 64 nt, Homo Sapiens
aaccaccugaauuauaucugguggcuugacauucaaauggaagguuguuuuauagcuucaaagu

SEQ ID NO: 68287 - RNA, 64 nt, Homo Sapiens
auagaugcuauuguucugauggcccggcugaauaaaauggaaauucuaguuuguuagaauuaug

SEQ ID NO: 68288 - RNA, 64 nt, Homo Sapiens
aagguuuuaaucauucuucuauaaaauacauuuaaaauggaaaaauacuuaauaucacuaaaua

SEQ ID NO: 68289 - RNA, 64 nt, Homo Sapiens
gauaaaccauuuuuuacaaauguguuuuauacaaaaauggaauugauuggcuagguuucucccg

SEQ ID NO: 68290 - RNA, 64 nt, Homo Sapiens
gcauagacaauuacuguagauuuuaacaacaguuaaauggaaaaauaauggggauauguggaau

SEQ ID NO: 68291 - RNA, 64 nt, Homo Sapiens
caaaacugaaauagccucccuauuuauauaauacaaauggaaauuaaauguuguauuucauauu

SEQ ID NO: 68292 - RNA, 64 nt, Homo Sapiens
guagucacagagaaauuuagccaaauuacuuaagaaauggaaaauauugacuuuuggaaaccaa

SEQ ID NO: 68293 - RNA, 64 nt, Homo Sapiens
cuugguguccuuuuuucucccaaacuuuauuuagaaauggaaggaguucaauuuuuucuuguuc

SEQ ID NO: 68294 - RNA, 64 nt, Homo Sapiens
gacuguacuuaaugccacugaacuguacacuuuaaaauggaaaauuuauauguauuuuuaccac

SEQ ID NO: 68295 - RNA, 64 nt, Homo Sapiens
auuagcuuguuacaauucuauuguuaugcacuuuaaauggaauacacuuaacaggaaguuuagu

SEQ ID NO: 68296 - RNA, 64 nt, Homo Sapiens
uucuaauauaaugacuuauauucuauagguuuuuaaauggaauuuauauuuaaaucauuuuaac

SEQ ID NO: 68297 - RNA, 64 nt, Homo Sapiens
aagaacaaaauaugaugagaauuugaaaugguaaaaauggaaagauggugggcaauauugcaau

SEQ ID NO: 68298 - RNA, 64 nt, Homo Sapiens
uacauaaauaaucauuuucacccccuagagaaauaaauggaauaccugauucaaauuaccuaga

SEQ ID NO: 68299 - RNA, 64 nt, Homo Sapiens
gaauuuauuggaguaacucaaauugccugaggaaaaauggaaaaauuauccaccagucgauuca

SEQ ID NO: 68300 - RNA, 64 nt, Homo Sapiens
agucagccagaaaucacagauacugcuuucacuuaaauggaaacaauucuccgauaaugcuuug

SEQ ID NO: 68301 - RNA, 64 nt, Homo Sapiens
agcagccauugggaaauugggagaaaugauaaacaaauggaaaaagaagaugucccuaaccuac

SEQ ID NO: 68302 - RNA, 64 nt, Homo Sapiens
gggagcuacugauggacaugugaaaaguaaguauaaauggaauaaaauuaauuaggcuaauagg

SEQ ID NO: 68303 - RNA, 64 nt, Homo Sapiens
agaaauaacauuugugaaaugguaaguagaaacgaaauggaaacuuuggcaaaagcuggugccu

SEQ ID NO: 68304 - RNA, 64 nt, Homo Sapiens
uuauuuauuuucacaguugacaccagcucuuaauaaauggaaacuguauuuugaucugcauuga

SEQ ID NO: 68305 - RNA, 64 nt, Homo Sapiens
ugaauuuuuaaaauauaugcacuuuaaaauaguaaaauggaaaguggaaaagaauuuuacaugc

SEQ ID NO: 68306 - RNA, 64 nt, Homo Sapiens
gaauuuuacaugcacuuuaaaauuaccuaccaaaaaauggaaaaguauuucccuucuucaaauu

SEQ ID NO: 68307 - RNA, 64 nt, Homo Sapiens
ugggcagugcugagucccugcaauagagcuaaugaaauggaagcuuguacugaaggcucagcag

SEQ ID NO: 68308 - RNA, 64 nt, Homo Sapiens
caaaauaaauuuuccaauuguucugaaauccaagaaauggaaucuuuucuugacaggcacaccu

SEQ ID NO: 68309 - RNA, 64 nt, Homo Sapiens
auguuuucuaaguuuuaauauugaauaauaaaaaaaauggaauuuauuuauuauguauaaaaug

SEQ ID NO: 68310 - RNA, 64 nt, Homo Sapiens
uccggaucugaaauuagccauguggcuaaagcagaaauggaacuuagacuaauagaaaggaggc

SEQ ID NO: 68311 - RNA, 64 nt, Homo Sapiens
auuaguauggccuauuuuuaauaagaacuuuugaaaauggaagggcaguuuuuggaauuacuug

SEQ ID NO: 68312 - RNA, 64 nt, Homo Sapiens
cuuguucuugcacaacuguauuauuugguuaugaaaauggaaucacauaaaauguuuuauuuug

SEQ ID NO: 68313 - RNA, 64 nt, Homo Sapiens
uuaugguggaccuauuacccuauggguaagaaauaaauggaaauaugacaucggauguuucagc

SEQ ID NO: 68314 - RNA, 64 nt, Homo Sapiens
acaccacucagugugauaauugugucuacagcuaaaauggaaauaguuuuaucuguacaguugu

SEQ ID NO: 68315 - RNA, 64 nt, Homo Sapiens
aaagcaagagguggcaacaaagcacaggcugacaaaauggaagcagaagcuaaaagccacuggc

SEQ ID NO: 68316 - RNA, 64 nt, Homo Sapiens
aaugucuaaggaggaggaggcauccccccucgggaaauggaaggucacccaccucuccagggcc

SEQ ID NO: 68317 - RNA, 64 nt, Homo Sapiens
gcaaauaauggaacauaaacaaaaauuuaaaaagaaauggaauguacaccuaccauguacccau

SEQ ID NO: 68318 - RNA, 64 nt, Homo Sapiens
gcacuucauauauucucauuaugcuuuguuuaagaaauggaaugaaauagcuuacagacagucu

SEQ ID NO: 68319 - RNA, 64 nt, Homo Sapiens
aaaagugaagugguaaauaguguacuaguuguuaaaauggaaauuuuccuaaggccaaggauaa

SEQ ID NO: 68320 - RNA, 64 nt, Homo Sapiens
gucucuuugauuuaaaauaaaccuguuuguuaggaaauggaaugauggacuacuuuuguaacuu

SEQ ID NO: 68321 - RNA, 64 nt, Homo Sapiens
cauucuccaacgauauacaagauaaggaugcuuaaaauggaaauauggaacaucccaagaagag

SEQ ID NO: 68322 - RNA, 64 nt, Homo Sapiens
gaacuuacuuaaaaauuggguucagauggguagcaaauggaauaguagaauuuguguucauaag

SEQ ID NO: 68323 - RNA, 64 nt, Homo Sapiens
agaaaucuaggaaguugugcuguaauuuuaggcgaaauggaagcuugacuucauauacaaagcc

SEQ ID NO: 68324 - RNA, 64 nt, Homo Sapiens
uuuuuaaaugaaggcaaauauguagauagcuguaaaauggaauaagcaccaagggcugccuauc

SEQ ID NO: 68325 - RNA, 64 nt, Homo Sapiens
ggcuuuagcgguucuugccucauuuugggauucuaaauggaagcuuucaacagagcauuccauu

SEQ ID NO: 68326 - RNA, 64 nt, Homo Sapiens
auaacuuuguuucucaaauuuucguugucagaacaaauggaaggagaauauuauuuagacuaau

SEQ ID NO: 68327 - RNA, 64 nt, Homo Sapiens
ggaauguauccccugccuauuuuccuuguguaacaaauggaaaacauucuccccugugagaaau

SEQ ID NO: 68328 - RNA, 64 nt, Homo Sapiens
cugcaugggaaagcaaagcagaaaacagugccccaaauggaaaaaagauacucacacagaacaa

SEQ ID NO: 68329 - RNA, 64 nt, Homo Sapiens
aucacugagcaguuguuuauacucaaaguaaaauaaauggaaaugagauagaaaaauuuuuauu

SEQ ID NO: 68330 - RNA, 64 nt, Homo Sapiens
cgcuggagaaacaaaauugccaugacuguuuggcaaauggaaaccaccauguucaaccaucugu

SEQ ID NO: 68331 - RNA, 64 nt, Homo Sapiens
ugcaggcauauaucaagaacacuuuuguuaucauaaauggaacuuaagggacauagaggauuua

SEQ ID NO: 68332 - RNA, 64 nt, Homo Sapiens
ugauaguuuuuuaaauuaaauaauucuaaggucaaaauggaacugaaucauuuaguugacucua

SEQ ID NO: 68333 - RNA, 64 nt, Homo Sapiens
aucuaugggaugugugguucuauaaaccucaguuaaauggaauuuaugguaaugcucuuacgga

SEQ ID NO: 68334 - RNA, 64 nt, Homo Sapiens
uuguguaaauucacaaaaauaguuuuaaagcuauaaauggaauuaguaauguguuauguaguac

SEQ ID NO: 68335 - RNA, 64 nt, Homo Sapiens
ccaguugcauuuagagaugaguugaguaaguggaaaauggaaaggcaaguguacuuuguggagu

SEQ ID NO: 68336 - RNA, 64 nt, Homo Sapiens
cuuguugcacuguucccaggcuggaagaucuucuaaauggaaugcaaugcuucuuguguguguu

SEQ ID NO: 68337 - RNA, 64 nt, Homo Sapiens
cuuucuccuguuuguuugcuuguuaguuuguuuaaaauggaaaaagggguucucuguguucugc

SEQ ID NO: 68338 - RNA, 64 nt, Homo Sapiens
uucaagggugauaggaaccauuauguugagcccaaaauggaaguaauaauaaaugccuccugga

SEQ ID NO: 68339 - RNA, 64 nt, Homo Sapiens
caaaaaucugaaagaaacguaaaugcaauuuuuaaaauggaaaaacaaaccuccaaguagcucc

SEQ ID NO: 68340 - RNA, 64 nt, Homo Sapiens
accucaccuccgcagcacccuuccucaguuuccaaaauggaaccccaggucuuccaagcucugc

SEQ ID NO: 68341 - RNA, 64 nt, Homo Sapiens
aaauaauggcuucacugaauacaauuuauaugguaaauggaaccuagcaugcaugcacaacaau

SEQ ID NO: 68342 - RNA, 64 nt, Homo Sapiens
guucucuuuccucugaagcaauaaggcacaugugaaauggaaauuuuuaucuaccaucaaccug

SEQ ID NO: 68343 - RNA, 64 nt, Homo Sapiens
ucaaaauaaaaggauggaggaagaucuacgaagcaaauggaaaacaaacaaaaaaagaggcagg

SEQ ID NO: 68344 - RNA, 64 nt, Homo Sapiens
accacugcuuaacgaaauaaaagaggaugcaaagaaauggaagagcauuccaugcucaugggua

SEQ ID NO: 68345 - RNA, 64 nt, Homo Sapiens
auggugcaguaguguggaguacuguaugcuggggaaauggaaccgcuuuggcccucaagagccc

SEQ ID NO: 68346 - RNA, 64 nt, Homo Sapiens
uuaguacuuucuuccugauggcagauaacuccacaaauggaaauauaaggccagaaacuucuga

SEQ ID NO: 68347 - RNA, 64 nt, Homo Sapiens
auauccuuccacccuugacugccaaaaaugugugaaauggaaaguugauggcagcagggccgac

SEQ ID NO: 68348 - RNA, 64 nt, Homo Sapiens
cucuauagauuugccaguuuggggcauuucauauaaauggaaucaucuguauguaagugguuaa

SEQ ID NO: 68349 - RNA, 64 nt, Homo Sapiens
cuuucuaccuaaauuuauuuguuauauguucacaaaauggaaggauuuuauuggagaaaagcaa

SEQ ID NO: 68350 - RNA, 64 nt, Homo Sapiens
augaugaagauauagucacuuucggaagaaaugaaaauggaaacaaguuagauuuuccuggagc

SEQ ID NO: 68351 - RNA, 64 nt, Homo Sapiens
gaggaagauugauuuucuccugcuugccuugcccaaauggaaugcugaauagccccccacugaa

SEQ ID NO: 68352 - RNA, 64 nt, Homo Sapiens
agcuugcuguguguguguguuguuccuccacucuaaauggaauggcuacugaauggcuugcagu

SEQ ID NO: 68353 - RNA, 62 nt, Homo Sapiens
ugggcaggcugcagccucaugccaugucucucucccacuaccugaugggcacauggacaggc

SEQ ID NO: 68354 - RNA, 62 nt, Homo Sapiens
ggccuugcaguggguguguggggaagucacugucccacuaugggucuccacuacccagucac

SEQ ID NO: 68355 - RNA, 64 nt, Homo Sapiens
aguaguuggcgcccaauggggggucccugagacuugcauguaaaacuagucuagaugucuucuu

SEQ ID NO: 68356 - RNA, 64 nt, Homo Sapiens
ucuucuuuuuuuguaaguuuuauuuuuguaauugugcauguaaagcaucauugaaucaauggau

SEQ ID NO: 68357 - RNA, 64 nt, Homo Sapiens
uuaacuucuguuguguuuugaaucucuccagaguugcauguagauagcauuuauuucugugccc

SEQ ID NO: 68358 - RNA, 64 nt, Homo Sapiens
uucuugaacaggcaaaugaaagcuuauuauagaaugcauguauuuucuuuuaucuuuggaacau

SEQ ID NO: 68359 - RNA, 64 nt, Homo Sapiens
aguagaaucaaaggugcagcugacugagacgacaugcauguaagauccacaaaaugagacaaug

SEQ ID NO: 68360 - RNA, 64 nt, Homo Sapiens
acgacaugcauguaagauccacaaaaugagacaaugcauguaaauccaugcucauguucuaaac

SEQ ID NO: 68361 - RNA, 64 nt, Homo Sapiens
uugggaauaauauuauaaacccuuacaaauuuuaugcauguaucuacugcauccuucaacucuc

SEQ ID NO: 68362 - RNA, 64 nt, Homo Sapiens
uauuuuuacaguaaccuugaauucuucugaguuuugcauguauuaaauucaauuaaugcugaac

SEQ ID NO: 68363 - RNA, 64 nt, Homo Sapiens
ucaauuuaaaauguaccucuaugacauggaguuuugcauguagaccggugcuugguguccuugc

SEQ ID NO: 68364 - RNA, 64 nt, Homo Sapiens
uaucuaaacacccacauauaggugauauuuaauaugcauguaugugcagcuaaucuaaaaaacu

SEQ ID NO: 68365 - RNA, 64 nt, Homo Sapiens
aacuacccuaugaaauguaaacuccccuuggaaaugcauguauguaaaacacuggcaaugaccc

SEQ ID NO: 68366 - RNA, 64 nt, Homo Sapiens
aaucuuuuaugcuguuuaugauaagagcauguucugcauguauugaucccccauccccuccaga

SEQ ID NO: 68367 - RNA, 64 nt, Homo Sapiens
cauaucuacccagaauuaacuccauuccagucucugcauguaaucaguuuuauccacagaaaca

SEQ ID NO: 68368 - RNA, 64 nt, Homo Sapiens
auauuauuguauuuaaaauguguuucuuacagacugcauguaguuggguauaauuuuuauccag

SEQ ID NO: 68369 - RNA, 64 nt, Homo Sapiens
ucuggaugucaucugagguguuggucagcaacagugcauguaccguuagccauaguggguuccc

SEQ ID NO: 68370 - RNA, 64 nt, Homo Sapiens
cggcuacuuagguaugcuuaccccuccccaguugugcauguacccaggggggcaguuguggucg

SEQ ID NO: 68371 - RNA, 64 nt, Homo Sapiens
cuuuucucucaacauuguuugcuuuuugcucauuugcauguauauuugguuuuaaaaauauuaa

SEQ ID NO: 68372 - RNA, 64 nt, Homo Sapiens
uacauaacuauccucaucaucacaugugauaauaugcauguaaauuguuucuauaaaucaaaua

SEQ ID NO: 68373 - RNA, 64 nt, Homo Sapiens
uugguagcaaguaaugauuaguccuagcagauguugcauguaaagggaaaaaaaucaaauguca

SEQ ID NO: 68374 - RNA, 64 nt, Homo Sapiens
ucuagcauucugccuacaguaguuucuccauaugugcauguacauuuuggaugaccucagcuug

SEQ ID NO: 68375 - RNA, 58 nt, Homo Sapiens
aggaguuacccaguccuugagaaggaggugcauguacguaccuaugugcauacacuua

SEQ ID NO: 68376 - RNA, 64 nt, Homo Sapiens
uuacuuuuugucauuauaaccauaacuaaauaucugcauguaccaagagucccuaagccacccc

SEQ ID NO: 68377 - RNA, 64 nt, Homo Sapiens
ggauuucauaaaggcuaauuaaauauagaaguguugcauguauaaaacccuugguguucauucu

SEQ ID NO: 68378 - RNA, 64 nt, Homo Sapiens
uuuggaaauauucuuggcucaggccaaggaaaucugcauguauuagaaaauucauaacauauau

SEQ ID NO: 68379 - RNA, 64 nt, Homo Sapiens
auuaagagaagccauuaaaauuuuacuaaaauugugcauguaaauuaauugucagcauuccaug

SEQ ID NO: 68380 - RNA, 64 nt, Homo Sapiens
cuuucagaagauuuuucuaacuuagggucugucuugcauguauuacaaccagaauacaguguuu

SEQ ID NO: 68381 - RNA, 64 nt, Homo Sapiens
uugagugaguagggaaaaaauauaaagcuuuacuuagauauaacuauauuuaagucuuuauaga

SEQ ID NO: 68382 - RNA, 64 nt, Homo Sapiens
gcuuuacuuagauauaacuuuauuuaagucuuuauagauauaaaaauucauaaauacaaaaaua

SEQ ID NO: 68383 - RNA, 64 nt, Homo Sapiens
ugcuuacauguaaagaaaggacccuuuuaaaaccuagauauaaaaucaacugucaaaaacuuca

SEQ ID NO: 68384 - RNA, 64 nt, Homo Sapiens
aacaugaaggaauggggaagcuauucaauauugcuagauauauuuuuauuuccauuuauaauuu

SEQ ID NO: 68385 - RNA, 64 nt, Homo Sapiens
gaugagagacugggaagggaaaagcauauauauauagauauauagagauauagauauauauaca

SEQ ID NO: 68386 - RNA, 64 nt, Homo Sapiens
gggaaaagcauauauauauagauauauagagauauagauauauauacaggaaacaccgcauccu

SEQ ID NO: 68387 - RNA, 64 nt, Homo Sapiens
cacauauauauacucacacauacaucuauagauauagauauacagauaucuauggauauagauc

SEQ ID NO: 68388 - RNA, 64 nt, Homo Sapiens
uauacacacauauauauacuuagaucuacaucuauagauauagauagauagauaucuauggaua

SEQ ID NO: 68389 - RNA, 64 nt, Homo Sapiens
gccauuuggucuuaauucugcugacgaguguccauagauauaaaaaaugcaaaugugcauuuuu

SEQ ID NO: 68390 - RNA, 64 nt, Homo Sapiens
uauguuauuuagucauuaugugcuuccuuacacauagauauaauacuacaguaaagucuguuuc

SEQ ID NO: 68391 - RNA, 64 nt, Homo Sapiens
agcagaacuauaaaaaaaaaauucucaaaacaucacaucacauuuuguucuaaaugcucuaaac

SEQ ID NO: 68392 - RNA, 64 nt, Homo Sapiens
acauuagcagaacuauaaaauaaacauucucaaaacaucacaucgugguuuguucuaaaugcuc

SEQ ID NO: 68393 - RNA, 64 nt, Homo Sapiens
aaaaagccagugccuauugaucacaaaaaaagccacaucacaaacaauaguguggaaagccaca

SEQ ID NO: 68394 - RNA, 64 nt, Homo Sapiens
aaaagccacaucacaaaaaauaguguggaaagccacaucacaaagggauucuggacuucuacaa

SEQ ID NO: 68395 - RNA, 64 nt, Homo Sapiens
cccauuauucagagcgcguaagaauugguguaagacaucacaaugcagcuggccgcccaguuug

SEQ ID NO: 68396 - RNA, 63 nt, Homo Sapiens
cccauuauucagagcgcguagaauugguguaagacaucacaaucagcuggccgcccaguuuga

SEQ ID NO: 68397 - RNA, 64 nt, Homo Sapiens
uguuuuucagguauugaguuucagauguaauuuaacaucacauuuuaaauacauuuuuaaaauu

SEQ ID NO: 68398 - RNA, 64 nt, Homo Sapiens
aauauauaauucagucucuaaguuaauauguuguacaucacaauaguauuauuguuauauauau

SEQ ID NO: 68399 - RNA, 64 nt, Homo Sapiens
uauuaauuuacaaauuagagaaagugucauugugacaucacaggcuuuccuugauuguuaugaa

SEQ ID NO: 68400 - RNA, 64 nt, Homo Sapiens
ucaaaagugaguuuucuuauuuccguuaacagaaacaucacaauauuauaguaacguauugucc

SEQ ID NO: 68401 - RNA, 64 nt, Homo Sapiens
auucuuuggguucuuuguaacauacuucuacuggacaucacagacauaugcaauguuuuuauua

SEQ ID NO: 68402 - RNA, 64 nt, Homo Sapiens
agaaacauaugcaauguuuuaacaauugcuaaagacaucacacuguuugcauuuuacuucagua

SEQ ID NO: 68403 - RNA, 64 nt, Homo Sapiens
cagaacucagaacccaagucugaucaggagaaaaacaucacacaaauuccaauugagaagcauu

SEQ ID NO: 68404 - RNA, 64 nt, Homo Sapiens
ugaacaaugagaacacauggagacaggaaggggaacaucacacucuagggacuguuguggggug

SEQ ID NO: 68405 - RNA, 64 nt, Homo Sapiens
uacaaaugugaagaauguggcaaagcuuuuaaccaguccucacaccuuaugagacauaagaaaa

SEQ ID NO: 68406 - RNA, 64 nt, Homo Sapiens
uacaaaugugaacaguguggcaaggucuuuaagaaguccucaacucuuacugcacauaagauca

SEQ ID NO: 68407 - RNA, 64 nt, Homo Sapiens
caccuucuccacggcagcgacgccucuucccaccaguccucagccagcaugccaguguggagag

SEQ ID NO: 68408 - RNA, 64 nt, Homo Sapiens
caucuugguagguauacauuacaucccaguccucaguccucagucuugggaccucaagccccca

SEQ ID NO: 68409 - RNA, 64 nt, Homo Sapiens
ccucagucaucuugguaggugcccccaacaucccaguccucaguacuacuucuugggaccucaa

SEQ ID NO: 68410 - RNA, 64 nt, Homo Sapiens
gguccuuuuuggauucuagguccugagucugugaaguccucaguguagaaaacacuuccuccuc

SEQ ID NO: 68411 - RNA, 64 nt, Homo Sapiens
gcucccccuccccaccccgcccauggcucgggucaguccucaucagucucgccagcgcccaccc

SEQ ID NO: 68412 - RNA, 64 nt, Homo Sapiens
uacaaaugugaagaauguggcaaagccuuuauccaguccucaacuccuaguaaacauaauuaau

SEQ ID NO: 68413 - RNA, 64 nt, Homo Sapiens
uacaacugugaagaauguggcaaagcuuuuaaccaguccucaaacuuuauugaacaaaauaauu

SEQ ID NO: 68414 - RNA, 64 nt, Homo Sapiens
uacaaaugugaagaaugugacaaagccuuuaaccaguccucaauuuuuacuaaacauaagaaaa

SEQ ID NO: 68415 - RNA, 64 nt, Homo Sapiens
uaugauugugaaaaauauggcaaaggcuuuaacuaguccucaguucuuaacacacauacgauaa

SEQ ID NO: 68416 - RNA, 64 nt, Homo Sapiens
ccuuaaaugggguagguggguuuuaaacucuuaaaccuggaacuauggucugggugccaccugu

SEQ ID NO: 68417 - RNA, 64 nt, Homo Sapiens
aguuccugucuccugaaugaggaguucucuaggaaccuggaaugaaacccucaggucugagaua

SEQ ID NO: 68418 - RNA, 64 nt, Homo Sapiens
uucuacaguaauuaauaugccacauucccuaauuaccuggaaaggaaauggccucaggcaauuu

SEQ ID NO: 68419 - RNA, 64 nt, Homo Sapiens
aaucguuucucagaaguacugucauuugaaugagaccuggaacagcuuacagaaaugacugccg

SEQ ID NO: 68420 - RNA, 64 nt, Homo Sapiens
uuggacauguguguggcucagcaguaugucuuggaccuggaaagggcuauuacaaagcaguacu

SEQ ID NO: 68421 - RNA, 64 nt, Homo Sapiens
ccauugcugccauggcacuuugcuccauguauggaccuggaaggugggcugaccuacuaaaacc

SEQ ID NO: 68422 - RNA, 64 nt, Homo Sapiens
uuugugcuuuacaaaacugugaaggauuguggucaccuggaacaggucuccaaucuauguuagc

SEQ ID NO: 68423 - RNA, 64 nt, Homo Sapiens
gggaaaaacaauuuuauuaccugcuuaaugguccaccuggaacuaaaagggauacuauuuucua

SEQ ID NO: 68424 - RNA, 64 nt, Homo Sapiens
ccuggggaaggacugacagaacaaagccuucuggaccuggaaagcugacacagccccagacccc

SEQ ID NO: 68425 - RNA, 64 nt, Homo Sapiens
cuccggucaccuccuucuuguaggagggagggauaccuggaagacgacucccacuuccagaagc

SEQ ID NO: 68426 - RNA, 64 nt, Homo Sapiens
uuuuaguacuugaugacucuaauuacaugaaugcaccuggaaugacauuuguaacagaagacgg

SEQ ID NO: 68427 - RNA, 64 nt, Homo Sapiens
aaguacucaggauagugccuggcauguaggaagcaccuggaaaauauucgcugugauuaccauc

SEQ ID NO: 68428 - RNA, 64 nt, Homo Sapiens
cuuuaacagaaggaaaugccgacaggguuccaggaccuggaacaaucagugagugggucccauc

SEQ ID NO: 68429 - RNA, 64 nt, Homo Sapiens
aaauaucccuuuuuuuccccggcuucaaucuuaaaccuggaaacuacaguauaaugacuacuau

SEQ ID NO: 68430 - RNA, 64 nt, Homo Sapiens
ggaagugcaaccacccaaugucucuggaagugccaccuggaagugccaccuggaagugucucug

SEQ ID NO: 68431 - RNA, 64 nt, Homo Sapiens
cccaaugucucuggaagugccaccuggaagugccaccuggaagugucucuggaagagcacccac

SEQ ID NO: 68432 - RNA, 64 nt, Homo Sapiens
guuuuuuguuuuuguuuuuggcagcgauggaauuaccuggaacaugacaauuuacaggaaugua

SEQ ID NO: 68433 - RNA, 64 nt, Homo Sapiens
uguuggagggaagggggaguaauguggcaggcggaccuggaaugccucugcccucucccugcag

SEQ ID NO: 68434 - RNA, 64 nt, Homo Sapiens
ucccacgagcugaugcacccccaggcuucaaaccaccuggaaugcacagcucagggaagcuggu

SEQ ID NO: 68435 - RNA, 64 nt, Homo Sapiens
cccugcuucagugcccaccugggcccccccagggaccuggaaacagugcuggggaguucugccu

SEQ ID NO: 68436 - RNA, 64 nt, Homo Sapiens
cucacugagauccauguaaggggcuccucuucccaccuggaacuugugaguggggacccaugau

SEQ ID NO: 68437 - RNA, 64 nt, Homo Sapiens
ggcccaggaccauggcuggggaggauaugucagcaccuggaaguggagugcaggcugcagcgcc

SEQ ID NO: 68438 - RNA, 64 nt, Homo Sapiens
gaugauuuuggccucauuacuuuaccacccccacaccuggaaagcauauacuauauuacaaaau

SEQ ID NO: 68439 - RNA, 64 nt, Homo Sapiens
acuuggugauauguccuauauuggcuaaauugaaaccuggaauuguggggcaaucuauuaauag

SEQ ID NO: 68440 - RNA, 64 nt, Homo Sapiens
agcauuggcauuauuuucaaagcuccucaauacuaccuggaaaaaacaaacaagcacucagccc

SEQ ID NO: 68441 - RNA, 64 nt, Homo Sapiens
ugccagaguuggcuaugccucgagaucaggaccaaccuggaaaaaccuacagacuaccaccuuu

SEQ ID NO: 68442 - RNA, 64 nt, Homo Sapiens
caucucccuuuuuuaaacaaccgcuggguccucgggggcuuacuggaggcugguuaaguugcag

SEQ ID NO: 68443 - RNA, 64 nt, Homo Sapiens
gaccaccacagggagcucagcaggugccgugugaggggcuuaaugucauugcugcaaaccucgg

SEQ ID NO: 68444 - RNA, 64 nt, Homo Sapiens
uguuuuggcaguacugaaauuguaauuaacucugggggcuuacuccuauuuuccucuacauuuu

SEQ ID NO: 68445 - RNA, 64 nt, Homo Sapiens
cugaggaaaccuaggaaaucuggugaugcaacugggggcuuacucaaagccacaccacagucgg

SEQ ID NO: 68446 - RNA, 64 nt, Homo Sapiens
uaggaaugacauaccugggcucaggggaagcaagggggcuuagaauuugugggguauucccaaa

SEQ ID NO: 68447 - RNA, 64 nt, Homo Sapiens
uaaaacugcucugcacuguuuaauccauuuccaaggggcuuagaaaagcuaacaaggguguguc

SEQ ID NO: 68448 - RNA, 64 nt, Homo Sapiens
aacuccaaaccuccuguuagcuguuauuucuauuuuuguagaaguaggaagugaaaauagguau

SEQ ID NO: 68449 - RNA, 64 nt, Homo Sapiens
auacaguggauuaauuaaaugcagcgaaccaauauuuguagaaggguuauauuuuacuacugug

SEQ ID NO: 68450 - RNA, 64 nt, Homo Sapiens
auaggggagugggaggaaggcccagggaaaacauuuuguagaguuggccuuuucaaggccuagu

SEQ ID NO: 68451 - RNA, 64 nt, Homo Sapiens
aaaacauaaaauuuguccagagccuucaugcaauuuuguagauugauaggaaguuucucgaguu

SEQ ID NO: 68452 - RNA, 64 nt, Homo Sapiens
gggucaccuacuagaagagauguuugcacugcuuuuuguagagaacuucagggcuuggaggugg

SEQ ID NO: 68453 - RNA, 64 nt, Homo Sapiens
aggagaugagaguuucuagugcacuacaagacacuuuguagaagcugacugacccuccugaacu

SEQ ID NO: 68454 - RNA, 64 nt, Homo Sapiens
acugucacguauauaaauugcuucuucauuuuaauuuguagaaguacuuuacaguaggaaacgc

SEQ ID NO: 68455 - RNA, 64 nt, Homo Sapiens
uuuuguuuuuuuuuaauugugucuuacagucaaguuuguagauuuucauaagccacaauuuuaa

SEQ ID NO: 68456 - RNA, 64 nt, Homo Sapiens
auugcaaauuaaccacacaauuauauuuuuggguuuuguagaaucuaccuguaauaagugugga

SEQ ID NO: 68457 - RNA, 64 nt, Homo Sapiens
aaauguuucagugccuagucaucucuggcaaguuuuuguagaaaaacuauacagcgaagagaca

SEQ ID NO: 68458 - RNA, 64 nt, Homo Sapiens
caugagccaccgagccuggccaauuuuuguguuuuuuguagagacgagguuuugccauguugcc

SEQ ID NO: 68459 - RNA, 64 nt, Homo Sapiens
uuccaauuuuucauuuuuuguuuguuauuuguuuuuuguagacagcacucugucacccaggcug

SEQ ID NO: 68460 - RNA, 64 nt, Homo Sapiens
acauuuaauagcuuguuaccguuauucuuucacuuuuguagauuaccuuucauuuucucuuuau

SEQ ID NO: 68461 - RNA, 64 nt, Homo Sapiens
auuuuuucugaauccuuauguugauuuugaugccuuuguagaauacaaugccaguuugcaauag

SEQ ID NO: 68462 - RNA, 64 nt, Homo Sapiens
uggagauucacucgacuaauuaauuuuuguguuuuuuguagagaugcacaccaccacaccuggc

SEQ ID NO: 68463 - RNA, 64 nt, Homo Sapiens
aaaggcaaugaugugggacuuauaaucccugagauuuguagacuggaaauaaaggaaaaucaag

SEQ ID NO: 68464 - RNA, 64 nt, Homo Sapiens
ucuaaugaagaaaaacgagcagucaauuuuacaauuuguagaacccccugaagacgaggugaaa

SEQ ID NO: 68465 - RNA, 54 nt, Homo Sapiens; identical to SEQ ID NO: 67612

SEQ ID NO: 68466 - RNA, 64 nt, Homo Sapiens
aaggaagaagaguaaaauuggcauauuuagguuuuuuguagaagaaagauacaagugaaaauua

SEQ ID NO: 68467 - RNA, 64 nt, Homo Sapiens
acaccugucuaaaaaguauguauuuuuaaauuuuuuuguagagacaggaucucacuauguucuc

SEQ ID NO: 68468 - RNA, 64 nt, Homo Sapiens
ucuugugacuuaguagacugaugaugauauccauuuuguagacucaucaacaugugguuggccu

SEQ ID NO: 68469 - RNA, 64 nt, Homo Sapiens
aaucagacucuugccuuugcacuuuuuuuuaacuuuuguagauaauuuuuguuaauuuguuuug

SEQ ID NO: 68470 - RNA, 64 nt, Homo Sapiens
ucauuguauaauguguauuuuuaaaaagugugucuuuguagauuaaaaucaacaacgcuugaag

SEQ ID NO: 68471 - RNA, 64 nt, Homo Sapiens
uuugucugaugcauuucauuuguauucauguuuguuuguagaugcacgugcuuuuguaugccca

SEQ ID NO: 68472 - RNA, 64 nt, Homo Sapiens
uuuuauauaaaaaugaaauaaaauguuaucuauuuuuguagauaaaauacugucugguuuuugu

SEQ ID NO: 68473 - RNA, 64 nt, Homo Sapiens
cucggucuugaagucauuugguuauuuaucuuuuuuuguagauuauuagucccuguuauaacca

SEQ ID NO: 68474 - RNA, 64 nt, Homo Sapiens
auguauuuugcuugggcacccugaguaaguccucuuuguagaugggcacaagcuggcugccaug

SEQ ID NO: 68475 - RNA, 64 nt, Homo Sapiens
gagauagucgaagcuaaaacgaagauggugaacuuuuguagaauuaagucuauguuuaaauuuu

SEQ ID NO: 68476 - RNA, 64 nt, Homo Sapiens
cagggucucacuguguugccuaaauaaauacuuuuuuguagagaacacuuggguaauuaaaaaa

SEQ ID NO: 68477 - RNA, 64 nt, Homo Sapiens
uuugcuguccagugugguaggugacgauggauauuuuguagacugcugucuaauagaacuuucu

SEQ ID NO: 68478 - RNA, 64 nt, Homo Sapiens
uggaguuuugccauguggucgcccagcuaauuuuuuuguagagacuacagguguucgccaccau

SEQ ID NO: 68479 - RNA, 64 nt, Homo Sapiens
uaaagggaucacauuugaagaaagccaacagagauuuguagauuuguuauacugcccauccccu

SEQ ID NO: 68480 - RNA, 64 nt, Homo Sapiens
cauuguaguagucuagcuuauuuccccacaagcuuuuguagaugauacuucacucuucuuuuuu

SEQ ID NO: 68481 - RNA, 64 nt, Homo Sapiens
acuuucucauuaagauauauauauagaaccacuuuuuguagauuaguauaagaaaaauauuuac

SEQ ID NO: 68482 - RNA, 64 nt, Homo Sapiens
auguauuuguuuuuuugugcugugagaauugauguuuguagauuaauaaucauuuuguuuagaa

SEQ ID NO: 68483 - RNA, 64 nt, Homo Sapiens
uuaugugaguaugcaaauauaagaguccccgauguuuguagacccagcauuaaacauauaugug

SEQ ID NO: 68484 - RNA, 64 nt, Homo Sapiens
augacuucuuguuugaauauaagaaugucagaaauuuguagaaaaaggagaucagagaaagcca

SEQ ID NO: 68485 - RNA, 64 nt, Homo Sapiens
ucaauugauccccaaccugcgaggcagucaccuauuuguagaaccugggaaaugggcuaggccu

SEQ ID NO: 68486 - RNA, 64 nt, Homo Sapiens
auucauaacauauauaggccucugaucggucguguuuguagaaauucuucuucucucucuuuuu

SEQ ID NO: 68487 - RNA, 64 nt, Homo Sapiens
cccuucacaccuggcugauuuuucaaaaaguuuuuuuguagaaacagggucucaccauguuguc

SEQ ID NO: 68488 - RNA, 64 nt, Homo Sapiens
ugaauacauucagaaucaccuccucuccccaaaauuuguagaaauaguuuuugaggaagccaaa

SEQ ID NO: 68489 - RNA, 64 nt, Homo Sapiens
cgcugcagcaaaaacuguuacuguguuuauuauauuuguagaaguauuagaaaaauauucuauu

SEQ ID NO: 68490 - RNA, 64 nt, Homo Sapiens
aucuuggacuucaggaaaugcaauuaugauaacguuuguagacagucacgucauguuagguguu

SEQ ID NO: 68491 - RNA, 64 nt, Homo Sapiens
ucaguauaguacugucaagggaagccauacacuuuuuguagacauggguaccaaaaauacccaa

SEQ ID NO: 68492 - RNA, 64 nt, Homo Sapiens
agaccaagaauucaagaugguugguggccagauuuuuguagacagagauggugauuuguuuagu

SEQ ID NO: 68493 - RNA, 64 nt, Homo Sapiens
gacuauggacauucaaaucaugggagaaaauaauuuuguagauuauguuccauugcuaaugaau

SEQ ID NO: 68494 - RNA, 64 nt, Homo Sapiens
aaguauauuuuuaaaguuguuuuauaagagagacuuuguagaagugccuagauuuugccagacu

SEQ ID NO: 68495 - RNA, 64 nt, Homo Sapiens
cuaaaagguaaauuaugggaaucacugaaauauuuuuguagauuaauuguuguaacauugucuu

SEQ ID NO: 68496 - RNA, 64 nt, Homo Sapiens
uuguguucauaaguucagauugggacuugagugguuuguagaauggaaggagggaauuuaaaaa

SEQ ID NO: 68497 - RNA, 64 nt, Homo Sapiens
agaaaagggagaucugcaucgaggccucauaauguuuguagaucagagaccucuguaguccugg

SEQ ID NO: 68498 - RNA, 64 nt, Homo Sapiens
uuagcuuuugucuaggcaacauuaaguuuuugauuuuguagaaagacucucuuaauaaaacugc

SEQ ID NO: 68499 - RNA, 64 nt, Homo Sapiens
cugucaggucaaaauauuuaaguggaaaucacuauuuguagaaauaacagauuccuuuauaugu

SEQ ID NO: 68500 - RNA, 64 nt, Homo Sapiens
gugauaacuuuaaauaaaacucaaauuuuuacuguuuguagacaggaaugcuguccuagagaac

SEQ ID NO: 68501 - RNA, 64 nt, Homo Sapiens
uggguccuagaaccuguugaguuucuaaugaauauuuguagaaucucauaaaacaguuuaaaua

SEQ ID NO: 68502 - RNA, 64 nt, Homo Sapiens
guuuuucauaaagaagagauuaauaguaaguguauuuguagaaaaagugugguuguacuuacgu

SEQ ID NO: 68503 - RNA, 64 nt, Homo Sapiens
uuuuucugugcauuguaaguuaaauacuucccuuuuuguagauauuauuagaaagcuaaaugga

SEQ ID NO: 68504 - RNA, 64 nt, Homo Sapiens
aaguaugcauucuuaucaccuaguauauaguuaguuuguagagugauuuccccccaguuucuug

SEQ ID NO: 68505 - RNA, 64 nt, Homo Sapiens
cuucaauuauaguuagucuuggugaaguaagauguuuguagacuuuagaguucuuuaauucuug

SEQ ID NO: 68506 - RNA, 64 nt, Homo Sapiens
ggcuuuuuaacuucugcagacaucaguauuauuauuuguagaaaaucguuauuauauucaucau

SEQ ID NO: 68507 - RNA, 64 nt, Homo Sapiens
uguaguccugugauugucauaacgucagagaauuuuuguagaaaaacaccuuucuaaccuucuu

SEQ ID NO: 68508 - RNA, 64 nt, Homo Sapiens
ugagucucacuauguugcccucuauuauuuauuuuuuguagagaggccaacucacauuuuucuu

SEQ ID NO: 68509 - RNA, 64 nt, Homo Sapiens
gggucucacuguguugcccagcuaauuauuauuuuuuguagacaggcaugcaucgccacgucug

SEQ ID NO: 68510 - RNA, 64 nt, Homo Sapiens
ugugcugaguucuauaauauaagcugccauauauuuuguagacaaguauggcuccuccauaucu

SEQ ID NO: 68511 - RNA, 64 nt, Homo Sapiens
uuuuaacaccuuuuacucuucuuacuggugcuauuuuguagaauaaggaacaacguugacaagu

SEQ ID NO: 68512 - RNA, 64 nt, Homo Sapiens
uaaggaaaugguggcaugaagacccucucccuucuuuguagaauuaagauaacuuugauuuuau

SEQ ID NO: 68513 - RNA, 64 nt, Homo Sapiens
ggugugacuggaaagcaugauauucuaggguugguuuguagauucaaauaauccagaaauauac

SEQ ID NO: 68514 - RNA, 64 nt, Homo Sapiens
ccugagaugcuggcuguacucagccuuugcaauuuuuguagauguagcuuaggacgugaguuau

SEQ ID NO: 68515 - RNA, 64 nt, Homo Sapiens
gguggcuuuucaguuacagaguccaguggaccauuuuguagaaccaugcagcucccugcggaag

SEQ ID NO: 68516 - RNA, 64 nt, Homo Sapiens
augccaccacacccagcugauuaucauauuuuuuuuuguagagguggggaagugcagugaugca

SEQ ID NO: 68517 - RNA, 64 nt, Homo Sapiens
augccaccacacccagcugauuaucauauuuuuuuuuguagaggugggguuuuaccauucccag

SEQ ID NO: 68518 - RNA, 64 nt, Homo Sapiens
ugggguuucuccauguuggucacgcccagcuaauuuuguagagacgauuacaggaaugcaccac

SEQ ID NO: 68519 - RNA, 64 nt, Homo Sapiens
guucccauaaaaauauuuuauuagcaguuuuuguuuuguagacauuaauuuaaaaguauuucuc

SEQ ID NO: 68520 - RNA, 64 nt, Homo Sapiens
uccaccuggacugaugggcacaggaggcaccaauagcgauuauugggggcaaugcgaggucucc

SEQ ID NO: 68521 - RNA, 64 nt, Homo Sapiens
accauugugauuuguuccugccccaccuuaacugagcgauuaaccugugaacuuccuucuccug

SEQ ID NO: 68522 - RNA, 64 nt, Homo Sapiens
uuuuaaaugggcuuugagaaaaaaaacagaaacaagcgauuauuucaaaucaaccaaccaacuc

SEQ ID NO: 68523 - RNA, 64 nt, Homo Sapiens
cauuauaucaauaauugcauaauaggcaaccucuagcgauuaccauaauuuugcucauugaagg

SEQ ID NO: 68524 - RNA, 64 nt, Homo Sapiens
ugaguggugaaauaauguuuggagacauaaugaaagcgauuaacauuuggcaaaauauaauaaa

SEQ ID NO: 68525 - RNA, 64 nt, Homo Sapiens
uauugaguaugucagcuuuucaucguugaaguaaagcgauuacauauuggcgugacuguaaaca

SEQ ID NO: 68526 - RNA, 64 nt, Homo Sapiens
aacaggcaaaaggaagcaggaauggcuuuauugcagcgauuaaugugauauguugguagauucu

SEQ ID NO: 68527 - RNA, 64 nt, Homo Sapiens
ggaauuuucauuguucuauaacaacaacaacaaaagcgauuauuauuuuagagcaucucauuua

SEQ ID NO: 68528 - RNA, 64 nt, Homo Sapiens
ugagcccuugccgggccuuugaagagggaaagugagcgauuaguacuguugguugaacuaugcu

SEQ ID NO: 68529 - RNA, 64 nt, Homo Sapiens
uuuuuuuucuacauugaaaauacaagaccuuuguagcgauuagaagaccuuguuuugaggauuu

SEQ ID NO: 68530 - RNA, 64 nt, Homo Sapiens
auuuuucgcuugcgagcaaggcauguuauacagaagcgauuaggagguuaggcuuuaaaauaaa

SEQ ID NO: 68531 - RNA, 64 nt, Homo Sapiens
acuauuaaaaaaguaauaguauuacagaaaaaugagcgauuaaauaguaauggauacaauuaag

SEQ ID NO: 68532 - RNA, 64 nt, Homo Sapiens
uuuaucaaggaagucuucaaauuugauucuaaauagcgauuauaaucuccaacuuuauuuugaa

SEQ ID NO: 68533 - RNA, 64 nt, Homo Sapiens
ugguauaccagcucggcagaacaguuccccacccagcgauuagggagcugggcuggccaguaca

SEQ ID NO: 68534 - RNA, 64 nt, Homo Sapiens
aauuuaaaaaugggagaucagugagggucagcucagcgauuagaaugggugaagcagaugcaug

SEQ ID NO: 68535 - RNA, 52 nt, Homo Sapiens
gcaaaaguucagacucauaaaaagcgauuaagaggccuaugccuguaauuuc

SEQ ID NO: 68536 - RNA, 64 nt, Homo Sapiens
uuuuuuaauuuuaaauuuuuggcucccgaggggaagcgauuacuugaauuuguucuuacauuau

SEQ ID NO: 68537 - RNA, 64 nt, Homo Sapiens
aaagcaacaaagaaauccggagcgcaaugucagaagcgauuaugucgaccuuuagauuuuugaa

SEQ ID NO: 68538 - RNA, 64 nt, Homo Sapiens
auuauguaagcaaggagccuauauguuuaaaaauagcgauuaaaccacuuugauuuaguuuuaa

SEQ ID NO: 68539 - RNA, 64 nt, Homo Sapiens
gaucaaaaucaaaagguaauaaguaaucauggccagcgauuauugguugcaacaauaauucauc

SEQ ID NO: 68540 - RNA, 64 nt, Homo Sapiens
ccggcgguuagaaaugugcccacagcugaaagucagcgauuaugagcuggggaacaugucggug

SEQ ID NO: 68541 - RNA, 64 nt, Homo Sapiens
gaacguaaaauggagauguaguccaaaaggauuaagcgauuaaaucaaauauucucuuaucccg

SEQ ID NO: 68542 - RNA, 64 nt, Homo Sapiens
aucuaaaguguguuguugcuaggauuuuuuucugagcgauuauuuguaaccucagcucugggag

SEQ ID NO: 68543 - RNA, 64 nt, Homo Sapiens
auuuacuguguaauacacgaguuuaaaaauuaagagcgauuagcuguucacuuugguaacaggu

SEQ ID NO: 68544 - RNA, 64 nt, Homo Sapiens
agacaucuuuccugcauugcucacuuaaaugaaaagcgauuaaaauuuuauuuuuuacauaagg

SEQ ID NO: 68545 - RNA, 64 nt, Homo Sapiens
gacaauugcucugaagaaaggcuauugaaacucaagcgauuacaaaauccaaaacgauagugua

SEQ ID NO: 68546 - RNA, 64 nt, Homo Sapiens
uaaauuauuguuaaagaauagagagcugcccuucagcgauuauuggaacuugggaaaggaauca

SEQ ID NO: 68547 - RNA, 64 nt, Homo Sapiens
gugccucagccuccagaguaugccuccugguucaagcgauuauuucucagcucacugcaaccuc

SEQ ID NO: 68548 - RNA, 64 nt, Homo Sapiens
ugauuugcugguaggauuuuguacaguuuagagaagcgauuauuuauugugaaacuguucucca

SEQ ID NO: 68549 - RNA, 64 nt, Homo Sapiens
agaggcaggacggcagagccaugauuucccaccgagcgauuacgagaaccucuucccccaauag

SEQ ID NO: 68550 - RNA, 64 nt, Homo Sapiens
ggaaugcaccaccacgcccaaauucuccugccucagcgauuacacucgccucccugguucaagc

SEQ ID NO: 68551 - RNA, 64 nt, Homo Sapiens
cacacuaauuuucuuauagaguaaaugaguaagaauucaucauuuuuuccaucucccuucuccc

SEQ ID NO: 68552 - RNA, 64 nt, Homo Sapiens
uaugugugagggcuuuauucucaggcaguaguuuauucaucauuugguaagccccuccccacac

SEQ ID NO: 68553 - RNA, 64 nt, Homo Sapiens
auaaaauaacuuguucugaacagcuacugcuuuuauucaucaaaaauaacuuuuuuucaauugc

SEQ ID NO: 68554 - RNA, 64 nt, Homo Sapiens
gguuucauaccaacacaggcguccuaugugucacauucaucacaaaacaagaauugaguugaug

SEQ ID NO: 68555 - RNA, 64 nt, Homo Sapiens
cugcaugauaacuuugcagcugagauaguuccuaauucaucaacguaacaaacaaagcuauugg

SEQ ID NO: 68556 - RNA, 64 nt, Homo Sapiens
auaagaaaaucuuuuucucccaauuaauuuaccaauucaucauuuuuuuuuuuuuguagaacuc

SEQ ID NO: 68557 - RNA, 64 nt, Homo Sapiens
auccuuggcugaauuaaaauuuuaggaauaauaaauucaucagauacuuuuuaacuggcuucau

SEQ ID NO: 68558 - RNA, 64 nt, Homo Sapiens
ccaaaaacagcaggccaucuguccugcagugcucauucaucacuaugacauuuuuuucugauuu

SEQ ID NO: 68559 - RNA, 64 nt, Homo Sapiens
gugcuagaagguucgaugccucuggaaugcaugugauacucaucuccauuuuguuuccuugauu

SEQ ID NO: 68560 - RNA, 64 nt, Homo Sapiens
ccacccccggcccuuuguuugacuugcgucgucugauacucaguauuguagcuuuuuguccgca

SEQ ID NO: 68561 - RNA, 64 nt, Homo Sapiens
ggaacuccgguccgguucuuucucuggagcucuagauacucacuuuuugugccccccaaaugaa

SEQ ID NO: 68562 - RNA, 64 nt, Homo Sapiens
gaucagauaaauauagaaaaguaaaauggaaaaugauacucaauaccuaguuaaacucauuuca

SEQ ID NO: 68563 - RNA, 64 nt, Homo Sapiens
acuuuaauuuccuguguaguuuacacccagagcagauacucauaaaguauaaaguaaaaacuuu

SEQ ID NO: 68564 - RNA, 64 nt, Homo Sapiens
uucugaaucucuaccagcugcucccagaaucacagauacucaggaccaucucaggcauccaggc

SEQ ID NO: 68565 - RNA, 64 nt, Homo Sapiens
uacagauagucguacugaucaugagagacuggcugauacucaaaguugcaguuacuuagcugca

SEQ ID NO: 68566 - RNA, 64 nt, Homo Sapiens
cuugcuguccagagggaguacuagucuucugugugauacucauaugcaugagcuagaauuuguu

SEQ ID NO: 68567 - RNA, 64 nt, Homo Sapiens
cggauacccauuggaaugacaagcagagcaugcagauacucaugcuggcuuaccagucuccugg

SEQ ID NO: 68568 - RNA, 64 nt, Homo Sapiens
acuagacuaacauaacagguuggucccaguaauagauacucagcccccugggguucucugcaga

SEQ ID NO: 68569 - RNA, 64 nt, Homo Sapiens
accuguuuuaagaaaaaacaguuuuauauuguuugauacucagugagagagaccuucuuauauu

SEQ ID NO: 68570 - RNA, 57 nt, Homo Sapiens
gaggcacugggcucagccuguggagcagauacucaagaccuguggcgucgccaguga

SEQ ID NO: 68571 - RNA, 64 nt, Homo Sapiens
uuaggaggaccaugugguugcucagccaugcuuggauacucacagcugaaguggcuuagaaggc

SEQ ID NO: 68572 - RNA, 64 nt, Homo Sapiens
acaaaagaaagucauaaaacuuauacucuaaagugauacucagaaagaacuuuugaaaaacuuu

SEQ ID NO: 68573 - RNA, 64 nt, Homo Sapiens
gaaaucacgucacuauuuugugcaaauacuaguugauacucagucagaaaaauucaaguagcuu

SEQ ID NO: 68574 - RNA, 64 nt, Homo Sapiens
aggcugaggcaggagaaucgugccuguaauccaagauacucagguagccgggcgugguggugca

SEQ ID NO: 68575 - RNA, 64 nt, Homo Sapiens
agaaauaaaaaaugauguuuagcaauugaauguagauacucagauuuuuuguuaauuuagcuaa

SEQ ID NO: 68576 - RNA, 64 nt, Homo Sapiens
uacgggugaaaugaaagcuuuuuugcauguacuugauacucagucuguaaacucagacuucgcu

SEQ ID NO: 68577 - RNA, 64 nt, Homo Sapiens
uguuguaauuuuauacagauuauaugagggauaagauacucaucaaauugcaaauucuuuuuuu

SEQ ID NO: 68578 - RNA, 64 nt, Homo Sapiens
auugcauuucccaagugcuauugcaauaacaguugauacucauuuuagguaccaaaccuuuuga

SEQ ID NO: 68579 - RNA, 64 nt, Homo Sapiens
ugagaaugaagaguaucacagugacgaacaaaaugauacucagaagcaauuuugugaagaacag

SEQ ID NO: 68580 - RNA, 64 nt, Homo Sapiens
aaacuaaacaaucuugcuccuagaguuuauguuggauacucaauucuuaaccaaaaucuugguc

SEQ ID NO: 68581 - RNA, 64 nt, Homo Sapiens
accacaacauuagcacggugccuugugcagaauagauacucaauaugugaauaugugucuacua

SEQ ID NO: 68582 - RNA, 64 nt, Homo Sapiens
cccauuugucccagugcugacuucuugggguccugauacucauuacauugagaaacuaaacccu

SEQ ID NO: 68583 - RNA, 64 nt, Homo Sapiens
aaugcaaauucauuauuuaaucaaaaaaugcauugauacucauuaguuuuauuuucuuaugaaa

SEQ ID NO: 68584 - RNA, 64 nt, Homo Sapiens
gucuaacaagaaagacauggugccauaaaucccugauacucaaacuuuuuaacucugacaccgu

SEQ ID NO: 68585 - RNA, 64 nt, Homo Sapiens
uuugcuuaaacccuuuaguguagugcuuuucagugauacucacggccacauugagacuuucuuc

SEQ ID NO: 68586 - RNA, 64 nt, Homo Sapiens
uuguaccuauauauucauaucauuuuggauaagggauacucagcaaaacacuucuggucccuag

SEQ ID NO: 68587 - RNA, 64 nt, Homo Sapiens
uuuuuggaauccugaccuuagaggcguuugagaggauacucauccauguauaccagaggcuuag

SEQ ID NO: 68588 - RNA, 64 nt, Homo Sapiens
aaguagccuuaugacaaacaucuacauaaaucuagauacucauuuugucuuacuuucagauuuc

SEQ ID NO: 68589 - RNA, 64 nt, Homo Sapiens
ucccuuauauaaaaugguguucccaaaaucugaggauacucaaggguuccaggacuccugaaga

SEQ ID NO: 68590 - RNA, 64 nt, Homo Sapiens
agugacuucaaagggaaaucguacaacaguuuuagauacucauuaaguugauuaaaaaccugca

SEQ ID NO: 68591 - RNA, 64 nt, Homo Sapiens
aauguaguuugcacuuaagcaugucuaccuggcagauacucagaagaaacacacuggauugggu

SEQ ID NO: 68592 - RNA, 64 nt, Homo Sapiens
uucaguaacuaguguuaaaguguuuacaguuuaagauacucauuaauuuggaaagcaguuuuaa

SEQ ID NO: 68593 - RNA, 64 nt, Homo Sapiens
gcuaguaacccuaccgaguuuuauauaugagugggauacucaaucuggccuuaaaaagauacac

SEQ ID NO: 68594 - RNA, 64 nt, Homo Sapiens
gggcuccugcucuccuucccgaugcugcucuagggauacucaggccaguuucuguuccuugugg

SEQ ID NO: 68595 - RNA, 64 nt, Homo Sapiens
cagguuucuugcuucuggcugcauucgcgguuaagauacucaaguugcaccauucuuucuuggu

SEQ ID NO: 68596 - RNA, 54 nt, Homo Sapiens
ucagucaagacaaugcuuaguucagauacucaaaaaugucuucacucugucuua

SEQ ID NO: 68597 - RNA, 64 nt, Homo Sapiens
uuaaaaucuaacaggucuguuuggcccauugauagauacucaaauggugucuccuucugguuau

SEQ ID NO: 68598 - RNA, 64 nt, Homo Sapiens
aacuuauuaaauuaaugcauacuggaaguacuuugauacucaaguuguuucacaagauuuauaa

SEQ ID NO: 68599 - RNA, 64 nt, Homo Sapiens
guggaaaggaucacagauuuugcuugagcaucaggauacucaaauugauagcugauguugaaac

SEQ ID NO: 68600 - RNA, 64 nt, Homo Sapiens
uuccuugaagcuaugagcauuucauauaaacugugauacucacacugggcuuccuaggcagaaa

SEQ ID NO: 68601 - RNA, 64 nt, Homo Sapiens
uaggaagacuccuuccucucaaaucacaacccaagauacucagacugccagugcagcccacacc

SEQ ID NO: 68602 - RNA, 64 nt, Homo Sapiens
ucaggcacaaauauauaugggccaaaacuagagugauacucauccuucaguagaauacagcagg

SEQ ID NO: 68603 - RNA, 64 nt, Homo Sapiens
ugauuaaauuaaaauuggauaagaaucccuaagagauacucaaaacuuuccuccacuguggagg

SEQ ID NO: 68604 - RNA, 64 nt, Homo Sapiens
cacugaauaaaaacauaauccaugaguucaugcugauacucaaauuucuuuuuaaaaaggagaa

SEQ ID NO: 68605 - RNA, 64 nt, Homo Sapiens
cauucccacauucuccuuucugagcuggcugugggauacucacaucugagugcaagcugcacug

SEQ ID NO: 68606 - RNA, 64 nt, Homo Sapiens
ccuuguacaagcacauaugaucacauuugugguugauacucaagaugcaauaaagcugcuaaag

SEQ ID NO: 68607 - RNA, 64 nt, Homo Sapiens
ugauaaauuuaaaugaccucagaucuuugcaccagauacucaucauauacaaauguuuuaguaa

SEQ ID NO: 68608 - RNA, 64 nt, Homo Sapiens
auaaagcuacaagcacgcacugaagcacuuuacugauacucauucaauuauucauaugacaguu

SEQ ID NO: 68609 - RNA, 64 nt, Homo Sapiens
uucauagguagaaauauuagcauuuuuauugaaagauacucacaggauuuuccagaggcuaaau

SEQ ID NO: 68610 - RNA, 64 nt, Homo Sapiens
gcacagagcucaguggauuugauucuuccauucagauacucauagcgauugcacacuuuauucu

SEQ ID NO: 68611 - RNA, 64 nt, Homo Sapiens
aggcugagguaggagaaucacgccuguaaucccagauacucagguagcugggcguggugacggg

SEQ ID NO: 68612 - RNA, 64 nt, Homo Sapiens
cugauaaucucuuaagagcgagaaacacgguccugauacucaucugcaccgcggucacuauuuc

SEQ ID NO: 68613 - RNA, 64 nt, Homo Sapiens
uacaaauguaaagaauguggaaaagcuuuucaccgauacucaauccuuaguacacauaagaaaa

SEQ ID NO: 68614 - RNA, 64 nt, Homo Sapiens
agugccccuuagaaaguuaaaagaauguagaaaagauacucagucuuaauccuaugcaaaaaaa

SEQ ID NO: 68615 - RNA, 64 nt, Homo Sapiens
aguauaaucaauacccuagguuaugcgucuauaugauacucaucugugaauauuauugguuuug

SEQ ID NO: 68616 - RNA, 64 nt, Homo Sapiens
uuugucuuuguacuccagugccuaguauauaagagauacucaauaaauaaauauuugucaaauc

SEQ ID NO: 68617 - RNA, 64 nt, Homo Sapiens
uccuucgucagcagcgccuccccagacccacgaggauacucacacugcacgccugaggcucucc

SEQ ID NO: 68618 - RNA, 50 nt, Homo Sapiens
cuucccuucaaaacccagccgauacucauuccuauuauuucuauaauuga

SEQ ID NO: 68619 - RNA, 64 nt, Homo Sapiens
aauggagauauuauaggaaauguuuugguaugaugauacucagauugaauaagagaauacuaau

SEQ ID NO: 68620 - RNA, 64 nt, Homo Sapiens
uuguggauaauaauugaauuguggguuagggacugauacucagaccucaaauuuuuaggggagg

SEQ ID NO: 68621 - RNA, 64 nt, Homo Sapiens
caaaaauaguuuuuuuuaaauuguuuuaaacuaagauacucaaugauauaaaaacauccugauc

SEQ ID NO: 68622 - RNA, 64 nt, Homo Sapiens
uugcauguucuuuuaaauuacuacauagcaaguugauacucauguugggucauuuacauguaca

SEQ ID NO: 68623 - RNA, 64 nt, Homo Sapiens
ucacucucaacagcuuauugagcuauagauucuugauacucaccgcaauggagggagacgaucu

SEQ ID NO: 68624 - RNA, 64 nt, Homo Sapiens
uuauaauaaaacucuucauuggugauacagagaugauacucaaauuuucuaaagcugugcuguc

SEQ ID NO: 68625 - RNA, 64 nt, Homo Sapiens
gaagaaaguggguaguggccuugugauugcaauggauacucaugucagaaacguaauucuuaca

SEQ ID NO: 68626 - RNA, 64 nt, Homo Sapiens
ucuuaugaaucuuuccagggagaaaaaaauucaugauacucauucuagcuacuugguuccccuc

SEQ ID NO: 68627 - RNA, 64 nt, Homo Sapiens
ccuuguaaacaugaaggggcagauaaaggaaggagauacucauguugauaaagagagcccuggu

SEQ ID NO: 68628 - RNA, 64 nt, Homo Sapiens
auaagacagggcaccuuuuaacucuaaaacuagugauacucagugacauagacuuugucuuaua

SEQ ID NO: 68629 - RNA, 64 nt, Homo Sapiens
acccccauccccgcaucuaaaaccaaggauuucagauacucauugcaguuguggaguuuaaucc

SEQ ID NO: 68630 - RNA, 64 nt, Homo Sapiens
cucgaaaaaagagacaacucaauacuuaggcuuggauacucauucagcaguccuucagaauuaa

SEQ ID NO: 68631 - RNA, 64 nt, Homo Sapiens
aauuaggaugaagaacuuuuuuuuuacuuuuuaugauacucagagaaaaauaaaaugaaaguac

SEQ ID NO: 68632 - RNA, 64 nt, Homo Sapiens
acaaaacuuuuaagaugcugugaccucagacccugauacucacccagaaauacccacagcauag

SEQ ID NO: 68633 - RNA, 64 nt, Homo Sapiens
ggcacugagaucuacaaaugaggaacaggugucagauacucauacucccuaagagacugaagag

SEQ ID NO: 68634 - RNA, 64 nt, Homo Sapiens
ucaaccacuuaauaacugagcaaaguuauauugugauacucaaauucacagcagaguaguuuug

SEQ ID NO: 68635 - RNA, 64 nt, Homo Sapiens
caguuucagagaaccaggagguuugggguuaagagauacucaaaaauuuucacaagccaaguag

SEQ ID NO: 68636 - RNA, 64 nt, Homo Sapiens
ggucuuccaucuagaacuguuuacaugaagauaagauacucacuguucaugaauacacuugaug

SEQ ID NO: 68637 - RNA, 64 nt, Homo Sapiens
ggcacuuuauuaaaacaucaaguuugaucagucugauacucaguugaaguucugggauguuuuc

SEQ ID NO: 68638 - RNA, 64 nt, Homo Sapiens
agccaauaacaugacaggagcaacuauuaauacagauacucagaucuucauaugcuggcaggaa

SEQ ID NO: 68639 - RNA, 64 nt, Homo Sapiens
uucuguccuaagcgucaucuugagccuugcacaugauacucagauuccucacccuugcuuagga

SEQ ID NO: 68640 - RNA, 64 nt, Homo Sapiens
agacaaagcacuuuugcucuccaaagcacuuuuggauacucaggaggaaagauaagauacaugu

SEQ ID NO: 68641 - RNA, 64 nt, Homo Sapiens
auuucaucguccaccuucccaauguaagaugcgugauacucaaccaauaaugauugauaccuca

SEQ ID NO: 68642 - RNA, 64 nt, Homo Sapiens
guggagcagggaauggagacaaaagucgcagaaagauacucaaagaccuuuguagguuguggga

SEQ ID NO: 68643 - RNA, 64 nt, Homo Sapiens
accauuagaauagucauaccauacuugacucagugauacucauguucuucauagguagaaacaa

SEQ ID NO: 68644 - RNA, 64 nt, Homo Sapiens
gaagcaaauccuuguuuggguggagccccuaggagauacucaggccccaagucacuacagcauc

SEQ ID NO: 68645 - RNA, 64 nt, Homo Sapiens
gauuguacuuagagaugugacuaccaaucaguuugauacucaaggaaaggggguuauucaagaa

SEQ ID NO: 68646 - RNA, 64 nt, Homo Sapiens
ccccaucuuuacugaauagaaaugaauucuuggagauacucaugcucccagauuccagaggguu

SEQ ID NO: 68647 - RNA, 64 nt, Homo Sapiens
uuucuacauagacgggaacauacauaggugggaagauacucaucauggagcauacucauauuuc

SEQ ID NO: 68648 - RNA, 64 nt, Homo Sapiens
ggcuggccacagcugggcaagugugccgggccaagauacucacauugcagccgggaaagccagg

SEQ ID NO: 68649 - RNA, 64 nt, Homo Sapiens
caacauagccuacuuuuauauucagccacuuuuagauacucauguaaaagcaugcagucgguuu

SEQ ID NO: 68650 - RNA, 64 nt, Homo Sapiens
cuguucccccuagagcugcuacccaucauguggagauacucaucgugacucacagguaccucca

SEQ ID NO: 68651 - RNA, 64 nt, Homo Sapiens
accaaguuuguguuuuuuugcuuuuaauuuuauugauacucaaagcauaggagcuggccaagag

SEQ ID NO: 68652 - RNA, 64 nt, Homo Sapiens
auagagaacaggauauagcaauaauagcuccuuagauacucaguggcuucugacuccaaucaag

SEQ ID NO: 68653 - RNA, 64 nt, Homo Sapiens
uuuuaauaaccaaaggcagguugguaucaucaaugauacucauuuguaaaaccaguguuggcaa

SEQ ID NO: 68654 - RNA, 60 nt, Homo Sapiens
auuaauuuuuuuucuagugaugaacaaaaugauacucagaagcaacuuucugaagaacag

SEQ ID NO: 68655 - RNA, 64 nt, Homo Sapiens
aaggguucacaucuuaaccugugcaauucagauugauacucagaauauggguugauuugaauau

SEQ ID NO: 68656 - RNA, 64 nt, Homo Sapiens
ucuuuuguuauuucugccuaauaugauuugccccgauacucaucuugcacggccagaacuguuu

SEQ ID NO: 68657 - RNA, 64 nt, Homo Sapiens
gcaaagcagaaaacagugccccaaauggaaaaaagauacucacacagaacaaaacaguucuugg

SEQ ID NO: 68658 - RNA, 64 nt, Homo Sapiens
agcaacuuucugaagaacaggugaugaacaaaaugauacucagaugagaaugaacaguaucaca

SEQ ID NO: 68659 - RNA, 64 nt, Homo Sapiens
ggagguagaccuugaagacaaugaagagaaugccgauacucagacugcagcuggaccggcaagc

SEQ ID NO: 68660 - RNA, 64 nt, Homo Sapiens
uguuucccuuuaaaccagauccuggagacagugagauacucagggcguuguuaacagggagugg

SEQ ID NO: 68661 - RNA, 64 nt, Homo Sapiens
ugucauguuuauaauucaaaaauuaguugcuuuugauacucagccucagguuuagauuguuuaa

SEQ ID NO: 68662 - RNA, 64 nt, Homo Sapiens
aucaguagcuugagaugcuauaaugcuguagcaugauacucagggcuccucucacaaguaguug

SEQ ID NO: 68663 - RNA, 64 nt, Homo Sapiens
uggaugauucugugacucaucuuuguaucuggcugauacucauuaugagaaaauacaaagcuuu

SEQ ID NO: 68664 - RNA, 64 nt, Homo Sapiens
aaugggaaaaggacagcacacaguauuuccuuuggauacucaggaucuaccugagccccaucuc

SEQ ID NO: 68665 - RNA, 64 nt, Homo Sapiens
aagggaugggauuucugggucccagagcgggugggauacucacgcacagcuucuucacuggugg

SEQ ID NO: 68666 - RNA, 64 nt, Homo Sapiens
accaccauuccuuggccagccuuuugccucccucgauacucaacaaagagaagcaaagccuccu

SEQ ID NO: 68667 - RNA, 64 nt, Homo Sapiens
acuggaucgccaucugcuacaacaacugccuggagauacucagaguguaguguugguggcgcug

SEQ ID NO: 68668 - RNA, 64 nt, Homo Sapiens
cagaggccagucugggccuuggcccugggugucugauacucacagagugaaacugugacccucu

SEQ ID NO: 68669 - RNA, 64 nt, Homo Sapiens
agaaguaucagaaguaguggagugcaauauguuagauacucagcauucagaagaagucugaaga

SEQ ID NO: 68670 - RNA, 64 nt, Homo Sapiens
ucuggaucuuucuaaaaaucucccaugggaaguggauacucaaguggagucuaggaagggcgug

SEQ ID NO: 68671 - RNA, 64 nt, Homo Sapiens
gugucacagcuguguccccuugccaucagcccaggauacucaccucagccaucccggcuggguu

SEQ ID NO: 68672 - RNA, 64 nt, Homo Sapiens
guagucagucuacaccuggauucgguguuggagcgauacucaauuuuaaaccguuaaagggaag

SEQ ID NO: 68673 - RNA, 64 nt, Homo Sapiens
ucaguuaacuaaugaggcggggaccagcagaaaagauacucagggucugaggcacaugggagug

SEQ ID NO: 68674 - RNA, 64 nt, Homo Sapiens
aucaaagauuucccaaugugaucucaucaucauggauacucaauuuguuuuuucuuauagagaa

SEQ ID NO: 68675 - RNA, 64 nt, Homo Sapiens
gggaggugacgcuagugucacgcugacgcuggccgauacucaggguaugcuaucuggaggccug

SEQ ID NO: 68676 - RNA, 64 nt, Homo Sapiens
ggagccucugcccuucuuuuucaggccuguaggagauacucaguuguccuagguaauaccacua

SEQ ID NO: 68677 - RNA, 64 nt, Homo Sapiens
aaguaugcuuggauccuuuguugaauuugucaaugauacucaucaccccucaccucuaggaucc

SEQ ID NO: 68678 - RNA, 64 nt, Homo Sapiens
cgagucuccgugcugguguuuaagucauuaaaaagauacucaaagagaauggccugccugaugc

SEQ ID NO: 68679 - RNA, 64 nt, Homo Sapiens
cugggaagaggcggggagaugucucugugcccaagauacucacugccucucugggugagcacag

SEQ ID NO: 68680 - RNA, 64 nt, Homo Sapiens
gugcccacccugcacuggggggagggugggcagggauacucagggacagggcaucaugggggau

SEQ ID NO: 68681 - RNA, 64 nt, Homo Sapiens
aaggaacacacacccauuaugcccaggaggcauggauacucaggcuagugguccuugcuggccu

SEQ ID NO: 68682 - RNA, 64 nt, Homo Sapiens
acauuuuucauuuuguuuaaauaauauacuguuugauacucaaaagaugcugucuacaagguag

SEQ ID NO: 68683 - RNA, 64 nt, Homo Sapiens
aguccugauuagccucccgggccacugguuucaggauacucaucgcccuggaaugugcauuccu

SEQ ID NO: 68684 - RNA, 64 nt, Homo Sapiens
ucuuauuuuuauuuuuuucuauaauuuacauguagauacucauucucguuuugcccguuguauc

SEQ ID NO: 68685 - RNA, 64 nt, Homo Sapiens
uggacagcaaugcucgaguuugugaauuuggagagauacucaaaagagcuaaaacugcagcauu

SEQ ID NO: 68686 - RNA, 64 nt, Homo Sapiens
uuucggaguccaggacuggcaggacaggucaucagauacucagaggcuguaucucugcccugcc

SEQ ID NO: 68687 - RNA, 56 nt, Homo Sapiens
uauaguuacguucauuucagaagaaagauacucauucucuuuuugcuacuacauaa

SEQ ID NO: 68688 - RNA, 64 nt, Homo Sapiens
ccuaggcguggaagagaaaaugugagguuguuuagauacucaucaggaccucacaggagcugag

SEQ ID NO: 68689 - RNA, 64 nt, Homo Sapiens
gccuucacaggauggaaguagaaugauuucaguagauacucauucuuggaaaaugccauaguuu

SEQ ID NO: 68690 - RNA, 64 nt, Homo Sapiens
aggaggacaaggcugacaagcaauccagggacaagauacucaccaggaccaggaaggggacucu

SEQ ID NO: 68691 - RNA, 64 nt, Homo Sapiens; identical to SEQ ID NO: 68690

SEQ ID NO: 68692 - RNA, 64 nt, Homo Sapiens
aggaugaggaagaggacuuucaauccagggacaagauacucaccaggcagacaaggcugacaag

SEQ ID NO: 68693 - RNA, 64 nt, Homo Sapiens
uucuuguuccuggccguggaguggggcacugggugauacucaguuugauuccuagccccguucu

SEQ ID NO: 68694 - RNA, 64 nt, Homo Sapiens
agcucccaagauuugcuugaaggcacaugccgaagauacucaagucaguagcaagugcuggaaa

SEQ ID NO: 68695 - RNA, 64 nt, Homo Sapiens
agccuccaacuuaaauuacauuagucaacuuauagauacucauaugaucacuuuucuuuuuaga

SEQ ID NO: 68696 - RNA, 64 nt, Homo Sapiens
acucaucauuuaccacugugcuuggcagagagcggauacucaaguaaguuuuguuaaaugaaug

SEQ ID NO: 68697 - RNA, 64 nt, Homo Sapiens
uuuuuguguuuuuuuguguggggggaggacaauggauacucagucgggcaggacagggaaacag

SEQ ID NO: 68698 - RNA, 64 nt, Homo Sapiens
auauuuacucaugcauuuacauuaagguuuaugggauacucaagauuuacaauaugacuuuaac

SEQ ID NO: 68699 - RNA, 64 nt, Homo Sapiens
gguacagagaaaugguugaugagagaacucuguggauacucauggacuuguuucagaaagauga

SEQ ID NO: 68700 - RNA, 64 nt, Homo Sapiens
caguagcucagagagaugcuaaaaaaucugcucagauacucagcaacgaccaaaaaaaaaaaaa

SEQ ID NO: 68701 - RNA, 64 nt, Homo Sapiens
uuuuuaaacuuuuuuuuuaacacugcacccgaccgauacucacacugggauuacaggugugagc

SEQ ID NO: 68702 - RNA, 64 nt, Homo Sapiens
caaagaguaaagaggcugagugugacuuuauaaagauacucauaaaaaauauaaacaacaaaac

SEQ ID NO: 68703 - RNA, 64 nt, Homo Sapiens
uuccugagggccaaggcauugcuguaagaaaaggucuagaaauaggugaaagugagaggugggg

SEQ ID NO: 68704 - RNA, 64 nt, Homo Sapiens
uuaggaaaauacauucugccccugaaugauucugucuagaaaagcucuggaguauugaucacua

SEQ ID NO: 68705 - RNA, 64 nt, Homo Sapiens
aaguuggaaaguccccgucccccagaaccucaagucuagaaaccaguauggaagggaggggucc

SEQ ID NO: 68706 - RNA, 64 nt, Homo Sapiens
gagagguucuggggaggaagggccaggagagagaucuagaaaguggguucacuagagcugggaa

SEQ ID NO: 68707 - RNA, 64 nt, Homo Sapiens
gcugacuccauuuuugucccuuuugaaacugauuucuagaaaaagcuuucuagagauaugauga

SEQ ID NO: 68708 - RNA, 64 nt, Homo Sapiens
ugcuuucuagagauaugauggguaacuguauuguucuagaaauagaaggaaagucccccugugu

SEQ ID NO: 68709 - RNA, 64 nt, Homo Sapiens
ucuucuuuauccuuaauugugacuaagauggaaaucuagaaaauauucaugcuucuaaguuucu

SEQ ID NO: 68710 - RNA, 64 nt, Homo Sapiens
cauuugccauguugaagaguguguauaggaaaggucuagaaauaaauaggcuugugcauaccua

SEQ ID NO: 68711 - RNA, 64 nt, Homo Sapiens
aauuugcaggcaaccauguuuugcguuuacuuccucuagaaaagaaaacauaaccauauguguu

SEQ ID NO: 68712 - RNA, 64 nt, Homo Sapiens
cuggcagguuuuuuguauugaugguaaacaauugucuagaaauuguacaagguuuuuaacaugg

SEQ ID NO: 68713 - RNA, 64 nt, Homo Sapiens
guauguaugaggaguuagggauggggagucaaguucuagaaaguuuugucugaaaaccuuugaa

SEQ ID NO: 68714 - RNA, 64 nt, Homo Sapiens
agaauaaauauuaauuuuuccacuucaguuuuauucuagaaaauacccuuuuuagaaauccagu

SEQ ID NO: 68715 - RNA, 64 nt, Homo Sapiens
cugagaggggaaaaugugauauaugugacaaggaucuagaaauuuauauagaccuauccucuaa

SEQ ID NO: 68716 - RNA, 64 nt, Homo Sapiens
gggggcagccucaaaaucauuauucuuuuuuuuuucuagaaacuuacauuauacauuauuauaa

SEQ ID NO: 68717 - RNA, 64 nt, Homo Sapiens
caaagaaauuggguaucauuaauggaaaguuacuucuagaaaagcauaucaaaauacaugaaca

SEQ ID NO: 68718 - RNA, 64 nt, Homo Sapiens
auucugagaggaguguauaggggauuauacacauucuagaaaugucccaccaucacuuaacgcc

SEQ ID NO: 68719 - RNA, 64 nt, Homo Sapiens
acugugucaaaaugauaauuuuguuauguuagccucuagaaaauuuaaguucagaaaaaugcac

SEQ ID NO: 68720 - RNA, 64 nt, Homo Sapiens
aaguuaacguagaaaauauccaaaaagcaguauuucuagaaaguguccaaaaagcaguauuucu

SEQ ID NO: 68721 - RNA, 64 nt, Homo Sapiens
caaguuuaaaauugccugcggaaugugugcaguaucuagaaaaaugaaccguaguuuuuguuuu

SEQ ID NO: 68722 - RNA, 64 nt, Homo Sapiens
acaagagcuccuccugaucacuauuacauauuuuucuagaaaaucuaaaguucagaagagaaug

SEQ ID NO: 68723 - RNA, 64 nt, Homo Sapiens
cacuuuuuuccaaaguguaauguacauaaaauuuucuagaaauaaauaucuauuccauuuguau

SEQ ID NO: 68724 - RNA, 64 nt, Homo Sapiens
aagaaaacaauaugaggagaaggugcuuguuaugucuagaaaguaucuuuucagugugauggca

SEQ ID NO: 68725 - RNA, 64 nt, Homo Sapiens
ugagaacaaggcuuugaaacugaacaagauaacuucuagaaaugaacuguacuaaucccuuucc

SEQ ID NO: 68726 - RNA, 64 nt, Homo Sapiens
ggcccugaacaaagccaaaaauuguagaaaccagucuagaaaaaguccugcucaucuguggcca

SEQ ID NO: 68727 - RNA, 64 nt, Homo Sapiens
uuucuauuucuaaccuauggaauaauucuuguucucuagaaagcuuguaguacauguuuuuacu

SEQ ID NO: 68728 - RNA, 64 nt, Homo Sapiens
ucuacuaaacagagaaauuugguggccuuagggaucuagaaacuugguuaaaauuauauugacu

SEQ ID NO: 68729 - RNA, 64 nt, Homo Sapiens
uuuaauugaguguaaacacaagcugcuuucaauaucuagaaauugaauauuuuaagaacuguag

SEQ ID NO: 68730 - RNA, 64 nt, Homo Sapiens
aaauacuccaagaaaaagaaacuguaguaguuggucuagaaacacaacauuuuuugugcuuuaa

SEQ ID NO: 68731 - RNA, 64 nt, Homo Sapiens
aucuugaccuugacuuugcaucccaagugacuggucuagaaauaggggaugaaaucccacaucc

SEQ ID NO: 68732 - RNA, 64 nt, Homo Sapiens
cucacucagguacacagugcuuguucuacaauguucuagaaauuuaaauaaacuuuauggcugu

SEQ ID NO: 68733 - RNA, 64 nt, Homo Sapiens
guguugugaaacuguaaauuucauacauuugacuucuagaaaacauuuuuguggcuuaugacag

SEQ ID NO: 68734 - RNA, 64 nt, Homo Sapiens
cuuugaacuuucacgcugaaacaugcuagugauaucuagaaagggcuaauuaggucucauccuu

SEQ ID NO: 68735 - RNA, 64 nt, Homo Sapiens
acuauguauauuuaaauuuaguaauuuucuaaucucuagaaaucucugcuguucaaaagguggc

SEQ ID NO: 68736 - RNA, 64 nt, Homo Sapiens
cauuccugguaguauaagucaccuaaaaaagacuucuagaaauauguacuuuaauuauuuguuu

SEQ ID NO: 68737 - RNA, 64 nt, Homo Sapiens
cagaaaauggacucugauuuuauauuugguaacuucuagaaagcguuucuuuuggggaaauguu

SEQ ID NO: 68738 - RNA, 64 nt, Homo Sapiens
ugaggauguuugaagcuuccccauuuaggagcuuucuagaaaguaacguuucuacuuugggguu

SEQ ID NO: 68739 - RNA, 64 nt, Homo Sapiens
agcccuuuuuccccccacuuauuccacaucuguuucuagaaaccgcucccugggacauucuuca

SEQ ID NO: 68740 - RNA, 64 nt, Homo Sapiens
cuucugaugcaugaaaaaugcgugguucuggagcucuagaaacaucaggacgugaugagguacu

SEQ ID NO: 68741 - RNA, 64 nt, Homo Sapiens
ucauaaucagcucuggaacauaaugacccgcuuuucuagaaaguuccuaugaaaggaugcaaua

SEQ ID NO: 68742 - RNA, 64 nt, Homo Sapiens
acgaguuauucacaccagcauuauuuauaagggcucuagaaaaacaaacacuaacugggggauu

SEQ ID NO: 68743 - RNA, 64 nt, Homo Sapiens
agaaaaguguuuuuagaaauguuugagagugaccucuagaaaaaaacuauagugauauaucagu

SEQ ID NO: 68744 - RNA, 64 nt, Homo Sapiens
cagucuuaaaucucuccgcuccauuguggguuauucuagaaaucgaagaucauguuccucggcu

SEQ ID NO: 68745 - RNA, 64 nt, Homo Sapiens
gaagaucaugucccuuagcugcauuguggguuauucuagaaauccaauguuaaaugccucuacu

SEQ ID NO: 68746 - RNA, 64 nt, Homo Sapiens
aacuauagugauauaucaguguuugggagugaccucuagaaaaaagaaaacuguuuuuagaaau

SEQ ID NO: 68747 - RNA, 64 nt, Homo Sapiens
aagaggugguagguuggaguaagaugcuacagaugcucucaagucaggaauagaaacugaugag

SEQ ID NO: 68748 - RNA, 64 nt, Homo Sapiens
uuacauuuguacagcaugaugaccuuuacaaagugcucucaaugcauuuacccauucguuauau

SEQ ID NO: 68749 - RNA, 62 nt, Homo Sapiens
ccaguugugaagaaaaauagaaucaauggcauuacuauuaguaaaaugcacaccuuuuucug

SEQ ID NO: 68750 - RNA, 64 nt, Homo Sapiens
uacuauuaguaaaaugcacaccuuuuucugaauuuacuauuauauuuguuuucaauuucauuuu

SEQ ID NO: 68751 - RNA, 64 nt, Homo Sapiens
aacccauaggcacuugggaugacacuguuaauaguacuauuaacauuacuaguacuaguacuau

SEQ ID NO: 68752 - RNA, 64 nt, Homo Sapiens
aguacuaguacuaugacacuauugcuauuacuaguacuauuacucuauugcuaguacuaguacu

SEQ ID NO: 68753 - RNA, 64 nt, Homo Sapiens
auuuuuauuuuaaaauaaaaaauaauaguacuauuacuauuacucuauuaguauuauuaacacu

SEQ ID NO: 68754 - RNA, 64 nt, Homo Sapiens
auuacuauuuuuauuuuaaaaacacuaauaauaguacuauuacuuauuaacuauuaguauuauu

SEQ ID NO: 68755 - RNA, 64 nt, Homo Sapiens
gaauuacucuacuguucuuuuaauuguaaacuaguacuauuaugugacuaauucacaaaaaaag

SEQ ID NO: 68756 - RNA, 64 nt, Homo Sapiens
ucaaccaccuuucugacuuuuuauuuuugaugauuacuauuacuauuauuauggaaaaauuaaa

SEQ ID NO: 68757 - RNA, 64 nt, Homo Sapiens
accuuucugacuuuuuauuuuugaugauuacuauuacuauuauuauggaaaaauuaaaaugucu

SEQ ID NO: 68758 - RNA, 64 nt, Homo Sapiens
gugguuugucuuugaaauuacgguuaauacuuuuagacaguaaguccggcugguugcagggcua

SEQ ID NO: 68759 - RNA, 64 nt, Homo Sapiens
agaaaaaucaaccaaucuguagguguugauaacuagacaguacuguguauguuacgugccugug

SEQ ID NO: 68760 - RNA, 64 nt, Homo Sapiens
agcuucguucacaugcuauuuaaaugcacaaaauagacaguaaggauuuaucuguucaguuuuu

SEQ ID NO: 68761 - RNA, 64 nt, Homo Sapiens
agacaucauucagugaauaaauuacuguagucaaagacaguaugggcuggcaguuuguguaauu

SEQ ID NO: 68762 - RNA, 64 nt, Homo Sapiens
ugugcuuauuacacaaaauuacuuugugguaaacagacaguauuguaaucccaucaaaagauga

SEQ ID NO: 68763 - RNA, 64 nt, Homo Sapiens
cacuucugugauccauuuuaauuuccaggccacaagacaguagugaugcucugaaaugaaaguu

SEQ ID NO: 68764 - RNA, 64 nt, Homo Sapiens
uuaaaaauaaguuuuaucuuaaaaucauauuugaagacaguaagacaguaaacuauuuuaggaa

SEQ ID NO: 68765 - RNA, 64 nt, Homo Sapiens
aaguuuuaucuuaaaaucauauuugaagacaguaagacaguaaacuauuuuaggaagucaaccc

SEQ ID NO: 68766 - RNA, 64 nt, Homo Sapiens
agaaacuuuguaugugcacacaaaaguauucaagagacaguauugcuaacaucucaucuuaaug

SEQ ID NO: 68767 - RNA, 64 nt, Homo Sapiens
uugaugaauucuuuugugaaacuugaaagagaauagacaguaugacauauagaauuaauacaaa

SEQ ID NO: 68768 - RNA, 64 nt, Homo Sapiens
ugccuucuauguagggggcucuaaggccagcccugacccagaccuugacccagaccugagucgg

SEQ ID NO: 68769 - RNA, 64 nt, Homo Sapiens
agggggcucuaaggccagcccugacccagaccuugacccagaccugagucggcugcucuugggg

SEQ ID NO: 68770 - RNA, 64 nt, Homo Sapiens
uaagguguaccaccaggcacaccucagucuucuugacccagagccugaaaacuguuuucacugg

SEQ ID NO: 68771 - RNA, 64 nt, Homo Sapiens
guuuggagaaagagggcaaucaggacucuucugggacccagaugaguucuucacuagcccuucu

SEQ ID NO: 68772 - RNA, 64 nt, Homo Sapiens
cuuaaugauguuuggauauaggaccaaguuuuaugacccagaggagauacuccuguuaguucag

SEQ ID NO: 68773 - RNA, 64 nt, Homo Sapiens
cagaacucggugguggaggcuaaaguaguauuuggacccagagcccugaugaauaaucugauau

SEQ ID NO: 68774 - RNA, 64 nt, Homo Sapiens
cucagcagaaagacccugaaggcaggcugcaaaugacccagaagagggaccugggaguccuggu

SEQ ID NO: 68775 - RNA, 64 nt, Homo Sapiens
aggccagggcugggcugugcaccugccucccacugacccagacccacuuccuccagagaggccu

SEQ ID NO: 68776 - RNA, 64 nt, Homo Sapiens
uagcucaaagaagggguuaaugaugcuaacuagagacccagaacgucugaaaacguccugauau

SEQ ID NO: 68777 - RNA, 64 nt, Homo Sapiens
caucugaugccucuacuaucauuaccucuauugggacccagaaaccaauaccccaaaauauggu

SEQ ID NO: 68778 - RNA, 64 nt, Homo Sapiens
cucagaguugauggugagagagugccuaagccaggacccagaaaccgggccugcucuagugagg

SEQ ID NO: 68779 - RNA, 64 nt, Homo Sapiens
cacacugcagccuccgccgauuggccuuggcuaggacccagagcccucucagccaggugccgug

SEQ ID NO: 68780 - RNA, 64 nt, Homo Sapiens
ggccuggcacacaaggcccaaaggccagggaggggacccagagagagaaggugagaggaaggca

SEQ ID NO: 68781 - RNA, 64 nt, Homo Sapiens
agggacuggaggcacccccaauggagcacucggugacccagagcgccuuccuguccaggucugc

SEQ ID NO: 68782 - RNA, 64 nt, Homo Sapiens
uggucgacagauguuagauguagagauaacucgggacccagaguguuugcagagagcagacagc

SEQ ID NO: 68783 - RNA, 64 nt, Homo Sapiens
gucacaaauaucccccauccagcaucuagacccagacccagagccugaacauaccuguguaauc

SEQ ID NO: 68784 - RNA, 64 nt, Homo Sapiens
cagagcgucacaaauaucccguaaucagcaucuagacccagacccacaaacugaacauaccugu

SEQ ID NO: 68785 - RNA, 64 nt, Homo Sapiens
guuguggugaggccaccaggcugaagucagcucagacccagaccucccugcuuaggccacucga

SEQ ID NO: 68786 - RNA, 64 nt, Homo Sapiens
cugugcuuguguuugcugcuaauguccagcuacagacccagaggauaagccacugggcacuggg

SEQ ID NO: 68787 - RNA, 64 nt, Homo Sapiens
gagcaggcgggcugaggagaguggaaaaggaagcgacccagaaauggcagggacacuucucuug

SEQ ID NO: 68788 - RNA, 64 nt, Homo Sapiens
uccaggauacaaaaaaaaacauuuaaaaauccgagacccagaacacuucuggucccaagcauuu

SEQ ID NO: 68789 - RNA, 64 nt, Homo Sapiens
aaggcaguccccccacgcccgagaaagccugggggacccagacaccuguccccacagucaaagc

SEQ ID NO: 68790 - RNA, 64 nt, Homo Sapiens
acccagacaccuguccccacagucaaagccuggggacccagacauccuguccccacagucagcc

SEQ ID NO: 68791 - RNA, 64 nt, Homo Sapiens
aacagacccggacagacagacacagccugaaacagacccagacaaacagacagacagacacagc

SEQ ID NO: 68792 - RNA, 64 nt, Homo Sapiens
cagacaaacagacagacagacacagccugaaacagacccagacagacagacagacagccugaaa

SEQ ID NO: 68793 - RNA, 64 nt, Homo Sapiens
cagacccagacagacagacagacagccugaaacagacccagacacagccugaaacagauccgga

SEQ ID NO: 68794 - RNA, 64 nt, Homo Sapiens
gauccggacagacagacagaaacagccugaaacagacccagacagacagacagacacagccuga

SEQ ID NO: 68795 - RNA, 64 nt, Homo Sapiens
aacagaccuagacagacagacacagauugaaacagacccagacaaacagacagacacagccuga

SEQ ID NO: 68796 - RNA, 64 nt, Homo Sapiens
gacccagacaaacagacagacacagccugaaacagacccagacacagccugaaacagacccgga

SEQ ID NO: 68797 - RNA, 64 nt, Homo Sapiens
gacccggacagacagacagacacagccugaaacagacccagacagacagacagacacagccuga

SEQ ID NO: 68798 - RNA, 64 nt, Homo Sapiens
gacccagacagacagacagacacagccugaaacagacccagacagacagaccgacgcagccuga

SEQ ID NO: 68799 - RNA, 64 nt, Homo Sapiens
gacccagacagacagaccgacgcagccugaaagagacccagacagagagacaggcagacacagc

SEQ ID NO: 68800 - RNA, 64 nt, Homo Sapiens
cagaucagaacaacggaggauagcuuugugccuggacccagagagugugggacuccccgcuuca

SEQ ID NO: 68801 - RNA, 64 nt, Homo Sapiens
uuuugcuuccugcuggaggcagggcaccugcugcgacccagauucuucugcaggaugugucugu

SEQ ID NO: 68802 - RNA, 59 nt, Homo Sapiens
ccacucuggccauccacuaauccaggggggacccagaccccacaagccauggagacuca

SEQ ID NO: 68803 - RNA, 64 nt, Homo Sapiens
guauacugcucuggccauccacuagcccagggaggacccagaccuccacacuccauggagacuc

SEQ ID NO: 68804 - RNA, 64 nt, Homo Sapiens
gcagcgucagacacccagaggagggagggacagagacccagaggaacaaaaagagccagugggg

SEQ ID NO: 68805 - RNA, 64 nt, Homo Sapiens
aaggaagagguggaaacccaaggauagagaaagagacccagaaagauagagggacagagccaaa

SEQ ID NO: 68806 - RNA, 64 nt, Homo Sapiens
uccagaagggucaucugcccagccagcccuccuugacccagaagcugacacccugggcuuccug

SEQ ID NO: 68807 - RNA, 64 nt, Homo Sapiens
caagacacugugccaccgccuccuggacaaccuggacccagauggagaagcucggacuuggcac

SEQ ID NO: 68808 - RNA, 64 nt, Homo Sapiens
uagaauguuggagcaaaagcaaugguugaugucagacccagacagaaacacacaggaacagaga

SEQ ID NO: 68809 - RNA, 64 nt, Homo Sapiens
aagaaugugugagcaaagauaaugguugauucuggacccagaucgauacucauggguacagaga

SEQ ID NO: 68810 - RNA, 64 nt, Homo Sapiens
uagaauguuugaacaaagacaguggucgauuccagacccagacagaaacccguagauacagaga

SEQ ID NO: 68811 - RNA, 64 nt, Homo Sapiens
gaaggugucaguugggcaugccugggguccaggagacccagaauucaccccuuccuuuacaggu

SEQ ID NO: 68812 - RNA, 64 nt, Homo Sapiens
ccagcuuagagaauagaguuacucacaaagccaagacccagaguggaacacuuugcccaagauu

SEQ ID NO: 68813 - RNA, 64 nt, Homo Sapiens
uggagaaauaaacgcauucuuguaggaguuaaaauaggccaaacuuguauuggcuguucaugua

SEQ ID NO: 68814 - RNA, 64 nt, Homo Sapiens
aaaugcugcgcauacccagaaugggcuuucccaauaggccaaaaagucuucaggacaccauuag

SEQ ID NO: 68815 - RNA, 64 nt, Homo Sapiens
uccacaugucaucaguuuucagauauuuucgauuccacuguaagucucauuuguguagcuuucc

SEQ ID NO: 68816 - RNA, 64 nt, Homo Sapiens
aagacuuggugggaaguaaguucugccaucaccuccacuguacccuguugcuggauacuugcag

SEQ ID NO: 68817 - RNA, 64 nt, Homo Sapiens
cgggaggcagagguugcagugagcugagauggugccacuguacuccagccugggugauaggaug

SEQ ID NO: 68818 - RNA, 64 nt, Homo Sapiens
cagccucccaaaaugcugggauuacaggcaugagccacuguacccagccaaaauuguuuucuuu

SEQ ID NO: 68819 - RNA, 64 nt, Homo Sapiens
gugccauaaauguuuuucaguaauauuuuuugguccacuguauuccugugacacagugcauuau

SEQ ID NO: 68820 - RNA, 64 nt, Homo Sapiens
ugucaaaugcaaaguuuuuauucauuccaagccaccacuguaaggaauaaagcuuagcuucugu

SEQ ID NO: 68821 - RNA, 64 nt, Homo Sapiens
caggaguuugaggcugcagugagcuaugauugcaccacuguacuccugccuuaaaaaaaaaaaa

SEQ ID NO: 68822 - RNA, 64 nt, Homo Sapiens
ugaggagcacuuuccaggcauaguuacagcuuccccacuguauuuacaagccagaauugugcaa

SEQ ID NO: 68823 - RNA, 64 nt, Homo Sapiens
auuuagacuauuuuaauaauacauauuauuuaccccacuguaacaucauguaaacuaaguaugu

SEQ ID NO: 68824 - RNA, 64 nt, Homo Sapiens
cagauuaggguauaggcaucuagagaugcacuguccacuguaaauacuauaaugagagccacau

SEQ ID NO: 68825 - RNA, 64 nt, Homo Sapiens
aggccaccacuggacuauugguuucaauauuagaccacuguagccgaaucagaggccagagagc

SEQ ID NO: 68826 - RNA, 64 nt, Homo Sapiens
uggcaauggccacccugguguuggcauauuggccccacuguaacuuuugggggcuucccggucu

SEQ ID NO: 68827 - RNA, 64 nt, Homo Sapiens
ccagcccgggugacagagcaaggccaagauuguaccacuguauuugcuugaacuugggaggugg

SEQ ID NO: 68828 - RNA, 64 nt, Homo Sapiens
gaaaugcaguguguugcaguucaaucggcacagaccacuguaagggaacaccuucuucuuuuug

SEQ ID NO: 68829 - RNA, 64 nt, Homo Sapiens
aaaaauuuaaaaaaaauuguacuguaccccgauaccacuguauaucccaaaguguugaugagcc

SEQ ID NO: 68830 - RNA, 64 nt, Homo Sapiens
ccgauaccacuguauaaaaaaaaguguugaugagccacuguaccuccucacgccucagccuccc

SEQ ID NO: 68831 - RNA, 64 nt, Homo Sapiens
agcguagcuauguguuggcccuggggcggcccaccccugccaagcuugccaacuucccugaggu

SEQ ID NO: 68832 - RNA, 64 nt, Homo Sapiens
gaccuuuagugcucccugcaccaaccucccaucccccugccaagauccuugaaggacccuggaa

SEQ ID NO: 68833 - RNA, 64 nt, Homo Sapiens
cuuggcagguuccagguggaaguugguagaaggccccugccaggucacagcaaugcucuccuug

SEQ ID NO: 68834 - RNA, 64 nt, Homo Sapiens
auguguuugauaaacaaccagauuguuucugguucccugccacuauaaaaacaccaugagagca

SEQ ID NO: 68835 - RNA, 64 nt, Homo Sapiens
uucuaccugggugcucaggaauguuccucgucaccccugccacucuguggucggugcccugcuu

SEQ ID NO: 68836 - RNA, 64 nt, Homo Sapiens
gagggcugcccuauaggucuucucuucccgccuccccugccaugcaaccagauguguugugagu

SEQ ID NO: 68837 - RNA, 64 nt, Homo Sapiens
caccuuccuuggccagcucccagaaccuccccuucccugccacgucuggggaaagcauccauca

SEQ ID NO: 68838 - RNA, 64 nt, Homo Sapiens
ccuagacuguguguuucauaagccaggcucuguccccugccauaguguguaauguccagucccc

SEQ ID NO: 68839 - RNA, 64 nt, Homo Sapiens
cuuggugccguccugccccugaggccaaaguucucccugccaucgcugugccaaagccaggucc

SEQ ID NO: 68840 - RNA, 64 nt, Homo Sapiens
gccuccaucagccagacgagauacgcuggaguugcccugccaucuggcuggaaugaugaagggg

SEQ ID NO: 68841 - RNA, 64 nt, Homo Sapiens
uuugguaucuucucuggccugccaaauggucucucccugccaauccaucuccuaggggacuggc

SEQ ID NO: 68842 - RNA, 64 nt, Homo Sapiens
uggaguggaccccuccuacuagcccauuucagcacccugccacugucaguguccuguugguccu

SEQ ID NO: 68843 - RNA, 64 nt, Homo Sapiens
ccccagguuaggaauaguggucacaucacuccaccccugccaggcuucuccagggacccuuaga

SEQ ID NO: 68844 - RNA, 64 nt, Homo Sapiens
uaucacuaaugacuugaacuuauuucucugucagcccugccacagcuuuggagaccuccaggau

SEQ ID NO: 68845 - RNA, 64 nt, Homo Sapiens
aggccaccuccccagcauuccaggcccuggccuccccugccaccgccucuuccuugaagaacug

SEQ ID NO: 68846 - RNA, 64 nt, Homo Sapiens
cacuaggcccccacuugccuaugcgcccccuccgcccugccacucuaugccugacgcgggagcc

SEQ ID NO: 68847 - RNA, 64 nt, Homo Sapiens
cuuaacccagaacccuuaggcaucauccggugggcccugccaauuggagggaggugggaaaccu

SEQ ID NO: 68848 - RNA, 64 nt, Homo Sapiens
aagcugucugcggcucaucgagccacacccucuucccugccagccugacugcagagguccgugc

SEQ ID NO: 68849 - RNA, 64 nt, Homo Sapiens
ugcucugagccuagacccuggccccugccuggcucccugccaggcucccugccaccccucacga

SEQ ID NO: 68850 - RNA, 64 nt, Homo Sapiens
agacccuggccccugccuggcucccugccaggcucccugccaccccucacgaccucugaugguc

SEQ ID NO: 68851 - RNA, 64 nt, Homo Sapiens
auuaggauuccuuccacggcuccggccgcuaggacccugccaggucccgcgcaccaucccugcc

SEQ ID NO: 68852 - RNA, 64 nt, Homo Sapiens
gaucagcccguaucaucugaggccugccugcccacccugccacccuccccucccuugcugcucu

SEQ ID NO: 68853 - RNA, 64 nt, Homo Sapiens
cacccugccacccuccccucccuugcugcucugccccugccagugcccagcccagcggcucugg

SEQ ID NO: 68854 - RNA, 64 nt, Homo Sapiens
ggaaacugagcuggaggagcuuggagcuugguuucccugccagagggcaaguuccuuucccucu

SEQ ID NO: 68855 - RNA, 64 nt, Homo Sapiens
cuggggcuuccucaggcaugacccccacccucuccccugccagggccacaucuccccaccucuc

SEQ ID NO: 68856 - RNA, 64 nt, Homo Sapiens
cauggaagagacagcucaggaaacuguccccagacccugccacaucugacucagguuggcagau

SEQ ID NO: 68857 - RNA, 64 nt, Homo Sapiens
uugagauuuuuuacuuuuuuuugggaagauguuucccugccaucugcacccggugguggugaug

SEQ ID NO: 68858 - RNA, 64 nt, Homo Sapiens
gccuuccuuggugccugucccccucugggucgcacccugccagaaugaugguggaucccaaaac

SEQ ID NO: 68859 - RNA, 64 nt, Homo Sapiens
caguaguucucauguaggacauucuccuuuauuccccugccaccguuaaacucuuuucuccuua

SEQ ID NO: 68860 - RNA, 64 nt, Homo Sapiens
augcuagauuauuggcugggccacagccccgccucccugccaggagauggaaaugagaggaccu

SEQ ID NO: 68861 - RNA, 64 nt, Homo Sapiens
ugacuccagaagucucugaccaggaguacaucugcccugccacagacucugcggaucagugcua

SEQ ID NO: 68862 - RNA, 64 nt, Homo Sapiens
uuucuggagaggugccaaacgucugccacuugcucccugccaacgcuagggagagaggggugcu

SEQ ID NO: 68863 - RNA, 64 nt, Homo Sapiens
ggcggcucuguguguuaauauucuggccaugcugcccugccauuccuacaauauauaaggugac

SEQ ID NO: 68864 - RNA, 64 nt, Homo Sapiens
gggcacuggaauggacagcacucaggcccguggccccugccacaaagcagccucgggcaggggu

SEQ ID NO: 68865 - RNA, 64 nt, Homo Sapiens
ggccggaagccgcagggggcgucugcccccgacccccugccacagagcgcacggugaugcucgg

SEQ ID NO: 68866 - RNA, 64 nt, Homo Sapiens
aaaaaaaaaaaaaaagccagacuccguccccacccccugccaaagccugggcaacgagagugaa

SEQ ID NO: 68867 - RNA, 64 nt, Homo Sapiens
agccagagcacaggaagagcgaggcagcagucaucccugccaccaaccugcacccugggaccaa

SEQ ID NO: 68868 - RNA, 64 nt, Homo Sapiens
caccuggcugaggcaugucuccuuccccagccagcccugccacacgcagcuagagcugggccua

SEQ ID NO: 68869 - RNA, 64 nt, Homo Sapiens
ucugugccuccacagccugcaaacuugaguguuucccugccacuagaggcaccugcacaacgac

SEQ ID NO: 68870 - RNA, 64 nt, Homo Sapiens
guugcagcccugcugcugccugccuggacuuggccccugccaccuccugccucagguguccgcu

SEQ ID NO: 68871 - RNA, 64 nt, Homo Sapiens
caagggaccugcuucuauuagcccuucuccauggcccugccaugcucuccaaaccacuuuuugc

SEQ ID NO: 68872 - RNA, 64 nt, Homo Sapiens
agcccugggaaaaggcugugcagcagcccugggacccugccagcaacaggaccacaaccccugc

SEQ ID NO: 68873 - RNA, 64 nt, Homo Sapiens
agcccugggacccugccagcaacaggaccacaaccccugccagcgcggcgucgcuccucugcuc

SEQ ID NO: 68874 - RNA, 64 nt, Homo Sapiens
uccccguguuuccaagucaguccuuuuugccccucccugccaccaguggaucugcuugccagag

SEQ ID NO: 68875 - RNA, 64 nt, Homo Sapiens
agcugaagggugggaacaacgauuccucugcugucccugccagguguguuccccaagaguaucu

SEQ ID NO: 68876 - RNA, 64 nt, Homo Sapiens
uggucagagacacggucacugauucacacccagucccugccacagaccgucucagacacgcaca

SEQ ID NO: 68877 - RNA, 64 nt, Homo Sapiens
gcacagugggccugcugcaugauucacacccagucccugccacagaccgucucagacacgcaca

SEQ ID NO: 68878 - RNA, 64 nt, Homo Sapiens; identical to SEQ ID NO: 68877

SEQ ID NO: 68879 - RNA, 64 nt, Homo Sapiens
ccacugcccuccugggccuuccagcaccgccuagcccugccaccccaagucggcacugaguggc

SEQ ID NO: 68880 - RNA, 64 nt, Homo Sapiens
accacuuccucagcagaaacgagggcauauggggcccugccaacucccaccccugacaacccga

SEQ ID NO: 68881 - RNA, 64 nt, Homo Sapiens
ugcgugcauccuacuauguggucagugggaaugacccugccaauggcgagccaagccgggcugu

SEQ ID NO: 68882 - RNA, 64 nt, Homo Sapiens
gagaggaccucgccccaagcaagccagugagcagcccugccagacuacugccagacugagaaac

SEQ ID NO: 68883 - RNA, 64 nt, Homo Sapiens
ccccaaggcgguugccggaggcacugaagcuccucccugccacagcagugccggccacacccau

SEQ ID NO: 68884 - RNA, 64 nt, Homo Sapiens
caggccgggcuagggacauggcccaggagcugggcccugccacccccaggagcuggguccugcc

SEQ ID NO: 68885 - RNA, 64 nt, Homo Sapiens
uuggcuccuccaggaaggcucaggagcccuaccucccugccauuauagcugcuccccgccagaa

SEQ ID NO: 68886 - RNA, 64 nt, Homo Sapiens
gacaaaaucaauaaaacuaaugucccuccccucucccugccaaaaggcaguuacauaucaauac

SEQ ID NO: 68887 - RNA, 64 nt, Homo Sapiens
ggcucaggccugggucuaagccaagugcggcugccccugccagaggcuugggaagaccgcccug

SEQ ID NO: 68888 - RNA, 64 nt, Homo Sapiens
ugcggcugccccugccagaggcuugggaagaccgcccugccaagugccaaggugaagaagugag

SEQ ID NO: 68889 - RNA, 64 nt, Homo Sapiens
aggcuugggcacgggagguuagaacucccccaggcccugccauuggguugucugucuccgucau

SEQ ID NO: 68890 - RNA, 64 nt, Homo Sapiens
cuccagguuuggggcuccuuccuuccacuccccucccugccagagucugucuuggccagugcca

SEQ ID NO: 68891 - RNA, 64 nt, Homo Sapiens
ccaccuccaggguccugaccaggucagagauguccccugccaugcagagcaggaagccucagcu

SEQ ID NO: 68892 - RNA, 64 nt, Homo Sapiens
agccucagcugggccuggagugucccugcuccagcccugccagggacagguuucucccuggaua

SEQ ID NO: 68893 - RNA, 64 nt, Homo Sapiens
ugcccugcuccuaaggguagaaaacuccaggguccccugccaccgacugcccagccacuccaag

SEQ ID NO: 68894 - RNA, 64 nt, Homo Sapiens
gggacaggcuggaaugagggaggcgucuucaucucccugccaucccccucucacgccacccccg

SEQ ID NO: 68895 - RNA, 64 nt, Homo Sapiens
ugggcuguaguuacauuaaugcccagccagccaccccugccacucacccuuccuggcccaggcc

SEQ ID NO: 68896 - RNA, 64 nt, Homo Sapiens
aagcagguuggacagaaaccgcugggucugacaucccugccagggaaguuguguggaagccaag

SEQ ID NO: 68897 - RNA, 64 nt, Homo Sapiens
aaaaugugcucugcagugucggcaucuuggcucucccugccagauggugggauccacacagaug

SEQ ID NO: 68898 - RNA, 64 nt, Homo Sapiens
caccaagcacugcccugggccacacugcuugaggcccugccaggaugccucugccuucgcauag

SEQ ID NO: 68899 - RNA, 64 nt, Homo Sapiens
gaacaaaggcugagauggcacugccagcugccuucccugccagacccccaccucgacucggccu

SEQ ID NO: 68900 - RNA, 64 nt, Homo Sapiens
guggacucuuguauuugaggacucuguucucccucccugccauugcccccaccacagcucuaug

SEQ ID NO: 68901 - RNA, 64 nt, Homo Sapiens
acuuggggagggcaguuuuguacccuaaaugccccccugccauacccuugucuuauuguccccc

SEQ ID NO: 68902 - RNA, 64 nt, Homo Sapiens
ccuccccagucaccaguucuguaggcacacugcccccugccaccgcuuugggaccacaugguca

SEQ ID NO: 68903 - RNA, 64 nt, Homo Sapiens
auccuuagcccccauaucugccugaccugugacccccugccacagaaccugaauccaucccccu

SEQ ID NO: 68904 - RNA, 64 nt, Homo Sapiens
agacagccucuccuucucagugcagggacgucaccccugccaggcaagcccagggcacagaugc

SEQ ID NO: 68905 - RNA, 64 nt, Homo Sapiens
aggauggcuucucccucucagugcgaggcuucaccccugccaggcaagcccagggcauagaugc

SEQ ID NO: 68906 - RNA, 64 nt, Homo Sapiens
agacagccucucccucucagugcagggacgucaccccugccaggcaagcccagggcacagaggc

SEQ ID NO: 68907 - RNA, 64 nt, Homo Sapiens
ggauggccccucccucucagugcgggaacgucaccccugccaggcaagcccagggcacagaugc

SEQ ID NO: 68908 - RNA, 64 nt, Homo Sapiens
ccacagagucuucagcgcaucccccaacagcagccccugccagucccucggguccaggcaaggc

SEQ ID NO: 68909 - RNA, 64 nt, Homo Sapiens
gccugccagcagcgccucagugcccgagcugguccccugccauuccgggaccucucuggaguac

SEQ ID NO: 68910 - RNA, 64 nt, Homo Sapiens
aggucugagccgacgcccuugccccugccccuaccccugccagcgcccacccccagccagggcc

SEQ ID NO: 68911 - RNA, 64 nt, Homo Sapiens
cacccacccagaaucugcccaguccccacuucuucccugccacgcgugugugugcgugugccac

SEQ ID NO: 68912 - RNA, 64 nt, Homo Sapiens
ccuuaccccaggagccaccccuguaccccccuugcccugccauucacccuccaccccuaccccu

SEQ ID NO: 68913 - RNA, 64 nt, Homo Sapiens
ccaaccaccagagaaaaaagacuguggggcccuccccugccaacuccccuucccuggccgccca

SEQ ID NO: 68914 - RNA, 64 nt, Homo Sapiens
cgggcucucccucacagccuccagagggaaccagcccugccaccaccuugacccuggacuucug

SEQ ID NO: 68915 - RNA, 64 nt, Homo Sapiens
gaaucugaaacaggaucaaacucugcuuccugggcccugccagcaucucuggcucggcuuucug

SEQ ID NO: 68916 - RNA, 64 nt, Homo Sapiens
caaagugcuaggauaacaggugugagccaccgcacccugccaaguuauuuuaaaauguaccauu

SEQ ID NO: 68917 - RNA, 64 nt, Homo Sapiens
gugugugugugguacccauuaaccuuccccaucucccugccagccccuaacuacccuccccagc

SEQ ID NO: 68918 - RNA, 64 nt, Homo Sapiens
guuucugaugacaguguuaucccaagacccugcccccugccagccgacccuccuggccuuccuc

SEQ ID NO: 68919 - RNA, 64 nt, Homo Sapiens
ucugaccguuuucacuugucuccuuucugacugucccugccaaugcuccagcugucgucugacu

SEQ ID NO: 68920 - RNA, 64 nt, Homo Sapiens
gcugggggugagaaggggaggaguugccuagaaccccugccaggugugugugugaggguugguu

SEQ ID NO: 68921 - RNA, 64 nt, Homo Sapiens
uggagacgcagaggccgaacgcucaggccacccucccugccacgcugccagauaagcuguaggg

SEQ ID NO: 68922 - RNA, 64 nt, Homo Sapiens
uggcccccucaggccuaugucugugaggaaggggcccugccacucuccccaagagggccuccau

SEQ ID NO: 68923 - RNA, 64 nt, Homo Sapiens
acaaagcccaggccugucaagagacgcagagggccccugccaggguuggccccagggacccugg

SEQ ID NO: 68924 - RNA, 64 nt, Homo Sapiens
cccccaaaggugccaccgugcgggucuccuagcucccugccagcuuccugucccugugcucacu

SEQ ID NO: 68925 - RNA, 64 nt, Homo Sapiens
aagcccgggcacccgcccagccgggcugggcccucccugccacacuagcuucccagggcugccc

SEQ ID NO: 68926 - RNA, 64 nt, Homo Sapiens
cagagcccuggccgcuggagacaccucacagcugcccugccaugcccugccacccagcauagac

SEQ ID NO: 68927 - RNA, 64 nt, Homo Sapiens
cagcauagacacaccucacaacagggcaucugaccccugccaccccaaguuucuguggcucauu

SEQ ID NO: 68928 - RNA, 64 nt, Homo Sapiens
gccuaugccccaccugcccuuugacauguagguacccugccacgggcccacccaucacguguga

SEQ ID NO: 68929 - RNA, 64 nt, Homo Sapiens
uuagugucuugguguaguguaggaucccagggcucccugccauuucccugugucugccaacccc

SEQ ID NO: 68930 - RNA, 64 nt, Homo Sapiens
gacagaccccgauuaaacccccucccugcagcugcccugccacccccaggcaucaccaacacgg

SEQ ID NO: 68931 - RNA, 64 nt, Homo Sapiens
aaaggacuugaucugaguugaggaccggggcagccccugccaccuagagcuugcccugggucag

SEQ ID NO: 68932 - RNA, 64 nt, Homo Sapiens
aaaaagggaggaagugggggcuggauaugcccaccccugccaaaagcccugaccccagggaagg

SEQ ID NO: 68933 - RNA, 64 nt, Homo Sapiens
ucccagacugauuacaugagacuggggaguccuucccugccaguuuucucauuuauuacagccu

SEQ ID NO: 68934 - RNA, 64 nt, Homo Sapiens
acaugggaccuggaggagccuaccuggggccugccccugccagcaggugccagggcuggugagg

SEQ ID NO: 68935 - RNA, 64 nt, Homo Sapiens
cagaugccaaugccaauuccaaggccagccacaacccugccaccuuggggaauccagccuggag

SEQ ID NO: 68936 - RNA, 64 nt, Homo Sapiens
gcuuaauaccaauuucucugaguuucuugaaaugucuuuaaaacagacauuuuucucaccaaac

SEQ ID NO: 68937 - RNA, 64 nt, Homo Sapiens
auguauacauuuuaggaaauguuacuuuuguuaaucuuuaaaaaauacaccuaaugaaagacau

SEQ ID NO: 68938 - RNA, 64 nt, Homo Sapiens
uacacuuuggcuaugaacaaauaauaaaaauuauucuuuaaaguaaugucuuuaaaggcaaagg

SEQ ID NO: 68939 - RNA, 64 nt, Homo Sapiens
gaacaaauaauaaaaauuauucuuuaaaguaaugucuuuaaaggcaaagggaaggguaaagucg

SEQ ID NO: 68940 - RNA, 64 nt, Homo Sapiens
ggaaugucagucagucucuguaguuaaaacuuuuucuuuaaaauucaauuaagguacuucuccc

SEQ ID NO: 68941 - RNA, 64 nt, Homo Sapiens
ggaaugucagucagucucuguaguuaaaacuuuuucuuuaaaauucaauuaaguuacaccagaa

SEQ ID NO: 68942 - RNA, 64 nt, Homo Sapiens
aucaggaaaaaaaccaaaacuuguacuuuacuaaucuuuaaacuuuucucuauuuagacuguuu

SEQ ID NO: 68943 - RNA, 64 nt, Homo Sapiens
uuuauaauguagcuucuuucugauuuuuaacguuucuuuaaauacacuaaucugauuuucacuc

SEQ ID NO: 68944 - RNA, 64 nt, Homo Sapiens
aacauccagaaaaaaaaaaguuuuaauuuaccagucuuuaaagcuaguguuaguacuuuaaaau

SEQ ID NO: 68945 - RNA, 64 nt, Homo Sapiens
uguauguacugguuacaucauucaucuuugucauucuuuaaaaguuucauagacuauuuccuuu

SEQ ID NO: 68946 - RNA, 64 nt, Homo Sapiens
uaaaucuccugacucacauuguucuugaugaaccucuuuaaauuucccuuauaaacaaugagca

SEQ ID NO: 68947 - RNA, 64 nt, Homo Sapiens
aaugaugacuguuuuugaaauauuauccuauaauucuuuaaagaaaugcugaaaagccauuguu

SEQ ID NO: 68948 - RNA, 64 nt, Homo Sapiens
uucuuuuagugaaauugucaccagcauccgguagucuuuaaacaagucaugaaguugguuugcu

SEQ ID NO: 68949 - RNA, 64 nt, Homo Sapiens
cuuuacuaauuauauaauuuuuuucauuuguuuuucuuuaaaucuauucaguaagagaauagaa

SEQ ID NO: 68950 - RNA, 64 nt, Homo Sapiens
caaaaaaaaaaagguaaaugggaucuccuauuuuucuuuaaauauguaaaaacaaaacuauaau

SEQ ID NO: 68951 - RNA, 64 nt, Homo Sapiens
uguuuuuucucuuuccaguauaugaaaaauuucuucuuuaaacugugcuacuaaacaagaagcc

SEQ ID NO: 68952 - RNA, 64 nt, Homo Sapiens
caccaauugacuuugaaaaguggagaaaguguauucuuuaaagagaauuuacuucuaaaagcca

SEQ ID NO: 68953 - RNA, 64 nt, Homo Sapiens
uuuacaaauuaaaaaaacauuuuuuucuugguagucuuuaaaaauuaggggauugaaaggaucc

SEQ ID NO: 68954 - RNA, 64 nt, Homo Sapiens
aaacauuuugcauguguaaagcuucaugaaguucucuuuaaaaaauaccaaagcuuguuuauuu

SEQ ID NO: 68955 - RNA, 64 nt, Homo Sapiens
uaguuauuugcuuuaaaauaaacucuucuuuuuuucuuuaaaguauacuaucucaaaacucauu

SEQ ID NO: 68956 - RNA, 64 nt, Homo Sapiens
uaacugaaauuugcugcugauauguugaguuuguucuuuaaaaaauagcucauauaucucaucu

SEQ ID NO: 68957 - RNA, 64 nt, Homo Sapiens
uccaaaguucagccaguuaucaguagauacaauaucuuuaaaugaacacacgaguguaugucuc

SEQ ID NO: 68958 - RNA, 64 nt, Homo Sapiens
auacacaagugugcauauacaguuaaugaaacuaucuuuaaauguuauucaugcuauaaagagu

SEQ ID NO: 68959 - RNA, 64 nt, Homo Sapiens
cuucccacucuccccgacuucauucacucaaacuucuuuaaauggggaaaaauauuugugacuc

SEQ ID NO: 68960 - RNA, 64 nt, Homo Sapiens
agauaguuagaaaaagauuuucauugaugacauaucuuuaaacuuucuugcaucaguauucuaa

SEQ ID NO: 68961 - RNA, 64 nt, Homo Sapiens
uauggcaucucucaacuuuugucugacuaccaugucuuuaaacaagaaaugugauuacaaagaa

SEQ ID NO: 68962 - RNA, 64 nt, Homo Sapiens
cuuuguacuaacuuuaucacagcugacugacauaucuuuaaauauuguuuuucuauauaaaaag

SEQ ID NO: 68963 - RNA, 64 nt, Homo Sapiens
cacaacacagagcugcuauuauauuuuaucuuguucuuuaaaauuuaaaugacugcugaaugac

SEQ ID NO: 68964 - RNA, 64 nt, Homo Sapiens
augcuggguguugcauuucuucuagcuauuauuuucuuuaaagaggaaucuguaucagaaagau

SEQ ID NO: 68965 - RNA, 64 nt, Homo Sapiens
auaucucauauaucucgucuuauguugaguuuguucuuuaaaaauaacugaaauuugcugcuga

SEQ ID NO: 68966 - RNA, 64 nt, Homo Sapiens
auacuaccucaaaacucauuaacucuucuuuuuuucuuuaaaguuaguuauuugcuuuaaaaua

SEQ ID NO: 68967 - RNA, 64 nt, Homo Sapiens
gauggcaagaugugggcaguaaauguuguucucuucuuuaaagguuuucuaacuggacugguuc

SEQ ID NO: 68968 - RNA, 64 nt, Homo Sapiens
acacacucaaaucaagaaaccaagaugaugaugaucuuuaaaauuuaucucaaaacugcacugu

SEQ ID NO: 68969 - RNA, 64 nt, Homo Sapiens
uugcuggcaccugcuauacuggaguauugcuaugucuuuaaaaaauuuuuuuuauuauauuuua

SEQ ID NO: 68970 - RNA, 64 nt, Homo Sapiens
uguucuuuuauaaauguaauaaggaauaucuugcucuuuaaaauuuauuaggauuuuuaugagu

SEQ ID NO: 68971 - RNA, 64 nt, Homo Sapiens
cugcccaucuuggaggugcauggcccaucagggaucuuuaaagugggagcaggaaaggcugcua

SEQ ID NO: 68972 - RNA, 64 nt, Homo Sapiens
aguucuuuggggcuuauuuucuggguaaggcucaucuuuaaaaacuggcuucagaggggagagg

SEQ ID NO: 68973 - RNA, 64 nt, Homo Sapiens
gacaaaaccaaaagaaauuaacaggccacagguuucuuuaaagcuguguuaacauaucuugccu

SEQ ID NO: 68974 - RNA, 64 nt, Homo Sapiens
acauuuugggaccagauguauuuggggauagaauucuuuaaauguaugggacuucaugcuuccu

SEQ ID NO: 68975 - RNA, 64 nt, Homo Sapiens
uuucugaguugaccaauaaauaaaaauaccacuuucuuuaaaaaagccuagggaauugaagcuc

SEQ ID NO: 68976 - RNA, 64 nt, Homo Sapiens
aaaaaaagaaaagaaaaagcagcauccuuauauuucuuuaaaauacauagaaauaaaguuagua

SEQ ID NO: 68977 - RNA, 64 nt, Homo Sapiens
agaauuauuguauuuaaaaaaaaacuaauacuuaucuuuaaaauaguaaauaggauuuuaaaca

SEQ ID NO: 68978 - RNA, 64 nt, Homo Sapiens
auuaaauaauuuuggccucucauaguuuucucucucuuuaaagagaauaaauagagggccaggu

SEQ ID NO: 68979 - RNA, 64 nt, Homo Sapiens
uaaguaauuugaauuggcagcuuucuuugcuaaaucuuuaaauucuguuaagauccucaaguaa

SEQ ID NO: 68980 - RNA, 64 nt, Homo Sapiens
aggcucccaucaugccauuuuuuguucauuuuaaucuuuaaaaaauaaaaauuaggcauauuaa

SEQ ID NO: 68981 - RNA, 64 nt, Homo Sapiens
acauugguuuaugacauaugcuuagcuuuugcuuucuuuaaaauaaagauaacauuuucaaaua

SEQ ID NO: 68982 - RNA, 62 nt, Homo Sapiens
aaguuaucuuuuaguuuauuguaaacaguuacucuuuaaagcuuuccuccaagggcaaauaa

SEQ ID NO: 68983 - RNA, 64 nt, Homo Sapiens
aaaguaaauuagaauuuuuauaugagauauuuauucuuuaaaucauaaaauaguucaccauggg

SEQ ID NO: 68984 - RNA, 64 nt, Homo Sapiens
uggauugucuggugaguuuuuuuuuccaucaguuucuuuaaaauaguucauguuaggggaagca

SEQ ID NO: 68985 - RNA, 64 nt, Homo Sapiens
auucugugagcaaaguuuguuauuuuuacaugaaucuuuaaacaaagucugggacgacaucuuu

SEQ ID NO: 68986 - RNA, 64 nt, Homo Sapiens
caguaaaauggacuagcauauaaaaauugcaguaucuuuaaaauugaaaaaucaucgaaaugua

SEQ ID NO: 68987 - RNA, 64 nt, Homo Sapiens
aguucucuucuuucuuuagcaaaucagagugacuucuuuaaaccacagguuguugaaauggcca

SEQ ID NO: 68988 - RNA, 64 nt, Homo Sapiens
gugcaugacacuaagauuuuauguuggagauacuucuuuaaauaaccuacagcuugggucuaug

SEQ ID NO: 68989 - RNA, 64 nt, Homo Sapiens
auaccuauuuuauaugaugggggaaaaaaaguaaucuuuaaacuggcuggcccagaguuuacau

SEQ ID NO: 68990 - RNA, 64 nt, Homo Sapiens
ugauacucucagauuuuaagggggaaaacuguucucuuuaaaauauuugucuuuaaacagcaac

SEQ ID NO: 68991 - RNA, 64 nt, Homo Sapiens
uuaagggggaaaacuguucucuuuaaaauauuugucuuuaaacagcaacuacagaaguggaagu

SEQ ID NO: 68992 - RNA, 64 nt, Homo Sapiens
agggagauggauuaaugugaguaacaggaaugugucuuuaaaaagcuagagugguuacauuuaa

SEQ ID NO: 68993 - RNA, 64 nt, Homo Sapiens
ucccacaacugggguaggaagcucaggacuuuuuucuuuaaagcuagucauuucaaaagcauau

SEQ ID NO: 68994 - RNA, 64 nt, Homo Sapiens
ucauauugcccaacagaaacaugggaaaaguagcucuuuaaaaagggaaaauuguuuagguuau

SEQ ID NO: 68995 - RNA, 64 nt, Homo Sapiens
gcauuuuugcaccaguaaaaguaaaguaaggauuucuuuaaauauugaauugugcaacuccugu

SEQ ID NO: 68996 - RNA, 64 nt, Homo Sapiens
cucugcuuguauuuugcgaugaagaugugauacaucuuuaaaugaaaauauaccaaaauuuagu

SEQ ID NO: 68997 - RNA, 64 nt, Homo Sapiens
caucaguacgugagacaagcaguuaauaguaugaucuuuaaaguuuugacaauauaaaauaaac

SEQ ID NO: 68998 - RNA, 64 nt, Homo Sapiens
aacaaaagaaagauugccugcuaggauugugccaucuuuaaaauuuuuacuauuggucauuugc

SEQ ID NO: 68999 - RNA, 64 nt, Homo Sapiens
gugugacuugaaauucaguaguaaaagaauuucuucuuuaaagcuuuaauuaccuucagacauu

SEQ ID NO: 69000 - RNA, 64 nt, Homo Sapiens
ccccuuaaagauaauguacaugcuucaugucaugucuuuaaaauaauuuaaucaacuuuauugu

SEQ ID NO: 69001 - RNA, 64 nt, Homo Sapiens
cgaucuuuaaguuguuacuauuguguuauucaugucuuuaaaucagauaccaaauauuuuuuag

SEQ ID NO: 69002 - RNA, 64 nt, Homo Sapiens
cuguuguacguacuacggaguucugccuacguucucuuuaaaaguaugguuucugucugaauua

SEQ ID NO: 69003 - RNA, 64 nt, Homo Sapiens
uuucauaauuuuuaaagguucucuauuaaugaggucuuuaaaccauaauagcaaacauuucuaa

SEQ ID NO: 69004 - RNA, 64 nt, Homo Sapiens
uauuuuuaggcacauuugugcuucccuacaaagaucuuuaaaguucuggacuuaagaguuucug

SEQ ID NO: 69005 - RNA, 64 nt, Homo Sapiens
augaaauuucugaucucaccgaauauugaggaucucuuuaaaaaguaugaucugugguuccuua

SEQ ID NO: 69006 - RNA, 64 nt, Homo Sapiens
gaaaaagaauuugguuuugcaaagauuuaauauuucuuuaaauacaaauuauguuggggaaaau

SEQ ID NO: 69007 - RNA, 64 nt, Homo Sapiens
acaagagaauuugguuauaaauauuuuucugcauucuuuaaaaggugcuccuucuuagcaauca

SEQ ID NO: 69008 - RNA, 64 nt, Homo Sapiens
gagaaauaaauauacaauuaacauuaaggaguguucuuuaaaaaccaaguuuguauauugaauu

SEQ ID NO: 69009 - RNA, 64 nt, Homo Sapiens
auuaaggugacaaagcacauaccuaugcuaggugucuuuaaaaauggacacuagguugccacag

SEQ ID NO: 69010 - RNA, 64 nt, Homo Sapiens
aauauucuuaguaccacaagauaugucauagguaucuuuaaaugaaauucuuagcuggaaaagu

SEQ ID NO: 69011 - RNA, 64 nt, Homo Sapiens
caugaaagucauugguaggccauuagcauugauaucuuuaaaacaucuacccuaaaccaucugc

SEQ ID NO: 69012 - RNA, 64 nt, Homo Sapiens
agaccagccugggcaacauaccaagacccccgucucuuuaaaaauauauauauuuuaaauauac

SEQ ID NO: 69013 - RNA, 64 nt, Homo Sapiens
uauuuuaaauauacuuaaauauauauuucuaauaucuuuaaauauauauauauauuuuaaagac

SEQ ID NO: 69014 - RNA, 64 nt, Homo Sapiens
cuuuuuuuuauuuugcaauucucuguauucuaugucuuuaaaaauuugaucuugacauuuaaug

SEQ ID NO: 69015 - RNA, 64 nt, Homo Sapiens
augaauuauuguuuuucauacuuuuuugcuuguuucuuuaaaguuuucugacgugcauaaugca

SEQ ID NO: 69016 - RNA, 64 nt, Homo Sapiens
uuuccagugucuucgccacauaaaauagccauuuucuuuaaaauaguuuuggacuaacgaagcu

SEQ ID NO: 69017 - RNA, 64 nt, Homo Sapiens
gcucauuuuaacaaauaugaccgagucuaguuuuucuuuaaaaggauaguuuaugaguaaucuu

SEQ ID NO: 69018 - RNA, 64 nt, Homo Sapiens
cuaguuuuucuuuaaaaggauaguuuaugaguaaucuuuaaaaccauuuccauaccaucuguau

SEQ ID NO: 69019 - RNA, 64 nt, Homo Sapiens
uuauuaccacauaguauuuuuauguuacccaucaucuuuaaaaacauuauaggcugggcauggu

SEQ ID NO: 69020 - RNA, 64 nt, Homo Sapiens
uaacucucuccagaaaauggauggagauaacuugucuuuaaaacuguaggccagccuuagccac

SEQ ID NO: 69021 - RNA, 64 nt, Homo Sapiens
uccuuccauagacagcugccucaaagggaaauccucuuuaaaccguaguuggcgcagaggucag

SEQ ID NO: 69022 - RNA, 64 nt, Homo Sapiens
caacuuuaaagguucuuuugguuugcauaguuuaucuuuaaaaauugaagcuucaguauaccau

SEQ ID NO: 69023 - RNA, 64 nt, Homo Sapiens
auaucugaaaguaguagucacgauggauauugguucuuuaaaauaacguagcugcaguugucca

SEQ ID NO: 69024 - RNA, 64 nt, Homo Sapiens
acuuucagauucuguugacaaguuaaggauuguuucuuuaaacaaaccaaaaguuaaauauucu

SEQ ID NO: 69025 - RNA, 64 nt, Homo Sapiens
gggaaggucaagcaaagaaccuuuaacauagagaucuuuaaaaaucagaauaccuaagcugcuu

SEQ ID NO: 69026 - RNA, 64 nt, Homo Sapiens
uagauucuugcuucugauaucaauagugguaaaaucuuuaaaacguaauaugaucaaaguuaag

SEQ ID NO: 69027 - RNA, 64 nt, Homo Sapiens
gcaagcagugagaaauaagagcuuuagacauauuucuuuaaaauauauuagugguuuacaaugc

SEQ ID NO: 69028 - RNA, 64 nt, Homo Sapiens
uauuagguuauacauuagucaguguuugggggugucuuuaaauaaaacauaucaauauaauuac

SEQ ID NO: 69029 - RNA, 64 nt, Homo Sapiens
uaggucuuuuuuuuauauuucaucuuuaaauaguucuuuaaaaaaaaaguguuguuuucaaagc

SEQ ID NO: 69030 - RNA, 64 nt, Homo Sapiens
guucuuuaaaaauaggucuuuguuuucaaagccaucuuuaaauauuuguuguaaauaaaagugu

SEQ ID NO: 69031 - RNA, 64 nt, Homo Sapiens
aaugucuuuguaugucucaaaccaagaaaauagcucuuuaaaagaaaauuaaccuuugugcaau

SEQ ID NO: 69032 - RNA, 64 nt, Homo Sapiens
uuuggagaagauauguaaauuuuuagagcuugguucuuuaaagauaaauaucuuuacguguguu

SEQ ID NO: 69033 - RNA, 64 nt, Homo Sapiens
cuugcaggaaugagucacuccucagaaaugaaccucuuuaaagcucagaaucguggagagaaua

SEQ ID NO: 69034 - RNA, 64 nt, Homo Sapiens
uuuauuguuugaagcgaguuaauauucucaguugucuuuaaaaaucaguuacucuaauuccagg

SEQ ID NO: 69035 - RNA, 64 nt, Homo Sapiens
uggcauuuucucuacacacucacccucuuccaguucuuuaaaaacguuuaugauauuaagauca

SEQ ID NO: 69036 - RNA, 64 nt, Homo Sapiens
cucuaaaucuuuauucaugugcuuuuacuguauuucuuuaaaaaauuaugcuucauauguuuuu

SEQ ID NO: 69037 - RNA, 64 nt, Homo Sapiens
augagggagcucaguguuuaaacggaaagagugcucuuuaaacauuaucaguuaguggaaauag

SEQ ID NO: 69038 - RNA, 64 nt, Homo Sapiens
guaaagccaugcuggaaaauuauaguuauuaaguucuuuaaaauuagcaugcaucuguuuauuc

SEQ ID NO: 69039 - RNA, 64 nt, Homo Sapiens
gacuaauggcaugagaaauacauguuucacaaggucuuuaaagucaaaugccugacuagggagc

SEQ ID NO: 69040 - RNA, 64 nt, Homo Sapiens
augcuuuuaacagagucugacuuggcugcaggaaucuuuaaaagggggcauccucuuuuuccaa

SEQ ID NO: 69041 - RNA, 64 nt, Homo Sapiens
aaauuuucuacucuuuuuguuuuuuguguuuuguucuuuaaagucagguccaauuuguaaaaac

SEQ ID NO: 69042 - RNA, 64 nt, Homo Sapiens
gggcugggcuuagacagaguugaucuguagaauaucuuuaaaggagagaugucaacuuucugca

SEQ ID NO: 69043 - RNA, 64 nt, Homo Sapiens
acuuaagcaaaagaaaaagauuacccaaaaacugucuuuaaaagagagagagagaaaaaaaaaa

SEQ ID NO: 69044 - RNA, 64 nt, Homo Sapiens
cucacauugccaggaugauaaguuccuuuccuuuucuuuaaagaaguugaaguuuaggaauccu

SEQ ID NO: 69045 - RNA, 64 nt, Homo Sapiens
aaaauuacccuuugacuuuuuuauaaguaauauaucuuuaaaagauucauacuucgggaauauu

SEQ ID NO: 69046 - RNA, 64 nt, Homo Sapiens
uacagcagggguaaacauucgauaucuaugcuguucuuuaaaucauuuuauuugggguucuuga

SEQ ID NO: 69047 - RNA, 64 nt, Homo Sapiens
gagaagcaauuuuggggaaggguuugaauuguuuucuuuaaagauguaaugucccuuucagaga

SEQ ID NO: 69048 - RNA, 64 nt, Homo Sapiens
gcacacuuguaggauaagugaaauggauacuacaucuuuaaacaguauuucauugccuguguau

SEQ ID NO: 69049 - RNA, 64 nt, Homo Sapiens
aacccuaucuagucaacugggcauaaugacauuuucuuuaaauuagacucuauuuugaauuaaa

SEQ ID NO: 69050 - RNA, 64 nt, Homo Sapiens
ucuuuuaugcauuuauuacuaacauagcuuuaaaucuuuaaauguauugaagcauugugcuguc

SEQ ID NO: 69051 - RNA, 64 nt, Homo Sapiens
uuaaaucuuaaaauugcugaauuuacccucauauucuuuaaaaaacuuaaagcauuaugaaugu

SEQ ID NO: 69052 - RNA, 64 nt, Homo Sapiens
ucagcuucuuuauuuccuccuaauggaaacauuaucuuuaaaaguugcauauaggaaauauaca

SEQ ID NO: 69053 - RNA, 64 nt, Homo Sapiens
ucuaccuugugccuguaaaaucgaaagauuuuuuucuuuaaaucauucaugugcuucuguuguc

SEQ ID NO: 69054 - RNA, 64 nt, Homo Sapiens
augcagggacucugcaaguuuggcuuuuaugaagucuuuaaagucuuguauagcaauaugcuug

SEQ ID NO: 69055 - RNA, 64 nt, Homo Sapiens
ccaggaucaucaaugcuauugacuaaagcagccaucuuuaaaaugcuuucccaaaaucaaagua

SEQ ID NO: 69056 - RNA, 64 nt, Homo Sapiens
cucaguuaucaacgccaaggcacugccuccagagucuuuaaauuucucccccacaggaacaaaa

SEQ ID NO: 69057 - RNA, 64 nt, Homo Sapiens
caugucaccuuagguaguaggaagaauuacaauuucuuuaaaucauuuaucuggauuuuuaugu

SEQ ID NO: 69058 - RNA, 64 nt, Homo Sapiens
ucuauauauacaaugaguaaaaucacagauuuuuucuuuaaauaaaaauaagucauuuuaauaa

SEQ ID NO: 69059 - RNA, 64 nt, Homo Sapiens
augcauagaucagaauuuuaaauuaaagguuuuuucuuuaaaugauuuguauuacuuuauuaaa

SEQ ID NO: 69060 - RNA, 64 nt, Homo Sapiens
auaacucaauuuggaguauuuuuuaaaugcuguaucuuuaaagaaaaguaaaauugucuuaaau

SEQ ID NO: 69061 - RNA, 64 nt, Homo Sapiens
uuacuaugguauauauuuugccucuuaaaaauuaucuuuaaaacaauuuuauugaauauaaugg

SEQ ID NO: 69062 - RNA, 64 nt, Homo Sapiens
gauucacuuuuauuguauaauuguaaaugauaugucuuuaaaauucugauacuuauuuauaaca

SEQ ID NO: 69063 - RNA, 64 nt, Homo Sapiens
auuacaacacuuaaaauugauucccuauaugcagucuuuaaagguccuaguucuauguguuugu

SEQ ID NO: 69064 - RNA, 64 nt, Homo Sapiens
uuuaaguauucuacaaaaaauuguguauuaauguucuuuaaaaguuaagggaacuuccugaauu

SEQ ID NO: 69065 - RNA, 64 nt, Homo Sapiens
guuuugacagaucaucucaucacaaguucuucauucuuuaaaauagugugcuuuaguacauagc

SEQ ID NO: 69066 - RNA, 64 nt, Homo Sapiens
uaaauauuuuugguuucuguauauuaucaugucuucuuuaaaagacaugacuguuguuugcacu

SEQ ID NO: 69067 - RNA, 64 nt, Homo Sapiens
gcucuuaaauaugcauauuuucugccaacucacuucuuuaaacaucuuucagcccagcgcugcg

SEQ ID NO: 69068 - RNA, 64 nt, Homo Sapiens
guguuuaaucgcaguggguaaucuuaucugauugucuuuaaaagugaaaaggauuaagauuuua

SEQ ID NO: 69069 - RNA, 64 nt, Homo Sapiens
auuaucaaaaaauucuuugucuaauauauuggagucuuuaaaaguguugaagaauaaaauauua

SEQ ID NO: 69070 - RNA, 64 nt, Homo Sapiens
cuucuaguauuuucuuauuucacuuuuacaccuaucuuuaaaaggaauuuaaauuuuguuuaua

SEQ ID NO: 69071 - RNA, 64 nt, Homo Sapiens
cacaggacagcgggaaaaaucgaugagcgccaccucuuuaaaaacucacuuacguuuguccuuu

SEQ ID NO: 69072 - RNA, 64 nt, Homo Sapiens
cauaugcucuuuuaaauguuugguuuauauauuuucuuuaaaaauccugggcuggcacauugac

SEQ ID NO: 69073 - RNA, 64 nt, Homo Sapiens
uuccaagaucucacuucugcauuaucuuuauggcucuuuaaaccagccaccuagccaaucaagg

SEQ ID NO: 69074 - RNA, 64 nt, Homo Sapiens
cuuaaaugccgucacuccugcugagauaaaugcgucuuuaaaaauagucucuguggcaggucac

SEQ ID NO: 69075 - RNA, 64 nt, Homo Sapiens
gauuaagugcuuuuuuuucaucacuugauuauuuucuuuaaaaucagcuauuacaggauauuuu

SEQ ID NO: 69076 - RNA, 64 nt, Homo Sapiens
ucugaaagauggguucaucuauguuuguguuugcucuuuaaacuauuguuucuccuaucccaag

SEQ ID NO: 69077 - RNA, 64 nt, Homo Sapiens
ugaagacuagugagauuucuguaauaauuuuaauucuuuaaaaagugaaagcuuguuguaaaga

SEQ ID NO: 69078 - RNA, 64 nt, Homo Sapiens
ugacauuccauacuaauauacauuguuuaugcuuucuuuaaaauaacuagaagaacauaaaaga

SEQ ID NO: 69079 - RNA, 64 nt, Homo Sapiens
augucaaguuaaaccauucugggauuugggaacuucuuuaaaggaaaauuguaguagaggucau

SEQ ID NO: 69080 - RNA, 64 nt, Homo Sapiens
aaccaccaccaacaacaaaaagaaaagggaauucucuuuaaagaaagagcaagaagcucucuua

SEQ ID NO: 69081 - RNA, 64 nt, Homo Sapiens
caaccccaaugggagaaaagagccaccuaugugaucuuuaaaucucuccucagcuccucugagc

SEQ ID NO: 69082 - RNA, 64 nt, Homo Sapiens
gcgugugugcguguguguggauuuuuaaagaaauucuuuaaagguuuaacgcuagauugugagg

SEQ ID NO: 69083 - RNA, 64 nt, Homo Sapiens
gaauacuguaacaauauguuuucuuggauuguugucuuuaaaaaggauuuuugugaagcaauug

SEQ ID NO: 69084 - RNA, 64 nt, Homo Sapiens
uugugcuacuuaguaaaaauuuucaauauauauuucuuuaaaccgucugucccacccugauccu

SEQ ID NO: 69085 - RNA, 64 nt, Homo Sapiens
auaauuauccaauaaaaaaaaacuguuaaacaacucuuuaaagguaacacauuuuuaaagucua

SEQ ID NO: 69086 - RNA, 64 nt, Homo Sapiens
aacagaauucagugcucuuuuauuuuacuguaaaucuuuaaaaucagucuuuugggaaccaaag

SEQ ID NO: 69087 - RNA, 64 nt, Homo Sapiens
uguucuuuaacacugacuacaugcugacacguacucuuuaaaagaugcauuauugauuuaaaua

SEQ ID NO: 69088 - RNA, 64 nt, Homo Sapiens
agaauuguagaacuauguuauaguccagucuacuucuuuaaaaaccauuuaaacugcuagauag

SEQ ID NO: 69089 - RNA, 64 nt, Homo Sapiens
agaauaguccaauagaaaauucauucuuuauaggucuuuaaaaauuacuuuuauuauauuguuu

SEQ ID NO: 69090 - RNA, 64 nt, Homo Sapiens
ugccuccagugcauccuuacuuagguauuauacuucuuuaaaaagcucugaagcugcuacaaua

SEQ ID NO: 69091 - RNA, 64 nt, Homo Sapiens
cugauuccuuuuguccacuuauauaguuauuuucucuuuaaaaaaaaauuuuuuuuaauguauu

SEQ ID NO: 69092 - RNA, 64 nt, Homo Sapiens
accuugcccuguccaauaaaggauauguuuccaaucuuuaaaugaaacuaaacacguguuuuug

SEQ ID NO: 69093 - RNA, 64 nt, Homo Sapiens
acggaacgacucacuuaauaguaccaaucaaggcucuuuaaaauucagugauauucagaagugu

SEQ ID NO: 69094 - RNA, 64 nt, Homo Sapiens
caccuccuuuggugaaaccacggccaauguuccuuagcugcaccaggcccgaagcuguucccau

SEQ ID NO: 69095 - RNA, 64 nt, Homo Sapiens
augcuauaccccacugcugcccgacacugcccuuuagcugcagagcuggauuagcuguugacca

SEQ ID NO: 69096 - RNA, 64 nt, Homo Sapiens
auauagcuaaccacuuuccauuugaaaaugaacuuagcugcaaaaucaaagguuuuguaaaacu

SEQ ID NO: 69097 - RNA, 64 nt, Homo Sapiens
cacacuaauucacauuuuuaaucacucauacuuuuagcugcaacuacgucgucauucuuguuac

SEQ ID NO: 69098 - RNA, 64 nt, Homo Sapiens
auuaauaaauugcauguguucauccgggcgcugauagcugcacuaugaugggaguuauuuuuac

SEQ ID NO: 69099 - RNA, 64 nt, Homo Sapiens
aacacuaagucucaagggcucuugacuucaucucuagcugcagaucaggggccaaacuuacuac

SEQ ID NO: 69100 - RNA, 64 nt, Homo Sapiens
aacuuauuucuuaaucaaaaggcaguacaaaaaaaguaauaauguuuuauaagauuguagaguu

SEQ ID NO: 69101 - RNA, 64 nt, Homo Sapiens
gaaauguaaaaugugaaaacuuuagaucauuuguaguaauaaauauuuuuaacuucauucauac

SEQ ID NO: 69102 - RNA, 64 nt, Homo Sapiens
gaaccagaauguagaagaguagucauguaacagcaguaauaacauacuucagcuuccauauagg

SEQ ID NO: 69103 - RNA, 64 nt, Homo Sapiens
agugaaaaaaaugagugggaagaaugaauauaaaaguaauaauauaaggaaaaagggaaaguaa

SEQ ID NO: 69104 - RNA, 64 nt, Homo Sapiens
uccacuaccaaaagacauuagagaaaaccuuaaaaguaauaaagagaaauauauuugucacuua

SEQ ID NO: 69105 - RNA, 64 nt, Homo Sapiens
cuggcuugaaguuuuucuauuuagcaaaauaauuaguaauaaguuuugacuaggucuaaagaau

SEQ ID NO: 69106 - RNA, 64 nt, Homo Sapiens
aaagucaaagcaguguucuaacuaauaaauacaaaguaauaacacaaaauuaugaauaggauau

SEQ ID NO: 69107 - RNA, 64 nt, Homo Sapiens
ucuguaugaauaagcauaaaccaaaauucuagaaaguaauaaauuagugauuaugauucuuauc

SEQ ID NO: 69108 - RNA, 64 nt, Homo Sapiens
cuguggaaguaauuggaucuguaauaaacugaacaguaauaaaacaauuaggcuugucagguua

SEQ ID NO: 69109 - RNA, 64 nt, Homo Sapiens
ugaacaguaauaaaacugugaggcuugucagguuaguaauaaacgagugaaauguuacccaauu

SEQ ID NO: 69110 - RNA, 64 nt, Homo Sapiens
uaugacuguuuucauauugccuuuacucuuuaucaguaauaaauccccucuaugggaaggaugc

SEQ ID NO: 69111 - RNA, 64 nt, Homo Sapiens
ucucaaugaauuuuaaaaauaguuguggagaaaaaguaauaauuuauauuuuguauagaaucac

SEQ ID NO: 69112 - RNA, 64 nt, Homo Sapiens
uuucccugggaaaaccuucagcugcuuuauuuuuaguaauaaauuucucuugucaauucuguuu

SEQ ID NO: 69113 - RNA, 64 nt, Homo Sapiens
auugaggacaacacaaaugggauugguacuuuauaguaauaaaucugaccagcagagggaggga

SEQ ID NO: 69114 - RNA, 64 nt, Homo Sapiens
augagaagaaaugauucauaaauuuugaacuaacaguaauaacuucuugaaaauccaauaaaau

SEQ ID NO: 69115 - RNA, 64 nt, Homo Sapiens
uugaaaaaaaauuuuuugauaugacuacucuaacaguaauaacuauaaaucucacuuuaaauaa

SEQ ID NO: 69116 - RNA, 64 nt, Homo Sapiens
ugcccagcuccaaaucaccuugauucauaucagcaguaauaaucacuuguguucugaaagaaag

SEQ ID NO: 69117 - RNA, 64 nt, Homo Sapiens
uauggaagaauucaaauauaaauaaaaaauugugaguaauaaaaugaacucacaguuucaacaa

SEQ ID NO: 69118 - RNA, 64 nt, Homo Sapiens
uguuuuuauuuguuaaccaguaauaacaguaauaaguaauaaaggacagugguagugcuccauu

SEQ ID NO: 69119 - RNA, 64 nt, Homo Sapiens
aauaaaguguuuuuauuugucuccauuuaauaacaguaauaaguaugacuugacagugguagug

SEQ ID NO: 69120 - RNA, 64 nt, Homo Sapiens
aguaagcauuuucucaaugcaguaauaauuaauuaguaauaauuaugaagccaucuuaauaauu

SEQ ID NO: 69121 - RNA, 64 nt, Homo Sapiens
aauuaguaauaauuaguaagccaucuuaauaauuaguaauaauuuagaccauuuggggaugaag

SEQ ID NO: 69122 - RNA, 64 nt, Homo Sapiens
aaaauuuauacaaaguuucaauuuuaguauuuacaguaauaaauuuuaagguguuuucaaugug

SEQ ID NO: 69123 - RNA, 64 nt, Homo Sapiens
uuaauauucuguuuuauacuaguguccguuugccaguaauaaaucauuucaaaggaaauaaauc

SEQ ID NO: 69124 - RNA, 64 nt, Homo Sapiens
aaaauucuuacuagauagauauauuccuuccucccaggaguauuagacuagcuaauaguaaagg

SEQ ID NO: 69125 - RNA, 64 nt, Homo Sapiens
cuuugggaggccaagggaggugaucacuugagcccaggaguaaagaccagccugggcaacauag

SEQ ID NO: 69126 - RNA, 64 nt, Homo Sapiens
gagcccgguggucuggauuggaguauggccagggcaggaguacacagaauagaauuuagacugu

SEQ ID NO: 69127 - RNA, 64 nt, Homo Sapiens
aacaugugucuaccugagggcuaguugaaggauccaggaguauuuucuucuugggugggcccug

SEQ ID NO: 69128 - RNA, 64 nt, Homo Sapiens
uguucaucauugaguaauggauuaagugaaaauccaggaguauccaucugcaguuaugugcuga

SEQ ID NO: 69129 - RNA, 64 nt, Homo Sapiens
gggauagagguggcagaaugaaccugguguagggcaggaguauguuguguaguuacaucaauuu

SEQ ID NO: 69130 - RNA, 61 nt, Homo Sapiens
ccuggaccugggaggccccugugagggccagcucuggaaaaaccugggaguugaugccgga

SEQ ID NO: 69131 - RNA, 61 nt, Homo Sapiens
caacugucacgugugcuagaagguucgaugccucuggaaugcaugugauacucaucuccau

SEQ ID NO: 69132 - RNA, 61 nt, Homo Sapiens
ggacacagggauggauaccaccuacccucgccucuggaauggccuacccaacccgagaaga

SEQ ID NO: 69133 - RNA, 61 nt, Homo Sapiens
gaaaccaaagucugccgcccaccucgcuccccucuggaaucuuccccaagggccaaaccca

SEQ ID NO: 69134 - RNA, 61 nt, Homo Sapiens
ucuccugacccucccacucccaucuccuuaccucuggaaccccccaggcccuacaaugcuc

SEQ ID NO: 69135 - RNA, 61 nt, Homo Sapiens
gacugucacucggcucucccuacccauuuggcucuggaagcugcuuggcccccccagauca

SEQ ID NO: 69136 - RNA, 61 nt, Homo Sapiens
uucuggaccaccaccugggaccaaccuucagcucuggaaccuucauaaagcaggucagcgu

SEQ ID NO: 69137 - RNA, 61 nt, Homo Sapiens
auccaugcucuguggccaggugccugccacccucuggaacucacaaaagcuggcuuuuauu

SEQ ID NO: 69138 - RNA, 61 nt, Homo Sapiens
gggaguuauggggucaucaaggaccuugccucucuggaaucugucaacccaguuuugggcu

SEQ ID NO: 69139 - RNA, 61 nt, Homo Sapiens
cgaccccaccugccauuaccuucagggccuccucuggaagagaacccauucucagagugca

SEQ ID NO: 69140 - RNA, 61 nt, Homo Sapiens
agacagacagaaagccagaggcuuagggaaacucuggaacccagacaagaaucuuuucgcu

SEQ ID NO: 69141 - RNA, 61 nt, Homo Sapiens
acucccaaauugucaaguccugcuuaacuuucucuggaaaauagaccccuucucaacauca

SEQ ID NO: 69142 - RNA, 61 nt, Homo Sapiens
uauuauuaauaacccccucugaauuucaugucucuggaauugaggugguagugaacagcag

SEQ ID NO: 69143 - RNA, 52 nt, Homo Sapiens
aagccaaauauggauucuagggcucuggaacugauugcucccaggaucuccu

SEQ ID NO: 69144 - RNA, 61 nt, Homo Sapiens
cguccugugacucgccuugccacaucugugucucuggaacccaggaccucuggaccucagg

SEQ ID NO: 69145 - RNA, 61 nt, Homo Sapiens
accccagccuaaugaaacccuagguguugggcucuggaaugggacuuugucccuucuaauu

SEQ ID NO: 69146 - RNA, 61 nt, Homo Sapiens
uauauauauaaaaccagagcugacaaugacacucuggaacauugcauaccuucuguacauu

SEQ ID NO: 69147 - RNA, 61 nt, Homo Sapiens
aggcagagggaugaaaugccaagacucuaugcucuggaaaaccugaggccaaauauugauc

SEQ ID NO: 69148 - RNA, 61 nt, Homo Sapiens
uacuauguuaugaaugguauuaaauuuuagucucuggaacauccaaaaccaagcaaaggga

SEQ ID NO: 69149 - RNA, 61 nt, Homo Sapiens
cagcaggauguugaauugaucaucagaugcccucuggaaugguuagcauccaaggugacag

SEQ ID NO: 69150 - RNA, 61 nt, Homo Sapiens
aggcuagauccuucccauaguaucaucuguccucuggaaugacucuccugucccuaaaggg

SEQ ID NO: 69151 - RNA, 61 nt, Homo Sapiens
cucuugcuccucauuccuccccugcccuuuucucuggaauaucuaagaugugagcugcauu

SEQ ID NO: 69152 - RNA, 61 nt, Homo Sapiens
acgagacugagguuaaacaucagaaaaaaaccucuggaaugaccuuccucauuccaggagg

SEQ ID NO: 69153 - RNA, 61 nt, Homo Sapiens
uuuguuacuuaaauauauagagaccaguuuucucuggaaguuuguuuaaaugacagaagcg

SEQ ID NO: 69154 - RNA, 61 nt, Homo Sapiens
uaaccccucccucaauaaauacauuacuguacucuggaauuuaggcaaaaccuuaaaucuc

SEQ ID NO: 69155 - RNA, 61 nt, Homo Sapiens
auuuuugaaguaaauuaaacauuuuucacaucucuggaaauuuagaguucuagaccucugg

SEQ ID NO: 69156 - RNA, 61 nt, Homo Sapiens
aaguugcagaugauucaaacacuuauuucugcucuggaauaauauuuauuguuagaaaaug

SEQ ID NO: 69157 - RNA, 61 nt, Homo Sapiens
ucuccacgcugaaugugauuaacuccagcaucucuggaaaacuacgugguggccgucugcc

SEQ ID NO: 69158 - RNA, 61 nt, Homo Sapiens
ugagaccacuggaggcacacaccaaggggcccucuggaacuggacaucaagggcggacacc

SEQ ID NO: 69159 - RNA, 61 nt, Homo Sapiens
gcuguauuugggccuaauccuccugggccagcucuggaaggugugacccugcucuuccagc

SEQ ID NO: 69160 - RNA, 61 nt, Homo Sapiens
ucauaggguugugaggcaaacaucuugugcccucuggaagcauauggucauuuacaagaca

SEQ ID NO: 69161 - RNA, 61 nt, Homo Sapiens
ugucugaacuugcugccuccagggcucguggcucuggaaugucguggcuuggauagaaucc

SEQ ID NO: 69162 - RNA, 61 nt, Homo Sapiens
aaaauauguauauauuaaaauucacuaaacucucuggaaaaagacgauagggcauaugaaa

SEQ ID NO: 69163 - RNA, 61 nt, Homo Sapiens
acaugucauuucauuuucaguugagaugauacucuggaaaaaaaaccaucaaauuuuauaa

SEQ ID NO: 69164 - RNA, 61 nt, Homo Sapiens
cagaggaguaagagaggaagcuugcagccaacucuggaaggcuccaggccacuaggccucc

SEQ ID NO: 69165 - RNA, 61 nt, Homo Sapiens
acagauucuuguuugguaaaaaaugagaauucucuggaauaucaaucucuucuucaaauca

SEQ ID NO: 69166 - RNA, 61 nt, Homo Sapiens
agaagucacacagacaaucaaaaaagucuuccucuggaaaguuuccuagaauuuaaaaaua

SEQ ID NO: 69167 - RNA, 61 nt, Homo Sapiens
gugcagagagugucaguuuccagaucuuucucucuggaaauguuuugaugcuagugaucuu

SEQ ID NO: 69168 - RNA, 61 nt, Homo Sapiens
gcauauccugcuagugauuugagcagauggucucuggaauuagaaacaaaacuaauuuuug

SEQ ID NO: 69169 - RNA, 61 nt, Homo Sapiens
aaacaugugaguaagugagagugagcagucccucuggaaagauaggcucuuuuugcugccu

SEQ ID NO: 69170 - RNA, 57 nt, Homo Sapiens
cuugggggguguuggggagagaacucccucuggaauuggccuguccgggggcacuga

SEQ ID NO: 69171 - RNA, 61 nt, Homo Sapiens
uacccauagaagacgggaagaaacucaaccacucuggaauuagagccuggggaggagcuua

SEQ ID NO: 69172 - RNA, 61 nt, Homo Sapiens
acauuuggagggaaagacaaggugggggccucucuggaagcggcuggagacagggguuuga

SEQ ID NO: 69173 - RNA, 61 nt, Homo Sapiens
uguuguauuuucucccaguaaaaaccaugcacucuggaauuuggggugauagggugggcua

SEQ ID NO: 69174 - RNA, 61 nt, Homo Sapiens
ugaguuacaaccaccaauaccugaauucucccucuggaaacuugugaucuaggcugcuggg

SEQ ID NO: 69175 - RNA, 61 nt, Homo Sapiens
cgucccagaauauuagccaggcuuaauguuucucuggaaagggcucauacacacuuaaaag

SEQ ID NO: 69176 - RNA, 61 nt, Homo Sapiens
gaggaaugccugugugagcaauguuagggugcucuggaagacccuauuuguuuucuucugu

SEQ ID NO: 69177 - RNA, 61 nt, Homo Sapiens
gggauuaaacagauacccaaugcaugcccuccucuggaacucccacuucuucccuccagcc

SEQ ID NO: 69178 - RNA, 61 nt, Homo Sapiens
gggaacauguggggacuacugcaguugaaaucucuggaagauacagaggugaccaggccug

SEQ ID NO: 69179 - RNA, 61 nt, Homo Sapiens
aacuguuugcaguuguaugcaggcgugaauccucuggaagggaugacccucugcgguuguc

SEQ ID NO: 69180 - RNA, 61 nt, Homo Sapiens
uaauaauuacaucauaaucaauugcaaaacacucuggaaagucucuuaacagguugaaguu

SEQ ID NO: 69181 - RNA, 61 nt, Homo Sapiens
cauuccccauccaucacuccugcuagguagccucuggaaagugcagaugcuacugacugcu

SEQ ID NO: 69182 - RNA, 61 nt, Homo Sapiens
uggccaggcagucccagaagcccuuccucaucucuggaauuccccuaccccagucacucgc

SEQ ID NO: 69183 - RNA, 61 nt, Homo Sapiens
auuaggaggcagccauaauaggguguggcugcucuggaagaugagagcccgucacaguccu

SEQ ID NO: 69184 - RNA, 61 nt, Homo Sapiens
uaauggguuauuucucuuugaggguggcuuucucuggaacauugguuagagcagcuuuguu

SEQ ID NO: 69185 - RNA, 61 nt, Homo Sapiens
gaugcagggauuggccagcuggguugguuugcucuggaauggcuaacucuugccugcuuug

SEQ ID NO: 69186 - RNA, 61 nt, Homo Sapiens
accaggcuguaaaagcaaaaccucguaucagcucuggaacaauaccugcaguuauucuuca

SEQ ID NO: 69187 - RNA, 61 nt, Homo Sapiens
cgaggugcccuugcaggugaccgggcgccgccucuggaagaacguguacgacgagcugggg

SEQ ID NO: 69188 - RNA, 61 nt, Homo Sapiens
caguccugaguuugcuacuuacuucuguggccucuggaaccuuauccaaccucuuggugcu

SEQ ID NO: 69189 - RNA, 61 nt, Homo Sapiens
aaaccaccaggaaugaauucacuccccacuucucuggaaccucaggacccgcccauuucuc

SEQ ID NO: 69190 - RNA, 61 nt, Homo Sapiens
ccucuggguacaaaagugccucaacgacaugcucuggaaaucccaaaugccacagucugag

SEQ ID NO: 69191 - RNA, 61 nt, Homo Sapiens
ggagaaggcgcuaccugcgugggacccucuucucuggaaaccuaauccuccuuucauuucc

SEQ ID NO: 69192 - RNA, 61 nt, Homo Sapiens
uuuuuuuuccccaguauugcccuggagcugucucuggaaaguagcuggcgagguuaccuua

SEQ ID NO: 69193 - RNA, 61 nt, Homo Sapiens
auucaagauagcugugauuucucucaccguucucuggaaauggcaucagauuuaaggauaa

SEQ ID NO: 69194 - RNA, 61 nt, Homo Sapiens
gccucucccugccaaagcccaacucccagggcucuggaaauggugaggcgaggggcuugag

SEQ ID NO: 69195 - RNA, 61 nt, Homo Sapiens
cauuccuccauguccucacggcuggauuucucucuggaaaggauuuucauucaucauggug

SEQ ID NO: 69196 - RNA, 61 nt, Homo Sapiens
cucuguaggccaguaguucucaaaguguggucucuggaagagcaguaucagcaucaucugg

SEQ ID NO: 69197 - RNA, 61 nt, Homo Sapiens
uaucuuacugaacaccuguagucccagcuuucucuggaaguggucguauuugagcaggaug

SEQ ID NO: 69198 - RNA, 61 nt, Homo Sapiens
ggaagggggcagggacgugaccuugacuuaccucuggaaagggucccagccuagacugcuu

SEQ ID NO: 69199 - RNA, 61 nt, Homo Sapiens
ccgguugcuggucagguccccauggcuuguucucuggaaccugacuuuagauguuuuggga

SEQ ID NO: 69200 - RNA, 61 nt, Homo Sapiens
ggguggcgcucagaccccacccuacgcucaucucuggaaggggcagcccugaguggucacu

SEQ ID NO: 69201 - RNA, 61 nt, Homo Sapiens
gggcaagcacuaccaggcugugggucugcaccucuggaagguagagaagcggcgggucaau

SEQ ID NO: 69202 - RNA, 61 nt, Homo Sapiens
caauaauuuccagugagcggaauguauguaucucuggaagucuccccuuuaaauuaaaaaa

SEQ ID NO: 69203 - RNA, 61 nt, Homo Sapiens
cuugcgcagagcuuacuuuguugucugcucccucuggaagcauguucaguuuagaaccauu

SEQ ID NO: 69204 - RNA, 61 nt, Homo Sapiens
guguccuuacccuucugcagauacacuugcucucuggaaguggucuucuuagaguugcagg

SEQ ID NO: 69205 - RNA, 61 nt, Homo Sapiens
agacucagguuucuuuggacuuuuucauucucucuggaaaccugaucaggugucuauaaca

SEQ ID NO: 69206 - RNA, 61 nt, Homo Sapiens
agaugaacgucaccaauggaaugguauauuccucuggaaaauuccccuaaguccuaacaga

SEQ ID NO: 69207 - RNA, 61 nt, Homo Sapiens
uagccaagaccaggagaagaugguucaaauccucuggaacaugagcacaggccgauggagg

SEQ ID NO: 69208 - RNA, 61 nt, Homo Sapiens
ucaggacccgcccauuucucacuccccacuucucuggaaccaaaccaccaggaaugaauuc

SEQ ID NO: 69209 - RNA, 61 nt, Homo Sapiens
gucucagaucuaaaauuuccaggcugcuuuacucuggaauaucacauuaagaaugugccug

SEQ ID NO: 69210 - RNA, 61 nt, Homo Sapiens
agacugauuuugcuuuuuuucgguuuuuagucucuggaaaacaguugaucagacugaaaaa

SEQ ID NO: 69211 - RNA, 61 nt, Homo Sapiens
aagcugggucucauguuugaguagguaccaucucuggaaaacuucaaucuagaauucucca

SEQ ID NO: 69212 - RNA, 61 nt, Homo Sapiens
cugguucccugccucuguauucagguguggccucuggaaccugacuccguuaggacgaaca

SEQ ID NO: 69213 - RNA, 61 nt, Homo Sapiens
auggaucagugacuguaguaggaguuugaggcucuggaacucucacauauucaagucuuua

SEQ ID NO: 69214 - RNA, 61 nt, Homo Sapiens
ugaaggcaagugacuucaguugagggcaagucucuggaaaagaggcuguaggcaucuggca

SEQ ID NO: 69215 - RNA, 61 nt, Homo Sapiens
cccuggccucugccugccucccgccugugcacucuggaaccucuggccucaggggaccugc

SEQ ID NO: 69216 - RNA, 61 nt, Homo Sapiens
uucucuugugucccuacucauugaaaccaaacucuggaaaggacccaauguaccaguauuu

SEQ ID NO: 69217 - RNA, 61 nt, Homo Sapiens
caguccacuugcugaagaaguugugucauuucucuggaagaauuuccaaaauucuggauuu

SEQ ID NO: 69218 - RNA, 61 nt, Homo Sapiens
ucaauauccacuucuuucagccuacuguagacucuggaaguauacuuuuugcauauguaag

SEQ ID NO: 69219 - RNA, 61 nt, Homo Sapiens
uuauaggccuugccaggguuucgagaagcugcucuggaauuugcaagucauggcugugccc

SEQ ID NO: 69220 - RNA, 61 nt, Homo Sapiens
aagcauuugugguaguaaaggaaaaccaacccucuggaaaauacauuuugagaaucucaaa

SEQ ID NO: 69221 - RNA, 61 nt, Homo Sapiens
uggcuugauguggcaagccgaaaccacuuggcucuggaaaucuaaguucauacugguuuaa

SEQ ID NO: 69222 - RNA, 61 nt, Homo Sapiens
uuuuacuuuuauauuuuugcuugaaucuuaacucuggaaaucaccugauguagaagaagac

SEQ ID NO: 69223 - RNA, 61 nt, Homo Sapiens
aggaaucgugcucucaaugcaaagugucauucucuggaauugcaccuggcucaggaaagga

SEQ ID NO: 69224 - RNA, 61 nt, Homo Sapiens
ggccuauggagagacaggccuuucucucagccucuggaagccaccugcucuuuugcucuag

SEQ ID NO: 69225 - RNA, 61 nt, Homo Sapiens
cuccuagagaagaacaauccucauggagaaacucuggaaaccuugacaauggcaacagugu

SEQ ID NO: 69226 - RNA, 61 nt, Homo Sapiens
cucuccaagcccuccucugaaccagcuaucccucuggaaugcagcugaccaaacaaauucc

SEQ ID NO: 69227 - RNA, 61 nt, Homo Sapiens
ugcaauaacaggaacaugagacuucgcaaaucucuggaaaauaauauccaaaugaaauuaa

SEQ ID NO: 69228 - RNA, 61 nt, Homo Sapiens
uguuuucaauauaauucuugauuucauuuuucucuggaauauauuggccuucuacagcuau

SEQ ID NO: 69229 - RNA, 61 nt, Homo Sapiens
ccuuuugcauuaaaaggacugucccuggagacucuggaaauccagggaagccccugguucu

SEQ ID NO: 69230 - RNA, 61 nt, Homo Sapiens
caacuucaucccagcugcugaugcccugcggcucuggaaagugaccuggucuggucaggca

SEQ ID NO: 69231 - RNA, 61 nt, Homo Sapiens
caggguugggugcuuauuuacagaccaagcacucuggaagcguuaugcccaucuccauagc

SEQ ID NO: 69232 - RNA, 61 nt, Homo Sapiens
uaccacaugcaaacauacaacugaagauuuccucuggaagcuaugaaccugaagauuaaaa

SEQ ID NO: 69233 - RNA, 61 nt, Homo Sapiens
cccagccacaccugagucccguugagggaggcucuggaaagcuucagccugugaggggagg

SEQ ID NO: 69234 - RNA, 61 nt, Homo Sapiens
uuuauggugguucagaagaaaucuaccucuucucuggaaugccuccaggaucuagccuucu

SEQ ID NO: 69235 - RNA, 61 nt, Homo Sapiens
ucuguuuuaugcuaaauggaaguguuuccaucucuggaaucagaagccaccuggaagaccc

SEQ ID NO: 69236 - RNA, 61 nt, Homo Sapiens
uggaaaucacauacacacacuaacaggcaggcucuggaagugaguaaaauggaauaauacc

SEQ ID NO: 69237 - RNA, 61 nt, Homo Sapiens
ugcagucaucaauggucagugagccucauuccucuggaacgaaugaaccaccugauuacaa

SEQ ID NO: 69238 - RNA, 61 nt, Homo Sapiens
uauucuauaagaaaaagcugaacuacguaaacucuggaaagcuguguuuaaauaaauugaa

SEQ ID NO: 69239 - RNA, 61 nt, Homo Sapiens
acucauucguuuaugaacacuguuuguauggcucuggaauaguccaguaaagagauugauu

SEQ ID NO: 69240 - RNA, 61 nt, Homo Sapiens
cucugaaguuauggcugggacaaacucuguucucuggaaugacuuuguauuuuugaagcgg

SEQ ID NO: 69241 - RNA, 61 nt, Homo Sapiens
uucuuuauaauaaaagccuuggcagcugggacucuggaaucgcccaugggggcuggagggg

SEQ ID NO: 69242 - RNA, 61 nt, Homo Sapiens
gccucauauggugauaugcccuggaagccaccucuggaaaaagacccccuccagaagcaua

SEQ ID NO: 69243 - RNA, 61 nt, Homo Sapiens
gcugggcaugggucauggcccuccccauguccucuggaacaccuuugccagacagcucugu

SEQ ID NO: 69244 - RNA, 61 nt, Homo Sapiens
ggagauaauacaauuccagauuauuuuuacucucuggaaaaguaaacaauggugauuuuau

SEQ ID NO: 69245 - RNA, 61 nt, Homo Sapiens
ugugcguucaugcuuuuucgaaaaacaaauucucuggaauuaaaauugaucggauugauua

SEQ ID NO: 69246 - RNA, 61 nt, Homo Sapiens
gcaugcacacugaacucugcuuagcuuuuaacucuggaagcuuuuuguuucucagucugcu

SEQ ID NO: 69247 - RNA, 61 nt, Homo Sapiens
agacugaggggcuuuguaaaaauccuccacucucuggaaggaaaauagccuauccuuaaua

SEQ ID NO: 69248 - RNA, 61 nt, Homo Sapiens
cauauguauauaacauguguuaacaugcccucucuggaaagguauaguuccccguguucac

SEQ ID NO: 69249 - RNA, 61 nt, Homo Sapiens
ucugugguugugaaggcaauauucagaucaccucuggaaucuggccauuggugcguguuuc

SEQ ID NO: 69250 - RNA, 61 nt, Homo Sapiens
agcacagggagcuucuguuguucugaucuaucucuggaaaaccagccauuccuccucccug

SEQ ID NO: 69251 - RNA, 61 nt, Homo Sapiens
cgagccucaggccaaggaccccugaugcagacucuggaaucccuggcccaaaggccugucu

SEQ ID NO: 69252 - RNA, 61 nt, Homo Sapiens
accugauggcuguucucccaccgggucugggcucuggaaggagccagaugcccccagaaag

SEQ ID NO: 69253 - RNA, 61 nt, Homo Sapiens
cccgaaguaauaagugaggacgaaugcacugcucuggaacauaacccagugcuaacugggg

SEQ ID NO: 69254 - RNA, 61 nt, Homo Sapiens
auugcuuuucucuuaccaguaugauuuguaacucuggaacacuauucuuacagaaugccuu

SEQ ID NO: 69255 - RNA, 61 nt, Homo Sapiens
auuaagaugagcccuaauauguaagauuuuccucuggaauggaugugagaaauguaaauuu

SEQ ID NO: 69256 - RNA, 61 nt, Homo Sapiens
gaacuaaauuguuucuaaauguagauggucccucuggaaaagcaguuuucagcaggggugg

SEQ ID NO: 69257 - RNA, 61 nt, Homo Sapiens
ugcagaaaaaaaagugcugcaguuuagauaccucuggaauuuuuccacagugucacagguu

SEQ ID NO: 69258 - RNA, 61 nt, Homo Sapiens
aaacuugaaucaggauuuuaugccccacauacucuggaacuugaaguauaauauacuuaau

SEQ ID NO: 69259 - RNA, 61 nt, Homo Sapiens
aucuguaucuuaaauggccccaggcaucugccucuggaaaacuauugagccuugcauguac

SEQ ID NO: 69260 - RNA, 61 nt, Homo Sapiens
ggguggcagccccugguagaaugcuggauuucucuggaaucuagaagugccauauuuuagu

SEQ ID NO: 69261 - RNA, 61 nt, Homo Sapiens
uuuugcuucuuacgaacgccuuuccucuccucucuggaaggauccgucucuguccgcgucc

SEQ ID NO: 69262 - RNA, 61 nt, Homo Sapiens
cuggcccaauuccucagacccccucugcacccucuggaacccucagcuaccacuuccccuu

SEQ ID NO: 69263 - RNA, 61 nt, Homo Sapiens
gaugagugaauguguucuggcucucuaucugcucuggaaugcuagauuuucuucugugcuu

SEQ ID NO: 69264 - RNA, 61 nt, Homo Sapiens
caaaaucaauuuauuaagagagggacuuuagcucuggaacuagcuucagaaauguuuuaaa

SEQ ID NO: 69265 - RNA, 61 nt, Homo Sapiens
aaagaacugacuuuugauaguucucagugaccucuggaauaaauuuuagcagaugguacuu

SEQ ID NO: 69266 - RNA, 61 nt, Homo Sapiens
cuuggugggagugaauuugcugacuguggagcucuggaagguaaccaggagacuacuccug

SEQ ID NO: 69267 - RNA, 61 nt, Homo Sapiens
ucacuuagcuccucauaacaagucuaacuggcucuggaaagcugaaagggcugcacuggaa

SEQ ID NO: 69268 - RNA, 61 nt, Homo Sapiens
uccuucuccugaaguucagccacccugaggccucuggaaagcaaagggcuccucuccaguc

SEQ ID NO: 69269 - RNA, 61 nt, Homo Sapiens
auccugcuaaaggagcaaagccuuguauuaccucuggaagacaacaaaaacaauuggcaac

SEQ ID NO: 69270 - RNA, 61 nt, Homo Sapiens
aaucaguaucuagaugguuuuuaaauguauucucuggaaauuguuuuauguaaaauaaaug

SEQ ID NO: 69271 - RNA, 61 nt, Homo Sapiens
cagauaugaagagcauuuuaagaggugcagccucuggaaguggaucaaacuagaacucaua

SEQ ID NO: 69272 - RNA, 59 nt, Homo Sapiens
ugacgguucccugucucugaaagaccuuucucuggaagaggagucugcauuguaguguc

SEQ ID NO: 69273 - RNA, 61 nt, Homo Sapiens
uauuuuguguccccaccuugauguuacaugacucuggaacaauaugaacuggauuuaagaa

SEQ ID NO: 69274 - RNA, 61 nt, Homo Sapiens
uucuuuuacuuaaccaggcuuauggcaugaucucuggaacaaauuuguaggaaaaaauuac

SEQ ID NO: 69275 - RNA, 61 nt, Homo Sapiens
agggcaccaaguuuuccuuuuuucuaaauagcucuggaaccaggcuuguaauccauagcau

SEQ ID NO: 69276 - RNA, 61 nt, Homo Sapiens
uguagaaaagguuuccucuagaacugaauuccucuggaauugagugauggacuucacaaca

SEQ ID NO: 69277 - RNA, 61 nt, Homo Sapiens
auaucugggccuuggaaggaaggacacagggcucuggaaggaggaggcugcaugccugaag

SEQ ID NO: 69278 - RNA, 61 nt, Homo Sapiens
acuccaguugccucagguugguucugcugugcucuggaaaguaacugcagccaccagguau

SEQ ID NO: 69279 - RNA, 61 nt, Homo Sapiens
uguuuuuagaggggcaaaaauauuuugcaagcucuggaauuguugaauguauucuuuuaua

SEQ ID NO: 69280 - RNA, 61 nt, Homo Sapiens
ggcuuucaugauuuggcaugauagguauauccucuggaaaaauucuugagggacaaugcca

SEQ ID NO: 69281 - RNA, 61 nt, Homo Sapiens
uggaauguuaaguccaggccuaaaacacuggcucuggaaucgaagaaaagagcugggacaa

SEQ ID NO: 69282 - RNA, 61 nt, Homo Sapiens
aaauguuccgggaucauguucuaucaaaagccucuggaaauuuauucaagauugugcucuu

SEQ ID NO: 69283 - RNA, 61 nt, Homo Sapiens
aacaacuggcaggacuguugaaaguauuugccucuggaaagaggaaaaacuaagagaauga

SEQ ID NO: 69284 - RNA, 61 nt, Homo Sapiens
aggaaagcuaaagaagacuaauaauuaaucucucuggaaaagaccauuaagaaccagaaaa

SEQ ID NO: 69285 - RNA, 61 nt, Homo Sapiens
aaaaaaaugaaaugaagagugugauuugguccucuggaaaauagaauguaauauguaaacu

SEQ ID NO: 69286 - RNA, 61 nt, Homo Sapiens
ugaagagcuguuugguuugacugugaggcagcucuggaacgucuccugugaucugugcuag

SEQ ID NO: 69287 - RNA, 61 nt, Homo Sapiens
accuugagauugaugcauuuuugaccugcaucucuggaaggucccaucucaagcauauaag

SEQ ID NO: 69288 - RNA, 61 nt, Homo Sapiens
ucagaucugugacuuaaucuuucucuucaggcucuggaaaaucuuauccuuugcucuguuu

SEQ ID NO: 69289 - RNA, 61 nt, Homo Sapiens
caugcauccuggccuugccaggcugucuuggcucuggaauuauaagaaggcccuguugacg

SEQ ID NO: 69290 - RNA, 61 nt, Homo Sapiens
cacaacuggugucagggcuccauucucacuucucuggaagcuuuuuacacuuauuuauuau

SEQ ID NO: 69291 - RNA, 61 nt, Homo Sapiens
uuguggguggggcccagggaccugccugaagcucuggaaacagccgccugcccgggagaac

SEQ ID NO: 69292 - RNA, 61 nt, Homo Sapiens
gaaggggcaggacucaucagccaggcaggcccucuggaaggaaacacccugcugcuggcug

SEQ ID NO: 69293 - RNA, 61 nt, Homo Sapiens
uguagcagaguacauaacuacauaaugccaacucuggaaucaaauuuccuuguuugaaucc

SEQ ID NO: 69294 - RNA, 61 nt, Homo Sapiens
cuguggaugccagcuuuggaaucagagccgccucuggaauaccugugcuuccagaguuagc

SEQ ID NO: 69295 - RNA, 61 nt, Homo Sapiens
caggcgcgguggcucaggccuguaaucccagcucuggaagcugaaggauagcuugagccca

SEQ ID NO: 69296 - RNA, 61 nt, Homo Sapiens
uuccuaucauuuuauuaucaccaugcaaugccucuggaauaaaacauacaggagucugucu

SEQ ID NO: 69297 - RNA, 61 nt, Homo Sapiens
ugugaccacauacguguuaggaggcugcaugcucuggaagccuggacucuaagcuggagcu

SEQ ID NO: 69298 - RNA, 61 nt, Homo Sapiens
uucuagauggaggaggcacugaugcuuguaacucuggaaagaggccuacacccaagggcua

SEQ ID NO: 69299 - RNA, 61 nt, Homo Sapiens
aagaugauauuucagaagaguuggcugccuucucuggaaacaaggaaaacccaauaauucc

SEQ ID NO: 69300 - RNA, 61 nt, Homo Sapiens
gccugaagccuuccucuggcuucacagaaugcucuggaacucuggggucuggucagggagu

SEQ ID NO: 69301 - RNA, 61 nt, Homo Sapiens
uucagggcccccucagcugucuccucccucccucuggaaaggaggguggggcucaggggcc

SEQ ID NO: 69302 - RNA, 61 nt, Homo Sapiens
aaaaugccaucucuuuuuaguugaaggaaaacucuggaaguaggugccauuggucauucug

SEQ ID NO: 69303 - RNA, 61 nt, Homo Sapiens
gcucucucgacagcaaaugguuuccccucaccucuggaauuaaagaaggaacuccaaaguu

SEQ ID NO: 69304 - RNA, 61 nt, Homo Sapiens
uacaaaaccacuucagagaccaggguaucuccucuggaaggaucuaagagaagguaagaca

SEQ ID NO: 69305 - RNA, 61 nt, Homo Sapiens
cgugugaucuuugaaaaccuuggcuuuagcccucuggaaucagagcuuacccaccauagua

SEQ ID NO: 69306 - RNA, 61 nt, Homo Sapiens
uaccuucacggccgcugcugaaaacccacaccucuggaagaauggagcagauugaaaugca

SEQ ID NO: 69307 - RNA, 61 nt, Homo Sapiens
auauaaaguuccuggcuuugccagagagucccucuggaaccugaguaaucaacaaaaucug

SEQ ID NO: 69308 - RNA, 61 nt, Homo Sapiens
cugauacaguaaauauaugaacagccacacccucuggaaaugggaguagagagacacacua

SEQ ID NO: 69309 - RNA, 61 nt, Homo Sapiens
uccugauaugaccaagaaagggagggacuuucucuggaauuuuucucuuccccaaauacag

SEQ ID NO: 69310 - RNA, 61 nt, Homo Sapiens
cuggaagcuguaugccacagguggaggaagacucuggaaccaagaaggaagaaaagaagga

SEQ ID NO: 69311 - RNA, 61 nt, Homo Sapiens
agggcccgaugcagcauuuuagcucugcacucucuggaauauugaccacgaccuuggcccc

SEQ ID NO: 69312 - RNA, 61 nt, Homo Sapiens
aucuuuagcuuugacuuuggucucuccuggccucuggaagcgugcuacuaaaacauuuucu

SEQ ID NO: 69313 - RNA, 61 nt, Homo Sapiens
uguggagacgccagcccugcccacuuguaugcucuggaauccccacuuucccuuccccacc

SEQ ID NO: 69314 - RNA, 61 nt, Homo Sapiens
aggguuuaagaugcuaggauagaagcugcagcucuggaaagagcagacaucuuccacgugg

SEQ ID NO: 69315 - RNA, 61 nt, Homo Sapiens
gggaggggcccugucacugugaugggggccucucuggaagauccuccucucaaaccuggca

SEQ ID NO: 69316 - RNA, 61 nt, Homo Sapiens
ucgaagugaaacauuugucugcuccaacccucucuggaaaaaccucccugccccaauccug

SEQ ID NO: 69317 - RNA, 61 nt, Homo Sapiens
uucuccauuucucccuaucauaucccugacacucuggaaucauauaauuauuuucaguuac

SEQ ID NO: 69318 - RNA, 61 nt, Homo Sapiens
uguagguuagcucugcccagaccauaagggacucuggaagcuggucauuuugccacacuua

SEQ ID NO: 69319 - RNA, 61 nt, Homo Sapiens
agaaaaccagagagucccauucauugaauuccucuggaauuuugauagugaaaccauuaga

SEQ ID NO: 69320 - RNA, 61 nt, Homo Sapiens
uuagcaaucuuauugcacacaauuugcacaucucuggaagcgacaggacaucuuacaagag

SEQ ID NO: 69321 - RNA, 61 nt, Homo Sapiens
ccaccaggguagggucucccgguucugugggcucuggaagguccacggguagugcgaccuc

SEQ ID NO: 69322 - RNA, 61 nt, Homo Sapiens
uucugaccucagacggcucugagccuuauuucucuggaagcggcuaagggacgguuggggg

SEQ ID NO: 69323 - RNA, 61 nt, Homo Sapiens
auuguuuacaggauauuccaaaauaaaaggacucuggaagauuuucauugaggauaaauug

SEQ ID NO: 69324 - RNA, 61 nt, Homo Sapiens
ccuacaggggcuccucugugggugaggggcccucuggaauggcaucccaugagcuuguggc

SEQ ID NO: 69325 - RNA, 61 nt, Homo Sapiens
uuauuuaaugauguaauuuauuguugcguuccucuggaagcugugacuggaauaaaccccc

SEQ ID NO: 69326 - RNA, 61 nt, Homo Sapiens
gaggcuggugcuguggccagggugagagcugcucuggaaaaugugacccagauccucacaa

SEQ ID NO: 69327 - RNA, 61 nt, Homo Sapiens
ugauuccaauauuauuacuuauaacacugaccucuggaaaauauuuuguucacaagaaaua

SEQ ID NO: 69328 - RNA, 61 nt, Homo Sapiens
auaauuucuaccuauugggccuuguucuguucucuggaacuaaacagaacaaccauuuacc

SEQ ID NO: 69329 - RNA, 61 nt, Homo Sapiens
ucaaggcaggcagcccaggcccaggaugcuucucuggaaccuagggcccgagcuucagcuu

SEQ ID NO: 69330 - RNA, 61 nt, Homo Sapiens
ucaggcugagaaauccuuucucauccucggucucuggaaagucuguugccgccuaacuuuc

SEQ ID NO: 69331 - RNA, 61 nt, Homo Sapiens
cccccaccuuucucgcuggaaggaacagagacucuggaagcaacgggggugcggcaggagc

SEQ ID NO: 69332 - RNA, 61 nt, Homo Sapiens
ggcuggcuggugcccuauuucccaggugucccucuggaaggccccuugggcuaggucugac

SEQ ID NO: 69333 - RNA, 61 nt, Homo Sapiens
agcauggccuugugaacuuagggcauucacucucuggaagucagagacccauucuaaacaa

SEQ ID NO: 69334 - RNA, 61 nt, Homo Sapiens
cgguaauaagagcuggcaagagguugacucucucuggaauguuaggggacaaacuccaucc

SEQ ID NO: 69335 - RNA, 61 nt, Homo Sapiens
gcccucuccucaccuccuuuucucucagugacucuggaaccugaaugcagcuuacaagaca

SEQ ID NO: 69336 - RNA, 61 nt, Homo Sapiens
gagcuagcagaaaauaacucaaaguugaagacucuggaagauuuugcuuuaaccuaacucg

SEQ ID NO: 69337 - RNA, 61 nt, Homo Sapiens
gccugcuggcucucccccagccccacauccccucuggaagagaauguaaaauaaaccugga

SEQ ID NO: 69338 - RNA, 61 nt, Homo Sapiens
cuugaacccuacuuucuggaaguggaguugacucuggaaguuuucuagcaacugaacaaaa

SEQ ID NO: 69339 - RNA, 61 nt, Homo Sapiens
gccuucaguaagaccacaagucugcaggaaacucuggaaucaggaagaaaagcuauguuca

SEQ ID NO: 69340 - RNA, 61 nt, Homo Sapiens
acaaacuccuacuacgucgucuaaauugcugcucuggaauaaggugauuucugcccccaga

SEQ ID NO: 69341 - RNA, 61 nt, Homo Sapiens
accuacccaaaccuuuuguucuguaaaacugcucuggaaauaccgggaagcccaguuuucu

SEQ ID NO: 69342 - RNA, 61 nt, Homo Sapiens
ccuguuaaauuuacaacacuaacgauguagacucuggaaaugccuaauaagucaaagaaga

SEQ ID NO: 69343 - RNA, 61 nt, Homo Sapiens
cucaaagaggaauugggaaaaauaaauugaacucuggaaucuucucucucaaguccuaaaa

SEQ ID NO: 69344 - RNA, 61 nt, Homo Sapiens
aggcucuggacagcagaagcagauucugccucucuggaaagcacuauucuuggaccaugcc

SEQ ID NO: 69345 - RNA, 61 nt, Homo Sapiens
uuuuucccuccccagaaucagccggcggcuacucuggaaugucccuaccugcuucacguug

SEQ ID NO: 69346 - RNA, 61 nt, Homo Sapiens
uuuguuucuucuguacccggccucccugggccucuggaagcgcacgacacagggcugguga

SEQ ID NO: 69347 - RNA, 61 nt, Homo Sapiens
aaauauaguuauuaaaggauuauuuauuguucucuggaaauuauacugcuugcaauuucug

SEQ ID NO: 69348 - RNA, 61 nt, Homo Sapiens
cacuaugguuuaccuugaguggggguguaaacucuggaaucucauaggggcagcagucuca

SEQ ID NO: 69349 - RNA, 61 nt, Homo Sapiens
aauagucaugcuucuuuauuugggucacccacucuggaagacuuaggaccauuugagcuug

SEQ ID NO: 69350 - RNA, 61 nt, Homo Sapiens
uuuagaaucaggcuagaauagccagauuuagcucuggaaugaaauuaaaaacauaacuauu

SEQ ID NO: 69351 - RNA, 54 nt, Homo Sapiens
ccagaagacugcaguggauuaggacucuggaaagguaaugugaagggucccuaa

SEQ ID NO: 69352 - RNA, 61 nt, Homo Sapiens
auccucuguuacccgcagaucagcagaaugacucuggaaccacuucaguuguggccucauu

SEQ ID NO: 69353 - RNA, 61 nt, Homo Sapiens
gacugacuguacacucccugaucagccagcacucuggaagcuuugggaucccaggaaccau

SEQ ID NO: 69354 - RNA, 61 nt, Homo Sapiens
cucagacuucuacuuuaccaaguaccacacacucuggaaugcuuuaguuuccuuuuccccu

SEQ ID NO: 69355 - RNA, 61 nt, Homo Sapiens
gagcacacuguccccaccgccuccccuuucucucuggaaaguugaaguaucuccaaaggcc

SEQ ID NO: 69356 - RNA, 61 nt, Homo Sapiens
ugauuuuuguuucuuuuggccugauuuguaucucuggaaugcauuuauucuugaaauauuu

SEQ ID NO: 69357 - RNA, 61 nt, Homo Sapiens
ccugggaucccuuccuggagaggcaggcugucucuggaaaaagccuccauugcccacccgc

SEQ ID NO: 69358 - RNA, 61 nt, Homo Sapiens
guuuggcacagcuuuggccacagccaggccccucuggaauuguccuuauuaaaccaguuuc

SEQ ID NO: 69359 - RNA, 61 nt, Homo Sapiens
ggccaggcugcacaccuggugggagaacacacucuggaauucucuauucuccuggucgggg

SEQ ID NO: 69360 - RNA, 61 nt, Homo Sapiens
aaagggacucuuccauuuugaaagaacugcacucuggaauugaccaguugcccucauuucc

SEQ ID NO: 69361 - RNA, 61 nt, Homo Sapiens
cuauggucuuacaagcaguaagcuacagagccucuggaacauucagauucccaaagaagcc

SEQ ID NO: 69362 - RNA, 61 nt, Homo Sapiens
ccuggagacccucgcccaacuaaacgacacucucuggaagccgcauggcaagucacaugcg

SEQ ID NO: 69363 - RNA, 61 nt, Homo Sapiens
gcugguucaaggcuguuuggcuaggggcagucucuggaaggcugcacugcccagugggcca

SEQ ID NO: 69364 - RNA, 61 nt, Homo Sapiens
ugggucagaaccuucucucugcaguuuggggcucuggaauugaugucacaggauuaaaugu

SEQ ID NO: 69365 - RNA, 61 nt, Homo Sapiens
ccccuucccuggcagguggcgaaacccaccucucuggaagguuaggcacacagauccccug

SEQ ID NO: 69366 - RNA, 61 nt, Homo Sapiens
uuggcucuucuuuguuuugucucucaggucccucuggaacuugcaggaaaccugaacccag

SEQ ID NO: 69367 - RNA, 61 nt, Homo Sapiens
aucuacaacuaauaggacaccuacauaaguucucuggaaauaaauuuguaauguguugcuu

SEQ ID NO: 69368 - RNA, 61 nt, Homo Sapiens
ucaugugaugaagcugacauuggggucagaucucuggaacaaguaaaacuugagaagcuuu

SEQ ID NO: 69369 - RNA, 61 nt, Homo Sapiens
agcaagaggaaccaguagcuaggacagaccucucuggaagcggcauccuccuugaaagagg

SEQ ID NO: 69370 - RNA, 61 nt, Homo Sapiens
gacccuuugcaagucuuuacagggcucgagccucuggaacugucugugaaagucagaacac

SEQ ID NO: 69371 - RNA, 61 nt, Homo Sapiens
aucccccguucugggcaaggccucagccuuccucuggaagcuggcuuccuuaccagaaaag

SEQ ID NO: 69372 - RNA, 61 nt, Homo Sapiens
uggguggggcccugcaccguauuucuccugccucuggaagggcagcuggggcugccauccc

SEQ ID NO: 69373 - RNA, 61 nt, Homo Sapiens
caucccuugccgcugccauggugguggcugucucuggaaagggggugauccucccuccugc

SEQ ID NO: 69374 - RNA, 61 nt, Homo Sapiens
agaggacuagcugacuuuugugccuucugcucucuggaaccggaccacucgcugccuuagg

SEQ ID NO: 69375 - RNA, 54 nt, Homo Sapiens
cccagcgccagcccccguccgcggcucuggaaggcuccaaggacguguccuuag

SEQ ID NO: 69376 - RNA, 61 nt, Homo Sapiens
ucaccauagggguuauaguuggcuugugcuacucuggaaucauuuuacuguuuguuuuuau

SEQ ID NO: 69377 - RNA, 61 nt, Homo Sapiens
auuuucccacagacuuccuggccuccugugacucuggaaagcaaaggauuggcuguguauu

SEQ ID NO: 69378 - RNA, 61 nt, Homo Sapiens
agggugcugcccgcucaaugcccagcagcagcucuggaaggcagugcucagccccaucacc

SEQ ID NO: 69379 - RNA, 61 nt, Homo Sapiens
agaaaucuaaaaaacgaaaagucuccaaagucucuggaauuugaaacacuuugcauaacgu

SEQ ID NO: 69380 - RNA, 61 nt, Homo Sapiens
ggccuccccuaagaggcuuuccccgaggcagcucuggaaucugugcccaccuggggccugg

SEQ ID NO: 69381 - RNA, 61 nt, Homo Sapiens
augcuaguauggaggcugugaaguccccaagcucuggaagcccacacuauuuguuggugau

SEQ ID NO: 69382 - RNA, 61 nt, Homo Sapiens
ucaggaauauugugguaagcugggaguaucacucuggaagaaaguaacaucuccagaugag

SEQ ID NO: 69383 - RNA, 61 nt, Homo Sapiens
cucauuguggaaacaagccaaaccaaaugaacucuggaaaaccuaaaacaaauguacauuu

SEQ ID NO: 69384 - RNA, 61 nt, Homo Sapiens
aagccugugcucagguugccuugaauguggacucuggaagagccaggggcccagaaugccg

SEQ ID NO: 69385 - RNA, 61 nt, Homo Sapiens
aucagcagucuucaaucgaucaauaauucugcucuggaagagaaggaacagggagcagaga

SEQ ID NO: 69386 - RNA, 61 nt, Homo Sapiens
cucaccucugcuccugucuucaucaccuucucucuggaagggaagaggaguuggaaggucu

SEQ ID NO: 69387 - RNA, 61 nt, Homo Sapiens
gcagagcgaguggaugcacuucccagcucaucucuggaagccuuugcuacucaagcuccuc

SEQ ID NO: 69388 - RNA, 61 nt, Homo Sapiens
cuccgggaucgugcagugacgucgcaagccucucuggaaagagugugcugccccuccccau

SEQ ID NO: 69389 - RNA, 61 nt, Homo Sapiens
auuaaagaauuccugggggcgccagagaacucucuggaaccagaugcagcagcagucuuua

SEQ ID NO: 69390 - RNA, 61 nt, Homo Sapiens
gcaugcauuuguaggugcaccauuuccaaagcucuggaaaguaacucauuauuuaauugaa

SEQ ID NO: 69391 - RNA, 61 nt, Homo Sapiens
ugaggugagaggaucacuugggucccagcuacucuggaagcacauggugggaugggcaugu

SEQ ID NO: 69392 - RNA, 58 nt, Homo Sapiens
caagcugauauugcuacaucugagauuucucuggaauauccaucaccagaaaaacuaa

SEQ ID NO: 69393 - RNA, 61 nt, Homo Sapiens
cccaagggaagaggcaaggugcaguagugggcucuggaauggucuggauagauagcuuaca

SEQ ID NO: 69394 - RNA, 61 nt, Homo Sapiens
cugggaaacuccuggaagacauuugccugcacucuggaaggacauccuggagggagacugg

SEQ ID NO: 69395 - RNA, 61 nt, Homo Sapiens
uguauuucuugaauuagaauccuaaaggauccucuggaagcugugcaauaagaacauagau

SEQ ID NO: 69396 - RNA, 61 nt, Homo Sapiens
gucuggaaaugucuuccugggagucagccagcucuggaaugaaaacuuguuuccacauuaa

SEQ ID NO: 69397 - RNA, 61 nt, Homo Sapiens
cuuuggggcugauuugucucuucauuuacagcucuggaacagcuucuuaaucaauccaaau

SEQ ID NO: 69398 - RNA, 61 nt, Homo Sapiens
ccacacuuguggggacuuagcugggccgcuccucuggaagcucugauucagcuggggcuag

SEQ ID NO: 69399 - RNA, 61 nt, Homo Sapiens
gccucuucuuguggcuuuuauggaacaaucucucuggaaguauuguguuuguuuuucaugu

SEQ ID NO: 69400 - RNA, 61 nt, Homo Sapiens
ugaagcagcaagaucacuugaaucccaacuacucuggaagcgugaucuaccacaccuggcc

SEQ ID NO: 69401 - RNA, 61 nt, Homo Sapiens
uguggggauggagaggaugguccuugcuuuacucuggaaagacaaugccuggguguccuca

SEQ ID NO: 69402 - RNA, 61 nt, Homo Sapiens
gcuccuugaagaaucucuccucucucucucucucuggaaagacccaacuuucucacugcug

SEQ ID NO: 69403 - RNA, 61 nt, Homo Sapiens
aagcaaugcuguucuguaaauuuauugaaaccucuggaacauuucaccuuuagagauggag

SEQ ID NO: 69404 - RNA, 61 nt, Homo Sapiens
gugagauugagagaacuaugaccugcagcaacucuggaaaccuggccugacagacaagcag

SEQ ID NO: 69405 - RNA, 61 nt, Homo Sapiens
uauucucacucccuugaucucaagggcguaacucuggaagcacagcuugacuacacgucau

SEQ ID NO: 69406 - RNA, 61 nt, Homo Sapiens
ugggcaagggacaaggugcuagaauccuaagcucuggaaauauuucaugacacugguguau

SEQ ID NO: 69407 - RNA, 61 nt, Homo Sapiens
cugccccugauggaacucauggagaaugaagcucuggaaauccucaccaaagcccuccgga

SEQ ID NO: 69408 - RNA, 61 nt, Homo Sapiens
ccccucucugaagagacuguccuugggccuccucuggaagcagcacccccagaggacaggg

SEQ ID NO: 69409 - RNA, 61 nt, Homo Sapiens
gcaugggcuaagucacucugcccuucggagccucuggaagcuuagggcacauugguuccag

SEQ ID NO: 69410 - RNA, 61 nt, Homo Sapiens
cuuauauaaaguaccagguuuuuuccccauucucuggaaauguuuguccucccuuaauuuu

SEQ ID NO: 69411 - RNA, 61 nt, Homo Sapiens
cauuauggauguugaaauggacagggaaggacucuggaagucucuuccuccuccuccucuu

SEQ ID NO: 69412 - RNA, 61 nt, Homo Sapiens
aagucccucuucuugccguuggccuuucugacucuggaaugaccacuguucauugaaaaau

SEQ ID NO: 69413 - RNA, 61 nt, Homo Sapiens
caugaggaaauagaagauucaggggccugagcucuggaagcugcaagcaaaagggauggga

SEQ ID NO: 69414 - RNA, 61 nt, Homo Sapiens
aaccauccaguaaaggucuuccgauaccccacucuggaagguggccgcaguguguguguau

SEQ ID NO: 69415 - RNA, 61 nt, Homo Sapiens
gccuuacucacaggcuuccaaagugcagugucucuggaacugugccuaugaaacaaacacu

SEQ ID NO: 69416 - RNA, 61 nt, Homo Sapiens
acaugugucaagcugcuugguucagagguggcucuggaaugcgaaggccucugaaggaccc

SEQ ID NO: 69417 - RNA, 61 nt, Homo Sapiens
agggggaggccuggaaggagggguccccauccucuggaaccuucuucuaguucgaggccuu

SEQ ID NO: 69418 - RNA, 61 nt, Homo Sapiens
auguguuaaauaucuguauaacuggagccaccucuggaauaccaucucucaagccccaagg

SEQ ID NO: 69419 - RNA, 60 nt, Homo Sapiens
ccagggagguugagcagugaccuuuucuugcucuggaagcuccuucgacaggggacguag

SEQ ID NO: 69420 - RNA, 61 nt, Homo Sapiens
guuucaguuaagucauuuuauguugauggcacucuggaauuguuuccuuuugcgugaucuc

SEQ ID NO: 69421 - RNA, 61 nt, Homo Sapiens
cugcugugaauuuguauuccuggccuggggccucuggaaguauggaaacuuucuaccugcu

SEQ ID NO: 69422 - RNA, 61 nt, Homo Sapiens
cccaucuguuucacugucucggagcagggaccucuggaauuuuuacuguuccucugggaaa

SEQ ID NO: 69423 - RNA, 61 nt, Homo Sapiens
aaauguaguuuucuacacucagauuguacuucucuggaaccuuacaucucagguaaugugu

SEQ ID NO: 69424 - RNA, 61 nt, Homo Sapiens
cuaauggcaggcaaagggagaggaugccauccucuggaaucucugugaaagcaaauacuaa

SEQ ID NO: 69425 - RNA, 61 nt, Homo Sapiens
ugaggcggcugcuugaaccucagguggaagccucuggaaccgagaacugaagugcagccau

SEQ ID NO: 69426 - RNA, 61 nt, Homo Sapiens
uguccucguguccaccuggcuaaaaccaagccucuggaaucggacaaagaaaacugcacaa

SEQ ID NO: 69427 - RNA, 61 nt, Homo Sapiens
augggccagcuugcaggggugccuaugggggcucuggaaggucccgucucaacagccccag

SEQ ID NO: 69428 - RNA, 61 nt, Homo Sapiens
gccacaguggcucacgccuguaaucccagaacucuggaaggcugaggcaggcggaucaccu

SEQ ID NO: 69429 - RNA, 61 nt, Homo Sapiens
ugggacaguuuuccauauccuugcuguggagcucuggaacacucucuaaauuucccucuau

SEQ ID NO: 69430 - RNA, 61 nt, Homo Sapiens
cucccuccagcaugggccugugucucaggcucucuggaagguggcccugccccggacccuc

SEQ ID NO: 69431 - RNA, 61 nt, Homo Sapiens
cuuucccccacccugucucuuccuuguccuucucuggaaaaugccaaaauacacgauguga

SEQ ID NO: 69432 - RNA, 61 nt, Homo Sapiens
gauuauagcaucuccuucugaguguuugggacucuggaaucugagacccauguucacauug

SEQ ID NO: 69433 - RNA, 61 nt, Homo Sapiens
aauggcaaaaauauuuccaguugcacuguaucucuggaagugaugcaugaauucgauugga

SEQ ID NO: 69434 - RNA, 61 nt, Homo Sapiens
ucaaccagagaacagcuccccuagacauggccucuggaaaaaggaaaucuuugguggccaa

SEQ ID NO: 69435 - RNA, 61 nt, Homo Sapiens
cauuacuaauagaaacacagccuuuccaauccucuggaacauauucugucuggguuuuuaa

SEQ ID NO: 69436 - RNA, 61 nt, Homo Sapiens
guacaaaauccuacuuuucagagccuuccagcucuggaaccucaaacauccucaugcucuc

SEQ ID NO: 69437 - RNA, 61 nt, Homo Sapiens
aacuauugaugaauuguuuccugggucacaucucuggaaaauagauguuacaguucuuaaa

SEQ ID NO: 69438 - RNA, 61 nt, Homo Sapiens
aaggcaucugcaacuccaaguccaugcagaacucuggaaggccaaguucaucgcagcaugu

SEQ ID NO: 69439 - RNA, 61 nt, Homo Sapiens
ugucuuuauuuccucaaagucaagcagcuuucucuggaaaaugaaugcuaauuagugugaa

SEQ ID NO: 69440 - RNA, 61 nt, Homo Sapiens
cagcccuagcccuuuagccuuucacccugugcucuggaaaggcuaccaaauacuggccaag

SEQ ID NO: 69441 - RNA, 61 nt, Homo Sapiens
cucuacaguauacuugugagcuucaugaagccucuggaaaacaauaaugucaccacacaca

SEQ ID NO: 69442 - RNA, 61 nt, Homo Sapiens
ccuuuguaaauagguguguucgaaaagugggcucuggaaucucggggucuuuccucagccu

SEQ ID NO: 69443 - RNA, 61 nt, Homo Sapiens
gcgccaggaaaagcuuccguuucgcaugguucucuggaaacucuggugagggacauuguag

SEQ ID NO: 69444 - RNA, 59 nt, Homo Sapiens
aaagaaaaaagucuuugaguauuugaaggcucuggaagacaaaccuaagagcacaguga

SEQ ID NO: 69445 - RNA, 61 nt, Homo Sapiens
acauuuuuaucuagaugaaaaggcuaguuuccucuggaaccaagcucaucccucccguccg

SEQ ID NO: 69446 - RNA, 61 nt, Homo Sapiens
uuauuccagcaguuguuccaacuaccuuccacucuggaaccuguguguucucagugaaaua

SEQ ID NO: 69447 - RNA, 61 nt, Homo Sapiens
gcaaauagaauaggaggggaacuaaugaucacucuggaaaugaaacccagaucgcuguguu

SEQ ID NO: 69448 - RNA, 61 nt, Homo Sapiens
uucccucuaccacugggcacuccucagacgacucuggaagcgguagucccucucaccugcu

SEQ ID NO: 69449 - RNA, 52 nt, Homo Sapiens
aucugcccgcccaccaugccggcucuggaaccaagaaccuaugaaucucuaa

SEQ ID NO: 69450 - RNA, 61 nt, Homo Sapiens
uagacuguauauguuuaauaugcaguuccuccucuggaaugugugguguuauagugguaac

SEQ ID NO: 69451 - RNA, 61 nt, Homo Sapiens
auuuccuccuagcccuuccaaugccugugcccucuggaaaagauaugacaguccagcaucg

SEQ ID NO: 69452 - RNA, 61 nt, Homo Sapiens
ucuuauguaugcaagcuccccauguuuucuccucuggaacuuguugcauuuaacugaaugu

SEQ ID NO: 69453 - RNA, 61 nt, Homo Sapiens
ggacuccuucucccucccuacaucccgaggccucuggaaugccaccccacuucugcaaacc

SEQ ID NO: 69454 - RNA, 61 nt, Homo Sapiens
ugaacagguuuauaaaacauagucuuugucucucuggaauaacuuugcacuuguaguuuug

SEQ ID NO: 69455 - RNA, 61 nt, Homo Sapiens
acauuaaggaugguggggguucauuagagaccucuggaaauguuuucuaagcucagggucu

SEQ ID NO: 69456 - RNA, 61 nt, Homo Sapiens
gagauuuauaaaguuuugauauuuuucccuacucuggaauuugaacuuucuucauguuugc

SEQ ID NO: 69457 - RNA, 61 nt, Homo Sapiens
auugacagcaaugguuucccgggcccagaaacucuggaaagauuuuguccagaagaauuca

SEQ ID NO: 69458 - RNA, 61 nt, Homo Sapiens
gugcuugaccuccuguauucugaauggugaacucuggaagcagggauugugucuggcucuu

SEQ ID NO: 69459 - RNA, 61 nt, Homo Sapiens
gcccuccuuaauuugggaagguuuguguuuucucuggaaugguacaugucuuccauguauc

SEQ ID NO: 69460 - RNA, 61 nt, Homo Sapiens
agucuucuguuugaaaggcuugaaucuaaaacucuggaagaauuuucuaagcagccagcag

SEQ ID NO: 69461 - RNA, 61 nt, Homo Sapiens
uuuaccacauguaacagauuuccuacuuggucucuggaaguuauuguuuuuauuccacacu

SEQ ID NO: 69462 - RNA, 61 nt, Homo Sapiens
cauucuuaaugguaagugucaauuuuuagaucucuggaacaaguguuaucuggaagguuua

SEQ ID NO: 69463 - RNA, 61 nt, Homo Sapiens
ggugguaggagguuuuuuuuuuuacccagggcucuggaaggacaccaaacuguucugcuug

SEQ ID NO: 69464 - RNA, 61 nt, Homo Sapiens
cuuguccaagccuuuaagacagcacugccuucucuggaacuaaaauuacaauugaaguaaa

SEQ ID NO: 69465 - RNA, 61 nt, Homo Sapiens
uuuggcagaacuaguugauuaguuuagggaucucuggaaaugucaguuuccugaagagcca

SEQ ID NO: 69466 - RNA, 61 nt, Homo Sapiens
uccuucaaaacuauaugguugccuagauucucucuggaaacugacuuugucaaauaaauag

SEQ ID NO: 69467 - RNA, 61 nt, Homo Sapiens
gagcauccgaccucuuggagcaaguuucugccucuggaaagggggcgggcccuuuucacaa

SEQ ID NO: 69468 - RNA, 61 nt, Homo Sapiens
cuggcugugaaaagucaggucuaccacccaccucuggaagacuaggguggaggucacugca

SEQ ID NO: 69469 - RNA, 61 nt, Homo Sapiens
cuaucagaagacaaaguuugucuacaggaaucucuggaaaaaggcucucccugcucccuuc

SEQ ID NO: 69470 - RNA, 61 nt, Homo Sapiens
uguggaguagcuguaauaaaucauuguaucacucuggaaaagauaguuuuuaacucuaugg

SEQ ID NO: 69471 - RNA, 61 nt, Homo Sapiens
aaaaaaaaaaaugaaaaaaaaucugguugaacucuggaaaagcuaaaaagauuacagcguc

SEQ ID NO: 69472 - RNA, 61 nt, Homo Sapiens
ucuugcugauaggaaugauaucaccugguugcucuggaagcucccaaggcccuaagguccc

SEQ ID NO: 69473 - RNA, 61 nt, Homo Sapiens
gauauauugguugguucauauucccgccucccucuggaauggaccuguacuuauuuuucuc

SEQ ID NO: 69474 - RNA, 61 nt, Homo Sapiens
caaacuaccaauuucucguugcccauguccccucuggaagacugagcccaccagccacagu

SEQ ID NO: 69475 - RNA, 61 nt, Homo Sapiens
uauuuauuuagcauagacauuaaagauaacucucuggaaaaugacuugacuaaggcucuca

SEQ ID NO: 69476 - RNA, 61 nt, Homo Sapiens
gcaccuuucuuccgucuguucacucugcggccucuggaaucccagcucuucucucucagaa

SEQ ID NO: 69477 - RNA, 61 nt, Homo Sapiens
ggaaccuggaccccagccuuggugggggagccucuggaaugcauggggcggguccuagcug

SEQ ID NO: 69478 - RNA, 61 nt, Homo Sapiens
guagcaugauugcgcucauggauacagauggcucuggaaagcucaaccugcaggaguucca

SEQ ID NO: 69479 - RNA, 61 nt, Homo Sapiens
uggaaagcucaaccugcaggaguuccaccaccucuggaacaagauuaaggccuggcaggug

SEQ ID NO: 69480 - RNA, 61 nt, Homo Sapiens
guccccaccacuccuggagucccaaugacuucucuggaaagacaaagagguuaucacaaaa

SEQ ID NO: 69481 - RNA, 61 nt, Homo Sapiens
uuguuuuauaaagaacgugauuuccagugaucucuggaagcgcuaaagcuaaaauuucugu

SEQ ID NO: 69482 - RNA, 61 nt, Homo Sapiens
gaggcauacacuuuuuacagauggacaaaagcucuggaacccuguggcuucaaauccuuug

SEQ ID NO: 69483 - RNA, 60 nt, Homo Sapiens
aguagauaaaacagcugcaauauaaacaguccucuggaauaaugguuugugguggaugcu

SEQ ID NO: 69484 - RNA, 61 nt, Homo Sapiens
gaaaugcagaccugugggcucuaccacaggccucuggaaucagaaucuucaggguggggcc

SEQ ID NO: 69485 - RNA, 61 nt, Homo Sapiens
cuaggcuuacaggccauccugagccaggggccucuggaaauucucuuccugaugguccuuu

SEQ ID NO: 69486 - RNA, 61 nt, Homo Sapiens
ggggcauuuugcuggggggagaugaggcagccucuggaauggcucagggauucagcccucc

SEQ ID NO: 69487 - RNA, 61 nt, Homo Sapiens
gccacccaggaaggaagcacagagcugggggcucuggaaacgcccugugucucuggcuaca

SEQ ID NO: 69488 - RNA, 61 nt, Homo Sapiens
cuccggacucuggcacgcuccagcagcccuccucuggaagcugcguccccucacccccugu

SEQ ID NO: 69489 - RNA, 61 nt, Homo Sapiens
gcagggaguggggauugguccuacuuucuuucucuggaaaggaaagccuccaagacuccau

SEQ ID NO: 69490 - RNA, 61 nt, Homo Sapiens
agacuccgagaguuauaacuauguaaagauccucuggaaaaugacugagacaauucugucc

SEQ ID NO: 69491 - RNA, 61 nt, Homo Sapiens
uggauuugcuucuuacccugaaaacuaaaaucucuggaaaaugccuggcugauucuuccuu

SEQ ID NO: 69492 - RNA, 61 nt, Homo Sapiens
cagcaggaucacagcugccuagaagggcaugcucuggaacccuccagcuuccagcuaggcc

SEQ ID NO: 69493 - RNA, 61 nt, Homo Sapiens
gcugauuuuauggacugaggcuggaaccuuccucuggaagucucgaugugcacugugaugc

SEQ ID NO: 69494 - RNA, 61 nt, Homo Sapiens
acacuagugugagccuucagaaaacugucaccucuggaaaugcgucuccaauaugacuauu

SEQ ID NO: 69495 - RNA, 61 nt, Homo Sapiens
cacugaauaaagcacgugcaugagggguccccucuggaaugaagggcuuggccagcgcugu

SEQ ID NO: 69496 - RNA, 61 nt, Homo Sapiens
acuccagcccagcuccaccugaugaagccuucucuggaacccaucagccuugaagggccuc

SEQ ID NO: 69497 - RNA, 61 nt, Homo Sapiens
cccugggcccaguaccuagcucugaagaacucucuggaagcuccuuaggccucugagaagc

SEQ ID NO: 69498 - RNA, 61 nt, Homo Sapiens
uuggcgggcaucgccgacccgaccugacuuacucuggaaucucagucacaacucaccuagc

SEQ ID NO: 69499 - RNA, 61 nt, Homo Sapiens
cagucccauuuccuuccuggcagauguggugcucuggaaucagacggccaguucuggcggc

SEQ ID NO: 69500 - RNA, 61 nt, Homo Sapiens
gcucacaaugagugugacaucuuccucuucucucuggaacgugggacauacuugcccccua

SEQ ID NO: 69501 - RNA, 61 nt, Homo Sapiens
agucacuuuuuuucccugaguuaaauguaugcucuggaaugagaugauguagcuguacauu

SEQ ID NO: 69502 - RNA, 61 nt, Homo Sapiens
aggccgggggagcagacagggccggugcucccucuggaagcuugggugaccggggcccugg

SEQ ID NO: 69503 - RNA, 61 nt, Homo Sapiens
ccucggccagcuggacccacaugagggccaccucuggaaccuucuucgaggcccuggccag

SEQ ID NO: 69504 - RNA, 61 nt, Homo Sapiens
gcaccucucugucccuuccgugucucacugucucuggaagcuucagcccauguguguccug

SEQ ID NO: 69505 - RNA, 61 nt, Homo Sapiens
cucuguguggauagacuccccagcguuuuuccucuggaaaugcccacagggcuugccgcgu

SEQ ID NO: 69506 - RNA, 61 nt, Homo Sapiens
cuccccacaguuuuaggaucuaaaugauugccucuggaacuauucuucuagacuaucccac

SEQ ID NO: 69507 - RNA, 61 nt, Homo Sapiens
ucuacaucagcugaaccugaaacucaggggacucuggaacaccauggacccugggggcugu

SEQ ID NO: 69508 - RNA, 61 nt, Homo Sapiens
cagagccccaggugccuggccuggccuagaccucuggaauugagauuaaacaauuuggagu

SEQ ID NO: 69509 - RNA, 61 nt, Homo Sapiens
ccugcugugacugaccuacaguggacuuucucucuggaauggaaccuucuuaggccuccug

SEQ ID NO: 69510 - RNA, 61 nt, Homo Sapiens
caccagcuugggcaacguaagaagaccgugucucuggaauuuuuuuuuuuuuuuaauuagc

SEQ ID NO: 69511 - RNA, 61 nt, Homo Sapiens
ucuugggaacgcuggagagcuugugcacagccucuggaaggaaaggcagcgcugacuucgu

SEQ ID NO: 69512 - RNA, 61 nt, Homo Sapiens
aggggcuccccgaccugccccuguacuggaacucuggaaagacagacugacacguuuccca

SEQ ID NO: 69513 - RNA, 61 nt, Homo Sapiens
aaaagagccuugucugaccucaggccgcugucucuggaagucuacauucuucccgaggcuc

SEQ ID NO: 69514 - RNA, 61 nt, Homo Sapiens
cacgucuuagcuucugaacagccuggccuggcucuggaaguacagucaggggccuccacau

SEQ ID NO: 69515 - RNA, 61 nt, Homo Sapiens
auugcugguccugaagcuuugcaaauaaaggcucuggaagcagucuggaaaguugggauuu

SEQ ID NO: 69516 - RNA, 61 nt, Homo Sapiens
aaccucuuucuaauacccucgaccacucauccucuggaaucuggggggcuauagccucaga

SEQ ID NO: 69517 - RNA, 61 nt, Homo Sapiens
gacagggaaguugaguuagcgcucauggaaccucuggaaagaguacauguuuaaaagaaga

SEQ ID NO: 69518 - RNA, 61 nt, Homo Sapiens
ggccacacacccgagagcugaagugguaggacucuggaagaauuacuuggaaaacaguggg

SEQ ID NO: 69519 - RNA, 61 nt, Homo Sapiens
gucgauggaacuggccacgcacaggcucuggcucuggaaggagggaugaugagugggcguu

SEQ ID NO: 69520 - RNA, 61 nt, Homo Sapiens
gcuuguuuguuuuuagauuccugagagaugucucuggaagggaaaguuuugagaacuaaug

SEQ ID NO: 69521 - RNA, 61 nt, Homo Sapiens
gacuuaaauguaaaaccccaaacuauaaaaacucuggaagauaaccuaggcaauaccauuc

SEQ ID NO: 69522 - RNA, 61 nt, Homo Sapiens
ggccuggccugaccaaugagaggccagaacacucuggaacaucggaagaggaguucuuugc

SEQ ID NO: 69523 - RNA, 61 nt, Homo Sapiens
gggagacggcuuuguccuggggacacuuucccucuggaaucucaagacgacguggcacaca

SEQ ID NO: 69524 - RNA, 61 nt, Homo Sapiens
gagagcuggaggacaauauccagggacauggcucuggaaaauaacuuuuuuuuuuuuaaga

SEQ ID NO: 69525 - RNA, 61 nt, Homo Sapiens
uagggaggugaguccucucuaucuccucuggcucuggaagcaccuugaaaaugugcauuuu

SEQ ID NO: 69526 - RNA, 61 nt, Homo Sapiens
auuacaagacggggagugagacuccugauugcucuggaagccugcugauuucuacaacuga

SEQ ID NO: 69527 - RNA, 61 nt, Homo Sapiens
cugcucugugucuguguugugaagcuugagacucuggaaagaaauggggagggggggcagg

SEQ ID NO: 69528 - RNA, 61 nt, Homo Sapiens
ccaucagcccuugcaagucccccacucaggccucuggaagguccagggaugggcucugaug

SEQ ID NO: 69529 - RNA, 61 nt, Homo Sapiens
cuaugaggguguauauauuuuuuacccaaagcucuggaauuguacauuuauuuuuuaaaac

SEQ ID NO: 69530 - RNA, 61 nt, Homo Sapiens
cgagccaguggcggcugguaucccgcggcggcucuggaagcuggacgcggaccacggcccg

SEQ ID NO: 69531 - RNA, 61 nt, Homo Sapiens
aacugggaacauugcauccauggguugaugucucuggaagugcaaccacccaaugucucug

SEQ ID NO: 69532 - RNA, 61 nt, Homo Sapiens
ugaugucucuggaagugcaaccacccaaugucucuggaagugccaccuggaagugccaccu

SEQ ID NO: 69533 - RNA, 61 nt, Homo Sapiens
agugccaccuggaagugccaccuggaagugucucuggaagagcacccaccacuguucagcc

SEQ ID NO: 69534 - RNA, 61 nt, Homo Sapiens
ggcagaggcuccgcggcaggaggagccggugcucuggaagaccugaaagaagcccaggugg

SEQ ID NO: 69535 - RNA, 61 nt, Homo Sapiens
uuagaacauauuugcauaagauagcuauuuacucuggaaaccaacaacuuuugagauuucc

SEQ ID NO: 69536 - RNA, 61 nt, Homo Sapiens
gaauuuugauagaaaaccauggggccaagagcucuggaagccuggccggaaagaccaaggu

SEQ ID NO: 69537 - RNA, 61 nt, Homo Sapiens
gagagucggagauaugacugacugauuccuucucuggaauaguuacuuuacaacacggucu

SEQ ID NO: 69538 - RNA, 61 nt, Homo Sapiens
cucucccuucccugcugccuugcagugaccccucuggaacucaggacucgauuuuaaggac

SEQ ID NO: 69539 - RNA, 61 nt, Homo Sapiens
ugccuucccuagaaccggaggccccggacuucucuggaaaaccgccugucugcaggcccga

SEQ ID NO: 69540 - RNA, 61 nt, Homo Sapiens
cuacauaaaugggaucauuuuauacauggugcucuggaacccacauuuuucaugcagucau

SEQ ID NO: 69541 - RNA, 60 nt, Homo Sapiens
ugaggaaucuggucaagugagcgggccuuacucuggaaggaggccucagagguuucucca

SEQ ID NO: 69542 - RNA, 61 nt, Homo Sapiens
ugagauuguaggugauauuuaugguuuuuuccucuggaagaauucaagggaaaggcacuaa

SEQ ID NO: 69543 - RNA, 61 nt, Homo Sapiens
aaagaauccuuagaugccuagaauagauuuucucuggaaauaggaggucagcaaaggucuu

SEQ ID NO: 69544 - RNA, 61 nt, Homo Sapiens
acccuuccggaacccuucggaggggaaugcgcucuggaaacgcuggauauccugggggagg

SEQ ID NO: 69545 - RNA, 61 nt, Homo Sapiens
gaggcaguagcaaagagauguucuugugcugcucuggaagacgcaaguccauuuuauuucc

SEQ ID NO: 69546 - RNA, 61 nt, Homo Sapiens
gacaccccagccagggacggcaucucugucacucuggaaggcaccuugagcagccucagau

SEQ ID NO: 69547 - RNA, 61 nt, Homo Sapiens
caggacucugggguuuuacaccaaaggaggccucuggaaccccccuuccagggccucugcu

SEQ ID NO: 69548 - RNA, 61 nt, Homo Sapiens
gccuggaaacugggcacagaccagcuuccuucucuggaaaaccaagccuagagccaccagc

SEQ ID NO: 69549 - RNA, 61 nt, Homo Sapiens
gccaauccauccuucccccauguaaagucuccucuggaaauccaugagaucaggcgccauc

SEQ ID NO: 69550 - RNA, 61 nt, Homo Sapiens
guccaagaacgaaccugccagaugagucacacucuggaacucgugcgucccucuuaggaga

SEQ ID NO: 69551 - RNA, 61 nt, Homo Sapiens
cacauggcuucaccugucccuccauugugggcucuggaaacagaaaaugagcagauuucuu

SEQ ID NO: 69552 - RNA, 61 nt, Homo Sapiens
gucuggacuagguguugaagcagacaacuuucucuggaaggucuaccaaguacgaugucuu

SEQ ID NO: 69553 - RNA, 61 nt, Homo Sapiens
caagcucugccucuccggguugcugagauuucucuggaaaaaacaggcagccucaagaaug

SEQ ID NO: 69554 - RNA, 61 nt, Homo Sapiens
caccguggcagaaaccgaggccugacagaaucucuggaauggagcuccaagcacagcaaag

SEQ ID NO: 69555 - RNA, 61 nt, Homo Sapiens
ugagcuccaagcacagcaaacacagccagugcucuggaaaugagaucuuggaacugaaacg

SEQ ID NO: 69556 - RNA, 61 nt, Homo Sapiens
caaggaggagacuucauuuaucuuuggcauucucuggaaugcauuuccuguuuuccuuuuu

SEQ ID NO: 69557 - RNA, 61 nt, Homo Sapiens
uuucccuucgaucuuaucucagaaucugcugcucuggaauaucuuuggaagccuugaguuc

SEQ ID NO: 69558 - RNA, 61 nt, Homo Sapiens
cugaggcacacuucaccaucacguaaauuuucucuggaagguauuuuaaaauagugaauau

SEQ ID NO: 69559 - RNA, 61 nt, Homo Sapiens
agccaagaaaagagaauauuaaauguugggacucuggaacuuuuggggaaacacuuugcug

SEQ ID NO: 69560 - RNA, 61 nt, Homo Sapiens
aagccuauuuccuccagccauauaaggacaacucuggaaacacugcuuuuuauacauuuug

SEQ ID NO: 69561 - RNA, 61 nt, Homo Sapiens
cucucuggaggguuaacucugcugucugaggcucuggaauguugcugaaaaaagcucuggg

SEQ ID NO: 69562 - RNA, 61 nt, Homo Sapiens
agcacacuugauuccucacuuucauaaucagcucuggaacaugacccgcuuuucuagaaag

SEQ ID NO: 69563 - RNA, 61 nt, Homo Sapiens
uccucacgguauauugauguuuuugcagggacucuggaauggaacugcagcucacgagacc

SEQ ID NO: 69564 - RNA, 61 nt, Homo Sapiens
agcuuuugcagaggagugguuuggcgagcaucucuggaaaugcuccucugauccuuuaggg

SEQ ID NO: 69565 - RNA, 61 nt, Homo Sapiens
gcuggugaggacucugccucaacuggccuggcucuggaaggucugcagggcugcccucucu

SEQ ID NO: 69566 - RNA, 61 nt, Homo Sapiens
auucaauacauuaugcuuaaauuagcaguuucucuggaauuccugucucuccuuuaaaaga

SEQ ID NO: 69567 - RNA, 61 nt, Homo Sapiens
uugauaucgucauauaaagccauugcaaggacucuggaaacugccgccaaugaccaauuuc

SEQ ID NO: 69568 - RNA, 61 nt, Homo Sapiens
cagcuuggcauucuucuuauucuagaggucucucuggaaaagauggagaaaaugaacagga

SEQ ID NO: 69569 - RNA, 61 nt, Homo Sapiens
auguaaugcuuccaaucuugacucucugacccucuggaaaucucacccauaaacaguaaug

SEQ ID NO: 69570 - RNA, 60 nt, Homo Sapiens
aacaguaucacauucuaggacaccaggaaacucuggaaugguguaccauacaacaaauaa

SEQ ID NO: 69571 - RNA, 61 nt, Homo Sapiens
ugaggaagugaacauuucgggaaacagaauccucuggaacuuacuggcucugucugaguaa

SEQ ID NO: 69572 - RNA, 61 nt, Homo Sapiens
ccucugcugucacugcucgaagcagcagucucucuggaagcaucugugucauggccaucgc

SEQ ID NO: 69573 - RNA, 61 nt, Homo Sapiens
agauggacucuagaagcacugagcucccugucucuggaaguauuuaagaaaaggcugggcc

SEQ ID NO: 69574 - RNA, 61 nt, Homo Sapiens
aaaaauaaaaauaaauauuggcgggggaacccucuggaaucaauaaaggcuuccuuaacca

SEQ ID NO: 69575 - RNA, 61 nt, Homo Sapiens
accccauuccagauauagaauguuucuaucucucuggaagguuccugcauguuauauggcu

SEQ ID NO: 69576 - RNA, 61 nt, Homo Sapiens
cuugcugaaccguuugugauugccauuugagcucuggaagccucuauugccaugagaguuc

SEQ ID NO: 69577 - RNA, 61 nt, Homo Sapiens
gauucuguccgugaaaugaauuggguagagucucuggaagguuuuaagcccauuuucaguu

SEQ ID NO: 69578 - RNA, 61 nt, Homo Sapiens
agcccaugcucuucuguacugucaugcccgucucuggaauguccacucccagagccugccc

SEQ ID NO: 69579 - RNA, 61 nt, Homo Sapiens
ggggaggcccagggcuggugagucuagaaugcucuggaacccuacaccuagugaugugugu

SEQ ID NO: 69580 - RNA, 61 nt, Homo Sapiens
ucuguccccucauuuuugagaucccccaauucucuggaacuauucugcugccccuuuuuau

SEQ ID NO: 69581 - RNA, 61 nt, Homo Sapiens
gugcguucugcauagaauucggccccauagccucuggaacuccuaggucugggugggcagu

SEQ ID NO: 69582 - RNA, 61 nt, Homo Sapiens
aucaucccgcuucucuccggggaggaggacgcucuggaacccgcuggggccucggagacuu

SEQ ID NO: 69583 - RNA, 61 nt, Homo Sapiens
acuuggcucugccccaugggcuccaagccaccucuggaaauucuccccgccaccccagggc

SEQ ID NO: 69584 - RNA, 61 nt, Homo Sapiens
cgcaccuuuaacuuugcagaaccccuucugacucuggaaaccccaggaggagccccgcuuc

SEQ ID NO: 69585 - RNA, 61 nt, Homo Sapiens
cucaggauucucacgacucugguuugaaagccucuggaaaaucccauuuucgcuuuccucu

SEQ ID NO: 69586 - RNA, 61 nt, Homo Sapiens
gucaccuuuucgggcgcagcuggcuugguuucucuggaaaugggcggcccuguacuuuuug

SEQ ID NO: 69587 - RNA, 61 nt, Homo Sapiens
gugguucccagggaugggccggggaggcccccucuggaaauggggccaaugggggccucag

SEQ ID NO: 69588 - RNA, 61 nt, Homo Sapiens
cauuuguuaaaaaaaaaaaacucgagcaggucucuggaagcugcacgcccaccccaugaaa

SEQ ID NO: 69589 - RNA, 61 nt, Homo Sapiens
ggccuugcccgguccccuuccacccacaacccucuggaaguccgcagacccuuaaaaaaau

SEQ ID NO: 69590 - RNA, 61 nt, Homo Sapiens
gcuugaggaugugguucucggcaccagguugcucuggaagaccuucacucagggucagcgg

SEQ ID NO: 69591 - RNA, 61 nt, Homo Sapiens
cuuuuucgacugccccaacugccacaccagacucuggaacccugccgugaaaccccagcca

SEQ ID NO: 69592 - RNA, 61 nt, Homo Sapiens
gcugggguaguuggugagcacuguucacagucucuggaaaauaguuggccagcgucuugcu

SEQ ID NO: 69593 - RNA, 61 nt, Homo Sapiens
cauggcuuuauuuucuuaauagugcuaaacgcucuggaaagaagcacaaguacguuaaaca

SEQ ID NO: 69594 - RNA, 61 nt, Homo Sapiens
ugagauguuguuugauagcaacgaaagauuucucuggaacaauuaacugacgcuuccuucc

SEQ ID NO: 69595 - RNA, 61 nt, Homo Sapiens
cugcauguauuguagcugugcugcauccucucucuggaaggucuugaggacccccacccuc

SEQ ID NO: 69596 - RNA, 61 nt, Homo Sapiens
ccccaacugggaauugagagguaaggucuuucucuggaaauccagcaguagaggaagggac

SEQ ID NO: 69597 - RNA, 61 nt, Homo Sapiens
cugccccuuccauggaaaagcuggaaaaaaacucuggaacccauauccaggcuuggugagg

SEQ ID NO: 69598 - RNA, 61 nt, Homo Sapiens
agugaagccuguuucguugaacuaauucuggcucuggaaauguuuuuguuuuauaguuauu

SEQ ID NO: 69599 - RNA, 61 nt, Homo Sapiens
cauuauuaacugauuaaugcacuuugaaguucucuggaauuaauuauuuuaacuuggccua

SEQ ID NO: 69600 - RNA, 61 nt, Homo Sapiens
acuucccacugauccauggggccuuuaagcccucuggaagcuuccauuaaagaugauuauu

SEQ ID NO: 69601 - RNA, 61 nt, Homo Sapiens
gcaacugcugcaggaugccuguaguagggaacucuggaaguguauugggcugaggugggau

SEQ ID NO: 69602 - RNA, 61 nt, Homo Sapiens
ucccugcacucccuccuggagcucugugggucucuggaagaggaaccaggagaagggcugg

SEQ ID NO: 69603 - RNA, 61 nt, Homo Sapiens
aaaauuguuuauacacucuuuccuccaugagcucuggaagguauaugcaucuucuguaaua

SEQ ID NO: 69604 - RNA, 61 nt, Homo Sapiens
ugauagucccuugaacacacaugcugccgagcucuggaaaaaccccacaggugaguccuca

SEQ ID NO: 69605 - RNA, 61 nt, Homo Sapiens
ccauuuucugguucuguguccucugccugggcucuggaagaggccuucccauggccauuuc

SEQ ID NO: 69606 - RNA, 61 nt, Homo Sapiens
cacucucagccacagggagcgaugcacuccgcucuggaacuuggcagagaugcauuccaga

SEQ ID NO: 69607 - RNA, 61 nt, Homo Sapiens
gcuacauagucaucauuaguugccuuuaaaacucuggaagaacuguaggccaauauagauu

SEQ ID NO: 69608 - RNA, 61 nt, Homo Sapiens
ugauuuuuguguaucugagaaaugcuuugcccucuggaacucucguuguggacuguaauua

SEQ ID NO: 69609 - RNA, 61 nt, Homo Sapiens
gaaaggcccuguaaagcccuuucugcaugaacucuggaacagcuuaccugccacagagcuu

SEQ ID NO: 69610 - RNA, 61 nt, Homo Sapiens
gaccagaguuaagcucucggcagcagguugucucuggaaacugggcgcaucccaagacagc

SEQ ID NO: 69611 - RNA, 61 nt, Homo Sapiens
uuucaaaagcuuaaggcccaaauacaaacuucucuggaauaaacgugguguuuuauuuucu

SEQ ID NO: 69612 - RNA, 61 nt, Homo Sapiens
aagccuuggcucguucucuucucucuucaaucucuggaaaaauaaguacauauaguugaua

SEQ ID NO: 69613 - RNA, 61 nt, Homo Sapiens
ccuggaaauuaaacccugccccacuucucuacucuggaaguccccgggagccucuccuugc

SEQ ID NO: 69614 - RNA, 61 nt, Homo Sapiens
uuauuuugguuaauguaauaaauaggaccuucucuggaaaagccagugagcauuacuuuua

SEQ ID NO: 69615 - RNA, 61 nt, Homo Sapiens
uugcuuuuagcagggaaagcugcugcuuuugcucuggaacuucccucccauauuuucuuuu

SEQ ID NO: 69616 - RNA, 61 nt, Homo Sapiens
gggugcucauguugguuuuaugugucuguaucucuggaacuucaugaacacuaagauuaau

SEQ ID NO: 69617 - RNA, 61 nt, Homo Sapiens
caacgaaggcaaugcugcuccagccagaagccucuggaagguggacuccguggggcuccac

SEQ ID NO: 69618 - RNA, 61 nt, Homo Sapiens
ucugugauccuuugcagguuguucucccugacucuggaacccuggaaccucugugacgcca

SEQ ID NO: 69619 - RNA, 61 nt, Homo Sapiens
ucugugacgccaguucucccguucucccugacucuggaaccucacucagcugcuccucuca

SEQ ID NO: 69620 - RNA, 61 nt, Homo Sapiens
aucucugggguuugcuuguuuguuacauuugcucuggaaacucuguguacagcgcugugca

SEQ ID NO: 69621 - RNA, 61 nt, Homo Sapiens
cugugaugcucccaagcaaaggaaaugcaagcucuggaaauucguuaauguauuugauguc

SEQ ID NO: 69622 - RNA, 61 nt, Homo Sapiens
agggccuccagcccucucacugugucccucucucuggaaaggaggaaggagccuauggcau

SEQ ID NO: 69623 - RNA, 61 nt, Homo Sapiens
auucucucucagccacaguggcaaauucauccucuggaaauagaagcacuuggcuggcuga

SEQ ID NO: 69624 - RNA, 61 nt, Homo Sapiens
ugaagcccugagaaggagagcuccccuggggcucuggaaccacccugccccuggcugggag

SEQ ID NO: 69625 - RNA, 61 nt, Homo Sapiens
ccucugcccccuccccaacauuaguuuugaacucuggaauugacuuugauuccugcgccuu

SEQ ID NO: 69626 - RNA, 61 nt, Homo Sapiens
ccaaagcagcucaucccuucgccagugagugcucuggaaagggaauacccaaggucaugua

SEQ ID NO: 69627 - RNA, 61 nt, Homo Sapiens
ucuuuguguuagggucucgaucuaagccacucucuggaaucugguaagaguagcuggguuu

SEQ ID NO: 69628 - RNA, 61 nt, Homo Sapiens
ugcaggccagaugguugcuggccugacuccccucuggaaacucacuccagucccaccccac

SEQ ID NO: 69629 - RNA, 61 nt, Homo Sapiens
agcgugugaaacagcgggggugcuggacaaacucuggaagcguaugcauucauuuauuccu

SEQ ID NO: 69630 - RNA, 61 nt, Homo Sapiens
ucugcuuagaauucugagagugaucugugagcucuggaauggguagcagcuggugggacac

SEQ ID NO: 69631 - RNA, 61 nt, Homo Sapiens
gugcuccucacaaaguuuccugcugugggcccucuggaauuucacgccaggaggcuguggc

SEQ ID NO: 69632 - RNA, 61 nt, Homo Sapiens
uggcaguguguaaagcacugcggaugauaagcucuggaagcuggcgucuguucugggagca

SEQ ID NO: 69633 - RNA, 61 nt, Homo Sapiens
aauaaggcugccuuggaggcgccuucuuuagcucuggaaagagugggcgcaggcacgccag

SEQ ID NO: 69634 - RNA, 61 nt, Homo Sapiens
ggauuuguggcagggauuccacucagaaccucucuggaauuugugccugaugugccuucca

SEQ ID NO: 69635 - RNA, 61 nt, Homo Sapiens
uccuacaaguuaaccaguugcacuacauaaucucuggaaauuaauuuucucuuuaggagaa

SEQ ID NO: 69636 - RNA, 61 nt, Homo Sapiens
ugucuacccaaucaacaguuuucccucuuugcucuggaaauauuuguacucauauagcaua

SEQ ID NO: 69637 - RNA, 61 nt, Homo Sapiens
aaugcuuuuccaacccaugagugcuaagagccucuggaagggagggcuucaggcccgaagg

SEQ ID NO: 69638 - RNA, 61 nt, Homo Sapiens
gaaauuaccugauaacuuaagacucugugaucucuggaaucaccauauguuucuuuuuugu

SEQ ID NO: 69639 - RNA, 61 nt, Homo Sapiens
caggggugguuacauagaccagcagcuacagcucuggaaauugaaaucauaaucugucaau

SEQ ID NO: 69640 - RNA, 61 nt, Homo Sapiens
gcuguggaguaagagggaaugcggugaggcacucuggaauaugacccuaccagagguugga

SEQ ID NO: 69641 - RNA, 61 nt, Homo Sapiens
uaacucuagaaauucucaguaugggguuucccucuggaaaaagaaaaucugaagacauuac

SEQ ID NO: 69642 - RNA, 61 nt, Homo Sapiens
uuaaacaaaccauccauaacuuggaauacugcucuggaaugaaaaggaacuaacuguugau

SEQ ID NO: 69643 - RNA, 61 nt, Homo Sapiens
uguggacaaaccguaggaaucuacucuucagcucuggaaguugcccuuugauguccuugag

SEQ ID NO: 69644 - RNA, 61 nt, Homo Sapiens
gaaggaacuagguaggagagugucccuguagcucuggaacuguguuuccgugacuuagcug

SEQ ID NO: 69645 - RNA, 61 nt, Homo Sapiens
uuugcuguagcaucuggucuuagguucauuucucuggaacaagcaccccgggaucauuuuc

SEQ ID NO: 69646 - RNA, 61 nt, Homo Sapiens
ccaaggcuccccgugcuucuuggucaccgcucucuggaaaaauucccagagcagacuuacc

SEQ ID NO: 69647 - RNA, 61 nt, Homo Sapiens
ggcauauauguacuaguggcuccugcacugacucuggaaaaaagacuugcacaaauacgga

SEQ ID NO: 69648 - RNA, 61 nt, Homo Sapiens
agacaugagaaccugguaacucauaaguuaucucuggaaagguaaguacauaauugugaau

SEQ ID NO: 69649 - RNA, 61 nt, Homo Sapiens
cacaguguugugcaccaggaugggcacuucccucuggaaauaacaguaucuuaaguuuaac

SEQ ID NO: 69650 - RNA, 61 nt, Homo Sapiens
cugauucagccagcauggauucuggucccaccucuggaaaugcucuuuaaaaauaaauugc

SEQ ID NO: 69651 - RNA, 61 nt, Homo Sapiens
aaggaugucaagaaggugaagcuacugagagcucuggaaagagaaaagaaaagcagaguca

SEQ ID NO: 69652 - RNA, 61 nt, Homo Sapiens
guccucuguauccucaugagugucauguagccucuggaaaaagagagaugacauaaccaua

SEQ ID NO: 69653 - RNA, 62 nt, Homo Sapiens
uccuggaccugggaggccccugugagggccagcucuggaaaaaccugggaguugaugccgga

SEQ ID NO: 69654 - RNA, 62 nt, Homo Sapiens
gcaacugucacgugugcuagaagguucgaugccucuggaaugcaugugauacucaucuccau

SEQ ID NO: 69655 - RNA, 62 nt, Homo Sapiens
aggacacagggauggauaccaccuacccucgccucuggaauggccuacccaacccgagaaga

SEQ ID NO: 69656 - RNA, 62 nt, Homo Sapiens
agaaaccaaagucugccgcccaccucgcuccccucuggaaucuuccccaagggccaaaccca

SEQ ID NO: 69657 - RNA, 62 nt, Homo Sapiens
aucuccugacccucccacucccaucuccuuaccucuggaaccccccaggcccuacaaugcuc

SEQ ID NO: 69658 - RNA, 62 nt, Homo Sapiens
ugacugucacucggcucucccuacccauuuggcucuggaagcugcuuggcccccccagauca

SEQ ID NO: 69659 - RNA, 62 nt, Homo Sapiens
auucuggaccaccaccugggaccaaccuucagcucuggaaccuucauaaagcaggucagcgu

SEQ ID NO: 69660 - RNA, 62 nt, Homo Sapiens
uauccaugcucuguggccaggugccugccacccucuggaacucacaaaagcuggcuuuuauu

SEQ ID NO: 69661 - RNA, 62 nt, Homo Sapiens
ugggaguuauggggucaucaaggaccuugccucucuggaaucugucaacccaguuuugggcu

SEQ ID NO: 69662 - RNA, 62 nt, Homo Sapiens
gcgaccccaccugccauuaccuucagggccuccucuggaagagaacccauucucagagugca

SEQ ID NO: 69663 - RNA, 62 nt, Homo Sapiens
cagacagacagaaagccagaggcuuagggaaacucuggaacccagacaagaaucuuuucgcu

SEQ ID NO: 69664 - RNA, 62 nt, Homo Sapiens
aacucccaaauugucaaguccugcuuaacuuucucuggaaaauagaccccuucucaacauca

SEQ ID NO: 69665 - RNA, 62 nt, Homo Sapiens
auauuauuaauaacccccucugaauuucaugucucuggaauugaggugguagugaacagcag

SEQ ID NO: 69666 - RNA, 52 nt, Homo Sapiens; identical to SEQ ID NO: 69143

SEQ ID NO: 69667 - RNA, 62 nt, Homo Sapiens
gcguccugugacucgccuugccacaucugugucucuggaacccaggaccucuggaccucagg

SEQ ID NO: 69668 - RNA, 62 nt, Homo Sapiens
aaccccagccuaaugaaacccuagguguugggcucuggaaugggacuuugucccuucuaauu

SEQ ID NO: 69669 - RNA, 62 nt, Homo Sapiens
auauauauauaaaaccagagcugacaaugacacucuggaacauugcauaccuucuguacauu

SEQ ID NO: 69670 - RNA, 62 nt, Homo Sapiens
aaggcagagggaugaaaugccaagacucuaugcucuggaaaaccugaggccaaauauugauc

SEQ ID NO: 69671 - RNA, 62 nt, Homo Sapiens
auacuauguuaugaaugguauuaaauuuuagucucuggaacauccaaaaccaagcaaaggga

SEQ ID NO: 69672 - RNA, 62 nt, Homo Sapiens
acagcaggauguugaauugaucaucagaugcccucuggaaugguuagcauccaaggugacag

SEQ ID NO: 69673 - RNA, 62 nt, Homo Sapiens
aaggcuagauccuucccauaguaucaucuguccucuggaaugacucuccugucccuaaaggg

SEQ ID NO: 69674 - RNA, 62 nt, Homo Sapiens
ccucuugcuccucauuccuccccugcccuuuucucuggaauaucuaagaugugagcugcauu

SEQ ID NO: 69675 - RNA, 62 nt, Homo Sapiens
gacgagacugagguuaaacaucagaaaaaaaccucuggaaugaccuuccucauuccaggagg

SEQ ID NO: 69676 - RNA, 62 nt, Homo Sapiens
auuuguuacuuaaauauauagagaccaguuuucucuggaaguuuguuuaaaugacagaagcg

SEQ ID NO: 69677 - RNA, 62 nt, Homo Sapiens
cuaaccccucccucaauaaauacauuacuguacucuggaauuuaggcaaaaccuuaaaucuc

SEQ ID NO: 69678 - RNA, 62 nt, Homo Sapiens
uauuuuugaaguaaauuaaacauuuuucacaucucuggaaauuuagaguucuagaccucugg

SEQ ID NO: 69679 - RNA, 62 nt, Homo Sapiens
aaguugcagaugauucaaacgacuuauuucugcucuggaauauauauuuauuguuagaaaau

SEQ ID NO: 69680 - RNA, 62 nt, Homo Sapiens
ucuccacgcugaaugugauucaacuccagcaucucuggaaaagcuacgugguggccgucugc

SEQ ID NO: 69681 - RNA, 62 nt, Homo Sapiens
ugagaccacuggaggcacaccaccaaggggcccucuggaacucggacaucaagggcggacac

SEQ ID NO: 69682 - RNA, 62 nt, Homo Sapiens
gcuguauuugggccuaaucccuccugggccagcucuggaagggugugacccugcucuuccag

SEQ ID NO: 69683 - RNA, 62 nt, Homo Sapiens
ucauaggguugugaggcaaaacaucuugugcccucuggaagcgauauggucauuuacaagac

SEQ ID NO: 69684 - RNA, 62 nt, Homo Sapiens
ugucugaacuugcugccucccagggcucguggcucuggaaugcucguggcuuggauagaauc

SEQ ID NO: 69685 - RNA, 62 nt, Homo Sapiens
aaaauauguauauauuaaaaauucacuaaacucucuggaaaagagacgauagggcauaugaa

SEQ ID NO: 69686 - RNA, 62 nt, Homo Sapiens
acaugucauuucauuuucagauugagaugauacucuggaaaauaaaaccaucaaauuuuaua

SEQ ID NO: 69687 - RNA, 62 nt, Homo Sapiens
cagaggaguaagagaggaagccuugcagccaacucuggaagggcuccaggccacuaggccuc

SEQ ID NO: 69688 - RNA, 62 nt, Homo Sapiens
acagauucuuguuugguaaaaaaaugagaauucucuggaauauucaaucucuucuucaaauc

SEQ ID NO: 69689 - RNA, 62 nt, Homo Sapiens
agaagucacacagacaaucaaaaaaagucuuccucuggaaagcuuuccuagaauuuaaaaau

SEQ ID NO: 69690 - RNA, 62 nt, Homo Sapiens
gugcagagagugucaguuucucagaucuuucucucuggaaaugguuuugaugcuagugaucu

SEQ ID NO: 69691 - RNA, 62 nt, Homo Sapiens
gcauauccugcuagugauuuggagcagauggucucuggaauugagaaacaaaacuaauuuuu

SEQ ID NO: 69692 - RNA, 62 nt, Homo Sapiens
aaacaugugaguaagugagaugugagcagucccucuggaaagcauaggcucuuuuugcugcc

SEQ ID NO: 69693 - RNA, 57 nt, Homo Sapiens; identical to SEQ ID NO: 69170

SEQ ID NO: 69694 - RNA, 62 nt, Homo Sapiens
uacccauagaagacgggaagaaaacucaaccacucuggaauuaagagccuggggaggagcuu

SEQ ID NO: 69695 - RNA, 62 nt, Homo Sapiens
acauuuggagggaaagacaaaggugggggccucucuggaagcaggcuggagacagggguuug

SEQ ID NO: 69696 - RNA, 62 nt, Homo Sapiens
uguuguauuuucucccaguaaaaaaccaugcacucuggaauuguggggugauagggugggcu

SEQ ID NO: 69697 - RNA, 62 nt, Homo Sapiens
ugaguuacaaccaccaauacgcugaauucucccucuggaaacauugugaucuaggcugcugg

SEQ ID NO: 69698 - RNA, 62 nt, Homo Sapiens
cgucccagaauauuagccagggcuuaauguuucucuggaaaguggcucauacacacuuaaaa

SEQ ID NO: 69699 - RNA, 62 nt, Homo Sapiens
gaggaaugccugugugagcauauguuagggugcucuggaagaucccuauuuguuuucuucug

SEQ ID NO: 69700 - RNA, 62 nt, Homo Sapiens
gggauuaaacagauacccaacugcaugcccuccucuggaacuccccacuucuucccuccagc

SEQ ID NO: 69701 - RNA, 62 nt, Homo Sapiens
gggaacauguggggacuacuggcaguugaaaucucuggaagacuacagaggugaccaggccu

SEQ ID NO: 69702 - RNA, 62 nt, Homo Sapiens
aacuguuugcaguuguaugccaggcgugaauccucuggaaggugaugacccucugcgguugu

SEQ ID NO: 69703 - RNA, 62 nt, Homo Sapiens
uaauaauuacaucauaaucauauugcaaaacacucuggaaagaucucuuaacagguugaagu

SEQ ID NO: 69704 - RNA, 62 nt, Homo Sapiens
cauuccccauccaucacuccuugcuagguagccucuggaaagcugcagaugcuacugacugc

SEQ ID NO: 69705 - RNA, 62 nt, Homo Sapiens
uggccaggcagucccagaagccccuuccucaucucuggaauuaccccuaccccagucacucg

SEQ ID NO: 69706 - RNA, 62 nt, Homo Sapiens
auuaggaggcagccauaauauggguguggcugcucuggaagagugagagcccgucacagucc

SEQ ID NO: 69707 - RNA, 62 nt, Homo Sapiens
uuaauggguuauuucucuuugaggguggcuuucucuggaacauugguuagagcagcuuuguu

SEQ ID NO: 69708 - RNA, 62 nt, Homo Sapiens
agaugcagggauuggccagcuggguugguuugcucuggaauggcuaacucuugccugcuuug

SEQ ID NO: 69709 - RNA, 62 nt, Homo Sapiens
uaccaggcuguaaaagcaaaaccucguaucagcucuggaacaauaccugcaguuauucuuca

SEQ ID NO: 69710 - RNA, 61 nt, Homo Sapiens; identical to SEQ ID NO: 69187

SEQ ID NO: 69711 - RNA, 62 nt, Homo Sapiens
ccaguccugaguuugcuacuuacuucuguggccucuggaaccuuauccaaccucuuggugcu

SEQ ID NO: 69712 - RNA, 62 nt, Homo Sapiens
aaaaccaccaggaaugaauucacuccccacuucucuggaaccucaggacccgcccauuucuc

SEQ ID NO: 69713 - RNA, 62 nt, Homo Sapiens
gccucuggguacaaaagugccucaacgacaugcucuggaaaucccaaaugccacagucugag

SEQ ID NO: 69714 - RNA, 62 nt, Homo Sapiens
gggagaaggcgcuaccugcgugggacccucuucucuggaaaccuaauccuccuuucauuucc

SEQ ID NO: 69715 - RNA, 62 nt, Homo Sapiens
uuuuuuuuuccccaguauugcccuggagcugucucuggaaaguagcuggcgagguuaccuua

SEQ ID NO: 69716 - RNA, 62 nt, Homo Sapiens
gauucaagauagcugugauuucucucaccguucucuggaaauggcaucagauuuaaggauaa

SEQ ID NO: 69717 - RNA, 62 nt, Homo Sapiens
agccucucccugccaaagcccaacucccagggcucuggaaauggugaggcgaggggcuugag

SEQ ID NO: 69718 - RNA, 62 nt, Homo Sapiens
acauuccuccauguccucacggcuggauuucucucuggaaaggauuuucauucaucauggug

SEQ ID NO: 69719 - RNA, 62 nt, Homo Sapiens
ccucuguaggccaguaguucucaaaguguggucucuggaagagcaguaucagcaucaucugg

SEQ ID NO: 69720 - RNA, 62 nt, Homo Sapiens
uuaucuuacugaacaccuguagucccagcuuucucuggaaguggucguauuugagcaggaug

SEQ ID NO: 69721 - RNA, 62 nt, Homo Sapiens
aggaagggggcagggacgugaccuugacuuaccucuggaaagggucccagccuagacugcuu

SEQ ID NO: 69722 - RNA, 62 nt, Homo Sapiens
cccgguugcuggucagguccccauggcuuguucucuggaaccugacuuuagauguuuuggga

SEQ ID NO: 69723 - RNA, 62 nt, Homo Sapiens
gggguggcgcucagaccccacccuacgcucaucucuggaaggggcagcccugaguggucacu

SEQ ID NO: 69724 - RNA, 62 nt, Homo Sapiens
cgggcaagcacuaccaggcugugggucugcaccucuggaagguagagaagcggcgggucaau

SEQ ID NO: 69725 - RNA, 62 nt, Homo Sapiens
caauaauuuccagugagcggaaauguauguaucucuggaaguccuccccuuuaaauuaaaaa

SEQ ID NO: 69726 - RNA, 62 nt, Homo Sapiens
cuugcgcagagcuuacuuuguuugucugcucccucuggaagcgauguucaguuuagaaccau

SEQ ID NO: 69727 - RNA, 62 nt, Homo Sapiens
guguccuuacccuucugcaggauacacuugcucucuggaaguuggucuucuuagaguugcag

SEQ ID NO: 69728 - RNA, 62 nt, Homo Sapiens
agacucagguuucuuuggacauuuuucauucucucuggaaacacugaucaggugucuauaac

SEQ ID NO: 69729 - RNA, 62 nt, Homo Sapiens
agaugaacgucaccaauggaaaugguauauuccucuggaaaauuuccccuaaguccuaacag

SEQ ID NO: 69730 - RNA, 62 nt, Homo Sapiens
uagccaagaccaggagaagagugguucaaauccucuggaacacugagcacaggccgauggag

SEQ ID NO: 69731 - RNA, 62 nt, Homo Sapiens
ucaggacccgcccauuucuccacuccccacuucucuggaaccaaaaccaccaggaaugaauu

SEQ ID NO: 69732 - RNA, 62 nt, Homo Sapiens
gucucagaucuaaaauuuccgaggcugcuuuacucuggaauauucacauuaagaaugugccu

SEQ ID NO: 69733 - RNA, 62 nt, Homo Sapiens
agacugauuuugcuuuuuuuacgguuuuuagucucuggaaaagcaguugaucagacugaaaa

SEQ ID NO: 69734 - RNA, 62 nt, Homo Sapiens
aagcugggucucauguuugaaguagguaccaucucuggaaaaacuucaaucuagaauucucc

SEQ ID NO: 69735 - RNA, 62 nt, Homo Sapiens
ccugguucccugccucuguauucagguguggccucuggaaccugacuccguuaggacgaaca

SEQ ID NO: 69736 - RNA, 62 nt, Homo Sapiens
uauggaucagugacuguaguaggaguuugaggcucuggaacucucacauauucaagucuuua

SEQ ID NO: 69737 - RNA, 62 nt, Homo Sapiens
uugaaggcaagugacuucaguugagggcaagucucuggaaaagaggcuguaggcaucuggca

SEQ ID NO: 69738 - RNA, 62 nt, Homo Sapiens
gcccuggccucugccugccucccgccugugcacucuggaaccucuggccucaggggaccugc

SEQ ID NO: 69739 - RNA, 62 nt, Homo Sapiens
uuucucuugugucccuacucauugaaaccaaacucuggaaaggacccaauguaccaguauuu

SEQ ID NO: 69740 - RNA, 62 nt, Homo Sapiens
gcaguccacuugcugaagaaguugugucauuucucuggaagaauuuccaaaauucuggauuu

SEQ ID NO: 69741 - RNA, 62 nt, Homo Sapiens
uucaauauccacuucuuucagccuacuguagacucuggaaguauacuuuuugcauauguaag

SEQ ID NO: 69742 - RNA, 62 nt, Homo Sapiens
guuauaggccuugccaggguuucgagaagcugcucuggaauuugcaagucauggcugugccc

SEQ ID NO: 69743 - RNA, 62 nt, Homo Sapiens
gaagcauuugugguaguaaaggaaaaccaacccucuggaaaauacauuuugagaaucucaaa

SEQ ID NO: 69744 - RNA, 62 nt, Homo Sapiens
guggcuugauguggcaagccgaaaccacuuggcucuggaaaucuaaguucauacugguuuaa

SEQ ID NO: 69745 - RNA, 62 nt, Homo Sapiens
uuuuuacuuuuauauuuuugcuugaaucuuaacucuggaaaucaccugauguagaagaagac

SEQ ID NO: 69746 - RNA, 62 nt, Homo Sapiens
aaggaaucgugcucucaaugcaaagugucauucucuggaauugcaccuggcucaggaaagga

SEQ ID NO: 69747 - RNA, 62 nt, Homo Sapiens
uggccuauggagagacaggccuuucucucagccucuggaagccaccugcucuuuugcucuag

SEQ ID NO: 69748 - RNA, 62 nt, Homo Sapiens
gcuccuagagaagaacaauccucauggagaaacucuggaaaccuugacaauggcaacagugu

SEQ ID NO: 69749 - RNA, 62 nt, Homo Sapiens
ccucuccaagcccuccucugaaccagcuaucccucuggaaugcagcugaccaaacaaauucc

SEQ ID NO: 69750 - RNA, 62 nt, Homo Sapiens
cugcaauaacaggaacaugagacuucgcaaaucucuggaaaauaauauccaaaugaaauuaa

SEQ ID NO: 69751 - RNA, 62 nt, Homo Sapiens
cuguuuucaauauaauucuugauuucauuuuucucuggaauauauuggccuucuacagcuau

SEQ ID NO: 69752 - RNA, 62 nt, Homo Sapiens
ccuuuugcauuaaaaggacuugucccuggagacucuggaaaucccagggaagccccugguuc

SEQ ID NO: 69753 - RNA, 62 nt, Homo Sapiens
caacuucaucccagcugcugaaugcccugcggcucuggaaaggugaccuggucuggucaggc

SEQ ID NO: 69754 - RNA, 62 nt, Homo Sapiens
caggguugggugcuuauuuaccagaccaagcacucuggaagcgguuaugcccaucuccauag

SEQ ID NO: 69755 - RNA, 62 nt, Homo Sapiens
uaccacaugcaaacauacaaacugaagauuuccucuggaagcauaugaaccugaagauuaaa

SEQ ID NO: 69756 - RNA, 62 nt, Homo Sapiens
cccagccacaccugagucccgguugagggaggcucuggaaagacuucagccugugaggggag

SEQ ID NO: 69757 - RNA, 62 nt, Homo Sapiens
uuuauggugguucagaagaauaucuaccucuucucuggaauguccuccaggaucuagccuuc

SEQ ID NO: 69758 - RNA, 62 nt, Homo Sapiens
ucuguuuuaugcuaaauggacaguguuuccaucucuggaauccagaagccaccuggaagacc

SEQ ID NO: 69759 - RNA, 62 nt, Homo Sapiens
uggaaaucacauacacacaccuaacaggcaggcucuggaaguugaguaaaauggaauaauac

SEQ ID NO: 69760 - RNA, 62 nt, Homo Sapiens
ugcagucaucaauggucaguagagccucauuccucuggaacgcaaugaaccaccugauuaca

SEQ ID NO: 69761 - RNA, 62 nt, Homo Sapiens
uauucuauaagaaaaagcugaaacuacguaaacucuggaaaggcuguguuuaaauaaauuga

SEQ ID NO: 69762 - RNA, 62 nt, Homo Sapiens
acucauucguuuaugaacacuuguuuguauggcucuggaauauguccaguaaagagauugau

SEQ ID NO: 69763 - RNA, 62 nt, Homo Sapiens
cucugaaguuauggcugggagcaaacucuguucucuggaaugaacuuuguauuuuugaagcg

SEQ ID NO: 69764 - RNA, 62 nt, Homo Sapiens
uucuuuauaauaaaagccuugggcagcugggacucuggaaucagcccaugggggcuggaggg

SEQ ID NO: 69765 - RNA, 62 nt, Homo Sapiens
gccucauauggugauaugccacuggaagccaccucuggaaaaaagacccccuccagaagcau

SEQ ID NO: 69766 - RNA, 62 nt, Homo Sapiens
gcugggcaugggucauggccucuccccauguccucuggaacacccuuugccagacagcucug

SEQ ID NO: 69767 - RNA, 62 nt, Homo Sapiens
ggagauaauacaauuccagauuuauuuuuacucucuggaaaaaguaaacaauggugauuuua

SEQ ID NO: 69768 - RNA, 62 nt, Homo Sapiens
ugugcguucaugcuuuuucgaaaaaacaaauucucuggaauuuaaaauugaucggauugauu

SEQ ID NO: 69769 - RNA, 62 nt, Homo Sapiens
gcaugcacacugaacucugcuuuagcuuuuaacucuggaagcuuuuuuguuucucagucugc

SEQ ID NO: 69770 - RNA, 62 nt, Homo Sapiens
agacugaggggcuuuguaaaaaauccuccacucucuggaaggcaaaauagccuauccuuaau

SEQ ID NO: 69771 - RNA, 62 nt, Homo Sapiens
cauauguauauaacaugugucuaacaugcccucucuggaaaguguauaguuccccguguuca

SEQ ID NO: 69772 - RNA, 62 nt, Homo Sapiens
ucugugguugugaaggcaaucauucagaucaccucuggaauccuggccauuggugcguguuu

SEQ ID NO: 69773 - RNA, 62 nt, Homo Sapiens
gagcacagggagcuucuguuguucugaucuaucucuggaaaaccagccauuccuccucccug

SEQ ID NO: 69774 - RNA, 62 nt, Homo Sapiens
ccgagccucaggccaaggaccccugaugcagacucuggaaucccuggcccaaaggccugucu

SEQ ID NO: 69775 - RNA, 62 nt, Homo Sapiens
caccugauggcuguucucccaccgggucugggcucuggaaggagccagaugcccccagaaag

SEQ ID NO: 69776 - RNA, 62 nt, Homo Sapiens
ucccgaaguaauaagugaggacgaaugcacugcucuggaacauaacccagugcuaacugggg

SEQ ID NO: 69777 - RNA, 62 nt, Homo Sapiens
aauugcuuuucucuuaccaguaugauuuguaacucuggaacacuauucuuacagaaugccuu

SEQ ID NO: 69778 - RNA, 62 nt, Homo Sapiens
cauuaagaugagcccuaauauguaagauuuuccucuggaauggaugugagaaauguaaauuu

SEQ ID NO: 69779 - RNA, 62 nt, Homo Sapiens
agaacuaaauuguuucuaaauguagauggucccucuggaaaagcaguuuucagcaggggugg

SEQ ID NO: 69780 - RNA, 62 nt, Homo Sapiens
augcagaaaaaaaagugcugcaguuuagauaccucuggaauuuuuccacagugucacagguu

SEQ ID NO: 69781 - RNA, 62 nt, Homo Sapiens
aaaacuugaaucaggauuuuaugccccacauacucuggaacuugaaguauaauauacuuaau

SEQ ID NO: 69782 - RNA, 62 nt, Homo Sapiens
caucuguaucuuaaauggccccaggcaucugccucuggaaaacuauugagccuugcauguac

SEQ ID NO: 69783 - RNA, 62 nt, Homo Sapiens
uggguggcagccccugguagaaugcuggauuucucuggaaucuagaagugccauauuuuagu

SEQ ID NO: 69784 - RNA, 62 nt, Homo Sapiens
uuuugcuucuuacgaacgcccuuuccucuccucucuggaaggcauccgucucuguccgcguc

SEQ ID NO: 69785 - RNA, 62 nt, Homo Sapiens
cuggcccaauuccucagaccucccucugcacccucuggaaccgcucagcuaccacuuccccu

SEQ ID NO: 69786 - RNA, 62 nt, Homo Sapiens
gaugagugaauguguucuggucucucuaucugcucuggaaugucuagauuuucuucugugcu

SEQ ID NO: 69787 - RNA, 62 nt, Homo Sapiens
caaaaucaauuuauuaagagaagggacuuuagcucuggaacucagcuucagaaauguuuuaa

SEQ ID NO: 69788 - RNA, 62 nt, Homo Sapiens
aaagaacugacuuuugauaguuucucagugaccucuggaauagaauuuuagcagaugguacu

SEQ ID NO: 69789 - RNA, 62 nt, Homo Sapiens
cuuggugggagugaauuugcgugacuguggagcucuggaagguuaaccaggagacuacuccu

SEQ ID NO: 69790 - RNA, 62 nt, Homo Sapiens
aucacuuagcuccucauaacaagucuaacuggcucuggaaagcugaaagggcugcacuggaa

SEQ ID NO: 69791 - RNA, 62 nt, Homo Sapiens
auccuucuccugaaguucagccacccugaggccucuggaaagcaaagggcuccucuccaguc

SEQ ID NO: 69792 - RNA, 62 nt, Homo Sapiens
aauccugcuaaaggagcaaagccuuguauuaccucuggaagacaacaaaaacaauuggcaac

SEQ ID NO: 69793 - RNA, 62 nt, Homo Sapiens
aaaucaguaucuagaugguuuuuaaauguauucucuggaaauuguuuuauguaaaauaaaug

SEQ ID NO: 69794 - RNA, 62 nt, Homo Sapiens
gcagauaugaagagcauuuuaagaggugcagccucuggaaguggaucaaacuagaacucaua

SEQ ID NO: 69795 - RNA, 59 nt, Homo Sapiens; identical to SEQ ID NO: 69272

SEQ ID NO: 69796 - RNA, 62 nt, Homo Sapiens
auauuuuguguccccaccuugauguuacaugacucuggaacaauaugaacuggauuuaagaa

SEQ ID NO: 69797 - RNA, 62 nt, Homo Sapiens
auucuuuuacuuaaccaggcuuauggcaugaucucuggaacaaauuuguaggaaaaaauuac

SEQ ID NO: 69798 - RNA, 62 nt, Homo Sapiens
gagggcaccaaguuuuccuuuuuucuaaauagcucuggaaccaggcuuguaauccauagcau

SEQ ID NO: 69799 - RNA, 62 nt, Homo Sapiens
uuguagaaaagguuuccucuagaacugaauuccucuggaauugagugauggacuucacaaca

SEQ ID NO: 69800 - RNA, 62 nt, Homo Sapiens
aauaucugggccuuggaaggaaggacacagggcucuggaaggaggaggcugcaugccugaag

SEQ ID NO: 69801 - RNA, 62 nt, Homo Sapiens
gacuccaguugccucagguugguucugcugugcucuggaaaguaacugcagccaccagguau

SEQ ID NO: 69802 - RNA, 62 nt, Homo Sapiens
auguuuuuagaggggcaaaaauauuuugcaagcucuggaauuguugaauguauucuuuuaua

SEQ ID NO: 69803 - RNA, 62 nt, Homo Sapiens
ggcuuucaugauuuggcaugaauagguauauccucuggaaaauauucuugagggacaaugcc

SEQ ID NO: 69804 - RNA, 62 nt, Homo Sapiens
uggaauguuaaguccaggccauaaaacacuggcucuggaaucggaagaaaagagcugggaca

SEQ ID NO: 69805 - RNA, 62 nt, Homo Sapiens
aaauguuccgggaucauguuucuaucaaaagccucuggaaauuuuauucaagauugugcucu

SEQ ID NO: 69806 - RNA, 62 nt, Homo Sapiens
aacaacuggcaggacuguugaaaaguauuugccucuggaaagaaggaaaaacuaagagaaug

SEQ ID NO: 69807 - RNA, 62 nt, Homo Sapiens
aggaaagcuaaagaagacuaaauaauuaaucucucuggaaaaugaccauuaagaaccagaaa

SEQ ID NO: 69808 - RNA, 62 nt, Homo Sapiens
aaaaaaaugaaaugaagaguugugauuugguccucuggaaaauuagaauguaauauguaaac

SEQ ID NO: 69809 - RNA, 62 nt, Homo Sapiens
ugaagagcuguuugguuugagcugugaggcagcucuggaacgaucuccugugaucugugcua

SEQ ID NO: 69810 - RNA, 62 nt, Homo Sapiens
accuugagauugaugcauuuguugaccugcaucucuggaagguucccaucucaagcauauaa

SEQ ID NO: 69811 - RNA, 62 nt, Homo Sapiens
ucagaucugugacuuaaucuuuucucuucaggcucuggaaaagucuuauccuuugcucuguu

SEQ ID NO: 69812 - RNA, 62 nt, Homo Sapiens
caugcauccuggccuugccagggcugucuuggcucuggaauuaauaagaaggcccuguugac

SEQ ID NO: 69813 - RNA, 62 nt, Homo Sapiens
cacaacuggugucagggcucucauucucacuucucuggaagccuuuuuacacuuauuuauua

SEQ ID NO: 69814 - RNA, 62 nt, Homo Sapiens
uuguggguggggcccagggacccugccugaagcucuggaaaccagccgccugcccgggagaa

SEQ ID NO: 69815 - RNA, 62 nt, Homo Sapiens
gaaggggcaggacucaucaggccaggcaggcccucuggaaggcaaacacccugcugcuggcu

SEQ ID NO: 69816 - RNA, 62 nt, Homo Sapiens
uuguagcagaguacauaacuacauaaugccaacucuggaaucaaauuuccuuguuugaaucc

SEQ ID NO: 69817 - RNA, 62 nt, Homo Sapiens
ucuguggaugccagcuuuggaaucagagccgccucuggaauaccugugcuuccagaguuagc

SEQ ID NO: 69818 - RNA, 62 nt, Homo Sapiens
ccaggcgcgguggcucaggccuguaaucccagcucuggaagcugaaggauagcuugagccca

SEQ ID NO: 69819 - RNA, 62 nt, Homo Sapiens
uuuccuaucauuuuauuaucaccaugcaaugccucuggaauaaaacauacaggagucugucu

SEQ ID NO: 69820 - RNA, 62 nt, Homo Sapiens
augugaccacauacguguuaggaggcugcaugcucuggaagccuggacucuaagcuggagcu

SEQ ID NO: 69821 - RNA, 62 nt, Homo Sapiens
auucuagauggaggaggcacugaugcuuguaacucuggaaagaggccuacacccaagggcua

SEQ ID NO: 69822 - RNA, 62 nt, Homo Sapiens
uaagaugauauuucagaagaguuggcugccuucucuggaaacaaggaaaacccaauaauucc

SEQ ID NO: 69823 - RNA, 62 nt, Homo Sapiens
cgccugaagccuuccucuggcuucacagaaugcucuggaacucuggggucuggucagggagu

SEQ ID NO: 69824 - RNA, 62 nt, Homo Sapiens
auucagggcccccucagcugucuccucccucccucuggaaaggaggguggggcucaggggcc

SEQ ID NO: 69825 - RNA, 62 nt, Homo Sapiens
gaaaaugccaucucuuuuuaguugaaggaaaacucuggaaguaggugccauuggucauucug

SEQ ID NO: 69826 - RNA, 62 nt, Homo Sapiens
agcucucucgacagcaaaugguuuccccucaccucuggaauuaaagaaggaacuccaaaguu

SEQ ID NO: 69827 - RNA, 62 nt, Homo Sapiens
auacaaaaccacuucagagaccaggguaucuccucuggaaggaucuaagagaagguaagaca

SEQ ID NO: 69828 - RNA, 62 nt, Homo Sapiens
acgugugaucuuugaaaaccuuggcuuuagcccucuggaaucagagcuuacccaccauagua

SEQ ID NO: 69829 - RNA, 62 nt, Homo Sapiens
uaccuucacggccgcugcugaaaaacccacaccucuggaagacauggagcagauugaaaugc

SEQ ID NO: 69830 - RNA, 62 nt, Homo Sapiens
auauaaaguuccuggcuuuggccagagagucccucuggaaccaugaguaaucaacaaaaucu

SEQ ID NO: 69831 - RNA, 62 nt, Homo Sapiens
cugauacaguaaauauaugaaacagccacacccucuggaaauugggaguagagagacacacu

SEQ ID NO: 69832 - RNA, 62 nt, Homo Sapiens
uccugauaugaccaagaaagaggagggacuuucucuggaauuagcgcuaaguaaacuugcca

SEQ ID NO: 69833 - RNA, 62 nt, Homo Sapiens
cuggaagcuguaugccacagaguggaggaagacucuggaaccaaagaaggaagaaaagaagg

SEQ ID NO: 69834 - RNA, 62 nt, Homo Sapiens
agggcccgaugcagcauuuucagcucugcacucucuggaauauuugaccacgaccuuggccc

SEQ ID NO: 69835 - RNA, 62 nt, Homo Sapiens
aucuuuagcuuugacuuugguucucuccuggccucuggaagcagugcuacuaaaacauuuuc

SEQ ID NO: 69836 - RNA, 62 nt, Homo Sapiens
uguggagacgccagcccugccccacuuguaugcucuggaaucccccacuuucccuuccccac

SEQ ID NO: 69837 - RNA, 62 nt, Homo Sapiens
aggguuuaagaugcuaggaugagaagcugcagcucuggaaaggagcagacaucuuccacgug

SEQ ID NO: 69838 - RNA, 62 nt, Homo Sapiens
gggaggggcccugucacuguagaugggggccucucuggaagauuccuccucucaaaccuggc

SEQ ID NO: 69839 - RNA, 62 nt, Homo Sapiens
ucgaagugaaacauuugucuggcuccaacccucucuggaaaacaccucccugccccaauccu

SEQ ID NO: 69840 - RNA, 62 nt, Homo Sapiens
uucuccauuucucccuaucacuaucccugacacucuggaaucuauauaauuauuuucaguua

SEQ ID NO: 69841 - RNA, 62 nt, Homo Sapiens
uguagguuagcucugcccagaaccauaagggacucuggaagccuggucauuuugccacacuu

SEQ ID NO: 69842 - RNA, 62 nt, Homo Sapiens
agaaaaccagagagucccauaucauugaauuccucuggaauuauugauagugaaaccauuag

SEQ ID NO: 69843 - RNA, 62 nt, Homo Sapiens
uuagcaaucuuauugcacacgaauuugcacaucucuggaagcugacaggacaucuuacaaga

SEQ ID NO: 69844 - RNA, 62 nt, Homo Sapiens
ccaccaggguagggucuccccgguucugugggcucuggaaggcuccacggguagugcgaccu

SEQ ID NO: 69845 - RNA, 62 nt, Homo Sapiens
cuucugaccucagacggcucugagccuuauuucucuggaagcggcuaagggacgguuggggg

SEQ ID NO: 69846 - RNA, 62 nt, Homo Sapiens
gauuguuuacaggauauuccaaaauaaaaggacucuggaagauuuucauugaggauaaauug

SEQ ID NO: 69847 - RNA, 62 nt, Homo Sapiens
uccuacaggggcuccucugugggugaggggcccucuggaauggcaucccaugagcuuguggc

SEQ ID NO: 69848 - RNA, 62 nt, Homo Sapiens
uuuauuuaaugauguaauuuauuguugcguuccucuggaagcugugacuggaauaaaccccc

SEQ ID NO: 69849 - RNA, 62 nt, Homo Sapiens
agaggcuggugcuguggccagggugagagcugcucuggaaaaugugacccagauccucacaa

SEQ ID NO: 69850 - RNA, 62 nt, Homo Sapiens
cugauuccaauauuauuacuuauaacacugaccucuggaaaauauuuuguucacaagaaaua

SEQ ID NO: 69851 - RNA, 62 nt, Homo Sapiens
uauaauuucuaccuauugggccuuguucuguucucuggaacuaaacagaacaaccauuuacc

SEQ ID NO: 69852 - RNA, 62 nt, Homo Sapiens
ucaaggcaggcagcccaggcuccaggaugcuucucuggaaccguagggcccgagcuucagcu

SEQ ID NO: 69853 - RNA, 62 nt, Homo Sapiens
ucaggcugagaaauccuuuccucauccucggucucuggaaaguucuguugccgccuaacuuu

SEQ ID NO: 69854 - RNA, 62 nt, Homo Sapiens
cccccaccuuucucgcuggacaggaacagagacucuggaagcuaacgggggugcggcaggag

SEQ ID NO: 69855 - RNA, 62 nt, Homo Sapiens
ggcuggcuggugcccuauuuccccaggugucccucuggaaggaccccuugggcuaggucuga

SEQ ID NO: 69856 - RNA, 62 nt, Homo Sapiens
agcauggccuugugaacuuaagggcauucacucucuggaaguucagagacccauucuaaaca

SEQ ID NO: 69857 - RNA, 62 nt, Homo Sapiens
cgguaauaagagcuggcaagcagguugacucucucuggaauguuuaggggacaaacuccauc

SEQ ID NO: 69858 - RNA, 62 nt, Homo Sapiens
ugcccucuccucaccuccuuuucucucagugacucuggaaccugaaugcagcuuacaagaca

SEQ ID NO: 69859 - RNA, 62 nt, Homo Sapiens
ggagcuagcagaaaauaacucaaaguugaagacucuggaagauuuugcuuuaaccuaacucg

SEQ ID NO: 69860 - RNA, 62 nt, Homo Sapiens
ugccugcuggcucucccccagccccacauccccucuggaagagaauguaaaauaaaccugga

SEQ ID NO: 69861 - RNA, 62 nt, Homo Sapiens
ucuugaacccuacuuucuggaaguggaguugacucuggaaguuuucuagcaacugaacaaaa

SEQ ID NO: 69862 - RNA, 62 nt, Homo Sapiens
ggccuucaguaagaccacaagucugcaggaaacucuggaaucaggaagaaaagcuauguuca

SEQ ID NO: 69863 - RNA, 62 nt, Homo Sapiens
uacaaacuccuacuacgucgucuaaauugcugcucuggaauaaggugauuucugcccccaga

SEQ ID NO: 69864 - RNA, 62 nt, Homo Sapiens
gaccuacccaaaccuuuuguucuguaaaacugcucuggaaauaccgggaagcccaguuuucu

SEQ ID NO: 69865 - RNA, 62 nt, Homo Sapiens
uccuguuaaauuuacaacacuaacgauguagacucuggaaaugccuaauaagucaaagaaga

SEQ ID NO: 69866 - RNA, 62 nt, Homo Sapiens
gcucaaagaggaauugggaaaaauaaauugaacucuggaaucuucucucucaaguccuaaaa

SEQ ID NO: 69867 - RNA, 62 nt, Homo Sapiens
aggcucuggacagcagaagccagauucugccucucuggaaagucacuauucuuggaccaugc

SEQ ID NO: 69868 - RNA, 62 nt, Homo Sapiens
uuuuucccuccccagaaucaggccggcggcuacucuggaauggucccuaccugcuucacguu

SEQ ID NO: 69869 - RNA, 62 nt, Homo Sapiens
uuuguuucuucuguacccggaccucccugggccucuggaagcugcacgacacagggcuggug

SEQ ID NO: 69870 - RNA, 62 nt, Homo Sapiens
aaauauaguuauuaaaggauguauuuauuguucucuggaaauauauacugcuugcaauuucu

SEQ ID NO: 69871 - RNA, 62 nt, Homo Sapiens
cacuaugguuuaccuugaguaggggguguaaacucuggaaucgucauaggggcagcagucuc

SEQ ID NO: 69872 - RNA, 62 nt, Homo Sapiens
aauagucaugcuucuuuauugugggucacccacucuggaagaacuuaggaccauuugagcuu

SEQ ID NO: 69873 - RNA, 62 nt, Homo Sapiens
uuuagaaucaggcuagaauaugccagauuuagcucuggaauggaaauuaaaaacauaacuau

SEQ ID NO: 69874 - RNA, 54 nt, Homo Sapiens; identical to SEQ ID NO: 69351

SEQ ID NO: 69875 - RNA, 62 nt, Homo Sapiens
auccucuguuacccgcagauucagcagaaugacucuggaacccacuucaguuguggccucau

SEQ ID NO: 69876 - RNA, 62 nt, Homo Sapiens
ggacugacuguacacucccugaucagccagcacucuggaagcuuugggaucccaggaaccau

SEQ ID NO: 69877 - RNA, 62 nt, Homo Sapiens
acucagacuucuacuuuaccaaguaccacacacucuggaaugcuuuaguuuccuuuuccccu

SEQ ID NO: 69878 - RNA, 62 nt, Homo Sapiens
agagcacacuguccccaccgccuccccuuucucucuggaaaguugaaguaucuccaaaggcc

SEQ ID NO: 69879 - RNA, 62 nt, Homo Sapiens
uugauuuuuguuucuuuuggccugauuuguaucucuggaaugcauuuauucuugaaauauuu

SEQ ID NO: 69880 - RNA, 62 nt, Homo Sapiens
gccugggaucccuuccuggagaggcaggcugucucuggaaaaagccuccauugcccacccgc

SEQ ID NO: 69881 - RNA, 62 nt, Homo Sapiens
cguuuggcacagcuuuggccacagccaggccccucuggaauuguccuuauuaaaccaguuuc

SEQ ID NO: 69882 - RNA, 62 nt, Homo Sapiens
aggccaggcugcacaccuggugggagaacacacucuggaauucucuauucuccuggucgggg

SEQ ID NO: 69883 - RNA, 62 nt, Homo Sapiens
aaagggacucuuccauuuugcaaagaacugcacucuggaauuggaccaguugcccucauuuc

SEQ ID NO: 69884 - RNA, 62 nt, Homo Sapiens
cuauggucuuacaagcaguacagcuacagagccucuggaacacuucagauucccaaagaagc

SEQ ID NO: 69885 - RNA, 62 nt, Homo Sapiens
ccuggagacccucgcccaacguaaacgacacucucuggaagcgcgcauggcaagucacaugc

SEQ ID NO: 69886 - RNA, 62 nt, Homo Sapiens
gcugguucaaggcuguuuggacuaggggcagucucuggaaggccugcacugcccagugggcc

SEQ ID NO: 69887 - RNA, 62 nt, Homo Sapiens
ugggucagaaccuucucucuugcaguuuggggcucuggaauuagaugucacaggauuaaaug

SEQ ID NO: 69888 - RNA, 62 nt, Homo Sapiens
ccccuucccuggcagguggcggaaacccaccucucuggaaggauuaggcacacagauccccu

SEQ ID NO: 69889 - RNA, 62 nt, Homo Sapiens
uuggcucuucuuuguuuugugcucucaggucccucuggaacugugcaggaaaccugaaccca

SEQ ID NO: 69890 - RNA, 62 nt, Homo Sapiens
aucuacaacuaauaggacacucuacauaaguucucuggaaauaaaauuuguaauguguugcu

SEQ ID NO: 69891 - RNA, 62 nt, Homo Sapiens
ucaugugaugaagcugacauuuggggucagaucucuggaacauaguaaaacuugagaagcuu

SEQ ID NO: 69892 - RNA, 62 nt, Homo Sapiens
agcaagaggaaccaguagcugaggacagaccucucuggaagcgggcauccuccuugaaagag

SEQ ID NO: 69893 - RNA, 62 nt, Homo Sapiens
gacccuuugcaagucuuuaccagggcucgagccucuggaacuugucugugaaagucagaaca

SEQ ID NO: 69894 - RNA, 62 nt, Homo Sapiens
aucccccguucugggcaagggccucagccuuccucuggaagccuggcuuccuuaccagaaaa

SEQ ID NO: 69895 - RNA, 62 nt, Homo Sapiens
uggguggggcccugcaccgucauuucuccugccucuggaaggggcagcuggggcugccaucc

SEQ ID NO: 69896 - RNA, 62 nt, Homo Sapiens
caucccuugccgcugccaugcgugguggcugucucuggaaaguggggugauccucccuccug

SEQ ID NO: 69897 - RNA, 62 nt, Homo Sapiens
agaggacuagcugacuuuuggugccuucugcucucuggaaccuggaccacucgcugccuuag

SEQ ID NO: 69898 - RNA, 54 nt, Homo Sapiens; identical to SEQ ID NO: 69375

SEQ ID NO: 69899 - RNA, 62 nt, Homo Sapiens
uucaccauagggguuauaguuggcuugugcuacucuggaaucauuuuacuguuuguuuuuau

SEQ ID NO: 69900 - RNA, 62 nt, Homo Sapiens
cauuuucccacagacuuccuggccuccugugacucuggaaagcaaaggauuggcuguguauu

SEQ ID NO: 69901 - RNA, 62 nt, Homo Sapiens
gagggugcugcccgcucaaugcccagcagcagcucuggaaggcagugcucagccccaucacc

SEQ ID NO: 69902 - RNA, 62 nt, Homo Sapiens
gagaaaucuaaaaaacgaaaagucuccaaagucucuggaauuugaaacacuuugcauaacgu

SEQ ID NO: 69903 - RNA, 62 nt, Homo Sapiens
gggccuccccuaagaggcuuuccccgaggcagcucuggaaucugugcccaccuggggccugg

SEQ ID NO: 69904 - RNA, 62 nt, Homo Sapiens
aaugcuaguauggaggcugugaaguccccaagcucuggaagcccacacuauuuguuggugau

SEQ ID NO: 69905 - RNA, 62 nt, Homo Sapiens
aucaggaauauugugguaagcugggaguaucacucuggaagaaaguaacaucuccagaugag

SEQ ID NO: 69906 - RNA, 62 nt, Homo Sapiens
ccucauuguggaaacaagccaaaccaaaugaacucuggaaaaccuaaaacaaauguacauuu

SEQ ID NO: 69907 - RNA, 62 nt, Homo Sapiens
caagccugugcucagguugccuugaauguggacucuggaagagccaggggcccagaaugccg

SEQ ID NO: 69908 - RNA, 62 nt, Homo Sapiens
aaucagcagucuucaaucgaucaauaauucugcucuggaagagaaggaacagggagcagaga

SEQ ID NO: 69909 - RNA, 62 nt, Homo Sapiens
ccucaccucugcuccugucuucaucaccuucucucuggaagggaagaggaguuggaaggucu

SEQ ID NO: 69910 - RNA, 62 nt, Homo Sapiens
ugcagagcgaguggaugcacuucccagcucaucucuggaagccuuugcuacucaagcuccuc

SEQ ID NO: 69911 - RNA, 62 nt, Homo Sapiens
acuccgggaucgugcagugacgucgcaagccucucuggaaagagugugcugccccuccccau

SEQ ID NO: 69912 - RNA, 62 nt, Homo Sapiens
auuaaagaauuccugggggcagccagagaacucucuggaacccagaugcagcagcagucuuu

SEQ ID NO: 69913 - RNA, 62 nt, Homo Sapiens
gcaugcauuuguaggugcacacauuuccaaagcucuggaaaguuaacucauuauuuaauuga

SEQ ID NO: 69914 - RNA, 62 nt, Homo Sapiens
ugaggugagaggaucacuuguggucccagcuacucuggaagcgacauggugggaugggcaug

SEQ ID NO: 69915 - RNA, 58 nt, Homo Sapiens; identical to SEQ ID NO: 69392

SEQ ID NO: 69916 - RNA, 62 nt, Homo Sapiens
cccaagggaagaggcaagguagcaguagugggcucuggaaugggucuggauagauagcuuac

SEQ ID NO: 69917 - RNA, 62 nt, Homo Sapiens
cugggaaacuccuggaagacgauuugccugcacucuggaagggacauccuggagggagacug

SEQ ID NO: 69918 - RNA, 62 nt, Homo Sapiens
uguauuucuugaauuagaauuccuaaaggauccucuggaagcaugugcaauaagaacauaga

SEQ ID NO: 69919 - RNA, 62 nt, Homo Sapiens
gucuggaaaugucuuccuggagagucagccagcucuggaaugcaaaacuuguuuccacauua

SEQ ID NO: 69920 - RNA, 62 nt, Homo Sapiens
cuuuggggcugauuugucucuuucauuuacagcucuggaacaugcuucuuaaucaauccaaa

SEQ ID NO: 69921 - RNA, 62 nt, Homo Sapiens
ccacacuuguggggacuuaggcugggccgcuccucuggaagccucugauucagcuggggcua

SEQ ID NO: 69922 - RNA, 62 nt, Homo Sapiens
gccucuucuuguggcuuuuauuggaacaaucucucuggaagucauuguguuuguuuuucaug

SEQ ID NO: 69923 - RNA, 62 nt, Homo Sapiens
ugaagcagcaagaucacuugcaaucccaacuacucuggaagccgugaucuaccacaccuggc

SEQ ID NO: 69924 - RNA, 62 nt, Homo Sapiens
uguggggauggagaggauggauccuugcuuuacucuggaaagcacaaugccuggguguccuc

SEQ ID NO: 69925 - RNA, 62 nt, Homo Sapiens
ugcuccuugaagaaucucuccucucucucucucucuggaaagacccaacuuucucacugcug

SEQ ID NO: 69926 - RNA, 62 nt, Homo Sapiens
caagcaaugcuguucuguaaauuuauugaaaccucuggaacauuucaccuuuagagauggag

SEQ ID NO: 69927 - RNA, 62 nt, Homo Sapiens
ugugagauugagagaacuaugaccugcagcaacucuggaaaccuggccugacagacaagcag

SEQ ID NO: 69928 - RNA, 62 nt, Homo Sapiens
guauucucacucccuugaucucaagggcguaacucuggaagcacagcuugacuacacgucau

SEQ ID NO: 69929 - RNA, 62 nt, Homo Sapiens
uugggcaagggacaaggugcuagaauccuaagcucuggaaauauuucaugacacugguguau

SEQ ID NO: 69930 - RNA, 62 nt, Homo Sapiens
acugccccugauggaacucauggagaaugaagcucuggaaauccucaccaaagcccuccgga

SEQ ID NO: 69931 - RNA, 62 nt, Homo Sapiens
gccccucucugaagagacuguccuugggccuccucuggaagcagcacccccagaggacaggg

SEQ ID NO: 69932 - RNA, 62 nt, Homo Sapiens
ggcaugggcuaagucacucugcccuucggagccucuggaagcuuagggcacauugguuccag

SEQ ID NO: 69933 - RNA, 62 nt, Homo Sapiens
ccuuauauaaaguaccagguuuuuuccccauucucuggaaauguuuguccucccuuaauuuu

SEQ ID NO: 69934 - RNA, 62 nt, Homo Sapiens
ccauuauggauguugaaauggacagggaaggacucuggaagucucuuccuccuccuccucuu

SEQ ID NO: 69935 - RNA, 62 nt, Homo Sapiens
uaagucccucuucuugccguuggccuuucugacucuggaaugaccacuguucauugaaaaau

SEQ ID NO: 69936 - RNA, 62 nt, Homo Sapiens
gcaugaggaaauagaagauucaggggccugagcucuggaagcugcaagcaaaagggauggga

SEQ ID NO: 69937 - RNA, 62 nt, Homo Sapiens
aaccauccaguaaaggucuuuccgauaccccacucuggaaggcuggccgcagugugugugua

SEQ ID NO: 69938 - RNA, 62 nt, Homo Sapiens
gccuuacucacaggcuuccauaagugcagugucucuggaacuagugccuaugaaacaaacac

SEQ ID NO: 69939 - RNA, 62 nt, Homo Sapiens
acaugugucaagcugcuuggcuucagagguggcucuggaaugacgaaggccucugaaggacc

SEQ ID NO: 69940 - RNA, 62 nt, Homo Sapiens
agggggaggccuggaaggaguggguccccauccucuggaaccguucuucuaguucgaggccu

SEQ ID NO: 69941 - RNA, 62 nt, Homo Sapiens
auguguuaaauaucuguauagacuggagccaccucuggaauaaccaucucucaagccccaag

SEQ ID NO: 69942 - RNA, 60 nt, Homo Sapiens; identical to SEQ ID NO: 69419

SEQ ID NO: 69943 - RNA, 62 nt, Homo Sapiens
guuucaguuaagucauuuuacuguugauggcacucuggaauuuguuuccuuuugcgugaucu

SEQ ID NO: 69944 - RNA, 62 nt, Homo Sapiens
cugcugugaauuuguauuccuuggccuggggccucuggaagugauggaaacuuucuaccugc

SEQ ID NO: 69945 - RNA, 62 nt, Homo Sapiens
cccaucuguuucacugucucaggagcagggaccucuggaauucuuuacuguuccucugggaa

SEQ ID NO: 69946 - RNA, 62 nt, Homo Sapiens
aaauguaguuuucuacacucuagauuguacuucucuggaaccuuuacaucucagguaaugug

SEQ ID NO: 69947 - RNA, 62 nt, Homo Sapiens
cuaauggcaggcaaagggagaaggaugccauccucuggaaucuucugugaaagcaaauacua

SEQ ID NO: 69948 - RNA, 62 nt, Homo Sapiens
ugaggcggcugcuugaaccuucagguggaagccucuggaaccagagaacugaagugcagcca

SEQ ID NO: 69949 - RNA, 62 nt, Homo Sapiens
uguccucguguccaccuggcauaaaaccaagccucuggaaucaggacaaagaaaacugcaca

SEQ ID NO: 69950 - RNA, 62 nt, Homo Sapiens
augggccagcuugcagggguggccuaugggggcucuggaaggcucccgucucaacagcccca

SEQ ID NO: 69951 - RNA, 62 nt, Homo Sapiens
ggccacaguggcucacgccuguaaucccagaacucuggaaggcugaggcaggcggaucaccu

SEQ ID NO: 69952 - RNA, 62 nt, Homo Sapiens
augggacaguuuuccauauccuugcuguggagcucuggaacacucucuaaauuucccucuau

SEQ ID NO: 69953 - RNA, 62 nt, Homo Sapiens
ucucccuccagcaugggccugugucucaggcucucuggaagguggcccugccccggacccuc

SEQ ID NO: 69954 - RNA, 62 nt, Homo Sapiens
ucuuucccccacccugucucuuccuuguccuucucuggaaaaugccaaaauacacgauguga

SEQ ID NO: 69955 - RNA, 62 nt, Homo Sapiens
ugauuauagcaucuccuucugaguguuugggacucuggaaucugagacccauguucacauug

SEQ ID NO: 69956 - RNA, 62 nt, Homo Sapiens
caauggcaaaaauauuuccaguugcacuguaucucuggaagugaugcaugaauucgauugga

SEQ ID NO: 69957 - RNA, 62 nt, Homo Sapiens
gucaaccagagaacagcuccccuagacauggccucuggaaaaaggaaaucuuugguggccaa

SEQ ID NO: 69958 - RNA, 62 nt, Homo Sapiens
ccauuacuaauagaaacacagccuuuccaauccucuggaacauauucugucuggguuuuuaa

SEQ ID NO: 69959 - RNA, 62 nt, Homo Sapiens
gguacaaaauccuacuuuucagagccuuccagcucuggaaccucaaacauccucaugcucuc

SEQ ID NO: 69960 - RNA, 62 nt, Homo Sapiens
aaacuauugaugaauuguuuccugggucacaucucuggaaaauagauguuacaguucuuaaa

SEQ ID NO: 69961 - RNA, 62 nt, Homo Sapiens
gaaggcaucugcaacuccaaguccaugcagaacucuggaaggccaaguucaucgcagcaugu

SEQ ID NO: 69962 - RNA, 62 nt, Homo Sapiens
cugucuuuauuuccucaaagucaagcagcuuucucuggaaaaugaaugcuaauuagugugaa

SEQ ID NO: 69963 - RNA, 62 nt, Homo Sapiens
ccagcccuagcccuuuagccuuucacccugugcucuggaaaggcuaccaaauacuggccaag

SEQ ID NO: 69964 - RNA, 62 nt, Homo Sapiens
cucuacaguauacuugugagacuucaugaagccucuggaaaagcaauaaugucaccacacac

SEQ ID NO: 69965 - RNA, 62 nt, Homo Sapiens
ccuuuguaaauagguguguuucgaaaagugggcucuggaauccucggggucuuuccucagcc

SEQ ID NO: 69966 - RNA, 62 nt, Homo Sapiens
gcgccaggaaaagcuuccguguucgcaugguucucuggaaacuucuggugagggacauugua

SEQ ID NO: 69967 - RNA, 59 nt, Homo Sapiens; identical to SEQ ID NO: 69444

SEQ ID NO: 69968 - RNA, 62 nt, Homo Sapiens
acauuuuuaucuagaugaaagaggcuaguuuccucuggaaccuaagcucaucccucccgucc

SEQ ID NO: 69969 - RNA, 62 nt, Homo Sapiens
uuauuccagcaguuguuccaaacuaccuuccacucuggaaccauguguguucucagugaaau

SEQ ID NO: 69970 - RNA, 62 nt, Homo Sapiens
gcaaauagaauaggaggggauacuaaugaucacucuggaaauugaaacccagaucgcugugu

SEQ ID NO: 69971 - RNA, 62 nt, Homo Sapiens
uucccucuaccacugggcacuuccucagacgacucuggaagcggguagucccucucaccugc

SEQ ID NO: 69972 - RNA, 52 nt, Homo Sapiens; identical to SEQ ID NO: 69449

SEQ ID NO: 69973 - RNA, 62 nt, Homo Sapiens
uagacuguauauguuuaauacugcaguuccuccucuggaaugcugugguguuauagugguaa

SEQ ID NO: 69974 - RNA, 62 nt, Homo Sapiens
auuuccuccuagcccuuccagaugccugugcccucuggaaaaggauaugacaguccagcauc

SEQ ID NO: 69975 - RNA, 62 nt, Homo Sapiens
ucuuauguaugcaagcucccucauguuuucuccucuggaacuauguugcauuuaacugaaug

SEQ ID NO: 69976 - RNA, 62 nt, Homo Sapiens
ggacuccuucucccucccuaccaucccgaggccucuggaauguccaccccacuucugcaaac

SEQ ID NO: 69977 - RNA, 62 nt, Homo Sapiens
ugaacagguuuauaaaacaugagucuuugucucucuggaauaaacuuugcacuuguaguuuu

SEQ ID NO: 69978 - RNA, 62 nt, Homo Sapiens
acauuaaggaugguggggguuucauuagagaccucuggaaauaguuuucuaagcucaggguc

SEQ ID NO: 69979 - RNA, 62 nt, Homo Sapiens
ggagauuuauaaaguuuugauauuuuucccuacucuggaauuugaacuuucuucauguuugc

SEQ ID NO: 69980 - RNA, 62 nt, Homo Sapiens
uauugacagcaaugguuucccgggcccagaaacucuggaaagauuuuguccagaagaauuca

SEQ ID NO: 69981 - RNA, 62 nt, Homo Sapiens
agugcuugaccuccuguauucugaauggugaacucuggaagcagggauugugucuggcucuu

SEQ ID NO: 69982 - RNA, 62 nt, Homo Sapiens
ugcccuccuuaauuugggaagguuuguguuuucucuggaaugguacaugucuuccauguauc

SEQ ID NO: 69983 - RNA, 62 nt, Homo Sapiens
agucuucuguuugaaaggcugugaaucuaaaacucuggaagauauuuucuaagcagccagca

SEQ ID NO: 69984 - RNA, 62 nt, Homo Sapiens
uuuaccacauguaacagauuuuccuacuuggucucuggaaguuuauuguuuuuauuccacac

SEQ ID NO: 69985 - RNA, 62 nt, Homo Sapiens
cauucuuaaugguaagugucaaauuuuuagaucucuggaacauaguguuaucuggaagguuu

SEQ ID NO: 69986 - RNA, 62 nt, Homo Sapiens
gggugguaggagguuuuuuuuuuuacccagggcucuggaaggacaccaaacuguucugcuug

SEQ ID NO: 69987 - RNA, 62 nt, Homo Sapiens
ucuuguccaagccuuuaagacagcacugccuucucuggaacuaaaauuacaauugaaguaaa

SEQ ID NO: 69988 - RNA, 62 nt, Homo Sapiens
uuuuggcagaacuaguugauuaguuuagggaucucuggaaaugucaguuuccugaagagcca

SEQ ID NO: 69989 - RNA, 62 nt, Homo Sapiens
guccuucaaaacuauaugguugccuagauucucucuggaaacugacuuugucaaauaaauag

SEQ ID NO: 69990 - RNA, 62 nt, Homo Sapiens
agagcauccgaccucuuggagcaaguuucugccucuggaaagggggcgggcccuuuucacaa

SEQ ID NO: 69991 - RNA, 62 nt, Homo Sapiens
cuggcugugaaaagucagguacuaccacccaccucuggaagaccuaggguggaggucacugc

SEQ ID NO: 69992 - RNA, 62 nt, Homo Sapiens
cuaucagaagacaaaguuugcucuacaggaaucucuggaaaauaggcucucccugcucccuu

SEQ ID NO: 69993 - RNA, 62 nt, Homo Sapiens
uguggaguagcuguaauaaagucauuguaucacucuggaaaaugauaguuuuuaacucuaug

SEQ ID NO: 69994 - RNA, 62 nt, Homo Sapiens
aaaaaaaaaaaugaaaaaaacaucugguugaacucuggaaaaggcuaaaaagauuacagcgu

SEQ ID NO: 69995 - RNA, 62 nt, Homo Sapiens
ucuugcugauaggaaugauacucaccugguugcucuggaagcuucccaaggcccuaaggucc

SEQ ID NO: 69996 - RNA, 62 nt, Homo Sapiens
gauauauugguugguucauacuucccgccucccucuggaaugugaccuguacuuauuuuucu

SEQ ID NO: 69997 - RNA, 62 nt, Homo Sapiens
caaacuaccaauuucucguuugcccauguccccucuggaagaacugagcccaccagccacag

SEQ ID NO: 69998 - RNA, 62 nt, Homo Sapiens
uuauuuauuuagcauagacauuaaagauaacucucuggaaaaugacuugacuaaggcucuca

SEQ ID NO: 69999 - RNA, 62 nt, Homo Sapiens
agcaccuuucuuccgucuguucacucugcggccucuggaaucccagcucuucucucucagaa

SEQ ID NO: 70000 - RNA, 62 nt, Homo Sapiens
uggaaccuggaccccagccuuggugggggagccucuggaaugcauggggcggguccuagcug

SEQ ID NO: 70001 - RNA, 62 nt, Homo Sapiens
cguagcaugauugcgcucauggauacagauggcucuggaaagcucaaccugcaggaguucca

SEQ ID NO: 70002 - RNA, 62 nt, Homo Sapiens
cuggaaagcucaaccugcaggaguuccaccaccucuggaacaagauuaaggccuggcaggug

SEQ ID NO: 70003 - RNA, 62 nt, Homo Sapiens
uguccccaccacuccuggagucccaaugacuucucuggaaagacaaagagguuaucacaaaa

SEQ ID NO: 70004 - RNA, 62 nt, Homo Sapiens
auuguuuuauaaagaacgugauuuccagugaucucuggaagcgcuaaagcuaaaauuucugu

SEQ ID NO: 70005 - RNA, 62 nt, Homo Sapiens
agaggcauacacuuuuuacagauggacaaaagcucuggaacccuguggcuucaaauccuuug

SEQ ID NO: 70006 - RNA, 61 nt, Homo Sapiens
gaguagauaaaacagcugcaauauaaacaguccucuggaauaaugguuugugguggaugcu

SEQ ID NO: 70007 - RNA, 62 nt, Homo Sapiens
agaaaugcagaccugugggcucuaccacaggccucuggaaucagaaucuucaggguggggcc

SEQ ID NO: 70008 - RNA, 62 nt, Homo Sapiens
ccuaggcuuacaggccauccugagccaggggccucuggaaauucucuuccugaugguccuuu

SEQ ID NO: 70009 - RNA, 62 nt, Homo Sapiens
gggggcauuuugcuggggggagaugaggcagccucuggaauggcucagggauucagcccucc

SEQ ID NO: 70010 - RNA, 62 nt, Homo Sapiens
agccacccaggaaggaagcacagagcugggggcucuggaaacgcccugugucucuggcuaca

SEQ ID NO: 70011 - RNA, 62 nt, Homo Sapiens
ccuccggacucuggcacgcuccagcagcccuccucuggaagcugcguccccucacccccugu

SEQ ID NO: 70012 - RNA, 62 nt, Homo Sapiens
ggcagggaguggggauugguccuacuuucuuucucuggaaaggaaagccuccaagacuccau

SEQ ID NO: 70013 - RNA, 62 nt, Homo Sapiens
agacuccgagaguuauaacucauguaaagauccucuggaaaacugacugagacaauucuguc

SEQ ID NO: 70014 - RNA, 62 nt, Homo Sapiens
uggauuugcuucuuacccuguaaaacuaaaaucucuggaaaacugccuggcugauucuuccu

SEQ ID NO: 70015 - RNA, 62 nt, Homo Sapiens
cagcaggaucacagcugccucagaagggcaugcucuggaaccccuccagcuuccagcuaggc

SEQ ID NO: 70016 - RNA, 62 nt, Homo Sapiens
gcugauuuuauggacugaggccuggaaccuuccucuggaaguucucgaugugcacugugaug

SEQ ID NO: 70017 - RNA, 62 nt, Homo Sapiens
acacuagugugagccuucaguaaaacugucaccucuggaaauagcgucuccaauaugacuau

SEQ ID NO: 70018 - RNA, 62 nt, Homo Sapiens
cacugaauaaagcacgugcauugagggguccccucuggaauggaagggcuuggccagcgcug

SEQ ID NO: 70019 - RNA, 62 nt, Homo Sapiens
acuccagcccagcuccaccucgaugaagccuucucuggaaccccaucagccuugaagggccu

SEQ ID NO: 70020 - RNA, 62 nt, Homo Sapiens
cccugggcccaguaccuagccucugaagaacucucuggaagcguccuuaggccucugagaag

SEQ ID NO: 70021 - RNA, 62 nt, Homo Sapiens
uuggcgggcaucgccgaccccgaccugacuuacucuggaaucaucagucacaacucaccuag

SEQ ID NO: 70022 - RNA, 62 nt, Homo Sapiens
cagucccauuuccuuccuggccagauguggugcucuggaaucgagacggccaguucuggcgg

SEQ ID NO: 70023 - RNA, 62 nt, Homo Sapiens
gcucacaaugagugugacauacuuccucuucucucuggaacguugggacauacuugcccccu

SEQ ID NO: 70024 - RNA, 62 nt, Homo Sapiens
agucacuuuuuuucccugaguuuaaauguaugcucuggaauguagaugauguagcuguacau

SEQ ID NO: 70025 - RNA, 62 nt, Homo Sapiens
gaggccgggggagcagacagggccggugcucccucuggaagcuugggugaccggggcccugg

SEQ ID NO: 70026 - RNA, 62 nt, Homo Sapiens
accucggccagcuggacccacaugagggccaccucuggaaccuucuucgaggcccuggccag

SEQ ID NO: 70027 - RNA, 62 nt, Homo Sapiens
ggcaccucucugucccuuccgugucucacugucucuggaagcuucagcccauguguguccug

SEQ ID NO: 70028 - RNA, 62 nt, Homo Sapiens
ucucuguguggauagacuccccagcguuuuuccucuggaaaugcccacagggcuugccgcgu

SEQ ID NO: 70029 - RNA, 62 nt, Homo Sapiens
acuccccacaguuuuaggaucuaaaugauugccucuggaacuauucuucuagacuaucccac

SEQ ID NO: 70030 - RNA, 62 nt, Homo Sapiens
aucuacaucagcugaaccugaaacucaggggacucuggaacaccauggacccugggggcugu

SEQ ID NO: 70031 - RNA, 62 nt, Homo Sapiens
ccagagccccaggugccuggccuggccuagaccucuggaauugagauuaaacaauuuggagu

SEQ ID NO: 70032 - RNA, 62 nt, Homo Sapiens
gccugcugugacugaccuacaguggacuuucucucuggaauggaaccuucuuaggccuccug

SEQ ID NO: 70033 - RNA, 62 nt, Homo Sapiens
acaccagcuugggcaacguaagaagaccgugucucuggaauuuuuuuuuuuuuuuaauuagc

SEQ ID NO: 70034 - RNA, 62 nt, Homo Sapiens
cucuugggaacgcuggagagcuugugcacagccucuggaaggaaaggcagcgcugacuucgu

SEQ ID NO: 70035 - RNA, 62 nt, Homo Sapiens
aggggcuccccgaccugcccacuguacuggaacucuggaaagcacagacugacacguuuccc

SEQ ID NO: 70036 - RNA, 62 nt, Homo Sapiens
aaaagagccuugucugaccuccaggccgcugucucuggaaguccuacauucuucccgaggcu

SEQ ID NO: 70037 - RNA, 62 nt, Homo Sapiens
cacgucuuagcuucugaacaugccuggccuggcucuggaagucacagucaggggccuccaca

SEQ ID NO: 70038 - RNA, 62 nt, Homo Sapiens
auugcugguccugaagcuuuugcaaauaaaggcucuggaagcuagucuggaaaguugggauu

SEQ ID NO: 70039 - RNA, 62 nt, Homo Sapiens
aaccucuuucuaauacccucagaccacucauccucuggaaucguggggggcuauagccucag

SEQ ID NO: 70040 - RNA, 62 nt, Homo Sapiens
gacagggaaguugaguuagcagcucauggaaccucuggaaagcaguacauguuuaaaagaag

SEQ ID NO: 70041 - RNA, 62 nt, Homo Sapiens
ggccacacacccgagagcuggaagugguaggacucuggaagaaauuacuuggaaaacagugg

SEQ ID NO: 70042 - RNA, 62 nt, Homo Sapiens
ggucgauggaacuggccacgcacaggcucuggcucuggaaggagggaugaugagugggcguu

SEQ ID NO: 70043 - RNA, 62 nt, Homo Sapiens
ugcuuguuuguuuuuagauuccugagagaugucucuggaagggaaaguuuugagaacuaaug

SEQ ID NO: 70044 - RNA, 62 nt, Homo Sapiens
agacuuaaauguaaaaccccaaacuauaaaaacucuggaagauaaccuaggcaauaccauuc

SEQ ID NO: 70045 - RNA, 62 nt, Homo Sapiens
uggccuggccugaccaaugagaggccagaacacucuggaacaucggaagaggaguucuuugc

SEQ ID NO: 70046 - RNA, 62 nt, Homo Sapiens
ugggagacggcuuuguccuggggacacuuucccucuggaaucucaagacgacguggcacaca

SEQ ID NO: 70047 - RNA, 62 nt, Homo Sapiens
ugagagcuggaggacaauauccagggacauggcucuggaaaauaacuuuuuuuuuuuuaaga

SEQ ID NO: 70048 - RNA, 62 nt, Homo Sapiens
auagggaggugaguccucucuaucuccucuggcucuggaagcaccuugaaaaugugcauuuu

SEQ ID NO: 70049 - RNA, 62 nt, Homo Sapiens
aauuacaagacggggagugagacuccugauugcucuggaagccugcugauuucuacaacuga

SEQ ID NO: 70050 - RNA, 62 nt, Homo Sapiens
ccugcucugugucuguguugugaagcuugagacucuggaaagaaauggggagggggggcagg

SEQ ID NO: 70051 - RNA, 62 nt, Homo Sapiens
cccaucagcccuugcaagucccccacucaggccucuggaagguccagggaugggcucugaug

SEQ ID NO: 70052 - RNA, 62 nt, Homo Sapiens
gcuaugaggguguauauauuuuuuacccaaagcucuggaauuguacauuuauuuuuuaaaac

SEQ ID NO: 70053 - RNA, 62 nt, Homo Sapiens
ccgagccaguggcggcugguaucccgcggcggcucuggaagcuggacgcggaccacggcccg

SEQ ID NO: 70054 - RNA, 62 nt, Homo Sapiens
gaacugggaacauugcauccauggguugaugucucuggaagugcaaccacccaaugucucug

SEQ ID NO: 70055 - RNA, 62 nt, Homo Sapiens
uugaugucucuggaagugcaaccacccaaugucucuggaagugccaccuggaagugccaccu

SEQ ID NO: 70056 - RNA, 62 nt, Homo Sapiens
aagugccaccuggaagugccaccuggaagugucucuggaagagcacccaccacuguucagcc

SEQ ID NO: 70057 - RNA, 62 nt, Homo Sapiens
aggcagaggcuccgcggcaggaggagccggugcucuggaagaccugaaagaagcccaggugg

SEQ ID NO: 70058 - RNA, 62 nt, Homo Sapiens
auuagaacauauuugcauaagauagcuauuuacucuggaaaccaacaacuuuugagauuucc

SEQ ID NO: 70059 - RNA, 62 nt, Homo Sapiens
agaauuuugauagaaaaccauggggccaagagcucuggaagccuggccggaaagaccaaggu

SEQ ID NO: 70060 - RNA, 62 nt, Homo Sapiens
cgagagucggagauaugacugacugauuccuucucuggaauaguuacuuuacaacacggucu

SEQ ID NO: 70061 - RNA, 62 nt, Homo Sapiens
ccucucccuucccugcugccuugcagugaccccucuggaacucaggacucgauuuuaaggac

SEQ ID NO: 70062 - RNA, 62 nt, Homo Sapiens
augccuucccuagaaccggaggccccggacuucucuggaaaaccgccugucugcaggcccga

SEQ ID NO: 70063 - RNA, 62 nt, Homo Sapiens
ucuacauaaaugggaucauuuuauacauggugcucuggaacccacauuuuucaugcagucau

SEQ ID NO: 70064 - RNA, 60 nt, Homo Sapiens; identical to SEQ ID NO: 69541

SEQ ID NO: 70065 - RNA, 62 nt, Homo Sapiens
ugagauuguaggugauauuuaaugguuuuuuccucuggaagagauucaagggaaaggcacua

SEQ ID NO: 70066 - RNA, 62 nt, Homo Sapiens
aaagaauccuuagaugccuaugaauagauuuucucuggaaaugaggaggucagcaaaggucu

SEQ ID NO: 70067 - RNA, 62 nt, Homo Sapiens
acccuuccggaacccuucgggaggggaaugcgcucuggaaacagcuggauauccugggggag

SEQ ID NO: 70068 - RNA, 62 nt, Homo Sapiens
gaggcaguagcaaagagaugcuucuugugcugcucuggaagaccgcaaguccauuuuauuuc

SEQ ID NO: 70069 - RNA, 62 nt, Homo Sapiens
gacaccccagccagggacggucaucucugucacucuggaaggucaccuugagcagccucaga

SEQ ID NO: 70070 - RNA, 62 nt, Homo Sapiens
caggacucugggguuuuacauccaaaggaggccucuggaacccccccuuccagggccucugc

SEQ ID NO: 70071 - RNA, 62 nt, Homo Sapiens
gccuggaaacugggcacagacccagcuuccuucucuggaaaauccaagccuagagccaccag

SEQ ID NO: 70072 - RNA, 62 nt, Homo Sapiens
gccaauccauccuucccccacuguaaagucuccucuggaaaucccaugagaucaggcgccau

SEQ ID NO: 70073 - RNA, 62 nt, Homo Sapiens
guccaagaacgaaccugccaagaugagucacacucuggaacuccgugcgucccucuuaggag

SEQ ID NO: 70074 - RNA, 62 nt, Homo Sapiens
cacauggcuucaccugucccuuccauugugggcucuggaaacaagaaaaugagcagauuucu

SEQ ID NO: 70075 - RNA, 62 nt, Homo Sapiens
gucuggacuagguguugaagucagacaacuuucucuggaagggucuaccaaguacgaugucu

SEQ ID NO: 70076 - RNA, 62 nt, Homo Sapiens
caagcucugccucuccgggugugcugagauuucucuggaaaauaacaggcagccucaagaau

SEQ ID NO: 70077 - RNA, 62 nt, Homo Sapiens
caccguggcagaaaccgagggccugacagaaucucuggaaugugagcuccaagcacagcaaa

SEQ ID NO: 70078 - RNA, 62 nt, Homo Sapiens
ugagcuccaagcacagcaaagcacagccagugcucuggaaauggagaucuuggaacugaaac

SEQ ID NO: 70079 - RNA, 62 nt, Homo Sapiens
caaggaggagacuucauuuauucuuuggcauucucuggaauggcauuuccuguuuuccuuuu

SEQ ID NO: 70080 - RNA, 62 nt, Homo Sapiens
uuucccuucgaucuuaucuccagaaucugcugcucuggaauaaucuuuggaagccuugaguu

SEQ ID NO: 70081 - RNA, 62 nt, Homo Sapiens
cugaggcacacuucaccaucuacguaaauuuucucuggaaggcuauuuuaaaauagugaaua

SEQ ID NO: 70082 - RNA, 62 nt, Homo Sapiens
agccaagaaaagagaauauugaaauguugggacucuggaacucuuuggggaaacacuuugcu

SEQ ID NO: 70083 - RNA, 62 nt, Homo Sapiens
aagccuauuuccuccagccaguauaaggacaacucuggaaacaacugcuuuuuauacauuuu

SEQ ID NO: 70084 - RNA, 62 nt, Homo Sapiens
cucucuggaggguuaacucuggcugucugaggcucuggaauguuugcugaaaaaagcucugg

SEQ ID NO: 70085 - RNA, 62 nt, Homo Sapiens
agcacacuugauuccucacuguucauaaucagcucuggaacaaugacccgcuuuucuagaaa

SEQ ID NO: 70086 - RNA, 62 nt, Homo Sapiens
uccucacgguauauugaugucuuuugcagggacucuggaaugugaacugcagcucacgagac

SEQ ID NO: 70087 - RNA, 62 nt, Homo Sapiens
agcuuuugcagaggagugguguuggcgagcaucucuggaaauggcuccucugauccuuuagg

SEQ ID NO: 70088 - RNA, 62 nt, Homo Sapiens
gcuggugaggacucugccucuaacuggccuggcucuggaaggcucugcagggcugcccucuc

SEQ ID NO: 70089 - RNA, 62 nt, Homo Sapiens
uauucaauacauuaugcuuaaauuagcaguuucucuggaauuccugucucuccuuuaaaaga

SEQ ID NO: 70090 - RNA, 62 nt, Homo Sapiens
guugauaucgucauauaaagccauugcaaggacucuggaaacugccgccaaugaccaauuuc

SEQ ID NO: 70091 - RNA, 62 nt, Homo Sapiens
gcagcuuggcauucuucuuauucuagaggucucucuggaaaagauggagaaaaugaacagga

SEQ ID NO: 70092 - RNA, 62 nt, Homo Sapiens
auguaaugcuuccaaucuuggacucucugacccucuggaaauucucacccauaaacaguaau

SEQ ID NO: 70093 - RNA, 60 nt, Homo Sapiens; identical to SEQ ID NO: 69570

SEQ ID NO: 70094 - RNA, 62 nt, Homo Sapiens
ugaggaagugaacauuucggagaaacagaauccucuggaacuauacuggcucugucugagua

SEQ ID NO: 70095 - RNA, 62 nt, Homo Sapiens
accucugcugucacugcucgaagcagcagucucucuggaagcaucugugucauggccaucgc

SEQ ID NO: 70096 - RNA, 62 nt, Homo Sapiens
cagauggacucuagaagcacugagcucccugucucuggaaguauuuaagaaaaggcugggcc

SEQ ID NO: 70097 - RNA, 62 nt, Homo Sapiens
uaaaaauaaaaauaaauauuggcgggggaacccucuggaaucaauaaaggcuuccuuaacca

SEQ ID NO: 70098 - RNA, 62 nt, Homo Sapiens
caccccauuccagauauagaauguuucuaucucucuggaagguuccugcauguuauauggcu

SEQ ID NO: 70099 - RNA, 62 nt, Homo Sapiens
ucuugcugaaccguuugugauugccauuugagcucuggaagccucuauugccaugagaguuc

SEQ ID NO: 70100 - RNA, 62 nt, Homo Sapiens
cgauucuguccgugaaaugaauuggguagagucucuggaagguuuuaagcccauuuucaguu

SEQ ID NO: 70101 - RNA, 62 nt, Homo Sapiens
cagcccaugcucuucuguacugucaugcccgucucuggaauguccacucccagagccugccc

SEQ ID NO: 70102 - RNA, 62 nt, Homo Sapiens
gggggaggcccagggcuggugagucuagaaugcucuggaacccuacaccuagugaugugugu

SEQ ID NO: 70103 - RNA, 62 nt, Homo Sapiens
aucuguccccucauuuuugagaucccccaauucucuggaacuauucugcugccccuuuuuau

SEQ ID NO: 70104 - RNA, 62 nt, Homo Sapiens
gugcguucugcauagaauucuggccccauagccucuggaacucccuaggucugggugggcag

SEQ ID NO: 70105 - RNA, 62 nt, Homo Sapiens
aucaucccgcuucucuccgguggaggaggacgcucuggaaccccgcuggggccucggagacu

SEQ ID NO: 70106 - RNA, 62 nt, Homo Sapiens
acuuggcucugccccaugggccuccaagccaccucuggaaaucucuccccgccaccccaggg

SEQ ID NO: 70107 - RNA, 62 nt, Homo Sapiens
cgcaccuuuaacuuugcagacaccccuucugacucuggaaacucccaggaggagccccgcuu

SEQ ID NO: 70108 - RNA, 62 nt, Homo Sapiens
cucaggauucucacgacucuugguuugaaagccucuggaaaauucccauuuucgcuuuccuc

SEQ ID NO: 70109 - RNA, 62 nt, Homo Sapiens
gucaccuuuucgggcgcagcguggcuugguuucucuggaaauagggcggcccuguacuuuuu

SEQ ID NO: 70110 - RNA, 62 nt, Homo Sapiens
gugguucccagggaugggccgggggaggcccccucuggaaaugggggccaaugggggccuca

SEQ ID NO: 70111 - RNA, 62 nt, Homo Sapiens
cauuuguuaaaaaaaaaaaaacucgagcaggucucuggaagccugcacgcccaccccaugaa

SEQ ID NO: 70112 - RNA, 62 nt, Homo Sapiens
ggccuugcccgguccccuucucacccacaacccucuggaagucccgcagacccuuaaaaaaa

SEQ ID NO: 70113 - RNA, 62 nt, Homo Sapiens
gcuugaggaugugguucucgggcaccagguugcucuggaagagccuucacucagggucagcg

SEQ ID NO: 70114 - RNA, 62 nt, Homo Sapiens
cuuuuucgacugccccaacuagccacaccagacucuggaaccucugccgugaaaccccagcc

SEQ ID NO: 70115 - RNA, 62 nt, Homo Sapiens
gcugggguaguuggugagcaucuguucacagucucuggaaaacuaguuggccagcgucuugc

SEQ ID NO: 70116 - RNA, 62 nt, Homo Sapiens
cauggcuuuauuuucuuaauaagugcuaaacgcucuggaaaggaagcacaaguacguuaaac

SEQ ID NO: 70117 - RNA, 62 nt, Homo Sapiens
ugagauguuguuugauagcacacgaaagauuucucuggaacacauuaacugacgcuuccuuc

SEQ ID NO: 70118 - RNA, 62 nt, Homo Sapiens
cugcauguauuguagcugugccugcauccucucucuggaaggcucuugaggacccccacccu

SEQ ID NO: 70119 - RNA, 62 nt, Homo Sapiens
cccccaacugggaauugagagguaaggucuuucucuggaaauccagcaguagaggaagggac

SEQ ID NO: 70120 - RNA, 62 nt, Homo Sapiens
acugccccuuccauggaaaagcuggaaaaaaacucuggaacccauauccaggcuuggugagg

SEQ ID NO: 70121 - RNA, 62 nt, Homo Sapiens
uagugaagccuguuucguugaacuaauucuggcucuggaaauguuuuuguuuuauaguuauu

SEQ ID NO: 70122 - RNA, 62 nt, Homo Sapiens
ccauuauuaacugauuaaugcacuuugaaguucucuggaauuaauuauuuuaacuuggccua

SEQ ID NO: 70123 - RNA, 62 nt, Homo Sapiens
cacuucccacugauccauggggccuuuaagcccucuggaagcuuccauuaaagaugauuauu

SEQ ID NO: 70124 - RNA, 62 nt, Homo Sapiens
ugcaacugcugcaggaugccuguaguagggaacucuggaaguguauugggcugaggugggau

SEQ ID NO: 70125 - RNA, 62 nt, Homo Sapiens
cucccugcacucccuccuggagcucugugggucucuggaagaggaaccaggagaagggcugg

SEQ ID NO: 70126 - RNA, 62 nt, Homo Sapiens
caaaauuguuuauacacucuuuccuccaugagcucuggaagguauaugcaucuucuguaaua

SEQ ID NO: 70127 - RNA, 62 nt, Homo Sapiens
uugauagucccuugaacacacaugcugccgagcucuggaaaaaccccacaggugaguccuca

SEQ ID NO: 70128 - RNA, 62 nt, Homo Sapiens
accauuuucugguucuguguccucugccugggcucuggaagaggccuucccauggccauuuc

SEQ ID NO: 70129 - RNA, 62 nt, Homo Sapiens
cacucucagccacagggagcagaugcacuccgcucuggaacucuggcagagaugcauuccag

SEQ ID NO: 70130 - RNA, 62 nt, Homo Sapiens
gcuacauagucaucauuaguuugccuuuaaaacucuggaagaaacuguaggccaauauagau

SEQ ID NO: 70131 - RNA, 62 nt, Homo Sapiens
ugauuuuuguguaucugagaaaaugcuuugcccucuggaacugcucguuguggacuguaauu

SEQ ID NO: 70132 - RNA, 62 nt, Homo Sapiens
gaaaggcccuguaaagcccuuuucugcaugaacucuggaacaagcuuaccugccacagagcu

SEQ ID NO: 70133 - RNA, 62 nt, Homo Sapiens
gaccagaguuaagcucucggccagcagguugucucuggaaaccugggcgcaucccaagacag

SEQ ID NO: 70134 - RNA, 62 nt, Homo Sapiens
uuuucaaaagcuuaaggcccaaauacaaacuucucuggaauaaacgugguguuuuauuuucu

SEQ ID NO: 70135 - RNA, 62 nt, Homo Sapiens
caagccuuggcucguucucuucucucuucaaucucuggaaaaauaaguacauauaguugaua

SEQ ID NO: 70136 - RNA, 62 nt, Homo Sapiens
gccuggaaauuaaacccugccccacuucucuacucuggaaguccccgggagccucuccuugc

SEQ ID NO: 70137 - RNA, 62 nt, Homo Sapiens
uuauuuugguuaauguaauaaaauaggaccuucucuggaaaaagccagugagcauuacuuuu

SEQ ID NO: 70138 - RNA, 62 nt, Homo Sapiens
uugcuuuuagcagggaaagcuugcugcuuuugcucuggaacuaucccucccauauuuucuuu

SEQ ID NO: 70139 - RNA, 62 nt, Homo Sapiens
gggugcucauguugguuuuauugugucuguaucucuggaacucucaugaacacuaagauuaa

SEQ ID NO: 70140 - RNA, 62 nt, Homo Sapiens
caacgaaggcaaugcugcucccagccagaagccucuggaaggguggacuccguggggcucca

SEQ ID NO: 70141 - RNA, 62 nt, Homo Sapiens
ucugugauccuuugcagguuaguucucccugacucuggaaccucuggaaccucugugacgcc

SEQ ID NO: 70142 - RNA, 62 nt, Homo Sapiens
ucugugacgccaguucucccaguucucccugacucuggaaccuucacucagcugcuccucuc

SEQ ID NO: 70143 - RNA, 62 nt, Homo Sapiens
aucucugggguuugcuuguuauguuacauuugcucuggaaaccucuguguacagcgcugugc

SEQ ID NO: 70144 - RNA, 62 nt, Homo Sapiens
ucugugaugcucccaagcaaaggaaaugcaagcucuggaaauucguuaauguauuugauguc

SEQ ID NO: 70145 - RNA, 62 nt, Homo Sapiens
cagggccuccagcccucucacugugucccucucucuggaaaggaggaaggagccuauggcau

SEQ ID NO: 70146 - RNA, 62 nt, Homo Sapiens
auucucucucagccacagugagcaaauucauccucuggaaaugagaagcacuuggcuggcug

SEQ ID NO: 70147 - RNA, 62 nt, Homo Sapiens
ugaagcccugagaaggagaggcuccccuggggcucuggaaccgacccugccccuggcuggga

SEQ ID NO: 70148 - RNA, 62 nt, Homo Sapiens
ccucugcccccuccccaacauuuaguuuugaacucuggaauuugacuuugauuccugcgccu

SEQ ID NO: 70149 - RNA, 62 nt, Homo Sapiens
ccaaagcagcucaucccuucagccagugagugcucuggaaaguggaauacccaaggucaugu

SEQ ID NO: 70150 - RNA, 62 nt, Homo Sapiens
ucuuuguguuagggucucgauucuaagccacucucuggaaucuugguaagaguagcuggguu

SEQ ID NO: 70151 - RNA, 62 nt, Homo Sapiens
ugcaggccagaugguugcugcgccugacuccccucuggaaacuucacuccagucccacccca

SEQ ID NO: 70152 - RNA, 62 nt, Homo Sapiens
agcgugugaaacagcggggguugcuggacaaacucuggaagcuguaugcauucauuuauucc

SEQ ID NO: 70153 - RNA, 62 nt, Homo Sapiens
ucugcuuagaauucugagagcugaucugugagcucuggaaugggguagcagcuggugggaca

SEQ ID NO: 70154 - RNA, 62 nt, Homo Sapiens
gugcuccucacaaaguuucccugcugugggcccucuggaauugucacgccaggaggcugugg

SEQ ID NO: 70155 - RNA, 62 nt, Homo Sapiens
uggcaguguguaaagcacugacggaugauaagcucuggaagcuuggcgucuguucugggagc

SEQ ID NO: 70156 - RNA, 62 nt, Homo Sapiens
aauaaggcugccuuggaggcggccuucuuuagcucuggaaaggagugggcgcaggcacgcca

SEQ ID NO: 70157 - RNA, 62 nt, Homo Sapiens
gggauuuguggcagggauuccacucagaaccucucuggaauuugugccugaugugccuucca

SEQ ID NO: 70158 - RNA, 62 nt, Homo Sapiens
uuccuacaaguuaaccaguugcacuacauaaucucuggaaauuaauuuucucuuuaggagaa

SEQ ID NO: 70159 - RNA, 62 nt, Homo Sapiens
uugucuacccaaucaacaguuuucccucuuugcucuggaaauauuuguacucauauagcaua

SEQ ID NO: 70160 - RNA, 62 nt, Homo Sapiens
aaaugcuuuuccaacccaugagugcuaagagccucuggaagggagggcuucaggcccgaagg

SEQ ID NO: 70161 - RNA, 62 nt, Homo Sapiens
ugaaauuaccugauaacuuaagacucugugaucucuggaaucaccauauguuucuuuuuugu

SEQ ID NO: 70162 - RNA, 62 nt, Homo Sapiens
ucaggggugguuacauagaccagcagcuacagcucuggaaauugaaaucauaaucugucaau

SEQ ID NO: 70163 - RNA, 62 nt, Homo Sapiens
ggcuguggaguaagagggaaugcggugaggcacucuggaauaugacccuaccagagguugga

SEQ ID NO: 70164 - RNA, 62 nt, Homo Sapiens
uuaacucuagaaauucucaguaugggguuucccucuggaaaaagaaaaucugaagacauuac

SEQ ID NO: 70165 - RNA, 62 nt, Homo Sapiens
guuaaacaaaccauccauaacuuggaauacugcucuggaaugaaaaggaacuaacuguugau

SEQ ID NO: 70166 - RNA, 62 nt, Homo Sapiens
uguggacaaaccguaggaaugcuacucuucagcucuggaagucugcccuuugauguccuuga

SEQ ID NO: 70167 - RNA, 62 nt, Homo Sapiens
gaaggaacuagguaggagaggugucccuguagcucuggaacugguguuuccgugacuuagcu

SEQ ID NO: 70168 - RNA, 62 nt, Homo Sapiens
uuugcuguagcaucuggucucuagguucauuucucuggaacagagcaccccgggaucauuuu

SEQ ID NO: 70169 - RNA, 62 nt, Homo Sapiens
ccaaggcuccccgugcuucucuggucaccgcucucuggaaaaaauucccagagcagacuuac

SEQ ID NO: 70170 - RNA, 62 nt, Homo Sapiens
ggcauauauguacuaguggcauccugcacugacucuggaaaaaaagacuugcacaaauacgg

SEQ ID NO: 70171 - RNA, 62 nt, Homo Sapiens
agacaugagaaccugguaacuucauaaguuaucucuggaaaggguaaguacauaauugugaa

SEQ ID NO: 70172 - RNA, 62 nt, Homo Sapiens
cacaguguugugcaccaggacugggcacuucccucuggaaaucaacaguaucuuaaguuuaa

SEQ ID NO: 70173 - RNA, 62 nt, Homo Sapiens
cugauucagccagcauggaucucuggucccaccucuggaaauagcucuuuaaaaauaaauug

SEQ ID NO: 70174 - RNA, 62 nt, Homo Sapiens
aaggaugucaagaaggugaaagcuacugagagcucuggaaagcagaaaagaaaagcagaguc

SEQ ID NO: 70175 - RNA, 62 nt, Homo Sapiens
guccucuguauccucaugagaugucauguagccucuggaaaagagagagaugacauaaccau

SEQ ID NO: 70176 - RNA, 63 nt, Homo Sapiens
auccuggaccugggaggccccugugagggccagcucuggaaaaaccugggaguugaugccgga

SEQ ID NO: 70177 - RNA, 63 nt, Homo Sapiens
ggcaacugucacgugugcuagaagguucgaugccucuggaaugcaugugauacucaucuccau

SEQ ID NO: 70178 - RNA, 63 nt, Homo Sapiens
caggacacagggauggauaccaccuacccucgccucuggaauggccuacccaacccgagaaga

SEQ ID NO: 70179 - RNA, 63 nt, Homo Sapiens
aagaaaccaaagucugccgcccaccucgcuccccucuggaaucuuccccaagggccaaaccca

SEQ ID NO: 70180 - RNA, 63 nt, Homo Sapiens
caucuccugacccucccacucccaucuccuuaccucuggaaccccccaggcccuacaaugcuc

SEQ ID NO: 70181 - RNA, 63 nt, Homo Sapiens
cugacugucacucggcucucccuacccauuuggcucuggaagcugcuuggcccccccagauca

SEQ ID NO: 70182 - RNA, 63 nt, Homo Sapiens
gauucuggaccaccaccugggaccaaccuucagcucuggaaccuucauaaagcaggucagcgu

SEQ ID NO: 70183 - RNA, 63 nt, Homo Sapiens
guauccaugcucuguggccaggugccugccacccucuggaacucacaaaagcuggcuuuuauu

SEQ ID NO: 70184 - RNA, 63 nt, Homo Sapiens
gugggaguuauggggucaucaaggaccuugccucucuggaaucugucaacccaguuuugggcu

SEQ ID NO: 70185 - RNA, 63 nt, Homo Sapiens
agcgaccccaccugccauuaccuucagggccuccucuggaagagaacccauucucagagugca

SEQ ID NO: 70186 - RNA, 63 nt, Homo Sapiens
gcagacagacagaaagccagaggcuuagggaaacucuggaacccagacaagaaucuuuucgcu

SEQ ID NO: 70187 - RNA, 63 nt, Homo Sapiens
aaacucccaaauugucaaguccugcuuaacuuucucuggaaaauagaccccuucucaacauca

SEQ ID NO: 70188 - RNA, 63 nt, Homo Sapiens
aauauuauuaauaacccccucugaauuucaugucucuggaauugaggugguagugaacagcag

SEQ ID NO: 70189 - RNA, 52 nt, Homo Sapiens; identical to SEQ ID NO: 69143

SEQ ID NO: 70190 - RNA, 63 nt, Homo Sapiens
ggcguccugugacucgccuugccacaucugugucucuggaacccaggaccucuggaccucagg

SEQ ID NO: 70191 - RNA, 63 nt, Homo Sapiens
aaaccccagccuaaugaaacccuagguguugggcucuggaaugggacuuugucccuucuaauu

SEQ ID NO: 70192 - RNA, 63 nt, Homo Sapiens
aauauauauauaaaaccagagcugacaaugacacucuggaacauugcauaccuucuguacauu

SEQ ID NO: 70193 - RNA, 63 nt, Homo Sapiens
gaaggcagagggaugaaaugccaagacucuaugcucuggaaaaccugaggccaaauauugauc

SEQ ID NO: 70194 - RNA, 63 nt, Homo Sapiens
aauacuauguuaugaaugguauuaaauuuuagucucuggaacauccaaaaccaagcaaaggga

SEQ ID NO: 70195 - RNA, 63 nt, Homo Sapiens
aacagcaggauguugaauugaucaucagaugcccucuggaaugguuagcauccaaggugacag

SEQ ID NO: 70196 - RNA, 63 nt, Homo Sapiens
uaaggcuagauccuucccauaguaucaucuguccucuggaaugacucuccugucccuaaaggg

SEQ ID NO: 70197 - RNA, 63 nt, Homo Sapiens
accucuugcuccucauuccuccccugcccuuuucucuggaauaucuaagaugugagcugcauu

SEQ ID NO: 70198 - RNA, 63 nt, Homo Sapiens
agacgagacugagguuaaacaucagaaaaaaaccucuggaaugaccuuccucauuccaggagg

SEQ ID NO: 70199 - RNA, 63 nt, Homo Sapiens
aauuuguuacuuaaauauauagagaccaguuuucucuggaaguuuguuuaaaugacagaagcg

SEQ ID NO: 70200 - RNA, 63 nt, Homo Sapiens
ccuaaccccucccucaauaaauacauuacuguacucuggaauuuaggcaaaaccuuaaaucuc

SEQ ID NO: 70201 - RNA, 63 nt, Homo Sapiens
auauuuuugaaguaaauuaaacauuuuucacaucucuggaaauuuagaguucuagaccucugg

SEQ ID NO: 70202 - RNA, 63 nt, Homo Sapiens
aaguugcagaugauucaaacugacuuauuucugcucuggaauauuauauuuauuguuagaaaa

SEQ ID NO: 70203 - RNA, 63 nt, Homo Sapiens
ucuccacgcugaaugugauuccaacuccagcaucucuggaaaaagcuacgugguggccgucug

SEQ ID NO: 70204 - RNA, 63 nt, Homo Sapiens
ugagaccacuggaggcacacccaccaaggggcccucuggaacugcggacaucaagggcggaca

SEQ ID NO: 70205 - RNA, 63 nt, Homo Sapiens
gcuguauuugggccuaauccgcuccugggccagcucuggaaggagugugacccugcucuucca

SEQ ID NO: 70206 - RNA, 63 nt, Homo Sapiens
ucauaggguugugaggcaaacacaucuugugcccucuggaagcggauauggucauuuacaaga

SEQ ID NO: 70207 - RNA, 63 nt, Homo Sapiens
ugucugaacuugcugccuccccagggcucguggcucuggaaugccucguggcuuggauagaau

SEQ ID NO: 70208 - RNA, 63 nt, Homo Sapiens
aaaauauguauauauuaaaaaauucacuaaacucucuggaaaaggagacgauagggcauauga

SEQ ID NO: 70209 - RNA, 63 nt, Homo Sapiens
acaugucauuucauuuucagaauugagaugauacucuggaaaaauaaaaccaucaaauuuuau

SEQ ID NO: 70210 - RNA, 63 nt, Homo Sapiens
cagaggaguaagagaggaagcccuugcagccaacucuggaaggugcuccaggccacuaggccu

SEQ ID NO: 70211 - RNA, 63 nt, Homo Sapiens
acagauucuuguuugguaaacaaaaugagaauucucuggaauaauucaaucucuucuucaaau

SEQ ID NO: 70212 - RNA, 63 nt, Homo Sapiens
agaagucacacagacaaucauaaaaaagucuuccucuggaaaggcuuuccuagaauuuaaaaa

SEQ ID NO: 70213 - RNA, 63 nt, Homo Sapiens
gugcagagagugucaguuucuucagaucuuucucucuggaaauagguuuugaugcuagugauc

SEQ ID NO: 70214 - RNA, 63 nt, Homo Sapiens
gcauauccugcuagugauuuuggagcagauggucucuggaauuugagaaacaaaacuaauuuu

SEQ ID NO: 70215 - RNA, 63 nt, Homo Sapiens
aaacaugugaguaagugagacugugagcagucccucuggaaaggcauaggcucuuuuugcugc

SEQ ID NO: 70216 - RNA, 57 nt, Homo Sapiens; identical to SEQ ID NO: 69170

SEQ ID NO: 70217 - RNA, 63 nt, Homo Sapiens
uacccauagaagacgggaaguaaaacucaaccacucuggaauuaaagagccuggggaggagcu

SEQ ID NO: 70218 - RNA, 63 nt, Homo Sapiens
acauuuggagggaaagacaagaggugggggccucucuggaagcgaggcuggagacagggguuu

SEQ ID NO: 70219 - RNA, 63 nt, Homo Sapiens
uguuguauuuucucccaguauaaaaaccaugcacucuggaauugguggggugauagggugggc

SEQ ID NO: 70220 - RNA, 63 nt, Homo Sapiens
ugaguuacaaccaccaauacggcugaauucucccucuggaaacaauugugaucuaggcugcug

SEQ ID NO: 70221 - RNA, 63 nt, Homo Sapiens
cgucccagaauauuagccagaggcuuaauguuucucuggaaagguggcucauacacacuuaaa

SEQ ID NO: 70222 - RNA, 63 nt, Homo Sapiens
gaggaaugccugugugagcaguauguuagggugcucuggaagauucccuauuuguuuucuucu

SEQ ID NO: 70223 - RNA, 63 nt, Homo Sapiens
gggauuaaacagauacccaaccugcaugcccuccucuggaacucccccacuucuucccuccag

SEQ ID NO: 70224 - RNA, 63 nt, Homo Sapiens
gggaacauguggggacuacuuggcaguugaaaucucuggaagagcuacagaggugaccaggcc

SEQ ID NO: 70225 - RNA, 63 nt, Homo Sapiens
aacuguuugcaguuguaugcucaggcgugaauccucuggaaggcugaugacccucugcgguug

SEQ ID NO: 70226 - RNA, 63 nt, Homo Sapiens
uaauaauuacaucauaaucauuauugcaaaacacucuggaaaguaucucuuaacagguugaag

SEQ ID NO: 70227 - RNA, 63 nt, Homo Sapiens
cauuccccauccaucacucccuugcuagguagccucuggaaaggcugcagaugcuacugacug

SEQ ID NO: 70228 - RNA, 63 nt, Homo Sapiens
uggccaggcagucccagaaggccccuuccucaucucuggaauucaccccuaccccagucacuc

SEQ ID NO: 70229 - RNA, 63 nt, Homo Sapiens
auuaggaggcagccauaauacuggguguggcugcucuggaagaggugagagcccgucacaguc

SEQ ID NO: 70230 - RNA, 63 nt, Homo Sapiens
uuuaauggguuauuucucuuugaggguggcuuucucuggaacauugguuagagcagcuuuguu

SEQ ID NO: 70231 - RNA, 63 nt, Homo Sapiens
gagaugcagggauuggccagcuggguugguuugcucuggaauggcuaacucuugccugcuuug

SEQ ID NO: 70232 - RNA, 63 nt, Homo Sapiens
uuaccaggcuguaaaagcaaaaccucguaucagcucuggaacaauaccugcaguuauucuuca

SEQ ID NO: 70233 - RNA, 61 nt, Homo Sapiens; identical to SEQ ID NO: 69187

SEQ ID NO: 70234 - RNA, 63 nt, Homo Sapiens
uccaguccugaguuugcuacuuacuucuguggccucuggaaccuuauccaaccucuuggugcu

SEQ ID NO: 70235 - RNA, 63 nt, Homo Sapiens
uaaaaccaccaggaaugaauucacuccccacuucucuggaaccucaggacccgcccauuucuc

SEQ ID NO: 70236 - RNA, 63 nt, Homo Sapiens
ugccucuggguacaaaagugccucaacgacaugcucuggaaaucccaaaugccacagucugag

SEQ ID NO: 70237 - RNA, 63 nt, Homo Sapiens
ggggagaaggcgcuaccugcgugggacccucuucucuggaaaccuaauccuccuuucauuucc

SEQ ID NO: 70238 - RNA, 63 nt, Homo Sapiens
uuuuuuuuuuccccaguauugcccuggagcugucucuggaaaguagcuggcgagguuaccuua

SEQ ID NO: 70239 - RNA, 63 nt, Homo Sapiens
agauucaagauagcugugauuucucucaccguucucuggaaauggcaucagauuuaaggauaa

SEQ ID NO: 70240 - RNA, 63 nt, Homo Sapiens
cagccucucccugccaaagcccaacucccagggcucuggaaauggugaggcgaggggcuugag

SEQ ID NO: 70241 - RNA, 63 nt, Homo Sapiens
gacauuccuccauguccucacggcuggauuucucucuggaaaggauuuucauucaucauggug

SEQ ID NO: 70242 - RNA, 63 nt, Homo Sapiens
cccucuguaggccaguaguucucaaaguguggucucuggaagagcaguaucagcaucaucugg

SEQ ID NO: 70243 - RNA, 63 nt, Homo Sapiens
auuaucuuacugaacaccuguagucccagcuuucucuggaaguggucguauuugagcaggaug

SEQ ID NO: 70244 - RNA, 63 nt, Homo Sapiens
uaggaagggggcagggacgugaccuugacuuaccucuggaaagggucccagccuagacugcuu

SEQ ID NO: 70245 - RNA, 63 nt, Homo Sapiens
ccccgguugcuggucagguccccauggcuuguucucuggaaccugacuuuagauguuuuggga

SEQ ID NO: 70246 - RNA, 63 nt, Homo Sapiens
agggguggcgcucagaccccacccuacgcucaucucuggaaggggcagcccugaguggucacu

SEQ ID NO: 70247 - RNA, 63 nt, Homo Sapiens
ccgggcaagcacuaccaggcugugggucugcaccucuggaagguagagaagcggcgggucaau

SEQ ID NO: 70248 - RNA, 63 nt, Homo Sapiens
caauaauuuccagugagcggaaaauguauguaucucuggaaguaccuccccuuuaaauuaaaa

SEQ ID NO: 70249 - RNA, 63 nt, Homo Sapiens
cuugcgcagagcuuacuuuguuuugucugcucccucuggaagcggauguucaguuuagaacca

SEQ ID NO: 70250 - RNA, 63 nt, Homo Sapiens
guguccuuacccuucugcagggauacacuugcucucuggaaguuuggucuucuuagaguugca

SEQ ID NO: 70251 - RNA, 63 nt, Homo Sapiens
agacucagguuucuuuggaccauuuuucauucucucuggaaacaacugaucaggugucuauaa

SEQ ID NO: 70252 - RNA, 63 nt, Homo Sapiens
agaugaacgucaccaauggagaaugguauauuccucuggaaaauuuuccccuaaguccuaaca

SEQ ID NO: 70253 - RNA, 63 nt, Homo Sapiens
uagccaagaccaggagaagaggugguucaaauccucuggaacaccugagcacaggccgaugga

SEQ ID NO: 70254 - RNA, 63 nt, Homo Sapiens
ucaggacccgcccauuucucucacuccccacuucucuggaaccuaaaaccaccaggaaugaau

SEQ ID NO: 70255 - RNA, 63 nt, Homo Sapiens
gucucagaucuaaaauuuccugaggcugcuuuacucuggaauauuucacauuaagaaugugcc

SEQ ID NO: 70256 - RNA, 63 nt, Homo Sapiens
agacugauuuugcuuuuuuuaacgguuuuuagucucuggaaaaagcaguugaucagacugaaa

SEQ ID NO: 70257 - RNA, 63 nt, Homo Sapiens
aagcugggucucauguuugacaguagguaccaucucuggaaaauacuucaaucuagaauucuc

SEQ ID NO: 70258 - RNA, 63 nt, Homo Sapiens
accugguucccugccucuguauucagguguggccucuggaaccugacuccguuaggacgaaca

SEQ ID NO: 70259 - RNA, 63 nt, Homo Sapiens
uuauggaucagugacuguaguaggaguuugaggcucuggaacucucacauauucaagucuuua

SEQ ID NO: 70260 - RNA, 63 nt, Homo Sapiens
uuugaaggcaagugacuucaguugagggcaagucucuggaaaagaggcuguaggcaucuggca

SEQ ID NO: 70261 - RNA, 63 nt, Homo Sapiens
agcccuggccucugccugccucccgccugugcacucuggaaccucuggccucaggggaccugc

SEQ ID NO: 70262 - RNA, 63 nt, Homo Sapiens
uuuucucuugugucccuacucauugaaaccaaacucuggaaaggacccaauguaccaguauuu

SEQ ID NO: 70263 - RNA, 63 nt, Homo Sapiens
ugcaguccacuugcugaagaaguugugucauuucucuggaagaauuuccaaaauucuggauuu

SEQ ID NO: 70264 - RNA, 63 nt, Homo Sapiens
cuucaauauccacuucuuucagccuacuguagacucuggaaguauacuuuuugcauauguaag

SEQ ID NO: 70265 - RNA, 63 nt, Homo Sapiens
aguuauaggccuugccaggguuucgagaagcugcucuggaauuugcaagucauggcugugccc

SEQ ID NO: 70266 - RNA, 63 nt, Homo Sapiens
agaagcauuugugguaguaaaggaaaaccaacccucuggaaaauacauuuugagaaucucaaa

SEQ ID NO: 70267 - RNA, 63 nt, Homo Sapiens
uguggcuugauguggcaagccgaaaccacuuggcucuggaaaucuaaguucauacugguuuaa

SEQ ID NO: 70268 - RNA, 63 nt, Homo Sapiens
cuuuuuacuuuuauauuuuugcuugaaucuuaacucuggaaaucaccugauguagaagaagac

SEQ ID NO: 70269 - RNA, 63 nt, Homo Sapiens
gaaggaaucgugcucucaaugcaaagugucauucucuggaauugcaccuggcucaggaaagga

SEQ ID NO: 70270 - RNA, 63 nt, Homo Sapiens
guggccuauggagagacaggccuuucucucagccucuggaagccaccugcucuuuugcucuag

SEQ ID NO: 70271 - RNA, 63 nt, Homo Sapiens
agcuccuagagaagaacaauccucauggagaaacucuggaaaccuugacaauggcaacagugu

SEQ ID NO: 70272 - RNA, 63 nt, Homo Sapiens
uccucuccaagcccuccucugaaccagcuaucccucuggaaugcagcugaccaaacaaauucc

SEQ ID NO: 70273 - RNA, 63 nt, Homo Sapiens
gcugcaauaacaggaacaugagacuucgcaaaucucuggaaaauaauauccaaaugaaauuaa

SEQ ID NO: 70274 - RNA, 63 nt, Homo Sapiens
ucuguuuucaauauaauucuugauuucauuuuucucuggaauauauuggccuucuacagcuau

SEQ ID NO: 70275 - RNA, 63 nt, Homo Sapiens
ccuuuugcauuaaaaggacucugucccuggagacucuggaaaugcccagggaagccccugguu

SEQ ID NO: 70276 - RNA, 63 nt, Homo Sapiens
caacuucaucccagcugcugcaaugcccugcggcucuggaaagugugaccuggucuggucagg

SEQ ID NO: 70277 - RNA, 63 nt, Homo Sapiens
caggguugggugcuuauuuagccagaccaagcacucuggaagcugguuaugcccaucuccaua

SEQ ID NO: 70278 - RNA, 63 nt, Homo Sapiens
uaccacaugcaaacauacaaaacugaagauuuccucuggaagcgauaugaaccugaagauuaa

SEQ ID NO: 70279 - RNA, 63 nt, Homo Sapiens
cccagccacaccugagucccggguugagggaggcucuggaaaggacuucagccugugagggga

SEQ ID NO: 70280 - RNA, 63 nt, Homo Sapiens
uuuauggugguucagaagaacuaucuaccucuucucuggaaugauccuccaggaucuagccuu

SEQ ID NO: 70281 - RNA, 63 nt, Homo Sapiens
ucuguuuuaugcuaaauggaccaguguuuccaucucuggaaucucagaagccaccuggaagac

SEQ ID NO: 70282 - RNA, 63 nt, Homo Sapiens
uggaaaucacauacacacacccuaacaggcaggcucuggaaguaugaguaaaauggaauaaua

SEQ ID NO: 70283 - RNA, 63 nt, Homo Sapiens
ugcagucaucaauggucaguaagagccucauuccucuggaacgacaaugaaccaccugauuac

SEQ ID NO: 70284 - RNA, 63 nt, Homo Sapiens
uauucuauaagaaaaagcugaaaacuacguaaacucuggaaagugcuguguuuaaauaaauug

SEQ ID NO: 70285 - RNA, 63 nt, Homo Sapiens
acucauucguuuaugaacacuuuguuuguauggcucuggaauacuguccaguaaagagauuga

SEQ ID NO: 70286 - RNA, 63 nt, Homo Sapiens
cucugaaguuauggcugggaggcaaacucuguucucuggaaugaaacuuuguauuuuugaagc

SEQ ID NO: 70287 - RNA, 63 nt, Homo Sapiens
uucuuuauaauaaaagccuuggggcagcugggacucuggaaucgagcccaugggggcuggagg

SEQ ID NO: 70288 - RNA, 63 nt, Homo Sapiens
gccucauauggugauaugccuacuggaagccaccucuggaaaagaagacccccuccagaagca

SEQ ID NO: 70289 - RNA, 63 nt, Homo Sapiens
gcugggcaugggucauggccgucuccccauguccucuggaacagcccuuugccagacagcucu

SEQ ID NO: 70290 - RNA, 63 nt, Homo Sapiens
ggagauaauacaauuccagaauuuauuuuuacucucuggaaaauaguaaacaauggugauuuu

SEQ ID NO: 70291 - RNA, 63 nt, Homo Sapiens
ugugcguucaugcuuuuucguaaaaaacaaauucucuggaauuguaaaauugaucggauugau

SEQ ID NO: 70292 - RNA, 63 nt, Homo Sapiens
gcaugcacacugaacucugccuuuagcuuuuaacucuggaagcguuuuuuguuucucagucug

SEQ ID NO: 70293 - RNA, 63 nt, Homo Sapiens
agacugaggggcuuuguaaauaaauccuccacucucuggaaggacaaaauagccuauccuuaa

SEQ ID NO: 70294 - RNA, 63 nt, Homo Sapiens
cauauguauauaacauguguacuaacaugcccucucuggaaagauguauaguuccccguguuc

SEQ ID NO: 70295 - RNA, 63 nt, Homo Sapiens
ucugugguugugaaggcaauucauucagaucaccucuggaaucucuggccauuggugcguguu

SEQ ID NO: 70296 - RNA, 63 nt, Homo Sapiens
ggagcacagggagcuucuguuguucugaucuaucucuggaaaaccagccauuccuccucccug

SEQ ID NO: 70297 - RNA, 63 nt, Homo Sapiens
uccgagccucaggccaaggaccccugaugcagacucuggaaucccuggcccaaaggccugucu

SEQ ID NO: 70298 - RNA, 63 nt, Homo Sapiens
ccaccugauggcuguucucccaccgggucugggcucuggaaggagccagaugcccccagaaag

SEQ ID NO: 70299 - RNA, 63 nt, Homo Sapiens
uucccgaaguaauaagugaggacgaaugcacugcucuggaacauaacccagugcuaacugggg

SEQ ID NO: 70300 - RNA, 63 nt, Homo Sapiens
gaauugcuuuucucuuaccaguaugauuuguaacucuggaacacuauucuuacagaaugccuu

SEQ ID NO: 70301 - RNA, 63 nt, Homo Sapiens
acauuaagaugagcccuaauauguaagauuuuccucuggaauggaugugagaaauguaaauuu

SEQ ID NO: 70302 - RNA, 63 nt, Homo Sapiens
gagaacuaaauuguuucuaaauguagauggucccucuggaaaagcaguuuucagcaggggugg

SEQ ID NO: 70303 - RNA, 63 nt, Homo Sapiens
uaugcagaaaaaaaagugcugcaguuuagauaccucuggaauuuuuccacagugucacagguu

SEQ ID NO: 70304 - RNA, 63 nt, Homo Sapiens
uaaaacuugaaucaggauuuuaugccccacauacucuggaacuugaaguauaauauacuuaau

SEQ ID NO: 70305 - RNA, 63 nt, Homo Sapiens
ucaucuguaucuuaaauggccccaggcaucugccucuggaaaacuauugagccuugcauguac

SEQ ID NO: 70306 - RNA, 63 nt, Homo Sapiens
auggguggcagccccugguagaaugcuggauuucucuggaaucuagaagugccauauuuuagu

SEQ ID NO: 70307 - RNA, 63 nt, Homo Sapiens
uuuugcuucuuacgaacgccccuuuccucuccucucuggaaggccauccgucucuguccgcgu

SEQ ID NO: 70308 - RNA, 63 nt, Homo Sapiens
cuggcccaauuccucagaccuucccucugcacccucuggaaccagcucagcuaccacuucccc

SEQ ID NO: 70309 - RNA, 63 nt, Homo Sapiens
gaugagugaauguguucugguucucucuaucugcucuggaaugcucuagauuuucuucugugc

SEQ ID NO: 70310 - RNA, 63 nt, Homo Sapiens
caaaaucaauuuauuaagagaaagggacuuuagcucuggaacuucagcuucagaaauguuuua

SEQ ID NO: 70311 - RNA, 63 nt, Homo Sapiens
aaagaacugacuuuugauaguuuucucagugaccucuggaauaagaauuuuagcagaugguac

SEQ ID NO: 70312 - RNA, 63 nt, Homo Sapiens
cuuggugggagugaauuugcugugacuguggagcucuggaaggguuaaccaggagacuacucc

SEQ ID NO: 70313 - RNA, 63 nt, Homo Sapiens
aaucacuuagcuccucauaacaagucuaacuggcucuggaaagcugaaagggcugcacuggaa

SEQ ID NO: 70314 - RNA, 63 nt, Homo Sapiens
gauccuucuccugaaguucagccacccugaggccucuggaaagcaaagggcuccucuccaguc

SEQ ID NO: 70315 - RNA, 63 nt, Homo Sapiens
gaauccugcuaaaggagcaaagccuuguauuaccucuggaagacaacaaaaacaauuggcaac

SEQ ID NO: 70316 - RNA, 63 nt, Homo Sapiens
aaaaucaguaucuagaugguuuuuaaauguauucucuggaaauuguuuuauguaaaauaaaug

SEQ ID NO: 70317 - RNA, 63 nt, Homo Sapiens
ugcagauaugaagagcauuuuaagaggugcagccucuggaaguggaucaaacuagaacucaua

SEQ ID NO: 70318 - RNA, 59 nt, Homo Sapiens; identical to SEQ ID NO: 69272

SEQ ID NO: 70319 - RNA, 63 nt, Homo Sapiens
cauauuuuguguccccaccuugauguuacaugacucuggaacaauaugaacuggauuuaagaa

SEQ ID NO: 70320 - RNA, 63 nt, Homo Sapiens
cauucuuuuacuuaaccaggcuuauggcaugaucucuggaacaaauuuguaggaaaaaauuac

SEQ ID NO: 70321 - RNA, 63 nt, Homo Sapiens
ggagggcaccaaguuuuccuuuuuucuaaauagcucuggaaccaggcuuguaauccauagcau

SEQ ID NO: 70322 - RNA, 63 nt, Homo Sapiens
uuuguagaaaagguuuccucuagaacugaauuccucuggaauugagugauggacuucacaaca

SEQ ID NO: 70323 - RNA, 63 nt, Homo Sapiens
uaauaucugggccuuggaaggaaggacacagggcucuggaaggaggaggcugcaugccugaag

SEQ ID NO: 70324 - RNA, 63 nt, Homo Sapiens
ggacuccaguugccucagguugguucugcugugcucuggaaaguaacugcagccaccagguau

SEQ ID NO: 70325 - RNA, 63 nt, Homo Sapiens
gauguuuuuagaggggcaaaaauauuuugcaagcucuggaauuguugaauguauucuuuuaua

SEQ ID NO: 70326 - RNA, 63 nt, Homo Sapiens
ggcuuucaugauuuggcaugcaauagguauauccucuggaaaaguauucuugagggacaaugc

SEQ ID NO: 70327 - RNA, 63 nt, Homo Sapiens
uggaauguuaaguccaggccaauaaaacacuggcucuggaaucaggaagaaaagagcugggac

SEQ ID NO: 70328 - RNA, 63 nt, Homo Sapiens
aaauguuccgggaucauguuuucuaucaaaagccucuggaaauuuuuauucaagauugugcuc

SEQ ID NO: 70329 - RNA, 63 nt, Homo Sapiens
aacaacuggcaggacuguuggaaaaguauuugccucuggaaaggaaggaaaaacuaagagaau

SEQ ID NO: 70330 - RNA, 63 nt, Homo Sapiens
aggaaagcuaaagaagacuaaaauaauuaaucucucuggaaaaaugaccauuaagaaccagaa

SEQ ID NO: 70331 - RNA, 63 nt, Homo Sapiens
aaaaaaaugaaaugaagagucugugauuugguccucuggaaaauuuagaauguaauauguaaa

SEQ ID NO: 70332 - RNA, 63 nt, Homo Sapiens
ugaagagcuguuugguuugaagcugugaggcagcucuggaacgaaucuccugugaucugugcu

SEQ ID NO: 70333 - RNA, 63 nt, Homo Sapiens
accuugagauugaugcauuuaguugaccugcaucucuggaagguuucccaucucaagcauaua

SEQ ID NO: 70334 - RNA, 63 nt, Homo Sapiens
ucagaucugugacuuaaucuuuuucucuucaggcucuggaaaaggucuuauccuuugcucugu

SEQ ID NO: 70335 - RNA, 63 nt, Homo Sapiens
caugcauccuggccuugccacgggcugucuuggcucuggaauuaaauaagaaggcccuguuga

SEQ ID NO: 70336 - RNA, 63 nt, Homo Sapiens
cacaacuggugucagggcucaucauucucacuucucuggaagcucuuuuuacacuuauuuauu

SEQ ID NO: 70337 - RNA, 63 nt, Homo Sapiens
uuguggguggggcccagggaacccugccugaagcucuggaaacgcagccgccugcccgggaga

SEQ ID NO: 70338 - RNA, 63 nt, Homo Sapiens
gaaggggcaggacucaucagugccaggcaggcccucuggaaggccaaacacccugcugcuggc

SEQ ID NO: 70339 - RNA, 63 nt, Homo Sapiens
uuuguagcagaguacauaacuacauaaugccaacucuggaaucaaauuuccuuguuugaaucc

SEQ ID NO: 70340 - RNA, 63 nt, Homo Sapiens
uucuguggaugccagcuuuggaaucagagccgccucuggaauaccugugcuuccagaguuagc

SEQ ID NO: 70341 - RNA, 63 nt, Homo Sapiens
gccaggcgcgguggcucaggccuguaaucccagcucuggaagcugaaggauagcuugagccca

SEQ ID NO: 70342 - RNA, 63 nt, Homo Sapiens
auuuccuaucauuuuauuaucaccaugcaaugccucuggaauaaaacauacaggagucugucu

SEQ ID NO: 70343 - RNA, 63 nt, Homo Sapiens
caugugaccacauacguguuaggaggcugcaugcucuggaagccuggacucuaagcuggagcu

SEQ ID NO: 70344 - RNA, 63 nt, Homo Sapiens
uauucuagauggaggaggcacugaugcuuguaacucuggaaagaggccuacacccaagggcua

SEQ ID NO: 70345 - RNA, 63 nt, Homo Sapiens
cuaagaugauauuucagaagaguuggcugccuucucuggaaacaaggaaaacccaauaauucc

SEQ ID NO: 70346 - RNA, 63 nt, Homo Sapiens
ucgccugaagccuuccucuggcuucacagaaugcucuggaacucuggggucuggucagggagu

SEQ ID NO: 70347 - RNA, 63 nt, Homo Sapiens
gauucagggcccccucagcugucuccucccucccucuggaaaggaggguggggcucaggggcc

SEQ ID NO: 70348 - RNA, 63 nt, Homo Sapiens
agaaaaugccaucucuuuuuaguugaaggaaaacucuggaaguaggugccauuggucauucug

SEQ ID NO: 70349 - RNA, 63 nt, Homo Sapiens
aagcucucucgacagcaaaugguuuccccucaccucuggaauuaaagaaggaacuccaaaguu

SEQ ID NO: 70350 - RNA, 63 nt, Homo Sapiens
aauacaaaaccacuucagagaccaggguaucuccucuggaaggaucuaagagaagguaagaca

SEQ ID NO: 70351 - RNA, 63 nt, Homo Sapiens
uacgugugaucuuugaaaaccuuggcuuuagcccucuggaaucagagcuuacccaccauagua

SEQ ID NO: 70352 - RNA, 63 nt, Homo Sapiens
uaccuucacggccgcugcugcaaaaacccacaccucuggaagagcauggagcagauugaaaug

SEQ ID NO: 70353 - RNA, 63 nt, Homo Sapiens
auauaaaguuccuggcuuugugccagagagucccucuggaaccaaugaguaaucaacaaaauc

SEQ ID NO: 70354 - RNA, 63 nt, Homo Sapiens
cugauacaguaaauauaugauaacagccacacccucuggaaaucugggaguagagagacacac

SEQ ID NO: 70355 - RNA, 63 nt, Homo Sapiens
uccugauaugaccaagaaagaaggagggacuuucucuggaauucagcgcuaaguaaacuugcc

SEQ ID NO: 70356 - RNA, 63 nt, Homo Sapiens
cuggaagcuguaugccacaggaguggaggaagacucuggaacccaaagaaggaagaaaagaag

SEQ ID NO: 70357 - RNA, 63 nt, Homo Sapiens
agggcccgaugcagcauuuuccagcucugcacucucuggaauauuuugaccacgaccuuggcc

SEQ ID NO: 70358 - RNA, 63 nt, Homo Sapiens
aucuuuagcuuugacuuuggcuucucuccuggccucuggaagcgagugcuacuaaaacauuuu

SEQ ID NO: 70359 - RNA, 63 nt, Homo Sapiens
uguggagacgccagcccugcccccacuuguaugcucuggaauccccccacuuucccuucccca

SEQ ID NO: 70360 - RNA, 63 nt, Homo Sapiens
aggguuuaagaugcuaggauggagaagcugcagcucuggaaagagagcagacaucuuccacgu

SEQ ID NO: 70361 - RNA, 63 nt, Homo Sapiens
gggaggggcccugucacugucagaugggggccucucuggaagacuuccuccucucaaaccugg

SEQ ID NO: 70362 - RNA, 63 nt, Homo Sapiens
ucgaagugaaacauuugucuuggcuccaacccucucuggaaaaucaccucccugccccaaucc

SEQ ID NO: 70363 - RNA, 63 nt, Homo Sapiens
uucuccauuucucccuaucaacuaucccugacacucuggaauccuauauaauuauuuucaguu

SEQ ID NO: 70364 - RNA, 63 nt, Homo Sapiens
uguagguuagcucugcccaguaaccauaagggacucuggaagcgcuggucauuuugccacacu

SEQ ID NO: 70365 - RNA, 63 nt, Homo Sapiens
agaaaaccagagagucccaugaucauugaauuccucuggaauugauugauagugaaaccauua

SEQ ID NO: 70366 - RNA, 63 nt, Homo Sapiens
uuagcaaucuuauugcacacagaauuugcacaucucuggaagccugacaggacaucuuacaag

SEQ ID NO: 70367 - RNA, 63 nt, Homo Sapiens
ccaccaggguagggucucccucgguucugugggcucuggaagggcuccacggguagugcgacc

SEQ ID NO: 70368 - RNA, 63 nt, Homo Sapiens
ucuucugaccucagacggcucugagccuuauuucucuggaagcggcuaagggacgguuggggg

SEQ ID NO: 70369 - RNA, 63 nt, Homo Sapiens
ugauuguuuacaggauauuccaaaauaaaaggacucuggaagauuuucauugaggauaaauug

SEQ ID NO: 70370 - RNA, 63 nt, Homo Sapiens
uuccuacaggggcuccucugugggugaggggcccucuggaauggcaucccaugagcuuguggc

SEQ ID NO: 70371 - RNA, 63 nt, Homo Sapiens
guuuauuuaaugauguaauuuauuguugcguuccucuggaagcugugacuggaauaaaccccc

SEQ ID NO: 70372 - RNA, 63 nt, Homo Sapiens
aagaggcuggugcuguggccagggugagagcugcucuggaaaaugugacccagauccucacaa

SEQ ID NO: 70373 - RNA, 63 nt, Homo Sapiens
acugauuccaauauuauuacuuauaacacugaccucuggaaaauauuuuguucacaagaaaua

SEQ ID NO: 70374 - RNA, 63 nt, Homo Sapiens
cuauaauuucuaccuauugggccuuguucuguucucuggaacuaaacagaacaaccauuuacc

SEQ ID NO: 70375 - RNA, 63 nt, Homo Sapiens
ucaaggcaggcagcccaggcuuccaggaugcuucucuggaaccgguagggcccgagcuucagc

SEQ ID NO: 70376 - RNA, 63 nt, Homo Sapiens
ucaggcugagaaauccuuucucucauccucggucucuggaaagguucuguugccgccuaacuu

SEQ ID NO: 70377 - RNA, 63 nt, Homo Sapiens
cccccaccuuucucgcuggagcaggaacagagacucuggaagccuaacgggggugcggcagga

SEQ ID NO: 70378 - RNA, 63 nt, Homo Sapiens
ggcuggcuggugcccuauuuaccccaggugucccucuggaaggaaccccuugggcuaggucug

SEQ ID NO: 70379 - RNA, 63 nt, Homo Sapiens
agcauggccuugugaacuuaaagggcauucacucucuggaaguuucagagacccauucuaaac

SEQ ID NO: 70380 - RNA, 63 nt, Homo Sapiens
cgguaauaagagcuggcaagccagguugacucucucuggaaugauuuaggggacaaacuccau

SEQ ID NO: 70381 - RNA, 63 nt, Homo Sapiens
uugcccucuccucaccuccuuuucucucagugacucuggaaccugaaugcagcuuacaagaca

SEQ ID NO: 70382 - RNA, 63 nt, Homo Sapiens
aggagcuagcagaaaauaacucaaaguugaagacucuggaagauuuugcuuuaaccuaacucg

SEQ ID NO: 70383 - RNA, 63 nt, Homo Sapiens
cugccugcuggcucucccccagccccacauccccucuggaagagaauguaaaauaaaccugga

SEQ ID NO: 70384 - RNA, 63 nt, Homo Sapiens
uucuugaacccuacuuucuggaaguggaguugacucuggaaguuuucuagcaacugaacaaaa

SEQ ID NO: 70385 - RNA, 63 nt, Homo Sapiens
gggccuucaguaagaccacaagucugcaggaaacucuggaaucaggaagaaaagcuauguuca

SEQ ID NO: 70386 - RNA, 63 nt, Homo Sapiens
cuacaaacuccuacuacgucgucuaaauugcugcucuggaauaaggugauuucugcccccaga

SEQ ID NO: 70387 - RNA, 63 nt, Homo Sapiens
ugaccuacccaaaccuuuuguucuguaaaacugcucuggaaauaccgggaagcccaguuuucu

SEQ ID NO: 70388 - RNA, 63 nt, Homo Sapiens
guccuguuaaauuuacaacacuaacgauguagacucuggaaaugccuaauaagucaaagaaga

SEQ ID NO: 70389 - RNA, 63 nt, Homo Sapiens
agcucaaagaggaauugggaaaaauaaauugaacucuggaaucuucucucucaaguccuaaaa

SEQ ID NO: 70390 - RNA, 63 nt, Homo Sapiens
aggcucuggacagcagaagcccagauucugccucucuggaaagcucacuauucuuggaccaug

SEQ ID NO: 70391 - RNA, 63 nt, Homo Sapiens
uuuuucccuccccagaaucauggccggcggcuacucuggaaugagucccuaccugcuucacgu

SEQ ID NO: 70392 - RNA, 63 nt, Homo Sapiens
uuuguuucuucuguacccgggaccucccugggccucuggaagcuugcacgacacagggcuggu

SEQ ID NO: 70393 - RNA, 63 nt, Homo Sapiens
aaauauaguuauuaaaggauuguauuuauuguucucuggaaaucauauacugcuugcaauuuc

SEQ ID NO: 70394 - RNA, 63 nt, Homo Sapiens
cacuaugguuuaccuugagucaggggguguaaacucuggaaucugucauaggggcagcagucu

SEQ ID NO: 70395 - RNA, 63 nt, Homo Sapiens
aauagucaugcuucuuuauuugugggucacccacucuggaagacacuuaggaccauuugagcu

SEQ ID NO: 70396 - RNA, 63 nt, Homo Sapiens
uuuagaaucaggcuagaauauugccagauuuagcucuggaaugagaaauuaaaaacauaacua

SEQ ID NO: 70397 - RNA, 54 nt, Homo Sapiens; identical to SEQ ID NO: 69351

SEQ ID NO: 70398 - RNA, 63 nt, Homo Sapiens
auccucuguuacccgcagauuucagcagaaugacucuggaaccucacuucaguuguggccuca

SEQ ID NO: 70399 - RNA, 63 nt, Homo Sapiens
aggacugacuguacacucccugaucagccagcacucuggaagcuuugggaucccaggaaccau

SEQ ID NO: 70400 - RNA, 63 nt, Homo Sapiens
aacucagacuucuacuuuaccaaguaccacacacucuggaaugcuuuaguuuccuuuuccccu

SEQ ID NO: 70401 - RNA, 63 nt, Homo Sapiens
cagagcacacuguccccaccgccuccccuuucucucuggaaaguugaaguaucuccaaaggcc

SEQ ID NO: 70402 - RNA, 63 nt, Homo Sapiens
auugauuuuuguuucuuuuggccugauuuguaucucuggaaugcauuuauucuugaaauauuu

SEQ ID NO: 70403 - RNA, 63 nt, Homo Sapiens
ugccugggaucccuuccuggagaggcaggcugucucuggaaaaagccuccauugcccacccgc

SEQ ID NO: 70404 - RNA, 63 nt, Homo Sapiens
ccguuuggcacagcuuuggccacagccaggccccucuggaauuguccuuauuaaaccaguuuc

SEQ ID NO: 70405 - RNA, 63 nt, Homo Sapiens
gaggccaggcugcacaccuggugggagaacacacucuggaauucucuauucuccuggucgggg

SEQ ID NO: 70406 - RNA, 63 nt, Homo Sapiens
aaagggacucuuccauuuugccaaagaacugcacucuggaauuaggaccaguugcccucauuu

SEQ ID NO: 70407 - RNA, 63 nt, Homo Sapiens
cuauggucuuacaagcaguaccagcuacagagccucuggaacaacuucagauucccaaagaag

SEQ ID NO: 70408 - RNA, 63 nt, Homo Sapiens
ccuggagacccucgcccaaccguaaacgacacucucuggaagcagcgcauggcaagucacaug

SEQ ID NO: 70409 - RNA, 63 nt, Homo Sapiens
gcugguucaaggcuguuuggcacuaggggcagucucuggaagggccugcacugcccagugggc

SEQ ID NO: 70410 - RNA, 63 nt, Homo Sapiens
ugggucagaaccuucucucugugcaguuuggggcucuggaauucagaugucacaggauuaaau

SEQ ID NO: 70411 - RNA, 63 nt, Homo Sapiens
ccccuucccuggcagguggcuggaaacccaccucucuggaagggauuaggcacacagaucccc

SEQ ID NO: 70412 - RNA, 63 nt, Homo Sapiens
uuggcucuucuuuguuuuguagcucucaggucccucuggaacuagugcaggaaaccugaaccc

SEQ ID NO: 70413 - RNA, 63 nt, Homo Sapiens
aucuacaacuaauaggacacuucuacauaaguucucuggaaaucaaaauuuguaauguguugc

SEQ ID NO: 70414 - RNA, 63 nt, Homo Sapiens
ucaugugaugaagcugacauuuuggggucagaucucuggaacaauaguaaaacuugagaagcu

SEQ ID NO: 70415 - RNA, 63 nt, Homo Sapiens
agcaagaggaaccaguagcuggaggacagaccucucuggaagcagggcauccuccuugaaaga

SEQ ID NO: 70416 - RNA, 63 nt, Homo Sapiens
gacccuuugcaagucuuuacacagggcucgagccucuggaacucugucugugaaagucagaac

SEQ ID NO: 70417 - RNA, 63 nt, Homo Sapiens
aucccccguucugggcaaggagccucagccuuccucuggaagcgcuggcuuccuuaccagaaa

SEQ ID NO: 70418 - RNA, 63 nt, Homo Sapiens
uggguggggcccugcaccguccauuucuccugccucuggaagggggcagcuggggcugccauc

SEQ ID NO: 70419 - RNA, 63 nt, Homo Sapiens
caucccuugccgcugccauggcgugguggcugucucuggaaagcuggggugauccucccuccu

SEQ ID NO: 70420 - RNA, 63 nt, Homo Sapiens
agaggacuagcugacuuuugggugccuucugcucucuggaaccguggaccacucgcugccuua

SEQ ID NO: 70421 - RNA, 54 nt, Homo Sapiens; identical to SEQ ID NO: 69375

SEQ ID NO: 70422 - RNA, 63 nt, Homo Sapiens
uuucaccauagggguuauaguuggcuugugcuacucuggaaucauuuuacuguuuguuuuuau

SEQ ID NO: 70423 - RNA, 63 nt, Homo Sapiens
acauuuucccacagacuuccuggccuccugugacucuggaaagcaaaggauuggcuguguauu

SEQ ID NO: 70424 - RNA, 63 nt, Homo Sapiens
agagggugcugcccgcucaaugcccagcagcagcucuggaaggcagugcucagccccaucacc

SEQ ID NO: 70425 - RNA, 63 nt, Homo Sapiens
ugagaaaucuaaaaaacgaaaagucuccaaagucucuggaauuugaaacacuuugcauaacgu

SEQ ID NO: 70426 - RNA, 63 nt, Homo Sapiens
ugggccuccccuaagaggcuuuccccgaggcagcucuggaaucugugcccaccuggggccugg

SEQ ID NO: 70427 - RNA, 63 nt, Homo Sapiens
caaugcuaguauggaggcugugaaguccccaagcucuggaagcccacacuauuuguuggugau

SEQ ID NO: 70428 - RNA, 63 nt, Homo Sapiens
aaucaggaauauugugguaagcugggaguaucacucuggaagaaaguaacaucuccagaugag

SEQ ID NO: 70429 - RNA, 63 nt, Homo Sapiens
uccucauuguggaaacaagccaaaccaaaugaacucuggaaaaccuaaaacaaauguacauuu

SEQ ID NO: 70430 - RNA, 63 nt, Homo Sapiens
ucaagccugugcucagguugccuugaauguggacucuggaagagccaggggcccagaaugccg

SEQ ID NO: 70431 - RNA, 63 nt, Homo Sapiens
caaucagcagucuucaaucgaucaauaauucugcucuggaagagaaggaacagggagcagaga

SEQ ID NO: 70432 - RNA, 63 nt, Homo Sapiens
uccucaccucugcuccugucuucaucaccuucucucuggaagggaagaggaguuggaaggucu

SEQ ID NO: 70433 - RNA, 63 nt, Homo Sapiens
augcagagcgaguggaugcacuucccagcucaucucuggaagccuuugcuacucaagcuccuc

SEQ ID NO: 70434 - RNA, 62 nt, Homo Sapiens; identical to SEQ ID NO: 69911

SEQ ID NO: 70435 - RNA, 63 nt, Homo Sapiens
auuaaagaauuccugggggcuagccagagaacucucuggaaccacagaugcagcagcagucuu

SEQ ID NO: 70436 - RNA, 63 nt, Homo Sapiens
gcaugcauuuguaggugcacaacauuuccaaagcucuggaaagguuaacucauuauuuaauug

SEQ ID NO: 70437 - RNA, 63 nt, Homo Sapiens
ugaggugagaggaucacuugguggucccagcuacucuggaagcggacauggugggaugggcau

SEQ ID NO: 70438 - RNA, 58 nt, Homo Sapiens; identical to SEQ ID NO: 69392

SEQ ID NO: 70439 - RNA, 63 nt, Homo Sapiens
cccaagggaagaggcaaggucagcaguagugggcucuggaauguggucuggauagauagcuua

SEQ ID NO: 70440 - RNA, 63 nt, Homo Sapiens
cugggaaacuccuggaagacggauuugccugcacucuggaaggugacauccuggagggagacu

SEQ ID NO: 70441 - RNA, 63 nt, Homo Sapiens
uguauuucuugaauuagaauauccuaaaggauccucuggaagccaugugcaauaagaacauag

SEQ ID NO: 70442 - RNA, 63 nt, Homo Sapiens
gucuggaaaugucuuccuggaagagucagccagcucuggaaugccaaaacuuguuuccacauu

SEQ ID NO: 70443 - RNA, 63 nt, Homo Sapiens
cuuuggggcugauuugucucauuucauuuacagcucuggaacacugcuucuuaaucaauccaa

SEQ ID NO: 70444 - RNA, 63 nt, Homo Sapiens
ccacacuuguggggacuuagagcugggccgcuccucuggaagcgcucugauucagcuggggcu

SEQ ID NO: 70445 - RNA, 63 nt, Homo Sapiens
gccucuucuuguggcuuuuaguuggaacaaucucucuggaaguucauuguguuuguuuuucau

SEQ ID NO: 70446 - RNA, 63 nt, Homo Sapiens
ugaagcagcaagaucacuugccaaucccaacuacucuggaagcgcgugaucuaccacaccugg

SEQ ID NO: 70447 - RNA, 63 nt, Homo Sapiens
uguggggauggagaggauggcauccuugcuuuacucuggaaaggcacaaugccuggguguccu

SEQ ID NO: 70448 - RNA, 63 nt, Homo Sapiens
augcuccuugaagaaucucuccucucucucucucucuggaaagacccaacuuucucacugcug

SEQ ID NO: 70449 - RNA, 63 nt, Homo Sapiens
acaagcaaugcuguucuguaaauuuauugaaaccucuggaacauuucaccuuuagagauggag

SEQ ID NO: 70450 - RNA, 63 nt, Homo Sapiens
uugugagauugagagaacuaugaccugcagcaacucuggaaaccuggccugacagacaagcag

SEQ ID NO: 70451 - RNA, 63 nt, Homo Sapiens
uguauucucacucccuugaucucaagggcguaacucuggaagcacagcuugacuacacgucau

SEQ ID NO: 70452 - RNA, 63 nt, Homo Sapiens
auugggcaagggacaaggugcuagaauccuaagcucuggaaauauuucaugacacugguguau

SEQ ID NO: 70453 - RNA, 63 nt, Homo Sapiens
cacugccccugauggaacucauggagaaugaagcucuggaaauccucaccaaagcccuccgga

SEQ ID NO: 70454 - RNA, 63 nt, Homo Sapiens
agccccucucugaagagacuguccuugggccuccucuggaagcagcacccccagaggacaggg

SEQ ID NO: 70455 - RNA, 63 nt, Homo Sapiens
cggcaugggcuaagucacucugcccuucggagccucuggaagcuuagggcacauugguuccag

SEQ ID NO: 70456 - RNA, 63 nt, Homo Sapiens
uccuuauauaaaguaccagguuuuuuccccauucucuggaaauguuuguccucccuuaauuuu

SEQ ID NO: 70457 - RNA, 63 nt, Homo Sapiens
cccauuauggauguugaaauggacagggaaggacucuggaagucucuuccuccuccuccucuu

SEQ ID NO: 70458 - RNA, 63 nt, Homo Sapiens
auaagucccucuucuugccguuggccuuucugacucuggaaugaccacuguucauugaaaaau

SEQ ID NO: 70459 - RNA, 63 nt, Homo Sapiens
agcaugaggaaauagaagauucaggggccugagcucuggaagcugcaagcaaaagggauggga

SEQ ID NO: 70460 - RNA, 63 nt, Homo Sapiens
aaccauccaguaaaggucuuauccgauaccccacucuggaaggccuggccgcagugugugugu

SEQ ID NO: 70461 - RNA, 63 nt, Homo Sapiens
gccuuacucacaggcuuccacuaagugcagugucucuggaacucagugccuaugaaacaaaca

SEQ ID NO: 70462 - RNA, 63 nt, Homo Sapiens
acaugugucaagcugcuuggccuucagagguggcucuggaaugaacgaaggccucugaaggac

SEQ ID NO: 70463 - RNA, 63 nt, Homo Sapiens
agggggaggccuggaaggaguuggguccccauccucuggaaccgguucuucuaguucgaggcc

SEQ ID NO: 70464 - RNA, 63 nt, Homo Sapiens
auguguuaaauaucuguauaggacuggagccaccucuggaauacaccaucucucaagccccaa

SEQ ID NO: 70465 - RNA, 60 nt, Homo Sapiens; identical to SEQ ID NO: 69419

SEQ ID NO: 70466 - RNA, 63 nt, Homo Sapiens
guuucaguuaagucauuuuaucuguugauggcacucuggaauuauguuuccuuuugcgugauc

SEQ ID NO: 70467 - RNA, 63 nt, Homo Sapiens
cugcugugaauuuguauucccuuggccuggggccucuggaaguggauggaaacuuucuaccug

SEQ ID NO: 70468 - RNA, 63 nt, Homo Sapiens
cccaucuguuucacugucucaaggagcagggaccucuggaauuacuuuacuguuccucuggga

SEQ ID NO: 70469 - RNA, 63 nt, Homo Sapiens
aaauguaguuuucuacacucguagauuguacuucucuggaacccuuuacaucucagguaaugu

SEQ ID NO: 70470 - RNA, 63 nt, Homo Sapiens
cuaauggcaggcaaagggagaaaggaugccauccucuggaauccuucugugaaagcaaauacu

SEQ ID NO: 70471 - RNA, 63 nt, Homo Sapiens
ugaggcggcugcuugaaccuaucagguggaagccucuggaacccagagaacugaagugcagcc

SEQ ID NO: 70472 - RNA, 63 nt, Homo Sapiens
uguccucguguccaccuggcaauaaaaccaagccucuggaaucgaggacaaagaaaacugcac

SEQ ID NO: 70473 - RNA, 63 nt, Homo Sapiens
augggccagcuugcagggguaggccuaugggggcucuggaaggucucccgucucaacagcccc

SEQ ID NO: 70474 - RNA, 63 nt, Homo Sapiens
cggccacaguggcucacgccuguaaucccagaacucuggaaggcugaggcaggcggaucaccu

SEQ ID NO: 70475 - RNA, 63 nt, Homo Sapiens
gaugggacaguuuuccauauccuugcuguggagcucuggaacacucucuaaauuucccucuau

SEQ ID NO: 70476 - RNA, 63 nt, Homo Sapiens
cucucccuccagcaugggccugugucucaggcucucuggaagguggcccugccccggacccuc

SEQ ID NO: 70477 - RNA, 63 nt, Homo Sapiens
gucuuucccccacccugucucuuccuuguccuucucuggaaaaugccaaaauacacgauguga

SEQ ID NO: 70478 - RNA, 63 nt, Homo Sapiens
cugauuauagcaucuccuucugaguguuugggacucuggaaucugagacccauguucacauug

SEQ ID NO: 70479 - RNA, 63 nt, Homo Sapiens
gcaauggcaaaaauauuuccaguugcacuguaucucuggaagugaugcaugaauucgauugga

SEQ ID NO: 70480 - RNA, 63 nt, Homo Sapiens
ugucaaccagagaacagcuccccuagacauggccucuggaaaaaggaaaucuuugguggccaa

SEQ ID NO: 70481 - RNA, 63 nt, Homo Sapiens
gccauuacuaauagaaacacagccuuuccaauccucuggaacauauucugucuggguuuuuaa

SEQ ID NO: 70482 - RNA, 63 nt, Homo Sapiens
agguacaaaauccuacuuuucagagccuuccagcucuggaaccucaaacauccucaugcucuc

SEQ ID NO: 70483 - RNA, 63 nt, Homo Sapiens
uaaacuauugaugaauuguuuccugggucacaucucuggaaaauagauguuacaguucuuaaa

SEQ ID NO: 70484 - RNA, 63 nt, Homo Sapiens
ggaaggcaucugcaacuccaaguccaugcagaacucuggaaggccaaguucaucgcagcaugu

SEQ ID NO: 70485 - RNA, 63 nt, Homo Sapiens
ccugucuuuauuuccucaaagucaagcagcuuucucuggaaaaugaaugcuaauuagugugaa

SEQ ID NO: 70486 - RNA, 63 nt, Homo Sapiens
cccagcccuagcccuuuagccuuucacccugugcucuggaaaggcuaccaaauacuggccaag

SEQ ID NO: 70487 - RNA, 63 nt, Homo Sapiens
cucuacaguauacuugugagcacuucaugaagccucuggaaaaagcaauaaugucaccacaca

SEQ ID NO: 70488 - RNA, 63 nt, Homo Sapiens
ccuuuguaaauagguguguucucgaaaagugggcucuggaaucucucggggucuuuccucagc

SEQ ID NO: 70489 - RNA, 63 nt, Homo Sapiens
gcgccaggaaaagcuuccguaguucgcaugguucucuggaaacauucuggugagggacauugu

SEQ ID NO: 70490 - RNA, 59 nt, Homo Sapiens; identical to SEQ ID NO: 69444

SEQ ID NO: 70491 - RNA, 63 nt, Homo Sapiens
acauuuuuaucuagaugaaacgaggcuaguuuccucuggaaccauaagcucaucccucccguc

SEQ ID NO: 70492 - RNA, 63 nt, Homo Sapiens
uuauuccagcaguuguuccauaacuaccuuccacucuggaaccgauguguguucucagugaaa

SEQ ID NO: 70493 - RNA, 63 nt, Homo Sapiens
gcaaauagaauaggaggggauuacuaaugaucacucuggaaaugugaaacccagaucgcugug

SEQ ID NO: 70494 - RNA, 63 nt, Homo Sapiens
uucccucuaccacugggcaccuuccucagacgacucuggaagcgggguagucccucucaccug

SEQ ID NO: 70495 - RNA, 52 nt, Homo Sapiens; identical to SEQ ID NO: 69449

SEQ ID NO: 70496 - RNA, 63 nt, Homo Sapiens
uagacuguauauguuuaauaacugcaguuccuccucuggaaugucugugguguuauaguggua

SEQ ID NO: 70497 - RNA, 63 nt, Homo Sapiens
auuuccuccuagcccuuccacgaugccugugcccucuggaaaaaggauaugacaguccagcau

SEQ ID NO: 70498 - RNA, 63 nt, Homo Sapiens
ucuuauguaugcaagcucccgucauguuuucuccucuggaacucauguugcauuuaacugaau

SEQ ID NO: 70499 - RNA, 63 nt, Homo Sapiens
ggacuccuucucccucccuacccaucccgaggccucuggaaugauccaccccacuucugcaaa

SEQ ID NO: 70500 - RNA, 63 nt, Homo Sapiens
ugaacagguuuauaaaacauugagucuuugucucucuggaauacaacuuugcacuuguaguuu

SEQ ID NO: 70501 - RNA, 63 nt, Homo Sapiens
acauuaaggauggugggggucuucauuagagaccucuggaaaugaguuuucuaagcucagggu

SEQ ID NO: 70502 - RNA, 63 nt, Homo Sapiens
aggagauuuauaaaguuuugauauuuuucccuacucuggaauuugaacuuucuucauguuugc

SEQ ID NO: 70503 - RNA, 63 nt, Homo Sapiens
uuauugacagcaaugguuucccgggcccagaaacucuggaaagauuuuguccagaagaauuca

SEQ ID NO: 70504 - RNA, 63 nt, Homo Sapiens
cagugcuugaccuccuguauucugaauggugaacucuggaagcagggauugugucuggcucuu

SEQ ID NO: 70505 - RNA, 63 nt, Homo Sapiens
cugcccuccuuaauuugggaagguuuguguuuucucuggaaugguacaugucuuccauguauc

SEQ ID NO: 70506 - RNA, 63 nt, Homo Sapiens
agucuucuguuugaaaggcuagugaaucuaaaacucuggaagacuauuuucuaagcagccagc

SEQ ID NO: 70507 - RNA, 63 nt, Homo Sapiens
uuuaccacauguaacagauucuuccuacuuggucucuggaaguuuuauuguuuuuauuccaca

SEQ ID NO: 70508 - RNA, 63 nt, Homo Sapiens
cauucuuaaugguaagugucuaaauuuuuagaucucuggaacauuaguguuaucuggaagguu

SEQ ID NO: 70509 - RNA, 63 nt, Homo Sapiens
ugggugguaggagguuuuuuuuuuuacccagggcucuggaaggacaccaaacuguucugcuug

SEQ ID NO: 70510 - RNA, 63 nt, Homo Sapiens
aucuuguccaagccuuuaagacagcacugccuucucuggaacuaaaauuacaauugaaguaaa

SEQ ID NO: 70511 - RNA, 63 nt, Homo Sapiens
auuuuggcagaacuaguugauuaguuuagggaucucuggaaaugucaguuuccugaagagcca

SEQ ID NO: 70512 - RNA, 63 nt, Homo Sapiens
aguccuucaaaacuauaugguugccuagauucucucuggaaacugacuuugucaaauaaauag

SEQ ID NO: 70513 - RNA, 63 nt, Homo Sapiens
cagagcauccgaccucuuggagcaaguuucugccucuggaaagggggcgggcccuuuucacaa

SEQ ID NO: 70514 - RNA, 63 nt, Homo Sapiens
cuggcugugaaaagucaggucacuaccacccaccucuggaagagccuaggguggaggucacug

SEQ ID NO: 70515 - RNA, 63 nt, Homo Sapiens
cuaucagaagacaaaguuugucucuacaggaaucucuggaaaaguaggcucucccugcucccu

SEQ ID NO: 70516 - RNA, 63 nt, Homo Sapiens
uguggaguagcuguaauaaaggucauuguaucacucuggaaaagugauaguuuuuaacucuau

SEQ ID NO: 70517 - RNA, 63 nt, Homo Sapiens
aaaaaaaaaaaugaaaaaaaucaucugguugaacucuggaaaauggcuaaaaagauuacagcg

SEQ ID NO: 70518 - RNA, 63 nt, Homo Sapiens
ucuugcugauaggaaugauaccucaccugguugcucuggaagcauucccaaggcccuaagguc

SEQ ID NO: 70519 - RNA, 63 nt, Homo Sapiens
gauauauugguugguucauaucuucccgccucccucuggaaugcugaccuguacuuauuuuuc

SEQ ID NO: 70520 - RNA, 63 nt, Homo Sapiens
caaacuaccaauuucucguugugcccauguccccucuggaagacacugagcccaccagccaca

SEQ ID NO: 70521 - RNA, 63 nt, Homo Sapiens
guuauuuauuuagcauagacauuaaagauaacucucuggaaaaugacuugacuaaggcucuca

SEQ ID NO: 70522 - RNA, 63 nt, Homo Sapiens
gagcaccuuucuuccgucuguucacucugcggccucuggaaucccagcucuucucucucagaa

SEQ ID NO: 70523 - RNA, 63 nt, Homo Sapiens
cuggaaccuggaccccagccuuggugggggagccucuggaaugcauggggcggguccuagcug

SEQ ID NO: 70524 - RNA, 63 nt, Homo Sapiens
ccguagcaugauugcgcucauggauacagauggcucuggaaagcucaaccugcaggaguucca

SEQ ID NO: 70525 - RNA, 63 nt, Homo Sapiens
ucuggaaagcucaaccugcaggaguuccaccaccucuggaacaagauuaaggccuggcaggug

SEQ ID NO: 70526 - RNA, 63 nt, Homo Sapiens
auguccccaccacuccuggagucccaaugacuucucuggaaagacaaagagguuaucacaaaa

SEQ ID NO: 70527 - RNA, 63 nt, Homo Sapiens
cauuguuuuauaaagaacgugauuuccagugaucucuggaagcgcuaaagcuaaaauuucugu

SEQ ID NO: 70528 - RNA, 63 nt, Homo Sapiens
cagaggcauacacuuuuuacagauggacaaaagcucuggaacccuguggcuucaaauccuuug

SEQ ID NO: 70529 - RNA, 62 nt, Homo Sapiens
ggaguagauaaaacagcugcaauauaaacaguccucuggaauaaugguuugugguggaugcu

SEQ ID NO: 70530 - RNA, 63 nt, Homo Sapiens
uagaaaugcagaccugugggcucuaccacaggccucuggaaucagaaucuucaggguggggcc

SEQ ID NO: 70531 - RNA, 63 nt, Homo Sapiens
accuaggcuuacaggccauccugagccaggggccucuggaaauucucuuccugaugguccuuu

SEQ ID NO: 70532 - RNA, 63 nt, Homo Sapiens
ugggggcauuuugcuggggggagaugaggcagccucuggaauggcucagggauucagcccucc

SEQ ID NO: 70533 - RNA, 63 nt, Homo Sapiens
aagccacccaggaaggaagcacagagcugggggcucuggaaacgcccugugucucuggcuaca

SEQ ID NO: 70534 - RNA, 63 nt, Homo Sapiens
gccuccggacucuggcacgcuccagcagcccuccucuggaagcugcguccccucacccccugu

SEQ ID NO: 70535 - RNA, 63 nt, Homo Sapiens
uggcagggaguggggauugguccuacuuucuuucucuggaaaggaaagccuccaagacuccau

SEQ ID NO: 70536 - RNA, 63 nt, Homo Sapiens
agacuccgagaguuauaacuccauguaaagauccucuggaaaagcugacugagacaauucugu

SEQ ID NO: 70537 - RNA, 63 nt, Homo Sapiens
uggauuugcuucuuacccuguuaaaacuaaaaucucuggaaaaccugccuggcugauucuucc

SEQ ID NO: 70538 - RNA, 63 nt, Homo Sapiens
cagcaggaucacagcugccuccagaagggcaugcucuggaaccuccuccagcuuccagcuagg

SEQ ID NO: 70539 - RNA, 63 nt, Homo Sapiens
gcugauuuuauggacugagggccuggaaccuuccucuggaaguuucucgaugugcacugugau

SEQ ID NO: 70540 - RNA, 63 nt, Homo Sapiens
acacuagugugagccuucaguuaaaacugucaccucuggaaauaagcgucuccaauaugacua

SEQ ID NO: 70541 - RNA, 63 nt, Homo Sapiens
cacugaauaaagcacgugcaguugagggguccccucuggaaugggaagggcuuggccagcgcu

SEQ ID NO: 70542 - RNA, 63 nt, Homo Sapiens
acuccagcccagcuccaccuucgaugaagccuucucuggaaccgccaucagccuugaagggcc

SEQ ID NO: 70543 - RNA, 63 nt, Homo Sapiens
cccugggcccaguaccuagcgcucugaagaacucucuggaagcgguccuuaggccucugagaa

SEQ ID NO: 70544 - RNA, 63 nt, Homo Sapiens
uuggcgggcaucgccgacccgcgaccugacuuacucuggaaucaaucagucacaacucaccua

SEQ ID NO: 70545 - RNA, 63 nt, Homo Sapiens
cagucccauuuccuuccugggccagauguggugcucuggaaucggagacggccaguucuggcg

SEQ ID NO: 70546 - RNA, 63 nt, Homo Sapiens
gcucacaaugagugugacauuacuuccucuucucucuggaacguuugggacauacuugccccc

SEQ ID NO: 70547 - RNA, 63 nt, Homo Sapiens
agucacuuuuuuucccugaguuuuaaauguaugcucuggaaugauagaugauguagcuguaca

SEQ ID NO: 70548 - RNA, 63 nt, Homo Sapiens
agaggccgggggagcagacagggccggugcucccucuggaagcuugggugaccggggcccugg

SEQ ID NO: 70549 - RNA, 63 nt, Homo Sapiens
gaccucggccagcuggacccacaugagggccaccucuggaaccuucuucgaggcccuggccag

SEQ ID NO: 70550 - RNA, 63 nt, Homo Sapiens
gggcaccucucugucccuuccgugucucacugucucuggaagcuucagcccauguguguccug

SEQ ID NO: 70551 - RNA, 63 nt, Homo Sapiens
uucucuguguggauagacuccccagcguuuuuccucuggaaaugcccacagggcuugccgcgu

SEQ ID NO: 70552 - RNA, 63 nt, Homo Sapiens
cacuccccacaguuuuaggaucuaaaugauugccucuggaacuauucuucuagacuaucccac

SEQ ID NO: 70553 - RNA, 63 nt, Homo Sapiens
uaucuacaucagcugaaccugaaacucaggggacucuggaacaccauggacccugggggcugu

SEQ ID NO: 70554 - RNA, 63 nt, Homo Sapiens
cccagagccccaggugccuggccuggccuagaccucuggaauugagauuaaacaauuuggagu

SEQ ID NO: 70555 - RNA, 63 nt, Homo Sapiens
ggccugcugugacugaccuacaguggacuuucucucuggaauggaaccuucuuaggccuccug

SEQ ID NO: 70556 - RNA, 63 nt, Homo Sapiens
aacaccagcuugggcaacguaagaagaccgugucucuggaauuuuuuuuuuuuuuuaauuagc

SEQ ID NO: 70557 - RNA, 63 nt, Homo Sapiens
ucucuugggaacgcuggagagcuugugcacagccucuggaaggaaaggcagcgcugacuucgu

SEQ ID NO: 70558 - RNA, 63 nt, Homo Sapiens
aggggcuccccgaccugccccacuguacuggaacucuggaaagucacagacugacacguuucc

SEQ ID NO: 70559 - RNA, 63 nt, Homo Sapiens
aaaagagccuugucugaccuuccaggccgcugucucuggaagugccuacauucuucccgaggc

SEQ ID NO: 70560 - RNA, 63 nt, Homo Sapiens
cacgucuuagcuucugaacaaugccuggccuggcucuggaaguccacagucaggggccuccac

SEQ ID NO: 70561 - RNA, 63 nt, Homo Sapiens
auugcugguccugaagcuuuuugcaaauaaaggcucuggaagcauagucuggaaaguugggau

SEQ ID NO: 70562 - RNA, 63 nt, Homo Sapiens
aaccucuuucuaauacccucgagaccacucauccucuggaaucaguggggggcuauagccuca

SEQ ID NO: 70563 - RNA, 63 nt, Homo Sapiens
gacagggaaguugaguuagcgagcucauggaaccucuggaaagccaguacauguuuaaaagaa

SEQ ID NO: 70564 - RNA, 63 nt, Homo Sapiens
ggccacacacccgagagcugggaagugguaggacucuggaagaaaauuacuuggaaaacagug

SEQ ID NO: 70565 - RNA, 63 nt, Homo Sapiens
aggucgauggaacuggccacgcacaggcucuggcucuggaaggagggaugaugagugggcguu

SEQ ID NO: 70566 - RNA, 63 nt, Homo Sapiens
uugcuuguuuguuuuuagauuccugagagaugucucuggaagggaaaguuuugagaacuaaug

SEQ ID NO: 70567 - RNA, 63 nt, Homo Sapiens
aagacuuaaauguaaaaccccaaacuauaaaaacucuggaagauaaccuaggcaauaccauuc

SEQ ID NO: 70568 - RNA, 63 nt, Homo Sapiens
cuggccuggccugaccaaugagaggccagaacacucuggaacaucggaagaggaguucuuugc

SEQ ID NO: 70569 - RNA, 63 nt, Homo Sapiens
gugggagacggcuuuguccuggggacacuuucccucuggaaucucaagacgacguggcacaca

SEQ ID NO: 70570 - RNA, 63 nt, Homo Sapiens
cugagagcuggaggacaauauccagggacauggcucuggaaaauaacuuuuuuuuuuuuaaga

SEQ ID NO: 70571 - RNA, 63 nt, Homo Sapiens
gauagggaggugaguccucucuaucuccucuggcucuggaagcaccuugaaaaugugcauuuu

SEQ ID NO: 70572 - RNA, 63 nt, Homo Sapiens
caauuacaagacggggagugagacuccugauugcucuggaagccugcugauuucuacaacuga

SEQ ID NO: 70573 - RNA, 63 nt, Homo Sapiens
gccugcucugugucuguguugugaagcuugagacucuggaaagaaauggggagggggggcagg

SEQ ID NO: 70574 - RNA, 63 nt, Homo Sapiens
acccaucagcccuugcaagucccccacucaggccucuggaagguccagggaugggcucugaug

SEQ ID NO: 70575 - RNA, 63 nt, Homo Sapiens
ugcuaugaggguguauauauuuuuuacccaaagcucuggaauuguacauuuauuuuuuaaaac

SEQ ID NO: 70576 - RNA, 63 nt, Homo Sapiens
gccgagccaguggcggcugguaucccgcggcggcucuggaagcuggacgcggaccacggcccg

SEQ ID NO: 70577 - RNA, 63 nt, Homo Sapiens
agaacugggaacauugcauccauggguugaugucucuggaagugcaaccacccaaugucucug

SEQ ID NO: 70578 - RNA, 63 nt, Homo Sapiens
guugaugucucuggaagugcaaccacccaaugucucuggaagugccaccuggaagugccaccu

SEQ ID NO: 70579 - RNA, 63 nt, Homo Sapiens
gaagugccaccuggaagugccaccuggaagugucucuggaagagcacccaccacuguucagcc

SEQ ID NO: 70580 - RNA, 63 nt, Homo Sapiens
uaggcagaggcuccgcggcaggaggagccggugcucuggaagaccugaaagaagcccaggugg

SEQ ID NO: 70581 - RNA, 63 nt, Homo Sapiens
aauuagaacauauuugcauaagauagcuauuuacucuggaaaccaacaacuuuugagauuucc

SEQ ID NO: 70582 - RNA, 63 nt, Homo Sapiens
cagaauuuugauagaaaaccauggggccaagagcucuggaagccuggccggaaagaccaaggu

SEQ ID NO: 70583 - RNA, 63 nt, Homo Sapiens
gcgagagucggagauaugacugacugauuccuucucuggaauaguuacuuuacaacacggucu

SEQ ID NO: 70584 - RNA, 63 nt, Homo Sapiens
cccucucccuucccugcugccuugcagugaccccucuggaacucaggacucgauuuuaaggac

SEQ ID NO: 70585 - RNA, 63 nt, Homo Sapiens
caugccuucccuagaaccggaggccccggacuucucuggaaaaccgccugucugcaggcccga

SEQ ID NO: 70586 - RNA, 63 nt, Homo Sapiens
uucuacauaaaugggaucauuuuauacauggugcucuggaacccacauuuuucaugcagucau

SEQ ID NO: 70587 - RNA, 60 nt, Homo Sapiens; identical to SEQ ID NO: 69541

SEQ ID NO: 70588 - RNA, 63 nt, Homo Sapiens
ugagauuguaggugauauuuaaaugguuuuuuccucuggaagaagauucaagggaaaggcacu

SEQ ID NO: 70589 - RNA, 63 nt, Homo Sapiens
aaagaauccuuagaugccuauugaauagauuuucucuggaaauagaggaggucagcaaagguc

SEQ ID NO: 70590 - RNA, 63 nt, Homo Sapiens
acccuuccggaacccuucggggaggggaaugcgcucuggaaacaagcuggauauccuggggga

SEQ ID NO: 70591 - RNA, 63 nt, Homo Sapiens
gaggcaguagcaaagagaugccuucuugugcugcucuggaagacccgcaaguccauuuuauuu

SEQ ID NO: 70592 - RNA, 63 nt, Homo Sapiens
gacaccccagccagggacggaucaucucugucacucuggaaggcucaccuugagcagccucag

SEQ ID NO: 70593 - RNA, 63 nt, Homo Sapiens
caggacucugggguuuuacacuccaaaggaggccucuggaaccacccccuuccagggccucug

SEQ ID NO: 70594 - RNA, 63 nt, Homo Sapiens
gccuggaaacugggcacagagcccagcuuccuucucuggaaaauuccaagccuagagccacca

SEQ ID NO: 70595 - RNA, 63 nt, Homo Sapiens
gccaauccauccuucccccaucuguaaagucuccucuggaaauucccaugagaucaggcgcca

SEQ ID NO: 70596 - RNA, 63 nt, Homo Sapiens
guccaagaacgaaccugccagagaugagucacacucuggaacugccgugcgucccucuuagga

SEQ ID NO: 70597 - RNA, 63 nt, Homo Sapiens
cacauggcuucaccugucccuuuccauugugggcucuggaaacaaagaaaaugagcagauuuc

SEQ ID NO: 70598 - RNA, 63 nt, Homo Sapiens
gucuggacuagguguugaaguucagacaacuuucucuggaaggcgucuaccaaguacgauguc

SEQ ID NO: 70599 - RNA, 63 nt, Homo Sapiens
caagcucugccucuccggguugugcugagauuucucuggaaaaauaacaggcagccucaagaa

SEQ ID NO: 70600 - RNA, 63 nt, Homo Sapiens
caccguggcagaaaccgaggagccugacagaaucucuggaauguugagcuccaagcacagcaa

SEQ ID NO: 70601 - RNA, 63 nt, Homo Sapiens
ugagcuccaagcacagcaaacgcacagccagugcucuggaaauuggagaucuuggaacugaaa

SEQ ID NO: 70602 - RNA, 63 nt, Homo Sapiens
caaggaggagacuucauuuauuucuuuggcauucucuggaaugugcauuuccuguuuuccuuu

SEQ ID NO: 70603 - RNA, 63 nt, Homo Sapiens
uuucccuucgaucuuaucucucagaaucugcugcucuggaauaaaucuuuggaagccuugagu

SEQ ID NO: 70604 - RNA, 63 nt, Homo Sapiens
cugaggcacacuucaccaucauacguaaauuuucucuggaaggccuauuuuaaaauagugaau

SEQ ID NO: 70605 - RNA, 63 nt, Homo Sapiens
agccaagaaaagagaauauuugaaauguugggacucuggaacuacuuuggggaaacacuuugc

SEQ ID NO: 70606 - RNA, 63 nt, Homo Sapiens
aagccuauuuccuccagccauguauaaggacaacucuggaaacaaacugcuuuuuauacauuu

SEQ ID NO: 70607 - RNA, 63 nt, Homo Sapiens
cucucuggaggguuaacucugggcugucugaggcucuggaaugguuugcugaaaaaagcucug

SEQ ID NO: 70608 - RNA, 63 nt, Homo Sapiens
agcacacuugauuccucacuaguucauaaucagcucuggaacaaaugacccgcuuuucuagaa

SEQ ID NO: 70609 - RNA, 63 nt, Homo Sapiens
uccucacgguauauugauguccuuuugcagggacucuggaaugaugaacugcagcucacgaga

SEQ ID NO: 70610 - RNA, 63 nt, Homo Sapiens
agcuuuugcagaggaguggugguuggcgagcaucucuggaaaucggcuccucugauccuuuag

SEQ ID NO: 70611 - RNA, 63 nt, Homo Sapiens
gcuggugaggacucugccuccuaacuggccuggcucuggaaggacucugcagggcugcccucu

SEQ ID NO: 70612 - RNA, 63 nt, Homo Sapiens
cuauucaauacauuaugcuuaaauuagcaguuucucuggaauuccugucucuccuuuaaaaga

SEQ ID NO: 70613 - RNA, 63 nt, Homo Sapiens
uguugauaucgucauauaaagccauugcaaggacucuggaaacugccgccaaugaccaauuuc

SEQ ID NO: 70614 - RNA, 63 nt, Homo Sapiens
ugcagcuuggcauucuucuuauucuagaggucucucuggaaaagauggagaaaaugaacagga

SEQ ID NO: 70615 - RNA, 63 nt, Homo Sapiens
auguaaugcuuccaaucuugugacucucugacccucuggaaaucucucacccauaaacaguaa

SEQ ID NO: 70616 - RNA, 60 nt, Homo Sapiens; identical to SEQ ID NO: 69570

SEQ ID NO: 70617 - RNA, 63 nt, Homo Sapiens
ugaggaagugaacauuucggaagaaacagaauccucuggaacuaauacuggcucugucugagu

SEQ ID NO: 70618 - RNA, 63 nt, Homo Sapiens
caccucugcugucacugcucgaagcagcagucucucuggaagcaucugugucauggccaucgc

SEQ ID NO: 70619 - RNA, 63 nt, Homo Sapiens
ucagauggacucuagaagcacugagcucccugucucuggaaguauuuaagaaaaggcugggcc

SEQ ID NO: 70620 - RNA, 63 nt, Homo Sapiens
auaaaaauaaaaauaaauauuggcgggggaacccucuggaaucaauaaaggcuuccuuaacca

SEQ ID NO: 70621 - RNA, 63 nt, Homo Sapiens
ccaccccauuccagauauagaauguuucuaucucucuggaagguuccugcauguuauauggcu

SEQ ID NO: 70622 - RNA, 63 nt, Homo Sapiens
uucuugcugaaccguuugugauugccauuugagcucuggaagccucuauugccaugagaguuc

SEQ ID NO: 70623 - RNA, 62 nt, Homo Sapiens; identical to SEQ ID NO: 70100

SEQ ID NO: 70624 - RNA, 63 nt, Homo Sapiens
gcagcccaugcucuucuguacugucaugcccgucucuggaauguccacucccagagccugccc

SEQ ID NO: 70625 - RNA, 63 nt, Homo Sapiens
agggggaggcccagggcuggugagucuagaaugcucuggaacccuacaccuagugaugugugu

SEQ ID NO: 70626 - RNA, 63 nt, Homo Sapiens
caucuguccccucauuuuugagaucccccaauucucuggaacuauucugcugccccuuuuuau

SEQ ID NO: 70627 - RNA, 63 nt, Homo Sapiens
gugcguucugcauagaauucguggccccauagccucuggaacuccccuaggucugggugggca

SEQ ID NO: 70628 - RNA, 63 nt, Homo Sapiens
aucaucccgcuucucuccgguuggaggaggacgcucuggaaccgccgcuggggccucggagac

SEQ ID NO: 70629 - RNA, 63 nt, Homo Sapiens
acuuggcucugccccauggggccuccaagccaccucuggaaauccucuccccgccaccccagg

SEQ ID NO: 70630 - RNA, 63 nt, Homo Sapiens
cgcaccuuuaacuuugcagaucaccccuucugacucuggaaacuucccaggaggagccccgcu

SEQ ID NO: 70631 - RNA, 63 nt, Homo Sapiens
cucaggauucucacgacucucugguuugaaagccucuggaaaaguucccauuuucgcuuuccu

SEQ ID NO: 70632 - RNA, 63 nt, Homo Sapiens
gucaccuuuucgggcgcagcuguggcuugguuucucuggaaaucagggcggcccuguacuuuu

SEQ ID NO: 70633 - RNA, 63 nt, Homo Sapiens
gugguucccagggaugggccagggggaggcccccucuggaaauagggggccaaugggggccuc

SEQ ID NO: 70634 - RNA, 63 nt, Homo Sapiens
cauuuguuaaaaaaaaaaaaaacucgagcaggucucuggaagcccugcacgcccaccccauga

SEQ ID NO: 70635 - RNA, 63 nt, Homo Sapiens
ggccuugcccgguccccuucaucacccacaacccucuggaaguacccgcagacccuuaaaaaa

SEQ ID NO: 70636 - RNA, 63 nt, Homo Sapiens
gcuugaggaugugguucucggggcaccagguugcucuggaagaggccuucacucagggucagc

SEQ ID NO: 70637 - RNA, 63 nt, Homo Sapiens
cuuuuucgacugccccaacucagccacaccagacucuggaaccuucugccgugaaaccccagc

SEQ ID NO: 70638 - RNA, 63 nt, Homo Sapiens
gcugggguaguuggugagcacucuguucacagucucuggaaaaucuaguuggccagcgucuug

SEQ ID NO: 70639 - RNA, 63 nt, Homo Sapiens
cauggcuuuauuuucuuaaucaagugcuaaacgcucuggaaagagaagcacaaguacguuaaa

SEQ ID NO: 70640 - RNA, 63 nt, Homo Sapiens
ugagauguuguuugauagcaccacgaaagauuucucuggaacaacauuaacugacgcuuccuu

SEQ ID NO: 70641 - RNA, 63 nt, Homo Sapiens
cugcauguauuguagcuguguccugcauccucucucuggaaggacucuugaggacccccaccc

SEQ ID NO: 70642 - RNA, 63 nt, Homo Sapiens
ccccccaacugggaauugagagguaaggucuuucucuggaaauccagcaguagaggaagggac

SEQ ID NO: 70643 - RNA, 63 nt, Homo Sapiens
aacugccccuuccauggaaaagcuggaaaaaaacucuggaacccauauccaggcuuggugagg

SEQ ID NO: 70644 - RNA, 63 nt, Homo Sapiens
cuagugaagccuguuucguugaacuaauucuggcucuggaaauguuuuuguuuuauaguuauu

SEQ ID NO: 70645 - RNA, 63 nt, Homo Sapiens
uccauuauuaacugauuaaugcacuuugaaguucucuggaauuaauuauuuuaacuuggccua

SEQ ID NO: 70646 - RNA, 63 nt, Homo Sapiens
acacuucccacugauccauggggccuuuaagcccucuggaagcuuccauuaaagaugauuauu

SEQ ID NO: 70647 - RNA, 63 nt, Homo Sapiens
gugcaacugcugcaggaugccuguaguagggaacucuggaaguguauugggcugaggugggau

SEQ ID NO: 70648 - RNA, 63 nt, Homo Sapiens
ucucccugcacucccuccuggagcucugugggucucuggaagaggaaccaggagaagggcugg

SEQ ID NO: 70649 - RNA, 63 nt, Homo Sapiens
ucaaaauuguuuauacacucuuuccuccaugagcucuggaagguauaugcaucuucuguaaua

SEQ ID NO: 70650 - RNA, 63 nt, Homo Sapiens
auugauagucccuugaacacacaugcugccgagcucuggaaaaaccccacaggugaguccuca

SEQ ID NO: 70651 - RNA, 63 nt, Homo Sapiens
gaccauuuucugguucuguguccucugccugggcucuggaagaggccuucccauggccauuuc

SEQ ID NO: 70652 - RNA, 63 nt, Homo Sapiens
cacucucagccacagggagcgagaugcacuccgcucuggaacugcuggcagagaugcauucca

SEQ ID NO: 70653 - RNA, 63 nt, Homo Sapiens
gcuacauagucaucauuaguuuugccuuuaaaacucuggaagauaacuguaggccaauauaga

SEQ ID NO: 70654 - RNA, 63 nt, Homo Sapiens
ugauuuuuguguaucugagauaaaugcuuugcccucuggaacuugcucguuguggacuguaau

SEQ ID NO: 70655 - RNA, 63 nt, Homo Sapiens
gaaaggcccuguaaagcccuuuuucugcaugaacucuggaacacagcuuaccugccacagagc

SEQ ID NO: 70656 - RNA, 63 nt, Homo Sapiens
gaccagaguuaagcucucgggccagcagguugucucuggaaacgcugggcgcaucccaagaca

SEQ ID NO: 70657 - RNA, 63 nt, Homo Sapiens
auuuucaaaagcuuaaggcccaaauacaaacuucucuggaauaaacgugguguuuuauuuucu

SEQ ID NO: 70658 - RNA, 63 nt, Homo Sapiens
ccaagccuuggcucguucucuucucucuucaaucucuggaaaaauaaguacauauaguugaua

SEQ ID NO: 70659 - RNA, 63 nt, Homo Sapiens
ugccuggaaauuaaacccugccccacuucucuacucuggaaguccccgggagccucuccuugc

SEQ ID NO: 70660 - RNA, 63 nt, Homo Sapiens
uuauuuugguuaauguaauauaaauaggaccuucucuggaaaaaagccagugagcauuacuuu

SEQ ID NO: 70661 - RNA, 63 nt, Homo Sapiens
uugcuuuuagcagggaaagcuuugcugcuuuugcucuggaacuuaucccucccauauuuucuu

SEQ ID NO: 70662 - RNA, 63 nt, Homo Sapiens
gggugcucauguugguuuuaauugugucuguaucucuggaacuccucaugaacacuaagauua

SEQ ID NO: 70663 - RNA, 63 nt, Homo Sapiens
caacgaaggcaaugcugcucaccagccagaagccucuggaagggguggacuccguggggcucc

SEQ ID NO: 70664 - RNA, 63 nt, Homo Sapiens
ucugugauccuuugcagguucaguucucccugacucuggaacccucuggaaccucugugacgc

SEQ ID NO: 70665 - RNA, 63 nt, Homo Sapiens
ucugugacgccaguucuccccaguucucccugacucuggaaccuuucacucagcugcuccucu

SEQ ID NO: 70666 - RNA, 63 nt, Homo Sapiens
aucucugggguuugcuuguucauguuacauuugcucuggaaacgcucuguguacagcgcugug

SEQ ID NO: 70667 - RNA, 63 nt, Homo Sapiens
gucugugaugcucccaagcaaaggaaaugcaagcucuggaaauucguuaauguauuugauguc

SEQ ID NO: 70668 - RNA, 63 nt, Homo Sapiens
ucagggccuccagcccucucacugugucccucucucuggaaaggaggaaggagccuauggcau

SEQ ID NO: 70669 - RNA, 63 nt, Homo Sapiens
auucucucucagccacaguggagcaaauucauccucuggaaauugagaagcacuuggcuggcu

SEQ ID NO: 70670 - RNA, 63 nt, Homo Sapiens
ugaagcccugagaaggagagagcuccccuggggcucuggaaccugacccugccccuggcuggg

SEQ ID NO: 70671 - RNA, 63 nt, Homo Sapiens
ccucugcccccuccccaacauuuuaguuuugaacucuggaauuaugacuuugauuccugcgcc

SEQ ID NO: 70672 - RNA, 63 nt, Homo Sapiens
ccaaagcagcucaucccuucuagccagugagugcucuggaaagguggaauacccaaggucaug

SEQ ID NO: 70673 - RNA, 63 nt, Homo Sapiens
ucuuuguguuagggucucgauuucuaagccacucucuggaaucauugguaagaguagcugggu

SEQ ID NO: 70674 - RNA, 63 nt, Homo Sapiens
ugcaggccagaugguugcugacgccugacuccccucuggaaacguucacuccagucccacccc

SEQ ID NO: 70675 - RNA, 63 nt, Homo Sapiens
agcgugugaaacagcgggggcuugcuggacaaacucuggaagccuguaugcauucauuuauuc

SEQ ID NO: 70676 - RNA, 63 nt, Homo Sapiens
ucugcuuagaauucugagagacugaucugugagcucuggaaugaggguagcagcuggugggac

SEQ ID NO: 70677 - RNA, 63 nt, Homo Sapiens
gugcuccucacaaaguuuccgcugcugugggcccucuggaauuugucacgccaggaggcugug

SEQ ID NO: 70678 - RNA, 63 nt, Homo Sapiens
uggcaguguguaaagcacugcacggaugauaagcucuggaagccuuggcgucuguucugggag

SEQ ID NO: 70679 - RNA, 63 nt, Homo Sapiens
aauaaggcugccuuggaggcaggccuucuuuagcucuggaaagggagugggcgcaggcacgcc

SEQ ID NO: 70680 - RNA, 63 nt, Homo Sapiens
ugggauuuguggcagggauuccacucagaaccucucuggaauuugugccugaugugccuucca

SEQ ID NO: 70681 - RNA, 63 nt, Homo Sapiens
uuuccuacaaguuaaccaguugcacuacauaaucucuggaaauuaauuuucucuuuaggagaa

SEQ ID NO: 70682 - RNA, 63 nt, Homo Sapiens
auugucuacccaaucaacaguuuucccucuuugcucuggaaauauuuguacucauauagcaua

SEQ ID NO: 70683 - RNA, 63 nt, Homo Sapiens
caaaugcuuuuccaacccaugagugcuaagagccucuggaagggagggcuucaggcccgaagg

SEQ ID NO: 70684 - RNA, 63 nt, Homo Sapiens
uugaaauuaccugauaacuuaagacucugugaucucuggaaucaccauauguuucuuuuuugu

SEQ ID NO: 70685 - RNA, 63 nt, Homo Sapiens
aucaggggugguuacauagaccagcagcuacagcucuggaaauugaaaucauaaucugucaau

SEQ ID NO: 70686 - RNA, 63 nt, Homo Sapiens
uggcuguggaguaagagggaaugcggugaggcacucuggaauaugacccuaccagagguugga

SEQ ID NO: 70687 - RNA, 63 nt, Homo Sapiens
uuuaacucuagaaauucucaguaugggguuucccucuggaaaaagaaaaucugaagacauuac

SEQ ID NO: 70688 - RNA, 63 nt, Homo Sapiens
gguuaaacaaaccauccauaacuuggaauacugcucuggaaugaaaaggaacuaacuguugau

SEQ ID NO: 70689 - RNA, 63 nt, Homo Sapiens
uguggacaaaccguaggaauagcuacucuucagcucuggaaguucugcccuuugauguccuug

SEQ ID NO: 70690 - RNA, 63 nt, Homo Sapiens
gaaggaacuagguaggagagugugucccuguagcucuggaacuggguguuuccgugacuuagc

SEQ ID NO: 70691 - RNA, 63 nt, Homo Sapiens
uuugcuguagcaucuggucuucuagguucauuucucuggaacaggagcaccccgggaucauuu

SEQ ID NO: 70692 - RNA, 63 nt, Homo Sapiens
ccaaggcuccccgugcuucuccuggucaccgcucucuggaaaagaauucccagagcagacuua

SEQ ID NO: 70693 - RNA, 63 nt, Homo Sapiens
ggcauauauguacuaguggcgauccugcacugacucuggaaaauaaagacuugcacaaauacg

SEQ ID NO: 70694 - RNA, 63 nt, Homo Sapiens
agacaugagaaccugguaacauucauaaguuaucucuggaaagugguaaguacauaauuguga

SEQ ID NO: 70695 - RNA, 63 nt, Homo Sapiens
cacaguguugugcaccaggaacugggcacuucccucuggaaauacaacaguaucuuaaguuua

SEQ ID NO: 70696 - RNA, 63 nt, Homo Sapiens
cugauucagccagcauggaugcucuggucccaccucuggaaaugagcucuuuaaaaauaaauu

SEQ ID NO: 70697 - RNA, 63 nt, Homo Sapiens
aaggaugucaagaaggugaacagcuacugagagcucuggaaagacagaaaagaaaagcagagu

SEQ ID NO: 70698 - RNA, 63 nt, Homo Sapiens
guccucuguauccucaugaguaugucauguagccucuggaaaaugagagagaugacauaacca

SEQ ID NO: 70699 - RNA, 62 nt, Homo Sapiens
accugaggugucauaucuuuuaaagaaacugcagcgccuuagaucucuauaaaaagaaaaaa

SEQ ID NO: 70700 - RNA, 63 nt, Homo Sapiens
gauguucuagcauggcugccacacaagccuucggcgccuuaaggcuugaccgugaggccagag

SEQ ID NO: 70701 - RNA, 63 nt, Homo Sapiens
gauaggucaucucagcccaacauggaggcaguggcgccuuaugcauaaccaaaguuguagggg

SEQ ID NO: 70702 - RNA, 63 nt, Homo Sapiens
guaucaauuuuaggagcuuuaaaacuuaagguggcgccuuauaaugcacaguugcagccugga

SEQ ID NO: 70703 - RNA, 63 nt, Homo Sapiens
cuccguauuucagacugaauggggguggggggggcgccuuagguacuuauuccagaugccuuc

SEQ ID NO: 70704 - RNA, 63 nt, Homo Sapiens
aaucauaaauucucaucagaggucuagggagucgcgccuuacagcccaaauuccuaccuaagg

SEQ ID NO: 70705 - RNA, 63 nt, Homo Sapiens
ccgucccgccccaggcccgggccugacaagaaagcgccuuacguuucuccgccccccgcccgc

SEQ ID NO: 70706 - RNA, 63 nt, Homo Sapiens
ucgagucggauccguguuggggcccggccgagagcgccuuagcaaguugcccucuccgagcua

SEQ ID NO: 70707 - RNA, 63 nt, Homo Sapiens
gcauaucaaaugguaguuagagggucggcuuuugcgccuuaaauagauuuuuuagaaaaacua

SEQ ID NO: 70708 - RNA, 63 nt, Homo Sapiens
cugccccugugguagagcccacuauaggcccaggcgccuuacgugcuucuccccuggaccuau

SEQ ID NO: 70709 - RNA, 63 nt, Homo Sapiens
gguuugccaaagccauccuuccucggacccggcgcgccuuacucuucaccaguaugaggguag

SEQ ID NO: 70710 - RNA, 63 nt, Homo Sapiens
ugagaagcauaaguguaacugaagccuugccuugcgccuuaggcauguuuauuuggguaggag

SEQ ID NO: 70711 - RNA, 63 nt, Homo Sapiens
guagcuccagggaacgcauguggauccuagacagcgccuuaucuaugauugaguguccgugua

SEQ ID NO: 70712 - RNA, 63 nt, Homo Sapiens
uuauuggacuaucuaauauccuccguugcacgggcgccuuaagcccgugcgcgcggauccucg

SEQ ID NO: 70713 - RNA, 63 nt, Homo Sapiens
gccccuaagccagcaugggcccugugagucugggcgccuuagauaaaggagcucuucacagca

SEQ ID NO: 70714 - RNA, 63 nt, Homo Sapiens
uucuugaagaaaggcaaaucugacuuuuucugugcgccuuaaacaauucuuguaacuuucuuc

SEQ ID NO: 70715 - RNA, 63 nt, Homo Sapiens
accacauccuuagagccaucaccuggcacgcaggcgccuuacauucuacgguagaacgugggg

SEQ ID NO: 70716 - RNA, 63 nt, Homo Sapiens
uuccugguugcacaaaagguaccaugggauccggcgccuuacucuagaaagcuacccugguug

SEQ ID NO: 70717 - RNA, 63 nt, Homo Sapiens
cugcugcccugggcuuuuggguccuggccgauggcgccuuaccgggcugccccugccgugcag

SEQ ID NO: 70718 - RNA, 63 nt, Homo Sapiens
gucaugauaggacaauauuuuaugugugugugugcgccuuauguauauaagcauauauauaau

SEQ ID NO: 70719 - RNA, 63 nt, Homo Sapiens
ucucugugauacaacaauaguauuucuucaaaugcgccuuaugcuacuuaucucagaaacagg

SEQ ID NO: 70720 - RNA, 63 nt, Homo Sapiens
agacagcagcaagccggauccaccaacaccgcagcgccuuaugaccccggaaccgagccagcc

SEQ ID NO: 70721 - RNA, 63 nt, Homo Sapiens
uugggaggccucauuggccaguuccuggaggcggcgccuuagaaggaaugggccuggcuuucc

SEQ ID NO: 70722 - RNA, 64 nt, Homo Sapiens
uaaaugucugcagagagauggauggauggauggauagauggauggauggguuggggaguggggg

SEQ ID NO: 70723 - RNA, 64 nt, Homo Sapiens
uggauggguuggggaguggggguggauggauggauagauggauggauggauggauggauggguu

SEQ ID NO: 70724 - RNA, 64 nt, Homo Sapiens
uggauggauggguugggggguggggguggauggauagauggauggauggauggacggauggggu

SEQ ID NO: 70725 - RNA, 64 nt, Homo Sapiens
uuucauuuugucuucuucuuuuuuuuucuuuuuuuagauggaguuuggcucuugucacccaggc

SEQ ID NO: 70726 - RNA, 64 nt, Homo Sapiens
gcucuucuuaaauauacauuauaaagagcaagcauagauggaaagugcauauugaacacaucug

SEQ ID NO: 70727 - RNA, 64 nt, Homo Sapiens
ggaucugaucuuagcaauuuuccaagaaccauauuagauggauaucgaccucguugaaaagaaa

SEQ ID NO: 70728 - RNA, 64 nt, Homo Sapiens
cgaccucguugaaaagaaaucaucaccaaugucuuagauggaaucgaaagcggagaguguauga

SEQ ID NO: 70729 - RNA, 64 nt, Homo Sapiens
augcuauuggcagggaauaagaauuuaaauguguuagauggaaauguuugcaauuaugcuguga

SEQ ID NO: 70730 - RNA, 64 nt, Homo Sapiens
uagaagcauuucucugcagggggcaaggaggugauagauggauacuuagcauugggaagacaga

SEQ ID NO: 70731 - RNA, 64 nt, Homo Sapiens
cagcccagaacucuguaacuuuucagaacugcuauacucaaacuugcagaucucacaucaagga

SEQ ID NO: 70732 - RNA, 64 nt, Homo Sapiens
uuuucuuuacauaaauauugauauauucuuuuucuacucaaagugccaaaggcuacaguuuuua

SEQ ID NO: 70733 - RNA, 64 nt, Homo Sapiens
aauguaaaucuuuaaaaauaauaggauuagaacuuacucaaaauggugacaucugcaucauuuc

SEQ ID NO: 70734 - RNA, 64 nt, Homo Sapiens
aauauauuuagaauuauguaaaguaaacauguauuacucaaaguauacuuaauauaguaaaucu

SEQ ID NO: 70735 - RNA, 64 nt, Homo Sapiens
cuuuuggguaaauaaaaaagucuaacuuucaguuuacucaaaaagaguugcuguuccuggagua

SEQ ID NO: 70736 - RNA, 64 nt, Homo Sapiens
acaauuugcacuguacacuaguauuugauguauuuacucaaaacaguucuguaagaaaugagug

SEQ ID NO: 70737 - RNA, 64 nt, Homo Sapiens
cuuauuguuugaaagacuuaauaacaucugggucuacucaaacaaagaaauuuuagauauuauc

SEQ ID NO: 70738 - RNA, 64 nt, Homo Sapiens
gcauugggcugaguaaguaacauacuucuuucacuacucaaaugacaugaaucucuaacagcuc

SEQ ID NO: 70739 - RNA, 64 nt, Homo Sapiens
ugaaugaaaaaacauaguuuaccaaaugucaguguacucaaacucuuuuaacugcuagcuauag

SEQ ID NO: 70740 - RNA, 64 nt, Homo Sapiens
uuaaggaaggauuucaggcauggcuugauccagcuacucaaaaaagguugucagaaaugucugu

SEQ ID NO: 70741 - RNA, 64 nt, Homo Sapiens
cagagaacuuuccagguuuauacuauaccucaagaccacauagauuagcuacugcuuauucuuu

SEQ ID NO: 70742 - RNA, 64 nt, Homo Sapiens
uucuccuccuccagaccuaguauucuaaguuauuaccacauaguauuuuuauguuacccaucau

SEQ ID NO: 70743 - RNA, 64 nt, Homo Sapiens
ggaccauuuuaucaaaguucguucauuuccguuaaccacauaacuaauaauuuaauuguuauuc

SEQ ID NO: 70744 - RNA, 64 nt, Homo Sapiens
gaguuaggcuaaauacaucagaaguguucuacugaccacauaagaaguuaguauugccaaucuu

SEQ ID NO: 70745 - RNA, 64 nt, Homo Sapiens
aaggcaaaaagauugucaaaauaaaaacaauaauucaaguaacaaugcccggaauauacguccu

SEQ ID NO: 70746 - RNA, 64 nt, Homo Sapiens
uucuaaaaucaaggugaaauuugaacagaaugguucaaguaaaaauucucaucuggucuccccu

SEQ ID NO: 70747 - RNA, 64 nt, Homo Sapiens
acugaaaaugugaaaguaacggcuuuggagacaaucaaguaacauauaugucugauacauauac

SEQ ID NO: 70748 - RNA, 64 nt, Homo Sapiens
uaccuguuugaagcuuuaaggaauauacuuuuccucaaguaauaauucauccuuaguacacaga

SEQ ID NO: 70749 - RNA, 64 nt, Homo Sapiens
gugucagcauuccuauuaaugucucacuuuacuuucaaguaauauuggugcuauuuaacauuuu

SEQ ID NO: 70750 - RNA, 64 nt, Homo Sapiens
uacacauaguucuguaauaaaacuguuugacuucucaaguaacaugacuuccuuauuucugaac

SEQ ID NO: 70751 - RNA, 64 nt, Homo Sapiens
gggaaauacacuguugcuaauacugaaauuacaaucaaguaacuaaggccuugaguucauaugu

SEQ ID NO: 70752 - RNA, 64 nt, Homo Sapiens
cccaacuugugaucuucuaccacuuuagagacauucaaguaauaguuuucuuagagcuuugcac

SEQ ID NO: 70753 - RNA, 64 nt, Homo Sapiens; identical to SEQ ID NO: 70741

SEQ ID NO: 70754 - RNA, 64 nt, Homo Sapiens; identical to SEQ ID NO: 70742

SEQ ID NO: 70755 - RNA, 64 nt, Homo Sapiens; identical to SEQ ID NO: 70743

SEQ ID NO: 70756 - RNA, 64 nt, Homo Sapiens; identical to SEQ ID NO: 70744

SEQ ID NO: 70757 - RNA, 64 nt, Homo Sapiens; identical to SEQ ID NO: 70745

SEQ ID NO: 70758 - RNA, 64 nt, Homo Sapiens; identical to SEQ ID NO: 70746

SEQ ID NO: 70759 - RNA, 64 nt, Homo Sapiens; identical to SEQ ID NO: 70747

SEQ ID NO: 70760 - RNA, 64 nt, Homo Sapiens; identical to SEQ ID NO: 70748

SEQ ID NO: 70761 - RNA, 64 nt, Homo Sapiens; identical to SEQ ID NO: 70749

SEQ ID NO: 70762 - RNA, 64 nt, Homo Sapiens; identical to SEQ ID NO: 70750

SEQ ID NO: 70763 - RNA, 64 nt, Homo Sapiens; identical to SEQ ID NO: 70751

SEQ ID NO: 70764 - RNA, 64 nt, Homo Sapiens; identical to SEQ ID NO: 70752

SEQ ID NO: 70765 - RNA, 64 nt, Homo Sapiens
ugccugagucacccaugaagacaggacagugcuucagccugaggcugagacugcgggauggucc

SEQ ID NO: 70766 - RNA, 64 nt, Homo Sapiens
ggcugcagcgagcuaugaucgcgccacuacacuccagccugagcaacagagugagacccugucu

SEQ ID NO: 70767 - RNA, 64 nt, Homo Sapiens
ggacagcgucggccugauuucccguaaaggugugcagccugagagacgggaagaggaggccucu

SEQ ID NO: 70768 - RNA, 64 nt, Homo Sapiens
agaggaggccucuggaccugcuggucugcacugacagccugaagggucuacacccucggcucac

SEQ ID NO: 70769 - RNA, 64 nt, Homo Sapiens
uccagcggucccaagaacacccgcucagaggcuucagccugacuccuucucucugcuagaguug

SEQ ID NO: 70770 - RNA, 64 nt, Homo Sapiens
ccaaggacagcacuugucauacugccucuggagccagccugacagaggugaagaggagauggac

SEQ ID NO: 70771 - RNA, 64 nt, Homo Sapiens
uccuauccucuaccacucucccacauguguugugcagccugagcugggcgcugccuuccuuucu

SEQ ID NO: 70772 - RNA, 64 nt, Homo Sapiens
agaugggcggaucaugaagucaggaguucgagaccagccugaccaacauggugaaaccccgucu

SEQ ID NO: 70773 - RNA, 64 nt, Homo Sapiens
gguugcagugagccgagauugugccccugcacuccagccugagcgacagugagacucugucuca

SEQ ID NO: 70774 - RNA, 64 nt, Homo Sapiens
gcaaaaugugauauguaccuaacgaaguauccuucagccugaaagaggaaugaaguacucauac

SEQ ID NO: 70775 - RNA, 64 nt, Homo Sapiens
ccuggggagcccgugaaggccgcacgggugccuccagccugagacaucaggggagagccugcag

SEQ ID NO: 70776 - RNA, 64 nt, Homo Sapiens
uccuuaucacugucuggucuccgagcuucggcugcagccugagguguguccugggcuccucaga

SEQ ID NO: 70777 - RNA, 64 nt, Homo Sapiens
gcaaccugacucucugcaucagaacacuccaauucagccugaguaauagggaacauuuucuuaa

SEQ ID NO: 70778 - RNA, 64 nt, Homo Sapiens
gcagcuguagaaacuuucccagugcuacuggcaacagccugagguuuucucauucaccucugca

SEQ ID NO: 70779 - RNA, 64 nt, Homo Sapiens
cuggccacccugccuggacgccagcuguucuucucagccugagcccugucccugcccuucucug

SEQ ID NO: 70780 - RNA, 64 nt, Homo Sapiens
uccccguucagaccagagugccccggccccuccccagccugagucuucuccuugcucugcgggg

SEQ ID NO: 70781 - RNA, 64 nt, Homo Sapiens
agcagagacggcagccccauccuucccgcagcaccagccugagccacaguggggcccauggccc

SEQ ID NO: 70782 - RNA, 64 nt, Homo Sapiens
gggucgccccuccucgggcgccugcgcuccucugcagccugagcuccacccuccccucuucuug

SEQ ID NO: 70783 - RNA, 64 nt, Homo Sapiens
ucccucgggcucgccugccacagcagugggugggcagccugagcauccguccuggcgauccugc

SEQ ID NO: 70784 - RNA, 64 nt, Homo Sapiens
uauuuuuguggacggaaucgaugguucggcaaagcagccugagucaacgccccugguggacagg

SEQ ID NO: 70785 - RNA, 64 nt, Homo Sapiens
uuugagcuggcuuguccaggcucaacagagacggcagccugaccugccagacaacuuguccuga

SEQ ID NO: 70786 - RNA, 64 nt, Homo Sapiens
aacauggugaaaccccaucucaagaauucgagaucagccugaccuauuugggaucauuugaggu

SEQ ID NO: 70787 - RNA, 64 nt, Homo Sapiens
cuucaccuccccgguucaagcaauucuccugccucagccugaagucgugaucugcccgccucgg

SEQ ID NO: 70788 - RNA, 64 nt, Homo Sapiens
auuguuguguuucugaaaagugaaauuuaaaaagcagccugaaaaauaaaaauuuauaauuugc

SEQ ID NO: 70789 - RNA, 64 nt, Homo Sapiens
aacaaaaugagacccuaucuacaccauugcacugcagccugaguggcugcagugagccaugucc

SEQ ID NO: 70790 - RNA, 64 nt, Homo Sapiens
gugcuagucucuguuuaaugucaaacaguugccccagccugacaccguaucaagcaucagucuc

SEQ ID NO: 70791 - RNA, 64 nt, Homo Sapiens
ucugggguccucacauggcguccugcccuugcuccagccugacaacagccugagaaaucccccc

SEQ ID NO: 70792 - RNA, 64 nt, Homo Sapiens
cacauggcguccugcccuugcuccagccugacaacagccugagaaauccccccguaacuuauua

SEQ ID NO: 70793 - RNA, 64 nt, Homo Sapiens
ccugugucccccgaacgcucugcaccuucugacgcagccugagaaugaccugcccuggccccag

SEQ ID NO: 70794 - RNA, 64 nt, Homo Sapiens
ccagucauuugauaaagauguuguuaaacugugucagccugagccuucaaaggguaaauuuaau

SEQ ID NO: 70795 - RNA, 64 nt, Homo Sapiens
gcggauggaucaccugaggucgggaauucgagaccagccugaccaacauggagaaacuccaucu

SEQ ID NO: 70796 - RNA, 64 nt, Homo Sapiens
gcugauccggggccacacggaggaggagccgccccagccugaggucugcaacaccaagaagugg

SEQ ID NO: 70797 - RNA, 64 nt, Homo Sapiens
gggaggccuggcuguggggauaguguggggcgaacagccugagcugaggauacccagguaccug

SEQ ID NO: 70798 - RNA, 64 nt, Homo Sapiens
ccucgucuccuuuccagugcccuccuggaaggcccagccugagucccuucucccaaauggcuuc

SEQ ID NO: 70799 - RNA, 64 nt, Homo Sapiens
cccggaagaauccucuucauguuuuagauugaaacagccugauuuguuuccacuuaucuuggau

SEQ ID NO: 70800 - RNA, 64 nt, Homo Sapiens
ucccacacuggggucaugagagcuaguuaguacucagccugaccccuaggucugguccugccag

SEQ ID NO: 70801 - RNA, 64 nt, Homo Sapiens
cugcucugggucagcugucagggagaccucccuucagccugagccaagcugcauugggaggaga

SEQ ID NO: 70802 - RNA, 64 nt, Homo Sapiens
ugagccucacauccuuuuccuugacuucucaacccagccugaaguccauugcgguuccgucacu

SEQ ID NO: 70803 - RNA, 64 nt, Homo Sapiens
cuaaucacuaacuccuuccuuuuccucugcaugccagccugaaaauuccaaaucuagccucuga

SEQ ID NO: 70804 - RNA, 64 nt, Homo Sapiens
gcuuuuuuuuggcuggcuuuguguucuucagccucagccugaagauccacagacaacucuauuu

SEQ ID NO: 70805 - RNA, 64 nt, Homo Sapiens
ucaacccaggugccccuggcggcuguccggaggucagccugauugagacacagugcgcuaguac

SEQ ID NO: 70806 - RNA, 64 nt, Homo Sapiens
agccaggagcagaagcaaagagcagacacacauacagccugaaacagaccuggacagacagaca

SEQ ID NO: 70807 - RNA, 64 nt, Homo Sapiens
cauacagccugaaacagaccuggacagacagacacagccugaaacagacccggacagacagaca

SEQ ID NO: 70808 - RNA, 64 nt, Homo Sapiens
gacacagccugaaacagacccggacagacagacacagccugaaacagacccagacaaacagaca

SEQ ID NO: 70809 - RNA, 64 nt, Homo Sapiens
cugaaacagacccagacaaacagacagacagacacagccugaaacagacccagacagacagaca

SEQ ID NO: 70810 - RNA, 64 nt, Homo Sapiens
cacagccugaaacagacccagacagacagacagacagccugaaacagacccagacacagccuga

SEQ ID NO: 70811 - RNA, 64 nt, Homo Sapiens
cagacagacagacagccugaaacagacccagacacagccugaaacagauccggacagacagaca

SEQ ID NO: 70812 - RNA, 64 nt, Homo Sapiens
cagccugaaacagauccggacagacagacagaaacagccugaaacagacccagacagacagaca

SEQ ID NO: 70813 - RNA, 64 nt, Homo Sapiens
cagccugaaacagacccagacagacagacagacacagccugaaacagacccggacagacagaca

SEQ ID NO: 70814 - RNA, 64 nt, Homo Sapiens
cagccugaaacagacccggacagacagacagacacagccugaaacagacccggacagacagaca

SEQ ID NO: 70815 - RNA, 64 nt, Homo Sapiens; identical to SEQ ID NO: 70814

SEQ ID NO: 70816 - RNA, 64 nt, Homo Sapiens
cagccugaaacagacccggacagacagacagacacagccugaaacagaccuagacagacagaca

SEQ ID NO: 70817 - RNA, 64 nt, Homo Sapiens
cagauugaaacagacccagacaaacagacagacacagccugaaacagacccagacacagccuga

SEQ ID NO: 70818 - RNA, 64 nt, Homo Sapiens
aacagacagacacagccugaaacagacccagacacagccugaaacagacccggacagacagaca

SEQ ID NO: 70819 - RNA, 64 nt, Homo Sapiens
cagccugaaacagacccggacagacagacagacacagccugaaacagacccagacagacagaca

SEQ ID NO: 70820 - RNA, 64 nt, Homo Sapiens
cagccugaaacagacccagacagacagacagacacagccugaaacagacccagacagacagacc

SEQ ID NO: 70821 - RNA, 64 nt, Homo Sapiens
cagccugaaacagacccagacagacagaccgacgcagccugaaagagacccagacagagagaca

SEQ ID NO: 70822 - RNA, 64 nt, Homo Sapiens
gaagcagcccccuguggcggccuuccgggucucgcagccugaagccuggauuccagcagugaau

SEQ ID NO: 70823 - RNA, 64 nt, Homo Sapiens
caagggcacauugcccauggcugggaacaugacccagccugaaagauacaggggaucauguuaa

SEQ ID NO: 70824 - RNA, 64 nt, Homo Sapiens
caccacuuucgugcaguaccaggcgccgcagcugcagccugacaggaugcagugaggggcguuc

SEQ ID NO: 70825 - RNA, 64 nt, Homo Sapiens
ucuucccucuacccccgcaccaccugcugugugccagccugagacgguuccugccugucuuggg

SEQ ID NO: 70826 - RNA, 64 nt, Homo Sapiens
ucacaacccaauaaaugggggcccuaagccaucucagccugaugacacucauccuugcuuucca

SEQ ID NO: 70827 - RNA, 64 nt, Homo Sapiens
aacauggagaaaccccaucucaggaguucgagaccagccugaccgcgggcagaucaccggaggu

SEQ ID NO: 70828 - RNA, 64 nt, Homo Sapiens
cacacgcuccuguugucaugaagugcggcaggaccagccugacgaguggaaaacaaaacccaga

SEQ ID NO: 70829 - RNA, 64 nt, Homo Sapiens
ugguucauggaggcuccuacgggcugaccccuuccagccugacucgcacgcugacggaccacga

SEQ ID NO: 70830 - RNA, 64 nt, Homo Sapiens
acauuauggguuuuauugcugugaaauaaauacaauaccagaguuacaugccagucauuucuca

SEQ ID NO: 70831 - RNA, 64 nt, Homo Sapiens
guucacaagugauggcucaugggaaauauuuuauauaccagaugcagaaacauuuuuuaaauaa

SEQ ID NO: 70832 - RNA, 64 nt, Homo Sapiens
gaggcccauuccugcauuugugaucauccucuagauaccagauauguccucauuuuguuuccua

SEQ ID NO: 70833 - RNA, 64 nt, Homo Sapiens
ccucuguccucauuuuguuuaccacuuuuagaagauaccagaugaugacaggcgggaguuuugu

SEQ ID NO: 70834 - RNA, 64 nt, Homo Sapiens
uguacagaaaugaagaugguucaguaccugcuacauaccagaucuauuacaugauaggauggaa

SEQ ID NO: 70835 - RNA, 64 nt, Homo Sapiens
cccuaccuuagggaagaagaaaacauuuuaaagaauaccagaaguagaaucacauguaacaguc

SEQ ID NO: 70836 - RNA, 64 nt, Homo Sapiens
cuguaaauauccaaguauaaagcccaggaacuucuagaauaacccagaugcgcuuuaauuuuuu

SEQ ID NO: 70837 - RNA, 64 nt, Homo Sapiens
aauuuuuuuuaauauguuuugaucacagaacuucuagaauaacccagaugcucuuucauauucu

SEQ ID NO: 70838 - RNA, 64 nt, Homo Sapiens
gagacagccaaacucugacaaaggcuuuuccuuauagaauaacccaaagccuaggugaggguug

SEQ ID NO: 70839 - RNA, 64 nt, Homo Sapiens
uuguuuaucaucuaauggcuguaaacuguaguacuagaauaaaaaaaauggaaaaucagcuuuu

SEQ ID NO: 70840 - RNA, 64 nt, Homo Sapiens
aaaccaauuuccugauggacuauuaaauucaucuuagaauaaauuagugaagaauuuaauuuua

SEQ ID NO: 70841 - RNA, 64 nt, Homo Sapiens
ucaucuuagaauaaauuagugaagaauuuaauuuuagaauaaauaauccaaucugaaauaauua

SEQ ID NO: 70842 - RNA, 64 nt, Homo Sapiens
aaaaaucuuucaacaaacugcuaucaauuucuuguagaauaaaauuucuuuaacaggauugcac

SEQ ID NO: 70843 - RNA, 64 nt, Homo Sapiens
aauggaaagcaacuugauauauauauuuuuaaaguagaauaaauuauuugaacaucauaguugu

SEQ ID NO: 70844 - RNA, 64 nt, Homo Sapiens
ucauacugaaauuauuuucuuagaauaauuuuauuagaauaauuauuaucuccuaauuguaugu

SEQ ID NO: 70845 - RNA, 64 nt, Homo Sapiens
uuauuagaauaauuucauacuccuaauuguauguuagaauaauuugaugaauaaaauaauuauc

SEQ ID NO: 70846 - RNA, 64 nt, Homo Sapiens
agaucacugaacuuuucaaaauaaagcuuuugcauagaauaaugaagaucuuuguuuuuuguuu

SEQ ID NO: 70847 - RNA, 64 nt, Homo Sapiens
ucuaacugugcaaagcagagugaaauucaauucauagaauaacaacugcugggaauauccgugc

SEQ ID NO: 70848 - RNA, 64 nt, Homo Sapiens
uucaagggauggcauaacuguaagaggucagugcuagaauaaaguccuguagguuuauuuugga

SEQ ID NO: 70849 - RNA, 64 nt, Homo Sapiens
uaaagaacacuggauuaauaaucuuuugggaggguagaauaaaauaauugauuacuauugcugc

SEQ ID NO: 70850 - RNA, 64 nt, Homo Sapiens
gccugaaauaaugggaguuuucuccuccacuuauuagaauaaggacccucagugacuaauuauu

SEQ ID NO: 70851 - RNA, 64 nt, Homo Sapiens
uuauaggucuaaaauuauaucuuaagguauguuguagaauaaauuaaaaggauaaucuaaauca

SEQ ID NO: 70852 - RNA, 64 nt, Homo Sapiens
uuccagaacuuagugggaagaggcaccauuauguuagaauaaauguacaguucuuuguacagaa

SEQ ID NO: 70853 - RNA, 64 nt, Homo Sapiens
ucuguauucauggauuggauuuugaaguacaaaguagaauaaauuauggaugucauccugugac

SEQ ID NO: 70854 - RNA, 64 nt, Homo Sapiens
uuguucuccuucuaaaaguuccaaguucuauuuuuagaauaaaacuuuugguauuucauuguua

SEQ ID NO: 70855 - RNA, 64 nt, Homo Sapiens
ucuuagaaaguuuugagaggacaccaaaauauuuuagaauaaauacauuuuuauacuaaaacaa

SEQ ID NO: 70856 - RNA, 64 nt, Homo Sapiens
acaaugguuuccaagaaaguaugugaaauaaaaguagaauaaacauuauaagcuguuuuuauau

SEQ ID NO: 70857 - RNA, 64 nt, Homo Sapiens
cuagucuuauaauagguuugguaaucuucagaccuagaauaauaucucuauuaggaaauauucu

SEQ ID NO: 70858 - RNA, 64 nt, Homo Sapiens
guguauaaucagagugccucuuauacauacuuuauagaauaaaggaacauuuugacagaugagg

SEQ ID NO: 70859 - RNA, 64 nt, Homo Sapiens
ucauuaucugugaaccauaauuuaaaaaucuuucuagaauaacaacagcagacuccacucuugu

SEQ ID NO: 70860 - RNA, 64 nt, Homo Sapiens
uagguuauuucuuggaaauugcaauacguaguucuagaauaaaaguacaaaaaauuagaauaag

SEQ ID NO: 70861 - RNA, 64 nt, Homo Sapiens
caauacguaguucuagaauaaaaguacaaaaaauuagaauaagaauucuuuaacauuuucuuua

SEQ ID NO: 70862 - RNA, 64 nt, Homo Sapiens
augguggcacauuucugcuauaaugaagauuaaauagaauaacaguuccaggauaacacugauu

SEQ ID NO: 70863 - RNA, 64 nt, Homo Sapiens
uauuucuauuuagaacacagaaaaugaaaauauuuagaauaaguuguacauuugaugacaaaua

SEQ ID NO: 70864 - RNA, 64 nt, Homo Sapiens
cccccaaaaaaaaaauucaguaggaauuccuucauagaauaacauguuauuuauugguauugac

SEQ ID NO: 70865 - RNA, 64 nt, Homo Sapiens
uucuuuaacuaccuuuggaaauacuguacaauguuagaauaauuuauuuugcuuuacaggaguu

SEQ ID NO: 70866 - RNA, 64 nt, Homo Sapiens
ggugaaagucgugugaaauccuguacacuguguauagaauaauguaauuuuauguuaauuguua

SEQ ID NO: 70867 - RNA, 64 nt, Homo Sapiens
ccgagagcuguggguaaaauuugaaaauuguauuuagaauaagaaauuuuacauuuuaaacccu

SEQ ID NO: 70868 - RNA, 64 nt, Homo Sapiens
caucaguauuaugauuccucauuuaaugugcucgcacuacaaugauuauuguuauuccuuuuua

SEQ ID NO: 70869 - RNA, 64 nt, Homo Sapiens
uuuaaaaaacuaugucuaaucucuacuuauguaucacuacaaacagaaaauuguaagaauugca

SEQ ID NO: 70870 - RNA, 64 nt, Homo Sapiens
aggagugaaaauagaguguaaaucuugccuuuggcacuacaaggugugugugugugugugugug

SEQ ID NO: 70871 - RNA, 64 nt, Homo Sapiens
uugcuuccuaccacagauucuuuauuuucccaaacacuacaaaaaaacuuuuaaaacuuugcca

SEQ ID NO: 70872 - RNA, 64 nt, Homo Sapiens
ggauguguaauaaccaugcucacuuuuuuucauacacuacaaggaguacauaaaucccgucaug

SEQ ID NO: 70873 - RNA, 62 nt, Homo Sapiens
gccagcucucaccagauggcucucagaauggacacuacaaauccuucacuucaguagauuag

SEQ ID NO: 70874 - RNA, 64 nt, Homo Sapiens
uggguagcuucaaacucaaauugaagagagucuucacuacaaucuucacuacaaccuuuggccu

SEQ ID NO: 70875 - RNA, 64 nt, Homo Sapiens
aacucaaauugaagagagucuucacuacaaucuucacuacaaccuuuggccuuccucucuacau

SEQ ID NO: 70876 - RNA, 64 nt, Homo Sapiens
ugucaaaauaaugagaacugucuuaaauuguaaacacuacaaaaaggggaauguuacguugauc

SEQ ID NO: 70877 - RNA, 64 nt, Homo Sapiens
gaccucucgaggggggacggugagcccuaucuuccacuacaaauucccagccagucaguggcuu

SEQ ID NO: 70878 - RNA, 64 nt, Homo Sapiens
cuaaugaaggccaucaucucuguaaaccacuugucacuacaaaaauacaauuacucaccaaaaa

SEQ ID NO: 70879 - RNA, 64 nt, Homo Sapiens
gcccaggcuggagugcaguggcgugaucuuggcucacuacaaccuccaccuuccaggcuuaagc

SEQ ID NO: 70880 - RNA, 64 nt, Homo Sapiens
auuugcauauaaccuaugcaaaauaauuaauaaaaugguguaguaaauaaaauaaaauaaaaua

SEQ ID NO: 70881 - RNA, 64 nt, Homo Sapiens
ccgggcaugguggcucacgcgucccuuauauaaaaugguguaggcaaaaucugaggauacucaa

SEQ ID NO: 70882 - RNA, 64 nt, Homo Sapiens
ugcgacuuucauauccuugccuagaauaggcugcaugguguaugucagugagggccacgaggcg

SEQ ID NO: 70883 - RNA, 64 nt, Homo Sapiens
uggguguccagggccccguagagagacauuuaagaugguguaugacagagcauuggccuugacc

SEQ ID NO: 70884 - RNA, 64 nt, Homo Sapiens
guucuugauugcuuuauuaucaucauacuaguguguucauuauagaguaucuguagaggugaau

SEQ ID NO: 70885 - RNA, 64 nt, Homo Sapiens
uuaaagcaagauucaauuccuuguucauuugaguguucauuauaugccaggcauugaccaguug

SEQ ID NO: 70886 - RNA, 64 nt, Homo Sapiens
aaggagacauagaaugugugcuuauucucagaagguucauuaacugaggugaugaguuaacaac

SEQ ID NO: 70887 - RNA, 64 nt, Homo Sapiens
gagcagucagcuuccuaaguguuuuaggacauuuguucauuauauuuuccgucauauaacuaga

SEQ ID NO: 70888 - RNA, 64 nt, Homo Sapiens
auuaaaccaguacuugucaguccaucuuaauacuguucauuaaggcacucucugucucuaaucc

SEQ ID NO: 70889 - RNA, 64 nt, Homo Sapiens
guaguaaaaaauguaggguuauuuaccauaaccuguucauuaauaucagaaauuuacaauagca

SEQ ID NO: 70890 - RNA, 64 nt, Homo Sapiens
uuuuaaucaagcaggaaaaaguucucaugauuaugccaacuauaauaguaauccucacugagug

SEQ ID NO: 70891 - RNA, 64 nt, Homo Sapiens
ugaauucuuaccauacugccauuaaaauaaauuugccaacuaguaaugcauacuggaaaucaaa

SEQ ID NO: 70892 - RNA, 64 nt, Homo Sapiens
auaacacccaucacauugucugagaauaggauuaaugagcaaaaguuaugauaauagaguuaua

SEQ ID NO: 70893 - RNA, 64 nt, Homo Sapiens
uaaugccgugaaugaaacacagucuguguagggaaugagcaaaaaaguugaauuccaauugcuu

SEQ ID NO: 70894 - RNA, 64 nt, Homo Sapiens
guauauguaauauauaugugggaaauacaggggaaugagcaaaucucaaagagcuggcgucuua

SEQ ID NO: 70895 - RNA, 64 nt, Homo Sapiens
cccaauacauuauuagacugaacugugaccugaaaugagcaauaaacucuguauuaauucacug

SEQ ID NO: 70896 - RNA, 64 nt, Homo Sapiens
aucauacuguucaaugguucgggaauauuuauaaaugagcaaauuaagcucagauuauuuaaau

SEQ ID NO: 70897 - RNA, 64 nt, Homo Sapiens
gcuucccuauuuauuuauuugcucccacauucugaugagcaaccuaagaaacccucugucauuc

SEQ ID NO: 70898 - RNA, 64 nt, Homo Sapiens
cauuauuugcccuauccaaauuucaagauuuaauaugagcaaccacagagugauuggcaaauau

SEQ ID NO: 70899 - RNA, 64 nt, Homo Sapiens
uauuuuauaugaacuuuuuuuuuguagugugaauaugagcaaucaauuaaaaacaacguauucc

SEQ ID NO: 70900 - RNA, 64 nt, Homo Sapiens
acacacuuaccuuacuaagucuuugcuuuaauaaaugagcaacccuggguauagucuuaaaauu

SEQ ID NO: 70901 - RNA, 64 nt, Homo Sapiens
aauuauuccuaaacucucuaaguguggacggagaaugagcaagccccagaaguauuuuacaacc

SEQ ID NO: 70902 - RNA, 64 nt, Homo Sapiens
cauuucacugcugucgaaguguacaggguaauucaugagcaagauuuguuuggggugggggcaa

SEQ ID NO: 70903 - RNA, 64 nt, Homo Sapiens
ccagaagcaaggcuagauucgaugucuucauaugaugagcaaggcuacucgguucacuugccca

SEQ ID NO: 70904 - RNA, 64 nt, Homo Sapiens
gauuaaacagaggcccacagugcugcaauagaagaugagcaaagguguagccaucuuugccuuu

SEQ ID NO: 70905 - RNA, 64 nt, Homo Sapiens
guaucacaucugcccucccucgggcaaagaggacaugagcaagcugcuguuugacccugguauu

SEQ ID NO: 70906 - RNA, 64 nt, Homo Sapiens
guauuguguagcuaggccuaaugaagcauucaaaaugagcaaugcuaauggguuguuuagcuuu

SEQ ID NO: 70907 - RNA, 64 nt, Homo Sapiens
ucuucucaccuugauuuugagcuggaauguuucaaugagcaaaauaaauuagacaaaaguuuac

SEQ ID NO: 70908 - RNA, 64 nt, Homo Sapiens
gcaguguuucucccacuuugauaugcuaacauuuaguaagcacuggcuuuaugaaagcggcuuu

SEQ ID NO: 70909 - RNA, 64 nt, Homo Sapiens
agccacuacauucuguggaaggagaucucucaggaguaagcauuguuuuuuuuucacaucuugu

SEQ ID NO: 70910 - RNA, 63 nt, Homo Sapiens
ucuugcaagaaagaauuugaggcgaauccauagaguaagcaaggcaaguuacuucuauauaga

SEQ ID NO: 70911 - RNA, 64 nt, Homo Sapiens
uccuucugcucauaaccugacaaaaugccaaacuaguaagcaggauagcugauaccacggcuau

SEQ ID NO: 70912 - RNA, 64 nt, Homo Sapiens
aagaaggaaaacuguaggggggaguaaugugcuaaguaagcagaauugccucaaaaagaaguug

SEQ ID NO: 70913 - RNA, 64 nt, Homo Sapiens
ggguguaggaucuggccagaaacacuguaggaguaguaagcagauguccuccuuccccuggaca

SEQ ID NO: 70914 - RNA, 64 nt, Homo Sapiens
gauuuugaggagcucuaagugguccaggaguccaaguaagcagucuggcuggaauaaggcagca

SEQ ID NO: 70915 - RNA, 64 nt, Homo Sapiens
uggaacgggaauuggccucucugcucccuucuucaguaagcaaggagccccgccccucaggccc

SEQ ID NO: 70916 - RNA, 63 nt, Homo Sapiens
ugagaguuuauggucuggauaauauaaauaaacaaguaagcauaugucagauguuguuaguuu

SEQ ID NO: 70917 - RNA, 64 nt, Homo Sapiens
uuuacuguaaauuaugauuccguaacugacuuguaguaagcaguguuucuggccccuaaguauu

SEQ ID NO: 70918 - RNA, 64 nt, Homo Sapiens
ugauucuaaaaggauuaucugaaauugaaaaacuaguaagcaaauaaaugauaaacauaaguaa

SEQ ID NO: 70919 - RNA, 64 nt, Homo Sapiens
guuaaagcuguaacaacugaaauugcauggaucaaguaagcauaguuuuauccagggagaaaaa

SEQ ID NO: 70920 - RNA, 64 nt, Homo Sapiens
cugagaacuaaagaguuuauaagaagaacuuaugaguaagcaguugcgucgcugacaaguucuc

SEQ ID NO: 70921 - RNA, 64 nt, Homo Sapiens
uugucucuguucacuacugcaugugaacuugccuaguaagcacuuggggucaaauucuguguga

SEQ ID NO: 70922 - RNA, 64 nt, Homo Sapiens
acaccauguuucugucucccuguaagcuuguuaaaguaagcaccacccaauuacaggggauaaa

SEQ ID NO: 70923 - RNA, 64 nt, Homo Sapiens
ugagagaacuguguuuuuccccugaaugagcuuuaguaagcaauuggcuuccuucuccaauuag

SEQ ID NO: 70924 - RNA, 64 nt, Homo Sapiens
guuaaggggugggucagaacuguagagacaauacaguaagcauaaauggaggcuuuucacugcc

SEQ ID NO: 70925 - RNA, 64 nt, Homo Sapiens
uuuaaaggauuuauuuuagacuauuuucacuuaaaguaagcauuuauuauauacacaaaauuug

SEQ ID NO: 70926 - RNA, 64 nt, Homo Sapiens
acugauuuacugguuugccuuauuaagcuuagaaaguaagcaaaaagagcaagagucuguacau

SEQ ID NO: 70927 - RNA, 64 nt, Homo Sapiens
uguauuaagaauguuccuuaaagguuuaagaagcaguaagcagcaucugaagccacaaucuauu

SEQ ID NO: 70928 - RNA, 64 nt, Homo Sapiens
caggcuccuugggcccuaagcaucaccagaagggaguaagcagggagagaagcaauauuacucc

SEQ ID NO: 70929 - RNA, 64 nt, Homo Sapiens
caacuuuuaaaagaaauaacuaaauuuucaaaugaguaagcagugccaccaacuaguguuuugc

SEQ ID NO: 70930 - RNA, 64 nt, Homo Sapiens
ugugcuuucuaucuaauuuuuauuaauuuguaagaguaagcaccuuuagaauauuaaaaauuaa

SEQ ID NO: 70931 - RNA, 64 nt, Homo Sapiens
auauucucaccauccugacugaagugaacuaugaaguaagcaacaaggaugacaagaaaaacau

SEQ ID NO: 70932 - RNA, 64 nt, Homo Sapiens
uuuuccaugcucuuaauguaggggguuuccuuucaguaagcaaccauucccucccuuacucuuc

SEQ ID NO: 70933 - RNA, 64 nt, Homo Sapiens
ugauggcauuugagaauuuagaagaauugcuugaaguaagcaacaagaaaauccucagcaaagu

SEQ ID NO: 70934 - RNA, 64 nt, Homo Sapiens
cacugcaagcucugaaucagagauagccagaguaaguaagcagcaaggcagcuaaauuucugaa

SEQ ID NO: 70935 - RNA, 64 nt, Homo Sapiens
ugaguuugcaaacucuugugggaacuacguagcuaguaagcauucacauuuccacaccagaacu

SEQ ID NO: 70936 - RNA, 64 nt, Homo Sapiens
auuuuccagaauucccaaaaauuuuguaaaaaacaguaagcaaaagaaauuuuagauugugaau

SEQ ID NO: 70937 - RNA, 64 nt, Homo Sapiens
caugauugccuucuuguuuuuuguccauucuaaaaguaagcaaagacagcuuuuagauacuuuu

SEQ ID NO: 70938 - RNA, 64 nt, Homo Sapiens
uaaaauucaaaagugaggaaaauguaaauaauaaaguaagcauuauaauuucaagcauaagugc

SEQ ID NO: 70939 - RNA, 64 nt, Homo Sapiens
gaguauaucaucaguacacucuaguuugacaauuaguaagcaauugugacaguuaaagaauauu

SEQ ID NO: 70940 - RNA, 64 nt, Homo Sapiens
cagcggcacucugagauccccuuuagcagugcugaguaagcagggcagcacaggaccgcgcuuc

SEQ ID NO: 70941 - RNA, 64 nt, Homo Sapiens
auuuaugggcucaggaucugaccgcagucccgggaguaagcauuucaaagggggaaggcagugu

SEQ ID NO: 70942 - RNA, 64 nt, Homo Sapiens
uugcuuggccagucuuugccuuucauccuguaaaaguaagcauguagaaggaggaaguugugcu

SEQ ID NO: 70943 - RNA, 64 nt, Homo Sapiens
accagcucaugucuuccccacaucucuucuugccaguaagcagcuuuggugggcagcagcagcu

SEQ ID NO: 70944 - RNA, 64 nt, Homo Sapiens
caguucuucaaauaaggacgcaaaucuucaggacaguaagcagaacaaucagaauggaauuaaa

SEQ ID NO: 70945 - RNA, 64 nt, Homo Sapiens
guucugcccucugcccuccagcuuuacccaccagaguaagcaaucuuuucuuuuuagaaaucaa

SEQ ID NO: 70946 - RNA, 64 nt, Homo Sapiens
agaaaagcauuucagaggcuaauuuaaaacaaaaaguaagcaccuaaaggcaaggacuuuguuu

SEQ ID NO: 70947 - RNA, 64 nt, Homo Sapiens
uugguaaagaauggaagguggagaagcucccugaaguaagcaaagacuuuccucuuagucgagc

SEQ ID NO: 70948 - RNA, 64 nt, Homo Sapiens
ugaggggcaacgaggcggcugggaugccgcccucaguaagcagcuugccaaucacuccaggucu

SEQ ID NO: 70949 - RNA, 64 nt, Homo Sapiens
uuuaacuuuuuuggcuguauguaauucagucauaaguaagcauuuucuaacguccauuauaucc

SEQ ID NO: 70950 - RNA, 64 nt, Homo Sapiens
auuuuaaagccuuauguauaaauaaaccaaaggaaguaagcagucauauugcuaauuugcuaac

SEQ ID NO: 70951 - RNA, 64 nt, Homo Sapiens
uuccucaucagaaguacuggcuucuuuagagaguaguaagcauggcugccuaugcuuggaguca

SEQ ID NO: 70952 - RNA, 64 nt, Homo Sapiens
uauguuucauuuaaucuucacaaaagaucuguagaguaagcaaagagaggcaaaaacaaugucu

SEQ ID NO: 70953 - RNA, 64 nt, Homo Sapiens
uguuugugggaaccacagaugguugggguugaacaguaagcacauugcugcaaugugguacgug

SEQ ID NO: 70954 - RNA, 64 nt, Homo Sapiens
ucccauuugcagagcucuacuacuucauuuccacaguaagcauauauauaaugaucacuucuga

SEQ ID NO: 70955 - RNA, 64 nt, Homo Sapiens
guguaugaguagccaggguaagggguaaaaggauaguaagcauagaaaccacuagaaagugggc

SEQ ID NO: 70956 - RNA, 64 nt, Homo Sapiens
acuaagcagucuuggagggcugaggagaaggaguaguaagcagauggaugcuggaagcugucgu

SEQ ID NO: 70957 - RNA, 64 nt, Homo Sapiens
uugcccaagguugcacagcaucacucacauugagaguaagcacggaggcuaugaggaaacugag

SEQ ID NO: 70958 - RNA, 64 nt, Homo Sapiens
guucuuugcaagcuuauuuagucuugguuagagaaguaagcagauaacuaucagagggaucuag

SEQ ID NO: 70959 - RNA, 64 nt, Homo Sapiens
caauaaaucacucaacuccuaugccguggcaccaaguaagcacuuuuagguaagcaccuagcac

SEQ ID NO: 70960 - RNA, 64 nt, Homo Sapiens
gaguuauauucuaccucucucagacaagaccugcaguaagcaaaauuuuccagagguucuccuc

SEQ ID NO: 70961 - RNA, 64 nt, Homo Sapiens
ucuuggacccacgagcagggugggugcccccagaaguaagcagcgccucgcagcccccucagca

SEQ ID NO: 70962 - RNA, 64 nt, Homo Sapiens
ucauccuaauugcgaagaguuuauuaaaccuaugaguaagcagcguuuuaaaagcuaaccauuu

SEQ ID NO: 70963 - RNA, 64 nt, Homo Sapiens
guucaucuucccauuuauuucuaguguucuugccaguaagcaugaucuguauuuuuuacaauac

SEQ ID NO: 70964 - RNA, 64 nt, Homo Sapiens
ucaaaguuuauaugccuggugcacagugcuuagaaguaagcaauucccaggucauagcucaaga

SEQ ID NO: 70965 - RNA, 62 nt, Homo Sapiens
cccaggacauuaaacucugauaggagaggaaaaguaagcaucucugcagaaagccaacaggu

SEQ ID NO: 70966 - RNA, 64 nt, Homo Sapiens
uucuuuuauucucccacagugcuccauguacagaaguaagcauagcagucauaugagcaaccac

SEQ ID NO: 70967 - RNA, 64 nt, Homo Sapiens
uauguuguaagcuuggguuauuaacugcuuuuauaguaagcaaaaaaauccuggucuuugucca

SEQ ID NO: 70968 - RNA, 64 nt, Homo Sapiens
uauguuucuuugucagccuucugcuucuaaucccaguaagcaacuuggacaggcauuuuaaaag

SEQ ID NO: 70969 - RNA, 64 nt, Homo Sapiens
ucccuguauuuccauuauucuuuauggaauauaaaguaagcaugaaagguaguuaaaacuuuca

SEQ ID NO: 70970 - RNA, 64 nt, Homo Sapiens
uguuuauucaugggugucagacagaaugauauccaguaagcacaagcugcugaagaggcaagag

SEQ ID NO: 70971 - RNA, 64 nt, Homo Sapiens
ccaacauuucguuuguuuauuugcucagaacuuaaguaagcauggaaauaucuugaacuguuua

SEQ ID NO: 70972 - RNA, 64 nt, Homo Sapiens
agcugccucuuugcugcuuuguaguggaagagguaguaagcaccuucugucagucugaagcgua

SEQ ID NO: 70973 - RNA, 64 nt, Homo Sapiens
cuguggaaacaugcaaaggacacugaggaugagaaguaagcaaagaggggucuucucuggguuu

SEQ ID NO: 70974 - RNA, 64 nt, Homo Sapiens
aaaaucgaguaauguauauagaaauguaaaagaaaguaagcauagaaaaauuaauuauaugguu

SEQ ID NO: 70975 - RNA, 64 nt, Homo Sapiens
aaaauugggaaaacuuuuuccuguacugcacuggaguaagcaagaauagagacuugagcuggau

SEQ ID NO: 70976 - RNA, 64 nt, Homo Sapiens
agcauauccuuuacccaggccauuccuaucauauaguaagcagaagaguugccaugaaaguaaa

SEQ ID NO: 70977 - RNA, 64 nt, Homo Sapiens
aaaaaauauuuuacauaauuacucauuuuuguugaguaagcaaaauuacaaaguguuuuuaaaa

SEQ ID NO: 70978 - RNA, 64 nt, Homo Sapiens
cuccgguucagcuuccgacaccagaguggaacccaguaagcaccaucaggaaugaauuucacua

SEQ ID NO: 70979 - RNA, 64 nt, Homo Sapiens
acagcagacaaaaugaaagaaaaugagagcagaaaguaagcauuuccagccuaucuaauuucuu

SEQ ID NO: 70980 - RNA, 64 nt, Homo Sapiens
ggagaauuacuugaacccgggaggcggagguugcaguaagcagagauugugccacuggacucca

SEQ ID NO: 70981 - RNA, 64 nt, Homo Sapiens
agggcuugaguucaucgaugcauguagaagucagaguaagcaaggaacacugagauuugauagg

SEQ ID NO: 70982 - RNA, 64 nt, Homo Sapiens
aauuagcaaagagauagucuuucuucccuacagcaguaagcaaauuuaaaguucauuggaaauc

SEQ ID NO: 70983 - RNA, 64 nt, Homo Sapiens
guuucuugcagaaaacacaauuaacagcauggguaguaagcaugugcuuagccauaacacucau

SEQ ID NO: 70984 - RNA, 64 nt, Homo Sapiens
uagugcccucagcuacugcaauuauaaggcauuaaguaagcaaacuacuguaaggcagaugcua

SEQ ID NO: 70985 - RNA, 64 nt, Homo Sapiens
aagaugcucuccgagguccauaaucucaaaugcuaguaagcagauugauuaaaaaaaaauuuua

SEQ ID NO: 70986 - RNA, 64 nt, Homo Sapiens
ugaaguaguuugauaauaaauggcacuauuacauaguaagcacaaagcaugaaccucagacuuc

SEQ ID NO: 70987 - RNA, 64 nt, Homo Sapiens
accuccaagacugucuccuuaaaggaaguucaacaguaagcagcgccuucucccauacauucca

SEQ ID NO: 70988 - RNA, 64 nt, Homo Sapiens
gaguuuaaagagaaaagggaaaaaagaaagaaaaaguaagcagggcuggcuucgcccgcguucu

SEQ ID NO: 70989 - RNA, 64 nt, Homo Sapiens
gugacaauuaauaauaaauaacgugucagcauuuaguaagcauccacuaaguguacaauacuuc

SEQ ID NO: 70990 - RNA, 64 nt, Homo Sapiens
gguucaagacugucauuuucuauuucaaccgaaaaguaagcauuuaacccggugaauaaaugua

SEQ ID NO: 70991 - RNA, 64 nt, Homo Sapiens
uucuaaugcugcauuuuuuuuuacgaagcaccuuaguaagcaccauuaaaaaaaaaaccaugaa

SEQ ID NO: 70992 - RNA, 64 nt, Homo Sapiens
uuauucugagccccgggggugucacccaucuuccaguaagcaguagccuucccuuuugccuuaa

SEQ ID NO: 70993 - RNA, 64 nt, Homo Sapiens
uuucaucugacagcguagauuaucuuuuaaaagcaguaagcaguagaauuuauauuguuuauua

SEQ ID NO: 70994 - RNA, 64 nt, Homo Sapiens
uugaagcaaaaacuuguauaucuuuuauaaauaaaguaagcacucugcaacccucuugaucuuc

SEQ ID NO: 70995 - RNA, 64 nt, Homo Sapiens
caaaagacuuaauauauugaaguaacacuuuuuuaguaagcaagauaccuuuuuauuucaauuc

SEQ ID NO: 70996 - RNA, 64 nt, Homo Sapiens
cgggaauacugucucuucuauguauuuugugaauaguaagcauaauuuuaguuuuguauuauca

SEQ ID NO: 70997 - RNA, 64 nt, Homo Sapiens
uauucucuauaaggcauucaccuuuugcuaacacaguaagcauguuaaaaaacaauuuuauugg

SEQ ID NO: 70998 - RNA, 64 nt, Homo Sapiens
uacuacauuuauaauggaaguccaaacauucuccaguaagcagguucuuccuucuuacugcuuu

SEQ ID NO: 70999 - RNA, 64 nt, Homo Sapiens
auaugauacgugcugcuuguucaucacaaaaaucaguaagcacaauaaaguggaugccaaacca

SEQ ID NO: 71000 - RNA, 64 nt, Homo Sapiens
auguaauggaugugagguagccgaaguuugguucaguaagcagggaauacagucguuccaucag

SEQ ID NO: 71001 - RNA, 64 nt, Homo Sapiens
uaucugucucuuauuugcacucauggauauucacaguaagcauuguuugacauauauuaaaacc

SEQ ID NO: 71002 - RNA, 64 nt, Homo Sapiens
ggauucugauuagaaagaggguugccuacagauuaguaagcaauuccuuggaucuuaugcacag

SEQ ID NO: 71003 - RNA, 64 nt, Homo Sapiens
agcuucaaaagaacacauacagaguaauccugagaguaagcaaaggaaccaugagaaccgaagc

SEQ ID NO: 71004 - RNA, 64 nt, Homo Sapiens
ggagacagguuuaaggguagaaugggcaaggcagaguaagcaggcucugguuuccucaggagga

SEQ ID NO: 71005 - RNA, 64 nt, Homo Sapiens
agcauaacaagguccaagauagucauaaaccuuaaguaagcaacaaugccggugagaauaagag

SEQ ID NO: 71006 - RNA, 64 nt, Homo Sapiens
uacuucaggccaacaagguuuggaaaaacuuccuaguaagcaucaggauuuuaaaaagaagcca

SEQ ID NO: 71007 - RNA, 64 nt, Homo Sapiens
gucuuuguggggcaguugucaucaaaggcagaucaguaagcaaguacaauagaagaaaagaucu

SEQ ID NO: 71008 - RNA, 64 nt, Homo Sapiens
ggcuucuguccuacucuguauucuggacucuccaaguaagcacacuuccagacaucugcguucc

SEQ ID NO: 71009 - RNA, 64 nt, Homo Sapiens
cugugaacguuguaguaaacggcagcuuaagauaaguaagcagagacaguguuaaggacgaguu

SEQ ID NO: 71010 - RNA, 64 nt, Homo Sapiens
cuuuguuguuaguaaauagacacuauguaaauaaaguaagcauagaaaaaagagaaacccgugg

SEQ ID NO: 71011 - RNA, 64 nt, Homo Sapiens
auucuugggagucaguguuauuugacaaagaguaaguaagcaguauugguagcauguaacagug

SEQ ID NO: 71012 - RNA, 64 nt, Homo Sapiens
ccuuaacuccuuaguauuucaauaguaaugguucaguaagcacuagugucucuucccucccucu

SEQ ID NO: 71013 - RNA, 64 nt, Homo Sapiens
ugucuacagucuauacucaauaccuauaaaaugcaguaagcauguguuacagaaagagguucug

SEQ ID NO: 71014 - RNA, 64 nt, Homo Sapiens
ugagaggaccuaaacacaaugacaccucaguaacaguaagcacaccaacugccaaguuauuagu

SEQ ID NO: 71015 - RNA, 64 nt, Homo Sapiens
ucuuucaagaaguucauacuuuaugaaauugcacaguaagcauuuauuuuucagaccauuuuug

SEQ ID NO: 71016 - RNA, 64 nt, Homo Sapiens
uuuuuggauauggcagcacuuguaaaaauaaagcaguaagcaaaauccuuuuaaacacagaaau

SEQ ID NO: 71017 - RNA, 64 nt, Homo Sapiens
caacuuuaauaauccauauuuauacuaucgcagaaguaagcauuuggcaaacguucagccauua

SEQ ID NO: 71018 - RNA, 64 nt, Homo Sapiens
uuaaguugcuuuaacaaacucguuugcaucgcuaaguaagcaacgaaaugaugcauaucauucc

SEQ ID NO: 71019 - RNA, 64 nt, Homo Sapiens
ccaacagaacugaguuccagcagaucaucucagcaguaagcacaguguucucaguuuaagauag

SEQ ID NO: 71020 - RNA, 64 nt, Homo Sapiens
auaaccuucuaccuuguaauauccaaauuugaggaguaagcagcgaagcugugaucgacuuaga

SEQ ID NO: 71021 - RNA, 64 nt, Homo Sapiens
auaccauugucgucauugguuuauuuguuagaugaguaagcaaguauauuuuucuaaagguaaa

SEQ ID NO: 71022 - RNA, 64 nt, Homo Sapiens
aguuacucaguacuaggaugcacccaguggugagaguaagcaucuuugacugaugacaggucuu

SEQ ID NO: 71023 - RNA, 64 nt, Homo Sapiens
ccugugucuggccccuccgcgagggcuacucagcaguaagcaggccuuaguacggcugcugcac

SEQ ID NO: 71024 - RNA, 64 nt, Homo Sapiens
uucagaaccccagaugagagccaaugucagauaaaguaagcauaguaauguagcaggaacuaca

SEQ ID NO: 71025 - RNA, 64 nt, Homo Sapiens
ucacaauuucuuacaaccaagcuuugugcucccgaguaagcagggauguacuaggggaauguaa

SEQ ID NO: 71026 - RNA, 64 nt, Homo Sapiens
cucuccuugccgcccugucaccuucaccucccggaguaagcagcgaggaagagcagcacugguc

SEQ ID NO: 71027 - RNA, 64 nt, Homo Sapiens
gaccacacacaucucugcuggaaagucaacauguaguaagcaagauuuaacuguuugauuauaa

SEQ ID NO: 71028 - RNA, 64 nt, Homo Sapiens
ggaguacugucucaguuucuaaccacucugugcaaguaagcaucuuacaacuggcucuuccucc

SEQ ID NO: 71029 - RNA, 64 nt, Homo Sapiens
uugaacauacaugcauugacuugacaaguuacugaguaagcagcauauucagcaggugccacua

SEQ ID NO: 71030 - RNA, 64 nt, Homo Sapiens
uggaagauuguuucagggugccaccccuuucuacaguaagcacuccuuggguucucccgucuca

SEQ ID NO: 71031 - RNA, 64 nt, Homo Sapiens
uaauucgcugcuucugagacgacauugccaaaugaguaagcacuuuauuuauauaacucacugg

SEQ ID NO: 71032 - RNA, 64 nt, Homo Sapiens
cuuuaugggcuuucucugagucggcugcuuccagaguaagcagugcucgcggaacagccccuag

SEQ ID NO: 71033 - RNA, 64 nt, Homo Sapiens
ugagaagccugggguuuggaagacugcugugcuuaguaagcaagacugccaggucccaagcuuc

SEQ ID NO: 71034 - RNA, 64 nt, Homo Sapiens
guuacuugcagguacuuuggaggcaaacagcaagaguaagcagucuaagguuuccagucagaug

SEQ ID NO: 71035 - RNA, 64 nt, Homo Sapiens
uccucuuuuuuaaaaauuugggucaaauucuggaaguaagcauuacucaaaauuccaaaaaggu

SEQ ID NO: 71036 - RNA, 64 nt, Homo Sapiens
gacuuuauaaugcaaccaggaguauugaaaaaaaaguaagcaaugagcucaaauaauuaaaaaa

SEQ ID NO: 71037 - RNA, 64 nt, Homo Sapiens
uuaaaguaauuucugaacuguguaaugugucuagaguaagcaaauacugcuaacaauuaacuca

SEQ ID NO: 71038 - RNA, 64 nt, Homo Sapiens
cuagaaaagguuauguucauuuuucaaaaagggaaguaagcaaacaaauauugccaacucuucu

SEQ ID NO: 71039 - RNA, 64 nt, Homo Sapiens
uuauuuuuuuacucugagaccagcaccagauguaaguaagcaucucauauauuucagccaaaua

SEQ ID NO: 71040 - RNA, 64 nt, Homo Sapiens
gagguuguuugacauacaguuguuuagcauuucuaguaagcaguuaaaauuccauuuuuuccag

SEQ ID NO: 71041 - RNA, 64 nt, Homo Sapiens
accuggggaaauggucagaccauaaagacaaacuaguaagcaugcuuaaauauguauaaaugua

SEQ ID NO: 71042 - RNA, 64 nt, Homo Sapiens
caaguggcuguucuuguaguuuucugcauagauaaguaagcaccacugaagcaccucuguggcu

SEQ ID NO: 71043 - RNA, 64 nt, Homo Sapiens
ugcugcugugucuuuagaacagugccuggcacacaguaagcacucaauaaaucuuugaugaaug

SEQ ID NO: 71044 - RNA, 64 nt, Homo Sapiens
guacuugcccacugacagucaauaucugucaccuaguaagcaaccaagagacccucccuucaug

SEQ ID NO: 71045 - RNA, 64 nt, Homo Sapiens
ccaauaccuggugaaucuaucgaauuacucaaaaaguaagcaaacaaaacauaggcugaaagca

SEQ ID NO: 71046 - RNA, 64 nt, Homo Sapiens
auggucagggagguggcaggcagggaccacccacaguaagcaccuaugacagcuagucaguuga

SEQ ID NO: 71047 - RNA, 64 nt, Homo Sapiens
cacauaaguggguaccuaucuaaggcugccugcuaguaagcaguccauuccaugaggcauacag

SEQ ID NO: 71048 - RNA, 64 nt, Homo Sapiens
gaucgcacugccucaauaacgcuucuacuccugcaguaagcacaaauuugcuagaacuguggaa

SEQ ID NO: 71049 - RNA, 64 nt, Homo Sapiens
cagucguggcucagaacuuaaaaacaggcaugcuaguaagcaguacuugauucuacugguaugc

SEQ ID NO: 71050 - RNA, 64 nt, Homo Sapiens
uauuuuuaucaauuuaacacgauguuuguacaggaguaagcaugaugauuuaauuacauuguuc

SEQ ID NO: 71051 - RNA, 64 nt, Homo Sapiens
uacuacauacaguacuuguaaaguguuagcuguaaguaagcacaaaauacauuuaaaauacaaa

SEQ ID NO: 71052 - RNA, 64 nt, Homo Sapiens
ggcuucuuggcuucucuggucucucguucaguuuaguaagcaaaugagucacuuacuucauauc

SEQ ID NO: 71053 - RNA, 64 nt, Homo Sapiens
uagcugggcacaguggcucauaggucacuuaagaaguaagcaacucgagcacugaagucaccau

SEQ ID NO: 71054 - RNA, 64 nt, Homo Sapiens
ucucagagaaugcuauucaauagaaaggcugaauaguaagcacuaguguuuaagcaacuuaaua

SEQ ID NO: 71055 - RNA, 64 nt, Homo Sapiens
uccgaccccuccuucuuuacugcgucuggccuggaguaagcaggugggcuucucugugugcauu

SEQ ID NO: 71056 - RNA, 50 nt, Homo Sapiens
caccuuaaguaguguguuaaaguaagcaagcagcaacuuuccaguuguag

SEQ ID NO: 71057 - RNA, 64 nt, Homo Sapiens
aggcuacccauuccauuccucucugugcaucuccaguaagcagaagcuguuuucagccauguuu

SEQ ID NO: 71058 - RNA, 64 nt, Homo Sapiens
uaucuuccagaaccuaggaggaugccuaacagagaguaagcacuuaaaaaauauuugucauaug

SEQ ID NO: 71059 - RNA, 64 nt, Homo Sapiens
cgcagccgccaacagcagcgcuguuagugagcuaaguaagcacugacuucguagaaaaccauaa

SEQ ID NO: 71060 - RNA, 64 nt, Homo Sapiens
gcaacucaaaugagaugggaugaaauccuaugacaguaagcaaaaacagaaccaugaaaaauga

SEQ ID NO: 71061 - RNA, 64 nt, Homo Sapiens
caaugaauccuaccucuugcccagucccaggcagaguaagcagggcccaccuagggaccaagaa

SEQ ID NO: 71062 - RNA, 64 nt, Homo Sapiens
aucugauuaacacagagaacaaccucgcucguucaguaagcauauugcauuuuuauuggaggaa

SEQ ID NO: 71063 - RNA, 64 nt, Homo Sapiens
augguugucaucacuaguggcaaaugaccuuccaaguaagcagaugggaacugaauuguguuuu

SEQ ID NO: 71064 - RNA, 64 nt, Homo Sapiens
ucucucccuuuuuuuuuuuuuauuaauguugcccaguaagcacccugucuugucuggugucuag

SEQ ID NO: 71065 - RNA, 64 nt, Homo Sapiens
cuuugugguuuaguuauaaaguggcuguuucaucaguaagcagcuggaaaaaccuuguggauaa

SEQ ID NO: 71066 - RNA, 64 nt, Homo Sapiens
uguauuuucucucucuagguuuauauaacuauacaguaagcauucucuugauggauuucuauuu

SEQ ID NO: 71067 - RNA, 64 nt, Homo Sapiens
uguagacggaauuggcauacggucuaauuuguguaguaagcaccuuuguucauacuaguaguga

SEQ ID NO: 71068 - RNA, 64 nt, Homo Sapiens
agcauuuauuccuaagguaggcaggguauuuccuaguaagcauacuuucuuaagacggaggcca

SEQ ID NO: 71069 - RNA, 64 nt, Homo Sapiens
gagaguguuuucauuuugugucuagguuugugugaguaagcaagaaauaaaccuuuguuguugu

SEQ ID NO: 71070 - RNA, 64 nt, Homo Sapiens
gcuuuauuuuagugagggcaauuacagagaaaagaguaagcagaaauguccuucugaguacugg

SEQ ID NO: 71071 - RNA, 64 nt, Homo Sapiens
aauagacugguuugacuauauuguuagcugccacaguaagcaggucauuguauagguaaaugcc

SEQ ID NO: 71072 - RNA, 64 nt, Homo Sapiens
uuuauuauuaaaugugcacacuaaaaggaccuuuaguaagcaaaauuuuuaagguuguuuuccc

SEQ ID NO: 71073 - RNA, 64 nt, Homo Sapiens
cauuacauuuuuagguggaauaggacuguauggaaguaagcaaauaacccacuggaugaaaauc

SEQ ID NO: 71074 - RNA, 64 nt, Homo Sapiens
uucucaaugcucugauuccaaauuaguaauaauuaguaagcauucuuaauaauuaguaauaauu

SEQ ID NO: 71075 - RNA, 64 nt, Homo Sapiens
gaaagggacgguuguggugaaguuugucaggcacaguaagcaugcugaguggcggggaucagaa

SEQ ID NO: 71076 - RNA, 64 nt, Homo Sapiens
ggagguaacaaauauugugcuuuuuaucacucaaaguaagcaauaaggaguaacauaaaacaug

SEQ ID NO: 71077 - RNA, 64 nt, Homo Sapiens
ccaagcgcuucguggcagggggauacguggcuuuaguaagcagacccacguuucuguaaaauca

SEQ ID NO: 71078 - RNA, 64 nt, Homo Sapiens
gggucagugcuucccuuggugucagggaccugagaguaagcacaugacagcgucugcuugcguu

SEQ ID NO: 71079 - RNA, 64 nt, Homo Sapiens
acacaacauaauuggagucuuaaaauagaggaagaguaagcaaagcaugucaaguuuuuguuuu

SEQ ID NO: 71080 - RNA, 64 nt, Homo Sapiens
cauugaucuuuuuugcuauauuuguauacaguacaguaagcacaauuggcacuguacaucuaaa

SEQ ID NO: 71081 - RNA, 64 nt, Homo Sapiens
uugggaguggucguauuaacuucuugcccaaagaaguaagcauauugguguuuucucaauuagu

SEQ ID NO: 71082 - RNA, 64 nt, Homo Sapiens
ccuucuacuucucuauacauuucagauucucuacaguaagcauguguuacauuuguaauuauaa

SEQ ID NO: 71083 - RNA, 64 nt, Homo Sapiens
uagauguuucacugaagaggaucuauagauggcaaguaagcauaugaaaagcuguuaaacucca

SEQ ID NO: 71084 - RNA, 64 nt, Homo Sapiens
uuuuuaaaaaucuuuuauaugucccuuauuuaucaguaagcaggccuuuuuguuuaagcacucg

SEQ ID NO: 71085 - RNA, 64 nt, Homo Sapiens
uaauuuuuaaggccaaggcagauuguuucacaauaguaagcacagaaucugggaugagaaacag

SEQ ID NO: 71086 - RNA, 64 nt, Homo Sapiens
augaaaagcacuuauugcuuguuacacauauggaaguaagcaaaggaggaaaaaagugaaucug

SEQ ID NO: 71087 - RNA, 64 nt, Homo Sapiens
acaaaguguauauuuuggaaauacguagggauagaguaagcagugcucuguaucuuaggcuuau

SEQ ID NO: 71088 - RNA, 64 nt, Homo Sapiens
guguuccuacaucuuuucugagagaaaauuuucuaguaagcaagauuuuucauugcagauacga

SEQ ID NO: 71089 - RNA, 64 nt, Homo Sapiens
aagcaucuggagaaaauucaguuaaaagaauaaaaguaagcagcugaggaauuacuaucacuca

SEQ ID NO: 71090 - RNA, 64 nt, Homo Sapiens
aauggaccauacuaccaaggaccaguccaccugaaccacacacucuaaagaaauauuuuuuaag

SEQ ID NO: 71091 - RNA, 64 nt, Homo Sapiens
cuuguuuuuucaucucauuauccaaguucugcagaccacacaggaacuugcuucauggcucuuu

SEQ ID NO: 71092 - RNA, 64 nt, Homo Sapiens
agggacagaugagcuuccggagacugcucuccucaccacacagcacuaguccauccucagcacc

SEQ ID NO: 71093 - RNA, 64 nt, Homo Sapiens
gcaccugagccucccucacuuggacacucaggggaccacacagagaaguggauggacacuucgc

SEQ ID NO: 71094 - RNA, 64 nt, Homo Sapiens
aaaccuugaagaaaaucaguuauuucaggugccuaccacacaggcacaagacauuuuucuacag

SEQ ID NO: 71095 - RNA, 64 nt, Homo Sapiens
acauuuuucuacaguauuucagggagacgagaacaccacacaagaacagaacccaguuagcagc

SEQ ID NO: 71096 - RNA, 64 nt, Homo Sapiens
aaaaagcagucuuagagaguuugugaaacuugucaccacacaauaucccggaucaucagcacaa

SEQ ID NO: 71097 - RNA, 64 nt, Homo Sapiens
uuccgcaguuuauucuggauacagaugugggaaaaccacacaaaggacuuauuuguuuuaaugu

SEQ ID NO: 71098 - RNA, 64 nt, Homo Sapiens
uccuauacucagcccagguacgagaaggaacucaaccacacacagcagcugccugguaagugga

SEQ ID NO: 71099 - RNA, 64 nt, Homo Sapiens
guuccacagacuggaccgcagaucauuaccuugaaccacacagaccugguucccugccucugua

SEQ ID NO: 71100 - RNA, 64 nt, Homo Sapiens
caaaugggggcaaccacaucaccacacacacacaaccacacacagcuguggccaccaacacaca

SEQ ID NO: 71101 - RNA, 64 nt, Homo Sapiens
cacaaccacacacacaaauggccaccaacacacaaccacacacagugacagaggcucagcugug

SEQ ID NO: 71102 - RNA, 64 nt, Homo Sapiens
aaauccuuuguaaaauuucuaccacacacagauaaccacacaaauuuguaucuuccauauaaua

SEQ ID NO: 71103 - RNA, 64 nt, Homo Sapiens
gauaaccacacaaaaaauccucuuccauauaauaaccacacacaaaauagaauuucgguuugua

SEQ ID NO: 71104 - RNA, 64 nt, Homo Sapiens
auauauacacacagauacaaguguacacacacacaccacacaccacacacaccccacuggcagu

SEQ ID NO: 71105 - RNA, 64 nt, Homo Sapiens
cacacagauacaaguguacacacacacaccacacaccacacacaccccacuggcagucuuugug

SEQ ID NO: 71106 - RNA, 64 nt, Homo Sapiens
uaauucagcuuuguccaaagggaguauuagugacaccacacauugguacugaauugucagaugu

SEQ ID NO: 71107 - RNA, 64 nt, Homo Sapiens
cuuugggaaagcucuugucucuggcacuguggagaccacacaccccuguuucagaaaucuggag

SEQ ID NO: 71108 - RNA, 64 nt, Homo Sapiens
aacacaaggucauggccacacugugacacacuacaccacacacaacagccaacagcuacaacag

SEQ ID NO: 71109 - RNA, 64 nt, Homo Sapiens
gcuacaacagccucacuuggucugccaggcccccaccacacaucccagcccaauccagguacgc

SEQ ID NO: 71110 - RNA, 64 nt, Homo Sapiens
agugaggccaggggcuaggacgcuggcaagccccaccacacaggcagucuguucccugcucccu

SEQ ID NO: 71111 - RNA, 64 nt, Homo Sapiens
acacccagccagggaauucucugggcucagcacgaccacacaggcccucccuggcucccugucc

SEQ ID NO: 71112 - RNA, 64 nt, Homo Sapiens
guaaauguuuauuaauagucguucaguccaacaaaccacacacagaaauacacguaugguuaau

SEQ ID NO: 71113 - RNA, 64 nt, Homo Sapiens
gcuaacugccaaaauacauucuuaaaaagcacacaccacacacagauguuuuauugagugaagc

SEQ ID NO: 71114 - RNA, 64 nt, Homo Sapiens
aaauauauccuugguucuauauacaugucugccuaccacacacaucuuggcacccugauuauuc

SEQ ID NO: 71115 - RNA, 64 nt, Homo Sapiens
ccacuuccagcagaguccugcacccucagugggcaccacacacccacaggaacuguucaguucc

SEQ ID NO: 71116 - RNA, 64 nt, Homo Sapiens
cacguucccauccacucacccacacaccacauacaccacacacaacagauauacacaccacaca

SEQ ID NO: 71117 - RNA, 64 nt, Homo Sapiens
cacaccacauacaccacacaagacagauauacacaccacacacaaucaggcaguccuugaggau

SEQ ID NO: 71118 - RNA, 64 nt, Homo Sapiens
acacacaagugcacagagcaacacaggugcacagaccacacagcauaggccacacagcacaugc

SEQ ID NO: 71119 - RNA, 64 nt, Homo Sapiens
gcacuaacacaugcacacacacacaagugcacagaccacacacacucacacacaguauacacau

SEQ ID NO: 71120 - RNA, 64 nt, Homo Sapiens
ugucagaaaagggcugggcuugggaaggggagguggaggccagguguccccagaccucuaaccc

SEQ ID NO: 71121 - RNA, 64 nt, Homo Sapiens
cauguuccccugggccccucagaaagucgagcuuggaggccagccuggaucugucucucccuuc

SEQ ID NO: 71122 - RNA, 64 nt, Homo Sapiens
gugcucuauccacugcagggccagccacucgccaggaggccacgggccacgggaagaaccaagc

SEQ ID NO: 71123 - RNA, 64 nt, Homo Sapiens
guuuucccucugggagccuaaaccaggcugcaucggaggccaggacccggaucauucacuguga

SEQ ID NO: 71124 - RNA, 64 nt, Homo Sapiens
gacuggagcugcuggaucccaguguggugguguaggaggccacagugagcagguggccccagcu

SEQ ID NO: 71125 - RNA, 64 nt, Homo Sapiens
uccaccccaucacgguggcccugagggcugacccggaggccaguggagcugccugguguccacg

SEQ ID NO: 71126 - RNA, 64 nt, Homo Sapiens
cuaagugcccugugcugguugccaggcgcagaggggaggccagcccugcccucaggaccugccu

SEQ ID NO: 71127 - RNA, 64 nt, Homo Sapiens
ccuccuccuuccagcaccugccagagcuucuccaggaggccaagcagaggcuccccucaugaag

SEQ ID NO: 71128 - RNA, 64 nt, Homo Sapiens
ugccaaggcgugggaugggaguuggggggccgcuggaggccaccggucugcaccacauggcggg

SEQ ID NO: 71129 - RNA, 64 nt, Homo Sapiens
cugggccccuuggcaaaccuuccuuuggggaaaaggaggccauuagauggagcagcucuuggga

SEQ ID NO: 71130 - RNA, 64 nt, Homo Sapiens
gaccagcuggggggcaggggggagaggggguaauggaggccaagccugcagcuuucuggaaauu

SEQ ID NO: 71131 - RNA, 64 nt, Homo Sapiens
gcagcccuagugggagcccagcacacugcuucucggaggccaggcccuccugcuggcugaggcu

SEQ ID NO: 71132 - RNA, 64 nt, Homo Sapiens
gugagcagggcccucagaggaaaggcaguauggcggaggccaugggggccccucggcauucaca

SEQ ID NO: 71133 - RNA, 64 nt, Homo Sapiens
caugguagcacacaccuguagucccagauacuugggaggccaaggcaggaggauugcuugagac

SEQ ID NO: 71134 - RNA, 64 nt, Homo Sapiens
cacgguggcucacgccuguaaucccagcacuuugggaggccaaggugggcggaucaccugaugu

SEQ ID NO: 71135 - RNA, 64 nt, Homo Sapiens
gugggaggauggguugagcagucucagcuacuugggaggccaugcagcguggugugugccugua

SEQ ID NO: 71136 - RNA, 64 nt, Homo Sapiens
gugggaguuuugcuugaggcauccgagcaauuugggaggccaagugcaguggcucacuccugua

SEQ ID NO: 71137 - RNA, 64 nt, Homo Sapiens
cugucccucccuugcugaacacucccugcuugcaggaggccaaacuucccaccccuacacacac

SEQ ID NO: 71138 - RNA, 64 nt, Homo Sapiens
cgcacuggugccaaaaccaggugggaugggacagggaggccacaugccugcugggcucccccca

SEQ ID NO: 71139 - RNA, 64 nt, Homo Sapiens
aagaucaaacaugcauggaugcaggugcacagggggaggccauaacuauaccuuauccauaggc

SEQ ID NO: 71140 - RNA, 64 nt, Homo Sapiens
gccagcaccugcccaguggggcuacugugaccauggaggccagucguguccccgugcaguaggg

SEQ ID NO: 71141 - RNA, 64 nt, Homo Sapiens
agacguucaacgccaccggaaccaugaagacggcggaggccagggacugugacauuucagccug

SEQ ID NO: 71142 - RNA, 64 nt, Homo Sapiens
cgcgguggcucacgccuguaaucccagcacuuugggaggccaagguggguggaccacaugaggu

SEQ ID NO: 71143 - RNA, 64 nt, Homo Sapiens
ugugguggcucacgccugugaucccagcacuuugggaggccaagacgggcggaucaugagguca

SEQ ID NO: 71144 - RNA, 64 nt, Homo Sapiens
cuugccuacugucaguggcuuugccaagaugggaggaggccagugcccacuugcccaccgaccu

SEQ ID NO: 71145 - RNA, 64 nt, Homo Sapiens
cacaguggcucacgccuguaaucccaacaccuugggaggccaaggcaggcagaucacgacauca

SEQ ID NO: 71146 - RNA, 64 nt, Homo Sapiens
ggaauacggggucccagagaggaaaaggguucuuggaggccaggagugcaagaaucuggagcug

SEQ ID NO: 71147 - RNA, 62 nt, Homo Sapiens
aggcuggggccccugggcugccgcgcaggcguggaggccagguuaacguccucauccgcuag

SEQ ID NO: 71148 - RNA, 64 nt, Homo Sapiens
gagaggcaaaggcucaggccggugugauaucacaggaggccagaagacaaugaccacuacccug

SEQ ID NO: 71149 - RNA, 64 nt, Homo Sapiens
cccaugagacugccugucacccucaaauccuaggggaggccauuugccccuugacacacgcccu

SEQ ID NO: 71150 - RNA, 64 nt, Homo Sapiens
cccaauggcucaugccuguaaucccaacacuuugggaggccaaggugggaggauggcuuguguc

SEQ ID NO: 71151 - RNA, 64 nt, Homo Sapiens
acucugggcugggcacaguggcucacacacuuugggaggccaagcgggggugcagaucaccuga

SEQ ID NO: 71152 - RNA, 64 nt, Homo Sapiens
gucgccgaauccucgugguuauaggugcuuggugggaggccaaguauucuguuaaagcaucuuc

SEQ ID NO: 71153 - RNA, 64 nt, Homo Sapiens
uucgcuagcagggagugggaaguaggcccucacaggaggccaccaagugacagagguagaaaac

SEQ ID NO: 71154 - RNA, 64 nt, Homo Sapiens
ugguuuugugaggagauuguccacaaaauuacauggaggccagcccugccucucuucuucagcg

SEQ ID NO: 71155 - RNA, 64 nt, Homo Sapiens
augugcagucuccacauagucaccuggaugcagaggaggccaggcacugguagucauguggccc

SEQ ID NO: 71156 - RNA, 64 nt, Homo Sapiens
cccaacuuuccaaagacccuuaucuucucaccuuggaggccacagccuggugguggcccacacc

SEQ ID NO: 71157 - RNA, 64 nt, Homo Sapiens
gagccacuccggccccgaauaccaugcgacacugggaggccaguagcugcuccccucugcacgg

SEQ ID NO: 71158 - RNA, 64 nt, Homo Sapiens
acgugaguggggcuggggcuguguauggugggaaggaggccaggacgagaaggaggcccagcaa

SEQ ID NO: 71159 - RNA, 64 nt, Homo Sapiens
ugggugagugggcuggggcuugccccucuaccugggaggccaaaguagcuuccagaacccaccc

SEQ ID NO: 71160 - RNA, 64 nt, Homo Sapiens
ccuugccauugaccguggccggcugucuccaugaggaggccaacgaugaccccuucccugaggu

SEQ ID NO: 71161 - RNA, 64 nt, Homo Sapiens
cacccugugccccggcaggcgagaccaguucccuggaggccaccgggacccacgcuccaaggcu

SEQ ID NO: 71162 - RNA, 64 nt, Homo Sapiens
gggauggggcugggggaugggccugagugagaggggaggccaagaguggccccaccuggcccuc

SEQ ID NO: 71163 - RNA, 64 nt, Homo Sapiens
aggccaagaguggccccaccuggcccucucugaaggaggccaccuccuaaaaggcccagagaga

SEQ ID NO: 71164 - RNA, 64 nt, Homo Sapiens
acacaguggcucaugcauguaauucuagcacuuuggaggccaaggcaggaggacugcuugagcc

SEQ ID NO: 71165 - RNA, 64 nt, Homo Sapiens
cacgguagcuuaugccuguaaucucagcacuuugggaggccaaggcaggcagaucaugagguca

SEQ ID NO: 71166 - RNA, 64 nt, Homo Sapiens
gcggguggauuaccuccaucaucccagcacuuugggaggccaagcacaguggcucacgccugua

SEQ ID NO: 71167 - RNA, 64 nt, Homo Sapiens
cacaggguggggcagcuuucaggcugggaaaugaggaggccaugcgccugggcaggggcagcca

SEQ ID NO: 71168 - RNA, 64 nt, Homo Sapiens
uugggcccucguuuccauugugugcccuggcccaggaggccauggcugcaggcaaagcuggaca

SEQ ID NO: 71169 - RNA, 64 nt, Homo Sapiens
caccuuccuagcugcugcucugaggcucauggugggaggccacuaaagcauagauuccccaaag

SEQ ID NO: 71170 - RNA, 64 nt, Homo Sapiens
gggaucguggagugcgggcccagccggccauccgggaggccaacaguaccccguguucguguac

SEQ ID NO: 71171 - RNA, 64 nt, Homo Sapiens
cugggggagcgugcagccaguggggagggaaccaggaggccacaaacccccagaggggcgccug

SEQ ID NO: 71172 - RNA, 64 nt, Homo Sapiens
ggcaauaggagagggucugaagggauuuggaccuggaggccaagugggaccagcggcuuguucu

SEQ ID NO: 71173 - RNA, 64 nt, Homo Sapiens
gcgggcggaucacuugagguaucccagcauuuugggaggccaagcaugguggcucaugccugua

SEQ ID NO: 71174 - RNA, 64 nt, Homo Sapiens
gugggcggaucacccugaggaucccagcacuuugggaggccaaggcaguggcucacaccuugua

SEQ ID NO: 71175 - RNA, 64 nt, Homo Sapiens
gaguacuagugacgggguugcuagcacaguugcaggaggccaagacccccuggaggaggaguac

SEQ ID NO: 71176 - RNA, 64 nt, Homo Sapiens
gacagcccugugagccuacaugugccuacccacuggaggccauggggaccugcccagcugcccg

SEQ ID NO: 71177 - RNA, 64 nt, Homo Sapiens
uuguucagguacaccaaagaggaagaagagcuguggaggccacccucuacaaagcuuuauagaa

SEQ ID NO: 71178 - RNA, 64 nt, Homo Sapiens
augguggcucaggucuguagucuuugggucuuugggaggccagggugggaggaucacuugagcu

SEQ ID NO: 71179 - RNA, 64 nt, Homo Sapiens
gucucuacaaaaaaaaauuaaaaagggggcuuugggaggccaaggcgggcagaucaugagggca

SEQ ID NO: 71180 - RNA, 64 nt, Homo Sapiens
uuuuaaaacuauuugagaugcacuuuuguacucaggaggccaaggcaggaggauugcuugagcc

SEQ ID NO: 71181 - RNA, 64 nt, Homo Sapiens
gcggguggauugcuugagccauccuagcacuuugggaggccaaccacaguggcucccaccuaua

SEQ ID NO: 71182 - RNA, 64 nt, Homo Sapiens
agccgacacucaagguguuccagagacacacucaggaggccagacagagcaggggcuucagcca

SEQ ID NO: 71183 - RNA, 64 nt, Homo Sapiens
gcaggugggucaccugggguaucucagcacuuugggaggccaagcaugguggcucacgccugua

SEQ ID NO: 71184 - RNA, 64 nt, Homo Sapiens
gugagaggauaacuugaaacaucccaacacuucgggaggccaagugcaguggcucacgccuaua

SEQ ID NO: 71185 - RNA, 64 nt, Homo Sapiens
uggccaucgggagagcucugaccugcacaccgcgggaggccagggugcugacugucaagcaucc

SEQ ID NO: 71186 - RNA, 64 nt, Homo Sapiens
ggaggguccccacagcccgugccccacgccgccuggaggccagaggggucaguggcccugcugu

SEQ ID NO: 71187 - RNA, 64 nt, Homo Sapiens
gcaguuggggguucgaguagaucucauggguacaggaggccagcagggaccaggccagucagcc

SEQ ID NO: 71188 - RNA, 64 nt, Homo Sapiens
ccccagccucuagcuacccuguaucgaggcaaggggaggccaguaaaguuugccaagccugauc

SEQ ID NO: 71189 - RNA, 64 nt, Homo Sapiens
aggguauuuccuaguaagcauacuuucuuaagacggaggccauuugguuccugggagaauaggc

SEQ ID NO: 71190 - RNA, 64 nt, Homo Sapiens
agcguuggcuuucgccuguaaucccaacacuuugggaggccaggacagaucacuugaggucagg

SEQ ID NO: 71191 - RNA, 64 nt, Homo Sapiens
cacgguggcucaugccuguaaucccagcacuuugggaggccaagacgggcggaucuuuugaggu

SEQ ID NO: 71192 - RNA, 64 nt, Homo Sapiens
gccaagacgggcggaucuuuugaggucgggaguuggaggccagccuggccaaaauggcaaaacc

SEQ ID NO: 71193 - RNA, 64 nt, Homo Sapiens
ugcaguggaucacgccuguaaucccagcacauugggaggccaaggcacauaggucacuugaggu

SEQ ID NO: 71194 - RNA, 64 nt, Homo Sapiens
uggguucaagcgauuccucugccucagcacuuugggaggccaaggcaggcagauaacaaaguca

SEQ ID NO: 71195 - RNA, 64 nt, Homo Sapiens
gggagcagaggagcggggcaggugauguaugucaggaggccacacgacgcagcugugaauggcc

SEQ ID NO: 71196 - RNA, 64 nt, Homo Sapiens
gcagggcaccaccaccaccauggcccccugcggcggaggccaaccccaaggcuccggaccacac

SEQ ID NO: 71197 - RNA, 64 nt, Homo Sapiens
guguaagcaauaacagaucuagcagcacaggccaggaggccacauucucuaacagggccagcug

SEQ ID NO: 71198 - RNA, 64 nt, Homo Sapiens
gcagguagaucacaaggucaaucccagcucuuugggaggccaagugcggugguucgugccugua

SEQ ID NO: 71199 - RNA, 64 nt, Homo Sapiens
cacucccaggcaggggugaggguggccuggcccaggaggccaggaaggagggcccugucugccu

SEQ ID NO: 71200 - RNA, 64 nt, Homo Sapiens
acuccugggggcccccaaggcuccccuccuguggggaggccaccuuuuaaggcaccacuagcag

SEQ ID NO: 71201 - RNA, 64 nt, Homo Sapiens
gguggccauggagacuccaccuggauccccuguaggaggccagggaggggaacucagcaguuca

SEQ ID NO: 71202 - RNA, 64 nt, Homo Sapiens
ccccguggcucacaccuguaauccuagcacauugggaggccaaggcaggcacaucaccugaguu

SEQ ID NO: 71203 - RNA, 64 nt, Homo Sapiens
aaugaucagaaccauuuuaccauguacucuuagaggaggccagucccacuacuuaaguacuugu

SEQ ID NO: 71204 - RNA, 64 nt, Homo Sapiens
aaugccguuggguggauugucugaggcugugaccggaggccaggacccugcaggacuuccgugg

SEQ ID NO: 71205 - RNA, 64 nt, Homo Sapiens
gagcaguggcugaguagcucccagcagucugccuggaggccaggcuaucuuggagagcugggga

SEQ ID NO: 71206 - RNA, 64 nt, Homo Sapiens
aaauaaggagcauauguccuucagacucucucugggaggccauauccuuccuagccuugcacuu

SEQ ID NO: 71207 - RNA, 64 nt, Homo Sapiens
agcucagccucaggcccaggccaggucaggcuucggaggccacacgccacagacgagcuccgag

SEQ ID NO: 71208 - RNA, 64 nt, Homo Sapiens
gcaggaggaucgcuggagccaucccagcacuuugggaggccaagugcgguggcucacgccugua

SEQ ID NO: 71209 - RNA, 64 nt, Homo Sapiens; identical to SEQ ID NO: 50174

SEQ ID NO: 71210 - RNA, 64 nt, Homo Sapiens; identical to SEQ ID NO: 50175

SEQ ID NO: 71211 - RNA, 64 nt, Homo Sapiens; identical to SEQ ID NO: 50176

SEQ ID NO: 71212 - RNA, 64 nt, Homo Sapiens; identical to SEQ ID NO: 50177

SEQ ID NO: 71213 - RNA, 64 nt, Homo Sapiens; identical to SEQ ID NO: 50178

SEQ ID NO: 71214 - RNA, 64 nt, Homo Sapiens; identical to SEQ ID NO: 50179

SEQ ID NO: 71215 - RNA, 64 nt, Homo Sapiens; identical to SEQ ID NO: 50180

SEQ ID NO: 71216 - RNA, 64 nt, Homo Sapiens; identical to SEQ ID NO: 50181

SEQ ID NO: 71217 - RNA, 64 nt, Homo Sapiens; identical to SEQ ID NO: 50182

SEQ ID NO: 71218 - RNA, 64 nt, Homo Sapiens; identical to SEQ ID NO: 50183

SEQ ID NO: 71219 - RNA, 64 nt, Homo Sapiens; identical to SEQ ID NO: 50184

SEQ ID NO: 71220 - RNA, 64 nt, Homo Sapiens; identical to SEQ ID NO: 50185

SEQ ID NO: 71221 - RNA, 64 nt, Homo Sapiens; identical to SEQ ID NO: 50186

SEQ ID NO: 71222 - RNA, 64 nt, Homo Sapiens; identical to SEQ ID NO: 50187

SEQ ID NO: 71223 - RNA, 64 nt, Homo Sapiens; identical to SEQ ID NO: 50188

SEQ ID NO: 71224 - RNA, 64 nt, Homo Sapiens; identical to SEQ ID NO: 50189

SEQ ID NO: 71225 - RNA, 64 nt, Homo Sapiens; identical to SEQ ID NO: 50190

SEQ ID NO: 71226 - RNA, 64 nt, Homo Sapiens; identical to SEQ ID NO: 50191

SEQ ID NO: 71227 - RNA, 64 nt, Homo Sapiens; identical to SEQ ID NO: 50192

SEQ ID NO: 71228 - RNA, 64 nt, Homo Sapiens; identical to SEQ ID NO: 50193

SEQ ID NO: 71229 - RNA, 64 nt, Homo Sapiens; identical to SEQ ID NO: 50194

SEQ ID NO: 71230 - RNA, 64 nt, Homo Sapiens; identical to SEQ ID NO: 50195

SEQ ID NO: 71231 - RNA, 64 nt, Homo Sapiens; identical to SEQ ID NO: 50196

SEQ ID NO: 71232 - RNA, 64 nt, Homo Sapiens; identical to SEQ ID NO: 50197

SEQ ID NO: 71233 - RNA, 64 nt, Homo Sapiens; identical to SEQ ID NO: 50198

SEQ ID NO: 71234 - RNA, 64 nt, Homo Sapiens; identical to SEQ ID NO: 50199

SEQ ID NO: 71235 - RNA, 64 nt, Homo Sapiens; identical to SEQ ID NO: 50200

SEQ ID NO: 71236 - RNA, 64 nt, Homo Sapiens; identical to SEQ ID NO: 50201

SEQ ID NO: 71237 - RNA, 64 nt, Homo Sapiens; identical to SEQ ID NO: 50202

SEQ ID NO: 71238 - RNA, 64 nt, Homo Sapiens; identical to SEQ ID NO: 50203

SEQ ID NO: 71239 - RNA, 64 nt, Homo Sapiens; identical to SEQ ID NO: 50204

SEQ ID NO: 71240 - RNA, 64 nt, Homo Sapiens; identical to SEQ ID NO: 50205

SEQ ID NO: 71241 - RNA, 64 nt, Homo Sapiens; identical to SEQ ID NO: 50206

SEQ ID NO: 71242 - RNA, 64 nt, Homo Sapiens; identical to SEQ ID NO: 50207

SEQ ID NO: 71243 - RNA, 64 nt, Homo Sapiens; identical to SEQ ID NO: 50208

SEQ ID NO: 71244 - RNA, 64 nt, Homo Sapiens; identical to SEQ ID NO: 50209

SEQ ID NO: 71245 - RNA, 64 nt, Homo Sapiens; identical to SEQ ID NO: 50210

SEQ ID NO: 71246 - RNA, 64 nt, Homo Sapiens; identical to SEQ ID NO: 50211

SEQ ID NO: 71247 - RNA, 64 nt, Homo Sapiens; identical to SEQ ID NO: 50212

SEQ ID NO: 71248 - RNA, 64 nt, Homo Sapiens; identical to SEQ ID NO: 50213

SEQ ID NO: 71249 - RNA, 64 nt, Homo Sapiens; identical to SEQ ID NO: 50214

SEQ ID NO: 71250 - RNA, 64 nt, Homo Sapiens; identical to SEQ ID NO: 50215

SEQ ID NO: 71251 - RNA, 64 nt, Homo Sapiens; identical to SEQ ID NO: 50216

SEQ ID NO: 71252 - RNA, 64 nt, Homo Sapiens; identical to SEQ ID NO: 50217

SEQ ID NO: 71253 - RNA, 64 nt, Homo Sapiens; identical to SEQ ID NO: 50218

SEQ ID NO: 71254 - RNA, 64 nt, Homo Sapiens; identical to SEQ ID NO: 50219

SEQ ID NO: 71255 - RNA, 64 nt, Homo Sapiens; identical to SEQ ID NO: 50220

SEQ ID NO: 71256 - RNA, 64 nt, Homo Sapiens; identical to SEQ ID NO: 50221

SEQ ID NO: 71257 - RNA, 64 nt, Homo Sapiens; identical to SEQ ID NO: 50222

SEQ ID NO: 71258 - RNA, 64 nt, Homo Sapiens; identical to SEQ ID NO: 50223

SEQ ID NO: 71259 - RNA, 64 nt, Homo Sapiens; identical to SEQ ID NO: 50224

SEQ ID NO: 71260 - RNA, 64 nt, Homo Sapiens; identical to SEQ ID NO: 50225

SEQ ID NO: 71261 - RNA, 64 nt, Homo Sapiens; identical to SEQ ID NO: 50226

SEQ ID NO: 71262 - RNA, 64 nt, Homo Sapiens; identical to SEQ ID NO: 50227

SEQ ID NO: 71263 - RNA, 64 nt, Homo Sapiens; identical to SEQ ID NO: 50228

SEQ ID NO: 71264 - RNA, 64 nt, Homo Sapiens; identical to SEQ ID NO: 50229

SEQ ID NO: 71265 - RNA, 64 nt, Homo Sapiens; identical to SEQ ID NO: 50230

SEQ ID NO: 71266 - RNA, 64 nt, Homo Sapiens; identical to SEQ ID NO: 50231

SEQ ID NO: 71267 - RNA, 64 nt, Homo Sapiens; identical to SEQ ID NO: 50232

SEQ ID NO: 71268 - RNA, 64 nt, Homo Sapiens; identical to SEQ ID NO: 50233

SEQ ID NO: 71269 - RNA, 64 nt, Homo Sapiens; identical to SEQ ID NO: 50234

SEQ ID NO: 71270 - RNA, 64 nt, Homo Sapiens; identical to SEQ ID NO: 50235

SEQ ID NO: 71271 - RNA, 64 nt, Homo Sapiens; identical to SEQ ID NO: 50236

SEQ ID NO: 71272 - RNA, 64 nt, Homo Sapiens; identical to SEQ ID NO: 50237

SEQ ID NO: 71273 - RNA, 64 nt, Homo Sapiens; identical to SEQ ID NO: 50238

SEQ ID NO: 71274 - RNA, 64 nt, Homo Sapiens; identical to SEQ ID NO: 50239

SEQ ID NO: 71275 - RNA, 64 nt, Homo Sapiens; identical to SEQ ID NO: 50240

SEQ ID NO: 71276 - RNA, 64 nt, Homo Sapiens; identical to SEQ ID NO: 50241

SEQ ID NO: 71277 - RNA, 64 nt, Homo Sapiens; identical to SEQ ID NO: 50242

SEQ ID NO: 71278 - RNA, 64 nt, Homo Sapiens; identical to SEQ ID NO: 50243

SEQ ID NO: 71279 - RNA, 64 nt, Homo Sapiens
gaccuaaagaaugcguuauccauccuauauaaaagaaagauaaaacacaggucaccaauuuucu

SEQ ID NO: 71280 - RNA, 64 nt, Homo Sapiens
cauuuuuugagccuaucauuaauuagcuuaguaugaaagauaagaaaaucuccauguuguaucc

SEQ ID NO: 71281 - RNA, 64 nt, Homo Sapiens
aagaacauggaggccaagaacauccauggcuaaugaaagauaccacugcacgcagugccuucag

SEQ ID NO: 71282 - RNA, 64 nt, Homo Sapiens
aaguaaugaguugggauuucagcaaucugcugaagaaagauaugacgaugccaaggauuucauc

SEQ ID NO: 71283 - RNA, 64 nt, Homo Sapiens
ugugguagacauguccuuccaauuuaaaugugaggaaagauaucacuguaggaagaaauggaau

SEQ ID NO: 71284 - RNA, 64 nt, Homo Sapiens
gaugaaguugaagagaaaucuuugagccaucuaggaaagauaugcauuaguggaggauagugcu

SEQ ID NO: 71285 - RNA, 64 nt, Homo Sapiens
cgucaccuguuacagguguacuuucuuaaugacugaaagauaaguggguagcaccgucagagag

SEQ ID NO: 71286 - RNA, 64 nt, Homo Sapiens
ggggcaaguuucacccaaaugccugagacugcuugaaagauauauuuuaaguggugcacuaauu

SEQ ID NO: 71287 - RNA, 64 nt, Homo Sapiens
ugaugauucguggagcccuaaagagaaaugaugugaaagauaaagguaguuagcaauaggugga

SEQ ID NO: 71288 - RNA, 64 nt, Homo Sapiens
ugcuaagaaagcaaauaagcuuuuauaguagugggaaagauacauuauaaaugacagaucucaa

SEQ ID NO: 71289 - RNA, 64 nt, Homo Sapiens
gagagugguugaguaauuuguccuguuuuacagagaaagauacuggcccucagaagcagauuau

SEQ ID NO: 71290 - RNA, 64 nt, Homo Sapiens
uauaguguauuugugaaagugaauuuaugaauuggaaagauauaucugcagccagaaagaaucu

SEQ ID NO: 71291 - RNA, 64 nt, Homo Sapiens
uuaauuacuuuauucaguaaagaaguaaaauaaugaaagauauguguaacuauuuuaaauguua

SEQ ID NO: 71292 - RNA, 64 nt, Homo Sapiens
cucauuuuuuuuauugaacccauaccagugguaggaaagauauucaaucuuauugccaacauuc

SEQ ID NO: 71293 - RNA, 64 nt, Homo Sapiens
gugugaaaaaggaauaaauuguuccaugcugguggaaagauagagauuguuuuuagagguuggu

SEQ ID NO: 71294 - RNA, 64 nt, Homo Sapiens
guauguuuuuaauaugcauagaacaaaagauuuggaaagauauacaccaaacuguuaaaugugg

SEQ ID NO: 71295 - RNA, 64 nt, Homo Sapiens
aauguaugcaauuccugaguuauuuucuguugaggaaagauaaagcuaccucuauaucauucaa

SEQ ID NO: 71296 - RNA, 64 nt, Homo Sapiens
agcugcaugacagguauugauggaagaaguucgggaaagauaccgggaccaaagagaaucauuu

SEQ ID NO: 71297 - RNA, 63 nt, Homo Sapiens
cacaggugugauccuccuugagcauugaggaggcacauggagaacuaaaucuuuuguaguagc

SEQ ID NO: 71298 - RNA, 63 nt, Homo Sapiens
uuuuucaacaauuucaacaaugacacaaaaauucacauggaaauggggaagauggucuguuuu

SEQ ID NO: 71299 - RNA, 63 nt, Homo Sapiens
gguuuuuuuuauacuaaaaauuuuuuuuaaaaucacauggaacucuaucuagauguguaagug

SEQ ID NO: 71300 - RNA, 63 nt, Homo Sapiens
cuuauagacagacuuauugguaauaaacuguugcacauggauacaguacauguaagcagccau

SEQ ID NO: 71301 - RNA, 63 nt, Homo Sapiens
cuugccaugccugugugcccguugggucacugccacauggaguuggacauuggacauugcuaa

SEQ ID NO: 71302 - RNA, 63 nt, Homo Sapiens
cacugucaugcaggucauaugucuggacacugccacauggagcgccacaucugggcauacagu

SEQ ID NO: 71303 - RNA, 63 nt, Homo Sapiens
ucuuccauuucguuuagcuguggguuuguuggucacauggagcccuguuguuuuggcucaauu

SEQ ID NO: 71304 - RNA, 63 nt, Homo Sapiens
cuacauguguuugaacuauucugucucucuugucacauggaauaaagccucaaaucuuccuua

SEQ ID NO: 71305 - RNA, 63 nt, Homo Sapiens
cauauuuuuggaagcaaaacacaacaccacgaccacauggaaauuuggcccuaauagcacugg

SEQ ID NO: 71306 - RNA, 63 nt, Homo Sapiens
uugaggccauagucuuuaaauacacuuguuucacacauggacgagacuuaaagaauuuucuaa

SEQ ID NO: 71307 - RNA, 63 nt, Homo Sapiens
acacuuguguuggcugugccuuuacuguccucacacauggaagguccuagaaagccuggucau

SEQ ID NO: 71308 - RNA, 63 nt, Homo Sapiens
gauuaaaagcaaauaccugucuaguaaagcuugcacauggauuaguaacuccccuuaaaaugu

SEQ ID NO: 71309 - RNA, 63 nt, Homo Sapiens
uuuacagacacugggcuaaaaaggguauucagacacauggacacacauuccuagaaugucauc

SEQ ID NO: 71310 - RNA, 63 nt, Homo Sapiens
augugaugcaauaaaauuuaaaauaaauuucugcacauggaauauuuucagcuggcucuucug

SEQ ID NO: 71311 - RNA, 63 nt, Homo Sapiens
ccuucauugcuggagacaguagaggcaugaacacacauggaugcacacacacacacgccaaug

SEQ ID NO: 71312 - RNA, 63 nt, Homo Sapiens
agauaugcacacacagaugcacacacagauauacacauggaugcacgcacaugccaaugcacg

SEQ ID NO: 71313 - RNA, 63 nt, Homo Sapiens
acacaccgaugugcgcacacacagauaugcacacacauggaugagcacacacacaccaaugcg

SEQ ID NO: 71314 - RNA, 64 nt, Homo Sapiens
auucguuguggauaauucauaccccugacccaucaucugcuaccuuaugcuguacaauuaaaau

SEQ ID NO: 71315 - RNA, 64 nt, Homo Sapiens
uauauaaauagacuugcaguuggagauuguuaccaucugcuacagcugcauaugucaguggcuc

SEQ ID NO: 71316 - RNA, 64 nt, Homo Sapiens
ggaacagugacauggacacccagccacuuuccacaucugcuagaggggcugaguccucacugag

SEQ ID NO: 71317 - RNA, 64 nt, Homo Sapiens
uccugugguguucugggcaugugccucuucacacaucugcuauuaugcugagcgcccugagccg

SEQ ID NO: 71318 - RNA, 63 nt, Homo Sapiens
cuguuauuguccccuaaugauaggauauucccugcugccuaccuggagauucaguaggaucuu

SEQ ID NO: 71319 - RNA, 63 nt, Homo Sapiens
ccuucaccucuguugcugaggaaaugguagaaugcugccuaucaccuccagcacaaucccagu

SEQ ID NO: 71320 - RNA, 63 nt, Homo Sapiens
gacucccgggccuugugugcgugucucauuguggcugccuaugaccgggacccccccacccac

SEQ ID NO: 71321 - RNA, 63 nt, Homo Sapiens
cagugccauucuuucacaacccaggagccuccagcugccuaacacagaggagucaggcccgcc

SEQ ID NO: 71322 - RNA, 64 nt, Homo Sapiens
uuuauuuauuaaauauuuggguagaauggcaacuaauucuaauugcuaggcuagcugguuugga

SEQ ID NO: 71323 - RNA, 64 nt, Homo Sapiens
agccuauccccagguagggguugccuuuaaaccaaauucuaaccccuccuugcuugucacccag

SEQ ID NO: 71324 - RNA, 64 nt, Homo Sapiens
cuugucauuuuaaugucauuauugaaauacuuuuaauucuaauuuucaaaagaaagcuaaaugc

SEQ ID NO: 71325 - RNA, 64 nt, Homo Sapiens
ugagaggaggggaguguaugucuagaguuaccccaauucuaaauagguaccaaaagaguauuga

SEQ ID NO: 71326 - RNA, 64 nt, Homo Sapiens
ucauucaaauggagacgccccaguggggggacuuaauucuaauccugcucaguggccagguuau

SEQ ID NO: 71327 - RNA, 64 nt, Homo Sapiens
ugaguuuuccaaagaccuuucaucgucaggauagaauucuaacuuguuuaaacuucucugacca

SEQ ID NO: 71328 - RNA, 64 nt, Homo Sapiens
uuagaaauaugcuucugccucaaaauggaaaauuaauucuaaacagauaaaguccugaaccuuu

SEQ ID NO: 71329 - RNA, 64 nt, Homo Sapiens
uaauguaguuacugugagcccccuaaaauguagaaauucuaacuccuucuuucagugacuucuu

SEQ ID NO: 71330 - RNA, 64 nt, Homo Sapiens
acccuugaccagaaauuuuucuucuaaagaauuuaauucuaaaaguuauagacauucccaaaga

SEQ ID NO: 71331 - RNA, 64 nt, Homo Sapiens
uuuguuaaaauaaauaacauuuaauuugacggaaaauucuaaaaaucaacauuugguaacuuaa

SEQ ID NO: 71332 - RNA, 64 nt, Homo Sapiens
auuuuguugaaugcuauggaauauuaauauaauuaauucuaaaauaucaccuaaaauaugucaa

SEQ ID NO: 71333 - RNA, 64 nt, Homo Sapiens
aauaaugcugauguucaacaccaucaccaucuucaauucuaauaccccccacacucucccuccc

SEQ ID NO: 71334 - RNA, 64 nt, Homo Sapiens
gcccugugauuugaaaaauaauaacauuaugaacaauucuaaaaacauuuucagaaacuuagug

SEQ ID NO: 71335 - RNA, 64 nt, Homo Sapiens
aaaauauaauuguuuuuuauuuuauucaagguaaaauucuaaauuuuuuuauacaggggaauau

SEQ ID NO: 71336 - RNA, 64 nt, Homo Sapiens
agagcaagcuuuuuuauuuugacaaaaauacucuaauucuaaccugcaaauucccagauuugaa

SEQ ID NO: 71337 - RNA, 64 nt, Homo Sapiens
aaguuugauauucaguggauacaaauagaacaugaauucuaaguuuuggguaauguuaacucag

SEQ ID NO: 71338 - RNA, 64 nt, Homo Sapiens
uuaaccucaucaaaagugugugaauuuuaaaacaaauucuaaaaaaacuauagugcuaaauugg

SEQ ID NO: 71339 - RNA, 64 nt, Homo Sapiens
gcucuuuuaaaugccaauuacagucccuuacuggaauucuaacuguaauuugcuuugcaaucaa

SEQ ID NO: 71340 - RNA, 64 nt, Homo Sapiens
uucaaaacaggcauuucauuuagcacuagguuugaauucuaaaacaauaaaaaugagcccuaug

SEQ ID NO: 71341 - RNA, 64 nt, Homo Sapiens
agcugagugacucuuuaauagaacccuuuaauguaauucuaauaaaguccauaucaugaauuca

SEQ ID NO: 71342 - RNA, 64 nt, Homo Sapiens
cuauauucucuguaguuacugaaaaccgaaagucaauucuaauuauucaucuuacauauuuuuc

SEQ ID NO: 71343 - RNA, 64 nt, Homo Sapiens
uuuucaacuguaaacuuauucugaaauaaaguaaaauucuaauuguuuaaauacugugaugaau

SEQ ID NO: 71344 - RNA, 64 nt, Homo Sapiens
aauauaguccaaacguugcacugaaacacaacagaauucuaagagaagugcuaaauuuuaaaag

SEQ ID NO: 71345 - RNA, 64 nt, Homo Sapiens
auuuuuaacauuacugaggucuaagaacuaauuuaauucuaaauuuugaagacacuaugccuuc

SEQ ID NO: 71346 - RNA, 64 nt, Homo Sapiens
aggaauaauuguauguaaagcgcauaagucauagaauucuaaucaauucuaauucccuguaauu

SEQ ID NO: 71347 - RNA, 64 nt, Homo Sapiens
cccuguaauucgcauaagucuaaguuauagagagaauucuaauuguaguagggauuaauuccca

SEQ ID NO: 71348 - RNA, 64 nt, Homo Sapiens
uuaccagcaaagaauauuuuuaauguggauaucuaauucuaaagucuguuccauuagaagcaau

SEQ ID NO: 71349 - RNA, 64 nt, Homo Sapiens
auauuguauuuuaaaaaugcauauugaucacuauaauucuaaaacaauuuuuuaaauaaaccag

SEQ ID NO: 71350 - RNA, 64 nt, Homo Sapiens
ccaguaugaauaguggaaacaaaauuuauuacagaauucuaauuauguacagaaaacauuagaa

SEQ ID NO: 71351 - RNA, 64 nt, Homo Sapiens
agucauauacacuggauaauaaaucaaaacuuaaaauucuaacccauacucugaauuucaguaa

SEQ ID NO: 71352 - RNA, 64 nt, Homo Sapiens
aucuaaauuuccuaacaagguaaaauauuuuaggaauucuaaacgcgugacuucucauuuuaaa

SEQ ID NO: 71353 - RNA, 64 nt, Homo Sapiens
uaggucucaagccuguauuugcuuguuuugacuuaauucuaaaauagguacaauucaguuguug

SEQ ID NO: 71354 - RNA, 64 nt, Homo Sapiens
uuugaaaauauuauaacugguauuuuuucuucacaauucuaaccuauccuuuaaucacauuuua

SEQ ID NO: 71355 - RNA, 64 nt, Homo Sapiens
cacuuguuuauuuugggggauuuuuuucuuuuuuaauucuaauuaacuagaagaaauuauuaac

SEQ ID NO: 71356 - RNA, 64 nt, Homo Sapiens
uaguggcccccacaggaguggagucuugaaaucuaauucuaaaugccagucagugaugaucgca

SEQ ID NO: 71357 - RNA, 64 nt, Homo Sapiens
auuuuaaugaaugugagcucuugacuuacucuagaauucuaauacagauacuuucugcacuagu

SEQ ID NO: 71358 - RNA, 64 nt, Homo Sapiens
gcccaggccuccaguccuugauaauaaacaaauuaauucuaaaguacaacuucaaugcuuaaua

SEQ ID NO: 71359 - RNA, 64 nt, Homo Sapiens
aucuucaucucaaauguagcacugauauuuuuaaaauucuaauaaauaucuguugcacuguuca

SEQ ID NO: 71360 - RNA, 64 nt, Homo Sapiens
gugucuaugacuuauuuccuuaguuagaugugauaauucuaagaacuuaacguguuuucuguca

SEQ ID NO: 71361 - RNA, 64 nt, Homo Sapiens
cacaagauuccaucuguggcucaagaagcacaccaauucuaaccucaaaagcagcagcaagucg

SEQ ID NO: 71362 - RNA, 64 nt, Homo Sapiens
ccuauauuuucaaguuauguguucuaauuuuuuuaauucuaauagaucaccacuuucucuucua

SEQ ID NO: 71363 - RNA, 64 nt, Homo Sapiens
agguuucuaauuuuguaauucugauucuaagauaaauucuaagguucaauuauaugcagacuga

SEQ ID NO: 71364 - RNA, 64 nt, Homo Sapiens
uguguacuucauaauaauuuaacuaagcaagucaaauucuaauggguagaggcacaaagaggca

SEQ ID NO: 71365 - RNA, 64 nt, Homo Sapiens
ucccaccuauuuucacuuguagcucauauauaauaauucuaauguuuuacucugaagucagaag

SEQ ID NO: 71366 - RNA, 64 nt, Homo Sapiens
gauuuuagcagguuuucuuuauaagaaucguguaaauucuaagauaaugcuuucuuguaguaga

SEQ ID NO: 71367 - RNA, 64 nt, Homo Sapiens
aacuguuuuaaccuucaggagauuacgcauuuugaauucuaaugacaagugccaacuuacagau

SEQ ID NO: 71368 - RNA, 64 nt, Homo Sapiens
auucuucacggcagccagaaaguuguaaggggccaauucuaaguuauauguuggaccucugaaa

SEQ ID NO: 71369 - RNA, 64 nt, Homo Sapiens
uaauuuacauauguucacgcaaucguucaagagcaauucuaauaaaacaaauguaagacuacaa

SEQ ID NO: 71370 - RNA, 64 nt, Homo Sapiens
cuuaaagauuauaaauuauguaaauacauuaauaaauucuaaguuucauuugacauuccauuga

SEQ ID NO: 71371 - RNA, 64 nt, Homo Sapiens
ucugaaaucauauaaaaagaaugucauuaguaaaaauucuaacuucguuuuguuuaaaagacau

SEQ ID NO: 71372 - RNA, 64 nt, Homo Sapiens
auuucuguaaaugauaccuacauucuaaagaguuaauucuaauuauuccgauaugaccuuaagg

SEQ ID NO: 71373 - RNA, 64 nt, Homo Sapiens
agaagauauuaagucccuuucaaaauggaaaauuaauucuaaacugagaaaaauguuccuacua

SEQ ID NO: 71374 - RNA, 64 nt, Homo Sapiens; identical to SEQ ID NO: 71372

SEQ ID NO: 71375 - RNA, 64 nt, Homo Sapiens; identical to SEQ ID NO: 71373

SEQ ID NO: 71376 - RNA, 64 nt, Homo Sapiens
uguggaagugagaaggagucacugugaugcuuagcuguccuaaaugaugguuugcucaaugcca

SEQ ID NO: 71377 - RNA, 64 nt, Homo Sapiens
gggcugaggaugcagaaacaggcaggacacagugcuguccuagcagugcacuggcgggucucuc

SEQ ID NO: 71378 - RNA, 64 nt, Homo Sapiens
guucuuuccugaccucuagcaauuuucuaaaguucuguccuagaaaaaccaacucaguauugga

SEQ ID NO: 71379 - RNA, 64 nt, Homo Sapiens
ucucauuuucaauccuguuucucacaucuuuacucuguccuaccaacuaccuuuccauaauguu

SEQ ID NO: 71380 - RNA, 64 nt, Homo Sapiens
acauauguaauuugugcagugugacauggacuugcuguccuaauggauguguugugccuugugu

SEQ ID NO: 71381 - RNA, 64 nt, Homo Sapiens
gacuaaauaggcccagccuccuucccuuccagcucuguccuaggagcauaggcgggaaaucuga

SEQ ID NO: 71382 - RNA, 64 nt, Homo Sapiens
cacaccuucccugccccguccugagugccccuuccuguccuaagcccccugcucucuucugagc

SEQ ID NO: 71383 - RNA, 64 nt, Homo Sapiens
ccugaggacccuucccuauccugagcccccuucccuguccuaagccugacgccugcaccgggcc

SEQ ID NO: 71384 - RNA, 64 nt, Homo Sapiens
ucauuugagcagggcucagcggggacagcuccuucuguccuacucugugucagguggggcagcu

SEQ ID NO: 71385 - RNA, 64 nt, Homo Sapiens
cauauucuguuggccagugugacaaggauugcuacuguccuacccacccuccuuucaccacaug

SEQ ID NO: 71386 - RNA, 64 nt, Homo Sapiens
ccugacgccugcaccgggcccugagcccccuucccuguccuaagccugaggacccuuccccauc

SEQ ID NO: 71387 - RNA, 64 nt, Homo Sapiens
cccccugcucucuucugagccugagugccccuuccuguccuaagcacaccuucccugccccguc

SEQ ID NO: 71388 - RNA, 64 nt, Homo Sapiens; identical to SEQ ID NO: 53591

SEQ ID NO: 71389 - RNA, 64 nt, Homo Sapiens; identical to SEQ ID NO: 53592

SEQ ID NO: 71390 - RNA, 64 nt, Homo Sapiens; identical to SEQ ID NO: 53593

SEQ ID NO: 71391 - RNA, 64 nt, Homo Sapiens; identical to SEQ ID NO: 53594

SEQ ID NO: 71392 - RNA, 64 nt, Homo Sapiens; identical to SEQ ID NO: 53595

SEQ ID NO: 71393 - RNA, 64 nt, Homo Sapiens; identical to SEQ ID NO: 53596

SEQ ID NO: 71394 - RNA, 64 nt, Homo Sapiens; identical to SEQ ID NO: 53597

SEQ ID NO: 71395 - RNA, 64 nt, Homo Sapiens; identical to SEQ ID NO: 53598

SEQ ID NO: 71396 - RNA, 64 nt, Homo Sapiens; identical to SEQ ID NO: 53599

SEQ ID NO: 71397 - RNA, 64 nt, Homo Sapiens; identical to SEQ ID NO: 53600

SEQ ID NO: 71398 - RNA, 64 nt, Homo Sapiens; identical to SEQ ID NO: 53601

SEQ ID NO: 71399 - RNA, 64 nt, Homo Sapiens; identical to SEQ ID NO: 53602

SEQ ID NO: 71400 - RNA, 64 nt, Homo Sapiens; identical to SEQ ID NO: 53603

SEQ ID NO: 71401 - RNA, 64 nt, Homo Sapiens; identical to SEQ ID NO: 53604

SEQ ID NO: 71402 - RNA, 64 nt, Homo Sapiens; identical to SEQ ID NO: 53605

SEQ ID NO: 71403 - RNA, 64 nt, Homo Sapiens; identical to SEQ ID NO: 53606

SEQ ID NO: 71404 - RNA, 64 nt, Homo Sapiens; identical to SEQ ID NO: 53607

SEQ ID NO: 71405 - RNA, 64 nt, Homo Sapiens; identical to SEQ ID NO: 53608

SEQ ID NO: 71406 - RNA, 64 nt, Homo Sapiens; identical to SEQ ID NO: 53609

SEQ ID NO: 71407 - RNA, 64 nt, Homo Sapiens; identical to SEQ ID NO: 53610

SEQ ID NO: 71408 - RNA, 64 nt, Homo Sapiens; identical to SEQ ID NO: 53611

SEQ ID NO: 71409 - RNA, 64 nt, Homo Sapiens; identical to SEQ ID NO: 53612

SEQ ID NO: 71410 - RNA, 64 nt, Homo Sapiens; identical to SEQ ID NO: 53613

SEQ ID NO: 71411 - RNA, 64 nt, Homo Sapiens; identical to SEQ ID NO: 53614

SEQ ID NO: 71412 - RNA, 64 nt, Homo Sapiens; identical to SEQ ID NO: 53615

SEQ ID NO: 71413 - RNA, 64 nt, Homo Sapiens; identical to SEQ ID NO: 53616

SEQ ID NO: 71414 - RNA, 64 nt, Homo Sapiens; identical to SEQ ID NO: 53617

SEQ ID NO: 71415 - RNA, 64 nt, Homo Sapiens; identical to SEQ ID NO: 53618

SEQ ID NO: 71416 - RNA, 64 nt, Homo Sapiens; identical to SEQ ID NO: 53619

SEQ ID NO: 71417 - RNA, 64 nt, Homo Sapiens; identical to SEQ ID NO: 53620

SEQ ID NO: 71418 - RNA, 64 nt, Homo Sapiens; identical to SEQ ID NO: 53621

SEQ ID NO: 71419 - RNA, 64 nt, Homo Sapiens; identical to SEQ ID NO: 53622

SEQ ID NO: 71420 - RNA, 64 nt, Homo Sapiens; identical to SEQ ID NO: 53623

SEQ ID NO: 71421 - RNA, 64 nt, Homo Sapiens; identical to SEQ ID NO: 53624

SEQ ID NO: 71422 - RNA, 64 nt, Homo Sapiens; identical to SEQ ID NO: 53625

SEQ ID NO: 71423 - RNA, 64 nt, Homo Sapiens
cccauaccccucagggugguucccuaccagccaggcuuacuacuucuagaagaaagcagagugc

SEQ ID NO: 71424 - RNA, 64 nt, Homo Sapiens
gaagaugguguggcccuguuagucuccguguguggcuuacuagccagccuugggaacugccaac

SEQ ID NO: 71425 - RNA, 64 nt, Homo Sapiens
gcuuuccaauccuuggugauugcuguaugucaaggcuuacuacuguaagcauuuauuaaguacc

SEQ ID NO: 71426 - RNA, 64 nt, Homo Sapiens
ggguuuucuaauaaaaacaauggguuagagaagugcuuacuaagaggauacccagugucuauuc

SEQ ID NO: 71427 - RNA, 64 nt, Homo Sapiens
acauucccuuccccauagccauccucucccccaugcuuacuaauccucugaggugccugcuggc

SEQ ID NO: 71428 - RNA, 64 nt, Homo Sapiens
ugccagguacuacauccuguuagcauuaaugaaugcuuacuauguaguagggaaagaagaaagc

SEQ ID NO: 71429 - RNA, 64 nt, Homo Sapiens
uaaaugauuuaaguuguuucuuuuuucuagggacgcuuacuaauucuuacucucaucagacauu

SEQ ID NO: 71430 - RNA, 64 nt, Homo Sapiens
acuauauagagaauauucuaugcaucuaugacgugcuuacuacugcagugcauuugucauuagu

SEQ ID NO: 71431 - RNA, 64 nt, Homo Sapiens
ccaagaguugcggcguauuggagacgaguuuaacgcuuacuaugcaaggaggguaaugauguuu

SEQ ID NO: 71432 - RNA, 64 nt, Homo Sapiens
uguauuucugcaguuucgguuuucauuugcuucagcuuacuaagaagcuucaaaucuaacucca

SEQ ID NO: 71433 - RNA, 64 nt, Homo Sapiens
auguaguucccuacucaggcuuucguagugauuagcuuacuaaggaacugaaaaugggccccuu

SEQ ID NO: 71434 - RNA, 64 nt, Homo Sapiens
cuggccacaguaauuggucaugugaugcaagccagcuuacuagcacuuugagaaugagucuccu

SEQ ID NO: 71435 - RNA, 64 nt, Homo Sapiens
acuucugaagggguguggcaucuguguuucugaugcuuacuacaauaugugaaccacuacuuua

SEQ ID NO: 71436 - RNA, 64 nt, Homo Sapiens
caauuacagggaaaaaacgugugaugauccugaagcuuacuaugcagccuacaaacagccuuag

SEQ ID NO: 71437 - RNA, 64 nt, Homo Sapiens
aacucccauuuuuaaaaccaucagaucucaugaggcuuacuaucacgagaacagcaugggaaag

SEQ ID NO: 71438 - RNA, 64 nt, Homo Sapiens
ggggcuuccaccauucccagaacugaucaaaguagcuuacuauaucuaaacuguaaaacaauau

SEQ ID NO: 71439 - RNA, 64 nt, Homo Sapiens
cuuuauuucuaacuccuuauugaagcuaaggggugcuuacuaaaaggaggcagccauauaggcc

SEQ ID NO: 71440 - RNA, 64 nt, Homo Sapiens
gcugcccucacugccucuuuuuccccugagucaggcuuacuaauuucucugcaggccacuuacc

SEQ ID NO: 71441 - RNA, 64 nt, Homo Sapiens
aaugauaucuauauucuaaaugauuaaaucuccagcuuacuauauucugacacauaucauucug

SEQ ID NO: 71442 - RNA, 64 nt, Homo Sapiens
aaaugaauauucaugccuuggaacagacauuauagcuuacuagcaguccuauaugucaccuagg

SEQ ID NO: 71443 - RNA, 64 nt, Homo Sapiens
uugaaaguuagauuaauaucgcucauuaucauuagcuuacuaacuccuuauuauuaaucuguua

SEQ ID NO: 71444 - RNA, 64 nt, Homo Sapiens
gccucuuguuuuucaccaaaacccuacaucucaggcuuacuaauuuuugugauauuuucauguu

SEQ ID NO: 71445 - RNA, 64 nt, Homo Sapiens
ggguaauuuguggucuaggccuuuuguuuucuaagcuuacuaucuuguguuuguuuauuugcuu

SEQ ID NO: 71446 - RNA, 64 nt, Homo Sapiens
uuuaugaucuaugucauauauuaaaaaagagcuugcuuacuacaagaaaaauauugaaauauug

SEQ ID NO: 71447 - RNA, 64 nt, Homo Sapiens
cuguggauaccaagguacaacuguauuuauuaacgcuuacuagaugugaggagagucugaauau

SEQ ID NO: 71448 - RNA, 64 nt, Homo Sapiens
cacuggcugagcggaugcaucuggggaugagguugcuuacuaagcuuugccagcugcugcugga

SEQ ID NO: 71449 - RNA, 64 nt, Homo Sapiens
aaagcaguuuaauuaagguaucaaaaauaucuuugcuuacuaucaagaagugucaaauagguuc

SEQ ID NO: 71450 - RNA, 64 nt, Homo Sapiens
augagacaguuuugauuuuguguuugaagcuauagcuuacuaucauauuguauggcuauuuuca

SEQ ID NO: 71451 - RNA, 64 nt, Homo Sapiens
uuuaaaucuuuauuuaccugcuuuagugccuuacgcuuacuaaaaagagaaaauagaaaggcug

SEQ ID NO: 71452 - RNA, 64 nt, Homo Sapiens
gaaagcaaaucagacacaaucuucuuccaaugaugcuuacuacacuaguugcucuugcuuuggu

SEQ ID NO: 71453 - RNA, 64 nt, Homo Sapiens
uuuuuuaaguaauuuuaaaaaaaauaaacacucugcuuacuacuugauuuuuuuuuucucuuuu

SEQ ID NO: 71454 - RNA, 64 nt, Homo Sapiens
ugaaucaacaagauuuccacaauucuucugucaagcuuacuacagugaaagaaugggauuggca

SEQ ID NO: 71455 - RNA, 64 nt, Homo Sapiens
cauaccaucugcugccccgcuuccccacagaacugcuuacuagcccugcggagccggcaccuac

SEQ ID NO: 71456 - RNA, 64 nt, Homo Sapiens
auguauuccggcagaauagugaguagaaugacaugcuuacuauacagaaggcaaaaauaggacu

SEQ ID NO: 71457 - RNA, 64 nt, Homo Sapiens
uaguguugcccuuaaguacaucagagcagauuuugcuuacuaugugucucuucugugaaagggu

SEQ ID NO: 71458 - RNA, 64 nt, Homo Sapiens
cacuucucuuuuucaguuuuacguucugauaguagcuuacuacugugacauuuucuuagccuua

SEQ ID NO: 71459 - RNA, 64 nt, Homo Sapiens
gucagagguuguaagggaagaguuuaugcugacugcuuacuagguguuugucauggaagagaag

SEQ ID NO: 71460 - RNA, 64 nt, Homo Sapiens
uuuuuugccuuuuguccuuuauuauuuauauuuugcuuacuaccaucucuguuuuugaauucuu

SEQ ID NO: 71461 - RNA, 62 nt, Homo Sapiens
gugaguauggcaaaacuuaauugauccuacaagcuuacuacacauaggaaaauucauacugg

SEQ ID NO: 71462 - RNA, 64 nt, Homo Sapiens
ccugcuguuucucagcaaagccuugcucucuggagcuuacuaugugcugguacuuaaagaguac

SEQ ID NO: 71463 - RNA, 64 nt, Homo Sapiens
auccagguguugacuauaaccagauuuacucuuugcuuacuagguuuuccauugucaccauugg

SEQ ID NO: 71464 - RNA, 64 nt, Homo Sapiens
uauuuguaauuauuuuuacaauuauaaauauuuagcuuacuaaaagacaaaauaguaucaacac

SEQ ID NO: 71465 - RNA, 64 nt, Homo Sapiens
cauggucuuggaaaagauugcuccugaacaaaaggcuuacuaucuuguuuucugaauucugagu

SEQ ID NO: 71466 - RNA, 64 nt, Homo Sapiens
cucauuuuauucauucagucgucaugaguugagugcuuacuacaugcaaggcacucugcuaguu

SEQ ID NO: 71467 - RNA, 64 nt, Homo Sapiens
cagaauuccguuuccuucuaacuaaugaaaaacugcuuacuaaaaaaaaauuuuauacuuuccu

SEQ ID NO: 71468 - RNA, 64 nt, Homo Sapiens
uuaugucuauauuuaaaucauugaacaccuucaugcuuacuauuuagauuacaggauuaauaua

SEQ ID NO: 71469 - RNA, 64 nt, Homo Sapiens
guaggcuguacaucucuuuugaaacauuuauauugcuuacuacuuuacccccaccuuaauuaga

SEQ ID NO: 71470 - RNA, 64 nt, Homo Sapiens
ucauugugugcacccacccagggccuuugguguggcuuacuauuacuguauuccaucuaguacg

SEQ ID NO: 71471 - RNA, 64 nt, Homo Sapiens
uugcccuggcuggaguucagugacaugaucucaggcuuacuacagccuccaccuucagguucaa

SEQ ID NO: 71472 - RNA, 64 nt, Homo Sapiens
aaaggauuugaugcuuuucucucagcauagguaugcuuacuaugaccuuccaaguuugacuugu

SEQ ID NO: 71473 - RNA, 64 nt, Homo Sapiens
aaaagcuguccacuguagagaaagccauuuuuaugcuuacuacucacagagaacaugagaacau

SEQ ID NO: 71474 - RNA, 64 nt, Homo Sapiens
guauuaauaccacugagacccuucuuagaacucugcuuacuaauuacaauaauagagaggaagc

SEQ ID NO: 71475 - RNA, 64 nt, Homo Sapiens
caaaggcuccacauuuaucaccagaaguagcaaagcuuacuagcuucuaaggcuaaauucauuu

SEQ ID NO: 71476 - RNA, 64 nt, Homo Sapiens
acugcucagaaugaguaagccuuugacaauaguagcuuacuaagccuauguuugauugcacagu

SEQ ID NO: 71477 - RNA, 64 nt, Homo Sapiens
ccagcaaagacugcaguuuuccaggcacugcuuggcuuacuauccaagaaaagaacucugcugu

SEQ ID NO: 71478 - RNA, 64 nt, Homo Sapiens
auuaugauacaguccaaagaaacugucagaauuugcuuacuauaguggaggcuauuuucauuaa

SEQ ID NO: 71479 - RNA, 64 nt, Homo Sapiens
aaaaggagacaauaaucaagucaaaagaauaaaugcuuacuaaucaucagaaaaucuguggcca

SEQ ID NO: 71480 - RNA, 64 nt, Homo Sapiens
ucuccacccucuugcauaccuccagggacagagagcuuacuaccucccaaggcagccuccugcc

SEQ ID NO: 71481 - RNA, 64 nt, Homo Sapiens
gccagucacuuugacaaagaugggaagauguugugcuuacuauggucauauuagucucucuaca

SEQ ID NO: 71482 - RNA, 64 nt, Homo Sapiens
uuucccccccaauucaaugaugacggauaguuuagcuuacuaugugugggucuuucaugagcag

SEQ ID NO: 71483 - RNA, 64 nt, Homo Sapiens
acaccguuuuccucgguggcgguaguagcaagaugcuuacuacccauggaugccaccagcuugc

SEQ ID NO: 71484 - RNA, 64 nt, Homo Sapiens
ucaacuguuuuaagcuguauauuucuuuaauucugcuuacuauuucauggaaaaaaauaaauuu

SEQ ID NO: 71485 - RNA, 64 nt, Homo Sapiens
auacuuauacaguuuagucaucaaugacuauuuugcuuacuauugugucuaugauaugugauac

SEQ ID NO: 71486 - RNA, 64 nt, Homo Sapiens
uaugcagcuucucuaccccacaucauaauccuuugcuuacuauuucuguuuauuuuuaaaugau

SEQ ID NO: 71487 - RNA, 64 nt, Homo Sapiens
cugacugccucaaguccagguguauuaacguucagcuuacuaaaguuugcacuuaauccuuaac

SEQ ID NO: 71488 - RNA, 64 nt, Homo Sapiens
aaaagaguuguauauaauaugaagccagugucuagcuuacuaaacccccacucccacaaacucu

SEQ ID NO: 71489 - RNA, 64 nt, Homo Sapiens
uaccuucucaggauuuuccucaucgcuagguggugcuuacuaauaacuaacaaaaccagcacca

SEQ ID NO: 71490 - RNA, 64 nt, Homo Sapiens
ugauuaaauaaaauuuacuucaaaaaaaaaguuugcuuacuauuaaaacuuuucuugagacaaa

SEQ ID NO: 71491 - RNA, 64 nt, Homo Sapiens
auaucauacaaaucaguuaguuuuuaggucaagggcuuacuauuucugggucuuuugcuacuaa

SEQ ID NO: 71492 - RNA, 64 nt, Homo Sapiens
ugcauagauguuucuacaguugugcaugaguagggcuuacuaagguucccagcaacugcuuguu

SEQ ID NO: 71493 - RNA, 64 nt, Homo Sapiens
cacagcccccucuagauucuuggaguuccgcagagcuuacuauacgcggucuguccuaaucuuu

SEQ ID NO: 71494 - RNA, 64 nt, Homo Sapiens
aauguaaagaaaauuguuuuuccucauugcugcagcuuacuaaauuuguguucaaaguaaaaua

SEQ ID NO: 71495 - RNA, 64 nt, Homo Sapiens
aaauucuguuuacuggcaaacuggucugacuuaugcuuacuaauuacugucuccuugggccaug

SEQ ID NO: 71496 - RNA, 64 nt, Homo Sapiens
uccauuucuguuaaaguggaucugcauaucuucagcuuacuaggugacccggaugcugacaucu

SEQ ID NO: 71497 - RNA, 64 nt, Homo Sapiens
acaaaaggcgcucuauacauauuauaauauauucgcuuacuaaaugaauaaggacuuuccaacu

SEQ ID NO: 71498 - RNA, 64 nt, Homo Sapiens
caacaggcugcauguuaaauggccaagaggugaggcuuacuauucacuaugaaaauggguucac

SEQ ID NO: 71499 - RNA, 64 nt, Homo Sapiens
uaaggugagugucuuagcauauuuuaaugcaguugcuuacuaaagguuuuaaccgcacaugcac

SEQ ID NO: 71500 - RNA, 64 nt, Homo Sapiens
auaaauucauccuucaggaaauggaaaugaacuugcuuacuaaugugugauuccuaguuguagc

SEQ ID NO: 71501 - RNA, 64 nt, Homo Sapiens
agagaugacuuugaugacucugccccucagcagggcuuacuaagcacuaccccuuaacagggau

SEQ ID NO: 71502 - RNA, 64 nt, Homo Sapiens
cuaaacacugcugcugccuuaauuuuagaaagcagcuuacuaguuuacccuugugguauaaagu

SEQ ID NO: 71503 - RNA, 64 nt, Homo Sapiens
uugccuuuugaccuccccauccccuuuagucccugcuuacuacuuugacauucacauccucagu

SEQ ID NO: 71504 - RNA, 64 nt, Homo Sapiens
uccaagugggucaauuccuuaguauaauauuaaggcuuacuaguaucacugcuuuuuccuuagc

SEQ ID NO: 71505 - RNA, 64 nt, Homo Sapiens
uucaauauggggcagacuagggaaaccuuugcuugcuuacuauuaggaggggaagucuucagua

SEQ ID NO: 71506 - RNA, 64 nt, Homo Sapiens
guagcauuuuucuaaaaccuuagucaucagauaugcuuacuaaaucuucagcauagaaggaagu

SEQ ID NO: 71507 - RNA, 64 nt, Homo Sapiens
ugugacaacccaagugggugaugaguuagcuucugcuuacuaccacacaaaccuggcuacggug

SEQ ID NO: 71508 - RNA, 64 nt, Homo Sapiens
ccguuugaccucucccaagauacaccagcagccugcuuacuacuaaacgcaauccaaaaggccu

SEQ ID NO: 71509 - RNA, 64 nt, Homo Sapiens
cgaacaaucuuucauuucugacucuguauucaaagcuuacuagaaagggugaggacaucagauc

SEQ ID NO: 71510 - RNA, 64 nt, Homo Sapiens
ugugggagcuuuugguauguacagucaaggaguggcuuacuacaauuuuuccuaacaggauuag

SEQ ID NO: 71511 - RNA, 64 nt, Homo Sapiens
uauaagacaacucauacuggaaccaguccuuaaggcuuacuacauggaauguggcaaagccuuu

SEQ ID NO: 71512 - RNA, 64 nt, Homo Sapiens
gaaggguugccuucuguaggucggaggaauggaggcuuacuaaccagguaagccuucuaugcau

SEQ ID NO: 71513 - RNA, 64 nt, Homo Sapiens
uggcugucucacaggucacagagccauuacaacagcuuacuaguuuuucauggauuuguuggau

SEQ ID NO: 71514 - RNA, 64 nt, Homo Sapiens
aaauaugugcuugaaaugagaaacuuugaucucugcuuacuaaugugccccauguccaagucca

SEQ ID NO: 71515 - RNA, 64 nt, Homo Sapiens
cucaagagauacagugguggcugacuuaugggcugcuuacuaguccacucugauauacuggcuu

SEQ ID NO: 71516 - RNA, 64 nt, Homo Sapiens
ugucuaagucauguucuaggcacuucacucaagagcuuacuauggaucgugucauuaucaucug

SEQ ID NO: 71517 - RNA, 64 nt, Homo Sapiens
auuuuuuuaacacuguaacauguaauuuuauacugcuuacuauaccccuggccccauaauaaau

SEQ ID NO: 71518 - RNA, 64 nt, Homo Sapiens
ucauuauuauaaguagcauacuugcagauaagaagcuuacuauauguaaguuauaguaccugua

SEQ ID NO: 71519 - RNA, 64 nt, Homo Sapiens
ugugguuugcacccuaacacguuguucauaaggagcuuacuaacuacacacauuuccacaggag

SEQ ID NO: 71520 - RNA, 64 nt, Homo Sapiens
ggcuuccuuaaagggucaagaaagcaauuuuucugcuuacuagauucauugagaucagcugugu

SEQ ID NO: 71521 - RNA, 64 nt, Homo Sapiens
accuccgccuccuggguucaguggcacgaucuuggcuuacuacaguugcccagacuggagugca

SEQ ID NO: 71522 - RNA, 64 nt, Homo Sapiens
aggcaguauuuugcuuuugcuuuaauauauacuagcuuacuauaaauuguuaacuagacuauuc

SEQ ID NO: 71523 - RNA, 64 nt, Homo Sapiens
uacucuguucaagcugcguugagauguuaaacuggcuuacuauagacuucguaaaaauggcucc

SEQ ID NO: 71524 - RNA, 50 nt, Homo Sapiens
cgagacaugguccagccuaagcuuacuaauacucacuuagugauuuguaa

SEQ ID NO: 71525 - RNA, 64 nt, Homo Sapiens
ggguuaacuauguauauucauuuucaaaggggcugcuuacuauaacuguugggugcaucagugc

SEQ ID NO: 71526 - RNA, 64 nt, Homo Sapiens
uacauucuugguggauaaauacagugagcuuuuggcuuacuauaaccaugcuaaguguauuucc

SEQ ID NO: 71527 - RNA, 64 nt, Homo Sapiens
uagcaauaauaaauauagugaauacuuacauagugcuuacuauaugcuaagcacuauuuuuagc

SEQ ID NO: 71528 - RNA, 64 nt, Homo Sapiens; identical to SEQ ID NO: 21289

SEQ ID NO: 71529 - RNA, 64 nt, Homo Sapiens; identical to SEQ ID NO: 21290

SEQ ID NO: 71530 - RNA, 64 nt, Homo Sapiens; identical to SEQ ID NO: 21291

SEQ ID NO: 71531 - RNA, 64 nt, Homo Sapiens; identical to SEQ ID NO: 21292

SEQ ID NO: 71532 - RNA, 64 nt, Homo Sapiens; identical to SEQ ID NO: 21293

SEQ ID NO: 71533 - RNA, 64 nt, Homo Sapiens; identical to SEQ ID NO: 21294

SEQ ID NO: 71534 - RNA, 64 nt, Homo Sapiens; identical to SEQ ID NO: 21295

SEQ ID NO: 71535 - RNA, 64 nt, Homo Sapiens; identical to SEQ ID NO: 21296

SEQ ID NO: 71536 - RNA, 64 nt, Homo Sapiens; identical to SEQ ID NO: 21297

SEQ ID NO: 71537 - RNA, 64 nt, Homo Sapiens; identical to SEQ ID NO: 21298

SEQ ID NO: 71538 - RNA, 64 nt, Homo Sapiens; identical to SEQ ID NO: 21299

SEQ ID NO: 71539 - RNA, 64 nt, Homo Sapiens; identical to SEQ ID NO: 21300

SEQ ID NO: 71540 - RNA, 64 nt, Homo Sapiens; identical to SEQ ID NO: 21301

SEQ ID NO: 71541 - RNA, 64 nt, Homo Sapiens; identical to SEQ ID NO: 21302

SEQ ID NO: 71542 - RNA, 64 nt, Homo Sapiens; identical to SEQ ID NO: 21303

SEQ ID NO: 71543 - RNA, 64 nt, Homo Sapiens
uggucuuguuaagagugcaauaaagagaaaauaugcagaauaacaccgaauuucaucauuuauc

SEQ ID NO: 71544 - RNA, 64 nt, Homo Sapiens
ucuuuuaggaaaccauuucaacuuuaaacaggaggcagaauaauaaacagaauuauaaaagcuu

SEQ ID NO: 71545 - RNA, 64 nt, Homo Sapiens
aaaaaaaaaaaaaaauccacaccguccuuggaaagcagaauaaaaggagcagaauauaaaaucc

SEQ ID NO: 71546 - RNA, 64 nt, Homo Sapiens
auccacaccguccuuggaaagcagaauaaaaggagcagaauauaaaauccaaagucugaccagu

SEQ ID NO: 71547 - RNA, 64 nt, Homo Sapiens
uacaauggcuaaaacguuuugagaguaacagcuagcagaauaauggauuucaaaauacauuagu

SEQ ID NO: 71548 - RNA, 64 nt, Homo Sapiens
aagaaauaaagcaugaucugucuauaauccuucagcagaauauuguccuagaauuuuucugauu

SEQ ID NO: 71549 - RNA, 64 nt, Homo Sapiens
guccucauugcauguguaguagucaauuguauuagcagaauauuaguagacaaaugcagcagca

SEQ ID NO: 71550 - RNA, 64 nt, Homo Sapiens
aaccaugggaggcaaagaaaauaauuucagcagggcagaauaaaccauugccuuugcuuuguuc

SEQ ID NO: 71551 - RNA, 64 nt, Homo Sapiens
cuuuuggucuuucacaccauucauauguuaaguggcagaauagccuuagugcuaccuccacuuu

SEQ ID NO: 71552 - RNA, 64 nt, Homo Sapiens
aguaguggauguuuuugaaguaucuaaaauaguagcagaauauuuuauacuugguccuugcaau

SEQ ID NO: 71553 - RNA, 64 nt, Homo Sapiens
aauacaucgaacaacuucaugaaccgguccaaaugcagaauauuaggauuggaauucucaacua

SEQ ID NO: 71554 - RNA, 64 nt, Homo Sapiens
uuucguuggggaagagaacuauuuacuccugccugcagaauacuuuuagccaacagaacaggua

SEQ ID NO: 71555 - RNA, 64 nt, Homo Sapiens
cuaauacucuccucgacaagucaugcuguuuuaugcagaauaauccaggcgugagaguguucuc

SEQ ID NO: 71556 - RNA, 64 nt, Homo Sapiens
ucaacucaguaggugagaauaauuaguagguucagcagaauaaacucuuuacaauuaauaacuc

SEQ ID NO: 71557 - RNA, 64 nt, Homo Sapiens
auaccuauccuguaguuacugaaaaucuggguaguaaaucuacccaauuaaaauggcacuuuau

SEQ ID NO: 71558 - RNA, 64 nt, Homo Sapiens
aggcuccuggaaggugaaaaguagucauuuguucuaaaucuauacauauuacuuguaucuagug

SEQ ID NO: 71559 - RNA, 64 nt, Homo Sapiens
auauuuuaugaaucagaauaaccuucaaauaaaauaaaucuaagucgguuaaaauggauuucau

SEQ ID NO: 71560 - RNA, 64 nt, Homo Sapiens
auauauuuuuauagaaaaacaaaucuacauaaaauaaaucuacuguuuagugagcaguaugauu

SEQ ID NO: 71561 - RNA, 64 nt, Homo Sapiens
accauauugaacacauggcauuuguagcauucuuuaaaucuaucuacugaaauguauuugacau

SEQ ID NO: 71562 - RNA, 64 nt, Homo Sapiens
caucuugugucuuuuguaaauugaauuuuuuuuuuaaaucuauuaggaacuggaaaacagcaag

SEQ ID NO: 71563 - RNA, 64 nt, Homo Sapiens
uaaggauugcagacgcucucugaagccauuuccauaaaucuauuauuuucuaaaugcuguaauu

SEQ ID NO: 71564 - RNA, 64 nt, Homo Sapiens
uacuguuuacugguggaguacuucuuuucuaggauaaaucuaauuggagaugacacaccuacug

SEQ ID NO: 71565 - RNA, 64 nt, Homo Sapiens
uccccaaaucaugcaguauugaguuaugacuuguuaaaucuauucccaugccagaaucuuauca

SEQ ID NO: 71566 - RNA, 64 nt, Homo Sapiens
augauccacaauaaucccuuugaucacguuaaucuaaaucuagaugucuuugucuaauuuuuuu

SEQ ID NO: 71567 - RNA, 64 nt, Homo Sapiens
auuagccgggcauggucgcuucucuuuacucuauuaaaucuagaggucuguaacaaaaguacuu

SEQ ID NO: 71568 - RNA, 64 nt, Homo Sapiens
cuggugcagcugagaacugugaauaaugagaaaauaaaucuaugagcacaagguaagucauaaa

SEQ ID NO: 71569 - RNA, 64 nt, Homo Sapiens
cccugcacucugccucacaaaggucuauauuauauaaaucuauauaaaucuauuuuauauuugu

SEQ ID NO: 71570 - RNA, 64 nt, Homo Sapiens
ugccucacaaaggucuauauuauauaaaucuauauaaaucuauuuuauauuuguauaaguaaau

SEQ ID NO: 71571 - RNA, 64 nt, Homo Sapiens
uauuaauauuuaacauuauuuugaauuuuaaaucuaaaucuauugguuguccugccugcaauau

SEQ ID NO: 71572 - RNA, 64 nt, Homo Sapiens
ucuauuuauuaauauuuaaccaauauuugaauuuuaaaucuaaaaguaaugguuguccugccug

SEQ ID NO: 71573 - RNA, 64 nt, Homo Sapiens
auaaacuuccauaacacuagguuagaccacccaauaaaucuagaaaucagcuuuuaaaaauauu

SEQ ID NO: 71574 - RNA, 64 nt, Homo Sapiens
guguucagaacuuaauugggcuugaacugagauuuaaaucuaauaaacaaguuaauaaaugugu

SEQ ID NO: 71575 - RNA, 64 nt, Homo Sapiens
uaagaaucuauuuuaauucccauuucugaauaaguaaaucuaaaauaaacuguuugacuugaau

SEQ ID NO: 71576 - RNA, 64 nt, Homo Sapiens
gaaaauaaacuguuugacuuagggcaaaauauuauaaaucuauauuaguacuuuaguucuguug

SEQ ID NO: 71577 - RNA, 64 nt, Homo Sapiens
acauauauauagauaaaaugauauauguucuucauaaaucuauuauuuauguuuauauauguuu

SEQ ID NO: 71578 - RNA, 64 nt, Homo Sapiens
cuaaauguuccuugaaguauauguucauauauccuaaaucuaucguucuuuccaacccugccac

SEQ ID NO: 71579 - RNA, 64 nt, Homo Sapiens
uaaauaacuauguaaauagaaacagauaccagaauaaaucuacagcuagacccuuagucaauag

SEQ ID NO: 71580 - RNA, 64 nt, Homo Sapiens
acaaauacauguaacuguagauaaaaccauauacuaaaucuauaagacuaagggauuuuuguua

SEQ ID NO: 71581 - RNA, 64 nt, Homo Sapiens
auaucaggaaggaacuuuucaagaaauguaauuauaaaucuacaucaaacagaauuuuaaggaa

SEQ ID NO: 71582 - RNA, 64 nt, Homo Sapiens
aaugcuccuacuuuaaguacuauaccagcgaauuuaaaucuaaaugaaaauguguaaucuaaaa

SEQ ID NO: 71583 - RNA, 64 nt, Homo Sapiens
caauaaaauauauuuuugaccauaacacuaagcguaaaucuaauuaacaaauacacaauucaca

SEQ ID NO: 71584 - RNA, 64 nt, Homo Sapiens; identical to SEQ ID NO: 71579

SEQ ID NO: 71585 - RNA, 64 nt, Homo Sapiens
acaaauacauguaacuguagauaaaaccacauacuaaaucuauaagacuaagggauuuuuguua

SEQ ID NO: 71586 - RNA, 64 nt, Homo Sapiens; identical to SEQ ID NO: 71581

SEQ ID NO: 71587 - RNA, 62 nt, Homo Sapiens
uaaauguucuuuaggagaacauuuugcuaaagcaugacuaaacugcaaaaaaaaaaaaagag

SEQ ID NO: 71588 - RNA, 62 nt, Homo Sapiens
agcuggggagaugccagugacaacauacaguucaugacuagguuuaggaauugggcacugag

SEQ ID NO: 71589 - RNA, 62 nt, Homo Sapiens
ugaccuguuucaccagcaggccuguuacucuccaugacuaacuguguaagugcuuaaaaugg

SEQ ID NO: 71590 - RNA, 62 nt, Homo Sapiens
aauggugauuaguguuaaaaaucaauuuaaaucaugacuaauaugguaaaaagauaaagcau

SEQ ID NO: 71591 - RNA, 62 nt, Homo Sapiens
aacauaaagaaacaauguccccuacauauccccaugacuacauaauccaucaucguaggaaa

SEQ ID NO: 71592 - RNA, 62 nt, Homo Sapiens
aacuaccccagcccaggcucgguccauaagcccaugacuaaacuagcuggagaagaggggag

SEQ ID NO: 71593 - RNA, 62 nt, Homo Sapiens
aguguuaggggcagaaguuuugccaaguaggacaugacuaggauugcaguaggggucccagc

SEQ ID NO: 71594 - RNA, 62 nt, Homo Sapiens
cacgcauauacgaguugguuuaucuuuguguacaugacuauaacccagugaugcugagguca

SEQ ID NO: 71595 - RNA, 62 nt, Homo Sapiens
uuucagggaugauaccggggacucuccagagccaugacuagauccaauggauucugcgaugc

SEQ ID NO: 71596 - RNA, 62 nt, Homo Sapiens
ucuaaaccuuucuaagcucagaugcauuuuugcaugacuaugucgaauauuucuuacugcca

SEQ ID NO: 71597 - RNA, 62 nt, Homo Sapiens
guaugcucucauuccucagguguuuugagaaacaugacuaauaaccacacaauuaaguagag

SEQ ID NO: 71598 - RNA, 62 nt, Homo Sapiens
cugacacagacucagcacuccgucaguguugccaugacuauuuuuauuaucauuauuaauga

SEQ ID NO: 71599 - RNA, 62 nt, Homo Sapiens
uugaaguuguuuuuucaaguucuuuucuuuuucaugacuauuaaauguaaaaauauuuguaa

SEQ ID NO: 71600 - RNA, 62 nt, Homo Sapiens
gcuucagagcucaugcgcguuacccacgauggcaugacuagcacagagcugaucucuguuuc

SEQ ID NO: 71601 - RNA, 62 nt, Homo Sapiens
agcaaagggggaaaaauaugcauuucaccccacaugacuaggaauccacaucagaaugauac

SEQ ID NO: 71602 - RNA, 62 nt, Homo Sapiens
gauuguugacguuuucccagcaaucuuaaucucaugacuauguucuucucccaaacaaggau

SEQ ID NO: 71603 - RNA, 62 nt, Homo Sapiens
guccucaggcaguggcccagggaugaacuagccaugacuaggaagguggucugcaccccaca

SEQ ID NO: 71604 - RNA, 62 nt, Homo Sapiens
gggaauuacuguggguucaguuggggcuccuccaugacuagucaauaugggguuccguugga

SEQ ID NO: 71605 - RNA, 62 nt, Homo Sapiens
caguuguguguguuuauucgccucuauuuuuucaugacuauuaacagaauauuuugacuaau

SEQ ID NO: 71606 - RNA, 62 nt, Homo Sapiens
auuuaagccuaugagaagauuucuuuaauagccaugacuauauguggcuggaugcuguuaau

SEQ ID NO: 71607 - RNA, 62 nt, Homo Sapiens
uucaaugaacugugcuuuucgcuuucuuucugcaugacuauuguaacuagauagaacauuaa

SEQ ID NO: 71608 - RNA, 62 nt, Homo Sapiens
gcugcagggucaggcuccugauaggaggauuucaugacuaugucauugucuccacucauuuu

SEQ ID NO: 71609 - RNA, 62 nt, Homo Sapiens
aaagaaagagguuuaacggacuuacaguuccacaugacuaaggaggccucacaaucauggug

SEQ ID NO: 71610 - RNA, 62 nt, Homo Sapiens
gcugaccuguuuuugguccacuuuugcccuuccaugacuaauaaggaagauauguguguauu

SEQ ID NO: 71611 - RNA, 62 nt, Homo Sapiens
aaggguuugggguuucuuuuugagagaugaggcaugacuacuuugccagggccuggaggcug

SEQ ID NO: 71612 - RNA, 62 nt, Homo Sapiens
guagagggcgcugucucgcgcugucugucuggcaugacuaauuggccucugguuucucucug

SEQ ID NO: 71613 - RNA, 62 nt, Homo Sapiens
ugguugcucugacagaucugaacacuuugcuucaugacuauuucgucauaaagguauauguu

SEQ ID NO: 71614 - RNA, 62 nt, Homo Sapiens
gaauuugucuccccgaaagggacacaauguggcaugacuaaguacuugcucucugagagcac

SEQ ID NO: 71615 - RNA, 62 nt, Homo Sapiens
gaggcagagagucacuugaccauccagaaauacaugacuacaaguccuuuaugacuguuugc

SEQ ID NO: 71616 - RNA, 62 nt, Homo Sapiens
ucuaaaaacugaauacucagcagcaauggcuacaugacuaugaauagugcaaagcacaguuu

SEQ ID NO: 71617 - RNA, 62 nt, Homo Sapiens
uauaaacauauauuuacaugauuuccuccaggcaugacuaggcugcuacauaauuacuuuca

SEQ ID NO: 71618 - RNA, 62 nt, Homo Sapiens
ggaaauaacugauuaaacaaauccgccacuuucaugacuagagaugaggaagaacaagggau

SEQ ID NO: 71619 - RNA, 62 nt, Homo Sapiens
gaaagcuauuuauuugucuucaguguucaaggcaugacuaguauuucuaauuagccuaauaa

SEQ ID NO: 71620 - RNA, 62 nt, Homo Sapiens
ugagaauaauugaugcugauuaaggugcaaaucaugacuaaagacuuuucuuucuucuuuug

SEQ ID NO: 71621 - RNA, 62 nt, Homo Sapiens
caagccugaagauacaagacuauuagaagaaacaugacuacccucaguguauuagaaaagag

SEQ ID NO: 71622 - RNA, 62 nt, Homo Sapiens
uuuggcacuuguggguggcuauuuugauuuggcaugacuacuuaauuuuuuaaaaaaauugu

SEQ ID NO: 71623 - RNA, 62 nt, Homo Sapiens
ggaaaaacccaaauuguuucuucuuugagagucaugacuaccuucugguguggagaaauugc

SEQ ID NO: 71624 - RNA, 62 nt, Homo Sapiens
cugccuugggacagguguguaauguuagugugcaugacuaauguaagaaauuguuauucuac

SEQ ID NO: 71625 - RNA, 62 nt, Homo Sapiens
ggguaugauuucagguccucugcacguguacacaugacuaggauaggcaggaguaagggugg

SEQ ID NO: 71626 - RNA, 62 nt, Homo Sapiens
gggaugauuauuagucacaucugcuaugcugucaugacuaggaccuuuagcaacauguucau

SEQ ID NO: 71627 - RNA, 62 nt, Homo Sapiens
uucuaauuguaacucaacacgacauguccuuccaugacuaaugaggaaagauaucuguggua

SEQ ID NO: 71628 - RNA, 62 nt, Homo Sapiens
uuuuacucuugguuuacagagagguuguauaucaugacuagcuuaacauucauuucaaccac

SEQ ID NO: 71629 - RNA, 62 nt, Homo Sapiens
uaguaaguacagaacaguaaugauaagcugcacaugacuacacucauccguauucuuugugu

SEQ ID NO: 71630 - RNA, 62 nt, Homo Sapiens
agugccauuuuuacugaugcuauauuuuaugccaugacuaaaauugaaaaauagccuuauug

SEQ ID NO: 71631 - RNA, 62 nt, Homo Sapiens
gacugaaauaaugugaaugaugauuuuguugacaugacuacaaaugaaagaauagaucagaa

SEQ ID NO: 71632 - RNA, 62 nt, Homo Sapiens
aaaaccgaacgccuguucccuuacugcuguaacaugacuaaugcugccauuaacacaucugg

SEQ ID NO: 71633 - RNA, 62 nt, Homo Sapiens
caaaugcaaaccuuugcaaauacaugucuacacaugacuacagacacaaaaacacaugagca

SEQ ID NO: 71634 - RNA, 62 nt, Homo Sapiens
uuuccuuaaagcacauuuuucugacauaaacucaugacuaaucuuugugcaaucaugaacuu

SEQ ID NO: 71635 - RNA, 62 nt, Homo Sapiens
ggugcagaaaagugaauugacuacaaaguagacaugacuaguuaacaacacagcugggaucu

SEQ ID NO: 71636 - RNA, 62 nt, Homo Sapiens
gacaacucgggugccacuuucuguuuauaguucaugacuauguuugucuuugaacucuagua

SEQ ID NO: 71637 - RNA, 62 nt, Homo Sapiens
ugcuuauccacuuaagacaacaaaucugugugcaugacuaugacaguuacuugguuagacau

SEQ ID NO: 71638 - RNA, 62 nt, Homo Sapiens
gggcagcuuugcacagcccuccaguucaccuccaugacuacaguauccacagcaggaagucc

SEQ ID NO: 71639 - RNA, 62 nt, Homo Sapiens
uucacaaguuucuguugaccuuguugauugagcaugacuacuaaauauuauguaauaaaaag

SEQ ID NO: 71640 - RNA, 62 nt, Homo Sapiens
auguaaaauguuuuguugaaguauauggcuaucaugacuaagugcuagaauuuauaguuaca

SEQ ID NO: 71641 - RNA, 62 nt, Homo Sapiens
caugaucaauauccuuuaggaaaugaaaaaaccaugacuaucaucaccaacauccuugggua

SEQ ID NO: 71642 - RNA, 62 nt, Homo Sapiens
caucuccucuccuucccaggaauccuugaucucaugacuauuaaaauguugcucugguuuua

SEQ ID NO: 71643 - RNA, 62 nt, Homo Sapiens
uagacauuaucuuuuggcucugaagaagcaaacaugacuagagacgcaccuugcugcagugu

SEQ ID NO: 71644 - RNA, 62 nt, Homo Sapiens
acgaccuauuagaguaaucugucaaagaaaagcaugacuaauagugcuucuugcagcaggug

SEQ ID NO: 71645 - RNA, 62 nt, Homo Sapiens
aagaaaacaugacuuuaucauaucuacugagacaugacuaggagaucaacaaccccuuuggc

SEQ ID NO: 71646 - RNA, 62 nt, Homo Sapiens
cuguuugaaacagacagauguaaacgcucaggcaugacuacgagaagaugaauuucauuaug

SEQ ID NO: 71647 - RNA, 62 nt, Homo Sapiens
aauuuaggauuugccgcuuccauaaaucaaagcaugacuaauagggggucucugaaauguaa

SEQ ID NO: 71648 - RNA, 62 nt, Homo Sapiens
ucuuuuauuuucaucuuuuuugguuuucuuggcaugacuaagaagcuuaaauguugauaaaa

SEQ ID NO: 71649 - RNA, 62 nt, Homo Sapiens
agaagaaaaaaaagaaaaagaaaucuaagcaacaugacuauucagacuaugaagacaguucc

SEQ ID NO: 71650 - RNA, 62 nt, Homo Sapiens
gcccagagaaggcuuaccccucuguaaauguccaugacuauuuaacguuuacuuccuucccc

SEQ ID NO: 71651 - RNA, 62 nt, Homo Sapiens
cgugguaccaaucucagucuccagcagguggccaugacuaccggcugcaguacccuacgcug

SEQ ID NO: 71652 - RNA, 62 nt, Homo Sapiens
uuuugauucggaaaucuauauuguaaacaguucaugacuagaaucuuaguguaguauagcua

SEQ ID NO: 71653 - RNA, 62 nt, Homo Sapiens
gcaugguuauuuuucuaguacauaaccaaauacaugacuauauugucuuuccauaugguuuu

SEQ ID NO: 71654 - RNA, 62 nt, Homo Sapiens
uauugguuccauaacucuguuaucaacuauaucaugacuaucuugcuuugucuugauguuuc

SEQ ID NO: 71655 - RNA, 62 nt, Homo Sapiens
uauauauugccaauuuuaguugcuuaauuaaccaugacuaugaauguauaauaaaaaugugg

SEQ ID NO: 71656 - RNA, 62 nt, Homo Sapiens
uugacaaaaguuuaaaacacuaacauaucuuucaugacuauuauuaccucauuaugcaaaaa

SEQ ID NO: 71657 - RNA, 62 nt, Homo Sapiens
aacgcguguugucucaaaccagucagggccgucaugacuacgcagcagcagcaguuuccaag

SEQ ID NO: 71658 - RNA, 62 nt, Homo Sapiens
accccggccucccuggggacauuguucauaaccaugacuaaucugugugugcuguagugacc

SEQ ID NO: 71659 - RNA, 62 nt, Homo Sapiens
uccaccaucaaaugcuguagagaaauaaaaagcaugacuauuaccuuacauuccuagagagc

SEQ ID NO: 71660 - RNA, 62 nt, Homo Sapiens
gccuagaaagcaaugugauguugcauaucagucaugacuaguuuuuauuuucuuauguaagu

SEQ ID NO: 71661 - RNA, 62 nt, Homo Sapiens
ucuggaacagcaggaagggugucuuccuccagcaugacuaagccucugcugcuggauuucau

SEQ ID NO: 71662 - RNA, 62 nt, Homo Sapiens
uuucccccacugggaaugcuggcugggagagccaugacuaccagacuuuuccucaggcuccu

SEQ ID NO: 71663 - RNA, 62 nt, Homo Sapiens
auacugaccuaccucaaagggcaguuuugaggcaugacuaaugcuuuuuagaaagcauuuug

SEQ ID NO: 71664 - RNA, 62 nt, Homo Sapiens
acuguuguucugcuuuuccuggcacucaaauucaugacuaguuuugaggucaaaccuauguu

SEQ ID NO: 71665 - RNA, 62 nt, Homo Sapiens
aucuuauauaagauuucuagguugcaucuaaccaugacuaugucauuauuuugauaauuagg

SEQ ID NO: 71666 - RNA, 62 nt, Homo Sapiens
gauaaacuaaacacgugacacaacauaguauucaugacuauguguuccccacuguaucuagg

SEQ ID NO: 71667 - RNA, 62 nt, Homo Sapiens
ggugcuaaauaggcagcagaucucaauucacacaugacuaccuuugagcuaaugacugucuc

SEQ ID NO: 71668 - RNA, 62 nt, Homo Sapiens
cuuucaaaugccauggguuacacuuuuaugggcaugacuauaaccauuuuuguaaagaguaa

SEQ ID NO: 71669 - RNA, 62 nt, Homo Sapiens
gagaagaagaagaagaagaagaccacaaaagacaugacuauccaacuuuuuaugacaaacug

SEQ ID NO: 71670 - RNA, 62 nt, Homo Sapiens
aaaucugaccuugucauuucaauaguuauuaacaugacuaaauauuaucuuaauuaagagga

SEQ ID NO: 71671 - RNA, 62 nt, Homo Sapiens
aaaaugguagcgcuuuguaugcauuuagaauacaugacuaguaguuuauauuucacugguag

SEQ ID NO: 71672 - RNA, 62 nt, Homo Sapiens
cugugaaagccuuuuaauuuauugaaauguuucaugacuacugcugcuagcucuucaagcca

SEQ ID NO: 71673 - RNA, 62 nt, Homo Sapiens
ggugcuguggggagaguagaaagagggguuggcaugacuaaaaauaccaguauguguauuaa

SEQ ID NO: 71674 - RNA, 62 nt, Homo Sapiens
cugauaaucuuauuuuuuaguucuagacuuuacaugacuaggugaugagcaaauaaaggaac

SEQ ID NO: 71675 - RNA, 62 nt, Homo Sapiens
auuuaucuucuuuuaguguaaauuucugauugcaugacuauucaucuugcugacuucuguag

SEQ ID NO: 71676 - RNA, 62 nt, Homo Sapiens
cuuucuacgcacagcuagaagaguagucauuucaugacuacacccagguucaugcuuguuug

SEQ ID NO: 71677 - RNA, 62 nt, Homo Sapiens
agcaauuaugccaagggccguuaggcucucaacaugacuauagagaccccgugucaucacgg

SEQ ID NO: 71678 - RNA, 62 nt, Homo Sapiens
guuaaagaagcaaucuccuuacuguguuucagcaugacuauguauuuuucuauguuuuuuua

SEQ ID NO: 71679 - RNA, 62 nt, Homo Sapiens
uaaagccaggggauuaucuuuauuuguauguacaugacuauuuuuuuuuuuaaguuuguuca

SEQ ID NO: 71680 - RNA, 62 nt, Homo Sapiens
ccuggcuccucucaccuugucccacugguguucaugacuaccgggagcugcccagggcagaa

SEQ ID NO: 71681 - RNA, 62 nt, Homo Sapiens
cagauggcuacugaguuaucauucuuaaaccgcaugacuauugucagauuauacaaggaugu

SEQ ID NO: 71682 - RNA, 62 nt, Homo Sapiens
agugcuucaaagucaauuuucuuaagcauuugcaugacuauuuuaauguaacuucuuuuuug

SEQ ID NO: 71683 - RNA, 62 nt, Homo Sapiens
gguuuucauagucgugaaguauuuaucauuugcaugacuaauggcacaggaaaaaccuauuc

SEQ ID NO: 71684 - RNA, 62 nt, Homo Sapiens
ggugaguugugccuuuuauaauguaagcauuacaugacuauuucguuuaaucaguuucugaa

SEQ ID NO: 71685 - RNA, 62 nt, Homo Sapiens
cgagaaccgucuuuacccgggguaacccccaucaugacuagacacacuucuuuuggucugaa

SEQ ID NO: 71686 - RNA, 62 nt, Homo Sapiens
auaaacuagaaucucuauuaaaagcuauaugacaugacuaugucauuaaaacuauauuugaa

SEQ ID NO: 71687 - RNA, 62 nt, Homo Sapiens
ucacagguggcagaauuuuuuuucacccgcuucaugacuaaacucauaccaacuugacuaug

SEQ ID NO: 71688 - RNA, 62 nt, Homo Sapiens
acgcugagcucugcagggacaaacccagcccacaugacuagccccuccccuuacgaacacag

SEQ ID NO: 71689 - RNA, 62 nt, Homo Sapiens
aaaacugaucaucugagucgauaccgguuaaccaugacuacccucugauaggauucaaacag

SEQ ID NO: 71690 - RNA, 62 nt, Homo Sapiens
auuuaagaaaaagcuaaaaagaauggaaaucgcaugacuauaacuuaagucuuucuucaaag

SEQ ID NO: 71691 - RNA, 62 nt, Homo Sapiens
uccccagugccauuguucuuccaaaugcuacccaugacuacaacacgucuuucucaaacucc

SEQ ID NO: 71692 - RNA, 62 nt, Homo Sapiens
cuaaaacuaaucuucauuuuaaaaggguaaaacaugacuauacagaaauuuaaauagaaaua

SEQ ID NO: 71693 - RNA, 62 nt, Homo Sapiens
acuuaagucuuucuucaaaggaauggaaaucgcaugacuauaauugaagaaaaagcuaaaaa

SEQ ID NO: 71694 - RNA, 62 nt, Homo Sapiens
ugucccaguacacgaaagggcuguuuuaaucacaugacuaccaaagucagaguucguguucc

SEQ ID NO: 71695 - RNA, 62 nt, Homo Sapiens
auuuccugacaauggggcauugcgaucuaaaacaugacuaucacugauguucaucaaaagua

SEQ ID NO: 71696 - RNA, 62 nt, Homo Sapiens
acacacaucaccccccuucuauaaucuuaagccaugacuagccugguggcguguuaguuucu

SEQ ID NO: 71697 - RNA, 62 nt, Homo Sapiens
aguagcugggaccacaggcaugcaccacuacgcaugacuaauuuuuuaaauauuugagacgg

SEQ ID NO: 71698 - RNA, 62 nt, Homo Sapiens
cauugugacauggucauuaccuuggauccuagcaugacuauaguugguguuuugcucggcag

SEQ ID NO: 71699 - RNA, 62 nt, Homo Sapiens; identical to SEQ ID NO: 71698

SEQ ID NO: 71700 - RNA, 62 nt, Homo Sapiens
cuuguugccgucgaguuggaccuaaccggccucaugacuagcuccccggucaucuacgacag

SEQ ID NO: 71701 - RNA, 62 nt, Homo Sapiens
guugaggaagaacaggggauauccgccacuuucaugacuagaggaaauaacuaauuaaacaa

SEQ ID NO: 71702 - RNA, 62 nt, Homo Sapiens
guugcauugccuggcacccaauauucaggguccaugacuaagacuggucuucucagaugccc

SEQ ID NO: 71703 - RNA, 62 nt, Homo Sapiens
uggcucaagaccgacauugccuugguuuguuacaugacuaucgugauggggaaacuggcugg

SEQ ID NO: 71704 - RNA, 62 nt, Homo Sapiens
ugccagaacuuucuuuuccuugcccccugugucaugacuagcuuaaguguacuugacuccca

SEQ ID NO: 71705 - RNA, 62 nt, Homo Sapiens
acguaaagguaucagggccgggcgcuguggcucaugacuauaaucccagcuguuugagaggc

SEQ ID NO: 71706 - RNA, 62 nt, Homo Sapiens
aaacacuaggccacgcaucugaucuguagucacaugacuaagccaagaggaaggagcaagac

SEQ ID NO: 71707 - RNA, 62 nt, Homo Sapiens
aaaagaaccgacuucugaaucgcagcuccacucaugacuaauaccucauuauuucagcuguc

SEQ ID NO: 71708 - RNA, 62 nt, Homo Sapiens
uuuuggggagugggugauauugccuguaugagcaugacuauaggugucugugugaaucuuug

SEQ ID NO: 71709 - RNA, 62 nt, Homo Sapiens
uugguuuucaccgguucggaauuuuggaaauacaugacuagucuauccugugccugucucau

SEQ ID NO: 71710 - RNA, 62 nt, Homo Sapiens
gugcgauucgugagcgccgccgacccccaccccaugacuauucgcuucuccuccgugccgug

SEQ ID NO: 71711 - RNA, 62 nt, Homo Sapiens
uuuucggaggccuccccagcuuugcguucugccaugacuaagaagaagguccuuauuucucu

SEQ ID NO: 71712 - RNA, 62 nt, Homo Sapiens
aaauguaaacguguauguauacaaguugacaccaugacuaguauuagggcuucguuguguua

SEQ ID NO: 71713 - RNA, 62 nt, Homo Sapiens
auagagagauuucuauaauuuugauacaaggucaugacuauccuagaacucucugugguuuu

SEQ ID NO: 71714 - RNA, 62 nt, Homo Sapiens
cuuggucucuaggauccaggcuccacagagcacaugacuagccaggccccuggcuuaagaag

SEQ ID NO: 71715 - RNA, 62 nt, Homo Sapiens
cucaacagcuuuccauucagucuggauccuuccaugacuacagccauuuaaguguucagcac

SEQ ID NO: 71716 - RNA, 62 nt, Homo Sapiens
aggaaauggaauugguauuucauuuuaauuuucaugacuacuaacucaccugaacuugcuau

SEQ ID NO: 71717 - RNA, 62 nt, Homo Sapiens
cccuucugauagccugccucacagaguuuagacaugacuagccagcuccuacaaucacugaa

SEQ ID NO: 71718 - RNA, 62 nt, Homo Sapiens
aagaaagagggcaaggaaaaaaggcuggacuccaugacuauauauacauacaucuaucuaca

SEQ ID NO: 71719 - RNA, 62 nt, Homo Sapiens
uuaucgauuuuuaucaauuuuccuuggagggacaugacuaauucagaaacugcgaggccagu

SEQ ID NO: 71720 - RNA, 62 nt, Homo Sapiens
caggagcagcgggcucacccccaggugccauucaugacuaaugcgggugacugucgcccaga

SEQ ID NO: 71721 - RNA, 62 nt, Homo Sapiens
cucucucaugacccaccucaacccagggccaacaugacuaagguccccaccaccccugcccc

SEQ ID NO: 71722 - RNA, 62 nt, Homo Sapiens
guacagccagauuuggaaacuaaagguuaccacaugacuagguuuggaaucuugaaugcuua

SEQ ID NO: 71723 - RNA, 62 nt, Homo Sapiens
auccacugacgaucauucuccuaaacugaacacaugacuagaauugguggugagauaucgcu

SEQ ID NO: 71724 - RNA, 64 nt, Homo Sapiens
gguguccuuccaggccucuuccccuuuccuccaucucuggcaacaguucuugggguuuggcaau

SEQ ID NO: 71725 - RNA, 64 nt, Homo Sapiens
gagaaauaaagauuuccuccaagccacaugaggacucuggcacccacccacaaagcaagaccug

SEQ ID NO: 71726 - RNA, 64 nt, Homo Sapiens
aaaccuccuccucccaggcagugagggggcaaggcucuggcacaaucaggacccccaagaguga

SEQ ID NO: 71727 - RNA, 64 nt, Homo Sapiens
aacucagggcccuggagcuggccugcucuccagccucuggcagggaccaggaaaagcagcagcu

SEQ ID NO: 71728 - RNA, 64 nt, Homo Sapiens
aaucagcuagacgcuauaccuuucccuccccauccucuggcagaaaccaagggugugucugcuc

SEQ ID NO: 71729 - RNA, 64 nt, Homo Sapiens
gcugcuaccuccucagaguucacaguccccucaccucuggcaggugggcuccccucugggccag

SEQ ID NO: 71730 - RNA, 64 nt, Homo Sapiens
aacucugaugcaccgcgaggaugccugugggccucucuggcagguuucacacucugccauguuc

SEQ ID NO: 71731 - RNA, 64 nt, Homo Sapiens
gagggagagacccugggugaccuggguaggauuccucuggcacgucuggauggaggcacucagg

SEQ ID NO: 71732 - RNA, 64 nt, Homo Sapiens
gucaagaauccaccuugggccagaccucggucagcucuggcacauagcauccuuaggucuugga

SEQ ID NO: 71733 - RNA, 64 nt, Homo Sapiens
ccgaugacgucgccggccucccugcaaggaaaagcucuggcacgugcgccccgcaacugacgcu

SEQ ID NO: 71734 - RNA, 64 nt, Homo Sapiens
cacugaccuguucuguugacuggggcccugcagacucuggcagagcugagaagggcagggaccu

SEQ ID NO: 71735 - RNA, 64 nt, Homo Sapiens
cuuccagcucagaacccaucccucugguggguaccucuggcacccaucugcaaauaucucccuc

SEQ ID NO: 71736 - RNA, 64 nt, Homo Sapiens
acucugaggccaccaaccucggcccucauccacccucuggcacaccagcucugggggaggcaca

SEQ ID NO: 71737 - RNA, 64 nt, Homo Sapiens
gcaaccacagucauugagaucacaacacggugaccucuggcaccuccugccccagguugaggcc

SEQ ID NO: 71738 - RNA, 64 nt, Homo Sapiens
gagagugggucucuguggcuuucacugauguucacucuggcauacuuucgcaauuuucuuuuuc

SEQ ID NO: 71739 - RNA, 64 nt, Homo Sapiens
cuuuuuaaauuucacagaagaggaaaguugccugcucuggcagguaugugcaagauagagugug

SEQ ID NO: 71740 - RNA, 64 nt, Homo Sapiens
uaugugcaagauagagugugaggaaaguugccugcucuggcaggcuuuuuaaauuucacagaag

SEQ ID NO: 71741 - RNA, 64 nt, Homo Sapiens
cuuucgcaauuuucuuuuucuucacugauguucacucuggcauagagagugggucucuguggcu

SEQ ID NO: 71742 - RNA, 64 nt, Homo Sapiens
uaugugcaggauacagugugaggaaaguggccugcucuggcaggcuuucuaaaucucacagaag

SEQ ID NO: 71743 - RNA, 64 nt, Homo Sapiens
cuucagcauuuuucuuuuuucucacugauguucacucuggcaucgagagugggucucuguggcu

SEQ ID NO: 71744 - RNA, 64 nt, Homo Sapiens
ucauaaccaauuggaaaccuuggcauuuccuggucucuggcacacuuuguuacaaacaucccuc

SEQ ID NO: 71745 - RNA, 64 nt, Homo Sapiens
uccuggucucuggcacaucauguuacaaacaucccucuggcauuggcuuagaguuuggcagcuu

SEQ ID NO: 71746 - RNA, 64 nt, Homo Sapiens
cucugacuucuugcccuuuggaaauggugcagcacucuggcauuuaucacccccaccugggucc

SEQ ID NO: 71747 - RNA, 64 nt, Homo Sapiens
uaaaggaguguccuuuacccucccagccuccaggcucuggcagaaauaaacuccaacccgacug

SEQ ID NO: 71748 - RNA, 64 nt, Homo Sapiens
agucccccagggggagagcaagcaagguggguggcucuggcacgagcccugcccacucuuaccg

SEQ ID NO: 71749 - RNA, 64 nt, Homo Sapiens
ggccaccacugcggugcuguuccuucacccccuccucuggcacacucaccaugaggacauucca

SEQ ID NO: 71750 - RNA, 64 nt, Homo Sapiens
augucucuuagaccuguucuggcugaagggcuaucucuggcaccucugagaucccuagguccug

SEQ ID NO: 71751 - RNA, 64 nt, Homo Sapiens
ucacucugcagcccuugaacauggcacugcccuccucuggcacucaugcugggccugugcccac

SEQ ID NO: 71752 - RNA, 64 nt, Homo Sapiens
aaacacccacaggacacugggggcugucacccugcucuggcaguccugcuaagagugucagggc

SEQ ID NO: 71753 - RNA, 64 nt, Homo Sapiens
cccuuccaggcaugaucuuccccaucaggcugggcucuggcagggaccugcccaggauggagau

SEQ ID NO: 71754 - RNA, 61 nt, Homo Sapiens
ugaccuccuugccucuugucuugaaccauagcaaaaggauacugcaucucucauuacugua

SEQ ID NO: 71755 - RNA, 61 nt, Homo Sapiens
ugauauuacagcuaaaaaaaucauucauuagcaaaaggaaaaguggucucaaccuaacauc

SEQ ID NO: 71756 - RNA, 61 nt, Homo Sapiens
uucacuuucagcgcuuauacuuuuauaaaagcaaaaggauaauaguuuauuguagugaugu

SEQ ID NO: 71757 - RNA, 61 nt, Homo Sapiens
gugugggucuuguuuggaucgacaugucgaccaaaaggaauauauaaauuaaaugagacga

SEQ ID NO: 71758 - RNA, 61 nt, Homo Sapiens
gugguuauuuuaaauauaaaaggaacugucucaaaaggauguaugguucaagauuguugau

SEQ ID NO: 71759 - RNA, 61 nt, Homo Sapiens
ucaggaacaaguaauguauuaugagcuacaacaaaaggacuuuuguauugcuuauuuuauu

SEQ ID NO: 71760 - RNA, 61 nt, Homo Sapiens
gguaugaugaugcgauaauaaauacuaacaucaaaaggacaagagaaaaaauaaagcaaga

SEQ ID NO: 71761 - RNA, 61 nt, Homo Sapiens
uuugguaucaucuucagagauaaaaaauuaucaaaaggaauucggugaagagcuggaaacu

SEQ ID NO: 71762 - RNA, 61 nt, Homo Sapiens
aaaaacaaacagaaacacaaacgauuuggaucaaaaggagaaaugauaagugacaaaagca

SEQ ID NO: 71763 - RNA, 61 nt, Homo Sapiens
auguagcccuggguuuaaugucaaaucaaggcaaaaggaauuaaauaauguacuuuuggcu

SEQ ID NO: 71764 - RNA, 61 nt, Homo Sapiens
accacagagggauauagugaacaaauuuuaacaaaaggacaaaggaacuaugaaaaccaga

SEQ ID NO: 71765 - RNA, 61 nt, Homo Sapiens
uaugaaaaccagaacaaauuuuguugaaguacaaaaggaacaguaaguugccaaaauguga

SEQ ID NO: 71766 - RNA, 61 nt, Homo Sapiens
accugugggguuagaacauaaggucagcugucaaaaggauagcuuacauuuuauaaguuua

SEQ ID NO: 71767 - RNA, 61 nt, Homo Sapiens
cauuugccaaaagcggcagaauguaaauagacaaaaggaaagcagguucaacguuauuuac

SEQ ID NO: 71768 - RNA, 61 nt, Homo Sapiens
cccgucccuuaaaaagacaaaaaaaauaaggcaaaaggaaagcaacuaagacacuggacua

SEQ ID NO: 71769 - RNA, 61 nt, Homo Sapiens
guguaacaucuauuuguuccucuuaccaaagcaaaaggauuggcuucauacaaaauagaca

SEQ ID NO: 71770 - RNA, 61 nt, Homo Sapiens
agcaccuuuuaaaccugcugcacauuggacucaaaaggaaaacuggaccaacaauaauuga

SEQ ID NO: 71771 - RNA, 61 nt, Homo Sapiens
aaguuuacaagacaugauauugcugcuuuuacaaaaggacauucuauuuauuuucgcagua

SEQ ID NO: 71772 - RNA, 61 nt, Homo Sapiens
aggccauaacuuuauuuguuucaagugaaugcaaaaggagccuaaucaaaacugggaguuc

SEQ ID NO: 71773 - RNA, 61 nt, Homo Sapiens
uccaaaaccuauucuaaacaggggguuugcucaaaaggaaaaguauauccuuuaaaggacu

SEQ ID NO: 71774 - RNA, 61 nt, Homo Sapiens
gccaaaguauccaucauuaguucccaacucacaaaaggaagugaaacuggaggaugacagu

SEQ ID NO: 71775 - RNA, 61 nt, Homo Sapiens
acaaugccauccuucauauuaauuuuggacucaaaaggaggaagacaaaagcugcagugaa

SEQ ID NO: 71776 - RNA, 61 nt, Homo Sapiens
uuuuuuugaaaaaagcucauuucaugcucugcaaaaggagagacucccaugaagccuuuug

SEQ ID NO: 71777 - RNA, 61 nt, Homo Sapiens
uacaaggccuaugaguauggauugggggggccaaaaggaaaaagcuccaugugccucuuug

SEQ ID NO: 71778 - RNA, 61 nt, Homo Sapiens
ugaaaggaugcuggcuauauauguuaaugagcaaaaggauuauaguuguuuuguuuuguuu

SEQ ID NO: 71779 - RNA, 61 nt, Homo Sapiens
ggacacugccuuaggcaauggucuauauaagcaaaaggagauagagaucugaaauaauuuu

SEQ ID NO: 71780 - RNA, 61 nt, Homo Sapiens
gaaugauucaaagcagaggaaaugauugguucaaaaggaaagaaagaaaaccuuucaacca

SEQ ID NO: 71781 - RNA, 61 nt, Homo Sapiens
aaaacaacucccgugauaugaucguuuaaugcaaaaggacaaaaucauucuaucauugagu

SEQ ID NO: 71782 - RNA, 61 nt, Homo Sapiens
uuucaacacacuaaaccaggaaaugcugaugcaaaaggauuaaaaaaauuauaugcugcau

SEQ ID NO: 71783 - RNA, 61 nt, Homo Sapiens
uagagguucugaauuucuucgaaguagaauucaaaaggagaaagccaguuaccuuugcacu

SEQ ID NO: 71784 - RNA, 61 nt, Homo Sapiens
uaauucuuguuuuuuucccagcuauauucaccaaaaggacuaaugaacuaaacauugccuu

SEQ ID NO: 71785 - RNA, 61 nt, Homo Sapiens
uacuucuuguuuuuucccaggcuauauucaccaaaaggacuaaugaacuaaacauugccuu

SEQ ID NO: 71786 - RNA, 61 nt, Homo Sapiens
aaaaucaaggaaagaaugaguugaaugugaacaaaaggaagacaaaguccaaaagucacuu

SEQ ID NO: 71787 - RNA, 61 nt, Homo Sapiens
cuacaagaaaguacgagauuaaugauauaaccaaaaggagccacaguguccuuuauguaag

SEQ ID NO: 71788 - RNA, 61 nt, Homo Sapiens
aaaaacaguggccuuuggucuuuauuuuucgcaaaaggagaucuucauauauaugauauca

SEQ ID NO: 71789 - RNA, 61 nt, Homo Sapiens
auagauuuucaguuguguguuuucugguaaacaaaaggauuauacaauggagcuaucauag

SEQ ID NO: 71790 - RNA, 61 nt, Homo Sapiens
aaacugacaggaaugcacauauguggccaaccaaaaggacagauagcaugagauagucuca

SEQ ID NO: 71791 - RNA, 61 nt, Homo Sapiens
aagauaaaauacagaagacuaucuuaacuugcaaaaggagauacaaaaacucuucauguga

SEQ ID NO: 71792 - RNA, 61 nt, Homo Sapiens
aaaacucaaucaauguaauucaguauuuuaacaaaaggaaugaaaaauuaucaucucaaua

SEQ ID NO: 71793 - RNA, 61 nt, Homo Sapiens
uggagacucaguucuccuaggaccauuuauucaaaaggacugcccucucuuguucuuggaa

SEQ ID NO: 71794 - RNA, 61 nt, Homo Sapiens
agguucugagcaaacaugaucuagcucucaccaaaaggaccugagcuagggucugcuggga

SEQ ID NO: 71795 - RNA, 61 nt, Homo Sapiens
gagauaauggaguggggaugacuguggcaaacaaaaggagauucgaacauucuagaggggc

SEQ ID NO: 71796 - RNA, 61 nt, Homo Sapiens
uuauuucauuaaauuugguuauagccuuaagcaaaaggaugagaaugaaacagcuuuaaaa

SEQ ID NO: 71797 - RNA, 61 nt, Homo Sapiens
ggaaagggaagggaauuuccgcguucugcuacaaaaggaauugugagccgaggcaguuccu

SEQ ID NO: 71798 - RNA, 64 nt, Homo Sapiens
cuccagggccgugagggcaagagggggaccugccaccagggagcuuccuggcucugggggaccc

SEQ ID NO: 71799 - RNA, 64 nt, Homo Sapiens
ccuugccauucugccccuggacccuucucuccggaccagggaggcgucccucccuaggagccac

SEQ ID NO: 71800 - RNA, 64 nt, Homo Sapiens
cuuuagaugcaugaauuuaucagcaugcggccugaccagggacuccauuccccaaauugaauau

SEQ ID NO: 71801 - RNA, 64 nt, Homo Sapiens
auggagcaguggcacccuauugcucuuccugcccaccagggaccuuccuaugggcaaggcccag

SEQ ID NO: 71802 - RNA, 64 nt, Homo Sapiens
caggccucccacucagagucaggacauggccuggaccagggaggcacccagagagggacaagau

SEQ ID NO: 71803 - RNA, 64 nt, Homo Sapiens
uguguaccugaggggcacccaguggacaggccagaccagggagaggcaugugaagcugccggaa

SEQ ID NO: 71804 - RNA, 64 nt, Homo Sapiens
caacaacugccccuucuuuaugcagaggugcagaaccagggacuccugggcccauccaggcugc

SEQ ID NO: 71805 - RNA, 64 nt, Homo Sapiens
gcccauccaggcugcucccugggguggagaagggaccagggauugcaggccccaucuccaggcu

SEQ ID NO: 71806 - RNA, 64 nt, Homo Sapiens
aguggaggacgagguaacucugggcagggccugcaccagggagguggguugcaggaggaggagc

SEQ ID NO: 71807 - RNA, 64 nt, Homo Sapiens
ggagagccagcaggguggauaggacaugguggagaccagggacaccuguuucuucuaagggagg

SEQ ID NO: 71808 - RNA, 64 nt, Homo Sapiens
ugccuagcuuggugagguuacucacccugucucuaccagggaggccccaucauccucgcgcguc

SEQ ID NO: 71809 - RNA, 64 nt, Homo Sapiens
ugccagagggcucgaugacucuggugcccgggcuaccagggacaccccucacaagccgcagcgg

SEQ ID NO: 71810 - RNA, 64 nt, Homo Sapiens
cagucucccugccccccaugccccagaccggcccaccagggacuagccgcugucgcacagccuc

SEQ ID NO: 71811 - RNA, 64 nt, Homo Sapiens
cauuuuccugcggcagagcagggccugguguggaaccagggagcugugggaagccacagcagaa

SEQ ID NO: 71812 - RNA, 64 nt, Homo Sapiens
aggcccuuagggcaggaagggacgaugagcaagucugccacaccaccuggugacugggaagggc

SEQ ID NO: 71813 - RNA, 64 nt, Homo Sapiens
auguguggguuucccagcuaacggacaagcuccccugccacacccagugcccacgcaugcucac

SEQ ID NO: 71814 - RNA, 64 nt, Homo Sapiens
gcccacacccaugcccaccauuccgucugcucaccugccacagauguucauaccacaucagugu

SEQ ID NO: 71815 - RNA, 64 nt, Homo Sapiens
gcgcuccggggccugagggcaggucuccucccaccugccacacacucccagggcagccccaacc

SEQ ID NO: 71816 - RNA, 64 nt, Homo Sapiens
ggucccggcucuuccuguguggaggugaugguaccugccacaccacagcugcgcacacagcugc

SEQ ID NO: 71817 - RNA, 64 nt, Homo Sapiens
gugggcacugugccagggcuggggccuucugcugcugccacacccagcucaggccugggccagc

SEQ ID NO: 71818 - RNA, 64 nt, Homo Sapiens
gcugcccugccucauagguacucagcagggcuggcugccacaggaggccacuacaaacugaccc

SEQ ID NO: 71819 - RNA, 64 nt, Homo Sapiens
cuaggucuaagaguugaacguggccuuguugcugcugccacaucgaccucaguugagcugccuc

SEQ ID NO: 71820 - RNA, 64 nt, Homo Sapiens
gagucuugccaugccugugugcuaaguugggucacugccacaugcagccuggacauuggacauu

SEQ ID NO: 71821 - RNA, 64 nt, Homo Sapiens
gagccacugucaugcaggucacagugucuggacacugccacaugacgcugccacaucugggcau

SEQ ID NO: 71822 - RNA, 64 nt, Homo Sapiens
ugggcauacagugucuggacacagugucuggacgcugccacaucaugcugccacaucugggcau

SEQ ID NO: 71823 - RNA, 64 nt, Homo Sapiens
ugggcauacagugucuggaccagcuggacggaugcugccacaucagaccuggagggcagccaca

SEQ ID NO: 71824 - RNA, 64 nt, Homo Sapiens
agcucauagcacaaaaaaagagggauggaccagacugccacagcuuuaaaaacacaguccugag

SEQ ID NO: 71825 - RNA, 64 nt, Homo Sapiens
aaaagaugaaauguaauuucauaugagcuauguacugccacaaagguaagauaccauuauauuu

SEQ ID NO: 71826 - RNA, 64 nt, Homo Sapiens
agcccauggcacaacuaacaggggauagacuagacugccacagcuuuaaaaaacacaaucuuaa

SEQ ID NO: 71827 - RNA, 64 nt, Homo Sapiens
gacuuuguucucauuaauauaagaggaauacgggcugccacauaguuuuuuagccuuugauggu

SEQ ID NO: 71828 - RNA, 64 nt, Homo Sapiens
cgggauuucauuucugcuuuuuuuuaaagagcaacugccacauggacugcacugauauauauuu

SEQ ID NO: 71829 - RNA, 64 nt, Homo Sapiens
gcacuggaauggacagcaggcaggcccguggccccugccacagggcagccucgggcaggggucu

SEQ ID NO: 71830 - RNA, 64 nt, Homo Sapiens
ccggaagccgcagggggcaccugcccccgacccccugccacagggcgcacggugaugcucgggu

SEQ ID NO: 71831 - RNA, 64 nt, Homo Sapiens
uggggccuccccagcugcuggccagacccuggcgcugccacaguccuggcacugcccaaggcca

SEQ ID NO: 71832 - RNA, 64 nt, Homo Sapiens
cuggugggaggagcgacugcccugcccaaaugaacugccacagcagggacagcuggaccgcaga

SEQ ID NO: 71833 - RNA, 64 nt, Homo Sapiens
caggggaaggcccugaggcgcugagaagaaguggcugccacaccugcucugccucagacguugc

SEQ ID NO: 71834 - RNA, 64 nt, Homo Sapiens
cagaggagggcagagggagagcaguguggagacccugccacagcggggagagacaggcagccca

SEQ ID NO: 71835 - RNA, 64 nt, Homo Sapiens
uguccuggccuuccucaugaggggguaagccgcucugccacacugugcugguacacugugccau

SEQ ID NO: 71836 - RNA, 64 nt, Homo Sapiens
gaaccauaucgaugaggucuguggguccgucaggcugccacacugcuucgcugcagcgcuugcu

SEQ ID NO: 71837 - RNA, 64 nt, Homo Sapiens
cuacagggucacucaguaugggugagcccaggcccugccacaaccaacugcgggguccucaugg

SEQ ID NO: 71838 - RNA, 64 nt, Homo Sapiens
gugaagaaggccuucaccuuaaggauguuaguuucugccacaauccuagugcccaucuuccuga

SEQ ID NO: 71839 - RNA, 64 nt, Homo Sapiens
agcaggagagcaugcccauauuggcuuacuuugucugccacagacacagacagagggaguuggg

SEQ ID NO: 71840 - RNA, 64 nt, Homo Sapiens
ccccaaacuccaccucuuggauuggcccuggcugcugccacacacauauccaagagcucagggc

SEQ ID NO: 71841 - RNA, 64 nt, Homo Sapiens
cccgacacuccugcuguccagggacccaggccagcugccacaccugagggcagacacagcucca

SEQ ID NO: 71842 - RNA, 64 nt, Homo Sapiens
gaaguucauagccaggauaguucaguuuuuccaucugccacaugggguuucuugcugucuggaa

SEQ ID NO: 71843 - RNA, 64 nt, Homo Sapiens
ccuaaggcugagugaggugucacccgccaggcagcugccacaggcauccucucacucacuucuc

SEQ ID NO: 71844 - RNA, 64 nt, Homo Sapiens
ggaugguggcucaggcgcucugcuacgccagcagcugccacaugacgaugccagcccgaggcac

SEQ ID NO: 71845 - RNA, 64 nt, Homo Sapiens
cagaauucgagacauacuuacagagccgcaccaucugccacaaaggccgccgagggcugagcuc

SEQ ID NO: 71846 - RNA, 64 nt, Homo Sapiens
gucagagacacggucacugauucacacccagucccugccacagaccgucucagacacgcacagu

SEQ ID NO: 71847 - RNA, 64 nt, Homo Sapiens
acagugggccugcugcaugauucacacccagucccugccacagaccgucucagacacgcacagu

SEQ ID NO: 71848 - RNA, 64 nt, Homo Sapiens; identical to SEQ ID NO: 71847

SEQ ID NO: 71849 - RNA, 64 nt, Homo Sapiens
uccuuucccuccuggccugcuuggggcugcggcacugccacacaggaggcgccccgggugggcu

SEQ ID NO: 71850 - RNA, 64 nt, Homo Sapiens
gggagcuaagccggcccuggguggccuugcuugucugccacagcgcggccuucagugucacagc

SEQ ID NO: 71851 - RNA, 64 nt, Homo Sapiens
ccccuggaaaugcuaccuacccagcuacacgucgcugccacaggcgccuggcaguagccucuuu

SEQ ID NO: 71852 - RNA, 64 nt, Homo Sapiens
gccuggcaguagccucuuucccagagggaacauccugccacaccuggggccaauccagggcagc

SEQ ID NO: 71853 - RNA, 64 nt, Homo Sapiens
acugggcaacuauucaugagugcucccuaccugacugccacagaaaaauuauaacauuuacuuu

SEQ ID NO: 71854 - RNA, 64 nt, Homo Sapiens
gcccggcuaauuuuuuguaugggacuacaggcgccugccacaacccucagccuccugaguagcu

SEQ ID NO: 71855 - RNA, 64 nt, Homo Sapiens
caagaagcucccaucacaagcuuggcauugcucucugccacacgugggcuuccucaggcuuguc

SEQ ID NO: 71856 - RNA, 64 nt, Homo Sapiens
gcucucugccacacgugggcuuccucaggcuugucugccacaagcuacuucucugagcucagaa

SEQ ID NO: 71857 - RNA, 57 nt, Homo Sapiens
ccuacgagaucucggugugaggacugacugccacacauccgccauggugccacgggg

SEQ ID NO: 71858 - RNA, 64 nt, Homo Sapiens
gggggggcaggcgggagcaggcacgggggugaugcugccacagggggcuggugacacccagagc

SEQ ID NO: 71859 - RNA, 64 nt, Homo Sapiens
guaauuaagucauauuucuuauccaggugguuaaagcauucauaaaggauuauaaaauuuuuuu

SEQ ID NO: 71860 - RNA, 64 nt, Homo Sapiens
gauguaauugagugaagguuugcacugagaaauuagcauucaggccuuacccccaugaaguauu

SEQ ID NO: 71861 - RNA, 64 nt, Homo Sapiens
ucccuguuucaauaagagucaaggcugcaauacaagcauucagucagugaauaugugauucuuu

SEQ ID NO: 71862 - RNA, 64 nt, Homo Sapiens
cauggucugcuagguugcaguacaacuuuucaaaagcauucagugugauuucauguuuguaauc

SEQ ID NO: 71863 - RNA, 64 nt, Homo Sapiens
uggcuggcugcuucuaggaauauaagaugccucaagcauucauuauuuaugauuugaauacugu

SEQ ID NO: 71864 - RNA, 64 nt, Homo Sapiens
uauuuuaauaguaaacagggaucacuuuuccuuuagcauucagaaugacaccauauucuuaaau

SEQ ID NO: 71865 - RNA, 64 nt, Homo Sapiens
uuuuauauggaaaggcuuacaaaucaauauuguaagcauucauuauuuaagaauguacaaugua

SEQ ID NO: 71866 - RNA, 64 nt, Homo Sapiens
ugauaaaacugauuuuguuuaacaggaaauuuuuagcauucagucauauaacaucugguuauca

SEQ ID NO: 71867 - RNA, 64 nt, Homo Sapiens
acucucucugggguugugagucagucagcccacaagcauucacagagugcuuaccugccccgag

SEQ ID NO: 71868 - RNA, 64 nt, Homo Sapiens
guuuugucauguggaaaaucaaaacaaguuagaaagcauucagauuguuucuuuuaaacucacu

SEQ ID NO: 71869 - RNA, 64 nt, Homo Sapiens
ugugauauuuuccagauuugaauuuuuuuuguacagcauucaugcucugcacuggucauuugag

SEQ ID NO: 71870 - RNA, 64 nt, Homo Sapiens
caccucaccugccuuggcaauucugugaggcuugagcauucauauaguuggcacuugauugcag

SEQ ID NO: 71871 - RNA, 64 nt, Homo Sapiens
gagagaagcucugugaauguaagcauugugggaaagcauucauaucugccaagauccuuugaau

SEQ ID NO: 71872 - RNA, 64 nt, Homo Sapiens
gagagaaacccuaugaauguaaagaaugcagaaaagcauucagcuugccuacuuccuuucauag

SEQ ID NO: 71873 - RNA, 64 nt, Homo Sapiens
gagaggcgcccuaagaauguaagcauugugggaaagcauucauaucugccaagaucguuugaau

SEQ ID NO: 71874 - RNA, 64 nt, Homo Sapiens
ggagagaaaccuaugaauguaaggaaugcaaacaagcauucaauuauuuuucuuccuugcauau

SEQ ID NO: 71875 - RNA, 64 nt, Homo Sapiens
gagagaauccguaugaauguaaggauugugggaaagcauucagcuugcuuaauugcuuucauag

SEQ ID NO: 71876 - RNA, 64 nt, Homo Sapiens
agagaacucugucuuaagcuacaugcccauagcuagcauucaaccccuggagucucacucccac

SEQ ID NO: 71877 - RNA, 64 nt, Homo Sapiens
gaggagucguaagaucuuaaggugcagguggcccagcauucaggcuuucuuuuuggcuagggaa

SEQ ID NO: 71878 - RNA, 64 nt, Homo Sapiens
cuacagagaaacuugaaauauuaggaaacuugugagcauucacauuucuguuuuucuacauuug

SEQ ID NO: 71879 - RNA, 64 nt, Homo Sapiens
aacuccuauuaauucacucuaaucaauaugaaauagcauucagugcacaucauccuucuacucu

SEQ ID NO: 71880 - RNA, 64 nt, Homo Sapiens
aaguaccuaaacauucgugaaaugauuuuuuuuagcugaaaaaugcuggcaagaagaauuuuaa

SEQ ID NO: 71881 - RNA, 64 nt, Homo Sapiens
uuugaaccaaaaaaaauuguuuuuacaucuuuaugcugaaaauguguuuagauuaggaauaugg

SEQ ID NO: 71882 - RNA, 64 nt, Homo Sapiens
aguagaucucaauguuuuauaauuccuuaaaacagcugaaaauugggacaacauacuuuacgca

SEQ ID NO: 71883 - RNA, 64 nt, Homo Sapiens
cacuauucacaggacauuggcauuaucuacuaaggcugaaaaugugcauauuccaugacucagg

SEQ ID NO: 71884 - RNA, 64 nt, Homo Sapiens
aauaauaacagacaaggucaaaaaauagaugcaggcugaaaagaaaaggaagugggcuaagaug

SEQ ID NO: 71885 - RNA, 64 nt, Homo Sapiens
gaagacugauuuaaugugguaaacuuuuacuagggcugaaaagauggcaucuuagaauuaaaca

SEQ ID NO: 71886 - RNA, 64 nt, Homo Sapiens
gucauuucccuguucacuuaugagcugcuuuuaugcugaaaauguuuuuucauuacaagcccca

SEQ ID NO: 71887 - RNA, 64 nt, Homo Sapiens
ccuuuugaaacauaagaaaaacauuuaaaccuaugcugaaaauacgauaaaagaaaaacaacuc

SEQ ID NO: 71888 - RNA, 64 nt, Homo Sapiens
gagaguuuuuauuaagugaaccaucacgauauuggcugaaaaguucuacauucuauuauuguau

SEQ ID NO: 71889 - RNA, 64 nt, Homo Sapiens
aaaacuacaaguuuauuuauaauuuaacaacucagcugaaaauauaacggguauauuuguuauu

SEQ ID NO: 71890 - RNA, 64 nt, Homo Sapiens
acuuagaagguuuaacacuucacugauuaauggugcugaaaacacguuacaauuaccacauauc

SEQ ID NO: 71891 - RNA, 64 nt, Homo Sapiens
uucuucaacaggauuacaguguagcuaccuacaugcugaaaaauauagccuuuaaaucauuuuu

SEQ ID NO: 71892 - RNA, 64 nt, Homo Sapiens
ucuaguaacaauacaugagaaagaugucuauguagcugaaaauaaaaugacgucacaagacaau

SEQ ID NO: 71893 - RNA, 64 nt, Homo Sapiens
aaaaaaaugauuguuuuagauuauauaacccacugcugaaaaaguuuuuuaaauuuacagaaua

SEQ ID NO: 71894 - RNA, 64 nt, Homo Sapiens
acaacuuguguuuauggcauuagcuugaaaacuugcugaaaaacucuucaacagggaaaacagc

SEQ ID NO: 71895 - RNA, 64 nt, Homo Sapiens
acuuggguauucucugauuucaauggacauggaagcugaaaauugguccagagaaccuggcaug

SEQ ID NO: 71896 - RNA, 64 nt, Homo Sapiens
auucagaugcacacccuucuagcccuucagguuugcugaaaagcuuuggggaaaggaggaggag

SEQ ID NO: 71897 - RNA, 64 nt, Homo Sapiens
aaaacgauuucauuguucaucaucuuagauaaaugcugaaaaggcaacuacuuuguuauuucua

SEQ ID NO: 71898 - RNA, 64 nt, Homo Sapiens
gaaguuggcuacucucagaaugcucuugccagcugcugaaaauaucaguagaacucauugaggg

SEQ ID NO: 71899 - RNA, 64 nt, Homo Sapiens
ucccagcacaaggcagagcugggaugaaaacagggcugaaaagacucagggccaauuauuggcu

SEQ ID NO: 71900 - RNA, 64 nt, Homo Sapiens
ucagggaaagaaggugauuuguauuugucuccccgcugaaaagaacaggauucaaguccagagu

SEQ ID NO: 71901 - RNA, 64 nt, Homo Sapiens
auaauguuuaauuagaauugugguggugguaguggaaggggauaauuguaaauaggaaacauga

SEQ ID NO: 71902 - RNA, 64 nt, Homo Sapiens
uuagaaucuaaccugcugucuucgugcucugugugaaggggaagcugggggguuagcaugaagu

SEQ ID NO: 71903 - RNA, 64 nt, Homo Sapiens
auccuaaugucuuagaaagcuugagaaugaaagugaaggggaugaguaauagggaauucacuua

SEQ ID NO: 71904 - RNA, 64 nt, Homo Sapiens
augccaauuuuuacuguaaugugcuucugcuuuugaaggggaaauacuauacauucuaagacug

SEQ ID NO: 71905 - RNA, 64 nt, Homo Sapiens
aagaucaaaacccaccaugcgaaggggaagaaaagaaggggaagaagaucaaagaagaaaagaa

SEQ ID NO: 71906 - RNA, 64 nt, Homo Sapiens
aaaagaaggggaagaagaucaaagaagaaaagaagaaggggaagaaaagaaggggaagaagauc

SEQ ID NO: 71907 - RNA, 64 nt, Homo Sapiens
aagaucaaagaagaaaagaagaaggggaagaaaagaaggggaaggcagaaauugaaaagaaggg

SEQ ID NO: 71908 - RNA, 64 nt, Homo Sapiens
aaaagaaggggaagaagaucauugaaaagaaggggaaggggaagugucugaauuuauugcagaa

SEQ ID NO: 71909 - RNA, 64 nt, Homo Sapiens
gggaagaaaagaaggggaagggagaaauugaaaagaaggggaaguuggcuuuucucuugacgug

SEQ ID NO: 71910 - RNA, 64 nt, Homo Sapiens
aaaaagcaaaugggauuaaggacucauggaaugggaaggggaaggggagucuuacuauaugugg

SEQ ID NO: 71911 - RNA, 64 nt, Homo Sapiens
caaaugggauuaaggacucauggaaugggaaggggaaggggagucuuacuauauguggaauaaa

SEQ ID NO: 71912 - RNA, 64 nt, Homo Sapiens
gucuuugagggccuuaaaagcuuuuucuaccugagaaggggagugaaggugaggggaggggagg

SEQ ID NO: 71913 - RNA, 64 nt, Homo Sapiens
ccccugagguucuccuggcucuucagguguuaaggaaggggaugacagcguuaggagccguuuc

SEQ ID NO: 71914 - RNA, 64 nt, Homo Sapiens
aggaagaagagugaaacaaaaggaaggugaaggggaaggggaaggcucauuguggaaacgaugg

SEQ ID NO: 71915 - RNA, 64 nt, Homo Sapiens
gggaagaggaagaagagugacgauggaggaaggugaaggggaagagcagagcucauuguggaaa

SEQ ID NO: 71916 - RNA, 64 nt, Homo Sapiens
aacuuuaguaaacccuaaguaaagucaaaauggagaaggggaaauauacagauggcuaguugca

SEQ ID NO: 71917 - RNA, 64 nt, Homo Sapiens
uuucccuucuuaaacagaaauaaauauuuggaaugaaggggaauguacuagaacacccuuuuug

SEQ ID NO: 71918 - RNA, 64 nt, Homo Sapiens
auuuccaccaacugaaucauuuaacaaugaaggggaaggggaagcuauuuuaaguuugaaaacu

SEQ ID NO: 71919 - RNA, 64 nt, Homo Sapiens
gggaagauuuccaccaacugaaaacuuuaacaaugaaggggaaguuagcacuauuuuaaguuug

SEQ ID NO: 71920 - RNA, 64 nt, Homo Sapiens
gagggagcagguaggaaacaggacgggggaggaggaaggggacaugaaaugcgcagccggcugu

SEQ ID NO: 71921 - RNA, 64 nt, Homo Sapiens
uguuugcaguagcagccgcugagcgcagagcugcgaaggggaacggcacacugaugggcgagcu

SEQ ID NO: 71922 - RNA, 64 nt, Homo Sapiens
guagaauguuccuggauguucauaucuaguguuugaaggggaggagggauuuaaacugguccug

SEQ ID NO: 71923 - RNA, 64 nt, Homo Sapiens
aaggaagauuguuguuuaaauucauuugaaaccagaaggggacuuuuuaguuguauguguaaca

SEQ ID NO: 71924 - RNA, 64 nt, Homo Sapiens
aggagugucgccgggaggccuucagggugggggggaaggggacaugggcaggaagcaccgaggg

SEQ ID NO: 71925 - RNA, 64 nt, Homo Sapiens
agaguaggccuuugcccgggggcagacuuagaaggaaggggagagacaaagggggacugaguuu

SEQ ID NO: 71926 - RNA, 64 nt, Homo Sapiens
cucccuccucuguaacuucugugcucagcugcuugaaggggagaugaggucccauccacagcug

SEQ ID NO: 71927 - RNA, 64 nt, Homo Sapiens
agucagauuuuuacagaggaugagguaggccuuagaaggggauguucuaggaaaagggagugcc

SEQ ID NO: 71928 - RNA, 64 nt, Homo Sapiens
caguagcacuaaugcuauguuaccacgggaaagggaaggggaagugugauugacuaguaauggc

SEQ ID NO: 71929 - RNA, 64 nt, Homo Sapiens
aagacuugggcucacaggcugggguacgagggaggaaggggagcagggcgcccaggggcgggcg

SEQ ID NO: 71930 - RNA, 64 nt, Homo Sapiens
gaguguucucaccaccacuuaugccccuagaagggaaggggagagggaaacgugcccucuguuu

SEQ ID NO: 71931 - RNA, 64 nt, Homo Sapiens
uuccauggucacagagaacuagugguggcucugagaaggggaggaccucugggcuuugauucca

SEQ ID NO: 71932 - RNA, 64 nt, Homo Sapiens
aaugagggcauuucaugaaccgggggccuuagcagaaggggaacggacagcaggagggaggcgu

SEQ ID NO: 71933 - RNA, 64 nt, Homo Sapiens
gaaggggcuuugggaucugggugagcgagauggagaaggggaaggagggagccaggccccgagg

SEQ ID NO: 71934 - RNA, 64 nt, Homo Sapiens
guuugcuuuuagugcuggccucuuugugggaauggaaggggacaagaaggccacaguaggccuc

SEQ ID NO: 71935 - RNA, 64 nt, Homo Sapiens
uccauuccugcugggucuuaucgggcuuccuggagaaggggacggcaagaaagucucuucggcc

SEQ ID NO: 71936 - RNA, 64 nt, Homo Sapiens
gaaauugcugcuucuccaacgaguccugggcagggaaggggaggaaggaagcugagcaucuccc

SEQ ID NO: 71937 - RNA, 64 nt, Homo Sapiens
aagaccccaggaggccaaagcuccagccuggagggaaggggacaccaggacauuccuuucccag

SEQ ID NO: 71938 - RNA, 64 nt, Homo Sapiens
acgaggacaucagagguuagcacaacaggcuguagaaggggaugaguggcuuccccuucagggc

SEQ ID NO: 71939 - RNA, 64 nt, Homo Sapiens
ucucacuucaauuauagaucaguauugagaaggggaaggggauuaaauuuccaggccuuuuuga

SEQ ID NO: 71940 - RNA, 64 nt, Homo Sapiens
gggauuucucacuucaauuauuuugaaguauugagaaggggaaguaugccaaauuuccaggccu

SEQ ID NO: 71941 - RNA, 61 nt, Homo Sapiens
gacugagaggcuuuucuagcugaggggucuacaccugcaagugagggccaugcaugcagua

SEQ ID NO: 71942 - RNA, 61 nt, Homo Sapiens
ggacgaguccccgggccugggagaaggucuacaccugcaaggcaggcauugcacauggugu

SEQ ID NO: 71943 - RNA, 61 nt, Homo Sapiens
ggcugaggcccugggcccagugaggaguguacaccugcaagcacaggcauugcacacggug

SEQ ID NO: 71944 - RNA, 61 nt, Homo Sapiens
ggcugagucccugggcucaggaaugggucuacaccugcaugacaggcauugcacacagugu

SEQ ID NO: 71945 - RNA, 61 nt, Homo Sapiens
ggcugaguuccugggcucgaugaagggucuacaccugcacaugcaggcauugcacacggug

SEQ ID NO: 71946 - RNA, 61 nt, Homo Sapiens
cccaggccucccucccccggauggaagccuccaccugcagccccuccugaccccaccuaga

SEQ ID NO: 71947 - RNA, 61 nt, Homo Sapiens
gagcagcacgccaaccccagacucacggcugcaccugcagggcugaggggcagggccguag

SEQ ID NO: 71948 - RNA, 61 nt, Homo Sapiens
caggugauuaaaaagcuuuauggacucagcccaccugcacccacccuuugcugacucuuuu

SEQ ID NO: 71949 - RNA, 61 nt, Homo Sapiens
cccagcaccuuaggaggccggugguggcucacaccugcaaugugcugcaguauggccagac

SEQ ID NO: 71950 - RNA, 61 nt, Homo Sapiens
guuucugguugucacugcaccacuggguguucaccugcaaagggacccugccagggaaggc

SEQ ID NO: 71951 - RNA, 61 nt, Homo Sapiens
caagguacccgaagaagcagcugccccaaugcaccugcaggccuggcccaacagaaaaacc

SEQ ID NO: 71952 - RNA, 61 nt, Homo Sapiens
gcacgccuggcuuuccuuggauacccacugucaccugcacuaugaagugcugcuggcuggg

SEQ ID NO: 71953 - RNA, 61 nt, Homo Sapiens
cccccuuuggcuuaauuaagugugcugucugcaccugcaagguauggccacccaaucuucu

SEQ ID NO: 71954 - RNA, 61 nt, Homo Sapiens
cagugcccccuuuuggagagaugagcuguaucaccugcagaugugggguaaguggggagca

SEQ ID NO: 71955 - RNA, 61 nt, Homo Sapiens
gcagagcucauuguggaaaccuuggagaagccaccugcacaccugcaaggcugucaacagu

SEQ ID NO: 71956 - RNA, 61 nt, Homo Sapiens
gcugucaacagucuuggagagaugccaaguacaccugcaaggugauguuugcggggaugac

SEQ ID NO: 71957 - RNA, 61 nt, Homo Sapiens
gccuugccaucgggcccaguucuccgggccccaccugcaccccuuucuucccccugggaua

SEQ ID NO: 71958 - RNA, 61 nt, Homo Sapiens
uuugccccagggugggugcaggugcgagugucaccugcagcugccucagucauucagaguu

SEQ ID NO: 71959 - RNA, 61 nt, Homo Sapiens
cccagcuacuugggaggccagugguaauguucaccugcagucuacuaaaaauuagccaagu

SEQ ID NO: 71960 - RNA, 61 nt, Homo Sapiens
agaagugcguaccagaaguacagugugcugucaccugcaacaaugaugaaguugcaaaugg

SEQ ID NO: 71961 - RNA, 61 nt, Homo Sapiens
ccgugcacaggcacacgugcuggucugcacacaccugcacacaccugcacacucgcuaugc

SEQ ID NO: 71962 - RNA, 61 nt, Homo Sapiens
gcacacgugcuggucugcacacaccugcacacaccugcacacucgcuaugccaggccuccu

SEQ ID NO: 71963 - RNA, 61 nt, Homo Sapiens
cgcaaucuggcuccuccuggaaaauuucccccaccugcagcgcugggccccaaggcuugcc

SEQ ID NO: 71964 - RNA, 61 nt, Homo Sapiens
ccauacucccacuuugugccaaaugacuuugcaccugcaaauggugcuucaaugucguuuu

SEQ ID NO: 71965 - RNA, 61 nt, Homo Sapiens
aauacaaaaaucagccagacaugguggcaugcaccugcaaucccagcuacucgggaggcug

SEQ ID NO: 71966 - RNA, 61 nt, Homo Sapiens
uuaacaugacauuuaccagcaacuugaacuucaccugcaaagcucuguggccacauuuuca

SEQ ID NO: 71967 - RNA, 61 nt, Homo Sapiens
cguaguucccugaaaacccacuguguccuugcaccugcaucacugccccaacuccuggaag

SEQ ID NO: 71968 - RNA, 61 nt, Homo Sapiens
uccccccacugcaggccccgagggacagagacaccugcaccgagaaaugcauccauuccuc

SEQ ID NO: 71969 - RNA, 61 nt, Homo Sapiens
cccagcuacuugggaggcugaugauggcacgcaccugcaguaguacaaaaauuagcugggc

SEQ ID NO: 71970 - RNA, 61 nt, Homo Sapiens
guccagugaaaugauauauuaucauccaaagcaccugcagacagccauguccuauuccuug

SEQ ID NO: 71971 - RNA, 61 nt, Homo Sapiens
cacguguguaugcacuccccgcagggcuaugcaccugcaggcggugccaucucuuguguau

SEQ ID NO: 71972 - RNA, 61 nt, Homo Sapiens
gucacucuuuugaugcugggauuacugccuucaccugcauagccacauuuccauuugcauc

SEQ ID NO: 71973 - RNA, 61 nt, Homo Sapiens
aagggucccaggcugucaggggcguuugcgccaccugcaagggcgugggucagagaguuuu

SEQ ID NO: 71974 - RNA, 61 nt, Homo Sapiens
gcugucccggcuccaucuugguucuagccgccaccugcaugaacacaguggcccggcuuaa

SEQ ID NO: 71975 - RNA, 61 nt, Homo Sapiens
guucuggucaaaacuaaaggaacucccuccccaccugcaggacuccgaagacagugcgacu

SEQ ID NO: 71976 - RNA, 61 nt, Homo Sapiens
ugagucagacaagugggagcuguaggaacugcaccugcagccucuucuuacuccccauuga

SEQ ID NO: 71977 - RNA, 61 nt, Homo Sapiens
uuguuggugucagggaggcuuacuggagccacaccugcaggcgcuguguucaggcaccacc

SEQ ID NO: 71978 - RNA, 61 nt, Homo Sapiens
ugucagcccagaugacuccucacccauccaccaccugcagcuugagauguuaacuauuaga

SEQ ID NO: 71979 - RNA, 61 nt, Homo Sapiens
gaagacgagagauagugggugugguggcucacaccugcaaucccagcacuuuggaaggccg

SEQ ID NO: 71980 - RNA, 61 nt, Homo Sapiens
gacugcuggggacccucgccuucccuccucucaccugcaggcugauccuucuuuucacuuu

SEQ ID NO: 71981 - RNA, 61 nt, Homo Sapiens
uacaccccgacccuccuccugucagcccccucaccugcagccuguugcccaauaaauuuaa

SEQ ID NO: 71982 - RNA, 61 nt, Homo Sapiens
ugcugacccuaggauuuuccuucccugcccucaccugcaaaugaguuaaagaagaggcgug

SEQ ID NO: 71983 - RNA, 61 nt, Homo Sapiens
ccgucccucuccccggacaaaccccugcacacaccugcacagcacgugcacacaccugcac

SEQ ID NO: 71984 - RNA, 61 nt, Homo Sapiens
ccccugcacacaccugcacagcacgugcacacaccugcacaugcccuagcaguuugccucu

SEQ ID NO: 71985 - RNA, 61 nt, Homo Sapiens
aacgcucaacuugguugcgguaccaucagcccaccugcauuuggcuuucgacuugcuuguu

SEQ ID NO: 71986 - RNA, 61 nt, Homo Sapiens
uuuagauccaugccauucacugacucacuaacaccugcaaaaucuuuaaggaaaaaagcug

SEQ ID NO: 71987 - RNA, 61 nt, Homo Sapiens
uuggguggggcuccugggaggugcaggucuccaccugcacaacuugcccugagcacuccug

SEQ ID NO: 71988 - RNA, 61 nt, Homo Sapiens
ggcugcccucuggggccacucagccagguggcaccugcagcgagagacauggaaagggaga

SEQ ID NO: 71989 - RNA, 64 nt, Homo Sapiens
cacugggggucuuccuccaccucccacuuuccaagggcuccaggaaucuggggccugaccacag

SEQ ID NO: 71990 - RNA, 64 nt, Homo Sapiens
agcaguacccaggcuuugcagaccacgcggggcagggcuccacugaagccacccccaccccucg

SEQ ID NO: 71991 - RNA, 64 nt, Homo Sapiens
cuaggggagcaccgugauggagaggacagagcaggggcuccagcaccuucuuucuggacuggcg

SEQ ID NO: 71992 - RNA, 64 nt, Homo Sapiens
ucuggacuggcguucaccucccugcucagugcuugggcuccacgggcaggggucagagcacucc

SEQ ID NO: 71993 - RNA, 64 nt, Homo Sapiens
uaugcauaugcaccaaaaaaccgagaggcccucugggcuccacuggggccggggacccagugag

SEQ ID NO: 71994 - RNA, 64 nt, Homo Sapiens
uccuguuuccagcuccccucgcugaaaggcagaggggcuccagggccuggcagccaugaagcag

SEQ ID NO: 71995 - RNA, 64 nt, Homo Sapiens
agccuggcuccggacucucggcucagacuuagcugggcuccagcaccagggucccugucuggga

SEQ ID NO: 71996 - RNA, 64 nt, Homo Sapiens
uuuugugcauuuccagaccaaaguuguucauuuggggcuccaguauuuggggauucacugcaug

SEQ ID NO: 71997 - RNA, 64 nt, Homo Sapiens
acucuucuuggugggggcuccuagcuguggcugggggcuccaggcgccccugugauuaccuccu

SEQ ID NO: 71998 - RNA, 64 nt, Homo Sapiens
agauucaauuccuguaacccaagacugagucuuagggcuccagucuccaccugcuugguuuccu

SEQ ID NO: 71999 - RNA, 64 nt, Homo Sapiens
gauaucggaugucguuuaaccugggcucgugguagggcuccagcauuucucccuccuuccuggu

SEQ ID NO: 72000 - RNA, 64 nt, Homo Sapiens
ggaugggggaggagcaugucggguggggguaggugggcuccacaguagguuucccagggaaggg

SEQ ID NO: 72001 - RNA, 64 nt, Homo Sapiens
caucucaugaggggagaggagccggggccuuaucgggcuccagcagccacagugggaugaacca

SEQ ID NO: 72002 - RNA, 64 nt, Homo Sapiens
agugcugggauuacaggcauaauuaucccagcuugggcuccaaauuaaacuccugggcuccagc

SEQ ID NO: 72003 - RNA, 64 nt, Homo Sapiens
aauuaucccagcuugggcucggucuuaaacuccugggcuccagcguucccuauguugcccagcu

SEQ ID NO: 72004 - RNA, 64 nt, Homo Sapiens
agauguucuagcugagagggccuggcccuggggugggcuccaggaaaacgcugguuaggccugg

SEQ ID NO: 72005 - RNA, 64 nt, Homo Sapiens
gcugcucggccucccugcagcucagcgcagcccagggcuccaagugaggcccagaagcccaugg

SEQ ID NO: 72006 - RNA, 64 nt, Homo Sapiens
gcaugcccagugauccugguucccuggcuuguaggggcuccagagccugcuuccugguuccuca

SEQ ID NO: 72007 - RNA, 64 nt, Homo Sapiens
aaauugcaaaaacccaucuucauuccuuuuuauggggcuccaggucauaaggaugagauauauu

SEQ ID NO: 72008 - RNA, 64 nt, Homo Sapiens
cccuugucagccgcagccuccacagccuccuugugggcuccagcagugcucugggagcgggcuc

SEQ ID NO: 72009 - RNA, 64 nt, Homo Sapiens
gccuccuugugggcuccagcagugcucugggagcgggcuccacaggaagugugucugaacucgg

SEQ ID NO: 72010 - RNA, 64 nt, Homo Sapiens
cucuuggaagggguaacagugaaccgcccuccaugggcuccacaucuuuuccuuuggcuuccaa

SEQ ID NO: 72011 - RNA, 64 nt, Homo Sapiens
uuuaaagaaaggagaaagccauuggaaaaaugaugggcuccauuaaggagacuaaugaaucugg

SEQ ID NO: 72012 - RNA, 64 nt, Homo Sapiens
ggcgccauuccgaggccgggccuucuucugacacgggcuccaaccccaccugaccaagcccggg

SEQ ID NO: 72013 - RNA, 64 nt, Homo Sapiens
accugucagagucuggggacucggcgugcagggcgggcuccaagcgcuuugcuuccggaacucc

SEQ ID NO: 72014 - RNA, 64 nt, Homo Sapiens
gucucaccugcgguggggugucggcucugccugggggcuccaucccuuucagccacucguggcc

SEQ ID NO: 72015 - RNA, 64 nt, Homo Sapiens
uuuaccugaggagcucuguccugcucccuguggagggcuccagauagcucagaaaugaccagcc

SEQ ID NO: 72016 - RNA, 64 nt, Homo Sapiens
aggugggcaggggaggucuggggcggcacaggcugggcuccagccccccaggccucuccucaga

SEQ ID NO: 72017 - RNA, 64 nt, Homo Sapiens
ggcucuaggcagacccugcggaccgccuggccgggggcuccaaggggccggggcgcccaccggg

SEQ ID NO: 72018 - RNA, 64 nt, Homo Sapiens
aacuaggcgguccugggauggggcauguggccaagggcuccagggccagggugugagggauggg

SEQ ID NO: 72019 - RNA, 64 nt, Homo Sapiens
cuggguggggcagggccuggccugguccaggcuugggcuccauucccaucacugcugucccucc

SEQ ID NO: 72020 - RNA, 64 nt, Homo Sapiens
agccucauccagccucagagcgugagcaccaccagggcuccaggcucucccugccucacuccuc

SEQ ID NO: 72021 - RNA, 64 nt, Homo Sapiens
cugggucugaggccccugccggaauugcgcucaggggcuccauguucccagaccaugggaaaug

SEQ ID NO: 72022 - RNA, 64 nt, Homo Sapiens
ucuauaaaccagugacuucuugcacagcccuacugggcuccacccuggccucgaagcccugggc

SEQ ID NO: 72023 - RNA, 64 nt, Homo Sapiens
guucuucaggcgacaggagagggggaagaacuaggggcuccauuccccucagcaagggugcaaa

SEQ ID NO: 72024 - RNA, 64 nt, Homo Sapiens
gcccacacagcacaacgucuuaccgugccuauuaccaagcgaguguuuguaaccauguaguuuu

SEQ ID NO: 72025 - RNA, 64 nt, Homo Sapiens
gcuccucugcuugggauucugggcuccucuggucccaagcgaaggguggacucagggaggccca

SEQ ID NO: 72026 - RNA, 64 nt, Homo Sapiens
gugaaaaauaucauuuucacaguugugucuuaugccaagcgaaaaagagaucagggagggcuaa

SEQ ID NO: 72027 - RNA, 64 nt, Homo Sapiens
cucucuacuggcacaaacuuacaucugccucaccccaagcgaggcucgacucuuucaaagcuuc

SEQ ID NO: 72028 - RNA, 64 nt, Homo Sapiens
ccuccugcuucaggaaagaaagcaaagcaaugcuccaagcgaggguuugguuaaguaauuuagg

SEQ ID NO: 72029 - RNA, 64 nt, Homo Sapiens
ugccacaucucacacucuaagcagugccacggcaccaagcgagcgcccauguuggccuuuuaca

SEQ ID NO: 72030 - RNA, 64 nt, Homo Sapiens
aaaaaaaaugcacugugacacguucuauauugugccaagcgaaaauuucauugacugaacugca

SEQ ID NO: 72031 - RNA, 64 nt, Homo Sapiens
agcuuccccggccgggagaccaguguuagaggauccaagcgaccuaaacagcugcuuuaugaaa

SEQ ID NO: 72032 - RNA, 64 nt, Homo Sapiens
uggaggaauacauuauuuuaucguauauuuuuguccaagcgaugagcugacggugguauugcuu

SEQ ID NO: 72033 - RNA, 64 nt, Homo Sapiens
cugcuaaagacagugcggaugcaagagcaccuggccaagcgagagcagcuggguaagcgccacc

SEQ ID NO: 72034 - RNA, 64 nt, Homo Sapiens
cagaucccacuaaagugucaagguguggaagggaccaagcgaccaaggaugggccaucuggggu

SEQ ID NO: 72035 - RNA, 64 nt, Homo Sapiens
gcagccgaggcgcaggccgagugggccgccaggaccaagcgagguggaccccgaaacggacggc

SEQ ID NO: 72036 - RNA, 64 nt, Homo Sapiens
aaaagucuuuaccaauaauauuuagagcuagucuccaagcgacgaaaaaaauguuuuaauauuu

SEQ ID NO: 72037 - RNA, 64 nt, Homo Sapiens
gcccuauugaggagaaggacugauggcagaacccccaagcgaauggaaggccaauuccuuacaa

SEQ ID NO: 72038 - RNA, 64 nt, Homo Sapiens
gcguuggugucugucauuaggcuggccgggcuccccaagcgaagagggcaucccggagcaggag

SEQ ID NO: 72039 - RNA, 61 nt, Homo Sapiens
uuaagcccugcgucaugugaacggaaagaggccaagcgauggccgcucucuccucuccccu

SEQ ID NO: 72040 - RNA, 64 nt, Homo Sapiens
ccaaaugcgccccuucaccucgcucucuuuucucccaagcgaaaacugcgccagccuccccgcc

SEQ ID NO: 72041 - RNA, 64 nt, Homo Sapiens
ucucaggugcaaagcaaaagaaugacgucuguggccaagcgaggagugcccagggaguccagcg

SEQ ID NO: 72042 - RNA, 64 nt, Homo Sapiens
aaucuuggcucacugcaaccuccaccucccagguccaagcgauucucuugccucagccucccaa

SEQ ID NO: 72043 - RNA, 64 nt, Homo Sapiens
gauuauggcucauugcagccucgacuucucggggccaagcgauccuccugccucagccuucuga

SEQ ID NO: 72044 - RNA, 64 nt, Homo Sapiens
gaggauucgcuugggaacggcgcacugggcugggccaagcgacucacgcaugugugugugugca

SEQ ID NO: 72045 - RNA, 64 nt, Homo Sapiens
ucugugagcaucaaccccacgaaacaucugaaugccaagcgaagaguagagaugggcucgugcu

SEQ ID NO: 72046 - RNA, 64 nt, Homo Sapiens
ucaaauauuuuuuuaaaacugaauugcaauugugccaagcgaauauaaugaauugaauuaaguu

SEQ ID NO: 72047 - RNA, 64 nt, Homo Sapiens
aaucucugcucacugcaacaucugccucccagguccaagcgauucuccugccucagccucccgu

SEQ ID NO: 72048 - RNA, 64 nt, Homo Sapiens
cuuggagcuuugacaaggaauucccuuggaucagccaagcgaaaaacugcggcuaagucucuuu

SEQ ID NO: 72049 - RNA, 64 nt, Homo Sapiens
cugaggacuccgaucgcgauacccgccgccgccgccaagcgaggcacugcggucccgcuuagcg

SEQ ID NO: 72050 - RNA, 64 nt, Homo Sapiens
ucaacagagaaggcaggaaugcauguaggagaauccaagcgaggcucuggcuggcuaacuggaa

SEQ ID NO: 72051 - RNA, 64 nt, Homo Sapiens
uggcgggcuccacguuagccggggccucugagugccaagcgacgacgugagccaacaagaagca

SEQ ID NO: 72052 - RNA, 64 nt, Homo Sapiens
uccccuccuucaacucuccccagaaauagcccaaccaagcgaguggauguccccaccacuccug

SEQ ID NO: 72053 - RNA, 64 nt, Homo Sapiens
uuuaauuauaagguaguaccuuaaaggauucuuuccaagcgagauuuguaccucagaguauuuu

SEQ ID NO: 72054 - RNA, 64 nt, Homo Sapiens
cuguaguuuucccagauuuucucuggcuuacccuccaagcgacuguguaccaagggcaaggacc

SEQ ID NO: 72055 - RNA, 64 nt, Homo Sapiens
ggcagcccaccaccguauaugagcacgaacuagaccaagcgaagaaaacgguggcagguuuggc

SEQ ID NO: 72056 - RNA, 64 nt, Homo Sapiens
aaaccugcaggggguuuggaagccaccguccuagccaagcgagcaccacaaagggaccuaccug

SEQ ID NO: 72057 - RNA, 64 nt, Homo Sapiens
uacguagguuuaagacuagucccuuggauaagccccaagcgaauuugucuucagauuauuaaaa

SEQ ID NO: 72058 - RNA, 64 nt, Homo Sapiens
ccgagauccugccacugcacuccagccugggcaaccaagcgagacucugccuuaaaaaaaaaaa

SEQ ID NO: 72059 - RNA, 64 nt, Homo Sapiens
cagcccucucuuggacuagacagcucacugaacuccaagcgagcgucacacugggacaggcgug

SEQ ID NO: 72060 - RNA, 64 nt, Homo Sapiens
cccauuggccuuagcccaagacuuggagucgaccccaagcgacagagugaccagaaacccuuuu

SEQ ID NO: 72061 - RNA, 64 nt, Homo Sapiens
cccaggggugaauuggauucuccuggggugugugccaagcgaaaagcugugugcaucgacguuc

SEQ ID NO: 72062 - RNA, 64 nt, Homo Sapiens
agcuguuaacucuaaaauguacuugggagauaggccaagcgagaggucaugggccaacuaagug

SEQ ID NO: 72063 - RNA, 64 nt, Homo Sapiens
cagagcacuacagagccucugaaagaccauagcaccaagcgagccccuucagauucccccacug

SEQ ID NO: 72064 - RNA, 64 nt, Homo Sapiens
auaagucaguacuuggguuguguaaucugcuaguccaagcgaacagcaaccuccugcuacccuc

SEQ ID NO: 72065 - RNA, 64 nt, Homo Sapiens
cgggagaggggagagggacgcacagcacugccugccaagcgagaaugcaggccccgcccccucg

SEQ ID NO: 72066 - RNA, 64 nt, Homo Sapiens
ggggagacacaguggacugaagcaugggccugucccaagcgagaaucugaagguugcacuggcc

SEQ ID NO: 72067 - RNA, 64 nt, Homo Sapiens
aaaugcuaucuugugguuuugcuuuuagcauccuaaugaguauguugcuauuaucugucuuuuu

SEQ ID NO: 72068 - RNA, 64 nt, Homo Sapiens
ccauuccuaggugucaucaguaaggaggauuaggaaugaguauuuauuuccuggcaaucacggg

SEQ ID NO: 72069 - RNA, 64 nt, Homo Sapiens
cagaauaaaccaagugauaauaaaugaaaagguaaaugaguaaugaauugucaguuuagauuca

SEQ ID NO: 72070 - RNA, 64 nt, Homo Sapiens
ugugucucaucgguuaauagccagaguuacagagaaugaguagauuuaaagcaagaugcgaugu

SEQ ID NO: 72071 - RNA, 64 nt, Homo Sapiens
uccuuucuccauaagugcaguagacaaaaguauuaaugaguauuccgagaagcaagcacaaaag

SEQ ID NO: 72072 - RNA, 51 nt, Homo Sapiens
agaaaaagcacauauacuagaaaugaguaacugaacaagaaagcacaauaa

SEQ ID NO: 72073 - RNA, 64 nt, Homo Sapiens
uuugcaguucaugguaaaaugcauuuucaaaccaaaugaguacuuauauauggaucucuguaga

SEQ ID NO: 72074 - RNA, 64 nt, Homo Sapiens
uuucugagaaugaaauggacgauuacacuuagaaaaugaguaauaguguuuaauaagucaguga

SEQ ID NO: 72075 - RNA, 64 nt, Homo Sapiens
gagcucaacuuuuauuccuaucuuuagaauuuuaaaugaguagagaacuggaauuuuucagcau

SEQ ID NO: 72076 - RNA, 64 nt, Homo Sapiens
aucuuguuuuguuuuaucacuuuguuaccuaaauaaugaguaggccuucuaccugguguuuacu

SEQ ID NO: 72077 - RNA, 64 nt, Homo Sapiens
aguuguugagcgagaaccccuucauuugaaaagaaaugaguaugcuacuauagggagaguuguu

SEQ ID NO: 72078 - RNA, 64 nt, Homo Sapiens
uaguacuuaccugguaggauuauggugaguauuaaaugaguaaauggaaacagcuuagaauagu

SEQ ID NO: 72079 - RNA, 64 nt, Homo Sapiens
aucuacuuaguuagccuuaguauuuguguguucuaaugaguaacaucucaggaaaaucugugau

SEQ ID NO: 72080 - RNA, 64 nt, Homo Sapiens
aacuugagaucuguauaaauaucuuuuuaaaacuaaugaguauguaccugccauccaguuuugg

SEQ ID NO: 72081 - RNA, 64 nt, Homo Sapiens
auaggcagucugcaucuucagauuucagagauuaaaugaguauucaguuuuauuuuuaguaaag

SEQ ID NO: 72082 - RNA, 64 nt, Homo Sapiens
uacaggacugaacuccuauacacguguacuguagaaugaguauuuuuuaauaccuuaagguagg

SEQ ID NO: 72083 - RNA, 64 nt, Homo Sapiens
uuuauccccaggaaucaauaauuuuuuugccuaggugccugacuccuuucagauucccucuuua

SEQ ID NO: 72084 - RNA, 64 nt, Homo Sapiens
uccaagccuuuucugggagcaaagccagggccuggugccugauuuucugaagccaggagcccuc

SEQ ID NO: 72085 - RNA, 64 nt, Homo Sapiens
cccaaagcuagagcuucuagagucucuuacugaagugccugaaauacauaggaacaagggggaa

SEQ ID NO: 72086 - RNA, 64 nt, Homo Sapiens
uuccuggggaaacauggcuuacaaaggaaaacaggugccugaaugucauaagccaggaaaugaa

SEQ ID NO: 72087 - RNA, 64 nt, Homo Sapiens
aaaaccugugguccgcccagaagagauuccuccagugccugagaaccgauuuuuacugagaaga

SEQ ID NO: 72088 - RNA, 64 nt, Homo Sapiens
auccagugcuguggaaguuaagguguugaccacugugccugaaaugaaaccacaaggcuugaga

SEQ ID NO: 72089 - RNA, 64 nt, Homo Sapiens
gccccaccccaccaugguagccuuagggugcugagugccugauacugccugacaagugccugac

SEQ ID NO: 72090 - RNA, 64 nt, Homo Sapiens
cuuagggugcugagugccugauacugccugacaagugccugacacgcagccuaguuccuuccug

SEQ ID NO: 72091 - RNA, 64 nt, Homo Sapiens
aacaagccuucccguccuugccccauaccacguugugccugaagaagaaaaccagguuucuucu

SEQ ID NO: 72092 - RNA, 64 nt, Homo Sapiens
aaaugagauuuuauuaucccacauggauccucuggugccugaaggagagaaucaaagccuuguc

SEQ ID NO: 72093 - RNA, 64 nt, Homo Sapiens
aauaauuggauuuaauuuuuuuuaacauugaaaagugccugaaaaaugguaaauucuuaaaugu

SEQ ID NO: 72094 - RNA, 64 nt, Homo Sapiens
ucccaaaguguugggauuacaggugugugucacugugccugacagcugacaguuuuaacugaca

SEQ ID NO: 72095 - RNA, 64 nt, Homo Sapiens
uguccuuccuccuuccuccccggauuggcuugcugugccugacggaugggcuguagaauggggu

SEQ ID NO: 72096 - RNA, 64 nt, Homo Sapiens
aaccucgaaacgaacaguuaaauugaaaugcuaugugccugacccaaugguaggcacauaguag

SEQ ID NO: 72097 - RNA, 64 nt, Homo Sapiens
gagaaggugccccuucaggcaccuaggggagagcgugccugacaacccagagagauucgacagu

SEQ ID NO: 72098 - RNA, 64 nt, Homo Sapiens
cugcccugcacucacaggagccaauggggucacggugccugaagagggccugacacuucacaga

SEQ ID NO: 72099 - RNA, 64 nt, Homo Sapiens
agaaaaauuucuauucuuuuuuuugcauccaauugugccugaacuuuuaaaauauguaaaugcu

SEQ ID NO: 72100 - RNA, 64 nt, Homo Sapiens
gcacccuagaaacaacauauugucccaugagcaggugccugagacacagaccccuuugcauuca

SEQ ID NO: 72101 - RNA, 64 nt, Homo Sapiens
gcacccagguggccgcguugggcugucagccaaggugccugaaacgauacgugugcccacucca

SEQ ID NO: 72102 - RNA, 64 nt, Homo Sapiens
gaaacgauacgugugcccacuccacugucacagugugccugaggaaggcugcuagggauguuag

SEQ ID NO: 72103 - RNA, 64 nt, Homo Sapiens
cccucagacagcccccugccgccccugcuggcuggugccugagcccccucgcccaucagugcca

SEQ ID NO: 72104 - RNA, 64 nt, Homo Sapiens
accccagaugugagggcaccggcaggcauggcuggugccugaagcuguccugacagcacuccuc

SEQ ID NO: 72105 - RNA, 64 nt, Homo Sapiens
agggugggugauugaugaguugucaaaaugauaggugccugagggcagacucgggcugucuagg

SEQ ID NO: 72106 - RNA, 64 nt, Homo Sapiens
auauguaaaccagggacaggacccaccuuguguagugccugacccaaagccuggcccugcacac

SEQ ID NO: 72107 - RNA, 64 nt, Homo Sapiens
uggcugugcccgaugugcacuaaaacuccccaaggugccugagaugacaugaagcucccagaga

SEQ ID NO: 72108 - RNA, 64 nt, Homo Sapiens
uggccgugcccgaugugcacugaaacuccccaaggugccugaaagcugccaaaagucucagaga

SEQ ID NO: 72109 - RNA, 64 nt, Homo Sapiens
ugaaacuuccugagaugaaaugaagcuuccaaaggugccugagaagagaugaaagucccugaga

SEQ ID NO: 72110 - RNA, 64 nt, Homo Sapiens
uuccuccagccugugcgcaccugcccuccuugcagcccagcacaccugcagguguaagggacga

SEQ ID NO: 72111 - RNA, 64 nt, Homo Sapiens
acaccucucccaaaaagcagcccacaaggcaggggcccagcagcccagccaucacucaucuuug

SEQ ID NO: 72112 - RNA, 64 nt, Homo Sapiens
ccaaguagcugggaugacaggcgcacaccaccacgcccagcaaauuuuuuguauuuuuaguaga

SEQ ID NO: 72113 - RNA, 64 nt, Homo Sapiens
cuuucaggcucuuagaagccauagauuuggacaagcccagcaagauggguguccuuccaggccu

SEQ ID NO: 72114 - RNA, 64 nt, Homo Sapiens
gucaucacugaucuaagcaguggcaucugagugggcccagcacauggccauagaggcccaggca

SEQ ID NO: 72115 - RNA, 64 nt, Homo Sapiens
cuugaugccagagggccagcaggcuccuggcugugcccagcaggcccagcaugcaggugguggg

SEQ ID NO: 72116 - RNA, 64 nt, Homo Sapiens
agagggccagcaggcuccuggcugugcccagcaggcccagcaugcagguggugggacacugggc

SEQ ID NO: 72117 - RNA, 64 nt, Homo Sapiens
ccagcagccugccuauggcuccagcugugcuguggcccagcagcauggccugcaucuggaagga

SEQ ID NO: 72118 - RNA, 64 nt, Homo Sapiens
gcauaucugugagcagcuguucccuguagccacugcccagcaccuccucaggccagccuggugc

SEQ ID NO: 72119 - RNA, 64 nt, Homo Sapiens
uuccgucaacguuguacuguguuucugugggcgggcccagcacugcccguguacauagugcauu

SEQ ID NO: 72120 - RNA, 64 nt, Homo Sapiens
uggguaauuuagauuguaaacggugugccugacugcccagcauuccacgaccuaggcaguaggc

SEQ ID NO: 72121 - RNA, 64 nt, Homo Sapiens
uucugcauuccaaacagcauguaguuccauucuugcccagcacugaguugagaaagcagcccca

SEQ ID NO: 72122 - RNA, 64 nt, Homo Sapiens
cuguggagacaacccacacugcaugugagcaucugcccagcaaccagagucaggagaccccaag

SEQ ID NO: 72123 - RNA, 64 nt, Homo Sapiens
gugucccuccucuuccuguagugccccucccauggcccagcagcuuggcugagcccccucuccu

SEQ ID NO: 72124 - RNA, 64 nt, Homo Sapiens
auuccuuagcagcucaggcgcagcccuagugggagcccagcacacugcuucucggaggccaggc

SEQ ID NO: 72125 - RNA, 64 nt, Homo Sapiens
caaccgccccgucugauaaguaaggagccccucugcccagcagccgccccgucugagaagugag

SEQ ID NO: 72126 - RNA, 64 nt, Homo Sapiens
cagccgccccgucugagaagugaggagccccucugcccagcagccacccugucugggaagugag

SEQ ID NO: 72127 - RNA, 64 nt, Homo Sapiens
cugccagcaguuacugugaacucuccuggagggcgcccagcagcccggcucggcccagcacccc

SEQ ID NO: 72128 - RNA, 64 nt, Homo Sapiens
cccucuccuggagggcgcccgccagcccggcucggcccagcacccgaaggccgacaccacuccu

SEQ ID NO: 72129 - RNA, 64 nt, Homo Sapiens
ucccgaaggccgacaccacuccaaacccuuagcagcccagcauugcacucccgggaugggugga

SEQ ID NO: 72130 - RNA, 64 nt, Homo Sapiens
agcugcuucagccgagagggccugugaucgccuggcccagcaggagccccucugcccagcaugc

SEQ ID NO: 72131 - RNA, 64 nt, Homo Sapiens
cccugugaucgccuggcccagccagagccccucugcccagcaugcaggugggaagaugaagccg

SEQ ID NO: 72132 - RNA, 64 nt, Homo Sapiens
augucaauuuuagcacucuccaggcacaaggacagcccagcaccagcuuuacagggcaguguuu

SEQ ID NO: 72133 - RNA, 64 nt, Homo Sapiens
auguguagcuggcgaggaauuacuuccacuucuggcccagcacaagcccugcuuuggccaccug

SEQ ID NO: 72134 - RNA, 64 nt, Homo Sapiens
ggagagcacacugauagaaauccuuguguccagugcccagcaacuccugccucagccucccgag

SEQ ID NO: 72135 - RNA, 64 nt, Homo Sapiens
ccaaagugcugggauuacaggcgugagccacugcgcccagcauguuagacaauuuuuaauucau

SEQ ID NO: 72136 - RNA, 64 nt, Homo Sapiens
cacccagcaggagaggcuccugguguagugggcagcccagcacuucccgcugcugccugccugu

SEQ ID NO: 72137 - RNA, 64 nt, Homo Sapiens
cgacgugggcggugggccccagccccacagaccagcccagcauucagguuaguucuacuucuuc

SEQ ID NO: 72138 - RNA, 64 nt, Homo Sapiens
ccuucgugaauccugcacugagacccaccacacagcccagcagcgccacagcagagccaaucac

SEQ ID NO: 72139 - RNA, 64 nt, Homo Sapiens
accuccugcacugcacuucuucugugagcucccugcccagcaccgcccucccucugcccucccg

SEQ ID NO: 72140 - RNA, 64 nt, Homo Sapiens
ccacauguguucaggacccuaccccggcccagcagcccagcagccugcuaguuacaguguaggc

SEQ ID NO: 72141 - RNA, 64 nt, Homo Sapiens
ccagcagcccacauguguucguguaggcaccccggcccagcagcgcacuaugcugcuaguuaca

SEQ ID NO: 72142 - RNA, 64 nt, Homo Sapiens
uuccuauggaagucuagcaaagcaauacgacucagcccagcacucucugccccaggacucaugg

SEQ ID NO: 72143 - RNA, 64 nt, Homo Sapiens
gaacauugucacuguuuucacugucaugcagggagcccagcacuguggccaggauggcagagac

SEQ ID NO: 72144 - RNA, 64 nt, Homo Sapiens
aaggagacacucaguuucacaagugagcccucuugcccagcacacaccuauggcuggcugggca

SEQ ID NO: 72145 - RNA, 64 nt, Homo Sapiens
agagguucaaaggcagcaaggcagugagcuaugagcccagcauggaugugucucaggcaccuca

SEQ ID NO: 72146 - RNA, 64 nt, Homo Sapiens
uaacaaaaacagcuucaacugauuucugguuguggcccagcaauuguuucucucccaucauccg

SEQ ID NO: 72147 - RNA, 64 nt, Homo Sapiens
acccugcuggaagaacugacccuuuugacagaaagcccagcacgcucgcucuuugcugagagcc

SEQ ID NO: 72148 - RNA, 64 nt, Homo Sapiens
gaggagagucgccgcagaugcagcuggagcugcugcccagcacagcacugugcaggacguggac

SEQ ID NO: 72149 - RNA, 64 nt, Homo Sapiens
cagaccuuugugccccuguggugguacccguagugcccagcauccugguucuuuccauccucuu

SEQ ID NO: 72150 - RNA, 64 nt, Homo Sapiens
ugcacugcccucacccucagccgucccaaggagugcccagcacuacucagcauguaguccagga

SEQ ID NO: 72151 - RNA, 64 nt, Homo Sapiens
cacaggccucuggaaucagaaucuucaggguggggcccagcagucuguguuuuaacagguucuc

SEQ ID NO: 72152 - RNA, 64 nt, Homo Sapiens
aacaguuuuaguggccugucgggugggugauggugcccagcaccagugucuuugauggugguga

SEQ ID NO: 72153 - RNA, 50 nt, Homo Sapiens
cuggggauccagcggauggagcccagcaucuaaacccagcugacacuuga

SEQ ID NO: 72154 - RNA, 64 nt, Homo Sapiens
uacccuggggccccagggagcaggacgcuccggggcccagcacguugcccugggccuguggccg

SEQ ID NO: 72155 - RNA, 64 nt, Homo Sapiens
gggccccaccuucaggucuuagugguucacaagagcccagcagccaggcuggcuuuuucauugu

SEQ ID NO: 72156 - RNA, 64 nt, Homo Sapiens
uaaaaaaaauuacaauaacaugaagaauuaccaagcccagcaaggucauagcuuucauguccau

SEQ ID NO: 72157 - RNA, 64 nt, Homo Sapiens
cgcaggcauaucucaacggagcucuugcccucuugcccagcagcucaagugaggguccaggaaa

SEQ ID NO: 72158 - RNA, 64 nt, Homo Sapiens
uaaacaguugaguuucuucuaaagaggaagccuugcccagcaaggaccagugagacagccggau

SEQ ID NO: 72159 - RNA, 64 nt, Homo Sapiens
ccggccggagaacaucugccuugcugcaccugaggcccagcagagccguuccugggacugucag

SEQ ID NO: 72160 - RNA, 64 nt, Homo Sapiens
agucaggcuaagaaacgccagcagggugggcugugcccagcaggaccuccagucacugugccca

SEQ ID NO: 72161 - RNA, 64 nt, Homo Sapiens
gugggcugugcccagcaggaccuccagucacugugcccagcaggagggacugugcagccuggaa

SEQ ID NO: 72162 - RNA, 64 nt, Homo Sapiens
cggauucuccuggacaccauuccuggagcuuugugcccagcacuucaaaccugcccucggacgc

SEQ ID NO: 72163 - RNA, 64 nt, Homo Sapiens
ugacugguucuucaggaacuuccgaggcacuguggcccagcagggcuggaugugcugcaggagc

SEQ ID NO: 72164 - RNA, 64 nt, Homo Sapiens
cagggguggcuucugucugugacagcaggcuggagcccagcauuccgagucaugcacucaggca

SEQ ID NO: 72165 - RNA, 64 nt, Homo Sapiens
cuucugacaagcaagggcuggaagccaaacaaaggcccagcagccaccaaagucagggagccug

SEQ ID NO: 72166 - RNA, 64 nt, Homo Sapiens
aagguggggccagugcuggggggagccugacagugcccagcaugcugccucuuccagggccucu

SEQ ID NO: 72167 - RNA, 64 nt, Homo Sapiens
ucuuccuccuuuguagaugcauccugggaucugggcccagcaucucuuauucaccauguccaag

SEQ ID NO: 72168 - RNA, 64 nt, Homo Sapiens
agcugagccaggcagagggggagggaggggagaagcccagcagagggugggggagagaggaaag

SEQ ID NO: 72169 - RNA, 64 nt, Homo Sapiens
cccaggcccugggggaccuggcccgcuccugcccgcccagcaccccaaguggcccccacccuca

SEQ ID NO: 72170 - RNA, 64 nt, Homo Sapiens
caaaggcaaugcucaaacacacaauguauugucugcccagcaaucuccccagaagacacaggaa

SEQ ID NO: 72171 - RNA, 64 nt, Homo Sapiens
ccagagaggccuguggcuaguuugcccugggggggcccagcacagccccagcccggagcccagc

SEQ ID NO: 72172 - RNA, 64 nt, Homo Sapiens
uaugugcuagagcccaggccagcucugagaccaagcccagcauugagaauaagcucuguucuaa

SEQ ID NO: 72173 - RNA, 64 nt, Homo Sapiens
ugguuacaguucucugacuuaagauugcucuaaggcccagcaugaggagaaaagcaggugcccu

SEQ ID NO: 72174 - RNA, 64 nt, Homo Sapiens
uagauucuggacuaacagacgggaucccuaacgugcccagcaugcaaaggcgccccuccccaga

SEQ ID NO: 72175 - RNA, 64 nt, Homo Sapiens
gggcugagcucugaggggugcugcuguggagggugcccagcaggacagcucacgaggcuuggac

SEQ ID NO: 72176 - RNA, 64 nt, Homo Sapiens
cguggugugagagggacagccugccauggagggugcccagcagaacgguucacaaggcuuggac

SEQ ID NO: 72177 - RNA, 64 nt, Homo Sapiens
cgugguaugagagggauggccugccguggagggugcccagcagaauggcucaugaggcuuggac

SEQ ID NO: 72178 - RNA, 64 nt, Homo Sapiens
cguggugugagagggacggcaccugguggagggugcccagcagagaacggcucacgagacuugg

SEQ ID NO: 72179 - RNA, 64 nt, Homo Sapiens
cguggugugagaggaacggccugcuguggagggugcccagcagaacggcucacgaggcuuggac

SEQ ID NO: 72180 - RNA, 64 nt, Homo Sapiens
agggacugaggccagacucacccagaagcuggccgcccagcagggacaggccaaucccuucccu

SEQ ID NO: 72181 - RNA, 64 nt, Homo Sapiens
ucagccugcucuucucucugcagcagugccccuggcccagcaccccugcagcuugugcucugcc

SEQ ID NO: 72182 - RNA, 64 nt, Homo Sapiens
gccccuggcccagcaccucagcagcuugugcucugcccagcaguuagcaaugcucccagguccu

SEQ ID NO: 72183 - RNA, 64 nt, Homo Sapiens; identical to SEQ ID NO: 55732

SEQ ID NO: 72184 - RNA, 64 nt, Homo Sapiens; identical to SEQ ID NO: 55733

SEQ ID NO: 72185 - RNA, 64 nt, Homo Sapiens; identical to SEQ ID NO: 55734

SEQ ID NO: 72186 - RNA, 64 nt, Homo Sapiens; identical to SEQ ID NO: 55735

SEQ ID NO: 72187 - RNA, 64 nt, Homo Sapiens; identical to SEQ ID NO: 55736

SEQ ID NO: 72188 - RNA, 64 nt, Homo Sapiens; identical to SEQ ID NO: 55737

SEQ ID NO: 72189 - RNA, 64 nt, Homo Sapiens
auguuguuuuaggggcuaaaguagauccagauccagacuguaaggcuaauguaggacuguauag

SEQ ID NO: 72190 - RNA, 64 nt, Homo Sapiens
ggccagugucauuuuauuuuuccuaaauauccaaagacuguacuugacuuucuccccauccccu

SEQ ID NO: 72191 - RNA, 64 nt, Homo Sapiens
uuuacacaauacacauggcuuaggacagacugaaagacuguaauuagccaggagagcaagcaca

SEQ ID NO: 72192 - RNA, 64 nt, Homo Sapiens
aacaucuucauugucaguucugaaaaggagacuaagacuguauaugcagaucugccuccaaggu

SEQ ID NO: 72193 - RNA, 64 nt, Homo Sapiens
cagauuuuauucucaccugggccauuugcagaugagacuguaguuugcagaugagacuguaguu

SEQ ID NO: 72194 - RNA, 64 nt, Homo Sapiens
ggccauuugcagaugagacuguaguuugcagaugagacuguaguuugcagauggcguggaagca

SEQ ID NO: 72195 - RNA, 64 nt, Homo Sapiens
aguuucggguguuuuucuccagucuuguuacuguagacuguagaaagcacgggccccaggcucu

SEQ ID NO: 72196 - RNA, 64 nt, Homo Sapiens
cuccuuuuucuugcuuugcgugcucaguuuuuacagacuguaaaggagauguguuguuugugaa

SEQ ID NO: 72197 - RNA, 64 nt, Homo Sapiens
gcccaugagauugaaggcacaaggcaaaauacuggagcacuaauacugcaaagugaauuuuaua

SEQ ID NO: 72198 - RNA, 64 nt, Homo Sapiens
gagagauugucaucaagaacggcagagguggauugagcacuaugcauccauaacaucuuaagcg

SEQ ID NO: 72199 - RNA, 64 nt, Homo Sapiens
gguggcacaggagcacugagccagggaauacugagagcacuaacuaugcacuaaccuagauuuu

SEQ ID NO: 72200 - RNA, 64 nt, Homo Sapiens
cccagcgcaguccugcucuccugugaccuguggagagcacuaaugaucacguguguugauggaa

SEQ ID NO: 72201 - RNA, 64 nt, Homo Sapiens
guagguuuaagagaauuuuuagccaugacuuuuggagcacuauuccauugucaguuauuaauaa

SEQ ID NO: 72202 - RNA, 64 nt, Homo Sapiens
ucgucuguguguggugugaccaauggugugcccagagcacuacucucaaaaucacuaguguuag

SEQ ID NO: 72203 - RNA, 64 nt, Homo Sapiens; identical to SEQ ID NO: 57588

SEQ ID NO: 72204 - RNA, 64 nt, Homo Sapiens; identical to SEQ ID NO: 57589

SEQ ID NO: 72205 - RNA, 64 nt, Homo Sapiens
cccauugccgacuugaauuuuuuuguaugaagucccuccugauuuugugugugugugucugugu

SEQ ID NO: 72206 - RNA, 64 nt, Homo Sapiens
uuuuuguuuuuuuaauuuaaauugaagguagcugccuccugaaagccagcauuaagccagaaca

SEQ ID NO: 72207 - RNA, 64 nt, Homo Sapiens
cgccuccuggguucaagggauucuccugucuuagccuccugaguagcugugauuacaggcaugc

SEQ ID NO: 72208 - RNA, 64 nt, Homo Sapiens
gucuuuuucaauaaaaagcacuguggauuucugcccuccugaugugcauauccguacuuccaug

SEQ ID NO: 72209 - RNA, 64 nt, Homo Sapiens
ccaugagguguuuucugugugcagaacauugucaccuccugaggcugugggccacagccaccuc

SEQ ID NO: 72210 - RNA, 64 nt, Homo Sapiens
caccuccuggguucaagcgauucuccugccucagccuccugaguagcugggauuacaggcacac

SEQ ID NO: 72211 - RNA, 64 nt, Homo Sapiens
caccauguuggccaggcuagucuugaauuccugaccuccugaccugcccaccucaaccucccaa

SEQ ID NO: 72212 - RNA, 64 nt, Homo Sapiens
ggcacuagguaggcuucuaccugcaggcggggcuccuccugaaggaggcggggcucuaggaugg

SEQ ID NO: 72213 - RNA, 64 nt, Homo Sapiens
cucuccgcgggugggacucuucccugggaaccgcccuccugauuaaggcguggcuucugcagga

SEQ ID NO: 72214 - RNA, 64 nt, Homo Sapiens
aaugguccgcuuuccuggagccaauggcccggccccuccugacucauccgccuggcccgggaau

SEQ ID NO: 72215 - RNA, 64 nt, Homo Sapiens
gccaagagcaucgugacccucgcugcagguacuuccuccugauggcagugccucgaggcaccgg

SEQ ID NO: 72216 - RNA, 64 nt, Homo Sapiens
aggcgaggagagugguuguucacaguggguggcaccuccugagaacuugcguccugcagaggac

SEQ ID NO: 72217 - RNA, 64 nt, Homo Sapiens
caccucccggauucaagcgauucuccugccucagccuccugaguagcuggaacuacaugcgcgu

SEQ ID NO: 72218 - RNA, 64 nt, Homo Sapiens
ccaaucccacaaucauggcucacugcagccaccaccuccugagcucaagugauccucccaucua

SEQ ID NO: 72219 - RNA, 64 nt, Homo Sapiens
gaccuccugggcucaggugauccucccaccucagccuccugaguagcuaggacuacagaugcuc

SEQ ID NO: 72220 - RNA, 64 nt, Homo Sapiens
accuccugggguucaagugauucuccugugucagccuccugaguagcugggauuacaggcgugu

SEQ ID NO: 72221 - RNA, 64 nt, Homo Sapiens
cugccuccuuaccucccacugccuccugaacccgccuccugaaccugagcucaccuccgaaccc

SEQ ID NO: 72222 - RNA, 64 nt, Homo Sapiens
ccgccuccugaaccugccuccaccuccgaacccgccuccugaacacagcaccagcaccugagcu

SEQ ID NO: 72223 - RNA, 64 nt, Homo Sapiens
ugccuaccggguucaagugauucuugugccucagccuccugaguagcugggauuauaggcaugc

SEQ ID NO: 72224 - RNA, 64 nt, Homo Sapiens
ugccuaccgaguucaagcgauucuugugcuucagccuccugaguagcugggacuauaggccugu

SEQ ID NO: 72225 - RNA, 64 nt, Homo Sapiens
ccugacuuuuuguguacauauuccuggcaaacggccuccugaacucuaccgacaaagacccuau

SEQ ID NO: 72226 - RNA, 64 nt, Homo Sapiens
cugaccuugcuagucugcccgucagagguuuuagccuccugaggucuaagaagacugcagcaag

SEQ ID NO: 72227 - RNA, 64 nt, Homo Sapiens
cgccuccuggguucaagcgauucuccagccucagccuccugaguagcuggaauuacagguacgc

SEQ ID NO: 72228 - RNA, 64 nt, Homo Sapiens
uguguccucagcuugucuggaggaggccugcaucccuccugagcucuuggaggugcccaggaac

SEQ ID NO: 72229 - RNA, 64 nt, Homo Sapiens
gaggggcaggagagcagugagggacagaggaaggccuccugaggagccagcagggaagaucugg

SEQ ID NO: 72230 - RNA, 64 nt, Homo Sapiens
auagccagagagcccaugaggacagccacccagcccuccugaagugauggcaccuauugagggu

SEQ ID NO: 72231 - RNA, 64 nt, Homo Sapiens
agcugggacuacaggcgcccuucuccugccucagccuccugaguugccucccgggcucacccca

SEQ ID NO: 72232 - RNA, 64 nt, Homo Sapiens
agcuggcauuauaggugcccuucuccugccucagccuccugaguugccucccagguucaagcag

SEQ ID NO: 72233 - RNA, 64 nt, Homo Sapiens
aggagggcgacugggggcccuggcccggcacuguccuccugaggggcaggcgccggcugcaaca

SEQ ID NO: 72234 - RNA, 64 nt, Homo Sapiens
gcaaccucugucucaagcgauucuccugccucagccuccugaguagcugggauuacaggugcau

SEQ ID NO: 72235 - RNA, 64 nt, Homo Sapiens
auuugacaaagacuugcuugucuugggccugucaccuccugaaaggcugcuuuagcuguggaug

SEQ ID NO: 72236 - RNA, 64 nt, Homo Sapiens
uccuagcaugcaguggaaagugcuuagcucucucccuccugaccucugggcagccagucaucaa

SEQ ID NO: 72237 - RNA, 64 nt, Homo Sapiens
caccuccuggguucaagcgcuucuccagccucagccuccugaguagcugggauuacagguaugu

SEQ ID NO: 72238 - RNA, 64 nt, Homo Sapiens
acgcuccuuacgucgagauguuggaccuugaagcccuccugaggccaacaugcaaaucuggcug

SEQ ID NO: 72239 - RNA, 64 nt, Homo Sapiens
uaccaaaccaggaaaacagcaccaucaaaccuuuccuccugacucaaaaagaaguggggaaaga

SEQ ID NO: 72240 - RNA, 64 nt, Homo Sapiens
ggcuugaggguuugccaacccaucuugcccucuaccuccugauaggccuuuaagacaaagcgcu

SEQ ID NO: 72241 - RNA, 64 nt, Homo Sapiens
gcucagcacggugaggccugccugcuauuuccagccuccugaaggcucaagcuuagaagccagc

SEQ ID NO: 72242 - RNA, 64 nt, Homo Sapiens
gggucccaaagccaauaugauagaggaccagaccccuccugacugcuguguguuuucugaaacc

SEQ ID NO: 72243 - RNA, 64 nt, Homo Sapiens
auaaaaccauggcagccuugucucugucuugacuccuccugagcucccgucauuuaucucucug

SEQ ID NO: 72244 - RNA, 64 nt, Homo Sapiens
acccaggcuuguggcccagguaucaccuucccuuccuccugagaguugaggccuguaaauacaa

SEQ ID NO: 72245 - RNA, 64 nt, Homo Sapiens
ggagagaaauccuccuggguacuccuggccagacccuccugaaucaucugcggcuuaaacucau

SEQ ID NO: 72246 - RNA, 64 nt, Homo Sapiens
gcugccuccacugaggcgggcacacaaggcggacccuccugaaacagccuccauuuucuucaaa

SEQ ID NO: 72247 - RNA, 64 nt, Homo Sapiens
aaaaagggagaaagaaaacuggggggguucucccccuccugauucagaaauggacaaagaaaac

SEQ ID NO: 72248 - RNA, 64 nt, Homo Sapiens
acgucucuucaagcauccucauuccgcgcggagaccuccugacaccugccucagcuaccuaaug

SEQ ID NO: 72249 - RNA, 64 nt, Homo Sapiens
cuacccucccucgcauccgccucugagccaggagccuccugacccugugaugccugacacaggg

SEQ ID NO: 72250 - RNA, 64 nt, Homo Sapiens
uccaggcuugggcuccauucccaucacugcugucccuccugaggucuggauuggggauggggac

SEQ ID NO: 72251 - RNA, 64 nt, Homo Sapiens
agcugggacuacaggcacaguccucccaucucagccuccugagugaacucccaggcucaagcga

SEQ ID NO: 72252 - RNA, 64 nt, Homo Sapiens
aacagaaagguguucauguggggcugccugggccccuccugaaguggucucaccugggugcuga

SEQ ID NO: 72253 - RNA, 64 nt, Homo Sapiens
gccuccugggguucaagugauccucccaccucagccuccugaguagcugggauuacaggcaccc

SEQ ID NO: 72254 - RNA, 64 nt, Homo Sapiens
ccguuccugucacauuuccccagccccaccuuccccuccugaugcccugaaagcuuccggaauu

SEQ ID NO: 72255 - RNA, 64 nt, Homo Sapiens
cgccucccggguucacgccauucuccugccucagccuccugaguagcugggacuacaggccccu

SEQ ID NO: 72256 - RNA, 64 nt, Homo Sapiens
caccacguuagccaggauggucucgaucuccugaccuccugaugcgccugccucagccucccag

SEQ ID NO: 72257 - RNA, 64 nt, Homo Sapiens
ugcugggauuacaggcguggucugcccgccucggccuccugaaggaacuccugaccucaagcga

SEQ ID NO: 72258 - RNA, 64 nt, Homo Sapiens
agcugggauuacagcacccguucuccugccucagccuccugagucgccuccuggguucaaguga

SEQ ID NO: 72259 - RNA, 64 nt, Homo Sapiens
agcugggacuacaggcgcccccauucugccucagccuccugagucucugccucccggguucaug

SEQ ID NO: 72260 - RNA, 64 nt, Homo Sapiens
agaugggacuacaggcacaguucuccugucucagccuccugagucgccuccuguguucaagcga

SEQ ID NO: 72261 - RNA, 64 nt, Homo Sapiens
cccguagccucauuucuuacugggacacacggguccuccugaguacauguccccaucagccugc

SEQ ID NO: 72262 - RNA, 64 nt, Homo Sapiens
cagcagcgaauggcaaugggagcuccuguggguaccuccugaagcuuggguugugugguuuggu

SEQ ID NO: 72263 - RNA, 64 nt, Homo Sapiens
agcugggcugacaggcacccuucucgugccucagccuccugaguuaccuccuggguucaaguga

SEQ ID NO: 72264 - RNA, 64 nt, Homo Sapiens
agcugggacuacaggcaugauccucccaccucagccuccugagugaacuccuggccuuaaguga

SEQ ID NO: 72265 - RNA, 64 nt, Homo Sapiens
agcugggauuacaggcauguuucuccugccucagccuccugagucgccuccaggguucaaguga

SEQ ID NO: 72266 - RNA, 64 nt, Homo Sapiens
acacaugaaccccuauaccagagguucucuacugccuccugaauccaacucccccagccuuguu

SEQ ID NO: 72267 - RNA, 64 nt, Homo Sapiens
gucgcacacacauuuggaaugcacacagcggcugccuccugauguuuguaucauagucguauug

SEQ ID NO: 72268 - RNA, 64 nt, Homo Sapiens
gcaguggcgcaaucucgccuuccugcagucuccgccuccugaguucaagcgauucuccugccuc

SEQ ID NO: 72269 - RNA, 64 nt, Homo Sapiens
aaagaagcagauuuuagaugaaaagaucuacugcccuccugaggcuucugugcuccuggcuucu

SEQ ID NO: 72270 - RNA, 64 nt, Homo Sapiens
uuaacagcccaugaacccaauuccagcaccguugccuccugacauaccaagcuucaaccucauu

SEQ ID NO: 72271 - RNA, 64 nt, Homo Sapiens
gugguggcacaaucucggcucacugcaaccuccaccuccugaguucaagcaauucuccugccuc

SEQ ID NO: 72272 - RNA, 64 nt, Homo Sapiens
ccagcugcucuaauaucgauuggggcucuuacucccuccugaggaacuuguguaccuucaggga

SEQ ID NO: 72273 - RNA, 64 nt, Homo Sapiens
ccaggaacgugcaaauuugcuucuguacuggaggccuccugaggagagcuucguugauggucuu

SEQ ID NO: 72274 - RNA, 64 nt, Homo Sapiens
augagauuaugggcuggcuccauuucuuggacuuaaaaugcauuauuaguuuaaaaaucuuucu

SEQ ID NO: 72275 - RNA, 64 nt, Homo Sapiens
aaccaggugcauaauugauugcccuuuggccauaaaaaugcagugucauggaucuuagagcuaa

SEQ ID NO: 72276 - RNA, 64 nt, Homo Sapiens
uauguacacauacauauauauaguugacacuugaaaaaugcaggugguaggggcacugacccac

SEQ ID NO: 72277 - RNA, 64 nt, Homo Sapiens
ugugauggccaguauauccaguccauggauaaagaaaaugcaucugcaucuccuaccccucuuc

SEQ ID NO: 72278 - RNA, 64 nt, Homo Sapiens
aaucucuacagccuugcucuccggggugguuaauaaaaugcaacacuuggcauuuuuauguuuu

SEQ ID NO: 72279 - RNA, 64 nt, Homo Sapiens
gaagaaaaauagaaucaauggcauuacuauuaguaaaaugcacaccuuuuucugaauuuacuau

SEQ ID NO: 72280 - RNA, 64 nt, Homo Sapiens
uuuauucauaaauaaaguuuuguguugauuugugaaaaugcaauuacaaucugagaugugucac

SEQ ID NO: 72281 - RNA, 64 nt, Homo Sapiens
uuuccuguucauagcaauauuaaaucaggaaaaaaaaaugcagggagguauuuaacagcugagc

SEQ ID NO: 72282 - RNA, 64 nt, Homo Sapiens
cuuggcagggaauauuuaaagcaacuucaaguuuaaaaugcagcuguugauucuaccaaacaac

SEQ ID NO: 72283 - RNA, 64 nt, Homo Sapiens
ggcuauuuucagcugaggaggggugaauauaggaaaaaugcauuuuugaaacguuugcaacaug

SEQ ID NO: 72284 - RNA, 64 nt, Homo Sapiens
uuuguguagcaacacauugugugcuauguuuauuaaaaugcagcgacaacuugagugucucacu

SEQ ID NO: 72285 - RNA, 64 nt, Homo Sapiens
uuuuucuucuucaauuuagcauaacagauacucuaaaaugcaggaaaaaguuugcuaacccuug

SEQ ID NO: 72286 - RNA, 64 nt, Homo Sapiens
uauaucuauaugugggaaccuguuucuuguuuagaaaaugcaacacaguauuacugaauauuaa

SEQ ID NO: 72287 - RNA, 64 nt, Homo Sapiens
uuuuuuuuaaaucuaagcauggacugguuguuauaaaaugcaauuguuaauguguuugguuugg

SEQ ID NO: 72288 - RNA, 64 nt, Homo Sapiens
agacaguguuaauguguuugauacuacuacugguaaaaugcagagaaauaccucauugaauauu

SEQ ID NO: 72289 - RNA, 64 nt, Homo Sapiens
uuuuugagaugcagauauagauugauaauuuugcaaaaugcacuguaucagaggcauaucauaa

SEQ ID NO: 72290 - RNA, 64 nt, Homo Sapiens
uucacagaggaauccaaaaaauacaguuugggggaaaaugcaauaauuuuugaugagaugggug

SEQ ID NO: 72291 - RNA, 64 nt, Homo Sapiens
ucaguuacaaacauuaucuccuuuaguuuuucagaaaaugcaucccugauuucauucauuucca

SEQ ID NO: 72292 - RNA, 64 nt, Homo Sapiens
cuuuucuugggggugggggaguuucccuuuucuaaaaaugcaaugcacuaaaacuauuuuaaga

SEQ ID NO: 72293 - RNA, 64 nt, Homo Sapiens
gcuccaugucuguaagucaaauguuacacaaaaaaaaaugcaaaugguguuucauuggaauuac

SEQ ID NO: 72294 - RNA, 64 nt, Homo Sapiens
uccaauguauuuggguaaaaauugcuucuuuuagaaaaugcaaagguuuauuugucuuaauaaa

SEQ ID NO: 72295 - RNA, 64 nt, Homo Sapiens
uuuuauaagggguuacucuuucaagaguaacaaaaaaaugcaaacuguaaugaaacuacauugu

SEQ ID NO: 72296 - RNA, 64 nt, Homo Sapiens
aacccaugugugaacugcacagagcaauucauagaaaaugcauagaaauuuguaacacuuuggu

SEQ ID NO: 72297 - RNA, 64 nt, Homo Sapiens
ugaguguuugucacauuucacuuucaugguauauaaaaugcaguuugcauauauaacuugaaua

SEQ ID NO: 72298 - RNA, 64 nt, Homo Sapiens
uuucagacuguuuugauagaaaaagcuaaauuuuaaaaugcauaucucacaguugccuaccugu

SEQ ID NO: 72299 - RNA, 64 nt, Homo Sapiens
uuggacagcaccuuuaagcucuacccccuacaucaaaaugcacuuuagugccccuucacgguac

SEQ ID NO: 72300 - RNA, 64 nt, Homo Sapiens
auaaaaggacuuguuagucuccagaacaucugcuaaaaugcaaguauauguauaagguaauagc

SEQ ID NO: 72301 - RNA, 64 nt, Homo Sapiens
cucaguauuuuggauuauucaaguguaugugguaaaaaugcagaugauugcugcuuuaccccag

SEQ ID NO: 72302 - RNA, 64 nt, Homo Sapiens
cacauggcaguugcaguaacuuguauggaaagagaaaaugcaaugagcccaguuacugcacuug

SEQ ID NO: 72303 - RNA, 64 nt, Homo Sapiens
cugucuucugucccccacacguaccagaaagugaaaaaugcagcgaguccucugggugguuaug

SEQ ID NO: 72304 - RNA, 64 nt, Homo Sapiens
aagggaagaacaguccucgggugauucagaggggaaaaugcaauccgggagguguuuccucagc

SEQ ID NO: 72305 - RNA, 64 nt, Homo Sapiens
cuuuuggcucuuuuugguauuaccagguuuuagcaaaaugcacauuuccaauggaauauguaua

SEQ ID NO: 72306 - RNA, 64 nt, Homo Sapiens
ugggguuaauauuuuaagaauguaaauguugaugaaaaugcaauaagugucuuaucuguacaga

SEQ ID NO: 72307 - RNA, 64 nt, Homo Sapiens
cuauuguugaaaagcaguuaagaaucucaucuagaaaaugcaaauaacaaaauuauacaaggau

SEQ ID NO: 72308 - RNA, 64 nt, Homo Sapiens
gaaaauuugaaagguaaaaauauuauccuuuuuaaaaaugcauugaaucccuaccagcaguagu

SEQ ID NO: 72309 - RNA, 64 nt, Homo Sapiens
cuaaccauuccauccuguuguuuaauuugaaagaaaaaugcaucuuuuucucaguuuuuaaugc

SEQ ID NO: 72310 - RNA, 64 nt, Homo Sapiens
cuaaagaugcaauaaauauguaauuuucuguuucaaaaugcaaugugaagcuguggugcacuau

SEQ ID NO: 72311 - RNA, 64 nt, Homo Sapiens
uucaggguuuaauuuugaaauaaaagauuaauauaaaaugcaacaacuuuuuauauuaccuauu

SEQ ID NO: 72312 - RNA, 64 nt, Homo Sapiens
uggaaugugaaauaaucaccuaggaaguugguuuaaaaugcacacuagugagcccaccuuagac

SEQ ID NO: 72313 - RNA, 64 nt, Homo Sapiens
gaaaauauaaguugucucuuaauaaccuucccucaaaaugcagaaagcuguaguucacaauucu

SEQ ID NO: 72314 - RNA, 64 nt, Homo Sapiens
uuggcuuaugaaaugccacuaguuauagauguuaaaaaugcagugaagcauaaagcuacuuuga

SEQ ID NO: 72315 - RNA, 64 nt, Homo Sapiens
acugaaaacguuagagacacacugcauugcagauaaaaugcaggcagcacaauauggccuaaac

SEQ ID NO: 72316 - RNA, 64 nt, Homo Sapiens
auggccuaaacugccauaguuuuagaaugugaaaaaaaugcauguuuacuuaccuguauacacc

SEQ ID NO: 72317 - RNA, 64 nt, Homo Sapiens
aagcaaagcacccaacaaugguaaauguuuuuuaaaaaugcagaacuaagauuuuugacucuaa

SEQ ID NO: 72318 - RNA, 64 nt, Homo Sapiens
uuggcagacucguauuuugauccugagagaguccaaaaugcacuggucacgaaacgucuaauac

SEQ ID NO: 72319 - RNA, 64 nt, Homo Sapiens
ugcuuguuuuuauuuucuugacacauuuauuaacaaaaugcaucauggaaaaaaaaaucuaccu

SEQ ID NO: 72320 - RNA, 64 nt, Homo Sapiens
cuucaacuuaacaaacacuuacguucuccuuuauaaaaugcauaguaaaccacuaacguuagcu

SEQ ID NO: 72321 - RNA, 64 nt, Homo Sapiens
auaggcuugaaaaaaauuggcggguaaaaaucacaaaaugcagucgaauauauauaugaaaacu

SEQ ID NO: 72322 - RNA, 64 nt, Homo Sapiens
aagaaggccaaaccagcuugccagugggccuuggaaaaugcaucuaaaaacucaugcugcucca

SEQ ID NO: 72323 - RNA, 64 nt, Homo Sapiens
gcugagaaacguugcuuucacuaaaauauuuuuuaaaaugcauuuggccauuuuuaauuuacag

SEQ ID NO: 72324 - RNA, 64 nt, Homo Sapiens
uguuaaaagaaguguauucuauuuauguuguuuuaaaaugcauacugagagacaaacaucuugu

SEQ ID NO: 72325 - RNA, 64 nt, Homo Sapiens
ugucacccuaaagaagcauauaaucauagcauuaaaaaugcacacauuacuccagguggaaggu

SEQ ID NO: 72326 - RNA, 64 nt, Homo Sapiens
auaaaauaaaauaaaauagucgugaaucuuguucaaaaugcagauuccucagauucaauaauga

SEQ ID NO: 72327 - RNA, 64 nt, Homo Sapiens
cccucugaguuuuuguauguauuauuauuaaagaaaaaugcaaucaggauuuuaaacauguaaa

SEQ ID NO: 72328 - RNA, 64 nt, Homo Sapiens
auauuuuucuauuuuacuugcucugaauacauugaaaaugcacuacacauuucucuguaguggg

SEQ ID NO: 72329 - RNA, 64 nt, Homo Sapiens
uugccaagagcucugauauuggcagguagucaagaaaaugcaaguuugauauuguuugcuaauu

SEQ ID NO: 72330 - RNA, 64 nt, Homo Sapiens
uuuuaaagcacuacguuuucuagcaacacagguaaaaaugcaccuuauacuucaugaacugauu

SEQ ID NO: 72331 - RNA, 64 nt, Homo Sapiens
cuaugaugccauuuaaaacuugaaaagaaccaaaaaaaugcaaacuccagcaauaugucugcau

SEQ ID NO: 72332 - RNA, 64 nt, Homo Sapiens
uccuaugugauuuuaacucugcuuuccuuuuuuaaaaaugcaaaccagugccaacaauccuagu

SEQ ID NO: 72333 - RNA, 64 nt, Homo Sapiens
guaucgauguuauguaaaaguucucagacuuuggaaaaugcauuucgagacagaaccuuguuau

SEQ ID NO: 72334 - RNA, 64 nt, Homo Sapiens
ugcucacauguaaaaacaucaguucauacuuaauaaaaugcaauuaccgucaaaucuuucagaa

SEQ ID NO: 72335 - RNA, 64 nt, Homo Sapiens
aauuaucauuuuguugauugugcuuuuauguaauaaaaugcaguacuuuaaaacauuuagauug

SEQ ID NO: 72336 - RNA, 64 nt, Homo Sapiens
uguuauguuagccucuagaaaauuuaaguucagaaaaaugcacuaugaccgguucguaauuuuu

SEQ ID NO: 72337 - RNA, 64 nt, Homo Sapiens
aagucuaaugucagaauaacuuacagaaaaauagaaaaugcacagcuuuaaaaugggcagaguu

SEQ ID NO: 72338 - RNA, 64 nt, Homo Sapiens
uugaaaauacuuuggauaauaaauuggaguuuuaaaaaugcaaauuugcuuaguaucuaauaau

SEQ ID NO: 72339 - RNA, 64 nt, Homo Sapiens
gaucaaaaaaauauaugacagauuauuuuguuuaaaaaugcaguuuuaauuaucuuagucuaua

SEQ ID NO: 72340 - RNA, 64 nt, Homo Sapiens
agugcacugaaauaucuuaucccaguaacaucuaaaaaugcaauucggaaaagugggcuaacac

SEQ ID NO: 72341 - RNA, 64 nt, Homo Sapiens
gggcuaacaccaauucacucagcagcagauggacaaaaugcacagugucuagaacugcucauug

SEQ ID NO: 72342 - RNA, 64 nt, Homo Sapiens
uuuuuccacacucagcuuucacagcauagauagaaaaaugcacaucuggcuuuguauuuucuuu

SEQ ID NO: 72343 - RNA, 64 nt, Homo Sapiens
acaguauuucuagcauggggaaaaaaaaaaaaaaaaaaugcaccuucucgccaccaaaaaaaaa

SEQ ID NO: 72344 - RNA, 64 nt, Homo Sapiens
cuggccaggcacaguggcucaacccugucucaaaaaaaugcagacagccuggaugacagagcaa

SEQ ID NO: 72345 - RNA, 64 nt, Homo Sapiens
ccaggugcgguggcucacacugggcugcuuguuaaaaaugcaggugccccaacugcacagcagu

SEQ ID NO: 72346 - RNA, 64 nt, Homo Sapiens
uuuaagguguucaagauauauucuuuuugguuuuaaaaugcaaaaucuuauuggcuguucuguu

SEQ ID NO: 72347 - RNA, 64 nt, Homo Sapiens
ucuuuauuaacaucacuagaugaaaccauaucuuaaaaugcagaaaugauuggaagguagaucu

SEQ ID NO: 72348 - RNA, 64 nt, Homo Sapiens
uuucuggaacugaauucuuaaacauaaaacagauaaaaugcaucuuguuacuacaaauguuaua

SEQ ID NO: 72349 - RNA, 64 nt, Homo Sapiens
ucuuaauaugauuugguaccuaaaguaauugaaaaaaaugcaguuuccuuuaauccuugacuau

SEQ ID NO: 72350 - RNA, 64 nt, Homo Sapiens
guauugauuuguacugguaguguugguguguuaaaaaaugcauuagcuucaagaacauucaagc

SEQ ID NO: 72351 - RNA, 64 nt, Homo Sapiens
uuuuuucccuugugaguuauuuuucuuuuauuuaaaaaugcacuccuuuuaacugucuccguuu

SEQ ID NO: 72352 - RNA, 64 nt, Homo Sapiens
ccugcaauucuguuugcaguguaacauuauaacuaaaaugcauuuuuuuuuuuuagcccuagag

SEQ ID NO: 72353 - RNA, 64 nt, Homo Sapiens
gcuuucauguaaaaugauauaacuguuuaagcaaaaaaugcacugggggauuuaaauacaggaa

SEQ ID NO: 72354 - RNA, 64 nt, Homo Sapiens
cagugagaaauaagaccucuagacauauuucuuuaaaaugcaagagugguuuacaaugcgcuuu

SEQ ID NO: 72355 - RNA, 64 nt, Homo Sapiens
uuaugagcuuuuuuuuuugcucugaaacauggccaaaaugcauuuguugaccuguuaaguauuc

SEQ ID NO: 72356 - RNA, 64 nt, Homo Sapiens
acauauucauauuguucaauuauuuuagcagcuaaaaaugcaucucuaugaacuuagaguuuac

SEQ ID NO: 72357 - RNA, 64 nt, Homo Sapiens
gugauuucuuauuauuauauuaguuuaaaaagaaaaaaugcaggcuuuacaguuaaacuaguuu

SEQ ID NO: 72358 - RNA, 64 nt, Homo Sapiens
gaagggaaagauugucauagaugguagggcuuugaaaaugcaggguaucagcugccacuccugg

SEQ ID NO: 72359 - RNA, 64 nt, Homo Sapiens
agauaauagaagacaaagagauuaaaaggaaauaaaaaugcaugauuaaaaacuaagaauaaaa

SEQ ID NO: 72360 - RNA, 64 nt, Homo Sapiens
gaaaccaaaugugccgagugauguaaaauggaagaaaaugcaaaucuugguagccacaccugca

SEQ ID NO: 72361 - RNA, 64 nt, Homo Sapiens
aauguauaaaaaagcaaaaacauagaaaacuugaaaaaugcagauuguaaaauaauauacucau

SEQ ID NO: 72362 - RNA, 64 nt, Homo Sapiens
gaaaaucauucugugugaagucaagaggccagagaaaaugcacaaacuguaggaaacuauagga

SEQ ID NO: 72363 - RNA, 64 nt, Homo Sapiens
cuagagagugguaaaucucagaaagcacaagcauaaaaugcagcucugggggcccuuuccacuu

SEQ ID NO: 72364 - RNA, 64 nt, Homo Sapiens
aguguccuccucucacaugagccagaucagccagaaaaugcaacacuuggaagaguuaaaugcu

SEQ ID NO: 72365 - RNA, 64 nt, Homo Sapiens
uuucuucuguacagucuaaagcuacagagaaaaaaaaaugcacucuucccuugccggcuccugg

SEQ ID NO: 72366 - RNA, 64 nt, Homo Sapiens
gaauggaaaacagugaacgguacuguaauuugucaaaaugcagaagugaaaguacucuguaggg

SEQ ID NO: 72367 - RNA, 64 nt, Homo Sapiens
uaaauuuggaaggaggaaauaaaaaaaaggaaauaaaaugcacauaucuaaugcagugauacca

SEQ ID NO: 72368 - RNA, 64 nt, Homo Sapiens
uuuuaauaaaaacugauacuaucauaaauuaaucaaaaugcacuguaucuuacagcuuaccuag

SEQ ID NO: 72369 - RNA, 64 nt, Homo Sapiens
uugggagagaaauuugucuaagaguuaaaauuuaaaaaugcaucuuuaacaugucagagagaag

SEQ ID NO: 72370 - RNA, 64 nt, Homo Sapiens
uaaacaugacauuuaauuugguggaagugaauauaaaaugcaucguaagaaaggauaaaaaggu

SEQ ID NO: 72371 - RNA, 64 nt, Homo Sapiens
cuccaaacaaauuucucaagucauccuuauuauuaaaaugcagcaccaaagagauaaagugaag

SEQ ID NO: 72372 - RNA, 64 nt, Homo Sapiens
caaaaguuaagaagccaaagcuacuugaucaugcaaaaugcacuuauauauuuguuacacugua

SEQ ID NO: 72373 - RNA, 64 nt, Homo Sapiens
cuaauaagaaauuuauuauggagauauagcccuuaaaaugcaauauuaagaacaaagaaauaga

SEQ ID NO: 72374 - RNA, 64 nt, Homo Sapiens
cuacugcaaauauaaaacauaaaguuuguuuaaaaaaaugcaaaucauucuuuaccuuaagaaa

SEQ ID NO: 72375 - RNA, 64 nt, Homo Sapiens
aaugugcauuuuauauaaagaugcauuuuauauaaaaaugcacaccuuuaaucucuauauggca

SEQ ID NO: 72376 - RNA, 64 nt, Homo Sapiens
aucucuauauggcagcauauacauauauauauauaaaaugcacacuuuuaaucucuauauggca

SEQ ID NO: 72377 - RNA, 64 nt, Homo Sapiens
uuacauucucuugaguuaauuaauauugaauagcaaaaugcauuuaaauaugcacuguucaccu

SEQ ID NO: 72378 - RNA, 64 nt, Homo Sapiens
auguccauuuuuguucccuaauuuauugcuucuaaaaaugcauuauguuuuacaaagauaucua

SEQ ID NO: 72379 - RNA, 64 nt, Homo Sapiens
uaaucaccuggugaggauuuggcauauccaccaaaaaaugcauccgauuuaaccaacaucucca

SEQ ID NO: 72380 - RNA, 64 nt, Homo Sapiens
ucccaccuuugugugaguguguaugaaagagaagaaaaugcaauuuuuagguaaucuuuuuuuu

SEQ ID NO: 72381 - RNA, 64 nt, Homo Sapiens
uagaguugacauguugacauuagccugaaaauccaaaaugcaugcaauuucuugaacucaggac

SEQ ID NO: 72382 - RNA, 64 nt, Homo Sapiens
cuuuuuuuuuuuuuuuuuuuaaguguaguaguagaaaaugcauugguggucaagggauaugauu

SEQ ID NO: 72383 - RNA, 64 nt, Homo Sapiens
uauucuucagauauucaaaaacauuuuuugcuuuaaaaugcauaucuuuaauuggguguugguc

SEQ ID NO: 72384 - RNA, 64 nt, Homo Sapiens
uuauuuauuuauguuagcauuuaaaaguuuaaaaaaaaugcauuugaccaggauaaaugaggua

SEQ ID NO: 72385 - RNA, 64 nt, Homo Sapiens
uccauagauagccagcaguggauguuacuccaggaaaaugcaggauuaaaauuguccuugugua

SEQ ID NO: 72386 - RNA, 64 nt, Homo Sapiens
auaacgugugaaucauuuuuuuaaacugaaauuuaaaaugcaacauaguuuaaucucugauuaa

SEQ ID NO: 72387 - RNA, 64 nt, Homo Sapiens
uagcuaucaagugugcuuuagucucaaaaaaaaaaaaaugcacagggccacagggcgagacucc

SEQ ID NO: 72388 - RNA, 64 nt, Homo Sapiens
aauuagccgggcgugguggccccugucucuacuaaaaaugcaaagucuggccaacaucgugaaa

SEQ ID NO: 72389 - RNA, 64 nt, Homo Sapiens
uagcugaggccggaugcgguggagccuuugaauaaaaaugcacgucacuguucccucugcuccu

SEQ ID NO: 72390 - RNA, 64 nt, Homo Sapiens
uuggcauggugggauggaugaaauauauucuucaaaaaugcauuaggcauuauguauauuuaaa

SEQ ID NO: 72391 - RNA, 64 nt, Homo Sapiens
aacaauagaaaaaugcugaacacuaaaguugaauaaaaugcauguggauugccaauuuuuaaaa

SEQ ID NO: 72392 - RNA, 64 nt, Homo Sapiens
cacaguuucuguaaauuauuugccucguaaaaugaaaaugcauuaucuugaauauuuucucuuu

SEQ ID NO: 72393 - RNA, 64 nt, Homo Sapiens
ccucguaaagaguccacugugccuagauuuaugaaaaaugcaugaucucaauuaguucacuuug

SEQ ID NO: 72394 - RNA, 64 nt, Homo Sapiens
gaaaaaagacugccuuggcaaagaauuuaucuuaaaaaugcaaguucugcugaucaggaaauuu

SEQ ID NO: 72395 - RNA, 64 nt, Homo Sapiens
uccgugagaacacaccacauguuaggacuagaagaaaaugcacaauuuguagggguuuggauga

SEQ ID NO: 72396 - RNA, 64 nt, Homo Sapiens
aaaauauuuaggauuugaccacacaauggcuaugaaaaugcaaguaguuuccucgcgugaccuc

SEQ ID NO: 72397 - RNA, 64 nt, Homo Sapiens
uauauuuuacacuccuuggaaacauuugaggaaaaaaaugcaauuugcacuucacuuuguugga

SEQ ID NO: 72398 - RNA, 64 nt, Homo Sapiens
ucuccuguaguuugaagacacacugacuccugacaaaaugcagccugcaacuuccuggagaaca

SEQ ID NO: 72399 - RNA, 64 nt, Homo Sapiens
ucauaugugguauuaguuuuaaagggucauuaggaaaaugcacauauuccaugaauuuuaagac

SEQ ID NO: 72400 - RNA, 64 nt, Homo Sapiens
uuuauuuguaugauauaaaguuauuacuuuaaacaaaaugcaaguauggggggauuguuuauaa

SEQ ID NO: 72401 - RNA, 64 nt, Homo Sapiens
auuuuaugauggagccucuuacagaaacauuaacaaaaugcaggaaucugccacauuucuuuuu

SEQ ID NO: 72402 - RNA, 64 nt, Homo Sapiens
aucucuuagauguggaaauauuuuuucgaaccugaaaaugcagcugguagaauuucaauggaag

SEQ ID NO: 72403 - RNA, 64 nt, Homo Sapiens
auccauguaaaauauauuuuaguugauauuuuguaaaaugcacuuuuuguguguguugauccug

SEQ ID NO: 72404 - RNA, 64 nt, Homo Sapiens
cuuggagaacuuuucugucuuacaagaggauuguaaaaugcacccaucagugcucuguaaaaca

SEQ ID NO: 72405 - RNA, 64 nt, Homo Sapiens
ccaaucagcgcucuguagcuagcaauagguuuguaaaaugcacccaucagcacucuguaaaacg

SEQ ID NO: 72406 - RNA, 64 nt, Homo Sapiens
agcacucuguaaaacgcaccaaucagcacucuguaaaaugcaccaaucagcaggauucuaaaag

SEQ ID NO: 72407 - RNA, 64 nt, Homo Sapiens
uaucauccgggcuccuuccgggcagaaacaacugaaaaugcacuucagacccacuuauuucugc

SEQ ID NO: 72408 - RNA, 64 nt, Homo Sapiens
acugggagaauaucacagugguuuuuguuagcagaaaaugcacuccagccucuguacucaucua

SEQ ID NO: 72409 - RNA, 64 nt, Homo Sapiens
uauuauagaauugucuacaucuguguuaaguuuaaaaaugcauuaccaaaucccauguuuccua

SEQ ID NO: 72410 - RNA, 64 nt, Homo Sapiens
ugaaacucaugcaauaauuaaucagaggugguacaaaaugcauuauagccuuaauaugccuuau

SEQ ID NO: 72411 - RNA, 64 nt, Homo Sapiens
aacuauagacagucacuucugcagucccaauuuaaaaaugcagaacugcuuuauccaagaaugc

SEQ ID NO: 72412 - RNA, 64 nt, Homo Sapiens
uuuuauuccuaagaauaaacaaaccccuacaguuaaaaugcaaagaugccugucaucuaaguau

SEQ ID NO: 72413 - RNA, 64 nt, Homo Sapiens
aaauacauaccuuauuuuaugcaauaaauuguuuaaaaugcaaggugguuauucugcauacugu

SEQ ID NO: 72414 - RNA, 64 nt, Homo Sapiens
gaagagcaccggguaaaaagcacaacaugcaguuaaaaugcaacuagaaaacuaauuuuaaaua

SEQ ID NO: 72415 - RNA, 64 nt, Homo Sapiens
cauuuuuccugauauguagagcagucuguuggcaaaaaugcauauauuuucuuucauauuugua

SEQ ID NO: 72416 - RNA, 64 nt, Homo Sapiens
cacauggggaugcuuuagggugagucuauaguacaaaaugcauaaaccauguccccaggaaauu

SEQ ID NO: 72417 - RNA, 64 nt, Homo Sapiens
acaugcuaagaucaaagcaaucaacagccaauaaaaaaugcacagaggcuguggcuuuuuauau

SEQ ID NO: 72418 - RNA, 64 nt, Homo Sapiens
aauauauuuuuagcagucuggaaauuuauugucuaaaaugcaugugaguguaugucuauauccu

SEQ ID NO: 72419 - RNA, 64 nt, Homo Sapiens
gauuaaaaacagaaauauggaaaagcuauguacuaaaaugcauaugaccuugggaauagggaaa

SEQ ID NO: 72420 - RNA, 64 nt, Homo Sapiens
uaugggaaauucuuauguaauacuauauaucuguaaaaugcaacaaaugaaauccacauguauu

SEQ ID NO: 72421 - RNA, 64 nt, Homo Sapiens
aaugaguacucagagaucaagauccccaaguaagaaaaugcagaggcucgggcuuguuugaggg

SEQ ID NO: 72422 - RNA, 64 nt, Homo Sapiens
caagacaucagaacuuauuccucuugucuaacugaaaaugcaugccugaugaccaaacucuccc

SEQ ID NO: 72423 - RNA, 64 nt, Homo Sapiens
gacuguggcaaacuccucauuaaaggaaaaaaaaaaaaugcaauaaaagagcaaaacuccaucu

SEQ ID NO: 72424 - RNA, 64 nt, Homo Sapiens
gacuggcugggugcaguggcugagagauuccuugaaaaugcaauaacgucagagaauuuaugcc

SEQ ID NO: 72425 - RNA, 64 nt, Homo Sapiens
ugaauuuaucauauuugcacgaguauguaaaaguaaaaugcaugcuguguuacuaucuuguuau

SEQ ID NO: 72426 - RNA, 64 nt, Homo Sapiens
uauauuacaguuuuccucuaaaagcaaaaaaaaaaaaaugcauuuuauauugcaguauccuuua

SEQ ID NO: 72427 - RNA, 64 nt, Homo Sapiens
gucucugguuugaaaugacuugaauaaaugagaaaaaaugcauuuuuacuuccugcagugaauu

SEQ ID NO: 72428 - RNA, 64 nt, Homo Sapiens
uucauaggcagcaucucagaggagcacuuguuuuaaaaugcagacacuugcauuagaaccaucu

SEQ ID NO: 72429 - RNA, 64 nt, Homo Sapiens
aagccgaagaguuagaacuuaaaagaaagagcugaaaaugcagaccagcaaugagaaggccagg

SEQ ID NO: 72430 - RNA, 64 nt, Homo Sapiens
cauuuuauuagggggauaaaacacaggccacgacaaaaugcaggcagcaggggaggugagccau

SEQ ID NO: 72431 - RNA, 64 nt, Homo Sapiens
cauuuuauuagggggauaagcaccgcgccuggccaaaaugcagacugggauuacaggcgugagc

SEQ ID NO: 72432 - RNA, 64 nt, Homo Sapiens
cuuuuuuuuuuuuuuuuuuugcacaggccaggacaaaaugcagacaccagggcagaaaugccgg

SEQ ID NO: 72433 - RNA, 64 nt, Homo Sapiens
auugcagaauuguuuagauuuuguacuuucuguuaaaaugcaugaaauuauaauguauucauau

SEQ ID NO: 72434 - RNA, 64 nt, Homo Sapiens
aaaucuuaauacuguuauucaccauaguuacuguaaaaugcaaaugauaaauauucacacuuga

SEQ ID NO: 72435 - RNA, 64 nt, Homo Sapiens
uuuauauuuccaaaaauaugaaaaaucuuaaccaucccuagaguuccauucacuauguguugau

SEQ ID NO: 72436 - RNA, 64 nt, Homo Sapiens
aauaguguuccucucuuauaaagucucaguaguaucccuagagaucaucucauaccuuacauau

SEQ ID NO: 72437 - RNA, 64 nt, Homo Sapiens
aguuauucaaugauaacugacaaacuaaauuauuucccuagaaaggaagaugaaaggaguggag

SEQ ID NO: 72438 - RNA, 64 nt, Homo Sapiens
ggaauggauaaaauauuugugguuuacuggguaaucccuagaugauguaugcuugcaguccuau

SEQ ID NO: 72439 - RNA, 64 nt, Homo Sapiens
auuggcuguccccucuauccgaaauccuuagcccucccuagagggcucaggcuuuaucagucag

SEQ ID NO: 72440 - RNA, 64 nt, Homo Sapiens
gccugggcaccucccacucgauucacacucuuguucccuagaaagugguucucgucgagagugc

SEQ ID NO: 72441 - RNA, 64 nt, Homo Sapiens
uguuuuguuuuuuuuuuuuaaugggggacaaaagagagggaaagaccccuauaaaucuauauau

SEQ ID NO: 72442 - RNA, 64 nt, Homo Sapiens
aacugguuugugggacaggggcagcuugcucaggagagggaauaacgcaggucccuuuucuugg

SEQ ID NO: 72443 - RNA, 64 nt, Homo Sapiens
gauggggagaauggucaauacugaaacauuccgaagagggaaugaaaguguuuucucagaacag

SEQ ID NO: 72444 - RNA, 64 nt, Homo Sapiens
uucccugcacccuggaaaggcuggaaggcagggcagagggaaugccaggccacuguggccagag

SEQ ID NO: 72445 - RNA, 64 nt, Homo Sapiens
cagaccccuuuagucacuccggaagugcccagcaagagggaaagccagcauccucugccuucua

SEQ ID NO: 72446 - RNA, 64 nt, Homo Sapiens
agagacuacaagcuggacaguuugccauuuggccagagggaaucgggcuguggcucagguaauu

SEQ ID NO: 72447 - RNA, 64 nt, Homo Sapiens
cugugcagagaccaagagguagggcauuccaggcagagggaaacuuugcagauggagaauagga

SEQ ID NO: 72448 - RNA, 64 nt, Homo Sapiens
aguuaacggugugggccacucuccuugcccagggagagggaaagcacuccugggccugccccag

SEQ ID NO: 72449 - RNA, 64 nt, Homo Sapiens
cuuuauuguuguuauuuuuguauuuuuaugaaacagagggaagaagggggaggguuggaaaauu

SEQ ID NO: 72450 - RNA, 64 nt, Homo Sapiens
ugagaaucauccagucuuaccagaauggaaagccagagggaaccgagccuccacucugggaugc

SEQ ID NO: 72451 - RNA, 64 nt, Homo Sapiens
aacugcacagccccacaggccucagagccagcccagagggaagcgugccugauccugcccuggg

SEQ ID NO: 72452 - RNA, 64 nt, Homo Sapiens
uguggggacuacucagaggcuugaaaucucuggaagagggaacagaggugaccaggccuggcag

SEQ ID NO: 72453 - RNA, 64 nt, Homo Sapiens
aauuccuuuccccuuuaggcggcuggcuacggcaagagggaaccagaggcauguucuugggcag

SEQ ID NO: 72454 - RNA, 64 nt, Homo Sapiens
gugcuggcuguggcuagagaggccauuggcucccagagggaacaggugaugagagauggggaga

SEQ ID NO: 72455 - RNA, 64 nt, Homo Sapiens
cuacaaaccuaaaaugcugcugccccaaagcacaagagggaagagcaccgccggggccacagga

SEQ ID NO: 72456 - RNA, 64 nt, Homo Sapiens
ccccuucccacccaccucuggcugaaggugcucaagagggaagcaauuauaagguggguggcag

SEQ ID NO: 72457 - RNA, 64 nt, Homo Sapiens
gcauugugugauauucucagaggcaggggaaaauagagggaaaaauagagacuauugguauguu

SEQ ID NO: 72458 - RNA, 64 nt, Homo Sapiens
acuggucaccacuggacgggaaggagaacagaggagagggaaagagaagcccaaccucugugau

SEQ ID NO: 72459 - RNA, 64 nt, Homo Sapiens
uuugacagucacagaagguuaaaagggagcuugaagagggaauguugggaauggacuggguuuu

SEQ ID NO: 72460 - RNA, 64 nt, Homo Sapiens
ucuaaauaauuucagggguacaaggguuugucauagagggaaccuaccuaaagcuaaaaaaaag

SEQ ID NO: 72461 - RNA, 64 nt, Homo Sapiens
ugagcgauuaguugagcccuuugaacuaugcugaagagggaaagugaaaguguaauacuguugg

SEQ ID NO: 72462 - RNA, 64 nt, Homo Sapiens
uugcacuauugggguaugauauucaaagcagcagagagggaacuacaacaguugggcugucaac

SEQ ID NO: 72463 - RNA, 64 nt, Homo Sapiens
auucugaguuuccaaaaucaaagauuugaccuuaagagggaagggaaaaaagugugaaaggaug

SEQ ID NO: 72464 - RNA, 64 nt, Homo Sapiens
uaucuuuugccuuuaagacgauucauucuugucuagagggaaaaucuggcugauuugggaauaa

SEQ ID NO: 72465 - RNA, 64 nt, Homo Sapiens
uaaaaaagaaccuuuguaaaguuuaaauaccaaaagagggaaaauuauuucagacgaggcugua

SEQ ID NO: 72466 - RNA, 64 nt, Homo Sapiens
gccacuggagguagagcuggagggcguaacuuuuagagggaacgcuccaccccccagguuguga

SEQ ID NO: 72467 - RNA, 64 nt, Homo Sapiens
auuaaucgguggcauauacugcacauacugaaauagagggaaaucacugaauguaaagagguuu

SEQ ID NO: 72468 - RNA, 64 nt, Homo Sapiens
uuagagaugagggggcuacagcagcaucaugcaaagagggaaagaugaagggauagaagaagag

SEQ ID NO: 72469 - RNA, 64 nt, Homo Sapiens
cuuuuagauuugauuauguauacaugacaccuaaagagggaacaaaaguuaguuuuauuuuuuu

SEQ ID NO: 72470 - RNA, 64 nt, Homo Sapiens
gcuagucagcuaagguaaauuucauuuucaaacgagagggaaacaugggaaguaaaagauuagg

SEQ ID NO: 72471 - RNA, 64 nt, Homo Sapiens
ggcagcaugcaugcuguuucgccuugggcacgggagagggaagucgagauagauagccaugucu

SEQ ID NO: 72472 - RNA, 64 nt, Homo Sapiens
ccaugcuuuuaagaacuaauagucugaggcccugagagggaaaugagcgcuggauucguggcac

SEQ ID NO: 72473 - RNA, 64 nt, Homo Sapiens
aggaucuuuuuuuuaaagacgugaagacagaaccagagggaauacauaguguucuccaucucua

SEQ ID NO: 72474 - RNA, 64 nt, Homo Sapiens
gauucaaauuuuuucauaauaaaugaaauggucuagagggaaaucuaaacaaaguauaaguuug

SEQ ID NO: 72475 - RNA, 64 nt, Homo Sapiens
acccucgggccgcuccccugagggaaagaccuacagagggaaagucuucuggauguuccuacag

SEQ ID NO: 72476 - RNA, 64 nt, Homo Sapiens
accuacagagggaaagaccccuggauguuccuacagagggaaaggugcuugcuuccagaaucuu

SEQ ID NO: 72477 - RNA, 64 nt, Homo Sapiens
gccauuaaagcagcucccuggaaaaacuugcaauagagggaaaaguguugacuguccuuucaag

SEQ ID NO: 72478 - RNA, 64 nt, Homo Sapiens
uuuccuuagauguuacccagaggaagcauguaagagagggaacaaaagagugcaggggguuggg

SEQ ID NO: 72479 - RNA, 64 nt, Homo Sapiens
uuguuguuuuacucuaaagcugggaaaggaaaugagagggaaaagaccccggagagggaagaaa

SEQ ID NO: 72480 - RNA, 64 nt, Homo Sapiens
gcugggaaaggaaaugagagggaaaagaccccggagagggaagaaaaucucaguauuuugaaaa

SEQ ID NO: 72481 - RNA, 64 nt, Homo Sapiens
acccccaggaacagcuuggcuguuccaccagagcagagggaaucauugcuggacuggauuucuu

SEQ ID NO: 72482 - RNA, 64 nt, Homo Sapiens
caccaagcaggcaaggcaaggaaggguguugcagagagggaacagcauaugcaaaggcguauca

SEQ ID NO: 72483 - RNA, 64 nt, Homo Sapiens
ccagaaucucugggacacauucaaagcaguguguagagggaaauuuauagcacuaaaugcccac

SEQ ID NO: 72484 - RNA, 64 nt, Homo Sapiens
uauuccuucugaaacuauuccaaucaaugggaaaagagggaauccucccuaacucauuuuauga

SEQ ID NO: 72485 - RNA, 64 nt, Homo Sapiens
ugaugacuuaaauggcagggucugugaucacaugagagggaagguuaagcacaaggucacauuc

SEQ ID NO: 72486 - RNA, 64 nt, Homo Sapiens
ggguucuccagguucaccaucugucuguguuuagagagggaagagccagggagcagccacacgu

SEQ ID NO: 72487 - RNA, 64 nt, Homo Sapiens
cggggcaggcuuagggcacaguuaggggccaaggagagggaaggccagggccccuguucuaggg

SEQ ID NO: 72488 - RNA, 64 nt, Homo Sapiens
aagaucacgccauugcacuccagccugggcaacgagagggaaacucuguuucaaaaaaaaaaaa

SEQ ID NO: 72489 - RNA, 64 nt, Homo Sapiens
guaaccgggagacaaauugacauuuuaaagggggagagggaaaacucuucuucuccuuccucua

SEQ ID NO: 72490 - RNA, 64 nt, Homo Sapiens
ucagacacagaugcauaggggaguccuuaucggaagagggaaaugcccucacccaauaugacug

SEQ ID NO: 72491 - RNA, 64 nt, Homo Sapiens
ggaagggagcauugcagccuaagaagaaggccagagagggaaaaggcaggugcuuuuggcagag

SEQ ID NO: 72492 - RNA, 64 nt, Homo Sapiens
agauucagagaaauuuagagcuaaaaaggcccuuagagggaaucuagcccaaccuacauuccac

SEQ ID NO: 72493 - RNA, 64 nt, Homo Sapiens
ccacccuguuacuuauguagaaacugaggcccagagagggaagaugaccugccccaagugguga

SEQ ID NO: 72494 - RNA, 64 nt, Homo Sapiens
agugcaauaggacauugugagaaggaauuuuucagggauucaucuacuaguuuaaaaaccccac

SEQ ID NO: 72495 - RNA, 64 nt, Homo Sapiens
agacugguucugguuggacagcuaaucugauuuggggauucacuguuucagaggacacagacaa

SEQ ID NO: 72496 - RNA, 64 nt, Homo Sapiens
gcucuccuuugcucucugcagcuguaagccagaggggauucaagguaaauaggcuuuacaggcu

SEQ ID NO: 72497 - RNA, 64 nt, Homo Sapiens
cucucucuucugagggaagguugguugcaaaagugggauucaugacccucccaggcuacaccau

SEQ ID NO: 72498 - RNA, 64 nt, Homo Sapiens
gcugaaucugcccaguucccccaggugccccccggggauucagggccaccaucagagccucucc

SEQ ID NO: 72499 - RNA, 64 nt, Homo Sapiens
ccugcccugcccccaccuuccacuggccuccagugggauucacugcccauccuacuucuacccu

SEQ ID NO: 72500 - RNA, 64 nt, Homo Sapiens
guauuuauaaaaacacugccauccuucauuaugagggauucaaacuauauucauaaguucuaaa

SEQ ID NO: 72501 - RNA, 64 nt, Homo Sapiens
uuaugccuauugauaucugcccugcuggguacaagggauucaauuaacacacauugauugagug

SEQ ID NO: 72502 - RNA, 64 nt, Homo Sapiens
gggggauauuuuuguugcuuauuaaaugauucuagggauucacuaaagagauaccgguuacauu

SEQ ID NO: 72503 - RNA, 64 nt, Homo Sapiens
uucccagaacgcuuuaaguguccagggugcagaagggauucauaugcauggcuggacuggugau

SEQ ID NO: 72504 - RNA, 64 nt, Homo Sapiens
ucugcaucuuaacugcucuuuuuuguauugaagagggauucacagcaacagagaaccaucccua

SEQ ID NO: 72505 - RNA, 64 nt, Homo Sapiens
gaguauuugaaaaauguauaguuguuguucaaacgggauucacauaaagccuguuuugucuuuu

SEQ ID NO: 72506 - RNA, 64 nt, Homo Sapiens
cuucucccagaguuuucuuuggagaacagaaagaagaaaggaaagaaaggaaccagaggcagag

SEQ ID NO: 72507 - RNA, 64 nt, Homo Sapiens
gaguuuucuuuggagaacagaaagaagaaaggaaagaaaggaaccagaggcagagagacgagga

SEQ ID NO: 72508 - RNA, 64 nt, Homo Sapiens
uccucuccaucugguguggaaacacugcccagggagaaaggaggaagcucacuguggacagucu

SEQ ID NO: 72509 - RNA, 64 nt, Homo Sapiens
auugugaagaggaggaaaagugaaucacggagagagaaaggaaaggauagaaucacaggcugcg

SEQ ID NO: 72510 - RNA, 64 nt, Homo Sapiens
auccagcuauacuuacuugcacaguggauuggagagaaaggauucuccagugugcacacucauc

SEQ ID NO: 72511 - RNA, 64 nt, Homo Sapiens
cuucacuuuacuacaguuacuuuugcaaacagacagaaaggauacacuucuaaccacauuuuac

SEQ ID NO: 72512 - RNA, 64 nt, Homo Sapiens
uguaaacagaauaaaauugaacaaauuaggggguagaaaggagcaguggugucguucaccguga

SEQ ID NO: 72513 - RNA, 64 nt, Homo Sapiens
ugacagccucguggacuaaaguucccagugugggagaaaggagcuaguuugcaauaaaaacagc

SEQ ID NO: 72514 - RNA, 64 nt, Homo Sapiens
aauaaauaugugccaucagaccaaaaaaaaguagagaaaggagcugaacuccacucucgaugcu

SEQ ID NO: 72515 - RNA, 64 nt, Homo Sapiens
gcugcaugaguucucgaaaauggugggaaaccuaagaaaggaggagggcuguauucacugaucc

SEQ ID NO: 72516 - RNA, 64 nt, Homo Sapiens
cacaauggcgauguggugagaaacuccugaaugaagaaaggaaccuugucuuucagggcauaag

SEQ ID NO: 72517 - RNA, 64 nt, Homo Sapiens
uuuaaaguacuucuuccccuuauccccucaauaaagaaaggaaauccaaauuugaagcaucacu

SEQ ID NO: 72518 - RNA, 64 nt, Homo Sapiens
uaucuuaguuuaaagggggaaagaaaagggaagaagaaaggaaaagagaaauccaacuccuuuu

SEQ ID NO: 72519 - RNA, 64 nt, Homo Sapiens
auuugcccuugauucuauuuugcuaauggaagauagaaaggagagaagguuuuuuuuuuuuuua

SEQ ID NO: 72520 - RNA, 64 nt, Homo Sapiens
ggcaaaagaacuaagacuuuuuucaaacuaaauuagaaaggagugucauuauuugacuguuaaa

SEQ ID NO: 72521 - RNA, 64 nt, Homo Sapiens
aauauuuuuggugggucuuuuuauggaaguuuaaagaaaggacaucaucauagauaugaucuaa

SEQ ID NO: 72522 - RNA, 64 nt, Homo Sapiens
ccaguaacugagggcccacuacguuacagaaggaagaaaggaaggcugggaaaguaaaggcagc

SEQ ID NO: 72523 - RNA, 64 nt, Homo Sapiens
agcuuugacauuaagcucccggcagucauuaaagagaaaggaguuucucuauguaagcagccau

SEQ ID NO: 72524 - RNA, 64 nt, Homo Sapiens
ccugucuuaaaacuggguuuuguguaaugucucuagaaaggaauacaccuuaaguguauacugu

SEQ ID NO: 72525 - RNA, 64 nt, Homo Sapiens
ccagcagguuuauaugugaagaguguagaguuucagaaaggauucaguugugcugaggucaaua

SEQ ID NO: 72526 - RNA, 64 nt, Homo Sapiens
cuccguuuugcaaaguggaggucuggcuuccaagagaaaggaggcauagcgucagagaggauau

SEQ ID NO: 72527 - RNA, 64 nt, Homo Sapiens
aggcaaaacacuccaggaccgauuggucagggggagaaaggaaauauugggguuucccaggaug

SEQ ID NO: 72528 - RNA, 64 nt, Homo Sapiens
ccaucaguuccagccuucucucaaggagaggcaaagaaaggagauacaguggagacaucuggaa

SEQ ID NO: 72529 - RNA, 64 nt, Homo Sapiens
uaaauaaauaaauaaauaaaaacaaaguugauuaagaaaggaaguauaggccaggcacaguggc

SEQ ID NO: 72530 - RNA, 64 nt, Homo Sapiens
gagcugaucccuacguccgugucuacuuguugccagaaaggaagugggcaugucguaagaagac

SEQ ID NO: 72531 - RNA, 64 nt, Homo Sapiens
agugaaaaauaguaggccacuuggcucacacagaagaaaggaguuaggaaaaguaaguacaaga

SEQ ID NO: 72532 - RNA, 64 nt, Homo Sapiens
cuagggaaaaugaaggaaguaccacaaacuggcuagaaaggagcuuaucaaucaccagugagga

SEQ ID NO: 72533 - RNA, 64 nt, Homo Sapiens
aaaucccauucacacauggccaggcuauccaaaaagaaaggagccauguucucaugugguuuac

SEQ ID NO: 72534 - RNA, 64 nt, Homo Sapiens
cuccucagucccaguuucugaaaggacucagcugagaaaggacaacuggguuccgcuuuccuua

SEQ ID NO: 72535 - RNA, 64 nt, Homo Sapiens
uuuauaauccuuaaugugaggcuaagguauaaggagaaaggagauugguaaggaagugugauac

SEQ ID NO: 72536 - RNA, 64 nt, Homo Sapiens
cuucuuacugugcuaugcauuuuauugagaguacagaaaggaagaggaaccuuuuuuuaaucac

SEQ ID NO: 72537 - RNA, 64 nt, Homo Sapiens
uuuuuaaucacuuguuuuguuuugacuauagauaagaaaggacuacagcauuugaugugugucc

SEQ ID NO: 72538 - RNA, 64 nt, Homo Sapiens
uaaaaucuaacguugaguaaaugugauagugaugagaaaggaauuuuguguacuguaaccuugc

SEQ ID NO: 72539 - RNA, 64 nt, Homo Sapiens
uuccccugccugccugagucguccaggggugcccagaaaggagccuccuuccggccccacuggg

SEQ ID NO: 72540 - RNA, 64 nt, Homo Sapiens
ggaccgaggaaggaaggaagcccuggaucccaggagaaaggaguacagggagcucagaccccaa

SEQ ID NO: 72541 - RNA, 64 nt, Homo Sapiens
uucagcucaaggcucccugcucagaauaccacaaagaaaggacacucccaggcugauccuuuau

SEQ ID NO: 72542 - RNA, 64 nt, Homo Sapiens
acuaacguuaccuugcuuuggaauucggauugauagaaaggaagcaagccaagccuuaagugug

SEQ ID NO: 72543 - RNA, 64 nt, Homo Sapiens
gcugagccuugguuaaaccagggagaaggggagcagaaaggaaacguuguuacugaugaguacc

SEQ ID NO: 72544 - RNA, 64 nt, Homo Sapiens
aauuuucuaaauauuuugauaucaauuuggguaaagaaaggaauacuuuuguuagaaugagaau

SEQ ID NO: 72545 - RNA, 64 nt, Homo Sapiens
cuaacuuugaaaagaccgcuguucauaaggagagagaaaggaggaagagaugagaaaggaagac

SEQ ID NO: 72546 - RNA, 64 nt, Homo Sapiens
cuguucauaaggagagagaaaggaggaagagaugagaaaggaagacagagaaagaaacucuaug

SEQ ID NO: 72547 - RNA, 64 nt, Homo Sapiens
ccucccuuccgcuccugcccagccugggggaaggagaaaggaggggagaaagcgggcucucacc

SEQ ID NO: 72548 - RNA, 64 nt, Homo Sapiens
uacgccaccuucuggacacucccuccuugagggcagaaaggagucccaggccugucccuaggga

SEQ ID NO: 72549 - RNA, 64 nt, Homo Sapiens
cuguacuuugaaaauggaucuuguuuugagguuuagaaaggagagagugggugugauuuuuguu

SEQ ID NO: 72550 - RNA, 64 nt, Homo Sapiens
uggcccuacuguagacagcuauggcagauauguaagaaaggaaaccuagccugugugccauuuc

SEQ ID NO: 72551 - RNA, 64 nt, Homo Sapiens
uagcccauuucuguuaaccucuuaucacuaagaaagaaaggaaagaaggagaugaauagaagaa

SEQ ID NO: 72552 - RNA, 64 nt, Homo Sapiens
uuuuuaaaccacagucuggagugauagcuacuguagaaaggaaauagacuuuguaugaacucuu

SEQ ID NO: 72553 - RNA, 64 nt, Homo Sapiens
cacugguuuuaaucuguagaauggcacacuauggagaaaggacauuaguaggucuuugguuuug

SEQ ID NO: 72554 - RNA, 64 nt, Homo Sapiens
aagaaaaccaaaacggaagauugccucauaaagaagaaaggaccuuggagucuagaggauauuc

SEQ ID NO: 72555 - RNA, 64 nt, Homo Sapiens
gaaaagacuuaaaacuggagaggugggagacauaagaaaggaaauucuuuuaaaacuugaauau

SEQ ID NO: 72556 - RNA, 64 nt, Homo Sapiens
gguuugcagaggagaguguaucagagcacugaaaagaaaggaaggaggcuuuucuauauacuuc

SEQ ID NO: 72557 - RNA, 64 nt, Homo Sapiens
aacaaguuucaagcaacuccagaaacaggaaagaagaaaggaguacauucccauuccagaaagg

SEQ ID NO: 72558 - RNA, 64 nt, Homo Sapiens
aacaggaaagaagaaaggagaacauucccauuccagaaaggagagguuggagaggcauaggaua

SEQ ID NO: 72559 - RNA, 64 nt, Homo Sapiens
cuuuggcuuccugcuguuggggguggaaaagacuagaaaggacauugcuuucucagccccaccc

SEQ ID NO: 72560 - RNA, 64 nt, Homo Sapiens
agcacucaccuagagcugucugugccucucugggagaaaggagagaggauaagaagggaaaguu

SEQ ID NO: 72561 - RNA, 64 nt, Homo Sapiens
ccccaucagacucuggacacccaggaaucaaaagagaaaggacuuuuuuggugacucaauccca

SEQ ID NO: 72562 - RNA, 64 nt, Homo Sapiens
ggaagaagaaugauggauuccuuuuggaucaaucagaaaggaaacacgaaagaaaagucaggaa

SEQ ID NO: 72563 - RNA, 64 nt, Homo Sapiens
gugcucuggggaugaggcauggguauaggaagggagaaaggaguuggagacaagauccucuuca

SEQ ID NO: 72564 - RNA, 64 nt, Homo Sapiens
gguuaggcugagcucccagcaggacaccgccugcagaaaggaccugcccugauaaugucccuuc

SEQ ID NO: 72565 - RNA, 64 nt, Homo Sapiens
ucuuuugccaauuccacuaauuguuugggugaagagaaaggaaguacagaaaacaugcagaaag

SEQ ID NO: 72566 - RNA, 64 nt, Homo Sapiens
gagaaaggaaguacagaaaacaugcagaaagcacagaaaggaaaaccaagguucucaugaaucu

SEQ ID NO: 72567 - RNA, 64 nt, Homo Sapiens
aacacaaauugcccccagaucuccaccuuugcaaagaaaggaaaaggacaggagcugucuggag

SEQ ID NO: 72568 - RNA, 64 nt, Homo Sapiens
gacaguggcggugccccauaugaauggcaauuagagaaaggacuacucuucuaagucccacucg

SEQ ID NO: 72569 - RNA, 64 nt, Homo Sapiens
cagaggaauuuuuuuuguuuuguuuugucuuuuaagaaaggaaagaaaggaugaaaaaaauaaa

SEQ ID NO: 72570 - RNA, 64 nt, Homo Sapiens
uuuuuuuguuuuguuuugucuuuuaagaaaggaaagaaaggaugaaaaaaauaaacagaaaacu

SEQ ID NO: 72571 - RNA, 64 nt, Homo Sapiens
guggccauucuuuuuuucuucacaagggaaggacagaaaggagaguuucaaucacuguccucca

SEQ ID NO: 72572 - RNA, 64 nt, Homo Sapiens
auuuaggggcaagcaggcgcacaugauuagcagaagaaaggaaccagcccauccauaguaacug

SEQ ID NO: 72573 - RNA, 64 nt, Homo Sapiens
gaaggauugcgcacccugcaaccagcuuucuaugagaaaggacuccugguggcucguggaggaa

SEQ ID NO: 72574 - RNA, 64 nt, Homo Sapiens
cuguggcuaaagcagaaaugucacauagacuaauagaaaggagguaguagccacaucuuguuca

SEQ ID NO: 72575 - RNA, 64 nt, Homo Sapiens
ucauuuaguugggucugaaaagaguaucaaaggcagaaaggagaaugaaagacaaagaaggaaa

SEQ ID NO: 72576 - RNA, 64 nt, Homo Sapiens
gcagccucagggcuuccuuaucaaggcugccuggagaaaggauguaacauuacugccuucagua

SEQ ID NO: 72577 - RNA, 64 nt, Homo Sapiens
acaccagaagauuuaggaugggaggguggggcgaagaaaggauuuugucucagggugggaagug

SEQ ID NO: 72578 - RNA, 64 nt, Homo Sapiens
caccuguacucucugcucuaauugauugacuauaagaaaggaugaucuaccuauuacucccagc

SEQ ID NO: 72579 - RNA, 64 nt, Homo Sapiens
agaccagaggauuuaggaugggagggcagggcaaagaaaggauuuugucucagggugggaagug

SEQ ID NO: 72580 - RNA, 64 nt, Homo Sapiens
caucuguacucugcucugcaauugacugacuauaagaaaggacaucugccuguuacuucccagc

SEQ ID NO: 72581 - RNA, 64 nt, Homo Sapiens
aaccaaaaugucacaacccagacucagauuucauagaaaggagcacuauauacuacagcagaau

SEQ ID NO: 72582 - RNA, 64 nt, Homo Sapiens
agaaaaaggagaaaaacaaaauaagugaaaagagagaaaggaaauugguuuuaugaauacaaag

SEQ ID NO: 72583 - RNA, 64 nt, Homo Sapiens
acuaggugacccggaugcugacaucugcugcugcagaaaggaagacuuuucauuguaauuucgc

SEQ ID NO: 72584 - RNA, 64 nt, Homo Sapiens
gucuucucccaucauugcccugcugugacuccaaagaaaggagcuucuugcugacagugcccug

SEQ ID NO: 72585 - RNA, 64 nt, Homo Sapiens
aaacagugguaauaaaaaaaaaaaaaagagagaaagaaaggaguuaacagcaaaaaaaaaaaaa

SEQ ID NO: 72586 - RNA, 64 nt, Homo Sapiens
aucauuuauaaugcucuguacaguguuuugagggagaaaggaccagcuaaaugacaaaacacag

SEQ ID NO: 72587 - RNA, 64 nt, Homo Sapiens
ucaggcaagagaaagaaauaaaaggcaaccaaaaagaaaggaagucgaaguaucucuguuugca

SEQ ID NO: 72588 - RNA, 64 nt, Homo Sapiens
agucagggaaucaaacuaaauguccaucagugguagaaaggauaaagaaaaugugguggcaggg

SEQ ID NO: 72589 - RNA, 64 nt, Homo Sapiens
cgugaaccccagggaacagcaggacacaaccucaagaaaggaagccugcaggguguggggaagg

SEQ ID NO: 72590 - RNA, 64 nt, Homo Sapiens
uaagcuggguguguucugucgggccuaugugaaaagaaaggaaccuaccacccauccaaccuuu

SEQ ID NO: 72591 - RNA, 64 nt, Homo Sapiens
caaaccacagaaaaauacaaguacaggcaacaggagaaaggaauggaaaaaagaaauugggagg

SEQ ID NO: 72592 - RNA, 64 nt, Homo Sapiens
gaauggcuuaaguaaacuaauaggcaacaugaccagaaaggaugauuauuuuuucauuguuaaa

SEQ ID NO: 72593 - RNA, 64 nt, Homo Sapiens
ggaaggaaucauuguuccaggcauccaucuuggaagaaaggaccagcuuugagcuccaucaagg

SEQ ID NO: 72594 - RNA, 64 nt, Homo Sapiens
ccaggaacugucauggauguccaaauggcuuugcagaaaggaaaugagaugacaguauuuaauc

SEQ ID NO: 72595 - RNA, 64 nt, Homo Sapiens
cacccauuuuuaagcugguuuucuccugauaagaagaaaggaagaaagccccagacgcuugguu

SEQ ID NO: 72596 - RNA, 64 nt, Homo Sapiens
auaaaccgagcuuuaaaggauaaaguguuaauaaagaaaggaagcugggcacaugucaaaaagg

SEQ ID NO: 72597 - RNA, 64 nt, Homo Sapiens
caaaaagggagaucgaaauguuagguaaucauuuagaaaggacagaaaauauuuaaaguggcuc

SEQ ID NO: 72598 - RNA, 64 nt, Homo Sapiens
uucauucaaagcuuuagaugugucccauguggcaagaaaggagacagugaauuuugucaaacaa

SEQ ID NO: 72599 - RNA, 64 nt, Homo Sapiens
acaucagcauaugagaaucucugagagguccucuagaaaggagagaaaaagcaccucuuuuggc

SEQ ID NO: 72600 - RNA, 64 nt, Homo Sapiens
cuugaacuguuuguucuugguugguucaaucugaagaaaggaagaguugaaaguuucaaaaacu

SEQ ID NO: 72601 - RNA, 64 nt, Homo Sapiens
uguugaagaugugauuucaacauuaacaacuugaagaaaggagcaaaaagacccagccaacugu

SEQ ID NO: 72602 - RNA, 64 nt, Homo Sapiens
gguuaaguuuaauuuucucugggggcaugaucucacaaagaauacucaagucuuuuucuucuua

SEQ ID NO: 72603 - RNA, 64 nt, Homo Sapiens
gggaaguauacaagcagagccaguucugguacaaacaaagaauuugacagggacaauggaaggg

SEQ ID NO: 72604 - RNA, 64 nt, Homo Sapiens
aauuuaaucaauugcaaagcaauuauauaaaaccacaaagaauguacugaaccuacuaacccuu

SEQ ID NO: 72605 - RNA, 64 nt, Homo Sapiens
cuucuuaauucaacccauaaucauuaaguacuuaacaaagaauauuuuacaagugauaguauuu

SEQ ID NO: 72606 - RNA, 64 nt, Homo Sapiens
ggcgucuuagaacucccuggcuuauauagcaucgacaaagaacaguaaauuuuuagagaaacaa

SEQ ID NO: 72607 - RNA, 64 nt, Homo Sapiens
acaaagaacaguaaauuuuuagagaaacaacaaaacaaagaaaaagagcuuugagucuguaggg

SEQ ID NO: 72608 - RNA, 64 nt, Homo Sapiens
aauguucucaagguuguccuacaugcccaaguuaacaaagaaaaagagagaacgaauguuagcc

SEQ ID NO: 72609 - RNA, 64 nt, Homo Sapiens
augcggcacugaaggaagaggacacggaucucuuacaaagaacaaaauuacacaacuuugaacu

SEQ ID NO: 72610 - RNA, 64 nt, Homo Sapiens
uugucucauuagccugaaugcuaugugcuagcccacaaagaauauguuuguccuuaggauaggc

SEQ ID NO: 72611 - RNA, 64 nt, Homo Sapiens
aaaccaaauuauuguucaaauaaaauaagcaauaacaaagaagaucagcaaaagggucuaccuu

SEQ ID NO: 72612 - RNA, 64 nt, Homo Sapiens
gucuacaaauaugcuuugcuacaguuugcuagucacaaagaauaugguggacucuucuaagaau

SEQ ID NO: 72613 - RNA, 64 nt, Homo Sapiens
auguaauugucacuugguucuuauuuuguagaagacaaagaaguugaaaauacuugauuugcuc

SEQ ID NO: 72614 - RNA, 64 nt, Homo Sapiens
accacugauugguauguucaacaaauuuguguauacaaagaaauggauaaaucacugcuauaua

SEQ ID NO: 72615 - RNA, 64 nt, Homo Sapiens
uauuuuuuuuuuacuauagagugagggguuguuaacaaagaauauauauuggucauucuuacaa

SEQ ID NO: 72616 - RNA, 64 nt, Homo Sapiens
agcugugcuguuuagaaacaacaucucagacuuuacaaagaaaugacaaagaaggcaauugcac

SEQ ID NO: 72617 - RNA, 64 nt, Homo Sapiens
uuagaaacaacaucucagacuuuacaaagaaaugacaaagaaggcaauugcacuuuuuaaggga

SEQ ID NO: 72618 - RNA, 64 nt, Homo Sapiens
gcaaaacugaccauaaaaaaccuugacuagggggacaaagaaaaaacaacacuaacaaacucuc

SEQ ID NO: 72619 - RNA, 64 nt, Homo Sapiens
cugucuaagacaguacaucuaaaaucacauccuaacaaagaagugggaaauuuccccaaaucag

SEQ ID NO: 72620 - RNA, 64 nt, Homo Sapiens
uuagcaaaggcucaugcugaaauuugccaguaaaacaaagaaguuuaaagacuggcagguacac

SEQ ID NO: 72621 - RNA, 64 nt, Homo Sapiens
aaaaaagaaaaaaaagaaaaaaaggaaaagaagaacaaagaaacaugacugucucaaagaguaa

SEQ ID NO: 72622 - RNA, 64 nt, Homo Sapiens
aaauuccuaugaccaaauugucauuuaaaacaagacaaagaaacaugcauuucauauagcuuuu

SEQ ID NO: 72623 - RNA, 64 nt, Homo Sapiens
aaacuguaucuuuagguuaaaaaucuggaguuuuacaaagaaggacugccuuugccagcauccu

SEQ ID NO: 72624 - RNA, 64 nt, Homo Sapiens
caugcuuucugaggagauagcaguagaugauauaacaaagaaagugaaagucuggccaacagag

SEQ ID NO: 72625 - RNA, 64 nt, Homo Sapiens
acagagagagagaauauuggaaaaaaaaaagaugacaaagaaaaccuugaaaauguuuauuuaa

SEQ ID NO: 72626 - RNA, 64 nt, Homo Sapiens
aauuccacaaugaaagaaugaaccaaucaaccaaacaaagaaaaaaacaggaacccaccaaacc

SEQ ID NO: 72627 - RNA, 64 nt, Homo Sapiens
cuuauuucagucuagcagcuaguaugauguuuauacaaagaaucuaucaucuauauaacuucaa

SEQ ID NO: 72628 - RNA, 64 nt, Homo Sapiens
aaugaacuaauucuuuacaaaaaaaacucgagcuacaaagaaagcuguaaaauguucuaagaua

SEQ ID NO: 72629 - RNA, 64 nt, Homo Sapiens
agagaagaaaucuuaaauguuuuauaucagagaaacaaagaacuaaacacaucuucuucaaaug

SEQ ID NO: 72630 - RNA, 64 nt, Homo Sapiens
gaagguccugcuauuacuaaggaguaaucuguguacaaagaaauaacaagucgaugaacuauuc

SEQ ID NO: 72631 - RNA, 64 nt, Homo Sapiens
ugcuauccauuucucauguuuuccauuguuugaaacaaagaagguuaccaagaagccuuuccug

SEQ ID NO: 72632 - RNA, 64 nt, Homo Sapiens
auuaaaauuauaucacaaauauauaugcuuccagacaaagaaaaguuuguuaguccugauuuuc

SEQ ID NO: 72633 - RNA, 64 nt, Homo Sapiens
gcccuccucuugcacuuggguucugacucccagaacaaagaacuugggagaacaguacgggaga

SEQ ID NO: 72634 - RNA, 64 nt, Homo Sapiens
gugauuuuuuuuuuuucuccucaugguuagagcuacaaagaacauauuuuuguugcuuuuacuu

SEQ ID NO: 72635 - RNA, 64 nt, Homo Sapiens
aucuucgcuuuucauguauggcuuaagcauaaaaacaaagaaaaggaaagcagaacugaaguua

SEQ ID NO: 72636 - RNA, 64 nt, Homo Sapiens
aacuugcauuagaaaaaaaagagauauauacaccacaaagaaucuaauaagaaauuuauuaugg

SEQ ID NO: 72637 - RNA, 64 nt, Homo Sapiens
auggagauauagcccuuaaaaugcaauauuaagaacaaagaaauagaaaaugguuuagauaucu

SEQ ID NO: 72638 - RNA, 64 nt, Homo Sapiens
uuuaagguagcccucucaucgucuuuuaguuccaacaaagaaaggugccaugucuuuacuagac

SEQ ID NO: 72639 - RNA, 64 nt, Homo Sapiens
aaguuguaaaaugucaagaaauucugcuguuacgacaaagaaacauuuuacgcuagauuaaaau

SEQ ID NO: 72640 - RNA, 64 nt, Homo Sapiens
ugcaggccagaagaaaaguuugccagcugucuacacaaagaauauucuagaaaccuguuauaau

SEQ ID NO: 72641 - RNA, 64 nt, Homo Sapiens
gcuuguauauacuuugccacauuaaaaacagaaaacaaagaaaacaucacauccccgaugcuaa

SEQ ID NO: 72642 - RNA, 64 nt, Homo Sapiens
aaacuguauaaagggauugguagucaaaacauguacaaagaaauaccuguaaaacuguuuuguc

SEQ ID NO: 72643 - RNA, 64 nt, Homo Sapiens
uacuguguuggacauauuauuuagacuuagucauacaaagaaacuuagcucuuuuuucaucuca

SEQ ID NO: 72644 - RNA, 64 nt, Homo Sapiens
aacguaccccccucaggugagaggggacugcuguacaaagaauauaggaaggccucuagacuac

SEQ ID NO: 72645 - RNA, 64 nt, Homo Sapiens
ucacaauaacaaggcugauuucagaugucucaccacaaagaaggaggauaagggagcgagguga

SEQ ID NO: 72646 - RNA, 64 nt, Homo Sapiens
auuacagaggaggugugaagcagcugaagggucggucaucuauuucccagacacaggaaaacua

SEQ ID NO: 72647 - RNA, 64 nt, Homo Sapiens
uuuuuuuuuucaaaaacuuuggauuuggcauauagucaucuauagggggauugguuccaggauc

SEQ ID NO: 72648 - RNA, 64 nt, Homo Sapiens
acgccacaucagcacaguagaccugccaagcuuggucaucuaugucaccacugucacaggaaga

SEQ ID NO: 72649 - RNA, 64 nt, Homo Sapiens
acaccacaccagcacaguagacuugccaagcuuggucaucuaugucaccaccgucacaggaagc

SEQ ID NO: 72650 - RNA, 64 nt, Homo Sapiens
cauuuuuuuccugauauuuccaccacuuuucagagucaucuacaaaauuuuucuuuccucaaga

SEQ ID NO: 72651 - RNA, 64 nt, Homo Sapiens
ugauaaggcuguauguuucuggaacaaaauauuggucaucuaaaaacuuucuguuuucuggggu

SEQ ID NO: 72652 - RNA, 64 nt, Homo Sapiens
acauuauuucauaaaauaagaauuuguucuguguuaucuaaagauguaucaguauauugucaca

SEQ ID NO: 72653 - RNA, 64 nt, Homo Sapiens
uaaaagccacaggggacaguuaaauaucuuaaaauaucuaaaacauuuuuuaaagcacuuagau

SEQ ID NO: 72654 - RNA, 64 nt, Homo Sapiens
aggaauacuaauuaauugaacauucauaaauaaauaucuaaauugaacuguaaaaucccuuggu

SEQ ID NO: 72655 - RNA, 64 nt, Homo Sapiens
cuaaucccgauuugaacaaugugaaacaacaaaauaucuaaaaaauguuuuaauugccaaccgu

SEQ ID NO: 72656 - RNA, 64 nt, Homo Sapiens
aagaaaacugauggcuaaguggacuguggauaccuaucuaaaagaucagaaaaaaaguccauau

SEQ ID NO: 72657 - RNA, 64 nt, Homo Sapiens
aaucuguguaauugggcccaaaaaaaaaaugcuguaucuaaaugucccgucucgggggcuuaaa

SEQ ID NO: 72658 - RNA, 64 nt, Homo Sapiens
gaaaauaugcagaauaacugcgaauuucaucauuuaucuaaagaacucaucuuuuuuuaaaaac

SEQ ID NO: 72659 - RNA, 64 nt, Homo Sapiens
cuaaaauaaacuaugaaugaaauauuuuauggaauaucuaaauacaguaggugccucuguacca

SEQ ID NO: 72660 - RNA, 64 nt, Homo Sapiens
caccugucuuucacuuuuugagacagacugaauauaucuaaaauuuccagcaauaaaaaaaaaa

SEQ ID NO: 72661 - RNA, 64 nt, Homo Sapiens
uuuuucacuugguuagcuaaagaagauguaaaaauaucuaaaauaauguucauggugaaucuua

SEQ ID NO: 72662 - RNA, 64 nt, Homo Sapiens
uguuaauagugcguaccucuuuucuggaaguuuauaucuaaaaauaaauaaaacuggaaaaaaa

SEQ ID NO: 72663 - RNA, 64 nt, Homo Sapiens
ccacaauauggaagaaguaucaggucugccaaucuaucuaaaagaacagggaagggguugggga

SEQ ID NO: 72664 - RNA, 64 nt, Homo Sapiens
aaaaaucauguauacccucacccaucuaaguugauaucuaaaauuuuaucuaaguugguaucua

SEQ ID NO: 72665 - RNA, 64 nt, Homo Sapiens
ucuaaguugauaucuaaaauuuuaucuaaguugguaucuaaaauuuuucaugggaaguuaaaua

SEQ ID NO: 72666 - RNA, 64 nt, Homo Sapiens
auguuuauaguguucauguaaaaaaaagacaaaauaucuaaaaauuguuacuauuauuccuuug

SEQ ID NO: 72667 - RNA, 64 nt, Homo Sapiens
ccugcuucagggcugggcgcuggacaugcaaucuuaucuaaaaguucuucccucaaaauuuuca

SEQ ID NO: 72668 - RNA, 64 nt, Homo Sapiens
auauaguugaauuucuuuaaaaaguuuucuauuuuaucuaaaaucuuuccauuauaucuaaauu

SEQ ID NO: 72669 - RNA, 64 nt, Homo Sapiens
aaaguuuucuauuuuaucuaaaaucuuuccauuauaucuaaauuagaaugaucauccugcgcaa

SEQ ID NO: 72670 - RNA, 64 nt, Homo Sapiens
uagaaaagguacaguaaaaauguguaucuaaacauaucuaaacaguaacacagugcuaaguauu

SEQ ID NO: 72671 - RNA, 64 nt, Homo Sapiens
uaucuaaacauagaaaaggugcuaaguauuuguguaucuaaacaguaggcgguuguaacacagu

SEQ ID NO: 72672 - RNA, 64 nt, Homo Sapiens
uuaguuuccuggaauaauaauuucauuuuuuucuuaucuaaaucaauuuaaauuaggguuggua

SEQ ID NO: 72673 - RNA, 64 nt, Homo Sapiens
cuaauugcaaauugaccacaaguuucauaccaacuaucuaaaacggucuggauacgaaguuuac

SEQ ID NO: 72674 - RNA, 64 nt, Homo Sapiens
gaccucaguuccuggaggggggaaagggugaaagagaaaccacguauuuuguuauuauuuugga

SEQ ID NO: 72675 - RNA, 64 nt, Homo Sapiens
auuauuuuggauuauuuuuuaucgaagagaucauagaaaccagagccuucuccccaggccugcc

SEQ ID NO: 72676 - RNA, 64 nt, Homo Sapiens
uccucugaaggccgggacccagucauacauccuuagaaaccaaaguaugguuuuuguuuucucu

SEQ ID NO: 72677 - RNA, 64 nt, Homo Sapiens
ccagccugggcaacagagcaagacccugucuuggagaaaccagaauuuuggaagagcaaauggg

SEQ ID NO: 72678 - RNA, 64 nt, Homo Sapiens
aaggauggagaaaaaucugggacagugucuucucagaaaccaccagccuugacgguaaugaaac

SEQ ID NO: 72679 - RNA, 64 nt, Homo Sapiens
aaggauggagaaauaucuaggaaagugucuucucagaaaccaccaaccuugaagguaaugaaac

SEQ ID NO: 72680 - RNA, 64 nt, Homo Sapiens
uucucagaaaccaccaaccuugaagugucuucugagaaaccaccaggcuugaagguaaugaaac

SEQ ID NO: 72681 - RNA, 64 nt, Homo Sapiens
aaggauggagaaauaucuaggaaagugucuucucagaaaccaccagccuugaagguaaugaaac

SEQ ID NO: 72682 - RNA, 64 nt, Homo Sapiens
aaggauggagaaaaaucuaggacagugucuucugagaaaccaccaggcuugaagguaaugaaac

SEQ ID NO: 72683 - RNA, 64 nt, Homo Sapiens
cauugagaggugauuuaguuuauauguuuuuggaagaaaccauuaauguuuaauuuaaucuuaa

SEQ ID NO: 72684 - RNA, 64 nt, Homo Sapiens
agccuuaaggcugaugcaguuuacuuacaaguuuagaaaccagaaugcuuuguuuuuaccagau

SEQ ID NO: 72685 - RNA, 64 nt, Homo Sapiens
uaauguuucuuaaaaguuuuugagaaaaaaaggaagaaaccaacucauucagaaggcucggauu

SEQ ID NO: 72686 - RNA, 64 nt, Homo Sapiens
aagauuccugauguugcacccauuguaagugaucagaaaccaucuguaucaaagucuggacgga

SEQ ID NO: 72687 - RNA, 64 nt, Homo Sapiens
guuauguacaaaaaaauggcgggaacuugggaccagaaaccacuuuguaguaaauaaguucaag

SEQ ID NO: 72688 - RNA, 64 nt, Homo Sapiens
auuuaaaauguuggucuaggauuuaacauauuuaagaaaccaauauuauguucuguuaauggga

SEQ ID NO: 72689 - RNA, 64 nt, Homo Sapiens
uucugacacuagguuuacaaucuuucuuggauagagaaaccauuucagaagacucacuuuucuu

SEQ ID NO: 72690 - RNA, 64 nt, Homo Sapiens
uucucacagauuaagggcuaguuuggccuauaugagaaaccauccaguuuuacuacauucuggu

SEQ ID NO: 72691 - RNA, 64 nt, Homo Sapiens
cuuuggggcagagacuuggcaucuucgcaguuuaagaaaccacguuuccuauccaauccgaagg

SEQ ID NO: 72692 - RNA, 64 nt, Homo Sapiens
ccugaccuacccauaacucccugcuaggcuaaguagaaaccagguuauuucucccugcuuaugg

SEQ ID NO: 72693 - RNA, 64 nt, Homo Sapiens
uuuucuccucagaaguaggguguaccuaaaagucagaaaccacaucagacuggugauaucguga

SEQ ID NO: 72694 - RNA, 64 nt, Homo Sapiens
aauaucgugucauauuuuccgaccagaaaagaaaagaaaccauaacauuaaguaaaauaaaaug

SEQ ID NO: 72695 - RNA, 64 nt, Homo Sapiens
ucuugggugggcccugaacaaagccaaaaauuguagaaaccagucuagaaaaaguccugcucau

SEQ ID NO: 72696 - RNA, 64 nt, Homo Sapiens
uuguccacagauguacuggccauuacaugaaacaagaaaccaagcaucuuugcuguuguuaauu

SEQ ID NO: 72697 - RNA, 64 nt, Homo Sapiens
gcaagggcagugcguggaaaggccggggaggugcagaaaccagagcccagggcaauggugucug

SEQ ID NO: 72698 - RNA, 64 nt, Homo Sapiens
cacacccaccagugcagccugaaguaacucccacagaaaccaucaucgucuuuguacaucguau

SEQ ID NO: 72699 - RNA, 64 nt, Homo Sapiens
cacuuggccucacuaccagaagaaggguggagucagaaaccaaagugaccuccagagcuguccu

SEQ ID NO: 72700 - RNA, 64 nt, Homo Sapiens
agagcaaauauuguucuucccauuuuacagauucagaaaccaaggcuaagggacuggucuaaag

SEQ ID NO: 72701 - RNA, 64 nt, Homo Sapiens
uauugcacauuagagaauugguccuggaagggaaagaaaccacagauuuuauuucaguacacaa

SEQ ID NO: 72702 - RNA, 64 nt, Homo Sapiens
uuuaguaguguuugguauguuuuaugugucugguagaaaccauauuuugguuaacagcaagaaa

SEQ ID NO: 72703 - RNA, 64 nt, Homo Sapiens
aauguucugauuacaucacugauugguaaugguuagaaaccauuaaccuaaaacuuacuauuua

SEQ ID NO: 72704 - RNA, 64 nt, Homo Sapiens
uuaaugucuuaaguaagugcuuaauuuggaauagagaaaccaguauauuuuaaaaaagaaaaau

SEQ ID NO: 72705 - RNA, 64 nt, Homo Sapiens
ccgccagcugauuggaugucuaggaaugacugaaagaaaccaaaacagccuguccacugcugcu

SEQ ID NO: 72706 - RNA, 64 nt, Homo Sapiens
cuuccgccccuggcagggacuucuggguuaugggagaaaccagagaugggaaugaggaaaauau

SEQ ID NO: 72707 - RNA, 64 nt, Homo Sapiens
agcaacggcuauuaaaugucacaauccuuuaauuagaaaccauuuauuggccggacgcgguggc

SEQ ID NO: 72708 - RNA, 64 nt, Homo Sapiens
agcgagacuccgucucaaaaaaaaaaaaaaaaaaagaaaccauuuauuuuaaaaaugauuagau

SEQ ID NO: 72709 - RNA, 64 nt, Homo Sapiens
cugcaucaauaccaaacauggggguuugguaaugagaaaccaggacaggccaucugcagugacc

SEQ ID NO: 72710 - RNA, 64 nt, Homo Sapiens
ccuugcccuggggccgguucuuacccagguccagagaaaccaacgcgggaugucagacuucacc

SEQ ID NO: 72711 - RNA, 64 nt, Homo Sapiens
ucuuaaaaaauuuuacauagaggcucaacccaaaagaaaccauugagaucccuuuucuuaaaaa

SEQ ID NO: 72712 - RNA, 64 nt, Homo Sapiens
ccuugccucaagcaaaagcagucguaagaucuuaagaaaccaauggcccagcauucagggagga

SEQ ID NO: 72713 - RNA, 64 nt, Homo Sapiens
cacaacaaaauggcuuguugguaguccagacuuuagaaaccaaaguuuuacuggcaguucuaua

SEQ ID NO: 72714 - RNA, 64 nt, Homo Sapiens
uuuaauaauguguuuaagauugguaucgaaaaccagaaaccacuaauuguucauguuguuugga

SEQ ID NO: 72715 - RNA, 64 nt, Homo Sapiens
uguaaaacucaaaugaccacuggcauaccauuagagaaaccauuagagaacacauaaaugauuu

SEQ ID NO: 72716 - RNA, 64 nt, Homo Sapiens
cagugccucaccuccagaucucuccgggugucugagaaaccaccggcggcccaggcugaagcca

SEQ ID NO: 72717 - RNA, 64 nt, Homo Sapiens
ugcuucccagagugccaagcuccgcucauuucuuagaaaccaccaagaccuguccaccuguagc

SEQ ID NO: 72718 - RNA, 64 nt, Homo Sapiens
cccacuucuuucuaggagauuaaaugucccccugagaaaccaaucauuucaacauagagucaca

SEQ ID NO: 72719 - RNA, 64 nt, Homo Sapiens
uuaauagaagaguaggccuggggaugucuuaguuagaaaccagaggguuggggguagagguuuu

SEQ ID NO: 72720 - RNA, 64 nt, Homo Sapiens
ggaaagugagagaaaucuauugaggaaacuagcuuuccgcuaccucagggagguguggacugga

SEQ ID NO: 72721 - RNA, 64 nt, Homo Sapiens
aguguucaauuagcaggcugauuucuuuuuccucuuccgcuaguugugaaagacaggggaaggg

SEQ ID NO: 72722 - RNA, 64 nt, Homo Sapiens
uaaccuaaaucaucucucucugcuuagaaauuucuuccgcuaguucaccuguugaacacuuugc

SEQ ID NO: 72723 - RNA, 64 nt, Homo Sapiens
uaagagcaccucauuccuguaauuucauuucugcuuccgcuaaguauuauuuacacugaauucc

SEQ ID NO: 72724 - RNA, 64 nt, Homo Sapiens
cuuucuucaauaucuauaggcuauugguuuucaguuccgcuauugcuaagcauuguuucccugg

SEQ ID NO: 72725 - RNA, 64 nt, Homo Sapiens
caagaaccuauauggccuucuguucugaauugucuuccgcuagccaguccaagugugcaacagc

SEQ ID NO: 72726 - RNA, 64 nt, Homo Sapiens
ccaagaugaugaguucagccuuuaucccucgugguuccgcuagauguaacuuauaggaguuaac

SEQ ID NO: 72727 - RNA, 64 nt, Homo Sapiens
cucuucuccauuugccucuuccuuccuauuucccuuccgcuaaggaaaaaaauuggugucacau

SEQ ID NO: 72728 - RNA, 64 nt, Homo Sapiens
aucuuugcagugaauuaugcuuugcuuuaaaacauuccgcuaaaaucauaaugggacauauaaa

SEQ ID NO: 72729 - RNA, 64 nt, Homo Sapiens
cuacccugucagccuuucaacacacaccccuccguuccgcuagccacccccugcuacucuccuc

SEQ ID NO: 72730 - RNA, 64 nt, Homo Sapiens
ccaaauguaaaacacuccuuaaguuccaaauguuuuccgcuaauagucuguccuaaagccuuug

SEQ ID NO: 72731 - RNA, 64 nt, Homo Sapiens
cucuucuaggauacacauuucacuauauaaaugguuccgcuaaugcaugguuugcaugacuuua

SEQ ID NO: 72732 - RNA, 64 nt, Homo Sapiens
acaacgucuacaaaugugaacugcaaagccugucuuccgcuagauucacuaaaagcaccgaaau

SEQ ID NO: 72733 - RNA, 64 nt, Homo Sapiens
gguggagaacauuugcaagaagcuuucaaaucccuuccgcuauagaauggaguguccagaaaua

SEQ ID NO: 72734 - RNA, 64 nt, Homo Sapiens
gaccaguucauccagcuuucugcccccucccauuuuccgcuacuuccccaagaggccaacccag

SEQ ID NO: 72735 - RNA, 64 nt, Homo Sapiens
cacuacccgucuuccugcaugccgggguggccacuuccgcuacaucagggcuauacccacuucu

SEQ ID NO: 72736 - RNA, 64 nt, Homo Sapiens
auauuaugcccaguguuccuagaggcuugccuguuuccgcuacuucuaaggggaagggacccau

SEQ ID NO: 72737 - RNA, 64 nt, Homo Sapiens
ucacagaccaaacguuuuaguuuggugcuaaugauuccgcuauuauacaagcuccauaacuccu

SEQ ID NO: 72738 - RNA, 64 nt, Homo Sapiens
uccaucuugagcucugaguuggcuaccaccaugauuccgcuacccaccagugcccacaucaggg

SEQ ID NO: 72739 - RNA, 64 nt, Homo Sapiens
ccugccauuucuucugcuagguuagaauuuuuacuuccgcuacccuguuagagucugucauaug

SEQ ID NO: 72740 - RNA, 64 nt, Homo Sapiens
gcacaguuuagaaaagguguuacauggaugagucuuccgcuauagguauuaagggagaguuauc

SEQ ID NO: 72741 - RNA, 64 nt, Homo Sapiens
gucuuuaacaggagcaaagaguuagcacucuuaguuccgcuacuauaauauugaccugccauac

SEQ ID NO: 72742 - RNA, 64 nt, Homo Sapiens
aagaggaggaaacuacuugaggagggacccaacuuuccgcuaucuuuuggguucauuccaaaua

SEQ ID NO: 72743 - RNA, 64 nt, Homo Sapiens
uugauuuugaauuguaaaugguaaauauuuaauauuccgcuaauuuuuuaaaagauauaguuuu

SEQ ID NO: 72744 - RNA, 64 nt, Homo Sapiens
cuuggugauagauucgccaccacugggccuuguuuuccgcuaauuccagggcagauuccagggc

SEQ ID NO: 72745 - RNA, 64 nt, Homo Sapiens
gauaaagcagauguggaugcaagcccccucacucuuccgcuaggacagugugagugcacgugug

SEQ ID NO: 72746 - RNA, 64 nt, Homo Sapiens
uucaucuaaagaugucucuggugauuuuuauauguuccgcuauauaauugaugcuuuauaguuu

SEQ ID NO: 72747 - RNA, 64 nt, Homo Sapiens
auccggcaagguuucuugcaccccgccuccaguuuuccgcuaguccacuuuccugugcccccac

SEQ ID NO: 72748 - RNA, 64 nt, Homo Sapiens
cccaggcacagccaccacuuugcaagugggaggaggggagaaggggagacaaaaccacugcaga

SEQ ID NO: 72749 - RNA, 64 nt, Homo Sapiens
gacugggaagggcugcuucucucguaagggucuuggggagaaguaagcccgcagccugccucug

SEQ ID NO: 72750 - RNA, 64 nt, Homo Sapiens
uaucugcauggaccucuguguauuauucacagauggggagaaccucucugcccuuggacccauu

SEQ ID NO: 72751 - RNA, 64 nt, Homo Sapiens
auacuuuucuucaacaaauuuccuggagagagaaggggagaagauguucuccugcauauaucau

SEQ ID NO: 72752 - RNA, 64 nt, Homo Sapiens
ccacaaauuuucaacaaucauuguagaaacuaagggggagaaaguaaucucaguuguuuuagaa

SEQ ID NO: 72753 - RNA, 64 nt, Homo Sapiens
ggguagugagauggaaauggugccugcagaaguuggggagaaggauacuuuugcacagccucca

SEQ ID NO: 72754 - RNA, 64 nt, Homo Sapiens
aauucuacuuuuauuuuugcuuacagaaaaacggggggagaauuaagccaaagaaguauauuua

SEQ ID NO: 72755 - RNA, 64 nt, Homo Sapiens
acauaaugaucaguaugcugugccagcuucauuuggggagaaauaacuaguagaaaguucuggg

SEQ ID NO: 72756 - RNA, 64 nt, Homo Sapiens
aauguggggugaaaugggaguagggggguggacaggggagaaacgaaaaccacaaaaagaaaac

SEQ ID NO: 72757 - RNA, 64 nt, Homo Sapiens
cuacaggguggugucagucaaggucuuucaggugggggagaaauugguuagggcucccacugcc

SEQ ID NO: 72758 - RNA, 64 nt, Homo Sapiens
uucacccucaguuuccucacuugaggagugggauggggagaacagagaguagcuguguuugaau

SEQ ID NO: 72759 - RNA, 64 nt, Homo Sapiens
gagcaauuuauacuuuacccucaggcuguccucuggggagaaggugccauggucuuaggugucu

SEQ ID NO: 72760 - RNA, 64 nt, Homo Sapiens
cugaaaagacaguugugugcauggaugugugcguggggagaaagaacguggguaagaugucccu

SEQ ID NO: 72761 - RNA, 64 nt, Homo Sapiens
ccagucccacuccugucaccccacgcucugcacuggggagaaaacgggaggugcucgugcuggc

SEQ ID NO: 72762 - RNA, 64 nt, Homo Sapiens
gccucucugccauuucggucguggacucagcuccggggagaaggcugugguuauuggggccaag

SEQ ID NO: 72763 - RNA, 64 nt, Homo Sapiens
gcauacgccaggagccuccucgcacugaaggaguggggagaagaucccuucccccuaagccaac

SEQ ID NO: 72764 - RNA, 64 nt, Homo Sapiens
agggguggcaugaugaggaagcccaccaggggcuggggagaagggcuagaaugcccgggcuggu

SEQ ID NO: 72765 - RNA, 64 nt, Homo Sapiens
ucuucuuggcagcuuaacauugacuucuugguuuggggagaaauaaauuuuguuucagaauuuu

SEQ ID NO: 72766 - RNA, 64 nt, Homo Sapiens
guaggaauccuuugagaaugugauuccuuuugauggggagaaagggcaaauuauuuuaauauuu

SEQ ID NO: 72767 - RNA, 64 nt, Homo Sapiens
guugaguuuucaugaauagagugcuggcagaaacggggagaaggagcccagacucugcccuguu

SEQ ID NO: 72768 - RNA, 64 nt, Homo Sapiens
cagggugauagcccagacucuccuuuaaagggagggggagaagccucgcaggaaaaugugggcu

SEQ ID NO: 72769 - RNA, 64 nt, Homo Sapiens
ugugugugugugugugcacauuuguuuggggaugggggagaagaagcuaaggggagaagucaac

SEQ ID NO: 72770 - RNA, 64 nt, Homo Sapiens
cacauuuguuuggggaugggggagaagaagcuaaggggagaagucaacauuuaugaaauauugc

SEQ ID NO: 72771 - RNA, 64 nt, Homo Sapiens
ggucaucaucgauucuacuuuuauggggcugaacggggagaaaaaaagaggggaaaaugaguuu

SEQ ID NO: 72772 - RNA, 64 nt, Homo Sapiens
uacauugugaaacuucuguaggagauauuuauggggggagaacuguagcagguaccacugauuu

SEQ ID NO: 72773 - RNA, 64 nt, Homo Sapiens
uaacaagguguggagugucagcgaggugcaauguggggagaauacauuguagaauauaagguuu

SEQ ID NO: 72774 - RNA, 64 nt, Homo Sapiens
gguggacgcagaccuugagaacaaccuaaauuauggggagaauuuuaaaauguuaaacuguaau

SEQ ID NO: 72775 - RNA, 64 nt, Homo Sapiens
aucggcccuguccccuggagugugucagagcccaggggagaaugcagcccaccaggagcaccug

SEQ ID NO: 72776 - RNA, 64 nt, Homo Sapiens
ucccuuccugcuuccuguuaccugucuugcuccuggggagaaagaggggccugaugagacucca

SEQ ID NO: 72777 - RNA, 64 nt, Homo Sapiens
ggcagaggcucaccucccucauccagcaugcugcggggagaaggaggaccagauuuucccagcc

SEQ ID NO: 72778 - RNA, 64 nt, Homo Sapiens
uggucccugcagaggggcuccacagccugggcaaggggagaaggccucccugccccucugcugg

SEQ ID NO: 72779 - RNA, 64 nt, Homo Sapiens
cugagucucagagcaggggacacucuguuuuccaggggagaaacgucagacaggcugggggccu

SEQ ID NO: 72780 - RNA, 64 nt, Homo Sapiens
cuguacucuguccagacauggggaaaggggagagggggagaaaacauggaggucagagccacaa

SEQ ID NO: 72781 - RNA, 64 nt, Homo Sapiens
uauuuuguguuuagggaagggaaaauggaggaaaggggagaagagcaaagggcgcuuuuaaaga

SEQ ID NO: 72782 - RNA, 64 nt, Homo Sapiens
cuaauaacaaagggguucugacacuaagacauuaggggagaauguuggguaggcagccagcacu

SEQ ID NO: 72783 - RNA, 64 nt, Homo Sapiens
guaccuuucccauuguggucaugccauuuggcagggggagaaugggaggcuuggccuucuuugu

SEQ ID NO: 72784 - RNA, 64 nt, Homo Sapiens
aacuuccaaauuggcucuuuggaggcgagaggaaggggagaacuuggagaauaguuuuugcuuu

SEQ ID NO: 72785 - RNA, 64 nt, Homo Sapiens
ugggggauggcuaagaaagcagccccguggggaaggggagaaagcaugaccugcagccaagccc

SEQ ID NO: 72786 - RNA, 64 nt, Homo Sapiens
aggaagggaagggcagaagggggggaggcggagaggggagaagaccuuccagggcuuuuccuuu

SEQ ID NO: 72787 - RNA, 64 nt, Homo Sapiens
gcugcuuuaaaagcucuguccuuggagccucccgcucccugaagugucucgcccccugcacagc

SEQ ID NO: 72788 - RNA, 64 nt, Homo Sapiens
gucuuucccccccucacccucaccaucugaggggcucccugagaucuugguagaggaggccccu

SEQ ID NO: 72789 - RNA, 64 nt, Homo Sapiens
gaggccagguguuggcagccggcccaaggccccucucccugaguccucacccagauaucaucca

SEQ ID NO: 72790 - RNA, 64 nt, Homo Sapiens
gcaagggcucacucccuccucaggcugacuccuucucccugacucuacuuucuggaagucuccc

SEQ ID NO: 72791 - RNA, 64 nt, Homo Sapiens
cugcucaggcugcucauuccugcucacccucagucucccugagcuaccaccuaacuccucacuc

SEQ ID NO: 72792 - RNA, 64 nt, Homo Sapiens
ccucagucucccugagcuaccaccuaacuccucacucccugaucaauggaaguccaggucagug

SEQ ID NO: 72793 - RNA, 64 nt, Homo Sapiens
ccggcucagccagccucacgcugcuaggaaauggcucccugaucuaucagguaagagccagggg

SEQ ID NO: 72794 - RNA, 64 nt, Homo Sapiens
cggaacugcugcggcaccuggcaaaaggcauggccucccugaugaucaccaccaaggguagccc

SEQ ID NO: 72795 - RNA, 64 nt, Homo Sapiens
gcccgugcagagagaugucaugggggcaccugcucucccugauagaugcugagagcauccagaa

SEQ ID NO: 72796 - RNA, 64 nt, Homo Sapiens
caggagcaugauggggacuuccaugcuggaauugcucccugauuaaaaugagauauggcuauuu

SEQ ID NO: 72797 - RNA, 64 nt, Homo Sapiens
gacuggcgccccucagagaccugcggaaagcccccucccugagucgucgccacaccaggcgaca

SEQ ID NO: 72798 - RNA, 64 nt, Homo Sapiens
gcguugcgggcuccuuccccgcagaggccggggccucccugacuuugcuucuucacucccaccu

SEQ ID NO: 72799 - RNA, 64 nt, Homo Sapiens
ggcccucccaaggcuacauccccaccccacaguucucccugagagagaucaaccucccugagau

SEQ ID NO: 72800 - RNA, 64 nt, Homo Sapiens
ccccaccccacaguucucccugagagagaucaaccucccugagaucaaccaaggcagaugugac

SEQ ID NO: 72801 - RNA, 64 nt, Homo Sapiens
ugucucuccucugcuguguccucaaucucucugucucccugaggcucuauuucugucucuccuc

SEQ ID NO: 72802 - RNA, 64 nt, Homo Sapiens
ugucucuccucugcuguguccucaaucucucugucucccugaggcucuauuucugucucugaug

SEQ ID NO: 72803 - RNA, 64 nt, Homo Sapiens
gugccaggugcgcuucugcagguggagccaagcucucccugaggccagaggcggggccugggcc

SEQ ID NO: 72804 - RNA, 64 nt, Homo Sapiens
ucucacccccucaggagugggcacgggagcccuucucccugacccugggcugcuuccugggggc

SEQ ID NO: 72805 - RNA, 64 nt, Homo Sapiens
ugaggauggggcuguuucuccccuccgacuggggcucccugaggauggggcuguuucuccccuc

SEQ ID NO: 72806 - RNA, 64 nt, Homo Sapiens
ugaggauggggcuguuucuccccuccgacuggggcucccugaggacagggcugugucuccccuc

SEQ ID NO: 72807 - RNA, 64 nt, Homo Sapiens
ugaggacagggcugugucuccccucagccuggggcucccugagucagggcugugucuccccuca

SEQ ID NO: 72808 - RNA, 64 nt, Homo Sapiens
cugagucagggcugugucuccccucagacuggggcucccugaggacggggcugugucugccuca

SEQ ID NO: 72809 - RNA, 64 nt, Homo Sapiens
ucaggacagcguugugucuccccucagacugcggcucccugaggacggggcugugucucccuca

SEQ ID NO: 72810 - RNA, 64 nt, Homo Sapiens
cugaggacggggcugugucucccucagacuggggcucccugaagaaagggcugcuucucccuca

SEQ ID NO: 72811 - RNA, 64 nt, Homo Sapiens
cugaagaaagggcugcuucucccucagacuggagcucccugaagauggggcugugucccccuca

SEQ ID NO: 72812 - RNA, 64 nt, Homo Sapiens
cuguagauuucaagacaaguagugaugucauuuucucccugagcuguaggguggaccuggaccc

SEQ ID NO: 72813 - RNA, 64 nt, Homo Sapiens
acagcacuuucccaugguccucacuggccucagucucccugaccggcagugugaggggauguag

SEQ ID NO: 72814 - RNA, 64 nt, Homo Sapiens
cccugcaaaugaaaccaaacgaaccccugcaacccucccugaacgugggacaagagcccucccu

SEQ ID NO: 72815 - RNA, 64 nt, Homo Sapiens
cccugcaacccucccugaacgugggacaagagcccucccugaacgcccucucccuuccccgguu

SEQ ID NO: 72816 - RNA, 64 nt, Homo Sapiens
uuguauugaaaauauuaugcgguucccaucaucccucccugauagccucuagugccuuuugagg

SEQ ID NO: 72817 - RNA, 64 nt, Homo Sapiens
gucuggggucaggcuuuggcagguugggugggcccucccugaggacggggcuccugagggguac

SEQ ID NO: 72818 - RNA, 64 nt, Homo Sapiens
gcccaccagccugugcuguaccaccgcccagcuucucccugaggcaccagccugugcugcauac

SEQ ID NO: 72819 - RNA, 64 nt, Homo Sapiens
gcccaccagccugugcugcaccaccgcccagcuucucccugaggcaccagccugugcugcauac

SEQ ID NO: 72820 - RNA, 64 nt, Homo Sapiens
ucucuaugccuaccuccccccauacccugcugaucucccugagccugccuuugagcccccguca

SEQ ID NO: 72821 - RNA, 64 nt, Homo Sapiens
cgucacguugggcacugcugccaaagacucccuccucccugaugcugggaugugggcucugaau

SEQ ID NO: 72822 - RNA, 64 nt, Homo Sapiens
cugcugcuucccacccagcugagaaugcccccuccucccugacuccucucugcccaugcaaauu

SEQ ID NO: 72823 - RNA, 64 nt, Homo Sapiens
gauggaaagacuugacugcauaaagaugucaguucucccugaguugauugauaggcuuaauggu

SEQ ID NO: 72824 - RNA, 64 nt, Homo Sapiens
aaaccaucaugagagagauaggucuccucuuccucucccugaagccaucccagcucuucaccca

SEQ ID NO: 72825 - RNA, 64 nt, Homo Sapiens
aaggucagugccaccuuaacgccauuguugucagcucccugaucaccccauggucaaugcuggu

SEQ ID NO: 72826 - RNA, 64 nt, Homo Sapiens
ccugggcuauggagagguugucccucaccagcaccucccugacacaccuccugagucacugggg

SEQ ID NO: 72827 - RNA, 64 nt, Homo Sapiens
uccaagauaagaauggccccuuggcccccauuugcucccugagcccucaccauccucuugcguu

SEQ ID NO: 72828 - RNA, 64 nt, Homo Sapiens
agaggaaaaguggucaaagaaaaacucuucauuucucccugauucuuaaacgaaggugguuaau

SEQ ID NO: 72829 - RNA, 64 nt, Homo Sapiens
gugacaaggcaggacaagagccuguuucgcuuuccucccugacccugccaggugccaacucaaa

SEQ ID NO: 72830 - RNA, 64 nt, Homo Sapiens
cccaggacuaugccagaagcugcgcagcucugcccucccugaggcagccugccuggaggauggg

SEQ ID NO: 72831 - RNA, 64 nt, Homo Sapiens
cccuucauuucuucaccgcguugauccuuuucaccucccugauccacccuucuuccccuucuag

SEQ ID NO: 72832 - RNA, 64 nt, Homo Sapiens
ccuggacucgcccaugaaccuguguguccccagucucccugaggucaggaagaagugcccaggg

SEQ ID NO: 72833 - RNA, 64 nt, Homo Sapiens
guuaaccacagaggagucacagguuuuagacaggcucccugaaucccagcauauacaaaagggg

SEQ ID NO: 72834 - RNA, 64 nt, Homo Sapiens
cccccaccacuaccagcucccaccagaugccacccucccugaaccuggggcucaaucccccuuu

SEQ ID NO: 72835 - RNA, 64 nt, Homo Sapiens
ugaaacucccgaaggugcccucccugagaugaaacucccugaggaaaagucccagagaugaagc

SEQ ID NO: 72836 - RNA, 64 nt, Homo Sapiens
ugaaacucccugaggugaaaucccagagaugaagcucccugagaagaagugcagcuuccaaaag

SEQ ID NO: 72837 - RNA, 64 nt, Homo Sapiens
ugcaacucccgaaggugcccuuccugagaugaaacucccugaagaaaggugccugagaugaaac

SEQ ID NO: 72838 - RNA, 64 nt, Homo Sapiens
cuggaaccucugugauccuucugugacgccaguucucccugacuucucccugacucuggaaccu

SEQ ID NO: 72839 - RNA, 64 nt, Homo Sapiens
cuggaaccucugugacgccaugcuccucucaguucucccugacuuggaacucauuucacucagc

SEQ ID NO: 72840 - RNA, 64 nt, Homo Sapiens
cauaguguccccaagaccacuccaggaauaaccccucccugagagacaccggacaugacugccc

SEQ ID NO: 72841 - RNA, 64 nt, Homo Sapiens
cugaauggaaaccuucccacaagaccccaccuaccucccugauguuccacgucgcguggucucc

SEQ ID NO: 72842 - RNA, 64 nt, Homo Sapiens
agcacacucaucccuuugucagagcagaaugugggcugcauauacccccgagugcauggcuugg

SEQ ID NO: 72843 - RNA, 64 nt, Homo Sapiens
acuagaggccucuugugacugcucacuucuggaagcugcauaugugggauaaacaagcaagauu

SEQ ID NO: 72844 - RNA, 64 nt, Homo Sapiens
caccgcccagcuucucccuggcccaccagccugugcugcauacccgcccagcuucucccugagg

SEQ ID NO: 72845 - RNA, 64 nt, Homo Sapiens
caccgcccagcuucucccuggcccaccagccugugcugcauaccccccugcccugccucugagg

SEQ ID NO: 72846 - RNA, 64 nt, Homo Sapiens
uucuggagccuguaguucuugcuuuguaauaaaugcugcauacuugggacaucuguaucucuug

SEQ ID NO: 72847 - RNA, 64 nt, Homo Sapiens
ggagucaguuagaaucguuucaugauuccaacuggcugcauauauucagacccaaagcuuuagg

SEQ ID NO: 72848 - RNA, 64 nt, Homo Sapiens
uugaauugauucuuuagaccggguuuuuuuuuaaugaauagauugauaaaacuagaagaaauga

SEQ ID NO: 72849 - RNA, 64 nt, Homo Sapiens
ucucugucuuggcauucuugcuccuuuuaccaugugaauagauuugugucauucucuaucauca

SEQ ID NO: 72850 - RNA, 64 nt, Homo Sapiens
auauuaauuuugcagaaaugggauaggcauuagaugaauagagacauauacaaaaaaaucuagu

SEQ ID NO: 72851 - RNA, 64 nt, Homo Sapiens
aggaagaacaauguucuuacuguuaaaaugacccugaauagaauaaugaagcugaaggcucaca

SEQ ID NO: 72852 - RNA, 64 nt, Homo Sapiens
cuuuuuuuauuucuuuuaggucuagggacaggagugaauagaaagggaggagagcucuauuaug

SEQ ID NO: 72853 - RNA, 64 nt, Homo Sapiens
cauuucuuugaggagaucaguauuguaacguaugugaauagaugauaacaauuaauauuacuaa

SEQ ID NO: 72854 - RNA, 64 nt, Homo Sapiens
gagcacaguaaguaugcauuucuguggaucugucugaauagaaaggaaugcucuugaaaggugg

SEQ ID NO: 72855 - RNA, 64 nt, Homo Sapiens
aguuuuucucaguaacuuacguuuuccagccaguugaauagauuugcacugggccuaucuuuuu

SEQ ID NO: 72856 - RNA, 64 nt, Homo Sapiens
uucacuuauuuauuaucauaaaaauuuaccagucugaauagaucuuguaaauauuugugaauag

SEQ ID NO: 72857 - RNA, 64 nt, Homo Sapiens
auuuaccagucugaauagaucuuguaaauauuugugaauagaaugaauaccuuucaugccacug

SEQ ID NO: 72858 - RNA, 64 nt, Homo Sapiens
uuuucauaagaguuuaaaugauguggacuagugaugaauagauagagcaaugucauuaauccau

SEQ ID NO: 72859 - RNA, 64 nt, Homo Sapiens
aucuucuguucccaacacugaauuuuugcgauauugaauagaacugagaaguaaagauaguugg

SEQ ID NO: 72860 - RNA, 64 nt, Homo Sapiens
uaaaacacuggacuagaagagauaaugauugaaacauuuaaaaaaaaaaagugcuccauucgca

SEQ ID NO: 72861 - RNA, 64 nt, Homo Sapiens
uacacuccugcugaaaaauguuaauccaaauacacauuuaaacuuagggucgguccuuauucug

SEQ ID NO: 72862 - RNA, 64 nt, Homo Sapiens
uuuugcaagaaaaaucuuugaauaagacuaacugcauuuaaaaggaauaaccuccuucucccuu

SEQ ID NO: 72863 - RNA, 64 nt, Homo Sapiens
ccaacuacaaaaauguuuggcaacuuuguguuuacauuuaaagaucauuugcaccuuuuucaag

SEQ ID NO: 72864 - RNA, 64 nt, Homo Sapiens
uguuucacucaugucugucauuuuauaagcauaucauuuaaaaagcuucuaaaaagcuauuucg

SEQ ID NO: 72865 - RNA, 64 nt, Homo Sapiens
gaugaaaauauauuucccuguaagcugaauuacucauuuaaaaauuuuaacuucuauaugggac

SEQ ID NO: 72866 - RNA, 64 nt, Homo Sapiens
uagugaaaaauucgcauucuggcugauuuuaagccauuuaaaauuuauauaaaacaaccuucca

SEQ ID NO: 72867 - RNA, 64 nt, Homo Sapiens
auauuaggcauguuuggaggcuuuccuauucuagcauuuaaauuuaaauuuuauuaaaauuaaa

SEQ ID NO: 72868 - RNA, 64 nt, Homo Sapiens
uaaauuuuauuaaaauuaaauaauuuaaaucuagcauuuaaauuuaaauaauuuaagucuagca

SEQ ID NO: 72869 - RNA, 64 nt, Homo Sapiens
ugcuagugaugaaucaaauauauuuuccuugaagcauuuaaauuugaauuaagccuucauagcg

SEQ ID NO: 72870 - RNA, 64 nt, Homo Sapiens
gaaaaguccuaaauuuaccuuauauuauugaugacauuuaaaggaaaaugauuaccucuugaga

SEQ ID NO: 72871 - RNA, 64 nt, Homo Sapiens
caguauauucaguaguugaauugucucacuccaucauuuaaaacgcacgucagcaagagccucu

SEQ ID NO: 72872 - RNA, 64 nt, Homo Sapiens
uugaugcuuaguuauguugcuaggaauuuugacucauuuaaacuagauuugugaagacaucaga

SEQ ID NO: 72873 - RNA, 64 nt, Homo Sapiens
uuuaggggauauuguaacccauaccaauaaaaagcauuuaaaaauaagugggaaaugagaaguu

SEQ ID NO: 72874 - RNA, 64 nt, Homo Sapiens
acaguuucccauaugaguaacaucagaauuuucucauuuaaaggguuuuggaccuccuucaugg

SEQ ID NO: 72875 - RNA, 64 nt, Homo Sapiens
agcucagaauaucacauugaaauuacuauaaauacauuuaaaauuaucuauuuuagaucuaagg

SEQ ID NO: 72876 - RNA, 64 nt, Homo Sapiens
aacguuuuccugaagcuguuucuggagagccacacauuuaaauacagacagcuuuccugaucau

SEQ ID NO: 72877 - RNA, 64 nt, Homo Sapiens
uuagacucccuacaguccuucaauggaaaaguaacauuuaaaaauccuuuggguaauucgaauu

SEQ ID NO: 72878 - RNA, 64 nt, Homo Sapiens
uuuuauaauuuuacuauuccagggugacauaaugcauuuaaauuugggauuuggguggaguauu

SEQ ID NO: 72879 - RNA, 64 nt, Homo Sapiens
uacauuuaguaaaguccccaagacauuagucuuacauuuaaacuuuuuucuuuaaaacaugguu

SEQ ID NO: 72880 - RNA, 64 nt, Homo Sapiens
ugaguuugaaaaagaaaaucuccagcaagcaucucauuuaaauaaagguuugucaucuuuaaaa

SEQ ID NO: 72881 - RNA, 64 nt, Homo Sapiens
auaggugugacccuacuaauaauuauuagaaauacauuuaaaaacaucgaguaccucaagucag

SEQ ID NO: 72882 - RNA, 64 nt, Homo Sapiens
cccauuuugaaauugccuauacagucuuagugaccauuuaaaccggacgaacuagguguuuaau

SEQ ID NO: 72883 - RNA, 64 nt, Homo Sapiens
uagauaaauaauaauagcccugagauguuucuaacauuuaaauaagaaaaaaaucaaaucgaag

SEQ ID NO: 72884 - RNA, 64 nt, Homo Sapiens
gcuaugcagaaauagagaucgaaccaaaaaaaaucauuuaaacuuuaaaaauauuuuaaaugga

SEQ ID NO: 72885 - RNA, 64 nt, Homo Sapiens
uggcugucaugguacccaagugacuuggaagaugcauuuaaauuacucagcugaaaucacuuga

SEQ ID NO: 72886 - RNA, 64 nt, Homo Sapiens
gaucacugucucaaagagauauuaaaauuuuauacauuuaaaaucauuguuaaauugauugagg

SEQ ID NO: 72887 - RNA, 64 nt, Homo Sapiens
uaaaaucauuguuaaauugauugaggaaaacaaccauuuaaaaaaaaucuauguugaauccuuu

SEQ ID NO: 72888 - RNA, 64 nt, Homo Sapiens
ugguaguggaaauucuaugccaagacuuguuauccauuuaaaaaccauugucuuggugguguua

SEQ ID NO: 72889 - RNA, 64 nt, Homo Sapiens
ugacauucuuaaaaaaagaaauucuuaagacuugcauuuaaaugacaaugaugauuaacuauga

SEQ ID NO: 72890 - RNA, 64 nt, Homo Sapiens
uagaacagguauauaagcuagugguacuauuugccauuuaaaacauaugauuuauuagcacaac

SEQ ID NO: 72891 - RNA, 64 nt, Homo Sapiens
aauaacaaacauuuuuuaaacaaugaaaagcccccauuuaaaaaguuuccaauggcucaggaga

SEQ ID NO: 72892 - RNA, 64 nt, Homo Sapiens
auguuaaauuggcuugaaaucaucgugaaagguacauuuaaaauuaagugcaccuagcuuauua

SEQ ID NO: 72893 - RNA, 64 nt, Homo Sapiens
uauucuucugaacucaucaaauaguuuucucaaccauuuaaaaagguuauuccaguaaaaggaa

SEQ ID NO: 72894 - RNA, 64 nt, Homo Sapiens
agaaucuaauuuuuaaagguagcaaacuacuaagcauuuaaaagaacuugcucugaccccucua

SEQ ID NO: 72895 - RNA, 64 nt, Homo Sapiens
cacccaugaaagaaaacuuuuaugcaaggucuugcauuuaaaagacagcuuugcgaauauuuug

SEQ ID NO: 72896 - RNA, 64 nt, Homo Sapiens
uugauaaccauagcauuaauacgcccauuauggucauuuaaauugggguuuauuucagcaaacu

SEQ ID NO: 72897 - RNA, 64 nt, Homo Sapiens
cuauaaaaugcaguaacauucuacuugcuuauuacauuuaaauccuuguguaacugaauguuua

SEQ ID NO: 72898 - RNA, 64 nt, Homo Sapiens
guuuauggugagguuuaaaggauaugaaacucuacauuuaaacaaguauuuuauauuuggguac

SEQ ID NO: 72899 - RNA, 64 nt, Homo Sapiens
cgguuugugguacacaaagaaucugccuuauaaacauuuaaaaccuggaaccagcaguucagag

SEQ ID NO: 72900 - RNA, 64 nt, Homo Sapiens
ugaccaaagacaauuaauucaccagcaaguuguucauuuaaaacucagucuauucuaggaauga

SEQ ID NO: 72901 - RNA, 64 nt, Homo Sapiens
aguaaggguaaaaaagauaauuguuggagugaagcauuuaaaagaagggaauaaauuuuugucu

SEQ ID NO: 72902 - RNA, 64 nt, Homo Sapiens
ugaucuguaguuuuuuugguacuaugaauuuguccauuuaaaaaacaccucagaaauugaaagc

SEQ ID NO: 72903 - RNA, 64 nt, Homo Sapiens
agaaagaacaugggugguacaaucugagaggccccauuuaaaaaggugauccgaugugcagcca

SEQ ID NO: 72904 - RNA, 64 nt, Homo Sapiens
uccagaugcccacaccacaccaaccaccugggagcauuuaaaacccccaccuugcagcgcauuc

SEQ ID NO: 72905 - RNA, 64 nt, Homo Sapiens
gaagaaccaaaacucucuucgauuugauuuucuacauuuaaaaugacacaaaucaaaugugaag

SEQ ID NO: 72906 - RNA, 64 nt, Homo Sapiens
aauaaguaaaucuaggcuauaaguuuuuaaugagcauuuaaaaacauuuuacuacauaguauac

SEQ ID NO: 72907 - RNA, 64 nt, Homo Sapiens
gcagacaguguuuugcacauauuccaucacaucacauuuaaauuagauuuguaauggcucccaa

SEQ ID NO: 72908 - RNA, 64 nt, Homo Sapiens
caaaguucuuuauugggugggcuuuuaguaaaaacauuuaaauaagagcaaagguuaauuuugu

SEQ ID NO: 72909 - RNA, 64 nt, Homo Sapiens
auaauugcgaauaucagaaauauugaguaguugucauuuaaaauaagaguuuaaaaguuuagcu

SEQ ID NO: 72910 - RNA, 64 nt, Homo Sapiens
uccucaagaaaggauugguaauugcucaaccaugcauuuaaaacucacauccucauacaauuua

SEQ ID NO: 72911 - RNA, 64 nt, Homo Sapiens
uaaacaguaauagcuacguuugggaaggaggaaacauuuaaauuauaaaggacugaauaaucua

SEQ ID NO: 72912 - RNA, 64 nt, Homo Sapiens
auacuuguggcuuuuauuaucuuuaaacuuguugcauuuaaaauauuuuuaaaaccuucuuaac

SEQ ID NO: 72913 - RNA, 64 nt, Homo Sapiens
uuaguuuauuaucagauaucuaaaaauuauuaaacauuuaaaaaaucuggcauuuuuaaacauu

SEQ ID NO: 72914 - RNA, 64 nt, Homo Sapiens
uuauuaaacauuuaaaaauucuggcauuuuuaaacauuuaaaaacuguuagaaauuaguuuuau

SEQ ID NO: 72915 - RNA, 64 nt, Homo Sapiens
ccauuuauauacuuuaaggagaaugcuguaauuccauuuaaauuuuaaauuaauuuucauguuu

SEQ ID NO: 72916 - RNA, 64 nt, Homo Sapiens
uaccaaauagaaacaccuucucccaaaucuauagcauuuaaagagccaaagcuguuaguuaaaa

SEQ ID NO: 72917 - RNA, 64 nt, Homo Sapiens
acauuuuacagauuuuauggauacaaguuacauacauuuaaaaaucuaaaaguaauaaauucca

SEQ ID NO: 72918 - RNA, 64 nt, Homo Sapiens
cacaguccugagagggaugguguauuauuuuaugcauuuaaaaauuuuuuauuuuaguccuauu

SEQ ID NO: 72919 - RNA, 64 nt, Homo Sapiens
acacaaucuuaaggggauaguguauuauuuugugcauuuaaaaaguuuuuauuucagcccuauu

SEQ ID NO: 72920 - RNA, 64 nt, Homo Sapiens
caacagauaucauuucagguuuuacauuaaugagcauuuaaauggaaauggauuuguucagcca

SEQ ID NO: 72921 - RNA, 64 nt, Homo Sapiens
guuaggaggcuuggagcuaucauuuuguaauuuucauuuaaauuuuccaaaauagggucucaaa

SEQ ID NO: 72922 - RNA, 64 nt, Homo Sapiens
auuaagaguauuuugcauuaaacgagaaauacaacauuuaaaaagugaacuauuaauauuuaaa

SEQ ID NO: 72923 - RNA, 64 nt, Homo Sapiens
acacaauucagugguuuuaaaccauauaaucacacauuuaaaauucaugagauacaauucacau

SEQ ID NO: 72924 - RNA, 64 nt, Homo Sapiens
auuaaacuuaaauaagugugcuaaggguaaaagacauuuaaagaaaauuuaaaauuucacaaaa

SEQ ID NO: 72925 - RNA, 64 nt, Homo Sapiens
uuuaaaaauuuaaaauuucauuuaaauuuucagucauuuaaaauuuuguuucagucauuuaaaa

SEQ ID NO: 72926 - RNA, 64 nt, Homo Sapiens
uuaaauuuucagucauuuaaaauuuuguuucagucauuuaaaauauuuugaauaauaauguuua

SEQ ID NO: 72927 - RNA, 64 nt, Homo Sapiens
aaaauauugaacucaaugauagcaccuaaacuuacauuuaaaagacagacauuccuucuacaug

SEQ ID NO: 72928 - RNA, 64 nt, Homo Sapiens
gguaagaggaagcuuacauuacauguccaguccacauuuaaagagcacuuacuguggaacaagc

SEQ ID NO: 72929 - RNA, 64 nt, Homo Sapiens
auguguuccauagauaucuuaauguaaaauuagucauuuaaauuacacugucaauuaaaaguaa

SEQ ID NO: 72930 - RNA, 64 nt, Homo Sapiens
acucaccuauaggagauuauuuuuaaguggaauccauuuaaacucaaaacaguuaugaaaagca

SEQ ID NO: 72931 - RNA, 64 nt, Homo Sapiens
uccugcauuuuaaggucuaaguuuaacuggucaacauuuaaauggauuggagcuauuaguacau

SEQ ID NO: 72932 - RNA, 64 nt, Homo Sapiens
auguuaaggccacagcacacauuuucaguaaauacauuuaaacaagccggaccauuuuuaguau

SEQ ID NO: 72933 - RNA, 64 nt, Homo Sapiens
auaucuuaaaaaagcagcaguccaucugggcacucauuuaaagucaaauaucuuaaagguaaaa

SEQ ID NO: 72934 - RNA, 64 nt, Homo Sapiens
gaauuuaauugaccgauauugugucaauauuuugcauuuaaaauagagguuuaacagugaaauu

SEQ ID NO: 72935 - RNA, 64 nt, Homo Sapiens
uauauagcuugaaagcaguuguauguuuuaauugcauuuaaaaauugaaauuuacugugagacu

SEQ ID NO: 72936 - RNA, 64 nt, Homo Sapiens
ggaaaagagagauuggauuucuucagaacagaggcauuuaaaaucagggacaaagaaauccccc

SEQ ID NO: 72937 - RNA, 64 nt, Homo Sapiens
uuuaauuuccauuaaaaagcaaauagcauugacacauuuaaagcuuuucauuuaaaguagugga

SEQ ID NO: 72938 - RNA, 64 nt, Homo Sapiens
aaaagcaaauagcauugacacauuuaaagcuuuucauuuaaaguaguggauguuuuugaaguau

SEQ ID NO: 72939 - RNA, 64 nt, Homo Sapiens
uacagucauuuaugccuaaagccuggugauuauucauuuaaaugaagaucacauuucauaucaa

SEQ ID NO: 72940 - RNA, 64 nt, Homo Sapiens
uccaauugaauuaaaguguggccucguuuuuagucauuuaaaauuguuuucuaaguaauugcug

SEQ ID NO: 72941 - RNA, 64 nt, Homo Sapiens
uacuguucacacuuuauuacuuacuaucuuuaagcauuuaaaaaauuuugaagaugagcauaua

SEQ ID NO: 72942 - RNA, 64 nt, Homo Sapiens
aacauuuuucucuccaacauuuuggaaaguuaaccauuuaaaaggagacgcgucagauggcaga

SEQ ID NO: 72943 - RNA, 64 nt, Homo Sapiens
uuaaaaaauuauguuccaaguuaaccuauauaaccauuuaaaauuugaaaagcaaaaaauacua

SEQ ID NO: 72944 - RNA, 64 nt, Homo Sapiens
uuaaucaguuacaguaaagauuuuugaaaacuaacauuuaaaaaaaauaucucaaguagaaaag

SEQ ID NO: 72945 - RNA, 64 nt, Homo Sapiens
uaauuucuauucaaaauacaagcauucucucugacauuuaaaaaauuucaaguuggccaauaau

SEQ ID NO: 72946 - RNA, 64 nt, Homo Sapiens
aaugaagacacugaaauacauaguccaguucucucauuuaaaaaguagguacuuauauaaaauc

SEQ ID NO: 72947 - RNA, 64 nt, Homo Sapiens
uuaaaggaauggaguuuuucuagccuuuaagcaucauuuaaauuaacuugcacaauguugaaca

SEQ ID NO: 72948 - RNA, 64 nt, Homo Sapiens
ucuuuuuagaaaauaacauaaaugauggcuggaucauuuaaagucuuauuuucuuuuaaugugc

SEQ ID NO: 72949 - RNA, 64 nt, Homo Sapiens
aaauuuuaauacuuguuugaaacuuaaaaacguucauuuaaauauucccuuaacauggcucaau

SEQ ID NO: 72950 - RNA, 64 nt, Homo Sapiens
cgugaaauuuguuaucuuugauguuguuuuaagacauuuaaaaauguuuauaaacauuacaacu

SEQ ID NO: 72951 - RNA, 64 nt, Homo Sapiens
ucaucuauuuuuggcagucugaauuuuuaaaacccauuuaaauuuuuuuccuuaccuuuuuauu

SEQ ID NO: 72952 - RNA, 64 nt, Homo Sapiens
uaauuaccaaccuguuaccuacuuugacuuuuugcauuuaaaacagacacuggcauggauauag

SEQ ID NO: 72953 - RNA, 64 nt, Homo Sapiens
aguuuaaagggaauuguguggccucuagccuagucauuuaaagaaggauguaacuuauaacauu

SEQ ID NO: 72954 - RNA, 64 nt, Homo Sapiens
uguacacuuccuccuuauuggaauauuuaaguugcauuuaaacuaaaacuaguauaauuuaguc

SEQ ID NO: 72955 - RNA, 64 nt, Homo Sapiens
uuuuauaguauaaaguauuuugacuuauaccucucauuuaaauacaaagacaggaucauacaca

SEQ ID NO: 72956 - RNA, 64 nt, Homo Sapiens
guaauucagaagaacagugucagaacaaaucacucauuuaaaaauaauuuuaauaaaagugaac

SEQ ID NO: 72957 - RNA, 64 nt, Homo Sapiens
acuucccucaauucuguaaacauguguauuuugacauuuaaaauauaugcuaaaucacauucag

SEQ ID NO: 72958 - RNA, 64 nt, Homo Sapiens
auaauuguguuugaccccaagggcggacugauaacauuuaaaaauuacaaaaguucuuauuacu

SEQ ID NO: 72959 - RNA, 64 nt, Homo Sapiens
aaaaugggauaagaauagucaagaaaaaacuaaacauuuaaacaugauuuaaaaucaaaucaaa

SEQ ID NO: 72960 - RNA, 64 nt, Homo Sapiens
auccaauuggauuauucuuauaugugcauuuccucauuuaaaaagaaaaguuuaaucuaaauga

SEQ ID NO: 72961 - RNA, 64 nt, Homo Sapiens
aguuaugguguagcugcugcuaacuaaugacacacauuuaaauccuguaaaauguggcucuaaa

SEQ ID NO: 72962 - RNA, 64 nt, Homo Sapiens
aaauuacuguuuuauguugaaagagauuucccuucauuuaaacuguauguugucauaacauuua

SEQ ID NO: 72963 - RNA, 64 nt, Homo Sapiens
gauuucccuucauuuaaacuguauguugucauaacauuuaaagaagaaaagguucuucuuggga

SEQ ID NO: 72964 - RNA, 64 nt, Homo Sapiens
auucaacauuguguaaaugaucuucaugcucauucauuuaaagcaucacuuuccagcccagcac

SEQ ID NO: 72965 - RNA, 64 nt, Homo Sapiens
aguguguagagggaaauuuagaaucucugggacacauuuaaagcaacaaagacacaacauacca

SEQ ID NO: 72966 - RNA, 64 nt, Homo Sapiens
ugcuaacaucacugucauagcauuuugcauuuuacauuuaaauauugcauauuuaaaaauuaau

SEQ ID NO: 72967 - RNA, 64 nt, Homo Sapiens
ugauaauaucuguaaugacaauacaaaaacuuaacauuuaaaacaaagauauuuauauauugcc

SEQ ID NO: 72968 - RNA, 64 nt, Homo Sapiens
auguucuaagguacauauacagggauuccauaaacauuuaaacacuauuuuccugaaaugcuuc

SEQ ID NO: 72969 - RNA, 64 nt, Homo Sapiens
gugaauuauuaaaaaucuuuaugaaacaaaagaccauuuaaauauaguauuguuguaaaacuuc

SEQ ID NO: 72970 - RNA, 64 nt, Homo Sapiens
ugauaauagcagggaauucuuaaaaaugugaaaacauuuaaaaaccaaaaggguaaggcaguuu

SEQ ID NO: 72971 - RNA, 64 nt, Homo Sapiens
uacuauguucuggaugaaaaagagguaaaaucuucauuuaaauaauguacaaacuaaaugggua

SEQ ID NO: 72972 - RNA, 64 nt, Homo Sapiens
auuucuaaaagggucuuuucuuuuaaagagugaucauuuaaauaauucugagauuaaaaaaaau

SEQ ID NO: 72973 - RNA, 64 nt, Homo Sapiens
ccagaaauggucaagcaauuauauucugggaggucauuuaaaugcuagucucagggcuugugua

SEQ ID NO: 72974 - RNA, 64 nt, Homo Sapiens
uccuauaccuucugaugggaguaaaacuguguagcauuuaaauuaaaauuuuuuagcaauuuuu

SEQ ID NO: 72975 - RNA, 64 nt, Homo Sapiens
uuuaaaaauugaagugcaaauauuaaaaguggcacauuuaaaaaagaaaguaguuuguaauuga

SEQ ID NO: 72976 - RNA, 64 nt, Homo Sapiens
ugggaaguggcuuccccaggaauuccugauagaacauuuaaaugaaacuucuggcuucuagaca

SEQ ID NO: 72977 - RNA, 64 nt, Homo Sapiens
ucacuguuaacacuuuucacuaaaaucauguaaccauuuaaaugcuuauuaucaaaagaauaau

SEQ ID NO: 72978 - RNA, 64 nt, Homo Sapiens
guuuucugaaaaaacuuuugugguuuauuaauuacauuuaaaaaacuagaaugacagauucagg

SEQ ID NO: 72979 - RNA, 64 nt, Homo Sapiens
aaauacuguuuguuuaaagcuuguuagauucucucauuuaaaaauggugcuggucagacuuuuu

SEQ ID NO: 72980 - RNA, 64 nt, Homo Sapiens
uaacugggucuuagcauccugucuuucuaaaaaccauuuaaagcaaccacuuuugacuagguaa

SEQ ID NO: 72981 - RNA, 64 nt, Homo Sapiens
gcaccuugcagaaaugcauuguaccauaugaguucauuuaaacuaaagcuucuuuccauaucaa

SEQ ID NO: 72982 - RNA, 64 nt, Homo Sapiens
uaugguucaaguacugcucuacauaaauagaacucauuuaaaaguuguauuggggauauguuuu

SEQ ID NO: 72983 - RNA, 64 nt, Homo Sapiens
uuuaaauugaaaaugggccagaagcaagcuaaaucauuuaaauggacuaucaagagugaccuuu

SEQ ID NO: 72984 - RNA, 64 nt, Homo Sapiens
auuuucugugacuucaaauuucuucagaauuagccauuuaaaaucaaaauggauucuugucucc

SEQ ID NO: 72985 - RNA, 64 nt, Homo Sapiens
cuucauucugauaucauuacgucaguuugacuuucauuuaaaucgcuagaugccuuuuuccccu

SEQ ID NO: 72986 - RNA, 64 nt, Homo Sapiens
ccccaggggaaaaugaagguuaggauuuaacagucauuuaaaaaaaaaauuuguuuugacggau

SEQ ID NO: 72987 - RNA, 64 nt, Homo Sapiens
aaaaaaauuuguuuugacggaugauuggauuauucauuuaaaaugauuagaaggcaaguuucua

SEQ ID NO: 72988 - RNA, 64 nt, Homo Sapiens
ggaaaguuugauaauacggauuguacacuacuuucauuuaaagggcccgccaagguugggagga

SEQ ID NO: 72989 - RNA, 64 nt, Homo Sapiens
aaugcaguugcucuagugaauacuuugcucucaacauuuaaaauuuccgaaguuaggaccuagu

SEQ ID NO: 72990 - RNA, 64 nt, Homo Sapiens
uuauacaagauugaaaaucuuguguaaauccugccauuuaaaaaguuguagcagauuguuuccu

SEQ ID NO: 72991 - RNA, 64 nt, Homo Sapiens
gcuuuauugcuuuuuuguauugguuaaaacuguacauuuaaaauugcuauguuacuauuuucua

SEQ ID NO: 72992 - RNA, 64 nt, Homo Sapiens
uguuuucuuuuuucuguuuuuuucuuuguuaauucauuuaaacucauugaaaacauaguauaca

SEQ ID NO: 72993 - RNA, 64 nt, Homo Sapiens
cucacccaauguacaaccaaugaaauaaaagaagcauuuaaaaggauuguauagucuuccuucu

SEQ ID NO: 72994 - RNA, 64 nt, Homo Sapiens
uugucuucaaguaaucugacagcauuaaauauugcauuuaaaaauuauacuguagcaaauacau

SEQ ID NO: 72995 - RNA, 64 nt, Homo Sapiens
aauauugcauuuaaaaauuauacuguagcaaauacauuuaaaaauuaaucacaacguuaagaug

SEQ ID NO: 72996 - RNA, 64 nt, Homo Sapiens
acagaaaaaagcaaauauaaauuuuuaaugacuccauuuaaaaauaucacagggugggggcaag

SEQ ID NO: 72997 - RNA, 64 nt, Homo Sapiens
uuuucccuccaguuuuuccucuaguucuuuuaggcauuuaaauuguuucuguuacucugugcaa

SEQ ID NO: 72998 - RNA, 64 nt, Homo Sapiens
aaggguaacuaugacaaagauacuuuugagauaacauuuaaaaguacuuuauauuuuacauaau

SEQ ID NO: 72999 - RNA, 64 nt, Homo Sapiens
aguuugccggcuaggugcggccacccccgccaaccauuuaaaaacauuacucauuugauuuccc

SEQ ID NO: 73000 - RNA, 64 nt, Homo Sapiens
gagugcucaucucauugaggggaucuguaaagaucauuuaaaugugacaggacagcaacuucag

SEQ ID NO: 73001 - RNA, 64 nt, Homo Sapiens
cugaauucauuuucuuagauuccuuacuauaaaucauuuaaaaauggaauuguuuuccuguuuu

SEQ ID NO: 73002 - RNA, 64 nt, Homo Sapiens
auaucauauaguaaaugcaauuugaguauaugcacauuuaaaaauuggaaguuuguaccaucug

SEQ ID NO: 73003 - RNA, 64 nt, Homo Sapiens
uguuuuuuauagaauucuauuagcaacucugauucauuuaaauaucacauccuuguucuuuauu

SEQ ID NO: 73004 - RNA, 64 nt, Homo Sapiens
aaaacacucuaguuuugcaaacaaaacauuuucccauuuaaagguuucaugaagccccaaggac

SEQ ID NO: 73005 - RNA, 64 nt, Homo Sapiens
uucuuauagaauucuuuaugcagugaauucuugacauuuaaauccguuaggcuuugaggcuuuu

SEQ ID NO: 73006 - RNA, 64 nt, Homo Sapiens
acuguauuuucauacuuuuuaaacuuuauugccacauuuaaaggugauuuuauaucaguauguu

SEQ ID NO: 73007 - RNA, 64 nt, Homo Sapiens
uaaaaugucauguuauuaacaguuauuagguugucauuuaaaaauaaaguuccuuuauauuucu

SEQ ID NO: 73008 - RNA, 64 nt, Homo Sapiens
uuugauucaguauucuuuuaucauaaauuuuuagcauuuaaaaauucacugauguacauuaagc

SEQ ID NO: 73009 - RNA, 64 nt, Homo Sapiens
aaugacuugaauuucucagauccuauugugaagucauuuaaaaugaaaauauacaugaugggau

SEQ ID NO: 73010 - RNA, 64 nt, Homo Sapiens
uacuuuuuaaggccauuuuagaauucaauauuugcauuuaaaaaugucuuaaaggaagcaucaa

SEQ ID NO: 73011 - RNA, 64 nt, Homo Sapiens
uccuuuucuuccacuuuaauuuaaaaguucaugucauuuaaaaacaagucaagaaauuaaaauu

SEQ ID NO: 73012 - RNA, 64 nt, Homo Sapiens
cagaaaauggacugaagucugaauaaggucauugcauuuaaaaagcauauaacuguacuugacu

SEQ ID NO: 73013 - RNA, 64 nt, Homo Sapiens
uagguauguaggaauagucacucacuggcugauacauuuaaagcagcagugugaauagcaagga

SEQ ID NO: 73014 - RNA, 64 nt, Homo Sapiens
aagaauacugagaacggcauaaagugaagaucgacauuuaaaaaaugaggugaaagaaagcuau

SEQ ID NO: 73015 - RNA, 64 nt, Homo Sapiens
uugcaagaaacucuuuuauuaaacuuggaacaaccauuuaaaugaaggauuuugugagauagaa

SEQ ID NO: 73016 - RNA, 64 nt, Homo Sapiens
auuguuuuuagucuugcuugaggaaugcacacuccauuuaaaaaauugugcgcucuguagauuu

SEQ ID NO: 73017 - RNA, 64 nt, Homo Sapiens
uuacaaaaagaaaaaaaaaauccuguuguauuaacauuuaaaaacagaauuguguuaugugauc

SEQ ID NO: 73018 - RNA, 64 nt, Homo Sapiens
uuaaaaagauacuucuguaacuuaagaaaccuggcauuuaaaucauauuuugucuuuagguaaa

SEQ ID NO: 73019 - RNA, 64 nt, Homo Sapiens
ggaaaugcagaaagcugugauuguaacauacauacauuuaaaauuaguaacuuaauauguaaag

SEQ ID NO: 73020 - RNA, 64 nt, Homo Sapiens
accccaaugucucucuuuuucucaagauacuauacauuuaaagcgggaaugaaacauuuauggc

SEQ ID NO: 73021 - RNA, 64 nt, Homo Sapiens
uauuaaagcauguuauuugauaaguuuuaaguaacauuuaaaaaugcugcguaucuugucucaa

SEQ ID NO: 73022 - RNA, 64 nt, Homo Sapiens
gacaugggugucgguuuuguacaaucuaccucaucauuuaaaauuucacuuuacugcauaggaa

SEQ ID NO: 73023 - RNA, 64 nt, Homo Sapiens
ucuuucuuuuuagcuauacauauccauuauuggacauuuaaauuuaaugacuaucaaguuuauu

SEQ ID NO: 73024 - RNA, 64 nt, Homo Sapiens
uuuuuguguuuuuaggagauaauuuuguuuucugcauuuaaacauauaauuguauucuacaaac

SEQ ID NO: 73025 - RNA, 64 nt, Homo Sapiens
aucccaggagccaaccucccccuuugcagggcugcauuuaaaaauuagguuugggacaguucuu

SEQ ID NO: 73026 - RNA, 64 nt, Homo Sapiens
uauuuagcaccugccagaugccagaaauuuauaccauuuaaaacucaguaagucuuuuaaauau

SEQ ID NO: 73027 - RNA, 64 nt, Homo Sapiens
ugaguaauuuuuacauuucuaagacauuaaaucccauuuaaauucugugugaacauuaaagaca

SEQ ID NO: 73028 - RNA, 64 nt, Homo Sapiens
aaacuguacaaagaagacgacuguuuuccauuuccauuuaaacauuuuuagccacuucauuucu

SEQ ID NO: 73029 - RNA, 64 nt, Homo Sapiens
ggucaaauuugucuuguuauuugugaguacaguacauuuaaaaaacauccuuaucgguuauuuu

SEQ ID NO: 73030 - RNA, 64 nt, Homo Sapiens
uuggaggcugggugcuguggucucacaaggggcucauuuaaaauggacagcagauucuuuuccu

SEQ ID NO: 73031 - RNA, 64 nt, Homo Sapiens
ggaauuucuauuuuugaaauucgcacacgggcggcauuuaaauaagaagcaaauaucaggccug

SEQ ID NO: 73032 - RNA, 57 nt, Homo Sapiens
aagccaagguagguguuugauagaacacauuuaaacaucaguauuaugaaaacuugu

SEQ ID NO: 73033 - RNA, 64 nt, Homo Sapiens
agaauuucauccaaauguuacccuguaauacuggcauuuaaaauucuuauuuaaccuuccuccc

SEQ ID NO: 73034 - RNA, 64 nt, Homo Sapiens
aauauguaaaggguauacauuaauugguacguagcauuuaaaaucaggucuuauaauuaaugcu

SEQ ID NO: 73035 - RNA, 64 nt, Homo Sapiens
uuucugacauagcauuuauguauaauaaaccagacauuuaaaguguacaauuugaugaguuuug

SEQ ID NO: 73036 - RNA, 64 nt, Homo Sapiens
uaugccuuaucagaaucuaaaugaaaauagcgaacauuuaaaagcuaucaccauuguaguagaa

SEQ ID NO: 73037 - RNA, 64 nt, Homo Sapiens
uauaacuauacuugucaaauagcaccuaucuaugcauuuaaaaaugcauuaauaucuaacauaa

SEQ ID NO: 73038 - RNA, 64 nt, Homo Sapiens
cccaaguaucuguuuauauaguuaguuuucagcucauuuaaaagaggcaaaaauuaaaagcuug

SEQ ID NO: 73039 - RNA, 64 nt, Homo Sapiens
ugcugcugcugugcucuguaaauucugaauaugacauuuaaacucugugccuacuaaagguauc

SEQ ID NO: 73040 - RNA, 64 nt, Homo Sapiens
auucucuauucaagugggaagucaguaugcauuacauuuaaauuuauuugauacugugcuugcu

SEQ ID NO: 73041 - RNA, 64 nt, Homo Sapiens
gugcauauuggagcagaacauaacauuguugggccauuuaaaauaugcauuuacauccuagauu

SEQ ID NO: 73042 - RNA, 62 nt, Homo Sapiens
aagagacuauauggccuucauucguucuuacuucccugaagcuauguguucuuuuuguucau

SEQ ID NO: 73043 - RNA, 62 nt, Homo Sapiens
uugaacccacacacaccccuugaaauugaugaucccugaaggauuggccacacgcuggaagc

SEQ ID NO: 73044 - RNA, 62 nt, Homo Sapiens
caugauuggcauauguuagaaacugauacaaaucccugaaacugauuguuuuagccugcucg

SEQ ID NO: 73045 - RNA, 62 nt, Homo Sapiens
uaguuaacugugucuaaaguuggaacuuuuguucccugaagcuaauguuucuucauugauua

SEQ ID NO: 73046 - RNA, 62 nt, Homo Sapiens
aggacggggcugugucugccucagacugggaaucccugaagauggggccgugucucccucaa

SEQ ID NO: 73047 - RNA, 62 nt, Homo Sapiens
aggacggggcugugucucccucagacuggggcucccugaagaaagggcugcuucucccucag

SEQ ID NO: 73048 - RNA, 62 nt, Homo Sapiens
aagaaagggcugcuucucccucagacuggagcucccugaagauggggcugugucccccucag

SEQ ID NO: 73049 - RNA, 62 nt, Homo Sapiens
uaaauagacuugaggaauccucuaccacagugucccugaaaccacaugcaucauucaggaag

SEQ ID NO: 73050 - RNA, 62 nt, Homo Sapiens
ucaggaagccuucacccugugacuauucagccucccugaauaugcuuucucuauagaaccac

SEQ ID NO: 73051 - RNA, 62 nt, Homo Sapiens
auuauuuuaagaugagacaagauuauugucaaucccugaaugucuggaguuaccucccaugg

SEQ ID NO: 73052 - RNA, 62 nt, Homo Sapiens
cuaauuaaggguugcaguccugaagcccugccucccugaagguggugaccucuuccuaaacu

SEQ ID NO: 73053 - RNA, 62 nt, Homo Sapiens
augaagaaacagggcuggauucuccaucugcaucccugaaaaacaucacugucaccucugaa

SEQ ID NO: 73054 - RNA, 62 nt, Homo Sapiens
ccugcaaaugaaaccaaacgccccugcaacccucccugaaccggacaagagcccucccugaa

SEQ ID NO: 73055 - RNA, 62 nt, Homo Sapiens
ccugcaacccucccugaaccggacaagagcccucccugaacccucucccuuccccgguugug

SEQ ID NO: 73056 - RNA, 62 nt, Homo Sapiens
cagaacagacccugugccuggucucuucaccuucccugaauuuugagcuggauagagguggg

SEQ ID NO: 73057 - RNA, 62 nt, Homo Sapiens
uucugaaaucucaaaugaguuaagcuccagggucccugaaucuggugggugcucccccuccc

SEQ ID NO: 73058 - RNA, 62 nt, Homo Sapiens
ucacaauuucucuaaucuuuacucauguuaugucccugaaugucuugguauagguuuaagug

SEQ ID NO: 73059 - RNA, 62 nt, Homo Sapiens
aaauagaaacaagagaaugcaccuagguuaauucccugaauccuacuugaacauuguauaaa

SEQ ID NO: 73060 - RNA, 62 nt, Homo Sapiens
uuaaccacagaggagucacuuuuuagacaggcucccugaaugagcauauacaaaaggggagg

SEQ ID NO: 73061 - RNA, 62 nt, Homo Sapiens
ccccaccacuaccagcuccccagaugccacccucccugaaccgggcucaaucccccuuucac

SEQ ID NO: 73062 - RNA, 62 nt, Homo Sapiens
uggauucuuucauacgauacuggguuugcugcucccugaagcgguggagcugggcaagauuu

SEQ ID NO: 73063 - RNA, 62 nt, Homo Sapiens
gacucagccaggcagacauggccagcacgggaucccugaaguggcucuuacagcucucuggu

SEQ ID NO: 73064 - RNA, 62 nt, Homo Sapiens
aagugcucuuuccagaugaaaaauugagucuuucccugaagugguuuaauaaaacugguuaa

SEQ ID NO: 73065 - RNA, 62 nt, Homo Sapiens
gcugcgggcccagucagugacagaugucagggucccugaacuucuguaaccagggcugucuu

SEQ ID NO: 73066 - RNA, 62 nt, Homo Sapiens
uugauagcugauuaauuugcccucaauucugcucccugaacuucacacauaaaucuucccaa

SEQ ID NO: 73067 - RNA, 62 nt, Homo Sapiens
ugaaaucacacucuuccucugggcauccuggaucccugaauuauccccccccccaugaagua

SEQ ID NO: 73068 - RNA, 64 nt, Homo Sapiens
uaauuggauauuggacucugcucauauaagcuacagacaaaagccaaaagacucucgcuguccc

SEQ ID NO: 73069 - RNA, 64 nt, Homo Sapiens
cugggcaacauggugaaacccgucucuaccaaacagacaaaaagcagccaggcgugguggcaca

SEQ ID NO: 73070 - RNA, 64 nt, Homo Sapiens
gagccgagaucgcaccacugcacuccagccuaggagacaaaacgagacuucauuuaaaaaaaau

SEQ ID NO: 73071 - RNA, 64 nt, Homo Sapiens
auuaauccucaguuccacgagacugcccacccacagacaaaaaaauauauauauuccuaaaguc

SEQ ID NO: 73072 - RNA, 64 nt, Homo Sapiens
cuucuuuaaacagaacaagacauuuuuaaaauacagacaaaacauuggccauuauuuucuaauc

SEQ ID NO: 73073 - RNA, 64 nt, Homo Sapiens
gaguauagaugccaagaugucuuuaaaguuuauuagacaaaacaaaguauaaggagagaaauaa

SEQ ID NO: 73074 - RNA, 64 nt, Homo Sapiens
gauuuucguucauuauaauauucacaauuccccaagacaaaaguagcuagugauuucaaaaggu

SEQ ID NO: 73075 - RNA, 64 nt, Homo Sapiens
caucuucuuaacggauggugauuuuaauggaaauagacaaaacauccuuccuccuagaacuuac

SEQ ID NO: 73076 - RNA, 64 nt, Homo Sapiens
caagguguaugcucucaaguaaauaaaugaauaaagacaaaagccacaaaaugaaugaauaaau

SEQ ID NO: 73077 - RNA, 64 nt, Homo Sapiens
uuauggaauuuuuaaguagguaaauaaaugguuaagacaaaauaguguuauagccuucauucuc

SEQ ID NO: 73078 - RNA, 64 nt, Homo Sapiens
aggucacugaaagaacuugauuugaauuacguuuagacaaaaaugauuuaauuguaaauucuua

SEQ ID NO: 73079 - RNA, 64 nt, Homo Sapiens
gcugauuguugcuugagaaauaauuacuaauucuagacaaaacucaauccuguaucuuccauca

SEQ ID NO: 73080 - RNA, 64 nt, Homo Sapiens
augguuaauauauauacuuacuaauggaaaggagagacaaaagcaccaaaauaauaaaaggcag

SEQ ID NO: 73081 - RNA, 64 nt, Homo Sapiens
uuaacaaagaaauaacaguauaaauggaaucuugagacaaaaccaauucagugcuauccaguua

SEQ ID NO: 73082 - RNA, 64 nt, Homo Sapiens
gaaguaucugugugcuuccaaccacuucuuuguaagacaaaacuaauaaaagcuuuucaacuca

SEQ ID NO: 73083 - RNA, 64 nt, Homo Sapiens
ccgcgcccagcccuggagugauacuuuuuauggaagacaaaagccccccaaaucuguguaaaau

SEQ ID NO: 73084 - RNA, 64 nt, Homo Sapiens
gagugaccaugccuagcucacuuccagguuuaacagacaaaauaaacuuacucuaguuuccauc

SEQ ID NO: 73085 - RNA, 64 nt, Homo Sapiens
aagccggcuuguuuccuccccggggaagugugugagacaaaacaaacugggcugggagagaaga

SEQ ID NO: 73086 - RNA, 64 nt, Homo Sapiens
ggagaggcccuggcgguccugaaucgagucucccagacaaaaaaagcgugggucccagucuaug

SEQ ID NO: 73087 - RNA, 64 nt, Homo Sapiens
guaggaaaucuuacauuuuuagauugggauuugaagacaaaauuggauaaaaguuugaagggcu

SEQ ID NO: 73088 - RNA, 64 nt, Homo Sapiens
gauucuuuugccaauggguggaugauaggagguuagacaaaaguaggccaucucuagguuacaa

SEQ ID NO: 73089 - RNA, 64 nt, Homo Sapiens
ccuggcccuggcccuuacuauuaggaaaauaaacagacaaaaacaaguaaauauauauggucau

SEQ ID NO: 73090 - RNA, 64 nt, Homo Sapiens
guaugacccacauuacuuuuuaugggugaaaauaagacaaaaauaauaguuuuagugaggaugg

SEQ ID NO: 73091 - RNA, 64 nt, Homo Sapiens
uuaugggauguaacuaaugcgaugauagaugcauagacaaaaaagguagucacaguccggaaga

SEQ ID NO: 73092 - RNA, 64 nt, Homo Sapiens
ucucucucucuuuuuguuuuaaugaccaccuugcagacaaaaucuuagggaacauauugauaga

SEQ ID NO: 73093 - RNA, 64 nt, Homo Sapiens
uaugacagccguggugguucgacuauuuucaaaaagacaaaaaacaucucauccuaauuaaggu

SEQ ID NO: 73094 - RNA, 64 nt, Homo Sapiens
ccacagcaaaaaaaaaaaucauacuauuugcauaagacaaaauauacuucauuaauacuucaca

SEQ ID NO: 73095 - RNA, 64 nt, Homo Sapiens
gaaagagacacaggguguauggagccaauagaaaagacaaaaauaacuuuauggacacuaaacu

SEQ ID NO: 73096 - RNA, 64 nt, Homo Sapiens
aaauggcacaaggaaucacaucaagaaaaauaauagacaaaagagaagccauagcucaggguca

SEQ ID NO: 73097 - RNA, 64 nt, Homo Sapiens
acagugcuaauguauaugguugcaguucacauaaagacaaaagcaucuguuaugaaaugaguag

SEQ ID NO: 73098 - RNA, 64 nt, Homo Sapiens
accucguuauuaaccaguguuccagucuuaaaguagacaaaauauucagagccauuuuuuuuaa

SEQ ID NO: 73099 - RNA, 64 nt, Homo Sapiens
acguuguacagaagcacaugucuuuaaugucuucagacaaaaaagccuuacauuaauuuaaugu

SEQ ID NO: 73100 - RNA, 64 nt, Homo Sapiens
gauugguuugcuuaaaauuaacuuauuuuguagaagacaaaaugaauugcacuucacuuaaugu

SEQ ID NO: 73101 - RNA, 64 nt, Homo Sapiens
auuauaaaugaugucagcauuuuaguaaacuuuuagacaaaauuuguuagggucauucaugaaa

SEQ ID NO: 73102 - RNA, 64 nt, Homo Sapiens
uaugcuugcuuuggaaugauacucagaauuaaacagacaaaaggauauaugcauuguguaaucc

SEQ ID NO: 73103 - RNA, 64 nt, Homo Sapiens
aaacuaguauuaagggaagcuugucucauugaucagacaaaaagaauuuaaaaacaaauuggcu

SEQ ID NO: 73104 - RNA, 64 nt, Homo Sapiens
uagucgaauguucuuuucuuuaccuuuacaauuaagacaaaauguuuaauaagaauagcaaaaa

SEQ ID NO: 73105 - RNA, 64 nt, Homo Sapiens
uacaaagaggaaaggggaaaaaugacucagaacaagacaaaagcucugacuguuuaaaguuauc

SEQ ID NO: 73106 - RNA, 64 nt, Homo Sapiens
guucacuaauaaauucugaguaaauuaguggugaagacaaaauauaacuuguuuuagugagcca

SEQ ID NO: 73107 - RNA, 64 nt, Homo Sapiens
gugagccacugaggaaagaauaugcuuauuacaaagacaaaauguggugcagaaacuaucuugc

SEQ ID NO: 73108 - RNA, 64 nt, Homo Sapiens
gcacacuccaguauuaauauuguauauacauuuuagacaaaaauuaugccuauacacuuuaaaa

SEQ ID NO: 73109 - RNA, 64 nt, Homo Sapiens
cacacaggaguaggugccaccuugcucaguaaagagacaaaagcagaaaaccuaaaacaagccu

SEQ ID NO: 73110 - RNA, 64 nt, Homo Sapiens
aaugucacgcaacuuauuuuuauuaauguuaacaagacaaaauaaauaaaaauguuucuacaga

SEQ ID NO: 73111 - RNA, 64 nt, Homo Sapiens
ucgccguuguuccuucuguacucauaccuacaucagacaaaauaaccucaccaaaagauccagc

SEQ ID NO: 73112 - RNA, 64 nt, Homo Sapiens
agcaauuggcagugcucauaaaucuguuaauaucagacaaaauggcuucucugaggaaaugcau

SEQ ID NO: 73113 - RNA, 64 nt, Homo Sapiens
gucuucucuuucaaaccagauaaaucauaauacuagacaaaauuuuugauugauagcacaguga

SEQ ID NO: 73114 - RNA, 64 nt, Homo Sapiens
cacacagcacuugggccagcaaauccuggaaggcagacaaaaauaagagccugaagcaaugcuu

SEQ ID NO: 73115 - RNA, 64 nt, Homo Sapiens
aucaguuuucagugugaauucacugaauguuuauagacaaaagaaaauacacacuaaaacuaau

SEQ ID NO: 73116 - RNA, 64 nt, Homo Sapiens
cagaaggaaaaaaaaacauaguauagauaugaucagacaaaaugacauauauccuuagcaccuc

SEQ ID NO: 73117 - RNA, 64 nt, Homo Sapiens
caaaaaacaaaaaaaacaaaucuuccugcuaaaaagacaaaaaaauuucauuauauucuccccc

SEQ ID NO: 73118 - RNA, 64 nt, Homo Sapiens
ggugguccuucuugaauucaaaacugugugcaacagacaaaaagcuuauaucauauuguuaaau

SEQ ID NO: 73119 - RNA, 64 nt, Homo Sapiens
uagggaugaucacucuuagaauaaaacugguuuuagacaaaaaaauuguugcuuuguuucucug

SEQ ID NO: 73120 - RNA, 64 nt, Homo Sapiens
ggagguccagguagauguaaaaaauggauuuaaaagacaaaaauaauauacuuggcacagcgaa

SEQ ID NO: 73121 - RNA, 64 nt, Homo Sapiens
aagacuaucaugugcaaucuguuguuccccuuacagacaaaauggacuggguuuuuuuguuguu

SEQ ID NO: 73122 - RNA, 64 nt, Homo Sapiens
cucauauaucagucucucacauggccacaauucuagacaaaaaccaaagacccagaggccagag

SEQ ID NO: 73123 - RNA, 64 nt, Homo Sapiens
aauaagucuguagcauaaagguuaaacuauuuuaagacaaaauaaaauagaguguauuuaaaca

SEQ ID NO: 73124 - RNA, 64 nt, Homo Sapiens
agaacaccccugccgacucccagcccggccaaaaagacaaaacacauagacgcacacacucagg

SEQ ID NO: 73125 - RNA, 64 nt, Homo Sapiens
gaagaagaagaaauaaaaacccacccaagcaagaagacaaaagguaaagacgcaacguuuccaa

SEQ ID NO: 73126 - RNA, 64 nt, Homo Sapiens
ucauuguaaucaaugugggaaagcuuucagucagagacaaaaucuucuugagcaugaaaaaauu

SEQ ID NO: 73127 - RNA, 64 nt, Homo Sapiens
uugaggccaaggagcuuuuuuuuuuuuuuuuucaagacaaaaggacucuguaauuccacuucua

SEQ ID NO: 73128 - RNA, 64 nt, Homo Sapiens
aaaaaaaaaacccaacaagaaaagacaaaacaaaagacaaaaaaguaaaaaaaaaaaaaaaaaa

SEQ ID NO: 73129 - RNA, 64 nt, Homo Sapiens
aaagacaaaaaaaaaaaaaaaaaaaaaaaaaaaaagacaaaacaugauaaaaaacuguaaaaaa

SEQ ID NO: 73130 - RNA, 64 nt, Homo Sapiens
aaaaaaagaaaauauuuuggaaaaacacaaaaaaagacaaaaaagauucuugaacuugaaaaaa

SEQ ID NO: 73131 - RNA, 64 nt, Homo Sapiens
uuuucuccuguguaucuuuguuguguuugguuucagacaaaaccauguuauuuauuagcccuaa

SEQ ID NO: 73132 - RNA, 64 nt, Homo Sapiens
aacccuuuucuccuguguauuuguguuugauuucagacaaaauuaaguuauuuauuagcccuaa

SEQ ID NO: 73133 - RNA, 56 nt, Homo Sapiens
aacuuucuucucuagaauaaaucaggagacaaaaugggguaaaaaacuucuuuuuc

SEQ ID NO: 73134 - RNA, 64 nt, Homo Sapiens
uucuuggacuuugccccgaaagcacauccauaaaagacaaaaucugauauauuggacuucuuca

SEQ ID NO: 73135 - RNA, 64 nt, Homo Sapiens
gaacaucacuucucucuucuuauauacuuuuccaagacaaaauggcaugcauguauauguaaaa

SEQ ID NO: 73136 - RNA, 64 nt, Homo Sapiens
uacaguagagacagaaacgaugacuugacgguugagacaaaaaaucuaacguguugauaaaaug

SEQ ID NO: 73137 - RNA, 64 nt, Homo Sapiens
guucgcuuagugauccacuguaagguguucauuuagacaaaauuucuucauccaaaauugcacc

SEQ ID NO: 73138 - RNA, 64 nt, Homo Sapiens
aaagugcaaacaacugagacaauaauaaaacuacagacaaaaacuguuuucuuuuucuuaaaaa

SEQ ID NO: 73139 - RNA, 64 nt, Homo Sapiens
uuacauauuuauucauguucaugguacucuucuaagacaaaaucagauugauaacuaugaaagu

SEQ ID NO: 73140 - RNA, 64 nt, Homo Sapiens
accacguuuauguuuaaauuucauuuuguucagcagacaaaauguacuucccuuaacuuucauu

SEQ ID NO: 73141 - RNA, 64 nt, Homo Sapiens
acaacuggaauugagguugcacacugugauuuuuacaccgaaaagccaaaaggagcuggccauc

SEQ ID NO: 73142 - RNA, 64 nt, Homo Sapiens
cuccauuagauaaaccaccauaguuuccugaaggacaccgaauugagcaacuuuugaguaucuu

SEQ ID NO: 73143 - RNA, 64 nt, Homo Sapiens
caacuugacuguaaaaguacuagauggugggcggacaccgaaguuuucagugguccuacaaagg

SEQ ID NO: 73144 - RNA, 64 nt, Homo Sapiens
gcugcagaaauucguugccaaagauuggacagagacaccgaaggaaaugggguggugaaacccc

SEQ ID NO: 73145 - RNA, 64 nt, Homo Sapiens
cagugucagcgaauccagaaggguaucagauuaaacaccgaauucagccacuggacuuuuaaaa

SEQ ID NO: 73146 - RNA, 64 nt, Homo Sapiens
cuuuaggacaauguuguguaaaucuuugaaggacacaccgaagaccuuuauacugugaucuuuu

SEQ ID NO: 73147 - RNA, 64 nt, Homo Sapiens
uuaauuuaagaaccagaggccuauuguccauuacacaccgaauggucaaauuaugagucccugc

SEQ ID NO: 73148 - RNA, 64 nt, Homo Sapiens
gcucgagggagaggcugccgccuuccuggugcacacaccgaagucaagacagggcaggaaguua

SEQ ID NO: 73149 - RNA, 64 nt, Homo Sapiens
gcaaucuaaauuguggcuugcaacaaucuggagcacaccgaaggaacaguccuuuaauaugaac

SEQ ID NO: 73150 - RNA, 64 nt, Homo Sapiens
auaagauuccaaagaacuuagauucauuucuucaacaccgaaaugcuggagguguuugaucagu

SEQ ID NO: 73151 - RNA, 64 nt, Homo Sapiens
ggcagcaaccauucaucuuuccuuugcucuggauacaccgaaugaccagguaacaucaucaggc

SEQ ID NO: 73152 - RNA, 64 nt, Homo Sapiens
acucaguccagagggucagaccuucuaggcaaguacaccgaaugugagucccagagcuaaagaa

SEQ ID NO: 73153 - RNA, 64 nt, Homo Sapiens
ccccuccccggcaucugccagcucagcacagaagacaccgaaugugcaucuggagguguugcgg

SEQ ID NO: 73154 - RNA, 64 nt, Homo Sapiens
acugcacaugcuaaugacuuccucugacagccacacaccgaaucuugaugaaaaaagagaagag

SEQ ID NO: 73155 - RNA, 64 nt, Homo Sapiens
aucccauggaagcugaggacuuauuccgcuuuccacaccgaacacuaaauguggaccaguauca

SEQ ID NO: 73156 - RNA, 64 nt, Homo Sapiens
caguucaucagauguucaccauggccaccgcagaacaccgaaguaauuccagcauagcggggaa

SEQ ID NO: 73157 - RNA, 64 nt, Homo Sapiens
cagaaaucuucuaaccuaccagagccuagaugagacaccgaauuaacauuaaaauuucaguaac

SEQ ID NO: 73158 - RNA, 63 nt, Homo Sapiens
accucacgccucucauucguauuaaaugucugcuacaccgaaaucaggaguuggcaaauaaga

SEQ ID NO: 73159 - RNA, 64 nt, Homo Sapiens
ucagauagcucagggacugcggcuuaagagagaaacaccgaaaucaucauccuccaaagcaaga

SEQ ID NO: 73160 - RNA, 64 nt, Homo Sapiens
cuuuuuuuuuuucucuccgaggcuugggacucagacaccgaaguuguacucauccaccccagcc

SEQ ID NO: 73161 - RNA, 64 nt, Homo Sapiens
ggccucggccuugcaccgggacgccgaguuugggacaccgaacacugggcaaaagagaaucccc

SEQ ID NO: 73162 - RNA, 64 nt, Homo Sapiens
ccauauaggccauuuuagaaggccaaggagagccacaccgaaaaaggagacaguuccugugauc

SEQ ID NO: 73163 - RNA, 64 nt, Homo Sapiens
aguagcucuguguuuagaguuggggacaaggaugacaccgaagguccaggaguccaggacagca

SEQ ID NO: 73164 - RNA, 50 nt, Homo Sapiens
gaguguuuuguuguuucagaacaccgaaaagcuuuggaggauuucacucu

SEQ ID NO: 73165 - RNA, 64 nt, Homo Sapiens
uucccauaaacuuaagugccgcuaugauccucuaacaccgaaaucgaauggcuuaaacuaauuu

SEQ ID NO: 73166 - RNA, 64 nt, Homo Sapiens
aguguaccaacgaauucaccauaaacagcugggcacaccgaaacugcucugcuagucaggauug

SEQ ID NO: 73167 - RNA, 64 nt, Homo Sapiens
agacuuuagcugaagaggaggacugcagccugugacaccgaaagugggagggcuuuagcaauga

SEQ ID NO: 73168 - RNA, 64 nt, Homo Sapiens
acagucccugugcugguuagacacggagcgcugcacaccgaaagcccaaauugggagcucugcc

SEQ ID NO: 73169 - RNA, 64 nt, Homo Sapiens
gcagaagagcagcuacggaguuggaaagaauaaaacaccgaauucuugugcauaagccugagau

SEQ ID NO: 73170 - RNA, 64 nt, Homo Sapiens
gggcuggcggcuccaaagcagagagagagugaggacaccgaacuauagagagagggaggagagc

SEQ ID NO: 73171 - RNA, 64 nt, Homo Sapiens
aaaugaaagaagcaagaaggauaauagaacuacaacaccgaaggauugcugacggaauaaaaac

SEQ ID NO: 73172 - RNA, 64 nt, Homo Sapiens
aucccugucgggcuccuccgacuccucgggcuggacaccgaaaccucccuucuuaaagcgugug

SEQ ID NO: 73173 - RNA, 64 nt, Homo Sapiens
cugggccuguauucccagagaguaacaccucauuacaccgaagcacaccgagguucacggucug

SEQ ID NO: 73174 - RNA, 64 nt, Homo Sapiens
agccgucccauuucuccuggcgggguaacccauuacaccgaaguccuuuguuuucuaccacaau

SEQ ID NO: 73175 - RNA, 64 nt, Homo Sapiens
uucugcuuuagcguaauugcuugaacugacaguuucuccuaacucaaaggacacuaugaacuuu

SEQ ID NO: 73176 - RNA, 64 nt, Homo Sapiens
agcagugaaggaaaugucagcaaccaaaggugauucuccuaaaguucugucugccuaagagaau

SEQ ID NO: 73177 - RNA, 64 nt, Homo Sapiens
guguguguguguguguguguguguguuggggggaucuccuaaauuauuucugugcaucuccuuu

SEQ ID NO: 73178 - RNA, 64 nt, Homo Sapiens
uuagggaggcaccagauuggagacagaugugcuaucuccuaacagagugaugaggcuucaguug

SEQ ID NO: 73179 - RNA, 64 nt, Homo Sapiens
ccuuuucuagucugucuucccaugguagcccaucucuccuaagaagaguguggcuucauuuguc

SEQ ID NO: 73180 - RNA, 64 nt, Homo Sapiens
uaaugcucaauacuuaccuauuggguuugguuuuucuccuaaaagguaccuaagcaaauaggag

SEQ ID NO: 73181 - RNA, 64 nt, Homo Sapiens
cagcccugucaaggaauaccaacagaauauugauucuccuaaacuguauaguaaccugcuaacc

SEQ ID NO: 73182 - RNA, 64 nt, Homo Sapiens
aucauguugucuguguuguguuaugugagaauuuucuccuaagucaugcagguaaugacaauau

SEQ ID NO: 73183 - RNA, 64 nt, Homo Sapiens
aacagucuuuaugaugggauuaagguggacaagaucuccuaagaucugugaaugggauuaaggu

SEQ ID NO: 73184 - RNA, 64 nt, Homo Sapiens
cuaagaucugugaaugggauuaagguggacaagaucuccuaagaucugaaaagaaaccuuaaua

SEQ ID NO: 73185 - RNA, 64 nt, Homo Sapiens
auucuuauuugggggagugggcaaaauguugauuauuuucuaaugcuuuguagcaaagcauauc

SEQ ID NO: 73186 - RNA, 64 nt, Homo Sapiens
cuuuuuuguaacuaauucugugagaguugagcucauuuucuaguuggaagaaugugauauuugu

SEQ ID NO: 73187 - RNA, 64 nt, Homo Sapiens
uucuguuaucuauguagacagaauggucauguauauuuucuauuaguugaguuuuuacaucuuu

SEQ ID NO: 73188 - RNA, 64 nt, Homo Sapiens
caguauaguuugaaagcggcacaauuaaaaauuaauuuucuaacaaaguugggagguuugaugg

SEQ ID NO: 73189 - RNA, 64 nt, Homo Sapiens
uaacacagguaucuaggaaguaagugcugaguugauuuucuagguucuuacguauuugaaaaau

SEQ ID NO: 73190 - RNA, 64 nt, Homo Sapiens
cuaucaauagucucuuuuccgcaggcaaaguggcauuuucuaaacauguuugcuuacugccagg

SEQ ID NO: 73191 - RNA, 64 nt, Homo Sapiens
gugauaaauguugauguuuucuguguacaaacacauuuucuaugcaugugucucuguguauaug

SEQ ID NO: 73192 - RNA, 64 nt, Homo Sapiens
guucauuucucauaacauauaugagguauacaaaauuuucuaacuccagauuguagucauuuug

SEQ ID NO: 73193 - RNA, 64 nt, Homo Sapiens
uagagaaugcuuaagggauuauuguuaguuagauauuuucuauuuccuucaagagcaguuauca

SEQ ID NO: 73194 - RNA, 64 nt, Homo Sapiens
uugccuagccgucacaccccuuauuuauccuuauauuuucuaaaauuuuauauaccaguuaauc

SEQ ID NO: 73195 - RNA, 64 nt, Homo Sapiens
aaaugacauuugagaaaaaauucucgggaauuguauuuucuaaucagaaucccuuguaucuccu

SEQ ID NO: 73196 - RNA, 64 nt, Homo Sapiens
ccuugccccuccauucuccuuugcccugaauaccauuuucuacccuucccuacuuuauuaggac

SEQ ID NO: 73197 - RNA, 64 nt, Homo Sapiens
ugacucuucaauguaaugaucagaguuuaaaaccauuuucuaauaauaaauuaaaucuucaguu

SEQ ID NO: 73198 - RNA, 64 nt, Homo Sapiens
auuucauuugcaucauuaggguauccuuaaacugauuuucuauuacaauuggaaguggagaaua

SEQ ID NO: 73199 - RNA, 64 nt, Homo Sapiens
uuaagaaauacuuucauuuauguuugcuagaaacauuuucuaaaugauagugauuagcugguua

SEQ ID NO: 73200 - RNA, 64 nt, Homo Sapiens
uggccuauugcacaagucuugacaaacaacauauauuuucuaaaacuauccagauuucauuauc

SEQ ID NO: 73201 - RNA, 64 nt, Homo Sapiens
uuuuguaaccugagcaguuaaugaaugugccaacauuuucuaggaagggacagcaagaauauuc

SEQ ID NO: 73202 - RNA, 64 nt, Homo Sapiens
uacuauuuagauauaacacuauguuuauuuacuaauuuucuagauuuucuacuuuauuaauugu

SEQ ID NO: 73203 - RNA, 64 nt, Homo Sapiens
gauauaacacuauguuuauuuacuaauuuucuagauuuucuacuuuauuaauuguuuugcacuu

SEQ ID NO: 73204 - RNA, 64 nt, Homo Sapiens
ggauaauugcuggguuauaauaauaaucuggacuauuuucuauaaauaaagguguggcagaaua

SEQ ID NO: 73205 - RNA, 64 nt, Homo Sapiens
uuaucccugugaauaauugacaaaacuaauauuuauuuucuagauccaguaaugucuuugaaag

SEQ ID NO: 73206 - RNA, 64 nt, Homo Sapiens
aacuaugguugccucaauaucucaaaccuagaucauuuucuaccggagauacauuggucaaaca

SEQ ID NO: 73207 - RNA, 64 nt, Homo Sapiens
auuccaauaggagauacauucuuuguuauaauauauuuucuaccauaauggguuuuauggauuu

SEQ ID NO: 73208 - RNA, 64 nt, Homo Sapiens
uggcuuuaauuuugaaaguauuucaguuacuuccauuuucuagaaagaauuguaauggcuacag

SEQ ID NO: 73209 - RNA, 64 nt, Homo Sapiens
cuuauuguacuuguuaucaaaauauguucauuaaauuuucuaugcuucuaaaaugcuuuuaauu

SEQ ID NO: 73210 - RNA, 64 nt, Homo Sapiens
uuucuucuaaaaugcuuuuaaauguuucacuaugauuuucuauucuacuaaauauuuuauauga

SEQ ID NO: 73211 - RNA, 64 nt, Homo Sapiens
gagccauguguacgaauugcaaucaugacaugguauuuucuauaauuauagagaucuuacuauu

SEQ ID NO: 73212 - RNA, 64 nt, Homo Sapiens
uuuuuggcuguauguaauucagucauaaguaagcauuuucuaacguccauuauaucccuuuagg

SEQ ID NO: 73213 - RNA, 64 nt, Homo Sapiens
guaguuuuucauuuccuacauuuauuagauuuucauuuucuauuaacaauugaauaccauuuca

SEQ ID NO: 73214 - RNA, 64 nt, Homo Sapiens
gaagaucuagauccuagauauuagaauaaaauuuauuuucuacuguauccauuucaaauguuaa

SEQ ID NO: 73215 - RNA, 64 nt, Homo Sapiens
gugugcuaugacccacuaugaccacagcaucugcauuuucuaaaaaauuccaugcagguguuuu

SEQ ID NO: 73216 - RNA, 64 nt, Homo Sapiens
cucugccuuguucuuaucaacuugaaauguuggcauuuucuaaccuuguuuuguuggcuacaau

SEQ ID NO: 73217 - RNA, 64 nt, Homo Sapiens
ucuguagagggaaaaacaucaaaguggggggacaauuuucuaguuucaaaugaguaaauagacc

SEQ ID NO: 73218 - RNA, 64 nt, Homo Sapiens
uuuaaaaugaagaaccaaaaaugugaaggauuugauuuucuacaauuuggaagacacaaaucaa

SEQ ID NO: 73219 - RNA, 64 nt, Homo Sapiens
auuuuuuauggagagaauguguauaguaguuaacauuuucuagugugagcgugaucucuuuuca

SEQ ID NO: 73220 - RNA, 64 nt, Homo Sapiens
aagugguaguaauuuuuuuuccucaguagaauuuauuuucuacaauccuuaagucugcucccac

SEQ ID NO: 73221 - RNA, 64 nt, Homo Sapiens
uuuuauuaccaauauauaagauaaaaaaaguuguauuuucuaauuauauuuucuaaagaaaaaa

SEQ ID NO: 73222 - RNA, 64 nt, Homo Sapiens
gaaaaaaauaaaaaaaguuguuuuaaaaaguuauauuuucuaaaugcuauuguagauggcaucu

SEQ ID NO: 73223 - RNA, 64 nt, Homo Sapiens
aaagaaugacuuuuccaagaguucuagauguuugauuuucuaauuaauacuuaucagaucuaca

SEQ ID NO: 73224 - RNA, 64 nt, Homo Sapiens
uaaagaagggaaucuguuuaucgcuuuucaaaauauuuucuaaagugggggaagaaaguuuaua

SEQ ID NO: 73225 - RNA, 64 nt, Homo Sapiens
accauguaacuccauugaacuuacauuauacuuaauuuucuaaagagaaaaaaaagcuuaauuu

SEQ ID NO: 73226 - RNA, 64 nt, Homo Sapiens
ugauaauaggcuaguuuugacuucuuggugccuaauuuucuagaauuuccaaggagauaaucuc

SEQ ID NO: 73227 - RNA, 64 nt, Homo Sapiens
guauugaucugcuuugaauuuucaagcagccagaauuuucuaguuuaaauuggcagaguuauaa

SEQ ID NO: 73228 - RNA, 64 nt, Homo Sapiens
uuguauuauuauauuggggaaaacauuuuuuaucauuuucuauuaagaaaauggaaaacuuaaa

SEQ ID NO: 73229 - RNA, 64 nt, Homo Sapiens
ugugauguaugccauuaaaaaaauuguuuuuuuaauuuucuauauuauaaacauaaaauaagua

SEQ ID NO: 73230 - RNA, 64 nt, Homo Sapiens
auuauuaaaugcugaggccaauaccaagaaguuuauuuucuauauuauacaauuaugaauuaca

SEQ ID NO: 73231 - RNA, 64 nt, Homo Sapiens
guuacauuuggagaggucuuguugagaaggcaaaauuuucuaaauauuuugauaucaauuuggg

SEQ ID NO: 73232 - RNA, 64 nt, Homo Sapiens
ucaaguuuuaagguuauauuuuuuaaaauaaugaauuuucuaucucuaggcaacaugucuuuau

SEQ ID NO: 73233 - RNA, 64 nt, Homo Sapiens
cauuugguauguuucauucauuggaauauuucuuauuuucuacguguuugaaaagccuguaaga

SEQ ID NO: 73234 - RNA, 64 nt, Homo Sapiens
uuuuuuuuuucuuaaaaucauagccauaugguaaauuuucuauuuuguuaugguucucuuuuau

SEQ ID NO: 73235 - RNA, 64 nt, Homo Sapiens
uauaaaauacauuguugccuauuuagggaguaacauuuucuaguuuuuguuucugguuaaaaug

SEQ ID NO: 73236 - RNA, 64 nt, Homo Sapiens
ggcuguugccaugaaggcuugcagaauugaguccauuuucuagcugccuuuauucacauaguga

SEQ ID NO: 73237 - RNA, 64 nt, Homo Sapiens
gauuuuugcaauguaaaauaaaguguuucugauuauuuucuauguaaaggaacccucuccuuuc

SEQ ID NO: 73238 - RNA, 64 nt, Homo Sapiens
ucuuuguuuuuaauugcagacauuuaaaaaugucauuuucuacuguuaagaguaauccucuuuc

SEQ ID NO: 73239 - RNA, 64 nt, Homo Sapiens
uagaguuuauuuuauucucagaguuuggacuacaauuuucuaagauguuucugguucaagacug

SEQ ID NO: 73240 - RNA, 64 nt, Homo Sapiens
caauuuucuaagauguuucugguucaagacugucauuuucuauuucaaccgaaaaguaagcauu

SEQ ID NO: 73241 - RNA, 64 nt, Homo Sapiens
uuuuucuuuacacuaaucgauacauuuagaaaaaauuuucuaaguuagagacaaguuuaaaagu

SEQ ID NO: 73242 - RNA, 64 nt, Homo Sapiens
guugguucuuguguuauaaacaccucuacucuguauuuucuacagcccagugcuucuugaaacu

SEQ ID NO: 73243 - RNA, 64 nt, Homo Sapiens
aaauguguaccauuuuuuaaguguuucacaauucauuuucuacugaaaugauguugcuagugca

SEQ ID NO: 73244 - RNA, 64 nt, Homo Sapiens
ugucacugcugacauaacucucuaauacugaaagauuuucuaaauuggauuaaaucugauauuu

SEQ ID NO: 73245 - RNA, 64 nt, Homo Sapiens
acugaaagauuuucuaaaugggauuaaaucugauauuuucuaaugggguuggggugguuccuuu

SEQ ID NO: 73246 - RNA, 64 nt, Homo Sapiens
acacucuccaggccgucaaauuauucucuuguucauuuucuauuuugaaucuccuuguuaguua

SEQ ID NO: 73247 - RNA, 64 nt, Homo Sapiens
uaacuuguuuguauagaaaauaguaacaaggacuauuuucuauuguugucaucuauuuacuaga

SEQ ID NO: 73248 - RNA, 64 nt, Homo Sapiens
ugccagcagaguaucugucuaaugaaauuagucuauuuucuacuagagagcuuaacagauaaaa

SEQ ID NO: 73249 - RNA, 64 nt, Homo Sapiens
ugcuuuccuuuuaaaaucagucaguauuuuucagauuuucuauaugacuuuaauuuucuuuaua

SEQ ID NO: 73250 - RNA, 64 nt, Homo Sapiens
uccaguguacaugagaacauauauuuauugcaugauuuucuagauacacagucuaugcauuauu

SEQ ID NO: 73251 - RNA, 64 nt, Homo Sapiens
cguuauccacccgauuuccuaauguaauugaaagauuuucuauuuugccacacacuuggagaca

SEQ ID NO: 73252 - RNA, 64 nt, Homo Sapiens
aauaauguaaaugucuucuaugcaacaucgguggauuuucuaaauuuacaaauaugugccauug

SEQ ID NO: 73253 - RNA, 64 nt, Homo Sapiens
gcugugcugucggugauacauaagaaaagcaauaauuuucuaaaaaccugaaauaauaagauaa

SEQ ID NO: 73254 - RNA, 64 nt, Homo Sapiens
gaauuagauguuaguaguaccuaacaaaugcauuauuuucuacauucaagcucuaacaaaguca

SEQ ID NO: 73255 - RNA, 64 nt, Homo Sapiens
cccgugguucaucugauauauuaaaaaugggccuauuuucuaucuaauaauuucucaaugaauu

SEQ ID NO: 73256 - RNA, 64 nt, Homo Sapiens
uuugaacacuaccuuugcuguaauuucauuugagauuuucuaaggguagaauuuggucucacca

SEQ ID NO: 73257 - RNA, 64 nt, Homo Sapiens
guguacauggagugaucauuuuacuaacauaaauauuuucuauguguguuucaguggaugacaa

SEQ ID NO: 73258 - RNA, 64 nt, Homo Sapiens
uaagacguguugagauuggccugggaauaucaucauuuucuaguugacauuugaauccugugug

SEQ ID NO: 73259 - RNA, 64 nt, Homo Sapiens
gucuaucauuuacaguuucaauagcacauaauuuauuuucuaugcauuauaaauggccuugcag

SEQ ID NO: 73260 - RNA, 64 nt, Homo Sapiens
cugggaguuaaaacgcagaguauuacuauaguuaauuuucuaggguucucuuaugaaaaguaua

SEQ ID NO: 73261 - RNA, 64 nt, Homo Sapiens
augcuuccagacaaagaaaaguuuguuaguccugauuuucuaaucguagccacucaaggaacag

SEQ ID NO: 73262 - RNA, 64 nt, Homo Sapiens
uauuuccuaacuuuauuuuuucuguuauaaagugauuuucuaagaaaagugcaaaaaaaaagau

SEQ ID NO: 73263 - RNA, 64 nt, Homo Sapiens
aaaugucucuaugaagguuuuugggcuguaagccauuuucuagccauaucucuugccccaaaga

SEQ ID NO: 73264 - RNA, 64 nt, Homo Sapiens
guacuugucugccccucauuucaaggccagaguuauuuucuauuuauguauuagucuaggcuga

SEQ ID NO: 73265 - RNA, 64 nt, Homo Sapiens
uucuguaucuucucacauucuguauacuguauccauuuucuagagaacccaguagcuuuuauac

SEQ ID NO: 73266 - RNA, 63 nt, Homo Sapiens
accaagauauucugccaaaauaucaggaccagaauuuucuaccuaaggaccagaauuuuuuau

SEQ ID NO: 73267 - RNA, 64 nt, Homo Sapiens
gaccaagauauucugccaaaauaucaggaccagaauuuucuaccuaaggaccagaauuuuuugu

SEQ ID NO: 73268 - RNA, 64 nt, Homo Sapiens
gaccagaauauucuaccuaaauaucaaggccaggauuuucuaccuaaagaccaggacuuuuuau

SEQ ID NO: 73269 - RNA, 64 nt, Homo Sapiens
gacuggaauauucuacccaaaugucaggaccaggauuuucuacccagagaccaagguguucuuc

SEQ ID NO: 73270 - RNA, 64 nt, Homo Sapiens
gaccaaaauauucuacccauaugucaggaccaggauuuucuacccagagaccaagguuaucuuc

SEQ ID NO: 73271 - RNA, 64 nt, Homo Sapiens
gaccaaaauauucuacccauaugucaggaccgggauuuucuacccagagaccugcauguucucu

SEQ ID NO: 73272 - RNA, 64 nt, Homo Sapiens
gaccagaauauucuacccaaaugucaggaccaagauuuucuaccaaaauaucagguaaaauaga

SEQ ID NO: 73273 - RNA, 64 nt, Homo Sapiens
cauuaacuugagcugcuggaggcacagagaauccauuuucuacaaggggagaggauuuucuaag

SEQ ID NO: 73274 - RNA, 64 nt, Homo Sapiens
ggcacagagaauccauuuucccggaggggagaggauuuucuaagaccaacacuuggagauuuuu

SEQ ID NO: 73275 - RNA, 64 nt, Homo Sapiens
auggaauauuuauaggccagggaauuauuguaccauuuucuaucugcucguuuucgcuggggau

SEQ ID NO: 73276 - RNA, 64 nt, Homo Sapiens
guaagaagagccauagcugagccauuugguguggauuuucuacuugguuaguuaaaagcccauu

SEQ ID NO: 73277 - RNA, 64 nt, Homo Sapiens
caacacauuuauuuauacuaaauaacugucaaccauuuucuaacaaaaaguaagacugaauuga

SEQ ID NO: 73278 - RNA, 64 nt, Homo Sapiens
ugggcacaaagaaaauuuagaucugacaaguauaauuuucuaaagacauuauuucaggauuaac

SEQ ID NO: 73279 - RNA, 64 nt, Homo Sapiens
caaguuuuauuuuaaaaacaauuuucuaaucugcauuuucuacuuuucaaaucaacuauuaaaa

SEQ ID NO: 73280 - RNA, 64 nt, Homo Sapiens
cugcauuuucuacucaaguuaucaacuauuaaaaauuuucuaauagugaaugaauacauuucaa

SEQ ID NO: 73281 - RNA, 64 nt, Homo Sapiens
ugaacuguggggauccaggacauaacuuugaggcauuuucuaaaguuaaaccugcugcaagagc

SEQ ID NO: 73282 - RNA, 64 nt, Homo Sapiens
cugcaggauuucugaugacauaaggguaccagauauuuucuauaaucagcucacucugaaacuu

SEQ ID NO: 73283 - RNA, 64 nt, Homo Sapiens
cuggaaacuuagugugccuugaccaggcuagaguauuuucuaaguacuuaaugaauauguuaag

SEQ ID NO: 73284 - RNA, 64 nt, Homo Sapiens
auauuuauuucauuuaagauaauuuucaaaguuaauuuucuaaauaagauaauucucauuugug

SEQ ID NO: 73285 - RNA, 64 nt, Homo Sapiens
aauaaaauuuauuaugcuuuauaaccucuucuguauuuucuaauuuuuucauugucuuugauaa

SEQ ID NO: 73286 - RNA, 64 nt, Homo Sapiens
guguuauacacuuugcuuccuucagccuagcugaauuuucuagucaucuaaauuucucaacuag

SEQ ID NO: 73287 - RNA, 64 nt, Homo Sapiens
uugacuguuuucauacuauauuuccuaaacugacauuuucuauuauucugaacacauagaucuc

SEQ ID NO: 73288 - RNA, 64 nt, Homo Sapiens
uucuuacaauguauguaugaauuugauuuauuuaauuuucuauaauuuaacuuaauauuuaauu

SEQ ID NO: 73289 - RNA, 64 nt, Homo Sapiens
gcaguuuucuuuccaguacuacuguguaacaaauauuuucuauuucauaaccauaccugauuau

SEQ ID NO: 73290 - RNA, 64 nt, Homo Sapiens
uuuggagaaaguuugugcccgaaccauuucaacuauuuucuauaucucccgguaaaaaugaauu

SEQ ID NO: 73291 - RNA, 64 nt, Homo Sapiens
uugcaacagcaaguugauuucuugugaucccagaauuuucuaagaggaugaguugaaucuauag

SEQ ID NO: 73292 - RNA, 64 nt, Homo Sapiens
auccauugcauuuuugccucuaaacaacuacagaauuuucuaggguuuuaaauuauguaaaaug

SEQ ID NO: 73293 - RNA, 64 nt, Homo Sapiens
aaaugucuuaugaauuucucuuuauauuaguuuuauuuucuagagacaaaucuugauaaguuuu

SEQ ID NO: 73294 - RNA, 64 nt, Homo Sapiens
ccucuacuuggucaguuucuguagcugaucuugcauuuucuacgagaguuuggagccauuuugg

SEQ ID NO: 73295 - RNA, 64 nt, Homo Sapiens
uccauuuuuuuuuuaauucuucccuuggauuaauauuuucuacugaaaagaaaugaaaucucag

SEQ ID NO: 73296 - RNA, 64 nt, Homo Sapiens
guuaaugcuagucacagccaggaggucagaaggaauuuucuacuucuggauccaaauguuaccu

SEQ ID NO: 73297 - RNA, 64 nt, Homo Sapiens
cugcuucauaguaagaagggauugagugccacugauuuucuaguuuuccagaggcaaauuuuga

SEQ ID NO: 73298 - RNA, 64 nt, Homo Sapiens
uagaaaacaugcaguaccuuuuuuaauguauuuaauuuucuacacuucuucauuuuaauucucc

SEQ ID NO: 73299 - RNA, 64 nt, Homo Sapiens
uugcaaauuggugauugugaaauuacagaaagugauuuucuagucugcuuuuuuuguuuaauuc

SEQ ID NO: 73300 - RNA, 64 nt, Homo Sapiens
uugauuaggagauuuuucaguucuccauauaauaauuuucuacaaucagaucuaugcuguggca

SEQ ID NO: 73301 - RNA, 64 nt, Homo Sapiens
ugagauugguugaaucugcaguuuuuuuuugaguauuuucuauuuauuguauuuuauuuuuauu

SEQ ID NO: 73302 - RNA, 64 nt, Homo Sapiens
ccuuaauggaauaaugggucuuagaaaaaucaccauuuucuagaaucuagaaggaauuagagga

SEQ ID NO: 73303 - RNA, 64 nt, Homo Sapiens
gugaauuucagaggucucugcuagccuugguaucauuuucuagcaauaacugagagccaguuaa

SEQ ID NO: 73304 - RNA, 64 nt, Homo Sapiens
uaguagaaaaaugaaguuuauuauaaguuuuuauauuuucuacuuguucauuuggugcaaacuc

SEQ ID NO: 73305 - RNA, 64 nt, Homo Sapiens
gggcugugcaauugcuggguacuuagauguuaaaauuuucuagugacccuaaaacaguuauauu

SEQ ID NO: 73306 - RNA, 64 nt, Homo Sapiens
uugucaguuuuaaaauauaaauagaguuucuaacauuuucuaguuuuauacuuucugccuucag

SEQ ID NO: 73307 - RNA, 64 nt, Homo Sapiens
cuuauuuguaagagaaaauuaguuggacuuguuuauuuucuaguagcuuuuauaaguacacuca

SEQ ID NO: 73308 - RNA, 64 nt, Homo Sapiens
aaaacauugauuuuuuuauaucuuucauaauauaauuuucuaacaaugcaauaaaaccacuaaa

SEQ ID NO: 73309 - RNA, 64 nt, Homo Sapiens
uuggacuuuaugagagagucuuauaagaaucacgauuuucuacaccugucauugagccaagaaa

SEQ ID NO: 73310 - RNA, 64 nt, Homo Sapiens
guauuuuggucauauugccaacuggaaagucaaaauuuucuaacaacuuuaaguaaguucuuug

SEQ ID NO: 73311 - RNA, 64 nt, Homo Sapiens
aguauguagcaaauggaaagccuagaaauaucuuauuuucuaaguuuaccuuuaguuuaccuaa

SEQ ID NO: 73312 - RNA, 64 nt, Homo Sapiens
uuuguguccauauuccauuagauugugauuauuaauuuucuagcuaugguauuacuauaucaca

SEQ ID NO: 73313 - RNA, 64 nt, Homo Sapiens
uagggaaagugauuuaaacuuuauuuaaagagguauuuucuaauuaugcacagauaucuacuuu

SEQ ID NO: 73314 - RNA, 64 nt, Homo Sapiens
guaucaucaccuuuuccagauacaaacuugccuuauuuucuaguuugugaacaagaacgaauga

SEQ ID NO: 73315 - RNA, 64 nt, Homo Sapiens
acuauaauaugugcugaaacuaaauuucuuuaauauuuucuauuccugucagcaccuuuucuag

SEQ ID NO: 73316 - RNA, 64 nt, Homo Sapiens
ugggaagaaguggaguuuuuugguuauuagguuaauuuucuaguaaaacacguugccuguuuuc

SEQ ID NO: 73317 - RNA, 64 nt, Homo Sapiens
uuuauuuugaacuaauuucuuagagaauaguuauauuuucuauuacacaaguuuaaaaauauua

SEQ ID NO: 73318 - RNA, 64 nt, Homo Sapiens
uaccacuacauuuuggugcuauuuaaggugugcaauuuucuauaggugacuuuugcaauucagg

SEQ ID NO: 73319 - RNA, 64 nt, Homo Sapiens
aaaucacgaauaugaaguacgaaaacacacaugaauuuucuauaauuuuauuauccaaaugcua

SEQ ID NO: 73320 - RNA, 64 nt, Homo Sapiens
acacuuguggagcaucaagcuuuucuaacuuacuauuuucuaaaaaaaggauuacgucugcauc

SEQ ID NO: 73321 - RNA, 64 nt, Homo Sapiens; identical to SEQ ID NO: 73311

SEQ ID NO: 73322 - RNA, 64 nt, Homo Sapiens; identical to SEQ ID NO: 73312

SEQ ID NO: 73323 - RNA, 64 nt, Homo Sapiens
ccuuccuccccuuuugcccccguggggcucccggcauccugaaagccagcaaagccuccagcau

SEQ ID NO: 73324 - RNA, 64 nt, Homo Sapiens
uccugaaagccagcaaagccuccagcaucuuuuccauccugaggugccucccaguggccuggcu

SEQ ID NO: 73325 - RNA, 64 nt, Homo Sapiens
ggaaauguuuucuucuacauugacuuuuuuuaagcauccugacaucccacugcucuacaggcug

SEQ ID NO: 73326 - RNA, 64 nt, Homo Sapiens
ugguaagcugccacacaccuagagaaucauuuaacauccugaccaugaauuguucacuacaauu

SEQ ID NO: 73327 - RNA, 64 nt, Homo Sapiens
uuuuuagaaccacagacuaucccucuuuuuagagcauccugaucaauugcaaguacuuccacuu

SEQ ID NO: 73328 - RNA, 64 nt, Homo Sapiens
accaguggcugacaaggcauauagggauauaugccauccugagaggaguaaaguguuuagauuc

SEQ ID NO: 73329 - RNA, 64 nt, Homo Sapiens
uguggcaucagucccugagucaccauggaagcagcauccugaccacagcuggcagucaagccac

SEQ ID NO: 73330 - RNA, 64 nt, Homo Sapiens
augccuccucuucugcacagaaugcuuccaccagcauccugagaagaaaugauuacuucugaaa

SEQ ID NO: 73331 - RNA, 64 nt, Homo Sapiens
uaacacuguuuuaaacuuuccucccauccugauacauccugaagaaucaugcuggagaccuuaa

SEQ ID NO: 73332 - RNA, 64 nt, Homo Sapiens
cauccugaaguaacacuguugagaccuuaacucccauccugauacacugauuuuaaucaugcug

SEQ ID NO: 73333 - RNA, 64 nt, Homo Sapiens
cagaucuuagcagagaugcuaacacaggagugaacauccugaaugaucuuucuauauaauaaau

SEQ ID NO: 73334 - RNA, 64 nt, Homo Sapiens
auagggcagagugcccagggcugucugcaguggccauccugagguuccccaugacgagagccuc

SEQ ID NO: 73335 - RNA, 64 nt, Homo Sapiens
uugcuggcgggauccccauggugcccggcauggccauccugaugauuugcacagaggaaagcgg

SEQ ID NO: 73336 - RNA, 64 nt, Homo Sapiens
uugcacagaggaaagcgggucccuccuagucuuucauccugaauagagcaagaggucccgaguc

SEQ ID NO: 73337 - RNA, 64 nt, Homo Sapiens
cuugauuuaggcuugggcugacgacaaaguuguacauccugaaccccaaagccgugagugucau

SEQ ID NO: 73338 - RNA, 64 nt, Homo Sapiens
aaguacagguguucuuuggcuuaggauaggguuacauccugauaaaauaaucauaagucaaaaa

SEQ ID NO: 73339 - RNA, 64 nt, Homo Sapiens
gcacagucucccugcucauggaguccccuuugcccauccugaaugccucacugccccucuugca

SEQ ID NO: 73340 - RNA, 64 nt, Homo Sapiens
cagaaguggaaauguccagccgugcagcaucuugcauccugaguggucuuuggauggcuugccc

SEQ ID NO: 73341 - RNA, 64 nt, Homo Sapiens
uaaaaaagcaagaauaugaagaaguaauuguaagcauccugaaacuauaaacaaagucuuccug

SEQ ID NO: 73342 - RNA, 64 nt, Homo Sapiens
auuuuaucaagaaagcagaucuacaucaggccuucauccugaggauuaaagcguaaaaggagac

SEQ ID NO: 73343 - RNA, 64 nt, Homo Sapiens
gaggaaaagucuuccuaauugugccccuaaagagcauccugauaccauucuauucuccagacau

SEQ ID NO: 73344 - RNA, 64 nt, Homo Sapiens
ggagaaguaguauuugccuauuucccccuucauccauccugagccaaauuucuuuugcugaaca

SEQ ID NO: 73345 - RNA, 64 nt, Homo Sapiens
uccaaucaaaccucagcccgaucccucaccuucuccaaaccagacagcagccaccuccucugag

SEQ ID NO: 73346 - RNA, 64 nt, Homo Sapiens
aucacaccaacucugacacaggaggugcugagcuccaaaccagccccccugcaugccccaugug

SEQ ID NO: 73347 - RNA, 64 nt, Homo Sapiens
acccgcagaugacacgcgcucuccaccacccaacccaaaccaugagaauuugcaacaggggagg

SEQ ID NO: 73348 - RNA, 64 nt, Homo Sapiens
guuagggucagccauuuuuaaugaucucggaugaccaaaccagccuucggagcguucucugucc

SEQ ID NO: 73349 - RNA, 64 nt, Homo Sapiens
ucagcauccuuucaagaauaguggggggacacaaccaaaccauauacaauucaaguugagauuu

SEQ ID NO: 73350 - RNA, 64 nt, Homo Sapiens
ucauucuaccccuggccccuggguggggacauagccaaaccauaacaauuucaaguugagauuu

SEQ ID NO: 73351 - RNA, 64 nt, Homo Sapiens
uggggaagccugucuagaugugggacucauugccccaaaccagggagaggaagagcucccacag

SEQ ID NO: 73352 - RNA, 64 nt, Homo Sapiens
ggggguaaacaggucucccagcauucugaguguuccaaaccaguaauccacaugccaauucaaa

SEQ ID NO: 73353 - RNA, 64 nt, Homo Sapiens
ucucgguuuucuuacacugugaucuuaaaaguuaccaaaccaaagucauuuucaguuugaggca

SEQ ID NO: 73354 - RNA, 64 nt, Homo Sapiens
agaggcccuucucacugagacagcaacauuuaaaccaaaccagaggaaguauuuguggaacuca

SEQ ID NO: 73355 - RNA, 64 nt, Homo Sapiens
cugaagggcuguaguagagacugagcucccauguccaaaccaucauauauaaagauaaauaugc

SEQ ID NO: 73356 - RNA, 64 nt, Homo Sapiens
cugugggggaugcauccagacacaaggcaguugcccaaaccauucagaacuucuaacuugacca

SEQ ID NO: 73357 - RNA, 64 nt, Homo Sapiens
acacuacccugagaucugcaagggcugauggauuccaaaccaggcacaaacuugugagcaucag

SEQ ID NO: 73358 - RNA, 52 nt, Homo Sapiens
accccauaugucaguguaaaagccaaaccaacugguaaccgaaaaagaauag

SEQ ID NO: 73359 - RNA, 64 nt, Homo Sapiens
agaggagagcuugaugugauuaucuucaaacccaccaaaccaacaggauaauugacaaauaaac

SEQ ID NO: 73360 - RNA, 64 nt, Homo Sapiens
caaaugcuaauguuuuauucaauguaaaggaagaccaaaccauguaccuuaugaagaccuuugu

SEQ ID NO: 73361 - RNA, 64 nt, Homo Sapiens
uugaaucugguuauuauuuaaaaacuagaagcccccaaaccagcagaucuuacugaagaugaug

SEQ ID NO: 73362 - RNA, 64 nt, Homo Sapiens
aaacuccagauaucaaggaauugggaaauccuggccaaaccaccccaagaugauuacacugaaa

SEQ ID NO: 73363 - RNA, 64 nt, Homo Sapiens
ugaacucauugaucgagugcugucugcuaaaucuccaaaccauucccaaaccuuuccccguagu

SEQ ID NO: 73364 - RNA, 64 nt, Homo Sapiens
cgaagugucagcccucaauguuggguacuuagacccaaaccaauaaauggugaguuuugaacaa

SEQ ID NO: 73365 - RNA, 64 nt, Homo Sapiens
uaccauuuaaguugagauuucaguggggacacagccaaaccauaucauucuaccccuggcaccu

SEQ ID NO: 73366 - RNA, 64 nt, Homo Sapiens
auaaauucaaguugcaauuucaguggggacauagccaaaccauaucacuggugaugccacuucu

SEQ ID NO: 73367 - RNA, 64 nt, Homo Sapiens
agcaaagucucaccccuuugucuacguugcuuccccaaaccaugagcagagggacuucgaugcc

SEQ ID NO: 73368 - RNA, 64 nt, Homo Sapiens
gcuuccccaaaccaugagcagagggacuucgaugccaaaccagacucggguccccuccugcuuc

SEQ ID NO: 73369 - RNA, 64 nt, Homo Sapiens
ccucggcugcuaugaguugguguuuacgggagugccaaaccagcccccaaaccaaucaaggguu

SEQ ID NO: 73370 - RNA, 64 nt, Homo Sapiens
caaggguuuguuuacgggagcuucagcagcuaccccaaaccaaugacgagcuagcccgaacuga

SEQ ID NO: 73371 - RNA, 64 nt, Homo Sapiens
ggaagacugccucaaacaaacaaaaaacaacaaaccaaaccaaaccaaaccaaaaaaaucucaa

SEQ ID NO: 73372 - RNA, 64 nt, Homo Sapiens
acugccucaaacaaacaaaaaacaacaaaccaaaccaaaccaaaccaaaaaaaucucaaagcga

SEQ ID NO: 73373 - RNA, 64 nt, Homo Sapiens
cucaaacaaacaaaaaacaacaaaccaaaccaaaccaaaccaaaaaaaucucaaagcgauugga

SEQ ID NO: 73374 - RNA, 64 nt, Homo Sapiens
ucugccugucccuguaucagcggcuacccaccuuccaaaccacucaggacaguacccguggcac

SEQ ID NO: 73375 - RNA, 64 nt, Homo Sapiens
cuuuucaugugauguggaaaccuacuucuguccuccaaaccaugaaaugugucaucuagacugc

SEQ ID NO: 73376 - RNA, 64 nt, Homo Sapiens
guauaauggguauacauuuuuguaaauagcauccccaaaccagccagccuucaguuauuuacaa

SEQ ID NO: 73377 - RNA, 64 nt, Homo Sapiens
cuccugcagcaugccccuuaagauuuucuacaacccaaaccaaguguauguauugauuucuagg

SEQ ID NO: 73378 - RNA, 64 nt, Homo Sapiens
ccuaucugcaugauucugaaagugauaacaccaaccaaaccacuguuaaauaggcaagguaccc

SEQ ID NO: 73379 - RNA, 64 nt, Homo Sapiens
auuauuucaauuauggcacuucuguacuaauucuccaaaccaguuaugcggcauuuaugaccaa

SEQ ID NO: 73380 - RNA, 64 nt, Homo Sapiens
guguuuaaaugugacacuugugagaaggcauuugccaaaccaagccagcuggagcgccacagcc

SEQ ID NO: 73381 - RNA, 64 nt, Homo Sapiens
uuaguaucgucaauggugccacauaaaacaugucccaaaccaaaucccacccgugcugggcaga

SEQ ID NO: 73382 - RNA, 64 nt, Homo Sapiens
guuccucggcggacucugcugaccuccugcagacccaaaccacagccacaucccagcuucugug

SEQ ID NO: 73383 - RNA, 64 nt, Homo Sapiens
ggcugccagccaggacccuggccugcagccugauccaaaccaaagacuguagaacccuggggug

SEQ ID NO: 73384 - RNA, 64 nt, Homo Sapiens
ccaugauaaugucaguaggaaaaccacagagaauccaaaccaauccuaggacuugacccuuacc

SEQ ID NO: 73385 - RNA, 64 nt, Homo Sapiens
gagaauccaaaccaauccauggacuugacccuuaccaaaccacagguuagaaaaccuucaccua

SEQ ID NO: 73386 - RNA, 64 nt, Homo Sapiens
aauccagacucaggguuccagaaaucccccguucccaaaccaaaccaaucauggaucuucccuu

SEQ ID NO: 73387 - RNA, 64 nt, Homo Sapiens
agacucaggguuccagaaaucccccguucccaaaccaaaccaaucauggaucuucccuuuaagg

SEQ ID NO: 73388 - RNA, 64 nt, Homo Sapiens
ugggugagaacaagcccaauccaaggaggaauggccaaaccagacaguaccuggaugauuccca

SEQ ID NO: 73389 - RNA, 64 nt, Homo Sapiens
ccacacacgugucuguuccgcuaagauccccaggccaaaccaugcaauaguucaggucagacau

SEQ ID NO: 73390 - RNA, 64 nt, Homo Sapiens
gaacagacaggcauaaaucuguucauaugguagaacacaugauguuagaguauauuuuguugaa

SEQ ID NO: 73391 - RNA, 64 nt, Homo Sapiens
guguaucucuauuucuggccaucacuuuuuuaauacacaugacuuuccucucccaguuuccaga

SEQ ID NO: 73392 - RNA, 64 nt, Homo Sapiens
acacaaaugcaaaccuuugcgagcauacaugucuacacaugacuauccugacacaaaaacacau

SEQ ID NO: 73393 - RNA, 64 nt, Homo Sapiens
auacaugucuacacaugacuauccugacacaaaaacacaugagcuuagucuuagucaccuuauu

SEQ ID NO: 73394 - RNA, 64 nt, Homo Sapiens
ccguauaugagcacaaguaagguuucagagcaacacacaugagaaagagaguaacccggaauug

SEQ ID NO: 73395 - RNA, 64 nt, Homo Sapiens
gaaaguaugacagauuucuacuuaacuagaauggacacaugauccacaauuuucucuucaaggg

SEQ ID NO: 73396 - RNA, 64 nt, Homo Sapiens
uucaugugggcuuaauuuuccucuguguaaauguacacaugaaccauuucaugugcagacgugc

SEQ ID NO: 73397 - RNA, 64 nt, Homo Sapiens
aaaugcuacuccaaucugaauggaaaauauaguaacacaugaaacuggguugacuggaaaggaa

SEQ ID NO: 73398 - RNA, 64 nt, Homo Sapiens
ucagaaaaacucuagggaugcacugcaugugugaacacaugauaaaaaagucaugcuuuauuuu

SEQ ID NO: 73399 - RNA, 64 nt, Homo Sapiens
uguaucaacaaugauuaacuccuuuauuauacauacacaugaaugugcauuuuugguaaaugca

SEQ ID NO: 73400 - RNA, 64 nt, Homo Sapiens
augcacacuggagauggaccucaagcuuucgaagacacaugacaggaaagcguuaucucauagc

SEQ ID NO: 73401 - RNA, 64 nt, Homo Sapiens
aggcacacuagagauggaccggaagcuuccaaagacacaugauaggaaagcauuugaucaucug

SEQ ID NO: 73402 - RNA, 64 nt, Homo Sapiens
acaggugcaauauauugacucuaauauaggaaaaacacaugagagcagggaaggaacuuacugu

SEQ ID NO: 73403 - RNA, 64 nt, Homo Sapiens
agucacuuuggagagaagcccucuuucuuaacuaacacaugagccuuuucauuuuuuuugucag

SEQ ID NO: 73404 - RNA, 64 nt, Homo Sapiens
ccacuuagucauguaagugcauauacacauacacacacaugaguguagacauguguuuauuaau

SEQ ID NO: 73405 - RNA, 64 nt, Homo Sapiens
uaauaauauguagaaaaauguaacuuagagaguaacacaugaacauugaaguuaaaacccagaa

SEQ ID NO: 73406 - RNA, 64 nt, Homo Sapiens
cccaccagaucuccauucuuugccaugagggccaacacaugagaccccaccucccucccugccu

SEQ ID NO: 73407 - RNA, 64 nt, Homo Sapiens
uucuguuguuuuguuuuuaacaacuauacuuugcacacaugaaggucacugugguuuguguguu

SEQ ID NO: 73408 - RNA, 64 nt, Homo Sapiens
auagauauuagaaacuaauaauuauacuaacaauacacaugagagcggaacuguuuuaauuaca

SEQ ID NO: 73409 - RNA, 64 nt, Homo Sapiens
caaacauagaauggaguaccuccauuggcuugagacacaugaccauacccucugauuauuggaa

SEQ ID NO: 73410 - RNA, 64 nt, Homo Sapiens
ugcuuuaaaauaaauaauaaauuuugcuaccaguuacauugaacuucuguuuauugucuguacc

SEQ ID NO: 73411 - RNA, 64 nt, Homo Sapiens
aaacuaaaacauaaaugaaaauagcauguuuuauuacauugaagucuuagaauuugagauguuc

SEQ ID NO: 73412 - RNA, 64 nt, Homo Sapiens
aaacuaaaguaccacaauaggaucauagcuuaaauacauugaaaucuagcuaaugcucagguga

SEQ ID NO: 73413 - RNA, 64 nt, Homo Sapiens
ccagccugacuguccucaugguaacuggcaguguuacauugaccccugaagagugaggacccgu

SEQ ID NO: 73414 - RNA, 64 nt, Homo Sapiens
uauggaucugugccacaggggauuuaugcugcuuuacauugacuaugcaguugaagaguugcac

SEQ ID NO: 73415 - RNA, 64 nt, Homo Sapiens
aaaagagaaaaauauuuuaauuuaaaaauuguaauacauugauuuauaaaaugccuucucugau

SEQ ID NO: 73416 - RNA, 64 nt, Homo Sapiens
auugguacauuuuaauuauuggucuucaguguuuuacauugaaucaaccccacccuacuagcua

SEQ ID NO: 73417 - RNA, 64 nt, Homo Sapiens
cuaaacagcaguuaaguuguaaacauuuucaacauacauugagcgaacaaaguacacuugauaa

SEQ ID NO: 73418 - RNA, 64 nt, Homo Sapiens
uuuuuaaagccagucuuguucacauccauuacuauacauugaauuaugcuguguaaaaauagaa

SEQ ID NO: 73419 - RNA, 64 nt, Homo Sapiens
uuccaaauuagcaacuucauccugcuuucuauuuuacauugaguaaaguuuuaaaaagacaaca

SEQ ID NO: 73420 - RNA, 64 nt, Homo Sapiens
ccugucaaagaccuaagucuguaagcuggugccauguccauacaccaugucacuuuacucuuca

SEQ ID NO: 73421 - RNA, 64 nt, Homo Sapiens
gugagagcacgauggugccuguguucugugaauguguccauaugugucuguaagagagacagag

SEQ ID NO: 73422 - RNA, 64 nt, Homo Sapiens; identical to SEQ ID NO: 23640

SEQ ID NO: 73423 - RNA, 64 nt, Homo Sapiens; identical to SEQ ID NO: 23641

SEQ ID NO: 73424 - RNA, 64 nt, Homo Sapiens; identical to SEQ ID NO: 23642

SEQ ID NO: 73425 - RNA, 64 nt, Homo Sapiens; identical to SEQ ID NO: 23643

SEQ ID NO: 73426 - RNA, 64 nt, Homo Sapiens; identical to SEQ ID NO: 23644

SEQ ID NO: 73427 - RNA, 64 nt, Homo Sapiens; identical to SEQ ID NO: 23645

SEQ ID NO: 73428 - RNA, 64 nt, Homo Sapiens; identical to SEQ ID NO: 23646

SEQ ID NO: 73429 - RNA, 64 nt, Homo Sapiens; identical to SEQ ID NO: 23647

SEQ ID NO: 73430 - RNA, 64 nt, Homo Sapiens; identical to SEQ ID NO: 23648

SEQ ID NO: 73431 - RNA, 64 nt, Homo Sapiens; identical to SEQ ID NO: 23649

SEQ ID NO: 73432 - RNA, 64 nt, Homo Sapiens; identical to SEQ ID NO: 23650

SEQ ID NO: 73433 - RNA, 64 nt, Homo Sapiens; identical to SEQ ID NO: 23651

SEQ ID NO: 73434 - RNA, 64 nt, Homo Sapiens; identical to SEQ ID NO: 23652

SEQ ID NO: 73435 - RNA, 64 nt, Homo Sapiens; identical to SEQ ID NO: 23653

SEQ ID NO: 73436 - RNA, 64 nt, Homo Sapiens; identical to SEQ ID NO: 23654

SEQ ID NO: 73437 - RNA, 64 nt, Homo Sapiens; identical to SEQ ID NO: 23655

SEQ ID NO: 73438 - RNA, 64 nt, Homo Sapiens; identical to SEQ ID NO: 23656

SEQ ID NO: 73439 - RNA, 64 nt, Homo Sapiens; identical to SEQ ID NO: 23657

SEQ ID NO: 73440 - RNA, 64 nt, Homo Sapiens; identical to SEQ ID NO: 23658

SEQ ID NO: 73441 - RNA, 64 nt, Homo Sapiens; identical to SEQ ID NO: 23659

SEQ ID NO: 73442 - RNA, 64 nt, Homo Sapiens; identical to SEQ ID NO: 23660

SEQ ID NO: 73443 - RNA, 64 nt, Homo Sapiens; identical to SEQ ID NO: 23661

SEQ ID NO: 73444 - RNA, 64 nt, Homo Sapiens; identical to SEQ ID NO: 23662

SEQ ID NO: 73445 - RNA, 64 nt, Homo Sapiens; identical to SEQ ID NO: 23663

SEQ ID NO: 73446 - RNA, 64 nt, Homo Sapiens; identical to SEQ ID NO: 23664

SEQ ID NO: 73447 - RNA, 64 nt, Homo Sapiens; identical to SEQ ID NO: 23665

SEQ ID NO: 73448 - RNA, 64 nt, Homo Sapiens; identical to SEQ ID NO: 23666

SEQ ID NO: 73449 - RNA, 64 nt, Homo Sapiens; identical to SEQ ID NO: 23667

SEQ ID NO: 73450 - RNA, 64 nt, Homo Sapiens; identical to SEQ ID NO: 23668

SEQ ID NO: 73451 - RNA, 64 nt, Homo Sapiens; identical to SEQ ID NO: 23669

SEQ ID NO: 73452 - RNA, 64 nt, Homo Sapiens; identical to SEQ ID NO: 23670

SEQ ID NO: 73453 - RNA, 64 nt, Homo Sapiens
ugccccacucccaucucuucuucccugccaccccucccugcagccuccgcggcucacuccagcc

SEQ ID NO: 73454 - RNA, 64 nt, Homo Sapiens
cuccuucuauucccuuccuucugcccugccugccucccugcaccugcggccucucuaggaagcu

SEQ ID NO: 73455 - RNA, 64 nt, Homo Sapiens
gguccucugggaugccagcucuccccuuugugcuucccugcagcaacccauggagggcccaggg

SEQ ID NO: 73456 - RNA, 64 nt, Homo Sapiens
caguuggugggggugcgggggugcguguccccauucccugcaacagcaaauggggcuccuucuu

SEQ ID NO: 73457 - RNA, 64 nt, Homo Sapiens
cuugggguuuggcuuuaguuacauccagaaagcuucccugcaauugaguccuggacuggacuga

SEQ ID NO: 73458 - RNA, 64 nt, Homo Sapiens
acagucccccagaaacuuaggacugguuuggaucucccugcauguugucgagaggauuuccuga

SEQ ID NO: 73459 - RNA, 64 nt, Homo Sapiens
agcugagagagacuugccgcacacaggucucccgucccugcaccuggcccugccuugagaagag

SEQ ID NO: 73460 - RNA, 64 nt, Homo Sapiens
ugcugaaucuagccuaauucuaagugagguuccuucccugcaaaucuggugaaaagcuuuucac

SEQ ID NO: 73461 - RNA, 64 nt, Homo Sapiens
cucagcccccgcccgucaccacgccucggccacgucccugcacugggcagccggcucuccuugc

SEQ ID NO: 73462 - RNA, 64 nt, Homo Sapiens
ccuuugccaaguggcauuacaaucacuucugaagucccugcagcccucuccuggaucaaaaaug

SEQ ID NO: 73463 - RNA, 64 nt, Homo Sapiens
cuuggggugugagugagacagcuugccagcugcaucccugcagacagaggauguguguccacau

SEQ ID NO: 73464 - RNA, 64 nt, Homo Sapiens
cuaacacaggagaugaugggaaccugucccgcagucccugcaugaccauuggcccugcuggccu

SEQ ID NO: 73465 - RNA, 64 nt, Homo Sapiens
cagcuuccuagcucaugcccgucugucuggguucucccugcagauggaggaugaccuucggucg

SEQ ID NO: 73466 - RNA, 64 nt, Homo Sapiens
ccaagucauugcucagccagagccccauucugaaucccugcaggacaaguaguccuugaaacug

SEQ ID NO: 73467 - RNA, 64 nt, Homo Sapiens
gccaaagccccaccuucagggagguuucccugcaucccugcaguuaggaugugcauuuucaccu

SEQ ID NO: 73468 - RNA, 64 nt, Homo Sapiens
ccugcagugccaaagccccauuucaccugagguuucccugcaucaaggaauuuaggaugugcau

SEQ ID NO: 73469 - RNA, 64 nt, Homo Sapiens
gagcuagaaggcccugcagcuacagcugcuucauucccugcauuagugccugguuacuggguac

SEQ ID NO: 73470 - RNA, 64 nt, Homo Sapiens
gagcuagaaggcccugcagcuacagcugcuucauucccugcauuagcgagcaguuauuggguac

SEQ ID NO: 73471 - RNA, 64 nt, Homo Sapiens
ucugaucuaucucuggaaaaccagccauuccuccucccugcagucagaauucuuugcccugucu

SEQ ID NO: 73472 - RNA, 64 nt, Homo Sapiens
aguaguuaaguacauaguguagcaaacuuuuacuucccugcagaauuuuguuucuggagaaggc

SEQ ID NO: 73473 - RNA, 64 nt, Homo Sapiens
cuaccacugcugaggacagucuggcacaagcgagucccugcaaaguuaccauaaagcuaaugcu

SEQ ID NO: 73474 - RNA, 64 nt, Homo Sapiens
gaggcaacagcauuucaagauucacccucaccucucccugcaugcuucccacccacccagucca

SEQ ID NO: 73475 - RNA, 64 nt, Homo Sapiens
gaaaaaucuugaacauuuauccaugccuucucucucccugcaaaacuuagcguuuggauagacu

SEQ ID NO: 73476 - RNA, 64 nt, Homo Sapiens
uacaaggacauguacuaacggcggcacccaggccucccugcagacuccaauggggccagcacug

SEQ ID NO: 73477 - RNA, 64 nt, Homo Sapiens
cccuuuacucagcccagcuggccaccuagaagucucccugcacagccucuaguguccggggacc

SEQ ID NO: 73478 - RNA, 64 nt, Homo Sapiens
cuucugacugacaguucaucuuucacaucuauacucccugcaccuccauguagcugauucuguu

SEQ ID NO: 73479 - RNA, 64 nt, Homo Sapiens
cggugguggugauguugggaagggcgcaaacacaucccugcacccagcgcugcggucuggucuc

SEQ ID NO: 73480 - RNA, 64 nt, Homo Sapiens
gguacuggcucuuuucuccuugacugaguuccuaucccugcacuagaaaucuccauuccacaca

SEQ ID NO: 73481 - RNA, 64 nt, Homo Sapiens
uguuccauugugacuucucuuccccagcaccccuucccugcaugaagaagauucuugugaaguu

SEQ ID NO: 73482 - RNA, 64 nt, Homo Sapiens
caucacaaagcccauacaacaccaaaaguagaaaucccugcacucuagcuuugauggcagcaag

SEQ ID NO: 73483 - RNA, 64 nt, Homo Sapiens
aaccugcagaauaaaugagaggacucucuugaccucccugcaucccuuccuggguguuaacugg

SEQ ID NO: 73484 - RNA, 64 nt, Homo Sapiens
ugauuuuggucaauuuuauuauuaauucuuaaauucccugcagagaaugcccccuuuauugcug

SEQ ID NO: 73485 - RNA, 64 nt, Homo Sapiens
uggcauugcucccacugagcccuacuccacccugucccugcacucccuugguugccaaaaaaau

SEQ ID NO: 73486 - RNA, 64 nt, Homo Sapiens
gaagcaccacucuagacuggggguuguuuccaagucccugcaaagaggggaugcuguguuuggg

SEQ ID NO: 73487 - RNA, 64 nt, Homo Sapiens
gugcguccugcuggucuggcccgccuacaacugcucccugcacgcuuccuccuggaguccggag

SEQ ID NO: 73488 - RNA, 64 nt, Homo Sapiens
ccaacaggugcauggugagugggccgcaccucugucccugcaaaacacagggugagaagaguca

SEQ ID NO: 73489 - RNA, 64 nt, Homo Sapiens
gggugaccuaagcguggugcccauggacuuccggucccugcaaccgcucaggguugcggcagag

SEQ ID NO: 73490 - RNA, 64 nt, Homo Sapiens
ccaccccugcgugcgccucuagccucaggccccgucccugcacccacgacaccaggcaggagug

SEQ ID NO: 73491 - RNA, 64 nt, Homo Sapiens
cguuuuacuuuggugucccagcgggucggccgguucccugcauucgugucuggggggcgacgug

SEQ ID NO: 73492 - RNA, 64 nt, Homo Sapiens
uuauacauuagacauuggcacuuguguaaaacugucccugcagauugagcaggaaguaaaaaca

SEQ ID NO: 73493 - RNA, 64 nt, Homo Sapiens
acucuguggguugcuaggauguaauuuuaaugcuucccugcaguccaaagaugauuuuuucacc

SEQ ID NO: 73494 - RNA, 64 nt, Homo Sapiens
cagccagugucuuguccuuaguaauuauuugcuuucccugcaguucaauuucuccuuggaacuc

SEQ ID NO: 73495 - RNA, 64 nt, Homo Sapiens
cagauacagcaacauggccuccugugccuggcugucccugcaccggguccucaccccuguccac

SEQ ID NO: 73496 - RNA, 64 nt, Homo Sapiens
cagccugaguucagccccaccccugggagcccccucccugcaacuacccuaggacacuggaaug

SEQ ID NO: 73497 - RNA, 64 nt, Homo Sapiens
cggcuggccaggugggcaggcccucucccaccccucccugcaggucccugcugauguggcugac

SEQ ID NO: 73498 - RNA, 64 nt, Homo Sapiens
cgccacacccccuucagcuaccucuuuccgugcaucccugcaccuauggagccucucuauuuua

SEQ ID NO: 73499 - RNA, 64 nt, Homo Sapiens
cacugggggagggaggcaucuuguuucuugugguucccugcaggccaguccuguccuccuuucc

SEQ ID NO: 73500 - RNA, 64 nt, Homo Sapiens
gucccgcucuuauccaacucuuccaggccccaccucccugcaccccuccccucuauagagcagg

SEQ ID NO: 73501 - RNA, 64 nt, Homo Sapiens
guuuuagcugaaucccuugcuucugugcuuucccucccugcacaugggcacuguaucagauaga

SEQ ID NO: 73502 - RNA, 64 nt, Homo Sapiens
gacaucgagacuccaggggguccuggcuccccugucccugcagcccugcaggucagugcaugau

SEQ ID NO: 73503 - RNA, 64 nt, Homo Sapiens
cugccuguuuaaagcaggcagcaggcuuaggccuucccugcaaccccaacacccacaaguuugu

SEQ ID NO: 73504 - RNA, 64 nt, Homo Sapiens
cccacacuucacagcaucuuuggaaccacuccacucccugcaucccuguggggaaacuguuccc

SEQ ID NO: 73505 - RNA, 64 nt, Homo Sapiens
ucaagcacuacgccuuccacugcugacugccagaucccugcauucacugggucucagauccuuc

SEQ ID NO: 73506 - RNA, 64 nt, Homo Sapiens
ccuggguccugcucuuccaacaacagugauaccaucccugcacuaugggucauuuucaaagggg

SEQ ID NO: 73507 - RNA, 64 nt, Homo Sapiens
caggaggccuccugacaccauagccccagagggaucccugcacccugggaauaaacagcugccc

SEQ ID NO: 73508 - RNA, 64 nt, Homo Sapiens
ugguacagauguuccugccuggggagguagcauuucccugcagaggguuggagcucuggcaccc

SEQ ID NO: 73509 - RNA, 64 nt, Homo Sapiens
cugggauggccagggucugacuuccccgugaucuucccugcagcuuugguagguucuucguucu

SEQ ID NO: 73510 - RNA, 64 nt, Homo Sapiens
ugcccugccaccgacagaccucaccaacacggccucccugcagcacugugcccuggcccaggca

SEQ ID NO: 73511 - RNA, 64 nt, Homo Sapiens
gaagggaaagcuggugguaggcaggucaugccccucccugcaggacagaagcaccuuugguucu

SEQ ID NO: 73512 - RNA, 64 nt, Homo Sapiens
uuugaggcuggcggggucugaggccacccccaccucccugcagcgcagaccccacccugucugc

SEQ ID NO: 73513 - RNA, 64 nt, Homo Sapiens
gugcaccugccccaggcucaggaucuuacccacuucccugcaaggguacucagucagcccagug

SEQ ID NO: 73514 - RNA, 64 nt, Homo Sapiens
ucacagccgaagcacuccauaucuugaacauuccgacguguaacgaccauaagguacaucauuu

SEQ ID NO: 73515 - RNA, 64 nt, Homo Sapiens
ggaccauaagguacaucauuaucuugaacauucugacguguaaagaccauaagguacaucaguu

SEQ ID NO: 73516 - RNA, 64 nt, Homo Sapiens
acuuucugacuaagcuaaaaaugaaugaaaaugguggcuaaagaaaauagggacucugaagaug

SEQ ID NO: 73517 - RNA, 64 nt, Homo Sapiens
aaaaaaguugaauuccaauugcuuuuuggccuuuuggcuaaaauaaauguagcaucuaauuuua

SEQ ID NO: 73518 - RNA, 64 nt, Homo Sapiens
uguggcuuaacuacuucucccuccuuguccagcacuuuucuagcucucccguuccccaucucca

SEQ ID NO: 73519 - RNA, 64 nt, Homo Sapiens
ugcccacuguuuuuucucuguugggagggaagcucuuuucuaggagugucucaguucugcuuuu

SEQ ID NO: 73520 - RNA, 64 nt, Homo Sapiens
caaauuagaagcuagcugagguagcuugcagcaucuuuucuaguugaaauggugaacugauagg

SEQ ID NO: 73521 - RNA, 64 nt, Homo Sapiens
uccacaguucauuuuuuuccgguaggaauaacuccuuuucuacauccacgcuccauagagucuc

SEQ ID NO: 73522 - RNA, 64 nt, Homo Sapiens
aguauuucugucucugaaauaaccuuuuacuuggcuuuucuagauagcuuuauuugauuucgag

SEQ ID NO: 73523 - RNA, 64 nt, Homo Sapiens
uugauuucgaguggcaaaauguuuuuuauuacggcuuuucuauugcuguaugauacagaacucu

SEQ ID NO: 73524 - RNA, 64 nt, Homo Sapiens
uucacuuugucaagcaccucaguuacacauucgccuuuucuaggauugcauuucccaagugcua

SEQ ID NO: 73525 - RNA, 64 nt, Homo Sapiens
cuccccauuuuaguuuucuaggacugaaaggauucuuuucuacauuauacauguguguugucau

SEQ ID NO: 73526 - RNA, 64 nt, Homo Sapiens
ucacucguuucuaggguuuuagugguuuagcuuucuuuucuauugaguguguucucuaaucaau

SEQ ID NO: 73527 - RNA, 64 nt, Homo Sapiens
gcauagucaggcugcaaauugaaaauggguuuuucuuuucuauucuggcuugaauuucucccca

SEQ ID NO: 73528 - RNA, 64 nt, Homo Sapiens
gguuaccaguuauccaaucagucugucaacuaaacuuuucuaaaacuaacucacuucggucucu

SEQ ID NO: 73529 - RNA, 64 nt, Homo Sapiens
caugcucuaccgcauuguagguuugaagguuuaucuuuucuaaugugucuuggacaacacuauu

SEQ ID NO: 73530 - RNA, 64 nt, Homo Sapiens
aaggccucuuacuuugggggugcagguggaagugcuuuucuacucugcagaccuaggggaaaac

SEQ ID NO: 73531 - RNA, 64 nt, Homo Sapiens
uuacugauaaccccuacaauggacaagcuguuuucuuuucuaggauccucuaaucuuucuacau

SEQ ID NO: 73532 - RNA, 64 nt, Homo Sapiens
aucaccaaacaauauguuaaccaaaauucugugccuuuucuauuagacucuggcaauaagccuu

SEQ ID NO: 73533 - RNA, 64 nt, Homo Sapiens
cucuguuucaacuuuaagcccacacacucuguagcuuuucuaaaacaguacauuccauucaugc

SEQ ID NO: 73534 - RNA, 64 nt, Homo Sapiens
cagggacuagggagggaggcagggaacguuuuuucuuuucuacaucuucacagguucggcuggg

SEQ ID NO: 73535 - RNA, 64 nt, Homo Sapiens
uaacaaauauuguggguaguagggcugacugcugcuuuucuaaaaaguaguucuuuaguaucaa

SEQ ID NO: 73536 - RNA, 64 nt, Homo Sapiens
aggauuauaggugauuucuauuuucuucuguauacuuuucuaugcuuucuagauuaucuacaug

SEQ ID NO: 73537 - RNA, 64 nt, Homo Sapiens
uuuuaaaaaaaacgcuccuuuguaggguuuuaaacuuuucuaauagauuuagauucacuuuugg

SEQ ID NO: 73538 - RNA, 64 nt, Homo Sapiens
ucuauucaaaguacuaauaucuacaugguccacacuuuucuauuuuaaaaaauuguguucucuu

SEQ ID NO: 73539 - RNA, 64 nt, Homo Sapiens
gaaagccaccauagcuguguccauuaaagucgagcuuuucuaaaucauuguaaaacuaucugaa

SEQ ID NO: 73540 - RNA, 64 nt, Homo Sapiens
uucccucgcuggggcagugcuuacuuuuuaaaaucuuuucuauucagcucugccuguuagacuc

SEQ ID NO: 73541 - RNA, 64 nt, Homo Sapiens
uuuuaauuaauuaauuuauucauuuuacuuauggcuuuucuaaugcagaacagggcaaacucuc

SEQ ID NO: 73542 - RNA, 64 nt, Homo Sapiens
gguuaaaggucugaagcagcaaauuccacuaucccuuuucuaaauguuuaaagacguguuuuua

SEQ ID NO: 73543 - RNA, 64 nt, Homo Sapiens
aaauaaaaugaucucucuuucucucucucucucucuuuucuaagaaacaauuaugugcacuuug

SEQ ID NO: 73544 - RNA, 64 nt, Homo Sapiens
ugcuagccuacaccuucucuuugguuuaguuuuccuuuucuauaacacucugaauugcuaaucu

SEQ ID NO: 73545 - RNA, 64 nt, Homo Sapiens
aacauguaaccuguaaccuuguuguuuaaguuuucuuuucuauuaauacucuguccuguggucc

SEQ ID NO: 73546 - RNA, 64 nt, Homo Sapiens
aauguaauugcuuaccugcacacaguuuuuuuuccuuuucuaaauuuguuugugaucauugaca

SEQ ID NO: 73547 - RNA, 64 nt, Homo Sapiens
agaaauguuuauugacaggucuuuucaaauaaugcuuuucuaauuaauagccaaagauuucaua

SEQ ID NO: 73548 - RNA, 64 nt, Homo Sapiens
aaauaaaagauaaaagagcgauacacaaagcuuucuuuucuaacuuuuccaagcaaaaucuaaa

SEQ ID NO: 73549 - RNA, 64 nt, Homo Sapiens
uguuucuaaagaaacccaugcugugaaauagagacuuuucuacugaucaucauaacucuguauc

SEQ ID NO: 73550 - RNA, 64 nt, Homo Sapiens
caaugaaguucacaauaggucauaaggucucuuccuuuucuaaaauugaaagacaagaaauuua

SEQ ID NO: 73551 - RNA, 64 nt, Homo Sapiens
uugaucuuuauauacucugaagcauuucuucaaacuuuucuacuuuuauuugucauugauaccu

SEQ ID NO: 73552 - RNA, 64 nt, Homo Sapiens
agaccaaugcuugaauaaguagaccccaagcauccuuuucuaaaaagugacuuaaaauaagcca

SEQ ID NO: 73553 - RNA, 64 nt, Homo Sapiens
uugugauugaguaaaagcagcuuaaauuacuuuucuuuucuacauuaagaaauauauucucaac

SEQ ID NO: 73554 - RNA, 64 nt, Homo Sapiens
ugaguuguugauuuuaggagccucucccuccuuucuuuucuaaggcuggauuaauucccagaac

SEQ ID NO: 73555 - RNA, 64 nt, Homo Sapiens
aaacuguugaucagcaaaaacauaccugcagcugcuuuucuaaccugucucagaccuuagguaa

SEQ ID NO: 73556 - RNA, 64 nt, Homo Sapiens
guaauauuaaugagaagggacaagcauggggauucuuuucuaaggaagguagauuuuuauaaaa

SEQ ID NO: 73557 - RNA, 64 nt, Homo Sapiens
ccuccuguugguuacuaaucccaguauggauuugcuuuucuaagucuuucuugugugugaugaa

SEQ ID NO: 73558 - RNA, 64 nt, Homo Sapiens
uauuuggugguuuauguuuaacucguuuacaagccuuuucuaagcaaagagaaccuuucggauc

SEQ ID NO: 73559 - RNA, 64 nt, Homo Sapiens
gacugaaaguagaagucugucaccagacucagcucuuuucuagccagcuggccgccugagggga

SEQ ID NO: 73560 - RNA, 64 nt, Homo Sapiens
acaggguggugcccuggccccgaggucaccccgacuuuucuaaaucuuguuugagugaagucau

SEQ ID NO: 73561 - RNA, 64 nt, Homo Sapiens
ccccuucccugucucaacaccugcuuugacccugcuuuucuauuauuacaucagucagcaucuu

SEQ ID NO: 73562 - RNA, 64 nt, Homo Sapiens
ugggcccauggcccagucacucaggggcgaguuucuuuucuaacauagcccuuucuuugccaug

SEQ ID NO: 73563 - RNA, 64 nt, Homo Sapiens
uucuuugccaugaggccaugaggcccgcuucauccuuuucuauuucccuagaaccuuaauggua

SEQ ID NO: 73564 - RNA, 64 nt, Homo Sapiens
uucagaucuuccaaagcacuauuuguuguaauaacuuuucuaaauguagugccuuuaaaggaaa

SEQ ID NO: 73565 - RNA, 64 nt, Homo Sapiens
ugcaaaaguggguggcaauauucagugcuuaacacuuuucuagcguugguacaucugagaaaug

SEQ ID NO: 73566 - RNA, 64 nt, Homo Sapiens
gugaguuuguuuaguucauucuucuguacuacugcuuuucuauuucaauuacucucuucuccua

SEQ ID NO: 73567 - RNA, 64 nt, Homo Sapiens
agaagcuuuuaaacuuuuugguugucuuccugaucuuuucuacacuuugcucuuaacuacugau

SEQ ID NO: 73568 - RNA, 64 nt, Homo Sapiens
uuuacaguaaaaccucauuaauuugaaguguuugcuuuucuacuggugauacuggagucuuauc

SEQ ID NO: 73569 - RNA, 64 nt, Homo Sapiens
aagcuuuaacuguagugccuaaauacuucucucucuuuucuaaaaccacugugccuacauuuaa

SEQ ID NO: 73570 - RNA, 64 nt, Homo Sapiens
uuuaaaccagaaaaccucauugucucucuccuuucuuuucuaucuugaaaagucaaaagagacc

SEQ ID NO: 73571 - RNA, 64 nt, Homo Sapiens
ccucuugccacuuuuaaaaucaacaaugcuuaggcuuuucuaagccugaaaugccuuguaccua

SEQ ID NO: 73572 - RNA, 64 nt, Homo Sapiens
uacaggccuacaacuuuugccucagacuguuccccuuuucuaaggguauucaaguuuucaccuu

SEQ ID NO: 73573 - RNA, 64 nt, Homo Sapiens
gaaggaugcacuaaaguucucacuuuagugagaacuuuucuagcuauuccaauacagaguucuu

SEQ ID NO: 73574 - RNA, 64 nt, Homo Sapiens
uaugcagaauaagcucuuuaggcuuggugucuuucuuuucuaauuacauaaauuauguuuaaau

SEQ ID NO: 73575 - RNA, 64 nt, Homo Sapiens
uuuuuuuguuuauuuuguuaagcuuuguacaggucuuuucuauuaaaaaaaaagauuaaaugcc

SEQ ID NO: 73576 - RNA, 64 nt, Homo Sapiens
uuccuuuucuuuguuuucuuuugacuuuuuucuccuuuucuauuugaacuguuuuauuuuccug

SEQ ID NO: 73577 - RNA, 64 nt, Homo Sapiens
gaguacauauauaugaaaauuauuaugacacgcacuuuucuaaucauuguacauuucucagagu

SEQ ID NO: 73578 - RNA, 64 nt, Homo Sapiens
cuuucaguugaauaagggccaagaacuuauuguucuuuucuauuaagaaucaaugcacaguaua

SEQ ID NO: 73579 - RNA, 64 nt, Homo Sapiens
aucuaacaggguuaauuucaaagcacugaugguucuuuucuacuagguacagaagugucaacag

SEQ ID NO: 73580 - RNA, 64 nt, Homo Sapiens
uguuccccuucccucacacccugccucgcccccacuuuucuaguuaacuuuuuccauaucccuc

SEQ ID NO: 73581 - RNA, 64 nt, Homo Sapiens
gaauggcacguugcugccagugccccagacaguucuuuucuacccugcgggcccgcacguuuua

SEQ ID NO: 73582 - RNA, 64 nt, Homo Sapiens
uucugauguuuguaaccagaaaccgcccguccuccuuuucuaguauccucauccucaucugugc

SEQ ID NO: 73583 - RNA, 64 nt, Homo Sapiens
cacuguuagagagagaccuacccacucuucuuagcuuuucuacugcgcggcgggcagagcgggg

SEQ ID NO: 73584 - RNA, 64 nt, Homo Sapiens
gacuaagaguguuuaaggauaauuagguuagagucuuuucuacacugagaggggcugcuggcug

SEQ ID NO: 73585 - RNA, 64 nt, Homo Sapiens
aaagaacagccuguaaaauccccaaaaucauuuucuuuucuaacccauuuaaugaaaagcagcc

SEQ ID NO: 73586 - RNA, 64 nt, Homo Sapiens
ugcaguguuaucucuugucucaagaaauacuuaccuuuucuauacauagaaaaacaaauguuac

SEQ ID NO: 73587 - RNA, 64 nt, Homo Sapiens
uguaaaauacuguaauuguaauuucuuguguguucuuuucuauuuccuaacugaaauccuauau

SEQ ID NO: 73588 - RNA, 64 nt, Homo Sapiens
ccccuuccccugugcucccuuucucuccucucuccuuuucuagccuguucuuuacauggggcuc

SEQ ID NO: 73589 - RNA, 64 nt, Homo Sapiens
cuucugaccaagggugguuaagugacacauagaacuuuucuaagagaagacagacaaguugaca

SEQ ID NO: 73590 - RNA, 64 nt, Homo Sapiens
cccaggcugaagccuggagucugcccccacuucccuuuucuauaauccacccuucugcaggccc

SEQ ID NO: 73591 - RNA, 64 nt, Homo Sapiens
cugaguugcuucccauuuccucuuucuagccguccuuuucuagugugugcucacucuuccuagg

SEQ ID NO: 73592 - RNA, 64 nt, Homo Sapiens
aguuguaaauucaauuuggaguuuauuuaauugacuuuucuaucacguuggggcacaugccaac

SEQ ID NO: 73593 - RNA, 64 nt, Homo Sapiens
cuggcaugguguuugggcagcaggcaucauuuuccuuuucuagcuucauaggaauauugugagc

SEQ ID NO: 73594 - RNA, 64 nt, Homo Sapiens
uggauuggucgccaucugcacgccaggcggcauccuuuucuaugaaguguugacuuuguaaauc

SEQ ID NO: 73595 - RNA, 64 nt, Homo Sapiens
gggccaggcucaccccucacccuuuuuuugguugcuuuucuaauaaagauggaacaguugucuu

SEQ ID NO: 73596 - RNA, 64 nt, Homo Sapiens
cugccuugcccguuugccuguuccuauucagugucuuuucuauuuuuuccucucucguucaugc

SEQ ID NO: 73597 - RNA, 64 nt, Homo Sapiens
uugguggccauguuuucuacccagacaggcccugcuuuucuaggauguggccuuagagcaagaa

SEQ ID NO: 73598 - RNA, 64 nt, Homo Sapiens
ucuccuaguuuuagguuguugguaccagcugugacuuuucuauuugaaguugggcgugcucugu

SEQ ID NO: 73599 - RNA, 64 nt, Homo Sapiens
cugagaucucaaugcgaaauaauugugcuaaaggcuuuucuacuuugugacuuacacagagcaa

SEQ ID NO: 73600 - RNA, 64 nt, Homo Sapiens
gagucugggcuuguuuguguuucuuuguugcuuucuuuucuauugaggagaaagacuuuuucac

SEQ ID NO: 73601 - RNA, 64 nt, Homo Sapiens
uuuuauaugccgcugcuuugugcugagguuuuagcuuuucuaugccuuguucuuuugaagcuug

SEQ ID NO: 73602 - RNA, 64 nt, Homo Sapiens
auaucaagaggcugcgccugugcggauagacuuccgcagugaagagugcgccaggugcuggccc

SEQ ID NO: 73603 - RNA, 64 nt, Homo Sapiens
uauacuuacgcuuccucaagcccugaugaaugcccgcagugagcccccauccugacugagguca

SEQ ID NO: 73604 - RNA, 62 nt, Homo Sapiens
cacucagggcugccacuaaccuguagaacaccccugugcaaauuuuaaaaaggaacccuuuu

SEQ ID NO: 73605 - RNA, 62 nt, Homo Sapiens
gugacugaacgagggauaauucaaacugacaaccugugcagucccguggaggguaggggagu

SEQ ID NO: 73606 - RNA, 62 nt, Homo Sapiens
ucagacugcccagcucagagugcccgucagggccugugcauccgcacgcggagccgucuguu

SEQ ID NO: 73607 - RNA, 62 nt, Homo Sapiens
cugggcgcucccugagucagagucucagaagaccugugcaggcuggcgugagaggagcggca

SEQ ID NO: 73608 - RNA, 62 nt, Homo Sapiens
ccccugcccugccgcugcagcaccaggucaggccugugcagagggaugccgcgcuccagcaa

SEQ ID NO: 73609 - RNA, 62 nt, Homo Sapiens
cugaugaggcacccaugagagagaugggggauccugugcagggccaaauuucccucucucgu

SEQ ID NO: 73610 - RNA, 62 nt, Homo Sapiens
ggcuccaguaaggauuggaggcacuuuccagcccugugcaguguugcuaccagcaagaauga

SEQ ID NO: 73611 - RNA, 62 nt, Homo Sapiens
aguacugugagguaggcaccgugacucggcugccugugcagaagguggagguggcaggcgga

SEQ ID NO: 73612 - RNA, 62 nt, Homo Sapiens
cccucccucucuucuucccuccuuccccgcucccugugcagaagggcugacaucaaaccaaa

SEQ ID NO: 73613 - RNA, 62 nt, Homo Sapiens
aaggaacccuccaguccugcucucuggccacaccugugcaggcagcugagaggcagcgugca

SEQ ID NO: 73614 - RNA, 62 nt, Homo Sapiens
guacgaccuuuacugucguaggcaucagucccccugugcauaugcaagggggacacaugaaa

SEQ ID NO: 73615 - RNA, 62 nt, Homo Sapiens
cuugguggcaaauaucucauggacucccggagccugugcagcacugaauaaagcacgugcaa

SEQ ID NO: 73616 - RNA, 62 nt, Homo Sapiens
aauaaaauggacagaauugcucacuaguuuuuccugugcaaagagacuguuugaaucuuguc

SEQ ID NO: 73617 - RNA, 62 nt, Homo Sapiens
guaggaucuuuagcaguaccgaauggggguauccugugcauugauaaauauguguugguaca

SEQ ID NO: 73618 - RNA, 62 nt, Homo Sapiens
ccuggcccucccagccaccuugcucugaugcaccugugcacccccuccagcaaggcagcacc

SEQ ID NO: 73619 - RNA, 62 nt, Homo Sapiens
ucuugcugguggaggcaugggaagcccugucaccugugcacagcuggcccugcuaggcugga

SEQ ID NO: 73620 - RNA, 62 nt, Homo Sapiens
aacugccagccccucucuuucaccuguuccauccugugcagcugacacacagcuaaggagcc

SEQ ID NO: 73621 - RNA, 62 nt, Homo Sapiens
ugccaaagacucgugggggccaucacaccugcccugugcagcggagccggaccaggcucuug

SEQ ID NO: 73622 - RNA, 62 nt, Homo Sapiens
uuugggcugcccuggcccccccgccacggugcccugugcaccgccagcaagcuggggccugu

SEQ ID NO: 73623 - RNA, 55 nt, Homo Sapiens
uucgggggguccugcuggggaugggccugugcagccuguggacauggagaucuag

SEQ ID NO: 73624 - RNA, 62 nt, Homo Sapiens
acacuggcucagcaguuccccagccaaaggaaccugugcaagggcaggccuuccucgauccu

SEQ ID NO: 73625 - RNA, 62 nt, Homo Sapiens
ggccaccugggagauagcaggugaagagggauccugugcagggguuaaagggaggugacagg

SEQ ID NO: 73626 - RNA, 62 nt, Homo Sapiens
caucgcccggcggucagugggcuucagaugggccugugcauccuggccaagcgucacccuca

SEQ ID NO: 73627 - RNA, 62 nt, Homo Sapiens
gucuggguggggcgcggaccccucacugugcgccugugcagggggugcuggugcacguggca

SEQ ID NO: 73628 - RNA, 62 nt, Homo Sapiens
cucaaugugccaggcucuuccucccaugacacccugugcaccagcugcacuggcuucccccu

SEQ ID NO: 73629 - RNA, 62 nt, Homo Sapiens
ggcuggagcggagcguccgugagcgcuuccucccugugcacugauccuggcccccucuuauu

SEQ ID NO: 73630 - RNA, 62 nt, Homo Sapiens
gccaccuggaggacuugccuguuccgacuccaccugugcagccggggccaccccaggagaaa

SEQ ID NO: 73631 - RNA, 62 nt, Homo Sapiens
ucacguauuuaugcauguggcaagcguuacuuccugugcacguagccagcccugggucuguc

SEQ ID NO: 73632 - RNA, 62 nt, Homo Sapiens
ggggagcuuugcuccaggacgggaguuguguuccugugcaagucggugggcuucuccugcau

SEQ ID NO: 73633 - RNA, 62 nt, Homo Sapiens
cugccaaggcuccauagcuuagcccccagaguccugugcauucucuguagcucaaggggggc

SEQ ID NO: 73634 - RNA, 62 nt, Homo Sapiens
ggaucagcagaggcuuaagaugggauacauggccugugcagugaggggaccuggguccuuug

SEQ ID NO: 73635 - RNA, 62 nt, Homo Sapiens
aauuacccagagauauauuuauuaacagccaaccugugcaaccugcuggagcuuuauuuuua

SEQ ID NO: 73636 - RNA, 64 nt, Homo Sapiens
uaguucagucuaguguugguagcaugacagaaaguggggaaaaugccgcaguuuguugccuuga

SEQ ID NO: 73637 - RNA, 64 nt, Homo Sapiens
ugauaagcuuuucuuuuaaacuuagguuuuaaguuggggaaagacuuaauuaacuaauauagua

SEQ ID NO: 73638 - RNA, 64 nt, Homo Sapiens
uccuguggugugcaaagcauuaugauaggcaccguggggaaacuggaaaugaauuugacaugaa

SEQ ID NO: 73639 - RNA, 64 nt, Homo Sapiens
uuacuuacuuuuauagcauuacugugccuagucguggggaaagagauggggcuguauagauuau

SEQ ID NO: 73640 - RNA, 64 nt, Homo Sapiens
aauggaucccugagcucugagccaagggugaggauggggaaacucuaagcucccaccuaauaag

SEQ ID NO: 73641 - RNA, 64 nt, Homo Sapiens
uggauugaauauacauugagcccaaagucaaguuuggggaaaaggcagacuaaggccuccuuuc

SEQ ID NO: 73642 - RNA, 64 nt, Homo Sapiens
gaggccauucugggccccuucucuugggauccuuuggggaaaagggggaaaggagauggagcag

SEQ ID NO: 73643 - RNA, 64 nt, Homo Sapiens
agauggagcagcucuugggaguggcucagggaccuggggaaaggucugcccuccacugggccca

SEQ ID NO: 73644 - RNA, 64 nt, Homo Sapiens
gauggagcucuugggcccagagcugccuguacuuuggggaaacagccccacucaauggccuaga

SEQ ID NO: 73645 - RNA, 64 nt, Homo Sapiens
gaggcaggaacaggguucugcgcagacccacagguggggaaacuccuccauacccagcccuaua

SEQ ID NO: 73646 - RNA, 64 nt, Homo Sapiens
ucugguccugaucuccaagugccagaugcaagaauggggaaaaggagguccugcccaagcacag

SEQ ID NO: 73647 - RNA, 64 nt, Homo Sapiens
gggccgagugaucuggggguugggaaggugggucuggggaaagugugccuaccucccucaagcc

SEQ ID NO: 73648 - RNA, 64 nt, Homo Sapiens
aaaaugaaaauucauuaguuucccuuuuuaauauuggggaaagauuauaaugauaguauaauua

SEQ ID NO: 73649 - RNA, 64 nt, Homo Sapiens
uuugggaaauauaagccagcugccugcaucguguuggggaaaugcuguccugagccauguaaua

SEQ ID NO: 73650 - RNA, 64 nt, Homo Sapiens
guaugcauaccugccagcucguaugccucuggcauggggaaauuaagggaacagugucuguuug

SEQ ID NO: 73651 - RNA, 64 nt, Homo Sapiens
cgcauuggcgcaauauuuaugggagugggagggauggggaaaauaaacuuaacucuacaaaagc

SEQ ID NO: 73652 - RNA, 64 nt, Homo Sapiens
ucagaaauccuacuucagaaguguaauaaauggauggggaaaucguuugauggggaaaagucuc

SEQ ID NO: 73653 - RNA, 64 nt, Homo Sapiens
agaaguguaauaaauggauggggaaaucguuugauggggaaaagucucuuguaaguaaaaguag

SEQ ID NO: 73654 - RNA, 64 nt, Homo Sapiens
aaggaaaaaagcaaaauuggccugaauauucucuuggggaaagagggcaccaaagaaaagggua

SEQ ID NO: 73655 - RNA, 64 nt, Homo Sapiens
uaaugaagcucugcauagaggaacuagucagaaguggggaaaacacugucuaauuuuuaucagu

SEQ ID NO: 73656 - RNA, 64 nt, Homo Sapiens
caaaaauaaaaaaaaucaaguauuggcaaagauguggggaaaauucucauaagcuacugaugag

SEQ ID NO: 73657 - RNA, 64 nt, Homo Sapiens
ggcuuguucuuguggcuucugaugauuucugacuuggggaaaaauggggaagaguugaaauacg

SEQ ID NO: 73658 - RNA, 64 nt, Homo Sapiens
gagggcugguagggaugagcucccugcacacagauggggaaacccuccccgaggcacccuccuc

SEQ ID NO: 73659 - RNA, 64 nt, Homo Sapiens
ggugcuucuggggaagugcuccuaggaccucccuuggggaaagaggaggccucaugcgucugcu

SEQ ID NO: 73660 - RNA, 64 nt, Homo Sapiens
cuucaggccuagggguuauccaaccaagcauucuuggggaaagagaaaucacugacauucuaua

SEQ ID NO: 73661 - RNA, 64 nt, Homo Sapiens
caggggcagauuucauaacaacaucucaaaaauuuggggaaacacaacguugaaaacuuccuaa

SEQ ID NO: 73662 - RNA, 64 nt, Homo Sapiens
uuauuuuucucugaccuuuccauccuugaaaaaauggggaaaaaagaagaaaaaagacaaaauc

SEQ ID NO: 73663 - RNA, 64 nt, Homo Sapiens
cugcugguuuggggcacaaggaagccuuaggguauggggaaaggcuguuauuaccuagaguuua

SEQ ID NO: 73664 - RNA, 63 nt, Homo Sapiens
auauucuuucccagugauuacucggaaacacaacuggggaaauuccuuuuuuuuuuuuuuuaa

SEQ ID NO: 73665 - RNA, 64 nt, Homo Sapiens
aauguccaaguuuguguaaaaucuggguacuguauggggaaaaaaugccauaagaaaaugcaau

SEQ ID NO: 73666 - RNA, 64 nt, Homo Sapiens
auuucuagguugaagcuggucaucugaacuaacuuggggaaacacaaacuuuggacgagacucu

SEQ ID NO: 73667 - RNA, 64 nt, Homo Sapiens
gggcuuugcaaagccgaggagacugcugcucuaauggggaaaggcgagagcugguaacuaggua

SEQ ID NO: 73668 - RNA, 64 nt, Homo Sapiens
uuguauguaaauguacagaaaucuguuguaccuuuggggaaaaugcgugucugcauggugucgc

SEQ ID NO: 73669 - RNA, 64 nt, Homo Sapiens
cugucuuuccaaaaguccaaccucucaacugguguggggaaaucgcugccucagccaagcugag

SEQ ID NO: 73670 - RNA, 64 nt, Homo Sapiens
aauuaaauaaauaaacucccacagagucuccaucuggggaaaaaauugcacuccagccugggcg

SEQ ID NO: 73671 - RNA, 64 nt, Homo Sapiens
cugucuuuacuaaaaauauacagccuggccaacauggggaaaccugaggucagaaguucaagac

SEQ ID NO: 73672 - RNA, 64 nt, Homo Sapiens
cauggcaugagagagggcagagaaacuaaguugcuggggaaaguuagaggaacugaaaguuugg

SEQ ID NO: 73673 - RNA, 64 nt, Homo Sapiens
uaaagaauaaugcuccucuuucaggguaauaaaguggggaaaaggaacgucuucucaaugcaag

SEQ ID NO: 73674 - RNA, 64 nt, Homo Sapiens
auauguuuauugacacauaaagagcauauguuauuggggaaagggggaaaguuaguugagaauc

SEQ ID NO: 73675 - RNA, 64 nt, Homo Sapiens
uaguugagaaucagagcauaaaugaacauauuacuggggaaagucuaccaauuccuauucccaa

SEQ ID NO: 73676 - RNA, 64 nt, Homo Sapiens
uuaagcaaaucuggcuuuguaaaaaaucauaauuuggggaaaguucuguucagaugugaucuau

SEQ ID NO: 73677 - RNA, 64 nt, Homo Sapiens
auuucuggaggggaaaaagauuacaauucuuuccuggggaaauuuuuguguuuuuaaguugguu

SEQ ID NO: 73678 - RNA, 64 nt, Homo Sapiens
aggaggagagcccuucaggucagaccugguaguuuggggaaaggcuggagaggcugcucccuua

SEQ ID NO: 73679 - RNA, 64 nt, Homo Sapiens
uggaaggagaaacagcugcauagcugggccugccuggggaaagggcagguacccucuaugccaa

SEQ ID NO: 73680 - RNA, 64 nt, Homo Sapiens
ucccacacaagcucgguggugacucuucggccccuggggaaaaacaaaaagauauugcugagau

SEQ ID NO: 73681 - RNA, 64 nt, Homo Sapiens
cgaggccagugagggacggcguggcugugcuuccuggggaaaugaacccccuccccacagacac

SEQ ID NO: 73682 - RNA, 64 nt, Homo Sapiens
aguucauugcagacaccaccauauugcuaucuaauggggaaauguagcuaugggccauaaccaa

SEQ ID NO: 73683 - RNA, 64 nt, Homo Sapiens
cacacucuccugggccccaaggagucccacggaauggggaaagcgggaacccuggaguucuugg

SEQ ID NO: 73684 - RNA, 64 nt, Homo Sapiens
caucagcccagggccgcguggugaaaucuggcaguggggaaagagcaaccccagcccgucccuu

SEQ ID NO: 73685 - RNA, 64 nt, Homo Sapiens
uagugggguugaaguaugacauaauauuucccauuggggaaaggagaauuucucuuagagggug

SEQ ID NO: 73686 - RNA, 64 nt, Homo Sapiens
cggcaccgggaaacucugcugguggaaucugggcuggggaaagaagcucugcuuuccagcgcuu

SEQ ID NO: 73687 - RNA, 64 nt, Homo Sapiens
uuucuccugaaagacugaacuucagcagcugugguggggaaacauuuccaagccuggaagggua

SEQ ID NO: 73688 - RNA, 64 nt, Homo Sapiens
caggucuggggccaggagugggacccaccauuuguggggaaaguagcauuccuccaccucaggc

SEQ ID NO: 73689 - RNA, 64 nt, Homo Sapiens
aaaagaacaggagcagcauaggcuguuugagcuuuggggaaaugaacuuugcuuuuuauauuua

SEQ ID NO: 73690 - RNA, 64 nt, Homo Sapiens
auggcgguuuuguggaauagaaaaggcggaaagguggggaaaagauugagaaauuggaugguug

SEQ ID NO: 73691 - RNA, 64 nt, Homo Sapiens
auuucuacucugucuccucaacucuguugauauuuggggaaaauucuguuuuucauagauucuu

SEQ ID NO: 73692 - RNA, 64 nt, Homo Sapiens
gaggaacaaguuuccgugucuucugccuuccucuuggggaaaggugccuuguugugaugaauua

SEQ ID NO: 73693 - RNA, 64 nt, Homo Sapiens
gagcaaggagaccauggcuacucuuugaaauggauggggaaaauuagcuuaaaaauuuaaucac

SEQ ID NO: 73694 - RNA, 64 nt, Homo Sapiens
gacauugccuugguuuguuacaugacuaucgugauggggaaacuggcuggaaauaguaaucaca

SEQ ID NO: 73695 - RNA, 64 nt, Homo Sapiens
ugguggagaacagagagaugagaagcagagggcuuggggaaagccuguuccucucugacucagc

SEQ ID NO: 73696 - RNA, 64 nt, Homo Sapiens
gcccgugagucauuguaagcguuggguagacagguggggaaaagguuuaacuccuggguuggcu

SEQ ID NO: 73697 - RNA, 64 nt, Homo Sapiens
ugggguagaguguagauggcggggagggucagguuggggaaagacguggguccugguugggagu

SEQ ID NO: 73698 - RNA, 64 nt, Homo Sapiens
ggaccacauaguccaucgaaguaaacggaggacuuggggaaaaauagauguaucggcaagcagu

SEQ ID NO: 73699 - RNA, 64 nt, Homo Sapiens
auagugugucuuuaacucuugguauugcacuggguggggaaaggaaccccaaaagaaaguuaca

SEQ ID NO: 73700 - RNA, 64 nt, Homo Sapiens
guuauagaaaaugucacugaagcagucagugacauggggaaauauaguaaggaagugaaaacuu

SEQ ID NO: 73701 - RNA, 64 nt, Homo Sapiens
aagucuugugauugacuuucauaugccuagauaauggggaaaaacauuaucauaaaauuuucau

SEQ ID NO: 73702 - RNA, 64 nt, Homo Sapiens
gccaacugcgugccaggcccaguacggaggacgcuggggaaauggugaaggaaacagaaaaaag

SEQ ID NO: 73703 - RNA, 64 nt, Homo Sapiens
aaaggucccugcccuucuggagaugacaacugaguggggaaaacagaccgugaacacaaaacau

SEQ ID NO: 73704 - RNA, 64 nt, Homo Sapiens
ugcugucaauuuuuuuuuaacccaaguauuuugguggggaaaagcaaguaucuauugcuuagca

SEQ ID NO: 73705 - RNA, 64 nt, Homo Sapiens
guagcuguuggugauugcauggugucucggugcauggggaaaggcaaggucuucugagcucauc

SEQ ID NO: 73706 - RNA, 64 nt, Homo Sapiens
gucaguguguguuuuucauuugauuuauuuaucuuggggaaagugaaaaauguaaucugcaagu

SEQ ID NO: 73707 - RNA, 64 nt, Homo Sapiens
ugcuuuggugguuuuaauauuauugugccagggauggggaaaugggggggguugugugggaaga

SEQ ID NO: 73708 - RNA, 64 nt, Homo Sapiens
uuugccccuaacacgaggaacucguuugaagggggcagcguagcaugucugauuugccaccugg

SEQ ID NO: 73709 - RNA, 64 nt, Homo Sapiens
gaauuguugcugucagauucacgaugaguuuucugcagcguacaauuuuuguuuuuauuuuugu

SEQ ID NO: 73710 - RNA, 64 nt, Homo Sapiens
uacccuaaggucauuaccacaggccaggggcugggcagcguacucaucaucaacccuaaaaagc

SEQ ID NO: 73711 - RNA, 64 nt, Homo Sapiens
caaaggguuugaaaugggaagguuugaguuccaggcagcguaugaacucuggagaggggcugcc

SEQ ID NO: 73712 - RNA, 64 nt, Homo Sapiens
cagcugcugcuugaggccauguguccugguuucggcagcguagcgcuuucugugugaugcagau

SEQ ID NO: 73713 - RNA, 64 nt, Homo Sapiens
acuguuaugauccuguguuuuucacagagguguugcagcguaucacagaacuuggcuaauggaa

SEQ ID NO: 73714 - RNA, 64 nt, Homo Sapiens
agaaguugggaccauagagccaggacuaagaguggcagcguaugcgaggaccagucugaucgcc

SEQ ID NO: 73715 - RNA, 64 nt, Homo Sapiens
uggggaagacagugcagccacccagccuuuaccagcagcguacggcagacgaaggcagucgagg

SEQ ID NO: 73716 - RNA, 64 nt, Homo Sapiens
ggaaaggagugagguauuucccgucuaacagaaagcagcguaucaacuccuauuguucugcacu

SEQ ID NO: 73717 - RNA, 64 nt, Homo Sapiens
cacacaaaccugaacaaagcaaauuuuuuuaaaagcagcguauguaagcaccgacacccacuca

SEQ ID NO: 73718 - RNA, 64 nt, Homo Sapiens
ucuaacucauuguuucccucggagucaagggugggcagcguacuccucgauuugggcagauggu

SEQ ID NO: 73719 - RNA, 64 nt, Homo Sapiens
caagucagauggcugcauuuuugagcauuaauuugcagcguauuucacuuuuucuguuauuuuc

SEQ ID NO: 73720 - RNA, 64 nt, Homo Sapiens
ccaagagcagcuccgcgccugcuggaucguggaugcagcguaaacaucuuccuucagacgaggc

SEQ ID NO: 73721 - RNA, 64 nt, Homo Sapiens
ucuaucggggaggguccuuggcgguaaccagagggcagcguagugucaacaccagagaccagga

SEQ ID NO: 73722 - RNA, 64 nt, Homo Sapiens
auaauuuguaauugugacuuguucuccccggcuggcagcguaguggggcugccaggccccagcu

SEQ ID NO: 73723 - RNA, 64 nt, Homo Sapiens
acuguuggugauaaguguauguggaaaugaaugcgcagcguaugagagccuucagaaacuguga

SEQ ID NO: 73724 - RNA, 64 nt, Homo Sapiens
aacacacagaaagcucccacagugggaccuugaugcagcguagcugguauuaacaaccgugggg

SEQ ID NO: 73725 - RNA, 64 nt, Homo Sapiens
uuacaggcauuuauauccauuuucagauguuagagcagcguauuuauagaaucauuuuaaucac

SEQ ID NO: 73726 - RNA, 64 nt, Homo Sapiens
uguggaguggaugggcucugagugugggugcauggcagcguaacuggagugugcgugugcaggc

SEQ ID NO: 73727 - RNA, 64 nt, Homo Sapiens
uacauugccuuuugucaggaucuuuuugaugagggcagcguaauagggcugucaaagucaccau

SEQ ID NO: 73728 - RNA, 64 nt, Homo Sapiens
agaguaaaagucuaccccucggugaagucguccugcagcguauuuuagcuguaaagggaagcga

SEQ ID NO: 73729 - RNA, 64 nt, Homo Sapiens
uuuggagccaaaaaauugauucuggggggugggggcagcguagaagugguauauccaaguauau

SEQ ID NO: 73730 - RNA, 64 nt, Homo Sapiens
gucuuuagaagcuggguggacucuuagugguccugcagcguauccuaaaagacuaccuuugaaa

SEQ ID NO: 73731 - RNA, 64 nt, Homo Sapiens
aauuuccucaacacuaacuucacugggauaaucagcagcguaacuacccuaaaagcauaucacu

SEQ ID NO: 73732 - RNA, 64 nt, Homo Sapiens
gacucagaugucucuggcguguggguaggugacggcagcguagccucuccggcagaagggaacu

SEQ ID NO: 73733 - RNA, 64 nt, Homo Sapiens
gacgaacuccuccagcaagccagcgcaugcuggugcagcguaagccaagucugcugaugagaga

SEQ ID NO: 73734 - RNA, 64 nt, Homo Sapiens
cuuugauuagggcuuuuuguuacuguuugacagugcagcguaaguaugcacagaugaagaugga

SEQ ID NO: 73735 - RNA, 64 nt, Homo Sapiens
caaaucccguacuccuugccaccggcuuccuagagcagcguagacagcugguaaacugaagagc

SEQ ID NO: 73736 - RNA, 64 nt, Homo Sapiens
ccaaaggcgcagaagccggcuggccguggugggggcagcguaggcguagcaucccucuccucuc

SEQ ID NO: 73737 - RNA, 64 nt, Homo Sapiens
ccgaguugaggauguugaacaacaugggaaggucgcagcguacuaagugaagaagucagaggac

SEQ ID NO: 73738 - RNA, 64 nt, Homo Sapiens
ugagaauucaggcaaacguccacaaaggucacaggcagcguacauacgguucuguuauacccca

SEQ ID NO: 73739 - RNA, 64 nt, Homo Sapiens
ccaugcuuuagagauccaucuuucuccacucaccgcagcguacuuggcacuucaguuucaaaca

SEQ ID NO: 73740 - RNA, 64 nt, Homo Sapiens; identical to SEQ ID NO: 43695

SEQ ID NO: 73741 - RNA, 64 nt, Homo Sapiens; identical to SEQ ID NO: 43696

SEQ ID NO: 73742 - RNA, 64 nt, Homo Sapiens; identical to SEQ ID NO: 43697

SEQ ID NO: 73743 - RNA, 64 nt, Homo Sapiens; identical to SEQ ID NO: 43698

SEQ ID NO: 73744 - RNA, 64 nt, Homo Sapiens; identical to SEQ ID NO: 43699

SEQ ID NO: 73745 - RNA, 64 nt, Homo Sapiens; identical to SEQ ID NO: 43700

SEQ ID NO: 73746 - RNA, 64 nt, Homo Sapiens; identical to SEQ ID NO: 43701

SEQ ID NO: 73747 - RNA, 64 nt, Homo Sapiens; identical to SEQ ID NO: 43702

SEQ ID NO: 73748 - RNA, 64 nt, Homo Sapiens; identical to SEQ ID NO: 43703

SEQ ID NO: 73749 - RNA, 64 nt, Homo Sapiens; identical to SEQ ID NO: 43704

SEQ ID NO: 73750 - RNA, 64 nt, Homo Sapiens; identical to SEQ ID NO: 43705

SEQ ID NO: 73751 - RNA, 64 nt, Homo Sapiens; identical to SEQ ID NO: 43706

SEQ ID NO: 73752 - RNA, 64 nt, Homo Sapiens; identical to SEQ ID NO: 43707

SEQ ID NO: 73753 - RNA, 64 nt, Homo Sapiens; identical to SEQ ID NO: 43708

SEQ ID NO: 73754 - RNA, 64 nt, Homo Sapiens; identical to SEQ ID NO: 43709

SEQ ID NO: 73755 - RNA, 64 nt, Homo Sapiens; identical to SEQ ID NO: 43710

SEQ ID NO: 73756 - RNA, 64 nt, Homo Sapiens; identical to SEQ ID NO: 43711

SEQ ID NO: 73757 - RNA, 64 nt, Homo Sapiens; identical to SEQ ID NO: 43712

SEQ ID NO: 73758 - RNA, 64 nt, Homo Sapiens; identical to SEQ ID NO: 43713

SEQ ID NO: 73759 - RNA, 64 nt, Homo Sapiens; identical to SEQ ID NO: 43714

SEQ ID NO: 73760 - RNA, 64 nt, Homo Sapiens; identical to SEQ ID NO: 43715

SEQ ID NO: 73761 - RNA, 64 nt, Homo Sapiens; identical to SEQ ID NO: 43716

SEQ ID NO: 73762 - RNA, 64 nt, Homo Sapiens
aguuuaauggaucgugaauuuuuuucauguaacuccuauucauaucccauagaucuaguauugu

SEQ ID NO: 73763 - RNA, 64 nt, Homo Sapiens
cugugaagucuaggcucagacaggcaucaacaaaccuauucaccccaccaucauccugaucuaa

SEQ ID NO: 73764 - RNA, 64 nt, Homo Sapiens
auauguauauuuuuuuauaagcauuauaaaauggccuauucauugcucuucaaaguuuuaacua

SEQ ID NO: 73765 - RNA, 64 nt, Homo Sapiens
aacacaaggauacauaagagaggagagauuaguaccuauucauuaggcaguggguuuuuccuag

SEQ ID NO: 73766 - RNA, 64 nt, Homo Sapiens
cucucagcuacuccugaaacggagcuuaccgccaccuauucaagcugggcauggggugguggug

SEQ ID NO: 73767 - RNA, 64 nt, Homo Sapiens
uccgagauucagacauagccuuuguuagcuggaaccuauucacuacuuacaggagagcugauaa

SEQ ID NO: 73768 - RNA, 64 nt, Homo Sapiens
auuacucuugagaaguagaacaaggcacuucaguccuauucaacauaguacuggaaguccucgc

SEQ ID NO: 73769 - RNA, 64 nt, Homo Sapiens
acauccaagcugagagccaaaucaagaaugcaauccuauucacaauugccacaaaaagaauaaa

SEQ ID NO: 73770 - RNA, 64 nt, Homo Sapiens
gaguagaauauaaacacauaauugcuuauguaugccuauucagaauaaauggguaacacugauu

SEQ ID NO: 73771 - RNA, 64 nt, Homo Sapiens
uacauuuugaauuuugaaccaugugacuguauuaccuauucaaaauaaacaauaaaugggccca

SEQ ID NO: 73772 - RNA, 64 nt, Homo Sapiens
uacauagucuuuuuuaaauggaaggagaaaaugucagccacauuacugucuguguagugccagg

SEQ ID NO: 73773 - RNA, 64 nt, Homo Sapiens
ccagaggcuaguggucacagacagcugggaauggcagccacagaggguccccucugggagaaac

SEQ ID NO: 73774 - RNA, 64 nt, Homo Sapiens
cagccuggugccacagucacgugggggaagaccucagccacagcuguaagcagcucucugccag

SEQ ID NO: 73775 - RNA, 64 nt, Homo Sapiens
aagaccucagccacagcuguaagcagcucucugccagccacauggccggggaccgaaaaacucc

SEQ ID NO: 73776 - RNA, 64 nt, Homo Sapiens
ccacuuggaguaugaacaaugggcacgggguuuucagccacaguucccucgaggccaguguuca

SEQ ID NO: 73777 - RNA, 64 nt, Homo Sapiens
cuauguaaagaugaaggcagagaucggaguuuugcagccacaagcuaagaaacaccaaggauug

SEQ ID NO: 73778 - RNA, 64 nt, Homo Sapiens
gacuuacgugguaaaaaaugaagucuccugcccacagccacauuagugaaccuagaagcagaga

SEQ ID NO: 73779 - RNA, 64 nt, Homo Sapiens
cauacacacacgcucgcacacgcccacacugcagcagccacaucagacucuccacucccccugc

SEQ ID NO: 73780 - RNA, 64 nt, Homo Sapiens
ggaacucgucucuuacauacucucccuccauccgcagccacagggugacucaguuucccucccu

SEQ ID NO: 73781 - RNA, 64 nt, Homo Sapiens
ugagucccuggcaguagccuggcucuggaaagcccagccacaccgugaggggaggguugaggga

SEQ ID NO: 73782 - RNA, 64 nt, Homo Sapiens
auuucucucucauugacucaucuguggcaaggggcagccacaccacuggugguagaacuccagu

SEQ ID NO: 73783 - RNA, 64 nt, Homo Sapiens
ugugaccugcugggccguggcacgcacacagccacagccacacgacacugccacugucccuugg

SEQ ID NO: 73784 - RNA, 64 nt, Homo Sapiens
cacacgugugaccugcugggccuuggcacgcacacagccacagcaauggcacacugccacuguc

SEQ ID NO: 73785 - RNA, 64 nt, Homo Sapiens
uguuuacauuggccuuugguuuuuuuuuuucuuucagccacaacuauaugcugauauaacucag

SEQ ID NO: 73786 - RNA, 64 nt, Homo Sapiens
guuggauagcugccacuaggguugcuucgaucuucagccacaugcuguccuugaagcagcuauu

SEQ ID NO: 73787 - RNA, 64 nt, Homo Sapiens
ccccaggcucucgcugcccugcuccaacuccuuucagccacauggagaaaggacagagccagcg

SEQ ID NO: 73788 - RNA, 64 nt, Homo Sapiens
acugccauuacccagugccguggagucccaggggcagccacaccccagccacaggccaaauccu

SEQ ID NO: 73789 - RNA, 64 nt, Homo Sapiens
ccaaauccuuggagucccagguguguuauuuccccagccacaggauccuuguuaccuaucucgu

SEQ ID NO: 73790 - RNA, 64 nt, Homo Sapiens
agagccaaucacagacccaccuaccacaccagcucagccacagccucugcauccccugcacccg

SEQ ID NO: 73791 - RNA, 64 nt, Homo Sapiens
ccaaacacaucaaacuugcucugugucuguccaccagccacagccacgaccauugaaaauaucu

SEQ ID NO: 73792 - RNA, 64 nt, Homo Sapiens
cauggacguuucauccaacagcaugugacagccacagccacacgagccgaccauccucgcaguu

SEQ ID NO: 73793 - RNA, 64 nt, Homo Sapiens
cacacgcauggacguuucaugcaguugcaugugacagccacagcuuugggagccgaccauccuc

SEQ ID NO: 73794 - RNA, 64 nt, Homo Sapiens
cggugggggcacagcacagacaccucccaccaaccagccacaccccccccaguaugggaaccag

SEQ ID NO: 73795 - RNA, 64 nt, Homo Sapiens
cagugggggcacagcacagacaccucccaccaaccagccacaccccccccggugugggaaccag

SEQ ID NO: 73796 - RNA, 64 nt, Homo Sapiens
gccaccgccacacuagugcugagaauguggaacccagccacacuuguugcaggacacuccgggg

SEQ ID NO: 73797 - RNA, 64 nt, Homo Sapiens
caagccaggggggcuccccggggacagaggaaaacagccacaaauggcaccagaugccagggaa

SEQ ID NO: 73798 - RNA, 64 nt, Homo Sapiens
ugcccuauucuccaugcuuuccacaccucauacgcagccacaucaaagaccccccgccagcuuc

SEQ ID NO: 73799 - RNA, 64 nt, Homo Sapiens
agaggcaaggggugccaggaggacaggugugacacagccacagcgcccagaacaacaguuggca

SEQ ID NO: 73800 - RNA, 64 nt, Homo Sapiens
gcccauguccccucuggaagugcacugagcccaccagccacaguggccagcaaugugguuccug

SEQ ID NO: 73801 - RNA, 64 nt, Homo Sapiens
uaucaaauuacugaagaucucaucaugcaugugucagccacagcgaaucccaugucuugguuau

SEQ ID NO: 73802 - RNA, 64 nt, Homo Sapiens
acaaccaaaauuauuaagcucugugcgaggcugucagccacacuagguaucagggaucccgaga

SEQ ID NO: 73803 - RNA, 64 nt, Homo Sapiens
agucagggcauggcuccaauccaagcucuuuccacagccacaucuccucuucccccagggcuuc

SEQ ID NO: 73804 - RNA, 64 nt, Homo Sapiens
cguggaacaggcaaggauggcaaccccaucaaaccagccacagcaauaugugagcauuggccau

SEQ ID NO: 73805 - RNA, 64 nt, Homo Sapiens
uuucccaugaccugugggcuccaaacucucccugcagccacaugccagccauacuugacugucc

SEQ ID NO: 73806 - RNA, 64 nt, Homo Sapiens
ugaggaguggccgggcaggccaugcccacagccacagccacagccagugugcacgccguccggc

SEQ ID NO: 73807 - RNA, 64 nt, Homo Sapiens
cacagcugaggaguggccgguccggccaugcccacagccacagcacggcccagugugcacgccg

SEQ ID NO: 73808 - RNA, 64 nt, Homo Sapiens
ugauuuucccuacacuucucccuggcccaggcuccagccacaggcaccucuccugcccccgccc

SEQ ID NO: 73809 - RNA, 64 nt, Homo Sapiens
cagccagagucaaugccuucaugggaagggcucccagccacacccagaguggcccaaagcuguu

SEQ ID NO: 73810 - RNA, 64 nt, Homo Sapiens
cacacacacgcuuguucacacucagaacccaggacagccacagccaccgcuuaggggaagccac

SEQ ID NO: 73811 - RNA, 64 nt, Homo Sapiens
aagaacugcucagggacauuaaaggucaaaaguccagccacacucauucauccuuuccccaggc

SEQ ID NO: 73812 - RNA, 64 nt, Homo Sapiens
ggaaaaagucagcgggucaagcuagccuguggcccagccacaacuagcugacaaagcuuccugg

SEQ ID NO: 73813 - RNA, 64 nt, Homo Sapiens
gaaagagacuuugccucacuagaccuaacagccacagccacacgguuauucauccaucccuuuc

SEQ ID NO: 73814 - RNA, 64 nt, Homo Sapiens
cacacggaaagagacuuugcccuuucagaccuaacagccacagcugcuuaguuauucauccauc

SEQ ID NO: 73815 - RNA, 64 nt, Homo Sapiens
cucuggggagccagucauuucgucauuugagagccagccacagcgcacagagaaagccagcugu

SEQ ID NO: 73816 - RNA, 64 nt, Homo Sapiens
ggcagguguccucccaggaaggaagaagaagcaccagccacaggcaggaagauguccuuccugg

SEQ ID NO: 73817 - RNA, 64 nt, Homo Sapiens
ucccccaagggggcuuuggguuauuggcccccagcagccacagucacgaucaaguuacacagcu

SEQ ID NO: 73818 - RNA, 64 nt, Homo Sapiens
cacgaucaaguuacacagcucagaacgcugcgcccagccacaccucccagaccccacauccccu

SEQ ID NO: 73819 - RNA, 64 nt, Homo Sapiens
ccuccaauaaagacagcaugcccaaggacccugccagccacagaagauccaggagggagccacc

SEQ ID NO: 73820 - RNA, 64 nt, Homo Sapiens
ccacaaccacccccaagccucaggagggcagacccagccacauacugauccaggguuccaccac

SEQ ID NO: 73821 - RNA, 64 nt, Homo Sapiens
accuugcggcaagucugaugaauuaacaaaauaacagccacauagugaauguaagagccuugga

SEQ ID NO: 73822 - RNA, 64 nt, Homo Sapiens
ucugucuguguuuagagaggcaagugccagggagcagccacacggaaggaaagauuucuccucu

SEQ ID NO: 73823 - RNA, 64 nt, Homo Sapiens
ggugcacagguagccccgacccucucaggcauuccagccacagaacaucaaagugagcgaguac

SEQ ID NO: 73824 - RNA, 64 nt, Homo Sapiens
ggaagcaccuccgguuggaggcacccaggcuugccagccacagagcgccccaaagucaccguca

SEQ ID NO: 73825 - RNA, 64 nt, Homo Sapiens
ggaguggccuuggcucccuggagagcccacgucucagccacaguucuccacucgccucggacuu

SEQ ID NO: 73826 - RNA, 64 nt, Homo Sapiens
uccucagaggaggaggaggaggaggcagcuccggcagccacagaaggcugcagcccagcccgcc

SEQ ID NO: 73827 - RNA, 64 nt, Homo Sapiens
ugccaccugagggagccgccugcaagcggcccugcagccacaaagcaacccgcccucugcaaaa

SEQ ID NO: 73828 - RNA, 64 nt, Homo Sapiens
aggagcugguggugggagaaugacggcagggacgcagccacaguucagacccuguccccucagc

SEQ ID NO: 73829 - RNA, 64 nt, Homo Sapiens
agcagcuugaccugguauucucauauggugagagcagccacagcaaugcagacacaaacugguu

SEQ ID NO: 73830 - RNA, 64 nt, Homo Sapiens
cugaguauuguuuguucaccaguuaacacaaauucagccacauucuauaucauucccaguuauu

SEQ ID NO: 73831 - RNA, 62 nt, Homo Sapiens
uguacaauguguugaccaucgagaggggaccuucggccgaguugaaaucguuagcaccuuag

SEQ ID NO: 73832 - RNA, 64 nt, Homo Sapiens
acgucacugugaugguggugcggugcagcggggcucggccgacacaacaggcuggccaacaagg

SEQ ID NO: 73833 - RNA, 64 nt, Homo Sapiens
aagaguagaugguugcccugcaucuugggcuccaucggccgaaacuuucccaagccagggugug

SEQ ID NO: 73834 - RNA, 64 nt, Homo Sapiens
ggcuccaacuuccuuccuuccuucggggccagucucggccgaagucuggucacgcucagacaga

SEQ ID NO: 73835 - RNA, 64 nt, Homo Sapiens
ugguuuccugcccagccuggaauggccccugucuucggccgagccuuggggucccacugcucga

SEQ ID NO: 73836 - RNA, 64 nt, Homo Sapiens
gaaacaucccaggcccugagcagcgugucuuuccucggccgagucaggcuuccuggugagccuc

SEQ ID NO: 73837 - RNA, 64 nt, Homo Sapiens
accuguccaaugcugcugguuccucugauucuccucggccgacccagaaaugaggaggcuguuu

SEQ ID NO: 73838 - RNA, 64 nt, Homo Sapiens
cccugcaucagcaaggccagccccagaaggagccucggccgagcgugcaacccggagccgccuu

SEQ ID NO: 73839 - RNA, 64 nt, Homo Sapiens
gcccaggagaaugaggagccucccugcaguguugucggccgaggccugagcucgcccugcccag

SEQ ID NO: 73840 - RNA, 64 nt, Homo Sapiens
ccuggacugggcuagccugcacugccugggaaagucggccgagggcccaaagcugcugaggggu

SEQ ID NO: 73841 - RNA, 64 nt, Homo Sapiens
aggcuggacacccucugccgcauccacugugacgucggccgaccgugucccagccacgcagggc

SEQ ID NO: 73842 - RNA, 64 nt, Homo Sapiens
ggcuccgggcuguguccuaaaugcaaagcacaccucggccgaggccugcgcccugacaugcuaa

SEQ ID NO: 73843 - RNA, 64 nt, Homo Sapiens
uuuaaacaugggcagcuuccgaggucaagcaucuucggccgauaaucagcaguggcccaggaag

SEQ ID NO: 73844 - RNA, 64 nt, Homo Sapiens
uauuuacagcucugacaaauuuugccagaguguuucggccgacgucaauucuuacacauaaaug

SEQ ID NO: 73845 - RNA, 64 nt, Homo Sapiens
ugggcacuuuuuaacauugcugauguaguaugcuuaagagaaaugaccuaaauaaggaucaauu

SEQ ID NO: 73846 - RNA, 64 nt, Homo Sapiens
ugucuuaucacucuuauuugacauuucguagguguaagagaaauggaaaugaaugguuucaaca

SEQ ID NO: 73847 - RNA, 64 nt, Homo Sapiens
ugucaguauuucaggguucuagcauugugcacgauaagagaauggugaaucguaagagaaccuc

SEQ ID NO: 73848 - RNA, 64 nt, Homo Sapiens
ucagcauugugcacgauaaguuaaaagugaaucguaagagaaccuguacauuuuuaauugcagu

SEQ ID NO: 73849 - RNA, 64 nt, Homo Sapiens
augucccaggcacuguacuaaccuacagagaugcuaagagaaaaaaaagacuuguuucugaucu

SEQ ID NO: 73850 - RNA, 64 nt, Homo Sapiens
gaaacucagggcuucuaguuucucuuagaaaagcuaagagaagauaaggucugaauaauagcag

SEQ ID NO: 73851 - RNA, 64 nt, Homo Sapiens
aauauuucacaacacaguaagacaaguuacaaacuaagagaaacguuguuuagucaaaagacca

SEQ ID NO: 73852 - RNA, 64 nt, Homo Sapiens
accccuaugcugcugagaugguuuuuuagaaagauaagagaaucgucauuauagacagcagugu

SEQ ID NO: 73853 - RNA, 64 nt, Homo Sapiens
acacuucuguucucuuagaacuuagaaguguuucuaagagaacagaaguaauaagagaaacagu

SEQ ID NO: 73854 - RNA, 64 nt, Homo Sapiens
gaacuuagaaguguuucuaagagaacagaaguaauaagagaaacaguuacguguggaauucaac

SEQ ID NO: 73855 - RNA, 64 nt, Homo Sapiens
gaacucacaguacaaaaauuguucucaagaauuauaagagaaaucaaauagauugcuuagaaug

SEQ ID NO: 73856 - RNA, 64 nt, Homo Sapiens
aagccauucucaagagauaauacuguugguggcauaagagaaucgggaacccugcccagacuaa

SEQ ID NO: 73857 - RNA, 64 nt, Homo Sapiens
aguucuuuaccucauucucaaaccuugauaaacauaagagaauucauaccggagagaaacugua

SEQ ID NO: 73858 - RNA, 64 nt, Homo Sapiens
cagucuuuaccacauccucaaacuuuguuaaacauaagagaauuuauaccagagagaaacccua

SEQ ID NO: 73859 - RNA, 64 nt, Homo Sapiens
aaagcuugcaaccacacucaaucuauucuaaauauaagagaaaugauauuggugagaagccaca

SEQ ID NO: 73860 - RNA, 62 nt, Homo Sapiens
cauuuuuuuccuccugguaguaaaugucagaguaagagaaacaaacuguuuagaauuaucau

SEQ ID NO: 73861 - RNA, 64 nt, Homo Sapiens
uaguaauuaaaaugugccuuuugaagauguuuucuaagagaaaggaaauacguugcagugaugu

SEQ ID NO: 73862 - RNA, 64 nt, Homo Sapiens
gaauauacucucaaagaauucacucucuuuuuauuaagagaacuaaauuguuucuaaauguaga

SEQ ID NO: 73863 - RNA, 64 nt, Homo Sapiens
aguugucuugugaaugacuuuuaagaaguguacuuaagagaaaaauccuaccuuauuugaauaa

SEQ ID NO: 73864 - RNA, 64 nt, Homo Sapiens
auguguggguacuugcuaauaguuuguguguuuguaagagaaaaguacaacaugacaagcugug

SEQ ID NO: 73865 - RNA, 64 nt, Homo Sapiens
caucaguuaagaaaucuacuagauuauguccacuuaagagaaauacuucagaaugcauccuuug

SEQ ID NO: 73866 - RNA, 64 nt, Homo Sapiens
cagaggauuuuuagggcagucugaggucuaaaguuaagagaacaaacuccguugucauuaacaa

SEQ ID NO: 73867 - RNA, 64 nt, Homo Sapiens
cuuuuagcaauauggagcuuaacaaauaccuggauaagagaaucaugcuuccucaacgaagggg

SEQ ID NO: 73868 - RNA, 64 nt, Homo Sapiens
gugacggacaacuugagaaaaagagaaauaaucguaagagaacaaaacaaaacguaacacaguu

SEQ ID NO: 73869 - RNA, 64 nt, Homo Sapiens
aaucguaagagaacagugacaaacguaacacaguuaagagaaauggccgcagagggaaaaaaca

SEQ ID NO: 73870 - RNA, 64 nt, Homo Sapiens
uaagcucaugagaugacauuuagauuucucaagguaagagaaaaauaggccaucaauaucacaa

SEQ ID NO: 73871 - RNA, 64 nt, Homo Sapiens
aauuaucccccaaaaugcaucuucaaauauuuucuaagagaaugguuccacauuguauuuuugu

SEQ ID NO: 73872 - RNA, 64 nt, Homo Sapiens
aaagauaaaauuugauacagguuuggugucauuauaagagaaaucauuauuaaaugaagcaagu

SEQ ID NO: 73873 - RNA, 64 nt, Homo Sapiens
agaaaucauuauuaaaugaagcaaguuaacacucuaagagaauuauuuugagauagaagugaag

SEQ ID NO: 73874 - RNA, 64 nt, Homo Sapiens
caaggggcagagcauggagggaagaggauuuuuauaagagaaauuucugcacuuugaaacuguc

SEQ ID NO: 73875 - RNA, 64 nt, Homo Sapiens
auaagagaaauuucugcacuuugaaacuguccucuaagagaauaagcauuuccuguucuuccag

SEQ ID NO: 73876 - RNA, 64 nt, Homo Sapiens
gagcugcacuccaugagugcaugagcuugaccuuuaagagaaauagagcagacaguuaagagaa

SEQ ID NO: 73877 - RNA, 64 nt, Homo Sapiens
gagcuugaccuuuaagagaaacagagcagacaguuaagagaaaucaaaacugauuacaacugcu

SEQ ID NO: 73878 - RNA, 64 nt, Homo Sapiens
uaaccccugagaaaugaacauugguaggagcauuuaagagaaaacuugcuuauuugcuaaugcc

SEQ ID NO: 73879 - RNA, 64 nt, Homo Sapiens
uuguuacuuucaaugugaggaaugaaugauaaauuaagagaaaaaaauaucaggaaggucaaua

SEQ ID NO: 73880 - RNA, 64 nt, Homo Sapiens
aggggcucccuucaccucucacuuagagauuuuauaagagaaccuuucuugaagugguguaaaa

SEQ ID NO: 73881 - RNA, 64 nt, Homo Sapiens
guuuguauuuuaaaugucaaaccagugagaucuuuaagagaaaacaggagagaagagaugucca

SEQ ID NO: 73882 - RNA, 64 nt, Homo Sapiens
gcacuuccccaccagugaucccuaggacuucuccuaagagaaggagagccuccagcagggcagg

SEQ ID NO: 73883 - RNA, 64 nt, Homo Sapiens
gauuuuccucauaucuuauuuaccuaggagcauguaagagaaagaagggagagaaaagguugca

SEQ ID NO: 73884 - RNA, 64 nt, Homo Sapiens
guuagcguuaaauggaaguaaauauauguauaccuaagagaaugucaaaauaaacaccaaacca

SEQ ID NO: 73885 - RNA, 64 nt, Homo Sapiens
ugugaaauugaagugaaacuaucucuguaggacuuaagagaauagcuaaaaggugugacuugcc

SEQ ID NO: 73886 - RNA, 64 nt, Homo Sapiens
agcuuaaaauaauuuuauuuacaagcaaguuauguaagagaauguuuuauacuauagccacaau

SEQ ID NO: 73887 - RNA, 64 nt, Homo Sapiens
uugaaaacaugacaagggcccguaguuguuuggauaagagaacuccagcauagagccuuauagc

SEQ ID NO: 73888 - RNA, 64 nt, Homo Sapiens
agaaaccuacucaagaaaagagaacacaagaacuuaagagaaaacucugaacaacacuaacaug

SEQ ID NO: 73889 - RNA, 64 nt, Homo Sapiens
ggaaaccuguuacagaaaagacucaaggagaacauaagagaaaaucugagaaaagaacauaaga

SEQ ID NO: 73890 - RNA, 64 nt, Homo Sapiens
uucagaaauucucaaaauacccuguggaauguaccuaugugaguagcaaaauuucuguauauuc

SEQ ID NO: 73891 - RNA, 64 nt, Homo Sapiens
cucuauuauggaacccaauguuuuuuaccuauaccuaugugaaaagugaaagacuugaauuuag

SEQ ID NO: 73892 - RNA, 64 nt, Homo Sapiens
cauucugugaaaagacuucuaggauagagagaaacuaugugacuggauuuaaaauaccugcaca

SEQ ID NO: 73893 - RNA, 64 nt, Homo Sapiens
cuacauuaggaauuggauugucaggcccuggguucuaugugacaaacuagcaugaaauauuguu

SEQ ID NO: 73894 - RNA, 64 nt, Homo Sapiens
ccauuuagcacacugcuuguggaagcaaaagcaucuaugugagaugaucuuuucauuuagguga

SEQ ID NO: 73895 - RNA, 64 nt, Homo Sapiens
acaaagguagcuuuucccaagaaccaaaaagaggcuaugugagccucuuugagugaagcuggga

SEQ ID NO: 73896 - RNA, 64 nt, Homo Sapiens
uaguuuuacuugguguuuauguugcaaucugguugugauuuauauuuuaaagcuuggugcuaaa

SEQ ID NO: 73897 - RNA, 64 nt, Homo Sapiens
ugccuaaaauaugauguuuaaaagcauacucuaugugauuuauuuauuucuaccuuucugaguc

SEQ ID NO: 73898 - RNA, 64 nt, Homo Sapiens
cgcacaaaagccaaacgcauccgacucucuaaaugugauuuauuucuugcuuugagauuggaga

SEQ ID NO: 73899 - RNA, 64 nt, Homo Sapiens
aaacuauuguuuguguuucuguguuucauauucagugauuuaauacaguaucauggcugaggug

SEQ ID NO: 73900 - RNA, 64 nt, Homo Sapiens
aguuaugcuaaaauauguaccuuuuuauuacauugugauuuagcaauagcaaucuuuaauaaac

SEQ ID NO: 73901 - RNA, 64 nt, Homo Sapiens
aauggaauggccuuggauguauugagggauaagugugauuuagaaugauccagucacugacuug

SEQ ID NO: 73902 - RNA, 64 nt, Homo Sapiens
uuuuuuuacauuuacaacguaucaauaaacaguagugauuuaauagucaauaggcuuuaacauc

SEQ ID NO: 73903 - RNA, 64 nt, Homo Sapiens
cauuuaaugucacaaaguuuuguuuuuuuaaaaagugauuuaaacuuaagauccgacauuuuuu

SEQ ID NO: 73904 - RNA, 64 nt, Homo Sapiens
augcuuguauacuaguuuuucuuucugauugucagugauuuauaagcuauaaaugaccaagguc

SEQ ID NO: 73905 - RNA, 64 nt, Homo Sapiens
ugaaaacauaaauuuucaggaugugaaaugaacagugauuuauaaaauggaaaucaaauuguac

SEQ ID NO: 73906 - RNA, 64 nt, Homo Sapiens
uuuuaauuuguugcugguuuggauaauuacuuuugugauuuagaaaaugcacuugaaauacacu

SEQ ID NO: 73907 - RNA, 64 nt, Homo Sapiens
ugcaucugucugugaguaaauuauagcaauccuggugauuuaggucugccuaacuaucaaagga

SEQ ID NO: 73908 - RNA, 64 nt, Homo Sapiens
uugauggucaauuucccuucagcagaaggaaaaggugauuuagaucaguagcucuuuugaaggu

SEQ ID NO: 73909 - RNA, 64 nt, Homo Sapiens
gcuuauagaacccauggguccaguuuaguaacgagugauuuaggcaaucaaugauagguuuaua

SEQ ID NO: 73910 - RNA, 64 nt, Homo Sapiens
guuuaugauuccacuuaacaaaaggccugcagaagugauuuauuauuuggguauuuggagauaa

SEQ ID NO: 73911 - RNA, 64 nt, Homo Sapiens
cuuauuucuuacuguaugaaagcuuaacagcaaugugauuuaagguuuuguuuuaaaugggaga

SEQ ID NO: 73912 - RNA, 64 nt, Homo Sapiens
ugauuuaagguuuuguuuuaaaugggagauguaagugauuuaauucauggguacuuuuagaacc

SEQ ID NO: 73913 - RNA, 64 nt, Homo Sapiens
gaaacugucugucuaauggucacagagcacuguagcacuuaacagauugccauggacaccaguu

SEQ ID NO: 73914 - RNA, 64 nt, Homo Sapiens
uuucuuuagugggggaggguaagaaaagcaguuugcacuuaaaaagaaaaaaaaaaaacgggug

SEQ ID NO: 73915 - RNA, 64 nt, Homo Sapiens
guuuacaaagcccuuucacggccuuguguggucagcacuuaacugauaaucaguauaauaauuu

SEQ ID NO: 73916 - RNA, 64 nt, Homo Sapiens
uucagcuugucucauccccacagagugacugagagcacuuaacaccaccuguggccccuaaacc

SEQ ID NO: 73917 - RNA, 64 nt, Homo Sapiens
gagcagagaugcagccagugcccaaauucauugagcacuuaaaguuuuuucuuuccucccuuac

SEQ ID NO: 73918 - RNA, 64 nt, Homo Sapiens
ggaggagggcgcagggugggcagaaguuuugaaugcacuuaaccaugacuaggaguguuagggg

SEQ ID NO: 73919 - RNA, 64 nt, Homo Sapiens
uguaaauugaauaauuuaucgcagauagcaguuagcacuuaaucuguuuuaaauuaauuuuuua

SEQ ID NO: 73920 - RNA, 64 nt, Homo Sapiens
aauaaagguacuuuacagcaaaacugucgcugaagcacuuaagauaaucaauuaguaauggcgg

SEQ ID NO: 73921 - RNA, 64 nt, Homo Sapiens
gcacuuuuuuaugaagaaaagacaagcugacuuggcacuuaaguauauuuaaaaauuguuucuu

SEQ ID NO: 73922 - RNA, 64 nt, Homo Sapiens
gcuguugagggccacuuuuuugcuaaagcacuuugcacuuaauggugcaggugacagcaggacu

SEQ ID NO: 73923 - RNA, 64 nt, Homo Sapiens
caauuuucaaauguacucaaugcugucuagucaugcacuuaaagcauaugcaaucacucguuua

SEQ ID NO: 73924 - RNA, 64 nt, Homo Sapiens
uucaguaguagucuugacuuuucuugauagaacugcacuuaauucgcgugcaguucauuucuag

SEQ ID NO: 73925 - RNA, 64 nt, Homo Sapiens
auuucuuaauuauuauaaaaauauuaagacaauagcacuuaaauuccucaacaguguuuucaga

SEQ ID NO: 73926 - RNA, 64 nt, Homo Sapiens
guuuuucauuuuaaaaaguccauaccuuauauaugcacuuaauuuguuggggcuuuacauacuu

SEQ ID NO: 73927 - RNA, 64 nt, Homo Sapiens
ucaaaguaguucaacaugcagacuaucuauauuugcacuuaaaaugcaagugacaaucagaggu

SEQ ID NO: 73928 - RNA, 64 nt, Homo Sapiens
uuuuuuuuuuuuuuuuagugcuccaagaguaguugcacuuaacuuuugacuccccuuauucccu

SEQ ID NO: 73929 - RNA, 64 nt, Homo Sapiens
ugcagguaguguuuaguuaucuacugcauuaugagcacuuaaaguacugcuagcuguagaacuc

SEQ ID NO: 73930 - RNA, 64 nt, Homo Sapiens
aacuuucuauuuuuagccuauauuuggaaagaaagcacuuaacauuuuaggaauucuuuuuaaa

SEQ ID NO: 73931 - RNA, 64 nt, Homo Sapiens
aaaagauacagugauauagcaauauguaccaguggcacuuaaccuuuuuguuuuuuuucaucuu

SEQ ID NO: 73932 - RNA, 64 nt, Homo Sapiens
auggaacccaaacagaagagcugucuauuucugugcacuuaacaggguuucaguacaaaugcug

SEQ ID NO: 73933 - RNA, 64 nt, Homo Sapiens
gauggaaggaggguagggaaucccccuucuccugaaucagcaggguuuuguuuucuuuguuuuu

SEQ ID NO: 73934 - RNA, 64 nt, Homo Sapiens
caccauggauuauauucuuuguuucuccccuuugaaucagcagaggauacuaaaugacagccuu

SEQ ID NO: 73935 - RNA, 64 nt, Homo Sapiens
auauuguaauaaagaaaucuuauuuuuauaauuaaaucagcaaaagaaaugaccauuucccuug

SEQ ID NO: 73936 - RNA, 64 nt, Homo Sapiens
gaaauuuucauaguuaaauuagaggugacauucgaaucagcaauuaaauuucaacaaagguucc

SEQ ID NO: 73937 - RNA, 64 nt, Homo Sapiens
auccauaccaaaacaacgacuccccuccuauuuuaaucagcaaaggggguuaucuuuuuuuuuu

SEQ ID NO: 73938 - RNA, 64 nt, Homo Sapiens
auauuaugccuaaaguaaauaaucaaugggcuuaaaucagcaaagugcucagauuuguguguuc

SEQ ID NO: 73939 - RNA, 64 nt, Homo Sapiens
ccauggugggagaguuuacaucacaaccacuacaaaucagcacuugcuuucuucuucuuaaaga

SEQ ID NO: 73940 - RNA, 64 nt, Homo Sapiens
cacuaauuucugcugcagcaucacgaucagggcaaaucagcacagccccccagccaucaguggu

SEQ ID NO: 73941 - RNA, 64 nt, Homo Sapiens
uucuguaccuggagagagaguuuaggcaaauaacaaucagcaaggaaaccuucaccagugagaa

SEQ ID NO: 73942 - RNA, 64 nt, Homo Sapiens
aacaaaaaaccauacacacacacacacacacacaaaucagcaucauaagggaauguagccuucc

SEQ ID NO: 73943 - RNA, 64 nt, Homo Sapiens
ugaaaaugggggcaggugagaaguccauuuugagaaucagcauaguaaauuacauuucuaaucc

SEQ ID NO: 73944 - RNA, 64 nt, Homo Sapiens
cuuaauauuuucuuuugucaccccagaggugaaaaaucagcaguugaagccugacaggccucag

SEQ ID NO: 73945 - RNA, 64 nt, Homo Sapiens
aaaaugcacccaucagcacucuguaaaacgcaccaaucagcacucuguaaaaugcaccaaucag

SEQ ID NO: 73946 - RNA, 64 nt, Homo Sapiens
aaaacgcaccaaucagcacucuguaaaaugcaccaaucagcaggauucuaaaaguagacaauca

SEQ ID NO: 73947 - RNA, 64 nt, Homo Sapiens
acucuguaucuagcucaagguuuguaaacacaccaaucagcacccugugucuagcucaguguuu

SEQ ID NO: 73948 - RNA, 64 nt, Homo Sapiens
ccuuugugucuagcucagggaucguaaacgcaccaaucagcacccugucaaaacagaccacuug

SEQ ID NO: 73949 - RNA, 64 nt, Homo Sapiens
aaaacagaccacuugacucucuguaaaauggaccaaucagcaggauguggguggggcgagacaa

SEQ ID NO: 73950 - RNA, 64 nt, Homo Sapiens
ccucagauaacugcuuuauggagacgggagucaaaaucagcaucgcuauaauaaagauuucccu

SEQ ID NO: 73951 - RNA, 64 nt, Homo Sapiens
uuugacuucuuaguagccacagugaaaagcccaaaaucagcaaaaugacuuuggagaguuucaa

SEQ ID NO: 73952 - RNA, 64 nt, Homo Sapiens
uugauuuuuguacgaaaaaaagcuuuguuauagaaaucagcauacuauuuuuuuaaaucuggag

SEQ ID NO: 73953 - RNA, 64 nt, Homo Sapiens
auacgguaaaugaggacucagcacagccaaccauaaucagcaugucugggauagacuggucuag

SEQ ID NO: 73954 - RNA, 64 nt, Homo Sapiens
acaugggcggggacaauaagcuguaaaauggaccaaucagcaggaagauggaccaaucagcgcu

SEQ ID NO: 73955 - RNA, 64 nt, Homo Sapiens
cuguaagauggaccaaucaguuguaaaauggaccaaucagcacuuuuucugucuuacaagagga

SEQ ID NO: 73956 - RNA, 64 nt, Homo Sapiens
ugauuaauuaauacuauuugaguuauuaaauguuaaucaaaaugaguauaucauuuccugucuu

SEQ ID NO: 73957 - RNA, 64 nt, Homo Sapiens
uuacaaaugaauauuucauguuuauauaagcuguaaucaaaaaggacuaguaguaguaguaagg

SEQ ID NO: 73958 - RNA, 64 nt, Homo Sapiens
auuucaacaauggacuaugccuugguuuuucacuaaucaaaaucaaaauuacucuuuaacauga

SEQ ID NO: 73959 - RNA, 64 nt, Homo Sapiens
acaauggacuaugccuugguuuuucacuaaucaaaaucaaaauuacucuuuaacaugauaaaug

SEQ ID NO: 73960 - RNA, 64 nt, Homo Sapiens
gaacuucuuguccuagaucagccccaaucuguuuaaucaaaauggaagguucaguaauuucaug

SEQ ID NO: 73961 - RNA, 64 nt, Homo Sapiens
uaauuacuguuuuuuauuuccacugccuuuauaaaaucaaaauuuucuccuuuugauaaaaacu

SEQ ID NO: 73962 - RNA, 64 nt, Homo Sapiens
auucguuuucauuuagaagccccucuguacagauaaucaaaauucaaaguugaaagaaucaaaa

SEQ ID NO: 73963 - RNA, 64 nt, Homo Sapiens
cucuguacagauaaucaaaauucaaaguugaaagaaucaaaagcagccacaguuauguaggucu

SEQ ID NO: 73964 - RNA, 64 nt, Homo Sapiens
aaauccccauuuuccuuuuacugcaaagaccuacaaucaaaagcucacucaggaaccagcggau

SEQ ID NO: 73965 - RNA, 64 nt, Homo Sapiens
agaauucucuggaauaacagcaaucucuucuucaaaucaaaauguaaggugugagguaacaauu

SEQ ID NO: 73966 - RNA, 64 nt, Homo Sapiens
uggcaguauuggcauuguucaagcaucccugaauaaucaaaaaugaauaaucuauggguuagaa

SEQ ID NO: 73967 - RNA, 64 nt, Homo Sapiens
uacuuuuauuuaggaguuugauaaaugauagguaaaucaaaaauucuggauagauaaucuggua

SEQ ID NO: 73968 - RNA, 64 nt, Homo Sapiens
ccucauaaggcaugaaguugaaugauacuucugaaaucaaaauuauaugaugcugagucugugg

SEQ ID NO: 73969 - RNA, 64 nt, Homo Sapiens
aggaaaauaaguuaaauuaacuuaaaaauacaaaaaucaaaaaguugaaaauuaaaagugcccu

SEQ ID NO: 73970 - RNA, 64 nt, Homo Sapiens
uuuauuuuaacccuugaaucugcuuuauguacauaaucaaaauaucuauaucuauaucuauauc

SEQ ID NO: 73971 - RNA, 64 nt, Homo Sapiens
cggaaugugcacguuuccaggggcgaguauugucaaucaaaagguuugcaaugauuuccuuccu

SEQ ID NO: 73972 - RNA, 64 nt, Homo Sapiens
cauauagccauugaucauaaacugacuaucauaaaaucaaaacaagugaaauaacaaaauggac

SEQ ID NO: 73973 - RNA, 64 nt, Homo Sapiens
auggaacgcuaaugaaacacagcuuacaaucgcaaaucaaaacucacaagugcucaucuguugu

SEQ ID NO: 73974 - RNA, 64 nt, Homo Sapiens
uuuugauaguuuuauggcuuuuuacuguuagacuaaucaaaaauaacuuuaaaaggaacaaaga

SEQ ID NO: 73975 - RNA, 64 nt, Homo Sapiens
acuauucaaguuguguacuuuaaacaaauauaaaaaucaaaaggcugccucuauuacaauccuc

SEQ ID NO: 73976 - RNA, 64 nt, Homo Sapiens
uagcacuaugcuugggggccauuuuaaacagugaaaucaaaaaaagaacagaaaugcaaaaacc

SEQ ID NO: 73977 - RNA, 64 nt, Homo Sapiens
aaauguccccggaucuuucguaucugaagaaaaaaaucaaaaacgggaaguuucacccucuccc

SEQ ID NO: 73978 - RNA, 64 nt, Homo Sapiens
uuuaguauuccucaucuucuaauccaaauaugaaaaucaaaagcuguggccuuggaguuugcua

SEQ ID NO: 73979 - RNA, 64 nt, Homo Sapiens
cuguaugcuuucuuugccuucaccuguguaggagaaucaaaaucuaauaaacuaacuuuaugug

SEQ ID NO: 73980 - RNA, 64 nt, Homo Sapiens
aaaaauaccacagcuuaguguaggaauuuuuaaaaaucaaaacauguauuugauuacuuagaga

SEQ ID NO: 73981 - RNA, 64 nt, Homo Sapiens
ugaaccagaggaaauauugaaguauuuguuacauaaucaaaagguuuuuucaucuuuugcaaaa

SEQ ID NO: 73982 - RNA, 64 nt, Homo Sapiens
uaauuuguugaguuuugccuucucuauuuggaugaaucaaaaugucuugaaaucucucucucuc

SEQ ID NO: 73983 - RNA, 64 nt, Homo Sapiens
ucaacguaaaaacugguuucuagaugauaaucaaaaucaaaaagauauauauauauauuaaacu

SEQ ID NO: 73984 - RNA, 64 nt, Homo Sapiens
aaaaagucaacguaaaaacuuaaacuuagaugauaaucaaaaucacacacauauauauauauau

SEQ ID NO: 73985 - RNA, 64 nt, Homo Sapiens
aguuuuauugaugcuugcugcagggcauaauuauaaucaaaauuuugaugucaucaaagaucac

SEQ ID NO: 73986 - RNA, 64 nt, Homo Sapiens
cuuugggaggcugagucggguggcucacaccuguaaucaaaacagaacucucggccgggcgcgg

SEQ ID NO: 73987 - RNA, 64 nt, Homo Sapiens
cagugaaacuuaugacuuggauauaugguugaagaaucaaaacaaaagcaaaaaaaaaaagcaa

SEQ ID NO: 73988 - RNA, 64 nt, Homo Sapiens
uaaaaagaaguuaacauucauaucucuguuuugaaaucaaaaaucauauuucaaaauucuuucc

SEQ ID NO: 73989 - RNA, 64 nt, Homo Sapiens
auaaaaaucugugaagagauaauuuuaggaacagaaucaaaagaguuacaaaggugaaaagcca

SEQ ID NO: 73990 - RNA, 64 nt, Homo Sapiens
gucauauuccugagaaguagcaaacaucccagcuaaucaaaauagccuuuuuuuuuaagcuugg

SEQ ID NO: 73991 - RNA, 64 nt, Homo Sapiens
aggagauuaaccucuuguuugauggucaauuaacaaucaaaaagccagccuuuggaggaauaga

SEQ ID NO: 73992 - RNA, 64 nt, Homo Sapiens
uuaaauauauauaaauaaagcaagaugaacuugcaaucaaaaacaccuuacaugagaagaugag

SEQ ID NO: 73993 - RNA, 64 nt, Homo Sapiens
uuggauuuacuagacgaaaaccauaccucucuucaaucaaaaugaaaacaaagcaaaugaauac

SEQ ID NO: 73994 - RNA, 64 nt, Homo Sapiens
auauuguagucauuuuaaaguacacaaagggcacaaucaaaaugagaugcacucauuuaaaucu

SEQ ID NO: 73995 - RNA, 64 nt, Homo Sapiens
ucccacuuaacacuuugauuagcaugaacuugccaaucaaaaaaugacaaucaauuugagaaaa

SEQ ID NO: 73996 - RNA, 64 nt, Homo Sapiens
cuggacaacauagugagauccuaucucuauaaaaaaucaaaaauuagccaggcaugguggugca

SEQ ID NO: 73997 - RNA, 64 nt, Homo Sapiens
cacugugaacuauuuugaaggccauauuuuaaaaaaucaaaaggucgguuccucugauuucaag

SEQ ID NO: 73998 - RNA, 64 nt, Homo Sapiens
uaaugcacauccucauucaccgauuauugaucaaaaucaaaaggcaucaaguaaucauggccag

SEQ ID NO: 73999 - RNA, 64 nt, Homo Sapiens
aacuauaucaucaccaagagauguuuauuagggcaaucaaaagauuuauuauuuuaaaaaaauc

SEQ ID NO: 74000 - RNA, 64 nt, Homo Sapiens
ugaaacuagacccccaucucuuagcauauacaaaaaucaaaauuaauuaaaaaguuaaaucuaa

SEQ ID NO: 74001 - RNA, 64 nt, Homo Sapiens
cuucuguauaccuucacccauuucaugaaaauaaaaucaaaagggaaaucaaaaauaaagaaaa

SEQ ID NO: 74002 - RNA, 64 nt, Homo Sapiens
uucacccauuucaugaaaauaaaaucaaaagggaaaucaaaaauaaagaaaacgcuaaagaaaa

SEQ ID NO: 74003 - RNA, 64 nt, Homo Sapiens
aaacaacaaguucugaguuaauaaaaaagucaaaaaucaaaaucaccaggacccacuggggcau

SEQ ID NO: 74004 - RNA, 64 nt, Homo Sapiens
aaugcaagcugagguuuugugugauaccuacgaaaaucaaaauaagcuuuccuucuuuucaaca

SEQ ID NO: 74005 - RNA, 64 nt, Homo Sapiens
ggcucacucaaaccagcacaacaaaguguuggaaaaucaaaagaucccaaauuuaauguggaag

SEQ ID NO: 74006 - RNA, 64 nt, Homo Sapiens
caaacaaacaaacaaacacucauaaaauauaaacaaucaaaaucaaaacaaaaacaaaacaaaa

SEQ ID NO: 74007 - RNA, 64 nt, Homo Sapiens
acccagccucaaaaaaaaaaaaaaaaaagugaugaaucaaaauuagaaauuaagaguuuuaaga

SEQ ID NO: 74008 - RNA, 64 nt, Homo Sapiens
ugagccaaggccacauagcuaccuacagugacagaaucaaaauucaaacucagguuuaucuagu

SEQ ID NO: 74009 - RNA, 64 nt, Homo Sapiens
gugagaugcaacaagcccugcuuuugcauaaugcaaucaaaaauauguguuuuuaagauuaguu

SEQ ID NO: 74010 - RNA, 64 nt, Homo Sapiens
guaaaguuacacuuuuauuuccuguauguuguacaaucaaaacacacuacuaccucuuaagucc

SEQ ID NO: 74011 - RNA, 64 nt, Homo Sapiens
agguguggaacuuuuauuuuguuuuaaaaauaugaaucaaaauuccuguguugugugccaaggu

SEQ ID NO: 74012 - RNA, 64 nt, Homo Sapiens
ggggacguagccuaacauuuuaccaacuuacguaaaucaaaaaagucauuauuguugcaggagu

SEQ ID NO: 74013 - RNA, 64 nt, Homo Sapiens
ucagugacuaagaggcugcaauaaggugccaugaaaucaaaaucaaagggcuagaacucuccaa

SEQ ID NO: 74014 - RNA, 64 nt, Homo Sapiens
aaaugauauaaaaacuauagucauaagaagagacaaucaaaaauaaucagccauaaaauauuaa

SEQ ID NO: 74015 - RNA, 64 nt, Homo Sapiens
auaauaaacuucauuuuaacaaaaaaaaucaaaaaaucaaaaaauauuuaaaaaaacaaaaaac

SEQ ID NO: 74016 - RNA, 64 nt, Homo Sapiens
ucaaaaaaauaauaaacuuccaaaaaacaaaaaaaaucaaaaaaaacaguuuuauuuaaaaaaa

SEQ ID NO: 74017 - RNA, 64 nt, Homo Sapiens
uguauuuacaggagaaagaggugauuauggagggaaucaaaaauacugcuuucaguuaguagcu

SEQ ID NO: 74018 - RNA, 64 nt, Homo Sapiens
uuaagugcgcauaucuuuucuguauacagcuuaaaaucaaaaauguauguuaagagaauuuuuu

SEQ ID NO: 74019 - RNA, 64 nt, Homo Sapiens
aagccagcaauuggcugggguccaggaaacaaagcaaaagcacaauaugugaaugugcugauug

SEQ ID NO: 74020 - RNA, 64 nt, Homo Sapiens
ggaaauuuauguuggcgauagccaagaccacaagcaaaagcacauacuggaaaugaugaguuag

SEQ ID NO: 74021 - RNA, 64 nt, Homo Sapiens
ugaaauaauugugcacaucuagaacugcuauaaacaaaagcaucagaaguucuaccaccuuauu

SEQ ID NO: 74022 - RNA, 64 nt, Homo Sapiens
ggccaguauuaagcagaaguccaaccauaagugucaaaagcacacaacuccuagacaaaguuug

SEQ ID NO: 74023 - RNA, 64 nt, Homo Sapiens
aaccccugauaaacugaucaaaaugaggaagaagcaaaagcagaucuuacauuguggcaagaaa

SEQ ID NO: 74024 - RNA, 64 nt, Homo Sapiens
cuaguuacuuccuagauaccugagccuguaaaaucaaaagcaagaggcaagucccuuccaccua

SEQ ID NO: 74025 - RNA, 64 nt, Homo Sapiens
uuuugcacuagaaauuuuuggggagcuuugcuggcaaaagcaguuagcccuuugauuccagaga

SEQ ID NO: 74026 - RNA, 64 nt, Homo Sapiens
aaauguuguauauagagucaucucuguucagauccaaaagcacauuccuguggacaaugcccag

SEQ ID NO: 74027 - RNA, 64 nt, Homo Sapiens
acuaucaucauauggacucuauguaacacaaauucaaaagcaaacuaaaagcuauaugcagagu

SEQ ID NO: 74028 - RNA, 64 nt, Homo Sapiens
auaaaauaaaaaauauuugucuccaccuuuuccccaaaagcaacagcaagacauauuuuguuag

SEQ ID NO: 74029 - RNA, 64 nt, Homo Sapiens
cuuaaggaauagaagcaaauuaaacgguaacauccaaaagcaaccacaaaccuaguacgacuuc

SEQ ID NO: 74030 - RNA, 64 nt, Homo Sapiens
guuuaagauuguaauuaaaaugauaguugauuuucaaaagcauuaauuuuuuuucauuguuuuu

SEQ ID NO: 74031 - RNA, 64 nt, Homo Sapiens
gaccccaccccggaccaguuacauucguuccuggcaaaagcaaauggaaauggucuccugucuc

SEQ ID NO: 74032 - RNA, 64 nt, Homo Sapiens
cuuugcacccucucccacaacaaauaccaagcaucaaaagcacuuucauuugaaaauuauuaug

SEQ ID NO: 74033 - RNA, 64 nt, Homo Sapiens
uuucccccaaauguaugucuucugucccuuuucucaaaagcaucgaaaugacuucuuuucuccu

SEQ ID NO: 74034 - RNA, 64 nt, Homo Sapiens
ggauugaacaacugcagagaaagaagcugaaauacaaaagcagaucuagaggaagggaacuuag

SEQ ID NO: 74035 - RNA, 64 nt, Homo Sapiens
cuuuaauugcauaguugaguugucuuacauuuuccaaaagcagguuaugauaagcacaugagag

SEQ ID NO: 74036 - RNA, 64 nt, Homo Sapiens
aaauuugcuagcaguaaaagauuucuuuucuggccaaaagcaguguuaaccccauguccucagc

SEQ ID NO: 74037 - RNA, 64 nt, Homo Sapiens
aaccccucccucuuuucaguaaauuuaccaaaagcaaaagcauauuauuuguauugaagaaaac

SEQ ID NO: 74038 - RNA, 64 nt, Homo Sapiens
agcauaaaccccucccucuugaaaacaaauuuaccaaaagcaaaaucugauuauuuguauugaa

SEQ ID NO: 74039 - RNA, 64 nt, Homo Sapiens
cuugacgucaagucuccuuccccgucauguuccucaaaagcaccaguuggggcaggcuggcugg

SEQ ID NO: 74040 - RNA, 64 nt, Homo Sapiens
ugagaucccgccucuucuucaacacccgacuccucaaaagcaaaaacaugcgaccgugaccagg

SEQ ID NO: 74041 - RNA, 64 nt, Homo Sapiens
gaaauuuguuguuuguuuaaacccaagugcugcacaaaagcagauacuugaggaaaacacuauu

SEQ ID NO: 74042 - RNA, 64 nt, Homo Sapiens
cacaaaagcagauacuugaggaaaacacuauuuccaaaagcacauguauugacaacaguuuuau

SEQ ID NO: 74043 - RNA, 64 nt, Homo Sapiens
accucucacaugcagcucagagcucccaagagcucaaaagcagaaauggccaggccuucugaaa

SEQ ID NO: 74044 - RNA, 64 nt, Homo Sapiens
cacaaccagugccauggaaaaccaaggauauuagcaaaagcagaaguugcuagugaccuuggga

SEQ ID NO: 74045 - RNA, 64 nt, Homo Sapiens
cuuuagaaguuaaaccacccgauaggccuucgagcaaaagcaaagauccaccgagagaagaaga

SEQ ID NO: 74046 - RNA, 64 nt, Homo Sapiens
cauucgucauccaaguccaggucuagaucacacucaaaagcaaagcauucucuucccagugccu

SEQ ID NO: 74047 - RNA, 64 nt, Homo Sapiens
acugacaggcacuauaauuucuguaacacacuaacaaaagcaugaaaaauaggaaccacaccaa

SEQ ID NO: 74048 - RNA, 64 nt, Homo Sapiens
uugaguugauaguuuuacaaauucuuaauagguucaaaagcaaucuggucugaauaacacugga

SEQ ID NO: 74049 - RNA, 64 nt, Homo Sapiens
uauuaugaaacuuuccuuugucauuauuagucuucaaaagcaugauuuuuaauaguuguugagu

SEQ ID NO: 74050 - RNA, 64 nt, Homo Sapiens
cuguguauaugucuuauaaaaggguauauguuggcaaaagcagauuacaucuuaagugaccuac

SEQ ID NO: 74051 - RNA, 64 nt, Homo Sapiens
auaaacucugggaaagauuuaaguuacuguuuaacaaaagcaacaaaaaagagauucuaguaca

SEQ ID NO: 74052 - RNA, 64 nt, Homo Sapiens
acuauuuugugacuaaauaucaacuaugugcauacaaaagcaauacaaaagcaaaguaaucuua

SEQ ID NO: 74053 - RNA, 64 nt, Homo Sapiens
guaaucuuacaacuaugugcauaguuuuuauugacaaaagcaaaagaguuuuaugaaagauggu

SEQ ID NO: 74054 - RNA, 64 nt, Homo Sapiens
gggcuacaguaaccaaaacugcaugauacugguacaaaagcauggugcugguacaaaagcagac

SEQ ID NO: 74055 - RNA, 64 nt, Homo Sapiens
ugcaugauacugguacaaaagcauggugcugguacaaaagcagacacauagaucaauggaacag

SEQ ID NO: 74056 - RNA, 64 nt, Homo Sapiens
uucagugaucagaauagauauccuuuuacacgcacaaaagcaauagauucauucaguggacaag

SEQ ID NO: 74057 - RNA, 64 nt, Homo Sapiens
gauuuacauaguaaguuucacacuaccuuauuaccaaaagcaaacaccucuuacuuuaaacuac

SEQ ID NO: 74058 - RNA, 64 nt, Homo Sapiens
ucugucacaucuacucaacucugcuguugacaugcaaaagcagcaauagacaauaugcguguaa

SEQ ID NO: 74059 - RNA, 64 nt, Homo Sapiens
ugaguguggcuguaauccaagaaaacuuuauuuacaaaagcagguggagggcuggguuuggccu

SEQ ID NO: 74060 - RNA, 64 nt, Homo Sapiens
aaaaaugcuguguugaaaugucuagggaaaccuucaaaagcaauugcaauagaaugaugucugc

SEQ ID NO: 74061 - RNA, 64 nt, Homo Sapiens
ggaccccaucccucuaaagcagggugaugcacagcaaaagcaaucaaaauguaacugcuaauca

SEQ ID NO: 74062 - RNA, 64 nt, Homo Sapiens
cacucacacuaggcaaugccauuucaaugcauuacuaaaugacauuuguaguuccuagcuccuc

SEQ ID NO: 74063 - RNA, 64 nt, Homo Sapiens
ggugguuguuuuuggucucuguugucacuaaagacuaaaugaggguuugcaguugggaaagagg

SEQ ID NO: 74064 - RNA, 64 nt, Homo Sapiens
aaauacuuucauuuauguuugcuagaaacauuuucuaaaugauagugauuagcugguuagccau

SEQ ID NO: 74065 - RNA, 64 nt, Homo Sapiens
guuuuagaauccuuugaaucuaaguauuuguuuccuaaaugaaacauuuguacaacauuugaug

SEQ ID NO: 74066 - RNA, 64 nt, Homo Sapiens
aaaaaucaaacauucauauccacaaaauuuucugcuaaaugacuccacacucagccuucucuac

SEQ ID NO: 74067 - RNA, 64 nt, Homo Sapiens
guaacugaagcuccagaguuaagguuucagauuucuaaaugaaacuaucuuuuucaauuacauc

SEQ ID NO: 74068 - RNA, 64 nt, Homo Sapiens
uuggguuuugaacucuccauaugauuuucacauucuaaaugacuccuuaagugagaauuucuaa

SEQ ID NO: 74069 - RNA, 64 nt, Homo Sapiens
uucacauucuaaaugacuuuuuaagugagaauuucuaaaugauuccccuaauucugugggugcc

SEQ ID NO: 74070 - RNA, 64 nt, Homo Sapiens
uaucacuguguauacagacaagagauguagaaaucuaaaugaauaugucauauguuaaaaauaa

SEQ ID NO: 74071 - RNA, 64 nt, Homo Sapiens
ugugcauuuccucauuuaaagagaaaaguuuaaucuaaaugauacauggucaucuggugaugaa

SEQ ID NO: 74072 - RNA, 64 nt, Homo Sapiens
uugccucuugggaaauuagcagauagucuuugcucuaaaugauaucugaguaaauagacuugag

SEQ ID NO: 74073 - RNA, 64 nt, Homo Sapiens
auacauuuuaaguauuuuuaaauagaugaaaauucuaaaugauuuucccucaaaucuaucuaga

SEQ ID NO: 74074 - RNA, 64 nt, Homo Sapiens
aacauuuucugaauucccauuuucuuguucgcggcuaaaugacaguuucugucauuacuuagau

SEQ ID NO: 74075 - RNA, 64 nt, Homo Sapiens
aaagguucuggcacuucaaugccaggcaggucuccuaaaugaacagaaugaucugugugagccg

SEQ ID NO: 74076 - RNA, 64 nt, Homo Sapiens
cugauuuuguuuuaucaaucugauuaaagaauaacuaaaugacuaguguauuuuaaaguaauaa

SEQ ID NO: 74077 - RNA, 64 nt, Homo Sapiens
uuucguugaugaaauguugccugccuuuugaaaccuaaaugaguaaugcauucuguacuacauc

SEQ ID NO: 74078 - RNA, 64 nt, Homo Sapiens
cucugagagaagcuauaauuuaaucugugaggaacuaaaugacaggagauuggugcuaauacgg

SEQ ID NO: 74079 - RNA, 64 nt, Homo Sapiens
uguuaguacaugauuuuaaagguuagaaccccuucuaaaugaauggucuguggaagauuuuagu

SEQ ID NO: 74080 - RNA, 64 nt, Homo Sapiens
gcgaagcuggaauacugcuaacacagaagaggaacuaaaugacuaaaaacacuuccaaaaagau

SEQ ID NO: 74081 - RNA, 64 nt, Homo Sapiens
aaaaaaagaauggacuguaagcuuuuuaauggaacuaaaugauccacugcuuaaaguacauuau

SEQ ID NO: 74082 - RNA, 64 nt, Homo Sapiens
uagaaaguauguuuguguugguuuuuuaagaagucuaaaugaaguuauuaauaccugaagcuuu

SEQ ID NO: 74083 - RNA, 64 nt, Homo Sapiens
aaaaaauugacuaccuggaggaaugauuaggaaucuaaaugaagccagcccucgguaucugcag

SEQ ID NO: 74084 - RNA, 64 nt, Homo Sapiens
cuggaauauguuuaguagauucuauguaaaacuacuaaaugacauauccaaguauagugcagau

SEQ ID NO: 74085 - RNA, 64 nt, Homo Sapiens
uguguugcagagaacucccaccaaggugcaacuccuaaaugaaucuauauuuaucugagugagu

SEQ ID NO: 74086 - RNA, 64 nt, Homo Sapiens
gcaagggaaacuggggagauggggauggaggaggaaggcugauauccucuggggagcacaucac

SEQ ID NO: 74087 - RNA, 64 nt, Homo Sapiens
cuggggagcacaucaccugaaggugccaaggaggaaggcugagaggggggccaccccauuucug

SEQ ID NO: 74088 - RNA, 64 nt, Homo Sapiens
ccgagagcgggcugugggcgucucucuuacgaugaaggcugaugccggccucggaaccagcuuu

SEQ ID NO: 74089 - RNA, 64 nt, Homo Sapiens
cggcccgggcugcguacacccccuaauugugccaaaggcugaccguggucacugcgguugccgc

SEQ ID NO: 74090 - RNA, 64 nt, Homo Sapiens
cagauacuuuuaccugagugaugcuucccuuccuaaggcugaccaagaccuguugauccuuuua

SEQ ID NO: 74091 - RNA, 64 nt, Homo Sapiens
auccuuuuagauuaaaaauaaaaugucgcauguaaaggcugaagucgcguuuuaucagaaugcc

SEQ ID NO: 74092 - RNA, 64 nt, Homo Sapiens
cauaggaguugcuugaaccuucccagcuacuuggaaggcugaggaugguggugaacaccuguaa

SEQ ID NO: 74093 - RNA, 64 nt, Homo Sapiens
gcuauuuuuuccuguggcugaauguccaucucauaaggcugagaagagcgggaguuaguauagg

SEQ ID NO: 74094 - RNA, 64 nt, Homo Sapiens
gaggugugauugggcccuccgcugccacaggccuaaggcugaguacuucuccacccgccaggca

SEQ ID NO: 74095 - RNA, 64 nt, Homo Sapiens
gcuccucuggguuugaggguaaacugggacggucaaggcugaagauucgcccguuacaucuucc

SEQ ID NO: 74096 - RNA, 64 nt, Homo Sapiens
caggagaauggcgugaacccucccagcuacuuggaaggcugaggcugguggcgggcgccuguag

SEQ ID NO: 74097 - RNA, 64 nt, Homo Sapiens
caggaggauugcuuaaacgcuagaauuacagaggaaggcugaggaccuuggccacccaaagugg

SEQ ID NO: 74098 - RNA, 64 nt, Homo Sapiens
ggaagcaggguggccuccagagccuugccauaaaaaggcugaaggcagccgggcgcaguggcuc

SEQ ID NO: 74099 - RNA, 64 nt, Homo Sapiens
cagacuccgucucaaaaaaaaaaaaaaaacaaaaaaggcugaaggcagcuguagcuccacacag

SEQ ID NO: 74100 - RNA, 64 nt, Homo Sapiens
uugaagagaguugcuuuugauaagaaaaaaagacaaggcugauuaugguauaaaguuugcucau

SEQ ID NO: 74101 - RNA, 64 nt, Homo Sapiens
augguauaaaguuugcucauuguagcuuuuaggaaaggcugaugacuuuuucucggagcauaua

SEQ ID NO: 74102 - RNA, 64 nt, Homo Sapiens
gcucucucuucucuguuacaaugcugguguggccaaggcugagaucgcuggggaagggggcucc

SEQ ID NO: 74103 - RNA, 64 nt, Homo Sapiens
cauucccggugcagaacaggggagagcuucccccaaggcugaugacacuacuugagaaaaugca

SEQ ID NO: 74104 - RNA, 64 nt, Homo Sapiens
aauuugccuguuuggggcagcuuuuaguaucgaugccacucaucugcagcagaagagaaagaag

SEQ ID NO: 74105 - RNA, 64 nt, Homo Sapiens
uuucauggaccaacugaucaauugccaguacuaagccacucauuguuauggcuuccuuuuugaa

SEQ ID NO: 74106 - RNA, 64 nt, Homo Sapiens
ucucugggguuucccucucuaguggaugggcagugccacucaggaccuauuuaugugggccuuc

SEQ ID NO: 74107 - RNA, 64 nt, Homo Sapiens
cguuccuauucacucggaaacagcacucuaaauggccacucaggaucaugagggaaggaaaaug

SEQ ID NO: 74108 - RNA, 64 nt, Homo Sapiens
aacuggcauggagggcccagcucuuccaacguaggccacucagcagggcuggggacuuguccuu

SEQ ID NO: 74109 - RNA, 64 nt, Homo Sapiens
agcuauguucccgccgcaguugccaagcacugcggccacucagcuguggggacagcccucgccc

SEQ ID NO: 74110 - RNA, 64 nt, Homo Sapiens; identical to SEQ ID NO: 53255

SEQ ID NO: 74111 - RNA, 64 nt, Homo Sapiens; identical to SEQ ID NO: 53256

SEQ ID NO: 74112 - RNA, 64 nt, Homo Sapiens; identical to SEQ ID NO: 53257

SEQ ID NO: 74113 - RNA, 64 nt, Homo Sapiens; identical to SEQ ID NO: 53258

SEQ ID NO: 74114 - RNA, 64 nt, Homo Sapiens; identical to SEQ ID NO: 53259

SEQ ID NO: 74115 - RNA, 64 nt, Homo Sapiens; identical to SEQ ID NO: 53260

SEQ ID NO: 74116 - RNA, 64 nt, Homo Sapiens; identical to SEQ ID NO: 53261

SEQ ID NO: 74117 - RNA, 64 nt, Homo Sapiens; identical to SEQ ID NO: 53262

SEQ ID NO: 74118 - RNA, 64 nt, Homo Sapiens; identical to SEQ ID NO: 53263

SEQ ID NO: 74119 - RNA, 64 nt, Homo Sapiens; identical to SEQ ID NO: 53264

SEQ ID NO: 74120 - RNA, 64 nt, Homo Sapiens; identical to SEQ ID NO: 53265

SEQ ID NO: 74121 - RNA, 64 nt, Homo Sapiens; identical to SEQ ID NO: 53266

SEQ ID NO: 74122 - RNA, 64 nt, Homo Sapiens; identical to SEQ ID NO: 53267

SEQ ID NO: 74123 - RNA, 64 nt, Homo Sapiens; identical to SEQ ID NO: 53268

SEQ ID NO: 74124 - RNA, 64 nt, Homo Sapiens; identical to SEQ ID NO: 53253

SEQ ID NO: 74125 - RNA, 64 nt, Homo Sapiens; identical to SEQ ID NO: 53254

SEQ ID NO: 74126 - RNA, 64 nt, Homo Sapiens
gagguggagagcaagacugaacagaaagaauagagaacaggaacgcugaacaggagaaagacaa

SEQ ID NO: 74127 - RNA, 64 nt, Homo Sapiens
aagacaaacagaaagaauaggagaaagagaagcugaacaggagaguggugcccguggaaagagg

SEQ ID NO: 74128 - RNA, 64 nt, Homo Sapiens
acaucaucuuauuauaucuuccucccaggcaucugaacaggauguucuguucaaccuguuuuga

SEQ ID NO: 74129 - RNA, 64 nt, Homo Sapiens
guguuagugauugggugauuuacucauauaaaaugaacaggaaagguaacuaacaauuuugaaa

SEQ ID NO: 74130 - RNA, 64 nt, Homo Sapiens
auugcaagguacaauuuucuccaauaaaucaggagaacaggaguuugaugaugcaaaguugauc

SEQ ID NO: 74131 - RNA, 63 nt, Homo Sapiens
uuggagaauacuuaaauaaaacaugugcaugcuugaacaggacaaaauguugacuguugcccu

SEQ ID NO: 74132 - RNA, 64 nt, Homo Sapiens
gaagaugggaaacaaaauaguggaggaugggagagaacaggaggcaguuaauauaaaacaucuu

SEQ ID NO: 74133 - RNA, 64 nt, Homo Sapiens
uagaaagccugaaagcugugagaucauguaucuagaacaggaguuccuuuccagaaaaauccuc

SEQ ID NO: 74134 - RNA, 64 nt, Homo Sapiens
guuacuuuuaagccuaccucgcuucugagagggugaacaggauuagggaucuucuauuuaagug

SEQ ID NO: 74135 - RNA, 64 nt, Homo Sapiens
gcagcagggcacuaaccuccugggaacucgcauggaacaggaggcccucucucugcagacaugc

SEQ ID NO: 74136 - RNA, 64 nt, Homo Sapiens
agaaaccccaaacucaggccgguaagggaaaagggaacaggaaauuuaucuuuugagaacuuuu

SEQ ID NO: 74137 - RNA, 64 nt, Homo Sapiens
ccacauugccagugacaugaaaacaccuagaucagaacaggaauagagcccuguaucaacccag

SEQ ID NO: 74138 - RNA, 64 nt, Homo Sapiens
augugucuaaaaauauugcuuaaucaagaaacuugaacaggauaauauuuguguagugaggucc

SEQ ID NO: 74139 - RNA, 64 nt, Homo Sapiens
cauaucuugauauuuaagaguauuggcuuuucaagaacaggacuuggguaguuuuaugucaaaa

SEQ ID NO: 74140 - RNA, 64 nt, Homo Sapiens
ccccuaaugagggugugagaagugccuucuccuuccccaggauggacucuucucggcucaggcu

SEQ ID NO: 74141 - RNA, 64 nt, Homo Sapiens
uuugccuuucugggagcagaaacagccauugcggccccaggaggggaacugagucacgcugggg

SEQ ID NO: 74142 - RNA, 64 nt, Homo Sapiens
cuggaacaggggucccuggaguucacaggcuuauccccaggaagccucacuccuggggaaagac

SEQ ID NO: 74143 - RNA, 64 nt, Homo Sapiens
aucccaagcagaauuagcaacaggaaaagcagagccccaggagagacacucuacuauauauacu

SEQ ID NO: 74144 - RNA, 64 nt, Homo Sapiens
gagucccuggaaaagaaagaauaaguggauucucccccaggagaauccuuuuugcaaagauagg

SEQ ID NO: 74145 - RNA, 64 nt, Homo Sapiens
cagcugaggucaguuucaggagggugaagcugauccccaggaauggaucagcugccaugggcac

SEQ ID NO: 74146 - RNA, 64 nt, Homo Sapiens
caaauguggugucugaaauggaguugagcagcugccccaggaucagccaugguagaguugggua

SEQ ID NO: 74147 - RNA, 64 nt, Homo Sapiens
aggucugccaucagcuuagucugaaugaguauuaccccaggaugccuccuuuguugcugcuucc

SEQ ID NO: 74148 - RNA, 64 nt, Homo Sapiens
cugaggucuuccugggcccucuuuuaggaugggcccccaggagauacuuugcugcccuugccau

SEQ ID NO: 74149 - RNA, 64 nt, Homo Sapiens
cccuuggcucagaguguggugacucuagccucauccccaggaccuaggaaccgagggcacacgg

SEQ ID NO: 74150 - RNA, 64 nt, Homo Sapiens
ggaauuuggggccuaggaacugggcuugccacagccccaggagagccaagggaggugccaacac

SEQ ID NO: 74151 - RNA, 64 nt, Homo Sapiens
cgguuuccacaucugugagggccuuccuugagcuccccaggaguaccuagggaccacguuagcu

SEQ ID NO: 74152 - RNA, 64 nt, Homo Sapiens
gggugaggggugacacucggguuccggcagcuuuccccaggaaagaggagugacuccaagaaga

SEQ ID NO: 74153 - RNA, 64 nt, Homo Sapiens
gucaacccaaaggagcugccgcacugacccagccccccaggaaacagugagacaagaaucaagu

SEQ ID NO: 74154 - RNA, 64 nt, Homo Sapiens
ggcagcagcaguaggacuauaaaccacagcugucccccaggaucccacuccuuuccugucugug

SEQ ID NO: 74155 - RNA, 64 nt, Homo Sapiens
cacagggcccaggaggcauuccacacaggcacugccccaggacaacacaacaaggacagucaca

SEQ ID NO: 74156 - RNA, 64 nt, Homo Sapiens
cuucaugguggguggaguggggguggcugggcucccccaggacagaggggacccugagguuggc

SEQ ID NO: 74157 - RNA, 64 nt, Homo Sapiens
ucugccuggucccuucucacgaggaggccgagggccccaggauguccccugggaggggaggcag

SEQ ID NO: 74158 - RNA, 64 nt, Homo Sapiens
ggcuuucaggaaacucucccgaacagacagaaaaccccaggaggaggguagcaguaaugaauag

SEQ ID NO: 74159 - RNA, 64 nt, Homo Sapiens
gggguggaacugaggaagagggagccugugacacccccaggaagcaugggcucugguucugcca

SEQ ID NO: 74160 - RNA, 64 nt, Homo Sapiens
gagggacagcauuucucuggguuugccaccacuuccccaggaaggagagagccuuggcgccucu

SEQ ID NO: 74161 - RNA, 64 nt, Homo Sapiens
gaguuugagguucauugucagcucuggaggccacccccaggaaguuucaaaaaguguggccuca

SEQ ID NO: 74162 - RNA, 64 nt, Homo Sapiens
augggccacuguccauggggaggcaccagacuuaccccaggagcuggaucugcugagucacccc

SEQ ID NO: 74163 - RNA, 64 nt, Homo Sapiens
aagcaccccuugccucugugccucccaaaacaugccccaggaaccagugaugucauuuuauucc

SEQ ID NO: 74164 - RNA, 64 nt, Homo Sapiens
ccguccuguccaugcgcuuccagggccccacgguccccaggaggacgcuuccuggccaaagccc

SEQ ID NO: 74165 - RNA, 64 nt, Homo Sapiens
ccucagaaucccacugcaauggacccaggcagcgccccaggaagccaugcugggcccccgccag

SEQ ID NO: 74166 - RNA, 64 nt, Homo Sapiens
caugcagggcccccaugcagaggagcguguacuaccccaggacggaugcaugcagggcccccac

SEQ ID NO: 74167 - RNA, 64 nt, Homo Sapiens
caugcagggcccccacaggaaggagcguguacuaccccaggauggacgcaugcagggcccccac

SEQ ID NO: 74168 - RNA, 64 nt, Homo Sapiens
caugcagggcccccacaggaaggagcguguacuaccccaggacggacgcaugcagggcccccac

SEQ ID NO: 74169 - RNA, 64 nt, Homo Sapiens
caugcagggcccccacaggauggagcguguacuaccccaggacggacgcaugcagggcccccac

SEQ ID NO: 74170 - RNA, 64 nt, Homo Sapiens
caugcagggcccccacuggaaggagcguguacuaccccaggacgaacgcaugcagggcccccac

SEQ ID NO: 74171 - RNA, 64 nt, Homo Sapiens
ucauccugcaaugggagagaagcagagacgaagaccccaggaagcuggcucaagguguagaggg

SEQ ID NO: 74172 - RNA, 64 nt, Homo Sapiens
cauagaacaggaccucugcuuuugcacaccuuuuccccaggagcagaagagaguggggccugcc

SEQ ID NO: 74173 - RNA, 64 nt, Homo Sapiens
cugccccuacgggcgcugcagccucccuuccaugccccaggaucacucucugcuggcaggauuc

SEQ ID NO: 74174 - RNA, 64 nt, Homo Sapiens
aaccgugaauguagggcccccagccucaccucugccccaggaccaacaacacccugguuuggag

SEQ ID NO: 74175 - RNA, 64 nt, Homo Sapiens
agggggucaccuaggggacugccucugugccucuccccaggaagcauccagggcagaggaagcc

SEQ ID NO: 74176 - RNA, 64 nt, Homo Sapiens
cucucccuuguggacaggcagaaaugugcccccgccccaggacccaccuuggggcuucucaugg

SEQ ID NO: 74177 - RNA, 64 nt, Homo Sapiens
aaccccuugggcuaggucugccacauuccuccggccccaggagccugggccucagcuucccuuc

SEQ ID NO: 74178 - RNA, 64 nt, Homo Sapiens
acaaccugagauuucuaagcguccccaggagcagccccaggagcuucuccaugacacgaggcca

SEQ ID NO: 74179 - RNA, 64 nt, Homo Sapiens
agccccaggagcacaaccuggacacgaggccaguccccaggagcacacacaugcuuuucuccau

SEQ ID NO: 74180 - RNA, 64 nt, Homo Sapiens
cccggccgccaccccacccggagggagaacggggccccaggagauccagggaccuagagaaugg

SEQ ID NO: 74181 - RNA, 64 nt, Homo Sapiens
cucugcacccccucaccccgagcgcucggagcccccccaggacaccuugcugaguccccugcca

SEQ ID NO: 74182 - RNA, 64 nt, Homo Sapiens
aggagagagaggggaaggagguaugaaucccaguccccaggaaccuagcucuuuaaacucuggg

SEQ ID NO: 74183 - RNA, 64 nt, Homo Sapiens
cuuuaaacucuggggagucggauucaggaaacacccccaggaggccaagccugaaaacagaggg

SEQ ID NO: 74184 - RNA, 64 nt, Homo Sapiens
acgugggcgcuggguccagaccucggcugccacgccccaggaccugcagcccucaugggggcug

SEQ ID NO: 74185 - RNA, 64 nt, Homo Sapiens
gagggaaggggauuuggagggaggcugucgucgcccccaggaaagacgggccugggggaggcgg

SEQ ID NO: 74186 - RNA, 64 nt, Homo Sapiens
gccucaggugccacagccugguucggccuggcggccccaggaggcagcagcaaccuugggcuuc

SEQ ID NO: 74187 - RNA, 64 nt, Homo Sapiens
gaggcccaggggagcccuguucacgcugguuucuccccaggacccaugagcuuccuggcuggcc

SEQ ID NO: 74188 - RNA, 64 nt, Homo Sapiens
ccuggcagagggagaggacaggaggaggagccuuccccaggaggaacgaggagagguggccacg

SEQ ID NO: 74189 - RNA, 64 nt, Homo Sapiens
aggagaaugagcuggagcgccagcaccacgauggccccaggacguuguuuaagaucugagaucc

SEQ ID NO: 74190 - RNA, 64 nt, Homo Sapiens
gccagggcagcccuuaucagcuugugacaaccuuccccaggacagaagucauacaaggccucug

SEQ ID NO: 74191 - RNA, 64 nt, Homo Sapiens
guggauccgggaccgaggguggucucuuggacaaccccaggaacuuggaccaaggcagagccaa

SEQ ID NO: 74192 - RNA, 64 nt, Homo Sapiens
guccccuauucauuaacagugugugcaaaugcaaccccaggacacauuauuguucugauagaug

SEQ ID NO: 74193 - RNA, 64 nt, Homo Sapiens
uuuuccauuccaggaacaaaggagaagccacuuuccccaggacgcaagacucuccccuccacug

SEQ ID NO: 74194 - RNA, 64 nt, Homo Sapiens
ucaggauuccacugacguccccagcugucaccucccccaggagacuuaaauccaaguuguuucu

SEQ ID NO: 74195 - RNA, 64 nt, Homo Sapiens
ugaucuuccacuugagcaacaggccgcugaaguuccccaggaaacauccaugugauuaagaucc

SEQ ID NO: 74196 - RNA, 64 nt, Homo Sapiens
caggggguggucugagucucccuucugacauuucccccaggaggauccucauaggcagagaagc

SEQ ID NO: 74197 - RNA, 64 nt, Homo Sapiens
cuccggccugggcucccccucggcccgcgccaucccccaggauccggggaccacaucuggcccc

SEQ ID NO: 74198 - RNA, 64 nt, Homo Sapiens
uggaucaggguuguucugggaguccugucagcuuccccaggagcucucugcugagcagcccagc

SEQ ID NO: 74199 - RNA, 64 nt, Homo Sapiens
cccaggagcucucugcugagcagcccagcacaacccccaggaaacacaaaugggguccagguca

SEQ ID NO: 74200 - RNA, 64 nt, Homo Sapiens
gcuuugaccuuuauucaagagaccagauggguugccccaggauccggcugccagcccugaggcc

SEQ ID NO: 74201 - RNA, 64 nt, Homo Sapiens
ccuggccugccguugcccugagcugcagccucggccccaggauccugcucacagucaccgcagg

SEQ ID NO: 74202 - RNA, 64 nt, Homo Sapiens
gucacaacaaccucgucaucauccccacuuuaaaccccaggagacugaaacucaaacaacccug

SEQ ID NO: 74203 - RNA, 64 nt, Homo Sapiens
cugagcucugaccuuucucuuggccccuuguacaccccaggagagaaguucucaaucccagcag

SEQ ID NO: 74204 - RNA, 64 nt, Homo Sapiens
cauugagccugcaggcuuugagugggaguguugcccccaggagccuuaucucagccaauuaccu

SEQ ID NO: 74205 - RNA, 64 nt, Homo Sapiens
agcaaagcaauacgacucagcccagcacucucugccccaggacucauggcucugcugugccuuc

SEQ ID NO: 74206 - RNA, 64 nt, Homo Sapiens
cuacccccuacucuggggcuugggggucaacuccccccaggacuuaccuuccaaaacaaacuuu

SEQ ID NO: 74207 - RNA, 64 nt, Homo Sapiens
gucagucccuguucuugagccucuuuucuccucuccccaggaugcagaaaguggugaacccagg

SEQ ID NO: 74208 - RNA, 64 nt, Homo Sapiens
cucgugucuuuggcccagaggggccccacaggcuccccaggaggagagccucacaggagggagg

SEQ ID NO: 74209 - RNA, 64 nt, Homo Sapiens
ccagacccuaacccgugagauugugggcugguuuccccaggaaucacagccucacaggagcagu

SEQ ID NO: 74210 - RNA, 64 nt, Homo Sapiens
gcacacggggccgcugggcaggugccccucacacccccaggaugucagugcucaccucgagcaa

SEQ ID NO: 74211 - RNA, 64 nt, Homo Sapiens
agaguccugcagagccucugggcugggcuggugcccccaggagauggagggccugguggaugcc

SEQ ID NO: 74212 - RNA, 64 nt, Homo Sapiens
cuggcugucucuagcgagggacuccaucccccacccccaggagccccgaccuccacccccucag

SEQ ID NO: 74213 - RNA, 64 nt, Homo Sapiens
gguccugagguacagagccagucccacuuggaggccccaggauuuaggccucaaaacugacuug

SEQ ID NO: 74214 - RNA, 64 nt, Homo Sapiens
gcccaggcuugggcagcaacaugagaugcagaacccccaggagcgcagaucaugcggcugcuuc

SEQ ID NO: 74215 - RNA, 64 nt, Homo Sapiens
uuggggcugccaacaagcagcaugggacccagccccccaggagacccugcugaugagccugcuc

SEQ ID NO: 74216 - RNA, 64 nt, Homo Sapiens
ggguauuuccaacacuuggcccaauggacagaagccccaggaaggaaaaucuaguuaaaauaau

SEQ ID NO: 74217 - RNA, 58 nt, Homo Sapiens
ccuaggcucgguggcuggacggcccccuccccaggaagagggcuucaagaucuucuga

SEQ ID NO: 74218 - RNA, 64 nt, Homo Sapiens
augaccagaugcccugcuccaucacaaccuccuuccccaggaaaacccacuuuccaaaagccca

SEQ ID NO: 74219 - RNA, 64 nt, Homo Sapiens
ggcuggccuuccuucucuucugagcccuccccugccccaggaacccuggccucaccaaaacagc

SEQ ID NO: 74220 - RNA, 64 nt, Homo Sapiens
cgugagccacagggcuagaagcacaggcccgucaccccaggaggaaaagcccagggucuggggc

SEQ ID NO: 74221 - RNA, 64 nt, Homo Sapiens
ugcucauccaccuucacaccacuugugagcugacccccaggaacagcuuggcuguuccaccaga

SEQ ID NO: 74222 - RNA, 56 nt, Homo Sapiens
gucaggagugggggaaaugaggugcaccccaggaaggccccguagaccuccgaaga

SEQ ID NO: 74223 - RNA, 64 nt, Homo Sapiens
aagaugucaaaggugugcagcuuccaaacggcauccccaggaucacugggcaaugcuggaaaga

SEQ ID NO: 74224 - RNA, 64 nt, Homo Sapiens
cuccagggcugaguggucagcccuggagugccagccccaggaagcagcccaaagauuuuccugu

SEQ ID NO: 74225 - RNA, 64 nt, Homo Sapiens
uaccgcgcccacacccaaucaucccaaccuugagccccaggagagggggcugggaccccuuccc

SEQ ID NO: 74226 - RNA, 64 nt, Homo Sapiens
cgggcccagaagagccccacgagggggcugggucccccaggacagggcagggcccagugggauu

SEQ ID NO: 74227 - RNA, 64 nt, Homo Sapiens
caaacacccaaacagaaaaauacaaauacacguaccccaggaaggggucccucaagucucugcu

SEQ ID NO: 74228 - RNA, 64 nt, Homo Sapiens
cccccucccagggcagccccugcccagcacaaaaccccaggacccuggcucugcacgccugggg

SEQ ID NO: 74229 - RNA, 53 nt, Homo Sapiens
cccuucuccaggaagaguaacagccccaggagguauugaaggacaggagagau

SEQ ID NO: 74230 - RNA, 64 nt, Homo Sapiens
gucgagagaccuguucuuucacagaugugagaagccccaggaugauugaccaugguguucagga

SEQ ID NO: 74231 - RNA, 64 nt, Homo Sapiens
uagaucuuggcuacugucauuauccuuuguccugccccaggauuuuuagagacuuggccaugaa

SEQ ID NO: 74232 - RNA, 64 nt, Homo Sapiens
cuguagcuucuuaacugguguucugucaccccauccccaggaaacuuugggauuacagcuugag

SEQ ID NO: 74233 - RNA, 64 nt, Homo Sapiens
ggccuugguacccccucucccccauguucacuucccccaggagaucucgugauucuguuuguua

SEQ ID NO: 74234 - RNA, 64 nt, Homo Sapiens
gagcuuggccuccaacauccucagccuuugccuaccccaggaauccaccccccaccuccaugcc

SEQ ID NO: 74235 - RNA, 64 nt, Homo Sapiens
gcccugcccucgaccuuccccucagcuagcucugccccaggacgaggucggccugugugcccag

SEQ ID NO: 74236 - RNA, 64 nt, Homo Sapiens
gaaccgaggccgucgccccucuucucucccuuuuccccaggaauaugaucuguuuugugcgucu

SEQ ID NO: 74237 - RNA, 64 nt, Homo Sapiens
caccccaggcugccaccccuccccacccguucacccccaggaugcuguugcuguaggacgccug

SEQ ID NO: 74238 - RNA, 64 nt, Homo Sapiens
uguugcuguaggacgccugcugcccuggagcccuccccaggaugugagccaguccccucgcugg

SEQ ID NO: 74239 - RNA, 64 nt, Homo Sapiens
gcucugguuucagagcagugccgggauugccuuuccccaggaucugugucggccauccaggaag

SEQ ID NO: 74240 - RNA, 64 nt, Homo Sapiens
acugggcacacgccaucccagagggcucaggaugccccaggaaggaaagaagggcaacagacua

SEQ ID NO: 74241 - RNA, 64 nt, Homo Sapiens
cugccaucuuggucaugagcuacugucugucccuccccaggacccgcggugggugcugcauguu

SEQ ID NO: 74242 - RNA, 64 nt, Homo Sapiens
uggcuuggguggcagagcccacuuguuucagggaccccaggaggugcccccuggcucccaggac

SEQ ID NO: 74243 - RNA, 64 nt, Homo Sapiens
ucaccaggagagccaaagacaggguugugccuuaccccaggagccaccccuguaccccccuugc

SEQ ID NO: 74244 - RNA, 64 nt, Homo Sapiens
ggcgccugccaccuccuccugcccucaguccccaccccaggagaaccaugguacugucuccaca

SEQ ID NO: 74245 - RNA, 64 nt, Homo Sapiens
ccugagaggggcuuauuggucccacccugcccuuccccaggaccgccagagcucggcagaguca

SEQ ID NO: 74246 - RNA, 64 nt, Homo Sapiens
ccaggucuggcucgcggcgguucgacgccgggacccccaggagacccggucauguggcgccugu

SEQ ID NO: 74247 - RNA, 64 nt, Homo Sapiens
ccugccccuccggggacaccuucccggccacgccccccaggacccccccucauccugccuccag

SEQ ID NO: 74248 - RNA, 64 nt, Homo Sapiens
cuaggcacuuucuuuccaugauugcccauaagacccccaggaagugggcaccccaggaaccgcc

SEQ ID NO: 74249 - RNA, 64 nt, Homo Sapiens
cgccauugcccauaagacccaggggaucugggcaccccaggaaccaaucugagccaugagaacg

SEQ ID NO: 74250 - RNA, 64 nt, Homo Sapiens
gccagucucaucuaauuucuacacauucccagcuccccaggaaaauuucagauauauuuuagua

SEQ ID NO: 74251 - RNA, 64 nt, Homo Sapiens
gagcuacugacuuguuaucaacaguccuuagaacccccaggagacuuuccauaggacauuucac

SEQ ID NO: 74252 - RNA, 64 nt, Homo Sapiens
cgcuggaggaagcugcucacuucucccuggaaguccccaggacagaccgaugccccugacagcc

SEQ ID NO: 74253 - RNA, 64 nt, Homo Sapiens
cgagaccggcuggaucgcggccggccccggggggccccaggaggcaggggagcccagcugucgg

SEQ ID NO: 74254 - RNA, 64 nt, Homo Sapiens
ggcuucgagaaagacaaacuggcuggcugcauucccccaggaugcuucauccggcuuagcuugg

SEQ ID NO: 74255 - RNA, 64 nt, Homo Sapiens
gugggguagacuggggggaucuggcugggccagaccccaggaagccauagacggugcggggggc

SEQ ID NO: 74256 - RNA, 64 nt, Homo Sapiens
gacccucuaucccaggaccuggggcugcaccuucccccaggaaugcacccacacugaaagauga

SEQ ID NO: 74257 - RNA, 64 nt, Homo Sapiens
acaggcuggacagaggagaacuccagcagcaaagccccaggagaacccacccgccccauccagg

SEQ ID NO: 74258 - RNA, 64 nt, Homo Sapiens
ugcggggaggagguuaugauucuuggcauccccaccccaggaagcuuuaugcaacacccaaaca

SEQ ID NO: 74259 - RNA, 64 nt, Homo Sapiens
ccaaagggcugcagucacccgaaggggacaaagaccccaggaggucccagcuccagccuggagg

SEQ ID NO: 74260 - RNA, 64 nt, Homo Sapiens
cuugggagcuuuaaagagcaggauagcucuuccuccccaggacuuggucuuuuuucugggucuu

SEQ ID NO: 74261 - RNA, 64 nt, Homo Sapiens
ccagugcucacacaaucagaccaaggaacaagacccccaggaaggaaacagauuuaagcaagac

SEQ ID NO: 74262 - RNA, 64 nt, Homo Sapiens
ugggagaggcaggaaggaucgggacaccuggagcccccaggagcgugaugcggccacaagccca

SEQ ID NO: 74263 - RNA, 64 nt, Homo Sapiens
ugggagaggcaggaaggaccgggaugccuggaguccccaggagcgugaugcugccccaagccca

SEQ ID NO: 74264 - RNA, 64 nt, Homo Sapiens
cuacaggggugucagccgcugaugcagguguggaccccaggaaccguuuggagaccaagcagca

SEQ ID NO: 74265 - RNA, 64 nt, Homo Sapiens
aagugagcguguagcguccugaggaauaaaauguuccgaugauguggaagcuccucugaugccu

SEQ ID NO: 74266 - RNA, 64 nt, Homo Sapiens
cuuucacacaggguuugcauuuaucagucuguuuuccgaugauguguacaugaaagaguacacc

SEQ ID NO: 74267 - RNA, 64 nt, Homo Sapiens
aaaaaguuucuaaaguguugcauauuuccuucuauccgaugagucaauuacaacagugagaaac

SEQ ID NO: 74268 - RNA, 64 nt, Homo Sapiens
aaaucuaagucauuugagaaccauuuaguuugcuuccgaugauuucuucucuauuguaagguuu

SEQ ID NO: 74269 - RNA, 64 nt, Homo Sapiens
uugggacuucaggaaaaaucaacuuuguuaggacuccgaugaguaaaaaaaaaaaaaacacuua

SEQ ID NO: 74270 - RNA, 64 nt, Homo Sapiens
gaaacucacuggagagcugaagggagcugccauguccgaugaaugccaacagacaggccacucu

SEQ ID NO: 74271 - RNA, 64 nt, Homo Sapiens
gcagccauuucuccuuuccugcagaggacgauccuccgaugaaaccagcugugggcagucagua

SEQ ID NO: 74272 - RNA, 64 nt, Homo Sapiens
guguguauuucuuaugcagucuuucccagggaacuccgaugaaguguuccaacaaaaugagcga

SEQ ID NO: 74273 - RNA, 64 nt, Homo Sapiens
acccggagaaggccgcugccccagccccguuccuuccgaugacagugcucuaggcugccccggg

SEQ ID NO: 74274 - RNA, 64 nt, Homo Sapiens
aguuacacaauuccuguuuucacaaaacuuuuauuccgaugaccacuguguaaucccugagcag

SEQ ID NO: 74275 - RNA, 64 nt, Homo Sapiens
uguuccaacaaaaugagcgacuuucccagggaacuccgaugaagguguguauuucuuaugcagu

SEQ ID NO: 74276 - RNA, 64 nt, Homo Sapiens
agccugugcuuggaaagaugguuaguugauaccguccgaugauucuucaguaaagauagauucc

SEQ ID NO: 74277 - RNA, 64 nt, Homo Sapiens
auguauauccugugguuuccccugccccucuguuuccgaugagguguacggaugagugaccugc

SEQ ID NO: 74278 - RNA, 64 nt, Homo Sapiens
caaggaaaauuaggguacucaaccuaaguucgguuccgaugaauucuuauccccugccccuucc

SEQ ID NO: 74279 - RNA, 64 nt, Homo Sapiens
uuucuacauuuacuuggccaauggauuucccuuauccgaugauuugacacuggguuagcucagc

SEQ ID NO: 74280 - RNA, 64 nt, Homo Sapiens
ugaucuuaguugucugcucaagacagcucuggcauccgaugaaggcuugguugcauucuuggac

SEQ ID NO: 74281 - RNA, 64 nt, Homo Sapiens
auucaccccaccccauuuucuuguuucugguccauccgaugagacggaugcucugaugcucuga

SEQ ID NO: 74282 - RNA, 64 nt, Homo Sapiens
cugacccuagaaugccaaggaacugagaaugggcuccgaugaaaaccuuccuuuucagauuccc

SEQ ID NO: 74283 - RNA, 64 nt, Homo Sapiens
ggagcaggagagagcugcugucagugagaaugacuccgaugagcugcucaucgaccuggagcgg

SEQ ID NO: 74284 - RNA, 64 nt, Homo Sapiens
cucagcccaccauuucuccuaggaaacagugcuuuccgaugagaucugaaugggacugaguccc

SEQ ID NO: 74285 - RNA, 64 nt, Homo Sapiens
uuuuuuuuuggaggggggagcaccaagaaagcaguccgaugagaacguuugcuuuacccaccgc

SEQ ID NO: 74286 - RNA, 64 nt, Homo Sapiens
gccugggccccgaagccaagcccuuuccagcuccuccgaugaaggcagccccugcccuggcaug

SEQ ID NO: 74287 - RNA, 64 nt, Homo Sapiens
cgcuugccuguuuccgcuugacccuuccuccagcuccgaugagaagaguauaaagcaucuuccu

SEQ ID NO: 74288 - RNA, 64 nt, Homo Sapiens
agugaaauuuaaaugugagaaucuccaaauuuguuccgaugacauuaaaauuaucucguuaaag

SEQ ID NO: 74289 - RNA, 64 nt, Homo Sapiens
gucuauugaaacugcaaagaucccggagcuggucuccgaugaaaaugccauuucuucguugcca

SEQ ID NO: 74290 - RNA, 64 nt, Homo Sapiens
ucguucuccacccaccagucagggacagcagccucccugucacucagcugagaaggccagcccu

SEQ ID NO: 74291 - RNA, 64 nt, Homo Sapiens
ugcagaucugugcucaucggagacugccccacggcccugucagagccgccacuccuauccccag

SEQ ID NO: 74292 - RNA, 64 nt, Homo Sapiens
gccccauacccgucacuacagccucaccucccaccccugucacuacggccucaccucccacccc

SEQ ID NO: 74293 - RNA, 64 nt, Homo Sapiens
cucccaccccugucacuacggccucaccucccaccccugucacuacagccucaccuccuacagc

SEQ ID NO: 74294 - RNA, 64 nt, Homo Sapiens
ccagcacuuugagaggccaagugcagugucucaccccugucaucuaguaaagcuggaaggccag

SEQ ID NO: 74295 - RNA, 64 nt, Homo Sapiens
guccuuacccccagccaccaguccccuccugaggcccugucagggaucccggccugaagcgcaa

SEQ ID NO: 74296 - RNA, 64 nt, Homo Sapiens
caaauuuuaacuuuuaauuuuuauuuuggcaaaacugucaaaugagaaaaaugauuuuaaaaac

SEQ ID NO: 74297 - RNA, 64 nt, Homo Sapiens
auuuaaccuggauagccacauuaaugaauuggugcugucaaaauauaguaauuuuuaaauuugu

SEQ ID NO: 74298 - RNA, 64 nt, Homo Sapiens
ccuucagucuaauaaccuugaagugguuuuugaacugucaaacuuugaccuguagaugcuguag

SEQ ID NO: 74299 - RNA, 64 nt, Homo Sapiens
ugauugcuacauacacuucucugaggaucaccugcugucaaauugccaucuacaguauuacagc

SEQ ID NO: 74300 - RNA, 64 nt, Homo Sapiens
ucaacuuagacuugacuuccaaaggguacuuucucugucaaaucccuuucuuuuggucacagag

SEQ ID NO: 74301 - RNA, 64 nt, Homo Sapiens
gggaguaggagaggggacaaccaaggcuccgugacugucaaacuacucucuuccaucucuuucc

SEQ ID NO: 74302 - RNA, 64 nt, Homo Sapiens
cggccuuuacuuccgccucccucagagcagcagccugucaaaacaccagauuacaacaaauuua

SEQ ID NO: 74303 - RNA, 64 nt, Homo Sapiens
gguagaagagguuaguuuuauagacaggaaggggcugucaaaggcagaaagaaaugaagaacaa

SEQ ID NO: 74304 - RNA, 64 nt, Homo Sapiens
gccacgaucucacuaaaggagcuuaauuauaauacugucaaauuaccccauguaccuuuauuga

SEQ ID NO: 74305 - RNA, 64 nt, Homo Sapiens
ccuuucauccuuuaauaguucacuguucaaagcacugucaaauuaaauuuggguaccauuuuau

SEQ ID NO: 74306 - RNA, 64 nt, Homo Sapiens
cuuuuccuuaaggugcacagguaaguacagcacacugucaaauuaaaaauauguuaccugcagu

SEQ ID NO: 74307 - RNA, 64 nt, Homo Sapiens
uuaagaaaacaaauguauaauuucugaagaauaucugucaaaauuuguggaaggcaguuuuaac

SEQ ID NO: 74308 - RNA, 64 nt, Homo Sapiens
uuaauccagcaaauauaugauuucguguuuuuuccugucaaacacucgaucagcuguucaucca

SEQ ID NO: 74309 - RNA, 64 nt, Homo Sapiens
aacaccugagaugaauugguuuaaaaguagcuugcugucaaagaauuaaaauauuuucacggaa

SEQ ID NO: 74310 - RNA, 64 nt, Homo Sapiens
acucuuauacccagaaaagaacauauuucagaaucugucaaacuuuuguguaucccacagauuc

SEQ ID NO: 74311 - RNA, 64 nt, Homo Sapiens
gcagcuauuugagggacuaagggauggagauauucugucaaaugaaucucuucaguauaccagu

SEQ ID NO: 74312 - RNA, 64 nt, Homo Sapiens
ugaagcugcuggggaagcuguggggugaagaaaacugucaaauagaaguaauugcagaagcagu

SEQ ID NO: 74313 - RNA, 64 nt, Homo Sapiens
uucacaaugccauacaggcugcccacuuauccaucugucaaaagaaaauucuucaaaaaacaca

SEQ ID NO: 74314 - RNA, 64 nt, Homo Sapiens
auaaaaugugucaauugucucugugauuuagaaacacuauuaauaacaucagagcaagguucua

SEQ ID NO: 74315 - RNA, 64 nt, Homo Sapiens
cuuaagcauuauagaauuucucuuaccagcaugacacuauuauauucaggaaacauggcacugc

SEQ ID NO: 74316 - RNA, 64 nt, Homo Sapiens
ucuugaguuuguuuucuaaaggagaccagaaauccacuauuacaaauguauuugaaaacauguu

SEQ ID NO: 74317 - RNA, 64 nt, Homo Sapiens
gucaaguuuuccauaaauucuacuucucauguggcacuauuauauaauaccuuugagaucuuug

SEQ ID NO: 74318 - RNA, 64 nt, Homo Sapiens
auuuaagcauagauucuucccacuuugcgggacacacuauuaauaaaagucacuauuauccuac

SEQ ID NO: 74319 - RNA, 64 nt, Homo Sapiens
cuaccacuuugcgggacacaaaaagaauaaaagucacuauuaucugagaaaauagagauaagua

SEQ ID NO: 74320 - RNA, 64 nt, Homo Sapiens
auuguuuuuaauuuuuaaaagauggcucuuguuccacuauuaacaaucuaaguccuuauuuucu

SEQ ID NO: 74321 - RNA, 64 nt, Homo Sapiens
aaaaaaaaaaauccccaaaaagccugacagacaccacuauuaaauuaacaugucuaggaguggg

SEQ ID NO: 74322 - RNA, 64 nt, Homo Sapiens
uugccuuuucuggacugucacaacaguucuccgucacuauuauuccuucuagcucuaauccugg

SEQ ID NO: 74323 - RNA, 64 nt, Homo Sapiens
uguuucuagucacuuuagaaaauaaagguaaaaacacuauuaccuuaggauaacaagaagagaa

SEQ ID NO: 74324 - RNA, 64 nt, Homo Sapiens
agauuguaauuagaugcaaaaauuaauauuaucacacuauuaucauccuuuaaaacaacuuuuc

SEQ ID NO: 74325 - RNA, 64 nt, Homo Sapiens
auauuaaguguaauuauuuuguauuugcacagcacacuauuaaaaaaacaaaacaaaaaacuau

SEQ ID NO: 74326 - RNA, 64 nt, Homo Sapiens
aaucucaacacuuugggaggccaaggugggaagaucacuugaucccaggaauucuagaucagcu

SEQ ID NO: 74327 - RNA, 64 nt, Homo Sapiens
ggucccagcuacucaggaggcugaggcaggaggaucacuugagcacaggaguuugaggcugcag

SEQ ID NO: 74328 - RNA, 64 nt, Homo Sapiens
aaucucagcacuuugggaggccaaggugggcggaucacuugaggucuggaguuugagaccagcc

SEQ ID NO: 74329 - RNA, 64 nt, Homo Sapiens
ggucccagcuacuugggaggcugaggugggaaaaucacuugaaccugggagggugagguugcag

SEQ ID NO: 74330 - RNA, 64 nt, Homo Sapiens
uguucagaagagaauaaaccaguguuuuuaccuuucacuugaaaaagaaguauaaaaacaacug

SEQ ID NO: 74331 - RNA, 64 nt, Homo Sapiens
aaucccaacaccuugggaggccaaggugggcggaucacuugaggucaggaguucaagaccaucu

SEQ ID NO: 74332 - RNA, 64 nt, Homo Sapiens
aacuccagcuacucgggagacugaaggacaagaaucacuugaaccugggaagccgagggacgag

SEQ ID NO: 74333 - RNA, 64 nt, Homo Sapiens
aaccccagcacuuugggaggccgaggcggguggaucacuugaggucaggaguucaagaccagcc

SEQ ID NO: 74334 - RNA, 64 nt, Homo Sapiens
aaucccagcugcuugggaggcugaggcaggagaaucacuugaacacaggaggcagagguugcag

SEQ ID NO: 74335 - RNA, 64 nt, Homo Sapiens
acaggaguuugaggcugcagcugacguggguggcucacuugagcggucccaguuacuugggagg

SEQ ID NO: 74336 - RNA, 64 nt, Homo Sapiens
ccaggaguuugggaccaggccugaggugggagcaucacuugagaaaucucggcacuuugggaga

SEQ ID NO: 74337 - RNA, 64 nt, Homo Sapiens
ccaggaggucaaggcugcagcugagguugcaggaucacuugagcggucccaucugcuugggagg

SEQ ID NO: 74338 - RNA, 64 nt, Homo Sapiens
ccaggaauuugagguuguagcugaggcagaaggaucacuugagcaaucccagcacuuuggaagg

SEQ ID NO: 74339 - RNA, 64 nt, Homo Sapiens
cucuuuuuauuuuacaagaguagucuacuuaaauucacuugauggccucuucuauuguucugau

SEQ ID NO: 74340 - RNA, 64 nt, Homo Sapiens
acaggaguuugagaccagccccgaggugggaggaucacuugagcaaucccaacacuuugggagg

SEQ ID NO: 74341 - RNA, 64 nt, Homo Sapiens
aaucccagcauuuugggaguccgaggugggcagaucacuugagcucaggaggucaagaucagcc

SEQ ID NO: 74342 - RNA, 64 nt, Homo Sapiens
uagucccacuacuuguggggcuaaggcaggaggaucacuugagccccggaggucgaggcuacag

SEQ ID NO: 74343 - RNA, 64 nt, Homo Sapiens
aauccuagcacuuugggaggcugaggaggaaggaucacuugagcccagaaguucgagacuagcc

SEQ ID NO: 74344 - RNA, 64 nt, Homo Sapiens
agucccagcauuccgggaggcugaggugggaggaucacuugagcccagggagguuggggcugca

SEQ ID NO: 74345 - RNA, 64 nt, Homo Sapiens
aaucccaacacuuuaggagaccaaggcgggcagaucacuugaggucagaaguuugagaccagcc

SEQ ID NO: 74346 - RNA, 64 nt, Homo Sapiens
agucccaacuacuagggaggcugaggcaggagaaucacuugaacccaggagguggagguugcag

SEQ ID NO: 74347 - RNA, 64 nt, Homo Sapiens
agucccagcucuaccccuucuuggccccuacaagucacuugacccaucuuaggcugagggugug

SEQ ID NO: 74348 - RNA, 64 nt, Homo Sapiens
aaucccagcacuuugggaggccaaaguggguggaucacuugaggaguucaagaccagccugguc

SEQ ID NO: 74349 - RNA, 64 nt, Homo Sapiens
aacuaaaaaaaaacaauaauauuaauauaugcauucacuugaaagccuuuuuaaaauuuuaugu

SEQ ID NO: 74350 - RNA, 64 nt, Homo Sapiens
ccagcuugggcaacauggcacuaaggcaggcagaucacuugagaaaucccagcgcuuugggagg

SEQ ID NO: 74351 - RNA, 64 nt, Homo Sapiens
caaggaguuugagaccagacgcacauugggaagaucacuugaggggcucaugccuguaauccca

SEQ ID NO: 74352 - RNA, 64 nt, Homo Sapiens
auccuuuaaaaauuccaaagucugcaaauuaggaucacuugagauccaaggguuuccaaacuug

SEQ ID NO: 74353 - RNA, 64 nt, Homo Sapiens
aaucccagcacuuugggaagccaaggugggcugaucacuugaucccaggaguuugagaccagcc

SEQ ID NO: 74354 - RNA, 64 nt, Homo Sapiens
uguagucucaacuauuggggaggcuaagguaggaucacuugaucccaggaggcggagguugcag

SEQ ID NO: 74355 - RNA, 64 nt, Homo Sapiens
aaucccagcacuuugugaggccaaggugggcggaucacuugaggccaggaauuugaaaccagcc

SEQ ID NO: 74356 - RNA, 64 nt, Homo Sapiens
uguaaucccagcacuuugggagguugcggguggaucacuugaggucaggaguucgagaccagcc

SEQ ID NO: 74357 - RNA, 64 nt, Homo Sapiens
uugggagguggagguugcagcugaggcacaagaaucacuugaacaaucucagcuacuugggagg

SEQ ID NO: 74358 - RNA, 64 nt, Homo Sapiens
ucaggcguuugagaccagccccaaggcaggcagaucacuugaggaaucccagcacuuugggagg

SEQ ID NO: 74359 - RNA, 64 nt, Homo Sapiens
ucaggaguucaagaccagccccaaggaggguggaucacuugagauaaucccagcacuuuggggg

SEQ ID NO: 74360 - RNA, 64 nt, Homo Sapiens
ccggaggcggagguugcggucugaggcggcagaaucacuugaacaucccagcuacccaggaagg

SEQ ID NO: 74361 - RNA, 64 nt, Homo Sapiens
auucugacccuuccuaaggguaaggacucuguauucacuugauugacauaagauuuaguccuaa

SEQ ID NO: 74362 - RNA, 64 nt, Homo Sapiens
ccaggagauagaggcugcagcugaggugggaggaucacuugagcagucacagguacuugggagg

SEQ ID NO: 74363 - RNA, 64 nt, Homo Sapiens
ccaggaguuugacaucaaccccaaggugggugggucacuugaacagaccucuuacuuugggagg

SEQ ID NO: 74364 - RNA, 64 nt, Homo Sapiens
ccgggagaugaagguugcagcugaggcaggagaaucacuugaacaaucccagcuacuugggagg

SEQ ID NO: 74365 - RNA, 64 nt, Homo Sapiens
ucaggaguucaagaccaauccugagguggguguaucacuugaggaaucccagcccuuugggagg

SEQ ID NO: 74366 - RNA, 64 nt, Homo Sapiens
ccaggagguugaggcugcagugauaagaggaggcucacuugagcgccugcggucccagcugcuc

SEQ ID NO: 74367 - RNA, 64 nt, Homo Sapiens
ucaggaguucaagaccagcucugaggcagguggaucacuugagcaaucccagcgcuuugggagg

SEQ ID NO: 74368 - RNA, 64 nt, Homo Sapiens
gaggucaggaguucgagacccugaggcgggugaaucacuugauuaaucccagcacuuugggagg

SEQ ID NO: 74369 - RNA, 64 nt, Homo Sapiens
ucugaaaauguacauguaugagaaaacuguauguucacuugaacauuuauuuacauacuuauaa

SEQ ID NO: 74370 - RNA, 64 nt, Homo Sapiens
ucaggaguucgagaccagccccgaggaggguggaucacuugaggaaucccagcacuuugcaagg

SEQ ID NO: 74371 - RNA, 64 nt, Homo Sapiens
gcuaggaugcuguuuaccccaucucucucuuauaucacuugaaugauauauuguaagugagagg

SEQ ID NO: 74372 - RNA, 64 nt, Homo Sapiens
aucuucaguaccucauuggaucacuuuucuuucaucacuugaguauucuagcagucauucuccu

SEQ ID NO: 74373 - RNA, 64 nt, Homo Sapiens
cugggagguggugguugcagccaaggcaggagaaucacuugaacaaucccagcuacgcaggagg

SEQ ID NO: 74374 - RNA, 64 nt, Homo Sapiens
ccaggagauugaggcugcaggaggcccuugaggaucacuugagccaugguggugggcuacucug

SEQ ID NO: 74375 - RNA, 64 nt, Homo Sapiens
ccaggaggccgaugcugcagcugaggcaguaagaucacuugagcaguuccagcuacucgggaag

SEQ ID NO: 74376 - RNA, 64 nt, Homo Sapiens
ccagaguuugagaccagccucugagguggaaggaucacuugaagaaucucagcacuuugggagg

SEQ ID NO: 74377 - RNA, 64 nt, Homo Sapiens
cugggagguggagguuguagcugagguggaagguucacuugagcaguaccugcuauugguaagg

SEQ ID NO: 74378 - RNA, 64 nt, Homo Sapiens
ccaggaguucgagagcagccccgaggggggcagaucacuugagcaaucccagcacuuugggagg

SEQ ID NO: 74379 - RNA, 64 nt, Homo Sapiens
cccacuguuauuaaagcaaaaaguauaauguucuucacuugaacuaaucaaauacaauagauua

SEQ ID NO: 74380 - RNA, 64 nt, Homo Sapiens
augacagagguuaaaauuuugucugcacuugaguucacuugaguuuacauuugaaaugugcaug

SEQ ID NO: 74381 - RNA, 64 nt, Homo Sapiens
aaucccagcacuuugggaggccaaggccagcggaucacuugaggucaggaguucgagaccagcc

SEQ ID NO: 74382 - RNA, 64 nt, Homo Sapiens
aaucccagcuacucgggaggcugaggcaggagaaucacuugaacccgggaggcggcgguugcag

SEQ ID NO: 74383 - RNA, 64 nt, Homo Sapiens
aauccgagcacuuugggaggcugaggcaggcggaucacuugaggucagcaguuugagacgagcc

SEQ ID NO: 74384 - RNA, 64 nt, Homo Sapiens
caggcgugguggcgggaggcugaggcaaggagaaucacuugaauacaagaggcagagguugcag

SEQ ID NO: 74385 - RNA, 64 nt, Homo Sapiens
augcauggcuauaaucccagccgaggugggaggaucacuugaguccagguucaagacuagccug

SEQ ID NO: 74386 - RNA, 64 nt, Homo Sapiens
agucccagcuacuugggaggcugaguugggaggaucacuugagccugggagguugaggcugcag

SEQ ID NO: 74387 - RNA, 64 nt, Homo Sapiens
ucaggagcucgagaccagcccugaggcaggcggaucacuugaggaaucccagcacuuugggagg

SEQ ID NO: 74388 - RNA, 64 nt, Homo Sapiens
ucaggagcucaagaccagccccaaggcgggcggaucacuugaggaaucccagcauuuugggagg

SEQ ID NO: 74389 - RNA, 64 nt, Homo Sapiens
aaucccaacacuuuaggaguccaaggcgggcggaucacuugaggucaggaguucaagaccagcu

SEQ ID NO: 74390 - RNA, 64 nt, Homo Sapiens
aaucccagcacuuugggaggcugaggcgggcagaucacuugaggccaggaguucaagaccagcc

SEQ ID NO: 74391 - RNA, 64 nt, Homo Sapiens
cuaggaguucggggcugcagacuugaauguaggaucacuugagucccaguuacuugggaggauc

SEQ ID NO: 74392 - RNA, 64 nt, Homo Sapiens
guaggaucacuugagucuagguuacuugggaggaucacuugaauuggcccaagucugaguccca

SEQ ID NO: 74393 - RNA, 64 nt, Homo Sapiens
ccagaagcucaaggcugcagcugagacgcaaggaucacuugagcggucccagcuacaggggagg

SEQ ID NO: 74394 - RNA, 64 nt, Homo Sapiens
ccaagaguuugagaccaacccugagaugggaggaucacuugaggaauccuagcacuuugggagg

SEQ ID NO: 74395 - RNA, 64 nt, Homo Sapiens
gucuuugggucuuugggaggccagggugggaggaucacuugagcucaggaguuugagaccagcc

SEQ ID NO: 74396 - RNA, 64 nt, Homo Sapiens
ccagcuacucgggaggcugagugaggcaggaggaucacuugagaccaggagguuguggcuguag

SEQ ID NO: 74397 - RNA, 64 nt, Homo Sapiens
ggguccagcuacucaggaggccaaggugggaggaucacuugagcccaggaguuuuagacuagcc

SEQ ID NO: 74398 - RNA, 64 nt, Homo Sapiens
ggucucagcuauucaggaggcugaggcaggagaaucacuugagaccaggaaguugaggcugcaa

SEQ ID NO: 74399 - RNA, 64 nt, Homo Sapiens
aaucccagcacuuucgguggccgggguggguggaucacuugaggccaggaguucaagaccaccc

SEQ ID NO: 74400 - RNA, 64 nt, Homo Sapiens
aaucccagcuacucaggaggcagaggcaggagaaucacuugaacccgggagguggaggcugcag

SEQ ID NO: 74401 - RNA, 64 nt, Homo Sapiens
aaucccagcacuuugggagggcgaggcuagcagaucacuugagguuaggaguucgauaccagcc

SEQ ID NO: 74402 - RNA, 64 nt, Homo Sapiens
aaucccagcuacugagggggcugaggcaugagaaucacuugaaccugggagacagagguugcaa

SEQ ID NO: 74403 - RNA, 64 nt, Homo Sapiens
ccaggaguucgaggcugcagcugaggugggagaaucacuugagcagucccagcugcuugggagg

SEQ ID NO: 74404 - RNA, 64 nt, Homo Sapiens
ucaggaguucgagaccagccgcugagugagaggaucacuugagcuaaucccagcauuuugggag

SEQ ID NO: 74405 - RNA, 64 nt, Homo Sapiens
uucuuuccuuggcccgcucccuuuuucuucugccucacuugaaucccccguaaacaccagacga

SEQ ID NO: 74406 - RNA, 64 nt, Homo Sapiens
aaucccagcuacuugggagacugaggcaagagaaucacuugaacccgggagguggagguggcag

SEQ ID NO: 74407 - RNA, 64 nt, Homo Sapiens
aguccccgcuacgcagguggcugaagcagaagaaucacuugaaccugagagguggagguugcag

SEQ ID NO: 74408 - RNA, 64 nt, Homo Sapiens
aaucccagcuacucaggaggcugaggcaggagaaucacuugaacccaggaggcagagguugcag

SEQ ID NO: 74409 - RNA, 64 nt, Homo Sapiens
ccgggagguugaggcugcagcugagccaggaggaucacuugagcagucccagcuacuagggagg

SEQ ID NO: 74410 - RNA, 64 nt, Homo Sapiens
cugggaggcagagguugcagcugagacacgagaaucacuugaacuaucccagcuacucaggaag

SEQ ID NO: 74411 - RNA, 64 nt, Homo Sapiens
ucaggaguucaagaccagcccacugagaggccgaucacuugagggcucacgccuguaaucccag

SEQ ID NO: 74412 - RNA, 64 nt, Homo Sapiens
ccaggaguucaagaccagccccaagguggguggaucacuugaggaaucccagcauuuugggagg

SEQ ID NO: 74413 - RNA, 64 nt, Homo Sapiens
guaaacacaguggcuggggaaacccuuccuagucucacuugauuccucaugacggaaaucacac

SEQ ID NO: 74414 - RNA, 64 nt, Homo Sapiens
uuccuauguggaaaugauuccagccaugguccccucacuugagcaugugaauauucucacggag

SEQ ID NO: 74415 - RNA, 64 nt, Homo Sapiens
aaucccagcacuuuaagaggccaaggcggauggaucacuugagcccaggaguucaacaccagcc

SEQ ID NO: 74416 - RNA, 64 nt, Homo Sapiens
agucccagccacucaagaggcacaggcgggaggaucacuugagccugggagguugugguugcag

SEQ ID NO: 74417 - RNA, 64 nt, Homo Sapiens
aaugcucgcacuuugugaggccaggguggguggaucacuugaggucaggaguucaagacuagcc

SEQ ID NO: 74418 - RNA, 64 nt, Homo Sapiens
aaucccagcuacucgggaggcugaggcaagagaaucacuugaacccaggaggcggagguugcag

SEQ ID NO: 74419 - RNA, 64 nt, Homo Sapiens
aaucccagcaguuugcgaggccgaggcagguggaucacuugagcccaggaguuugaaaccagcc

SEQ ID NO: 74420 - RNA, 64 nt, Homo Sapiens
aguccuagcuacucaggaggcugaggugggaggaucacuugagcuugggaggcggugguugcag

SEQ ID NO: 74421 - RNA, 64 nt, Homo Sapiens
ccaggaagcagagguugcagcugaggcaagugaaucacuugaacaaucccagcuacuugggagg

SEQ ID NO: 74422 - RNA, 64 nt, Homo Sapiens
ucaggaguuugagaccaccccugagguggguggaucacuugaggaaucccagcauuuugagagg

SEQ ID NO: 74423 - RNA, 64 nt, Homo Sapiens
ucaggaguucgagaccagcccugagaugggcagaucacuugaggaaccccagcacuuugggagg

SEQ ID NO: 74424 - RNA, 64 nt, Homo Sapiens
ucaggaauucgagaccagccccaaggagggaggaucacuugaacaaucccagcacuuugggaag

SEQ ID NO: 74425 - RNA, 64 nt, Homo Sapiens
ccaggaggcggaguuuguggcuaaggcaggagaaucacuugaauaaucccagcuacuugggagg

SEQ ID NO: 74426 - RNA, 64 nt, Homo Sapiens
ccaagaggcagaguuugcagcugaggugggaggaucacuugaaccacacaccuguagucccagg

SEQ ID NO: 74427 - RNA, 64 nt, Homo Sapiens
ccaggaguuugagaccaaccacaagguggguggaucacuugaggaaucccagcacuuugggagg

SEQ ID NO: 74428 - RNA, 64 nt, Homo Sapiens
ccaggaguugugaggucaacuggaagggggaggaucacuugagaaaucccaguacuuuaggaca

SEQ ID NO: 74429 - RNA, 64 nt, Homo Sapiens
ucauaaccuuaaagugacacgauuuguacaaaaaucacuugacgcaaucaucacaguaauuauu

SEQ ID NO: 74430 - RNA, 64 nt, Homo Sapiens
cuaugaggucgaggcuacagcugaggugggaggaucacuugagcuccaucaccugugguuccag

SEQ ID NO: 74431 - RNA, 64 nt, Homo Sapiens
ucaggagcuugagaccagcccugaggcagguggaucacuugagcaaucucagaacuuugggagg

SEQ ID NO: 74432 - RNA, 64 nt, Homo Sapiens
agucccagcuacucgggaggcugaagcagaaggaucacuugagucugagaauucgguguuguuu

SEQ ID NO: 74433 - RNA, 64 nt, Homo Sapiens
uaaucccagcuacagggaggcugaggcaggagaaucacuugaaccugggaggcagagguuucag

SEQ ID NO: 74434 - RNA, 64 nt, Homo Sapiens
guguccuccgcacagccggucagaacugugugacucacuugaggcaggaccgagagugacaucc

SEQ ID NO: 74435 - RNA, 64 nt, Homo Sapiens
aaucccagcacuuugggaggcugaggaggguggaucacuugaggccaggaauucgagaccagcc

SEQ ID NO: 74436 - RNA, 51 nt, Homo Sapiens
cacuagagaagagucugugagucacuugaggaggcgagucuagcagauucu

SEQ ID NO: 74437 - RNA, 64 nt, Homo Sapiens
aaucccagcuauucggaaggcugaggcaggagaaucacuugaacccaggaggcggagguugcgg

SEQ ID NO: 74438 - RNA, 64 nt, Homo Sapiens
ugauagaggggccugugcaaggugcugucccaugucacuugaaccgcguugcccgucccugcgu

SEQ ID NO: 74439 - RNA, 64 nt, Homo Sapiens
ccaggaggcggagguugcagcugaggcacgagaaucacuugaacaaucccagcuacucgggagg

SEQ ID NO: 74440 - RNA, 64 nt, Homo Sapiens
cugggacacggagguugcagcuaaggcaggagaaucacuugaacaaucuuagcuacucaggagg

SEQ ID NO: 74441 - RNA, 64 nt, Homo Sapiens
ccacacacacgcucaacccccagcacuugcauggucacuugagcgggucuuaggaaggagguga

SEQ ID NO: 74442 - RNA, 64 nt, Homo Sapiens
ucaggaguucgaagucagcccugagacaggcagaucacuugaggaaucccagcacuuugggagg

SEQ ID NO: 74443 - RNA, 64 nt, Homo Sapiens
ucaggaguucaagaccagccccgaggcgggcagaucacuugaggaaucccaguacuuugggagg

SEQ ID NO: 74444 - RNA, 64 nt, Homo Sapiens
uuaggaguuugagaacuggccugaggcgggcagaucacuugaggaacccuagcacuuugggagg

SEQ ID NO: 74445 - RNA, 64 nt, Homo Sapiens
ucaggaguuuaagaccagccccaaggugggcggaucacuugagcuaauccuacacuuugggagg

SEQ ID NO: 74446 - RNA, 64 nt, Homo Sapiens
ccgggaggcagagguugcggcugaggcaggagaaucacuugaacaaucccaguuacucgggagg

SEQ ID NO: 74447 - RNA, 64 nt, Homo Sapiens
ccaggaguuugagaccagccccgaaguggguggaucacuugaggaaucccagcacuuugggagg

SEQ ID NO: 74448 - RNA, 64 nt, Homo Sapiens
guacaccaucaacaggaauguaucauuuugucaucaauggcagcauuccagaggaucaugaaga

SEQ ID NO: 74449 - RNA, 64 nt, Homo Sapiens
auggaguuucacucuuguugcccaggcuggagugcaauggcacaaucucggcucacugcaaccu

SEQ ID NO: 74450 - RNA, 64 nt, Homo Sapiens
gcuuugacaucgaguacaaaaauaaucaaagaagcaauggcaaaggguaauguauagagugcuu

SEQ ID NO: 74451 - RNA, 64 nt, Homo Sapiens
uuacaccugcagggagaaacucuggaaaccuugacaauggcaacagugugucucuucagcgcac

SEQ ID NO: 74452 - RNA, 64 nt, Homo Sapiens
ucuucucggacuccccugggaaugcccugucagccaauggcagcgaccaaugacagagccugaa

SEQ ID NO: 74453 - RNA, 64 nt, Homo Sapiens
acucuucaggcuggggugugaaccacucccuggccaauggcaucacagccaacggcuaugacaa

SEQ ID NO: 74454 - RNA, 64 nt, Homo Sapiens
aucuuggcucacugcaaccucccaggcuggggcgcaauggcacggacagggucuugcucuguca

SEQ ID NO: 74455 - RNA, 64 nt, Homo Sapiens
ucuguccaaccuccuuucuggauuaaacauggugcaauggcaccgaaaucccuuggccuccaga

SEQ ID NO: 74456 - RNA, 64 nt, Homo Sapiens
cacagagucuugcucuguugcccaggcuggagugcaauggcaugaucucggcucaccgcaaccu

SEQ ID NO: 74457 - RNA, 64 nt, Homo Sapiens
agucccuucuuccaagugguuuuuccaaaucgcacaauggcaaagccaaacagaggaagaaaca

SEQ ID NO: 74458 - RNA, 64 nt, Homo Sapiens
gucuuggcucacugcaaccuccaggcugggagggcaauggcacccggaguuucgcucuuguugc

SEQ ID NO: 74459 - RNA, 64 nt, Homo Sapiens
uuuuuagucaagguacacagaaguuuggcaauuucaauggcauauaauagauaccaaauuaggg

SEQ ID NO: 74460 - RNA, 64 nt, Homo Sapiens
uuuucuuaaauccaaguuggccguuuuauuaguauguuucaaauguguauuaccaaugugggug

SEQ ID NO: 74461 - RNA, 64 nt, Homo Sapiens
cacaauuuuuggaauaugucauaauuuuuuucccuguuucaaauguguucagaggaaauagaau

SEQ ID NO: 74462 - RNA, 64 nt, Homo Sapiens
uuugauaaauauccucucaguguuuuaucuuccauguuucaacaacuauugaaauaugaaaugc

SEQ ID NO: 74463 - RNA, 64 nt, Homo Sapiens
ucuuuaggcagccuucugaggagaaaagcaacccuguuucaaauccacugccaauucagcuccu

SEQ ID NO: 74464 - RNA, 64 nt, Homo Sapiens
aucccauucaggcuacaagugacgacaaagauucuguuucaaauauagccacagaaauaaagga

SEQ ID NO: 74465 - RNA, 64 nt, Homo Sapiens
aucccauucaggcuacaagugacgagaaagauucuguuucaaauauagccacagaaauaaagaa

SEQ ID NO: 74466 - RNA, 64 nt, Homo Sapiens
agucaguucugugaucugggucucuaaucugugcuguuucaaaguucucuguggcaaagcagca

SEQ ID NO: 74467 - RNA, 64 nt, Homo Sapiens
agaacugaacugagguucauggauuuuccaggacuguuucaaacaugcccauuacuaacggcaa

SEQ ID NO: 74468 - RNA, 64 nt, Homo Sapiens
acaacaggccagugcagacuuugcuuccuccuuuuguuucaaaggaccuuaucuacccauuaac

SEQ ID NO: 74469 - RNA, 64 nt, Homo Sapiens
guuagagacaccucagucgggccacaacugucucuguuucaacuuuaagcccacacacucugua

SEQ ID NO: 74470 - RNA, 64 nt, Homo Sapiens
gcccucauuaacaagaauaacauuuaaaggagauuguuucaaaauauuuuugcaaauugagaua

SEQ ID NO: 74471 - RNA, 64 nt, Homo Sapiens
uuauaauuaaauguaaaauugaaaauucauuugcuguuucaaagugugauaucuuucacaauag

SEQ ID NO: 74472 - RNA, 64 nt, Homo Sapiens
gaaguugguuucugguccaaauaacugguagagcuguuucaaagccuaacagcauauugcucuu

SEQ ID NO: 74473 - RNA, 64 nt, Homo Sapiens
caauuuuggaucagcugccuuuauguuucugagguguuucaacauuauagaguauugaugucau

SEQ ID NO: 74474 - RNA, 64 nt, Homo Sapiens
auagucuucauuuuuaaaaaacugaagacaaacuuguuucaaugcuccgucaacauguccucau

SEQ ID NO: 74475 - RNA, 64 nt, Homo Sapiens
gaguaucucucuaguagaauacaaucuaaaaguguguuucaauugagagugggcuugcaagaac

SEQ ID NO: 74476 - RNA, 64 nt, Homo Sapiens
aaugaaugcagagggagcuuggucaaacugcuuuuguuucaacugcaggcaggggagcaaaagg

SEQ ID NO: 74477 - RNA, 64 nt, Homo Sapiens
uuccuacucauagccaaccaauaaauucaguaucuguuucaaauauuuuagaaguguaguuugu

SEQ ID NO: 74478 - RNA, 64 nt, Homo Sapiens
guauuauuugccuucauaauagaacccaagagucuguuucaauuuaugaauucaguauuugcac

SEQ ID NO: 74479 - RNA, 64 nt, Homo Sapiens
aacaaaauuuaguauucaagcugagugagaauacuguuucaaugagcaugucccuaagauaaac

SEQ ID NO: 74480 - RNA, 64 nt, Homo Sapiens
ccaugguuuagauugcaaguguacuuuauaccauuguuucaacuucaaccuuuauuuuuguaua

SEQ ID NO: 74481 - RNA, 64 nt, Homo Sapiens
agaaguuacuagcacugacacacugauuuugaaauguuucaaaaugaguagauaugauuagauc

SEQ ID NO: 74482 - RNA, 64 nt, Homo Sapiens
ugacccucccacccccugcuucgcaggcacccacuguuucaacucuggcuaauagggagacccu

SEQ ID NO: 74483 - RNA, 64 nt, Homo Sapiens
uuaguuugcauucaccuuuaaagucacauuuccauguuucaacacucaccuucccucuuuuuua

SEQ ID NO: 74484 - RNA, 64 nt, Homo Sapiens
acccagccugcuucuuguccagcauugauccuucuguuucaacaacuccuccacugggcagagc

SEQ ID NO: 74485 - RNA, 64 nt, Homo Sapiens
aaguggcuuuuggggccccagguugagcucuggauguuucaagccaaggcucggcuauucccgc

SEQ ID NO: 74486 - RNA, 64 nt, Homo Sapiens
ccauugggcccucgucugccucuccaggauuguauguuucaagccuuguccuguguuccuuugu

SEQ ID NO: 74487 - RNA, 64 nt, Homo Sapiens
augaguggcggcauguugguagugccggacuuccuguuucaaguuuucuggggccucgcuaauu

SEQ ID NO: 74488 - RNA, 64 nt, Homo Sapiens
gaaaauagauccccuuaaagggcuuuccagcaauuguuucaaagccuauuaccuuucugaggcu

SEQ ID NO: 74489 - RNA, 64 nt, Homo Sapiens
uacaggaaaaacauuccuauuauggaaaauuuuuuguuucaaaauauaauugaauggauauucc

SEQ ID NO: 74490 - RNA, 64 nt, Homo Sapiens
aggaaaaaaaaaucucacaaguucuuuuggaacuuguuucaagccaaaaacucucaagaaagca

SEQ ID NO: 74491 - RNA, 64 nt, Homo Sapiens
ugcuagcauguacuguaugggaggaugauccagauguuucaaagagaauuucucuuaguuuagu

SEQ ID NO: 74492 - RNA, 64 nt, Homo Sapiens
gcauaaugaaauaaaauuuuauuuuuauuugagcuguuucaauauaucuuugauuauucuuuua

SEQ ID NO: 74493 - RNA, 64 nt, Homo Sapiens
auacugugcggaaacacaccaaacacaaugugcauguuucaauggucauuccacuugugaaaga

SEQ ID NO: 74494 - RNA, 64 nt, Homo Sapiens
cauccaacuguuuguuauaagcuaaauacuguaauguuucaaaauucaguucauagcguagacu

SEQ ID NO: 74495 - RNA, 64 nt, Homo Sapiens
gaauuguuuguuuucucauuacugugucaaagaguguuucaaaaaaaucuaaaaauaguuaagc

SEQ ID NO: 74496 - RNA, 64 nt, Homo Sapiens
guuuuauucaaaccacaaauuaauacuaauggaauguuucaaaguauucucauugugagaauuu

SEQ ID NO: 74497 - RNA, 64 nt, Homo Sapiens
gaacuacaacuugucuuccuuauacaaugaaauuuguuucaaguacuucugacuauauuaacaa

SEQ ID NO: 74498 - RNA, 64 nt, Homo Sapiens
auauuaggcaaaauuuaacuaucuuuucacuuaguguuucaaacuuaaagauuuuuaaaaguuu

SEQ ID NO: 74499 - RNA, 64 nt, Homo Sapiens
acuuagagcagugaagacuauuugcugcugcccauguuucaaauugaacaaacaaugaaaacuc

SEQ ID NO: 74500 - RNA, 61 nt, Homo Sapiens
agguguccaacuggcccuauaucagccuuuuuguuucaaugagaaagaguacuucaucuag

SEQ ID NO: 74501 - RNA, 64 nt, Homo Sapiens
gaugaccguguacaauaccguuaaaaaagaaaucuguuucaacacuuuuuuaaacuaagaucug

SEQ ID NO: 74502 - RNA, 64 nt, Homo Sapiens
ggauugcuuuuuccucucauuuauuugagaauuuuguuucaaagcaaaccacugugaacauuuu

SEQ ID NO: 74503 - RNA, 64 nt, Homo Sapiens
ucuauuuaacugcaauugagaaaggaaauuucccuguuucaaaaagggaccuaggugcaagugc

SEQ ID NO: 74504 - RNA, 64 nt, Homo Sapiens
uauguggcacucgccccccauuaugagaucuuguuguuucaaaggguguccuuaagauaaugag

SEQ ID NO: 74505 - RNA, 64 nt, Homo Sapiens
ucuuugaauacuugcacauugcuaaauggagaaauguuucaauuuccucucacuuggccuugca

SEQ ID NO: 74506 - RNA, 64 nt, Homo Sapiens
gauuggaucuuugaaagcuuaugguugugaagacuguuucaaauaauaacugccuaggauacug

SEQ ID NO: 74507 - RNA, 64 nt, Homo Sapiens
ucagaacagguuuuuuuguuaguguguguuuguguguuucaagguguguguguaugagagagag

SEQ ID NO: 74508 - RNA, 64 nt, Homo Sapiens
uucuuaucuggaaauaauauacuuuacaaaccuuuguuucaacuuaaacugaauaguucaggag

SEQ ID NO: 74509 - RNA, 64 nt, Homo Sapiens
ggacuguuacagacugaaagugauuuuggaacuguguuucaaauaugacauaaccaauuuguaa

SEQ ID NO: 74510 - RNA, 64 nt, Homo Sapiens
cagacccacccagagcccucugcuuuacguggccuguuucaacaugguuugaccuuuagagagu

SEQ ID NO: 74511 - RNA, 64 nt, Homo Sapiens
aagucaugugcauuuccacgccacugaggagcuuuguuucaaccaaaaaccuggaugucacugg

SEQ ID NO: 74512 - RNA, 64 nt, Homo Sapiens
aaugugguugaagaaagugggccaggugguugaagaaagccaugugggagcucagcaaauccca

SEQ ID NO: 74513 - RNA, 64 nt, Homo Sapiens
aggcuggugggcuuucaaauugguacuuccagaggaaagccaagcugcuucuguugugagcgaa

SEQ ID NO: 74514 - RNA, 64 nt, Homo Sapiens
gaguuaagugaccucagguaaaagccacagaguugaaagccacaacacgaaagccacagaguug

SEQ ID NO: 74515 - RNA, 64 nt, Homo Sapiens
gaguugaaagccacagaguuaaagccacagaguugaaagccacacuauaccgccaucuuacacg

SEQ ID NO: 74516 - RNA, 64 nt, Homo Sapiens
gaguugaaagccacagaguuccgccaucuuacacgaaagccacauugguguccauggcccuaua

SEQ ID NO: 74517 - RNA, 64 nt, Homo Sapiens
uaacauagcuauaauuacuaauuuaaaugaaauagaaagccauauucacauuuuauuuggagau

SEQ ID NO: 74518 - RNA, 64 nt, Homo Sapiens
aggauucagcaauuuaagcaaggaaguugagaaagaaagccacaccaagacguuugaggccagu

SEQ ID NO: 74519 - RNA, 64 nt, Homo Sapiens
acuaagucagaggucuggucccucauguuuaggugaaagccagagaaugacagcuguagucaua

SEQ ID NO: 74520 - RNA, 64 nt, Homo Sapiens
augauucaucuucaguaauuuuuagaagcaagaagaaagccauuguguccucuacaauuaacaa

SEQ ID NO: 74521 - RNA, 64 nt, Homo Sapiens
gccccugccugcagguuagagaggcaggccgcgggaaagccaggcaagggaggaagccaggggc

SEQ ID NO: 74522 - RNA, 64 nt, Homo Sapiens
ggagcuccaauucgugaccccagggaauggccuugaaagccauuugugggggaugaagcccagg

SEQ ID NO: 74523 - RNA, 64 nt, Homo Sapiens
gagauucucauaacuugagaaaaguuuagccccugaaagccaugaagagcaaaagaauggcaga

SEQ ID NO: 74524 - RNA, 64 nt, Homo Sapiens
gagucacugagaccaaggcuaggcuagguggguugaaagccaagaaaggccuccuggcugucug

SEQ ID NO: 74525 - RNA, 64 nt, Homo Sapiens
ccauuucugucuccagaguuuacucauugcgucggaaagccaaggaggacgaauagaguuuaau

SEQ ID NO: 74526 - RNA, 64 nt, Homo Sapiens
uuuuccugaauuaugauggugauuugaccguaaugaaagccacacucuucgggagacauguuga

SEQ ID NO: 74527 - RNA, 64 nt, Homo Sapiens
ugagaccacuucauagcaaggugaccaagguuuggaaagccaccuacccuuuggaaacccuggg

SEQ ID NO: 74528 - RNA, 64 nt, Homo Sapiens
ccaccaguagugcugguugcaccugcugcaccaggaaagccacugucuccacggagcccucggg

SEQ ID NO: 74529 - RNA, 64 nt, Homo Sapiens
auaaagcuugggguuuuuuuuuuuccuuuguuaagaaagccaaccaaucacaaugauauaguca

SEQ ID NO: 74530 - RNA, 64 nt, Homo Sapiens
uauagaauuucaggguuaggguuuaaagaaaggagaaagccauuggaaaaaugaugggcuccau

SEQ ID NO: 74531 - RNA, 64 nt, Homo Sapiens
cacugcuuagcuaucauaguuuuauauuauaauagaaagccagcaucuuuuuauuucugauagu

SEQ ID NO: 74532 - RNA, 64 nt, Homo Sapiens
accuguuuguacuguucuauacucagugguugaugaaagccaaagagaaucaaagauggauuaa

SEQ ID NO: 74533 - RNA, 64 nt, Homo Sapiens
ugcccugaacccagcagacacuuguaugccuugggaaagccaguaggacuuucugccaacuuuu

SEQ ID NO: 74534 - RNA, 54 nt, Homo Sapiens
agguaagagccagcugauaugagagaaagccaggaggaauggguguguuuguag

SEQ ID NO: 74535 - RNA, 64 nt, Homo Sapiens
gguucugaagaggcgaauuuagucagguggcacugaaagccaugcaggugacuuccaaagaaug

SEQ ID NO: 74536 - RNA, 64 nt, Homo Sapiens
cuuuuaaauuuuuugguuuuccuggauaugugcugaaagccaaaucugaaggccauuacagugg

SEQ ID NO: 74537 - RNA, 64 nt, Homo Sapiens
guggaggcugagguggcugcgcuccuccccccaggaaagccaagcagcccggcuggccgccgcc

SEQ ID NO: 74538 - RNA, 64 nt, Homo Sapiens
uuccagccugagugcuggcccuacuucgaaccaggaaagccagagcuagggguccugaaccagg

SEQ ID NO: 74539 - RNA, 64 nt, Homo Sapiens
ggacuagagccaaaaacuuguacauaaaagugcagaaagccagauccaagaugaacuugaagau

SEQ ID NO: 74540 - RNA, 64 nt, Homo Sapiens
uaccucaguggcuaccaaccauauuucaccaguggaaagccagugaccuaccaacgaccauacc

SEQ ID NO: 74541 - RNA, 64 nt, Homo Sapiens
ggacuagauccaaagacuuguacaucaaaguacagaaagccagauccaagaugaacuugaagau

SEQ ID NO: 74542 - RNA, 64 nt, Homo Sapiens
ggacuagaggccaagacuuguacaucaaugugcagaaagccagaaccaaaaugagugugcagau

SEQ ID NO: 74543 - RNA, 64 nt, Homo Sapiens
agaagaaauagaacagcugaagucucaaaucauugucuggaauuuuccucaccuuggcuagcuc

SEQ ID NO: 74544 - RNA, 64 nt, Homo Sapiens
ccauucccaccccuuugcuuugccauuugcaagagucuggaauugucaggucucagcuucgaaa

SEQ ID NO: 74545 - RNA, 64 nt, Homo Sapiens
uuguaucgcaaagcuauaugugaaacaaccuauggucuggaaauaagccuuuuaauacuaagua

SEQ ID NO: 74546 - RNA, 64 nt, Homo Sapiens
gcuuuggucccacagccuuggauuagucaaggaagucuggaaaauaauuugguauugcacaggu

SEQ ID NO: 74547 - RNA, 64 nt, Homo Sapiens
acuaaccgagugcugaauagcaaugggcuucagugucuggaauggcuuucugcaacucuuuuug

SEQ ID NO: 74548 - RNA, 64 nt, Homo Sapiens
aaccugcucaucguucagcuuccaaaauucugaagucuggaaguuuuuccuucaagaaaagaaa

SEQ ID NO: 74549 - RNA, 64 nt, Homo Sapiens
agggguucucuguguucugccccuguaauucuaggucuggaaccuuuauuuguucuagggcagc

SEQ ID NO: 74550 - RNA, 64 nt, Homo Sapiens
gucugugaccuggucuucccaucccugcauuccugucuggaaccagugaaugcauuagaaccuu

SEQ ID NO: 74551 - RNA, 64 nt, Homo Sapiens
agggacucuugacagccaccgcuuucacacccuggucuggaauaaggaaacaucggagggagaa

SEQ ID NO: 74552 - RNA, 64 nt, Homo Sapiens
gccgagauugcagccucugcccggccgccaccccgucuggaaagugaggagcgccucugcccgg

SEQ ID NO: 74553 - RNA, 64 nt, Homo Sapiens
cagaguugcugauuccacccagaaagacaaacuugucuggaaacuucccccaggaugggcuucg

SEQ ID NO: 74554 - RNA, 64 nt, Homo Sapiens
cgacaauguuacaaguggaacuuagcagggccuggucuggaagucacaagcgccagggccaggg

SEQ ID NO: 74555 - RNA, 64 nt, Homo Sapiens
acaggcagggaaauguuaggaggucagccuccagcaggccuagucucaggcucuaaaguacuga

SEQ ID NO: 74556 - RNA, 64 nt, Homo Sapiens
cuugucaucauggacuccaacaggguuagagggacaggccuaaucaacugaaacuccucggaga

SEQ ID NO: 74557 - RNA, 64 nt, Homo Sapiens
ggggcucuggaaggaugggccgucucaacagccccaggccuaugagcacaguggggacaucucc

SEQ ID NO: 74558 - RNA, 64 nt, Homo Sapiens
gacguuucucuccaaggccccgcccugcugucuccaggccuauacagccugccucucccgccca

SEQ ID NO: 74559 - RNA, 64 nt, Homo Sapiens
accgucccaacugcuaauucaaagacauggaacccaggccuacacucucugucacaaugccuca

SEQ ID NO: 74560 - RNA, 64 nt, Homo Sapiens
aucuccccagcagaugcaaaggaggaagcaggaccaggccuaggugucagcccaccugaggcug

SEQ ID NO: 74561 - RNA, 64 nt, Homo Sapiens; identical to SEQ ID NO: 74543

SEQ ID NO: 74562 - RNA, 64 nt, Homo Sapiens; identical to SEQ ID NO: 74544

SEQ ID NO: 74563 - RNA, 64 nt, Homo Sapiens; identical to SEQ ID NO: 74545

SEQ ID NO: 74564 - RNA, 64 nt, Homo Sapiens; identical to SEQ ID NO: 74546

SEQ ID NO: 74565 - RNA, 64 nt, Homo Sapiens; identical to SEQ ID NO: 74547

SEQ ID NO: 74566 - RNA, 64 nt, Homo Sapiens; identical to SEQ ID NO: 74548

SEQ ID NO: 74567 - RNA, 64 nt, Homo Sapiens; identical to SEQ ID NO: 74549

SEQ ID NO: 74568 - RNA, 64 nt, Homo Sapiens; identical to SEQ ID NO: 74550

SEQ ID NO: 74569 - RNA, 64 nt, Homo Sapiens; identical to SEQ ID NO: 74551

SEQ ID NO: 74570 - RNA, 64 nt, Homo Sapiens; identical to SEQ ID NO: 74552

SEQ ID NO: 74571 - RNA, 64 nt, Homo Sapiens; identical to SEQ ID NO: 74553

SEQ ID NO: 74572 - RNA, 64 nt, Homo Sapiens; identical to SEQ ID NO: 74554

SEQ ID NO: 74573 - RNA, 64 nt, Homo Sapiens; identical to SEQ ID NO: 74555

SEQ ID NO: 74574 - RNA, 64 nt, Homo Sapiens; identical to SEQ ID NO: 74556

SEQ ID NO: 74575 - RNA, 64 nt, Homo Sapiens; identical to SEQ ID NO: 74557

SEQ ID NO: 74576 - RNA, 64 nt, Homo Sapiens; identical to SEQ ID NO: 74558

SEQ ID NO: 74577 - RNA, 64 nt, Homo Sapiens; identical to SEQ ID NO: 74559

SEQ ID NO: 74578 - RNA, 64 nt, Homo Sapiens; identical to SEQ ID NO: 74560

SEQ ID NO: 74579 - RNA, 64 nt, Homo Sapiens
agcagauauggaccccucugcacaggccucccgaaguccugaagcugggcggcagugagguguc

SEQ ID NO: 74580 - RNA, 64 nt, Homo Sapiens
cccucccauccucucacccacuggaccccguaggaguccugaccccagaugcccaagucuuggg

SEQ ID NO: 74581 - RNA, 58 nt, Homo Sapiens
guccagugccugaacccuuagagaugucccaguucaucgcaaagaaguauucagaaaa

SEQ ID NO: 74582 - RNA, 58 nt, Homo Sapiens
gacagaauuauaguguuuggcccccggcccaguucaggugcugucuugccagugccgg

SEQ ID NO: 74583 - RNA, 58 nt, Homo Sapiens
agggcaugcuguaauuucacacaauuuuccaguucaaaaauggagaauacuucgccua

SEQ ID NO: 74584 - RNA, 58 nt, Homo Sapiens
aucuuggcucacugcgaccuccaccuccccaguucaagcgauucuccugccucagccu

SEQ ID NO: 74585 - RNA, 58 nt, Homo Sapiens
gugcuguuucuaucacuauuguaauuugccaguucauuuuucaugcugaaaguaauau

SEQ ID NO: 74586 - RNA, 58 nt, Homo Sapiens
uauuuccuauaauaggaugcugccuaacccaguucaucucuauguccuguucacugaa

SEQ ID NO: 74587 - RNA, 58 nt, Homo Sapiens
agagccugugauaguuacuguggagcagccaguucauggggucccccuuggggcccca

SEQ ID NO: 74588 - RNA, 58 nt, Homo Sapiens
auuaacccaagugaaccaaccaaagucaccaguucagaagugcuaagcuaauaggagu

SEQ ID NO: 74589 - RNA, 58 nt, Homo Sapiens
agcauggcaugcagcacacacggcugcuccaguucauggccucccaggggugcugggg

SEQ ID NO: 74590 - RNA, 58 nt, Homo Sapiens
aacugcacccugguccucuccccaguccccaguucacccuccaucccucaccuuccuc

SEQ ID NO: 74591 - RNA, 58 nt, Homo Sapiens
augggaaggaccuugguugggacucuuuccaguucacuuggggcagagggaauuuaau

SEQ ID NO: 74592 - RNA, 58 nt, Homo Sapiens
gugcugggcaggacaaagcaucagcuguccaguucaggccucuccucuuucccuggug

SEQ ID NO: 74593 - RNA, 64 nt, Homo Sapiens
aaccaugcagcaggugcuugaguuucaccuuucuccaguccagcagaauuacauuuugaugacc

SEQ ID NO: 74594 - RNA, 64 nt, Homo Sapiens
cuuuuuuuaaaaaagaauuugauugacaauauauccaguccaauauaaguaugaaggauucucu

SEQ ID NO: 74595 - RNA, 64 nt, Homo Sapiens
uuuagaugccuucuuuucccucccuaauuuguagccaguccaaccuuucauuccuuggaggauu

SEQ ID NO: 74596 - RNA, 64 nt, Homo Sapiens
caccgaagcguugaccugaacauauuagugcaauccaguccagauuggaccuuugauccuaugu

SEQ ID NO: 74597 - RNA, 64 nt, Homo Sapiens
uagaaauauuaguguuacggaagugccuaauaucccaguccaaauuuuuuuuuuuuuuuuuuuu

SEQ ID NO: 74598 - RNA, 64 nt, Homo Sapiens
cugggauuacaggugugagccaccacgccuggccccaguccaaaauauuuaaagauuguuuccu

SEQ ID NO: 74599 - RNA, 64 nt, Homo Sapiens
cagaacacacagccuccaucgaaugcauucucccccaguccacccugguugucucuucugcaaa

SEQ ID NO: 74600 - RNA, 64 nt, Homo Sapiens
uggucaccacugcugcuaccagccaacccaccccccaguccacaucucuggcacugucaaaagc

SEQ ID NO: 74601 - RNA, 64 nt, Homo Sapiens
cacagcuggggcgggcccuguggcugggcggcagccaguccagcucuugcuuccucuggcccgu

SEQ ID NO: 74602 - RNA, 64 nt, Homo Sapiens
ccugcagcaccccggcuuucccgggucuccagccccaguccagaguugggcaccacaccggcca

SEQ ID NO: 74603 - RNA, 64 nt, Homo Sapiens
ucugccuugccggcucuccaccacccugacccagccaguccagcgucccugacuuggggcacuu

SEQ ID NO: 74604 - RNA, 64 nt, Homo Sapiens
ccacucugggcugggcugugccgagggugccuggccaguccacuaugggggcugcuggcagacc

SEQ ID NO: 74605 - RNA, 64 nt, Homo Sapiens
acccggaacuugggccaaucagccucaccuugucccaguccacuccuaacacuagcaucagucc

SEQ ID NO: 74606 - RNA, 64 nt, Homo Sapiens
ucaaggccaaaguccugagcccccuccgcuggucccaguccagcucuuaucaacuccccaaagg

SEQ ID NO: 74607 - RNA, 64 nt, Homo Sapiens; identical to SEQ ID NO: 72674

SEQ ID NO: 74608 - RNA, 64 nt, Homo Sapiens; identical to SEQ ID NO: 72675

SEQ ID NO: 74609 - RNA, 64 nt, Homo Sapiens; identical to SEQ ID NO: 72676

SEQ ID NO: 74610 - RNA, 64 nt, Homo Sapiens; identical to SEQ ID NO: 72677

SEQ ID NO: 74611 - RNA, 64 nt, Homo Sapiens; identical to SEQ ID NO: 72678

SEQ ID NO: 74612 - RNA, 64 nt, Homo Sapiens; identical to SEQ ID NO: 72679

SEQ ID NO: 74613 - RNA, 64 nt, Homo Sapiens; identical to SEQ ID NO: 72680

SEQ ID NO: 74614 - RNA, 64 nt, Homo Sapiens; identical to SEQ ID NO: 72681

SEQ ID NO: 74615 - RNA, 64 nt, Homo Sapiens; identical to SEQ ID NO: 72682

SEQ ID NO: 74616 - RNA, 64 nt, Homo Sapiens; identical to SEQ ID NO: 72683

SEQ ID NO: 74617 - RNA, 64 nt, Homo Sapiens; identical to SEQ ID NO: 72684

SEQ ID NO: 74618 - RNA, 64 nt, Homo Sapiens; identical to SEQ ID NO: 72685

SEQ ID NO: 74619 - RNA, 64 nt, Homo Sapiens; identical to SEQ ID NO: 72686

SEQ ID NO: 74620 - RNA, 64 nt, Homo Sapiens; identical to SEQ ID NO: 72687

SEQ ID NO: 74621 - RNA, 64 nt, Homo Sapiens; identical to SEQ ID NO: 72688

SEQ ID NO: 74622 - RNA, 64 nt, Homo Sapiens; identical to SEQ ID NO: 72689

SEQ ID NO: 74623 - RNA, 64 nt, Homo Sapiens; identical to SEQ ID NO: 72690

SEQ ID NO: 74624 - RNA, 64 nt, Homo Sapiens; identical to SEQ ID NO: 72691

SEQ ID NO: 74625 - RNA, 64 nt, Homo Sapiens; identical to SEQ ID NO: 72692

SEQ ID NO: 74626 - RNA, 64 nt, Homo Sapiens; identical to SEQ ID NO: 72693

SEQ ID NO: 74627 - RNA, 64 nt, Homo Sapiens; identical to SEQ ID NO: 72694

SEQ ID NO: 74628 - RNA, 64 nt, Homo Sapiens; identical to SEQ ID NO: 72695

SEQ ID NO: 74629 - RNA, 64 nt, Homo Sapiens; identical to SEQ ID NO: 72696

SEQ ID NO: 74630 - RNA, 64 nt, Homo Sapiens; identical to SEQ ID NO: 72697

SEQ ID NO: 74631 - RNA, 64 nt, Homo Sapiens; identical to SEQ ID NO: 72698

SEQ ID NO: 74632 - RNA, 64 nt, Homo Sapiens; identical to SEQ ID NO: 72699

SEQ ID NO: 74633 - RNA, 64 nt, Homo Sapiens; identical to SEQ ID NO: 72700

SEQ ID NO: 74634 - RNA, 64 nt, Homo Sapiens; identical to SEQ ID NO: 72701

SEQ ID NO: 74635 - RNA, 64 nt, Homo Sapiens; identical to SEQ ID NO: 72702

SEQ ID NO: 74636 - RNA, 64 nt, Homo Sapiens; identical to SEQ ID NO: 72703

SEQ ID NO: 74637 - RNA, 64 nt, Homo Sapiens; identical to SEQ ID NO: 72704

SEQ ID NO: 74638 - RNA, 64 nt, Homo Sapiens; identical to SEQ ID NO: 72705

SEQ ID NO: 74639 - RNA, 64 nt, Homo Sapiens; identical to SEQ ID NO: 72706

SEQ ID NO: 74640 - RNA, 64 nt, Homo Sapiens; identical to SEQ ID NO: 72707

SEQ ID NO: 74641 - RNA, 64 nt, Homo Sapiens; identical to SEQ ID NO: 72708

SEQ ID NO: 74642 - RNA, 64 nt, Homo Sapiens; identical to SEQ ID NO: 72709

SEQ ID NO: 74643 - RNA, 64 nt, Homo Sapiens; identical to SEQ ID NO: 72710

SEQ ID NO: 74644 - RNA, 64 nt, Homo Sapiens; identical to SEQ ID NO: 72711

SEQ ID NO: 74645 - RNA, 64 nt, Homo Sapiens; identical to SEQ ID NO: 72712

SEQ ID NO: 74646 - RNA, 64 nt, Homo Sapiens; identical to SEQ ID NO: 72713

SEQ ID NO: 74647 - RNA, 64 nt, Homo Sapiens; identical to SEQ ID NO: 72714

SEQ ID NO: 74648 - RNA, 64 nt, Homo Sapiens; identical to SEQ ID NO: 72715

SEQ ID NO: 74649 - RNA, 64 nt, Homo Sapiens; identical to SEQ ID NO: 72716

SEQ ID NO: 74650 - RNA, 64 nt, Homo Sapiens; identical to SEQ ID NO: 72717

SEQ ID NO: 74651 - RNA, 64 nt, Homo Sapiens; identical to SEQ ID NO: 72718

SEQ ID NO: 74652 - RNA, 64 nt, Homo Sapiens; identical to SEQ ID NO: 72719

SEQ ID NO: 74653 - RNA, 64 nt, Homo Sapiens
acagaugguauuuugggcagaaagcucuuagacaauggacuauccaaagcacuauuuaaauucu

SEQ ID NO: 74654 - RNA, 64 nt, Homo Sapiens
agaugauucuguacccuaguauaucuuuuugggcauggacuaauuuguaucuguuuaacucaua

SEQ ID NO: 74655 - RNA, 64 nt, Homo Sapiens
ugagugaugcuggauaagguauuguauuucaacaauggacuaugccuugguuuuucacuaauca

SEQ ID NO: 74656 - RNA, 64 nt, Homo Sapiens
cccagucucagauauucuguuacagaaacacaaaauggacuaagacaccacccuuuuccaaaau

SEQ ID NO: 74657 - RNA, 64 nt, Homo Sapiens
auaaaaauauauaagagggacuuuaugggauaguauggacuauggaaaaacaaauuugcacaau

SEQ ID NO: 74658 - RNA, 64 nt, Homo Sapiens
ggaaugagagguggggaggggagauuguugagagauggacuaggaaguggaagcaggcuggaaa

SEQ ID NO: 74659 - RNA, 64 nt, Homo Sapiens
caauuuuuucuggcaacuguaaauggaaaaauauauggacuaaacguagcccugugcuguauca

SEQ ID NO: 74660 - RNA, 64 nt, Homo Sapiens
agaaauauuuccuauugagacaagguucuccuauauggacuaggcagcugguuccagcccuggc

SEQ ID NO: 74661 - RNA, 64 nt, Homo Sapiens
guaugcaaaaagccuggcaauuucugagaauuaaauggacuaauccuguuucauaugaaggucg

SEQ ID NO: 74662 - RNA, 64 nt, Homo Sapiens
gguccuuugugaaagagcaagggcuuauggugcuauggacuaggcaugcugcaaucacuguccu

SEQ ID NO: 74663 - RNA, 64 nt, Homo Sapiens
caggggucugguauaaaaaccaugccucagccccauggacuaagucuugcucugaguuauguga

SEQ ID NO: 74664 - RNA, 64 nt, Homo Sapiens
ggagagggggccaaggggauaaagcuguaaucucauggacuagaggacccuccugucagugugc

SEQ ID NO: 74665 - RNA, 64 nt, Homo Sapiens
gauucugcuuugaauauagcuacagaaauaaaggauggacuacagugugggacagguaauuuug

SEQ ID NO: 74666 - RNA, 64 nt, Homo Sapiens
ugccaaucacgaguacaguacaagcagccagcauauggacuacaaagacacauucgacaugcug

SEQ ID NO: 74667 - RNA, 64 nt, Homo Sapiens
cucuguggaucacagaguguaacaauggaccuaaauggacuauaguauauuggauguuaaaucc

SEQ ID NO: 74668 - RNA, 64 nt, Homo Sapiens
ugucugguggccccguuucugugugcaacaggguauggacuauccucuugaguuugucgcucau

SEQ ID NO: 74669 - RNA, 64 nt, Homo Sapiens
gaggcucuaacacugcucagucaauuuggccgggauggacuaaugucaccaguugcuuuuucag

SEQ ID NO: 74670 - RNA, 64 nt, Homo Sapiens
cacaauacagugguauaaacccuggauuuagaacauggacuacagcauuuuggcuccggggcau

SEQ ID NO: 74671 - RNA, 64 nt, Homo Sapiens
acguugauuucuuauugcuguauaaaagagggacauggacuauauacuuugaaauuaucaccca

SEQ ID NO: 74672 - RNA, 64 nt, Homo Sapiens
aaucugaacugcuaauguggcugcuuuguagggaauggacuaauaucaguguguuagaucuuaa

SEQ ID NO: 74673 - RNA, 64 nt, Homo Sapiens
uuuaugucgugugugugugugagugcuucuucagauggacuaaaaaaguggaauuagaaagcug

SEQ ID NO: 74674 - RNA, 64 nt, Homo Sapiens
gccuguugugaaaauguuugcauuccaaauucucauggacuauucaugugccauucuauacugu

SEQ ID NO: 74675 - RNA, 64 nt, Homo Sapiens
uauuguaaguguagaaaauccugccagcccauaaauggacuauuuuucuuguuaggaguuuauc

SEQ ID NO: 74676 - RNA, 64 nt, Homo Sapiens
uuauucagccauaaaaagaagguauauccauacaauggacuauaugaauagauaaaccaaaucu

SEQ ID NO: 74677 - RNA, 64 nt, Homo Sapiens
aaaugccuuuacauagaaggaaucugcaucgaucauggacuacuaacgggacauaguaugugac

SEQ ID NO: 74678 - RNA, 64 nt, Homo Sapiens
auggacgaaugcugcuucaugcgacuccaugucaauggacuauuuuauucaacucggguauuua

SEQ ID NO: 74679 - RNA, 64 nt, Homo Sapiens
uguguguguaauuauggccaaaaggacauaggagauggacuaagaugucuuggaccaccuuugu

SEQ ID NO: 74680 - RNA, 64 nt, Homo Sapiens
gaagaucaucaauggcugcgguagccuaguaggaauggacuauauaauaauauagcaggugcuc

SEQ ID NO: 74681 - RNA, 64 nt, Homo Sapiens
ugaauucuaacauuaaaucacagcccaaaauuugauggacuaauuauuauuuuaaaauauauga

SEQ ID NO: 74682 - RNA, 64 nt, Homo Sapiens
ccauaaaauaagcuuuauaaaaaccaauuuccugauggacuauuaaauucaucuuagaauaaau

SEQ ID NO: 74683 - RNA, 64 nt, Homo Sapiens
ugaagauagcuuaguguaaacacaagccuaggacauggacuagguaaagacaaaguccuugcau

SEQ ID NO: 74684 - RNA, 64 nt, Homo Sapiens
auauuauuuaucuuguucuuuuaaaaucaguaaaauggacuagcguauaaaaauugcaguaucu

SEQ ID NO: 74685 - RNA, 64 nt, Homo Sapiens
ucugugaggauaggaguuaugucacugaggccuuauggacuaacuaacuccauauuucugugag

SEQ ID NO: 74686 - RNA, 64 nt, Homo Sapiens
ccucauuagcauguuugcauaaaaauuauaagacauggacuagucaaagaaacauguuaaaaaa

SEQ ID NO: 74687 - RNA, 64 nt, Homo Sapiens
cucuuguuuuuauuaaaaacuagaaugcuuuugcauggacuaucuguguuuuucacauguauua

SEQ ID NO: 74688 - RNA, 64 nt, Homo Sapiens
gccagcuuucauuaagaauccucagcacccugaaauggacuaagugcauggcuuugagaagugc

SEQ ID NO: 74689 - RNA, 64 nt, Homo Sapiens
gcagucaucucacuaguuauguucaaaaaaguacauggacuauaucgcacaacaggugcuaguu

SEQ ID NO: 74690 - RNA, 64 nt, Homo Sapiens
aaaauguauuugaacauugguucuguaaaagauaauggacuaaaaaaguagagaggaguuguag

SEQ ID NO: 74691 - RNA, 64 nt, Homo Sapiens
auauaaauuacaaacacauauuagagaauccauaauggacuagaauucucaauuucacuucaaa

SEQ ID NO: 74692 - RNA, 64 nt, Homo Sapiens
ccaagggaaucuguaaagaaaugcuuuggguggaauggacuacuaagcauuccccaaagauaac

SEQ ID NO: 74693 - RNA, 64 nt, Homo Sapiens
aggacccuugugugggaacaagucaccuguuggaauggacuaaaaagccuucagggcugcucgg

SEQ ID NO: 74694 - RNA, 64 nt, Homo Sapiens
uaauagcuugcgaaauauuagcaauuuucccauuauggacuauucucucuaaagcaagagagac

SEQ ID NO: 74695 - RNA, 64 nt, Homo Sapiens
uaacgggauuuuaaaaauauauacauuuuacaacauggacuagaaaaggaccauuagaucaggg

SEQ ID NO: 74696 - RNA, 64 nt, Homo Sapiens
uacagaccuaguuacugggaauucauuacuugccauggacuaccuuugcuaagaaaagucugaa

SEQ ID NO: 74697 - RNA, 60 nt, Homo Sapiens
acuuucaaacagaaguuuaaaaaaaucaaaauggacuaagguagagacaaaacuuuauug

SEQ ID NO: 74698 - RNA, 64 nt, Homo Sapiens
cuaauccccuuuugguggugugacugaggaagggauggacuaagggaggaaggugggaagcaga

SEQ ID NO: 74699 - RNA, 64 nt, Homo Sapiens
augugaaacagccucuugccucugccaaagacuaauggacuaaagaauuuggccuugguugggc

SEQ ID NO: 74700 - RNA, 64 nt, Homo Sapiens
ggcaaugccaggagcccugagcccagggacccacauggacuaaagccagcucugacccaggucc

SEQ ID NO: 74701 - RNA, 64 nt, Homo Sapiens
cacacuuuuaauuuugucagguuuuaugcauguaauggacuauguaaacaggauuauuauuagu

SEQ ID NO: 74702 - RNA, 64 nt, Homo Sapiens
uguauuuuauuuuaaaauguacaacuaaauuguuauggacuacaggguuauuuuuauggucaua

SEQ ID NO: 74703 - RNA, 64 nt, Homo Sapiens
gauggaugcggacgauggaagcagacacggaccuauggacuauggcagacucuuccuccacaca

SEQ ID NO: 74704 - RNA, 64 nt, Homo Sapiens
uguuccacauuguauuuuugaauaaaaauuccaaauggacuauuagcauaaggcauuaaaugac

SEQ ID NO: 74705 - RNA, 64 nt, Homo Sapiens
uuaauuuaaaugacuucuugcaccaucuugccuaauggacuagauuggacuguaucaacauuga

SEQ ID NO: 74706 - RNA, 64 nt, Homo Sapiens
aaugucuacugaagcuuaaccgaagaacuaauaaauggacuacaguagcucacguuacagggaa

SEQ ID NO: 74707 - RNA, 64 nt, Homo Sapiens
aguuauaauguguguuaccuucuaccccgaaaugauggacuacaacuuuacgguaaucauuaac

SEQ ID NO: 74708 - RNA, 64 nt, Homo Sapiens
ggcacagggcucuaucucucaaauuaauaaagaaauggacuaaucaccagccgaaccaauguca

SEQ ID NO: 74709 - RNA, 64 nt, Homo Sapiens
caggauguuaauaaugaagcgaaauaauuuaguaauggacuauaaugggugcuaauugauaaug

SEQ ID NO: 74710 - RNA, 64 nt, Homo Sapiens
uaugugaaaccuaaaggaagugguucuguugcaaauggacuauaaacagggacauuauauucuu

SEQ ID NO: 74711 - RNA, 64 nt, Homo Sapiens
ccagucaugggcaguccuuuacagcagcaugagaauggacuaauacacuccucaaauguuuuga

SEQ ID NO: 74712 - RNA, 64 nt, Homo Sapiens
auuuucuuccuuugaagcuuuaggcagagccauaauggacuaaaacauuuugacuaaguuuuua

SEQ ID NO: 74713 - RNA, 64 nt, Homo Sapiens
ccggcauauccuggccguaacgauuuuuauaguuauggacuacuugaaaccacuacugagggua

SEQ ID NO: 74714 - RNA, 64 nt, Homo Sapiens
uucuuuacccauggaauguaauauuuuugcaaagauggacuacuucacaaaugguuauaaaguc

SEQ ID NO: 74715 - RNA, 64 nt, Homo Sapiens
agaaaccaagaaauuaacaacugaaagcauuuuaauggacuauuuauuaaagugcaaacaaacu

SEQ ID NO: 74716 - RNA, 64 nt, Homo Sapiens
cauucuaaagcuagaggaaguaugugauauacacauggacuaaggcucaggugacacuauggcu

SEQ ID NO: 74717 - RNA, 64 nt, Homo Sapiens
uccaggguaaaaucaauguuguacauugacguguauggacuaaacauuguacuuugauaagucu

SEQ ID NO: 74718 - RNA, 64 nt, Homo Sapiens
cauaagguucucuauuuaaguagaguccagaaacauggacuacacagugauucaaaaucaggua

SEQ ID NO: 74719 - RNA, 64 nt, Homo Sapiens
ucuuuuguagugacauuaaauuuggcuauaaaagauggacuacaugugauacuccuauggacgu

SEQ ID NO: 74720 - RNA, 64 nt, Homo Sapiens
ggaaugaugcuuccauuggcuuuuucuuguuaccauggacuaggaagaaaacaugguuuccaaa

SEQ ID NO: 74721 - RNA, 64 nt, Homo Sapiens
gggaagaggaaggaagguggguggggcugguaguauggacuaaggugcugcaggaccuggggcc

SEQ ID NO: 74722 - RNA, 64 nt, Homo Sapiens
uagaaguuacagagucaugugggacuguuuuucuauggacuaagauuuuuucacccuuagaaaa

SEQ ID NO: 74723 - RNA, 64 nt, Homo Sapiens
cuuucuaaucaagaggcgugugcccuaccuuugcauggacuauugucugcagugcuguguaaaa

SEQ ID NO: 74724 - RNA, 64 nt, Homo Sapiens
gcccagucccccaucuaaguucaguuucuuagggauggacuauggauccgggauucaggagcuc

SEQ ID NO: 74725 - RNA, 64 nt, Homo Sapiens
accacaacugacacaggaaaccaacacccaaagcauggacuaaccccaacgcacaggaaaaggu

SEQ ID NO: 74726 - RNA, 64 nt, Homo Sapiens
cacaugaagaaauuaguccuaacaacacuaugagauggacuauaacuugcccaaauuuuuuuuu

SEQ ID NO: 74727 - RNA, 64 nt, Homo Sapiens
acgccguccuggcugcgcaggaggggccgcuggcauggacuaagaaauccugacaccaagaagg

SEQ ID NO: 74728 - RNA, 64 nt, Homo Sapiens
guguuagaaaaccuuaauuuuuuuucccuuuuguauggacuacaaauaaaacuuggggcaauuu

SEQ ID NO: 74729 - RNA, 64 nt, Homo Sapiens
cacuucuuucuaaauguaucggagaaaaaaucaaauggacuacaagcacguguuugcugugcuu

SEQ ID NO: 74730 - RNA, 64 nt, Homo Sapiens
cacacuuacauguauguauuuugauagauauuacauggacuaaauuuugucaauuucauguaau

SEQ ID NO: 74731 - RNA, 64 nt, Homo Sapiens
agagagacugggucaaguaaaucuugguucugauauggacuaggucuaaacaaaaccuguuuga

SEQ ID NO: 74732 - RNA, 64 nt, Homo Sapiens
cugaagguguacuucaccagcuuuacuuaggagaauggacuaagguuaagaguuuuccuucagg

SEQ ID NO: 74733 - RNA, 64 nt, Homo Sapiens
uuuauuaaaggauuguuuuuuuggggaguuuuagauggacuaaucacgacuagaaccuuaggca

SEQ ID NO: 74734 - RNA, 64 nt, Homo Sapiens
augcucucuggagcuuaguaaaagauccugaagcauggacuaacucuagguucuccagugacag

SEQ ID NO: 74735 - RNA, 64 nt, Homo Sapiens
uacugacaaggacaccaaccuagggugcaaacagauggacuaugguucaaggacacuggaauug

SEQ ID NO: 74736 - RNA, 64 nt, Homo Sapiens
uugucuacugugguccugugcacguuggccucagauggacuacaggagauuacaacguacaagg

SEQ ID NO: 74737 - RNA, 64 nt, Homo Sapiens
ccagccuaggcccuuaaucuugcuguuauuuuccauggacuaaaggucuggucaucugagcuca

SEQ ID NO: 74738 - RNA, 64 nt, Homo Sapiens
ccaagucuguaccucaaaugaauucuuuaaggagauggacuaauugacuugcaaagaccuaccu

SEQ ID NO: 74739 - RNA, 64 nt, Homo Sapiens
uuuaaaucccacaaauugacacuuucuaucuucaauggacuaagauuuuuuuggucaguaaucu

SEQ ID NO: 74740 - RNA, 64 nt, Homo Sapiens
uggcccuuuaagaguuagcuuuuuaccugcacaaauggacuaaaaaaucuggcacaaaacauug

SEQ ID NO: 74741 - RNA, 64 nt, Homo Sapiens
acucagugugaguaacuucaaucagaaaaacagaauggacuagguuagaccuuugcuuaugcaa

SEQ ID NO: 74742 - RNA, 64 nt, Homo Sapiens
augaaaugcacuguauugcuccuuagacaccugaauggacuaaggcugccaccccucuucugcu

SEQ ID NO: 74743 - RNA, 64 nt, Homo Sapiens
ccuugugcauugccuaauuuuuacuuaaaauuaaauggacuauuaaaugagaacuuuauauaua

SEQ ID NO: 74744 - RNA, 64 nt, Homo Sapiens
uuuguaacuuaccuguuuguugaugaaaaguaaaauggacuacuuguucaaaacagggaaagac

SEQ ID NO: 74745 - RNA, 64 nt, Homo Sapiens
aacgaugcuggcuuucaagcgaaucgccaugcccauggacuaaguauagauaauugauauaaaa

SEQ ID NO: 74746 - RNA, 64 nt, Homo Sapiens
uaauuuuaagagauaguggauagacaaauacaaaauggacuaaaacuucauauuuuuccaucau

SEQ ID NO: 74747 - RNA, 64 nt, Homo Sapiens
ugggcaaagccccugggaacgaggccuauccacuauggacuaugguaacuugguaggauuuuua

SEQ ID NO: 74748 - RNA, 64 nt, Homo Sapiens
agagacuugauuuuggugcugaaggggaagcuagauggacuaggucuuuuuuuuaaguggggag

SEQ ID NO: 74749 - RNA, 64 nt, Homo Sapiens
ugggagaaauuagaaaacaaccagaagccagaggauggacuaagugaauauacagagccuugau

SEQ ID NO: 74750 - RNA, 64 nt, Homo Sapiens
cuggugauggcaaaugacuggcuuucucuuguggauggacuauaggaagcacuuucugaauuau

SEQ ID NO: 74751 - RNA, 64 nt, Homo Sapiens
acuucgcugaguuccacuguggauuacaguuuguauggacuacuacuguaaauuauagcuuguu

SEQ ID NO: 74752 - RNA, 64 nt, Homo Sapiens
acacuguccugggaggcguucagaggguuccaugauggacuagguuuggaaccacuggguuaaa

SEQ ID NO: 74753 - RNA, 64 nt, Homo Sapiens
cuauuuuuugcaaauuuguaugugcuuucaauugauggacuacuuuccagcaaacguacgggaa

SEQ ID NO: 74754 - RNA, 64 nt, Homo Sapiens
agggagggaacucuugacacugagccacuaaaauauggacuaauuuuuuggacaaaucuucaaa

SEQ ID NO: 74755 - RNA, 64 nt, Homo Sapiens
cuuaccagcagagcaccuuagacagucccugccaauggacuaacuugucuuuggacccugaggc

SEQ ID NO: 74756 - RNA, 64 nt, Homo Sapiens
uccuuaccucccugguccccguuugucaaagaggauggacuaaaugaucucugaaaguguugaa

SEQ ID NO: 74757 - RNA, 64 nt, Homo Sapiens
aaggacauuugaugcugguaguauggauuaugagauggacuagccccugccccagcccagcucu

SEQ ID NO: 74758 - RNA, 64 nt, Homo Sapiens
uguccugaccaucgcacaccggcuuaacacuaucauggacuacaccaggugggacacggaaacc

SEQ ID NO: 74759 - RNA, 64 nt, Homo Sapiens
gaaauaaugggaaagguugaauuaauuccugggcauggacuaccagaugaccacaaguugcguu

SEQ ID NO: 74760 - RNA, 64 nt, Homo Sapiens
gagggggaaaaaucacuaacaugaaaggcaaaaaauggacuaugauuccuguggggaaacaauu

SEQ ID NO: 74761 - RNA, 64 nt, Homo Sapiens
cugugcugugugcuggaaaaaguggggagaguggauggacuagaugaugaccuugaauuugggg

SEQ ID NO: 74762 - RNA, 64 nt, Homo Sapiens
uaauucaaacugauuagcccuuaauauucuuguaauggacuagagaucacaaagcucaaggaau

SEQ ID NO: 74763 - RNA, 64 nt, Homo Sapiens
ccuauaaaccaaagucucugcuuaucuuuaauauauggacuauuucguuauuuugcugggucag

SEQ ID NO: 74764 - RNA, 64 nt, Homo Sapiens
uccuuaggggacggcuuugggggucccacgagacauggacuaggaguuuaagcaggacagugug

SEQ ID NO: 74765 - RNA, 64 nt, Homo Sapiens
gaacuauagaaaagacagacugugcuauucaaagauggacuauuccacuucugacauuccauua

SEQ ID NO: 74766 - RNA, 64 nt, Homo Sapiens
aaaguuccuuauccuuuugacucuugcuuucaagauggacuacauugcugcuuuacccacgcau

SEQ ID NO: 74767 - RNA, 64 nt, Homo Sapiens
caguaauaacuaguuggccaacugacugugguccauggacuacacagugaguagagguucuuua

SEQ ID NO: 74768 - RNA, 64 nt, Homo Sapiens
uuggcacagaggacucuucugauaacuugaaaaaauggacuaccuuuuucagggaucuuuugga

SEQ ID NO: 74769 - RNA, 64 nt, Homo Sapiens
ccagugccuugauauuggacggcccuuaccagacauggacuauguaucuuugaaccgggaagca

SEQ ID NO: 74770 - RNA, 64 nt, Homo Sapiens
gacucuuucaaagggaucuguaauuuuuuguuucauggacuauggggcuuaccaguggcccagg

SEQ ID NO: 74771 - RNA, 64 nt, Homo Sapiens
uauuaaaugauauuuacauaagggaaguguggacauggacuaaaaagccauuuuggagacagug

SEQ ID NO: 74772 - RNA, 64 nt, Homo Sapiens
ccuguacuaauauaugguagaaaugugggaaauaauggacuagaagaaagcaauuacuacugcu

SEQ ID NO: 74773 - RNA, 64 nt, Homo Sapiens
cauuagagcaacuuucugggagguuguuagaaaaauggacuauccaaguccccgucugccuggc

SEQ ID NO: 74774 - RNA, 64 nt, Homo Sapiens
uaaauaccuucguauauauguguuuuuguuguaaauggacuauauccaauucuuuuaaaauuaa

SEQ ID NO: 74775 - RNA, 64 nt, Homo Sapiens
gaagaucagaaggggcuucacgcuucuccuggacauggacuagcuugagccaaggcaguggcac

SEQ ID NO: 74776 - RNA, 64 nt, Homo Sapiens
aggggauggguuugucuugucuucuuuuuaauuuauggacuagucucauuacuccggaauuaug

SEQ ID NO: 74777 - RNA, 64 nt, Homo Sapiens
uuaugaaagaauauguaaaguagcuucgagcuguauggacuauauucuaagcuuaaauauugca

SEQ ID NO: 74778 - RNA, 64 nt, Homo Sapiens
uguaguaucaauuuccuccugaaguccuuuucauauggacuaauguguuuaagauacuugauuu

SEQ ID NO: 74779 - RNA, 64 nt, Homo Sapiens
uucauucagguuuuuuaaaggauauuuaacuuuuauggacuagaaggaaucacgagggcuacug

SEQ ID NO: 74780 - RNA, 64 nt, Homo Sapiens
gcaauacauuucuuccuucagugguucgaaggauauggacuauucauuuccucagucucccuuu

SEQ ID NO: 74781 - RNA, 64 nt, Homo Sapiens
uguccaaacuaagaauaaaaaccaguguagaagaauggacuaucgaagcuucagaaaccguggg

SEQ ID NO: 74782 - RNA, 64 nt, Homo Sapiens
cugugcuacccaccccuuccauggacugaauaagauggacuaacaggccuguguuuuuguguuu

SEQ ID NO: 74783 - RNA, 64 nt, Homo Sapiens
uugcucucauguguaauguuuuuucuuaagagaaauggacuauuaguuugugaguguuuauugg

SEQ ID NO: 74784 - RNA, 64 nt, Homo Sapiens
ugagugguagcgguaguuggcgagcugagaacacauggacuagcauugguguccugugggaggg

SEQ ID NO: 74785 - RNA, 64 nt, Homo Sapiens
guuguuuugauuuguuuuuggcuaaguagaggacauggacuaguuguagcaaacagaacaugcu

SEQ ID NO: 74786 - RNA, 64 nt, Homo Sapiens
gcgugugugcuaguuaauagguuuaguagcuuuuauggacuaaaaaugauugauuguaucuuga

SEQ ID NO: 74787 - RNA, 64 nt, Homo Sapiens
cguguauccagauggacugacaggccgagagcggauggacuacaugaaacgcaagagccgcgag

SEQ ID NO: 74788 - RNA, 64 nt, Homo Sapiens
aggaagcacaucuguagugcacucccagcaggccauggacuagucacuaaccccacacucaaag

SEQ ID NO: 74789 - RNA, 64 nt, Homo Sapiens
cacccacagaaagagagcacugaccccgauggcgauggacuacugaagcccuaacucagccaac

SEQ ID NO: 74790 - RNA, 64 nt, Homo Sapiens
cacuuaauuagaaacgugauaaauauauggacaaauggacuauacauacuauaagaggacugua

SEQ ID NO: 74791 - RNA, 64 nt, Homo Sapiens
uuugcaguccaacaucagccaccauccacaggaaauggacuauuugcugcacagcagaaauuac

SEQ ID NO: 74792 - RNA, 64 nt, Homo Sapiens
cauuccuacagaagugggccgcaucgcacuuuaccaagcugaugcuccaucccccauggaggag

SEQ ID NO: 74793 - RNA, 64 nt, Homo Sapiens
ucauuguuuccaccuugggaguggcuggagacuucaagcugacucaucgccugcuuucucucca

SEQ ID NO: 74794 - RNA, 64 nt, Homo Sapiens
uaucuuuaauucgcuauccaaaauuaaauuauugcaagcugauucacauauaaagaugcaggua

SEQ ID NO: 74795 - RNA, 64 nt, Homo Sapiens
ucgccugguuaaagaugcucugcgucaauuaagucaagcugaagcuacugacuucugcaaagua

SEQ ID NO: 74796 - RNA, 64 nt, Homo Sapiens
aauucagaaccccaacuacuguguuaugcaaaagcaagcugauuaaaugacacucauauaauua

SEQ ID NO: 74797 - RNA, 64 nt, Homo Sapiens
uauaaagaauugugguuuauauauuuaaaagugucaagcugaguauuaaaauguaugcauguug

SEQ ID NO: 74798 - RNA, 64 nt, Homo Sapiens
uggggugguugugccagccugccuuuggcagcugcaagcugagguggcagcucugaccaccucu

SEQ ID NO: 74799 - RNA, 64 nt, Homo Sapiens
uagaggcaagccaggccagggagcugggagcgagcaagcugaggccacguccacaaggagcuuu

SEQ ID NO: 74800 - RNA, 64 nt, Homo Sapiens
gcacacgggacugguauucuggcuguacuaaugacaagcugagucaagacccuggagggucaua

SEQ ID NO: 74801 - RNA, 64 nt, Homo Sapiens
ugucauccuucuucaauaaaugcugaaugacauucaagcugauuuucuagaccacugagaaaau

SEQ ID NO: 74802 - RNA, 64 nt, Homo Sapiens
aaaucaucacuucagcuccugauuggucccaggccaagcugaauagcccuuaggaauaaucacu

SEQ ID NO: 74803 - RNA, 64 nt, Homo Sapiens
gaauaaucacuucaacuccugauuggucccgggccaagcugaauagcccuuaugaaucaucacu

SEQ ID NO: 74804 - RNA, 64 nt, Homo Sapiens
gguuccugauuggucccgggccaaggucccagaccaagcugaaucacgcuuucuccaagacagc

SEQ ID NO: 74805 - RNA, 64 nt, Homo Sapiens
augccuuccuuugggcuggcagggugaagaugcccaagcugaagagggcuggggcugggauggg

SEQ ID NO: 74806 - RNA, 64 nt, Homo Sapiens
guauccaaauuugccaucucgcugggcgagcuaccaagcugaagcuaaggcagaggcugagggg

SEQ ID NO: 74807 - RNA, 64 nt, Homo Sapiens
cugcccaccaucaagaugccgaaguuguagagagcaagcugaagagccccggcccgcugcuccu

SEQ ID NO: 74808 - RNA, 64 nt, Homo Sapiens
cacacacacacacacacacaucgccgcacccccuaccccccaaagauagaaucauccauuccca

SEQ ID NO: 74809 - RNA, 64 nt, Homo Sapiens
gugugggggaccugcagagauacuugcugacuuaaccccccauacucgucuugacuguuuuccc

SEQ ID NO: 74810 - RNA, 64 nt, Homo Sapiens
ugaaacgguuugagagacgccggccucuaauuccaccccccaaggcuuccuuuuuaucauaacg

SEQ ID NO: 74811 - RNA, 64 nt, Homo Sapiens
aagggacuggacgcccucauuguaagguuaacccaccccccagcacuauccccuuccucaucca

SEQ ID NO: 74812 - RNA, 64 nt, Homo Sapiens
ucgcaggugucugaggccagaagggucugggcgcaccccccagggccugaggcuguggccucca

SEQ ID NO: 74813 - RNA, 64 nt, Homo Sapiens
ggacgcccaugccaggcccgccacgaccgggucgaccccccaggccccucuccugccagacagc

SEQ ID NO: 74814 - RNA, 64 nt, Homo Sapiens
gcuuaggacuuggcccuguuaugagcugacccccaccccccaccccccaccccccccccccgcc

SEQ ID NO: 74815 - RNA, 64 nt, Homo Sapiens
acuuggcccuguuaugagcugacccccaccccccaccccccaccccccccccccgccaacuccu

SEQ ID NO: 74816 - RNA, 64 nt, Homo Sapiens
cucaucugugguccaggccggcaucguccuggccaccccccagaucuggugccugcuggccggc

SEQ ID NO: 74817 - RNA, 64 nt, Homo Sapiens
ugucguccaccccaggacgagccaucagggacagaccccccacccccaaggcugcagccacacc

SEQ ID NO: 74818 - RNA, 64 nt, Homo Sapiens
ugcucgggguuuuuuauuuauaaaaccucuccccaccccccaccccccaacuuccuggguuuuc

SEQ ID NO: 74819 - RNA, 64 nt, Homo Sapiens
gguuuuuuauuuauaaaaccucuccccaccccccaccccccaacuuccuggguuuucucauugu

SEQ ID NO: 74820 - RNA, 64 nt, Homo Sapiens
aaaaggaaaaaaugaaugagucccgcugcugcccaccccccacaggccacgagccaccacugcc

SEQ ID NO: 74821 - RNA, 64 nt, Homo Sapiens
cuucucccuacacucccagcgagaggcugugaccaccccccaucgaagcccuucuugcuuuuga

SEQ ID NO: 74822 - RNA, 64 nt, Homo Sapiens
ucuggggccucaucacuguguccucccauccuguaccccccauuggggccuccccugcuauccc

SEQ ID NO: 74823 - RNA, 64 nt, Homo Sapiens
cuccaggagcuaguggagggacagcagcuuggguaccccccaaccuaggggggagggggguggc

SEQ ID NO: 74824 - RNA, 64 nt, Homo Sapiens
gcgucagcuccuaccucugaaccuuucaccccccaccccccacauucaccuuugaccuugccuc

SEQ ID NO: 74825 - RNA, 64 nt, Homo Sapiens
ccccacagcgucagcuccuauugccucaccuuucaccccccaccgcugcaguucaccuuugacc

SEQ ID NO: 74826 - RNA, 64 nt, Homo Sapiens
ugagccccagcuccuaccucuugccucaccuuuaaccccccaccgcugcacuucaccgcugacc

SEQ ID NO: 74827 - RNA, 64 nt, Homo Sapiens
ucugcuuuuagcuucccuaugcagcuguaggcauaccccccaaguugcuuuuauacauuuuucu

SEQ ID NO: 74828 - RNA, 64 nt, Homo Sapiens
uaaccauuguuggcaaccuggaacuuugaaugcuaccccccaagauugauuuaggggcuuugga

SEQ ID NO: 74829 - RNA, 64 nt, Homo Sapiens
uacagcacuggcuuuucuuuacaggagugagacaaccccccagggaguaucagggauugugggg

SEQ ID NO: 74830 - RNA, 64 nt, Homo Sapiens
acacccuccucccagggaggcccaaaacuggcucaccccccagagucagggacugaagggggac

SEQ ID NO: 74831 - RNA, 64 nt, Homo Sapiens
cccuccucccucagacccagacccaggaguccagaccccccagcuccagccccuccucccucag

SEQ ID NO: 74832 - RNA, 64 nt, Homo Sapiens
cccuccucccucagacccagacccaggaguccagaccccccagccccagccccuccucccucag

SEQ ID NO: 74833 - RNA, 64 nt, Homo Sapiens
gggagggguagugcuccacagcuuuuccuuccccaccccccagccuuagaugccucgcucuuuu

SEQ ID NO: 74834 - RNA, 64 nt, Homo Sapiens
uacuccugcugucuaccucuccucacaccccagcaccccccauuuuuucaaaccuugguaucug

SEQ ID NO: 74835 - RNA, 64 nt, Homo Sapiens
uuuucaacuuccugcuggaaacuagagguggggcaccccccaccccccagccucgcacuguguc

SEQ ID NO: 74836 - RNA, 64 nt, Homo Sapiens
cuuccugcuggaaacuagagguggggcaccccccaccccccagccucgcacuguguccuugggg

SEQ ID NO: 74837 - RNA, 64 nt, Homo Sapiens
aauccacuaagaaggccugucuacacugcaggggaaccucaagaacuuuucauugcacuucuaa

SEQ ID NO: 74838 - RNA, 64 nt, Homo Sapiens
uugauaucacugacucuugaaaucacuaacagugaaccucaaauuugguuaugauguuaacaga

SEQ ID NO: 74839 - RNA, 64 nt, Homo Sapiens
cuucaaaaggaagagccuuuuaaaaacauuugccaaccucaagaauaaauacugaaagucuuga

SEQ ID NO: 74840 - RNA, 64 nt, Homo Sapiens
uguuuuuuuaacgucagccagauauuuagaaaauaaccucaaaaguguuuauauggucagugag

SEQ ID NO: 74841 - RNA, 64 nt, Homo Sapiens
uucccacuggaaaguaaacaaaaccaucccucccaaccucaaagcuaggccacacucuauuuca

SEQ ID NO: 74842 - RNA, 64 nt, Homo Sapiens
aaaccauaaagcuuggagugagccacaaaacuguaaccucaagguucugaaauacacuaagagc

SEQ ID NO: 74843 - RNA, 64 nt, Homo Sapiens
guauuaaauagcauuggggaggacuuaacguccuaaccucaauuuccaguacacagucugauaa

SEQ ID NO: 74844 - RNA, 64 nt, Homo Sapiens
uuucauuucugguuuaaccaggaagcauugggaaaccauguaugcucacuggagacucagaagg

SEQ ID NO: 74845 - RNA, 64 nt, Homo Sapiens
cuggaagauaggacacuuucgagaucuaguggauaccauguaucauaacuacuucugaacuccu

SEQ ID NO: 74846 - RNA, 64 nt, Homo Sapiens
gauauuucucaacacuuaaauucauaaaauuaagaccauguaaggguauguuuuuagagaaaug

SEQ ID NO: 74847 - RNA, 64 nt, Homo Sapiens
ucuuugcucauucacucaguaauacugagcacuuaccauguaccagaauuuuacuaggcacaac

SEQ ID NO: 74848 - RNA, 64 nt, Homo Sapiens
auugcuguaaaugauaaugucaaucaguuaauuuaccauguaaauuagaaagaacauuuuaaaa

SEQ ID NO: 74849 - RNA, 64 nt, Homo Sapiens
ccaugggaccaauugagagucuguuuuggauuuaaccauguaauguuauugcuugucaggugga

SEQ ID NO: 74850 - RNA, 64 nt, Homo Sapiens
aguaauauaucauauguaaauucuuagucauuagaccauguaaccuuugguuaccagagaaauu

SEQ ID NO: 74851 - RNA, 64 nt, Homo Sapiens
auucuuguauagaccaacuuuuuuucauuuucaaaccauguacauauuaguugauugcuguaac

SEQ ID NO: 74852 - RNA, 64 nt, Homo Sapiens
ugcaaaguaaggaggacuaagggaaaaugaugguaccauguaacagaaugagagcuaauuccaa

SEQ ID NO: 74853 - RNA, 64 nt, Homo Sapiens
gucauauaugaauuuaaaccuaguaccauccaaaaccauguaauggauuuuaagaaucuguuag

SEQ ID NO: 74854 - RNA, 64 nt, Homo Sapiens
uaaagauguauuuuguauaacuuaaauaauaaugcuaaaguauacuaggguuuuuuuuucuuga

SEQ ID NO: 74855 - RNA, 64 nt, Homo Sapiens
auauauggucuaauaguuuuuuaaagcuuuuggacuaaaguauuccacaaaucuuaccucuuua

SEQ ID NO: 74856 - RNA, 64 nt, Homo Sapiens
auuaguauguuaagauucugaauauuaugguggccuaaaguaggcuucuugguacaccagauua

SEQ ID NO: 74857 - RNA, 64 nt, Homo Sapiens
augucaauaaaguuuauuuaggucauagaauauccuaaaguaucacauaguuaaauuuuucagu

SEQ ID NO: 74858 - RNA, 64 nt, Homo Sapiens
uuuuuggugauaucugccugggaaaucucucuuccuaaaguauuuguauaugggaguccuuguu

SEQ ID NO: 74859 - RNA, 64 nt, Homo Sapiens
ggccauuuacuuaaggugaaauuuuaagauggagcuaaaguaagaucacugguuuuuagaacca

SEQ ID NO: 74860 - RNA, 64 nt, Homo Sapiens
auagaugguguaugcuguaucuucacagauuguucuaaaguaaauuucuauuuaugcaacucau

SEQ ID NO: 74861 - RNA, 64 nt, Homo Sapiens
uuucuccagaucagacuuuacccucccaccaauucuaaaguagcggagacucuuguacuugauc

SEQ ID NO: 74862 - RNA, 63 nt, Homo Sapiens
aaaaaaaaaaaaaaaaaaaaaguagguaugaucucuaaaguaaacuuaucaaaaaggcaggaa

SEQ ID NO: 74863 - RNA, 64 nt, Homo Sapiens
gccauucagaaaagcagguuacaaugcccccggccuaaaguacuagcugcacucaccaaggacc

SEQ ID NO: 74864 - RNA, 64 nt, Homo Sapiens
uucuuugaaaaaaugcauugacucuuuaagacaucuaaaguaucacauuauccauaauuuauug

SEQ ID NO: 74865 - RNA, 64 nt, Homo Sapiens
aucaaaccagauaauucucuaauucuucuuuaaucuaaaguagauagcuucccacuggaaagua

SEQ ID NO: 74866 - RNA, 64 nt, Homo Sapiens
gcuuuauuggauucacuuuguguguguuagugcucuaaaguagcaguauuauuauuaaacuguc

SEQ ID NO: 74867 - RNA, 64 nt, Homo Sapiens
auuauuaaacuguccccagaguaacccuguaggccuaaaguacucaguuuuaagacaaacacua

SEQ ID NO: 74868 - RNA, 64 nt, Homo Sapiens
uaaauguaaacauguagacugcauucgaggugaccuaaaguagagaggucaugaacuuugagaa

SEQ ID NO: 74869 - RNA, 64 nt, Homo Sapiens
ugguuaucaugggaaaguaucaugcagaguauuucuaaaguaauucuaauuucaauuauagugu

SEQ ID NO: 74870 - RNA, 64 nt, Homo Sapiens
caacucaagggcacauagaauauggcccagggggcuaaaguaaacauuuuacagagaaagaaau

SEQ ID NO: 74871 - RNA, 64 nt, Homo Sapiens; identical to SEQ ID NO: 58517

SEQ ID NO: 74872 - RNA, 64 nt, Homo Sapiens; identical to SEQ ID NO: 58518

SEQ ID NO: 74873 - RNA, 64 nt, Homo Sapiens; identical to SEQ ID NO: 58519

SEQ ID NO: 74874 - RNA, 64 nt, Homo Sapiens; identical to SEQ ID NO: 58520

SEQ ID NO: 74875 - RNA, 64 nt, Homo Sapiens; identical to SEQ ID NO: 58521

SEQ ID NO: 74876 - RNA, 64 nt, Homo Sapiens; identical to SEQ ID NO: 58522

SEQ ID NO: 74877 - RNA, 64 nt, Homo Sapiens; identical to SEQ ID NO: 58523

SEQ ID NO: 74878 - RNA, 64 nt, Homo Sapiens; identical to SEQ ID NO: 58524

SEQ ID NO: 74879 - RNA, 64 nt, Homo Sapiens; identical to SEQ ID NO: 58525

SEQ ID NO: 74880 - RNA, 64 nt, Homo Sapiens; identical to SEQ ID NO: 58526

SEQ ID NO: 74881 - RNA, 64 nt, Homo Sapiens; identical to SEQ ID NO: 58527

SEQ ID NO: 74882 - RNA, 64 nt, Homo Sapiens; identical to SEQ ID NO: 58528

SEQ ID NO: 74883 - RNA, 64 nt, Homo Sapiens; identical to SEQ ID NO: 58529

SEQ ID NO: 74884 - RNA, 64 nt, Homo Sapiens; identical to SEQ ID NO: 58530

SEQ ID NO: 74885 - RNA, 64 nt, Homo Sapiens; identical to SEQ ID NO: 58531

SEQ ID NO: 74886 - RNA, 64 nt, Homo Sapiens; identical to SEQ ID NO: 58532

SEQ ID NO: 74887 - RNA, 64 nt, Homo Sapiens
auucuaggggcaugaggguauuuuuuagguucuaagguuuuaucuuguugcaagagugggaccu

SEQ ID NO: 74888 - RNA, 64 nt, Homo Sapiens
uuccccugguuugucucauucuucuugguugaguagguuuuaacugggguagcacuccugcuag

SEQ ID NO: 74889 - RNA, 64 nt, Homo Sapiens
accaaaugcuguuaacguuagccaccgguaacuuagguuuuaccgcuuacuuacguacuucaau

SEQ ID NO: 74890 - RNA, 64 nt, Homo Sapiens
acuuacuauaccuuguacugccaaaauuuuuuaaagguuuuaggagcacuacuggauucaacug

SEQ ID NO: 74891 - RNA, 64 nt, Homo Sapiens
aaguuaccuuuaauacaaucgcuuaagauuucuaagguuuuaaacuucauuauaacauuuaugu

SEQ ID NO: 74892 - RNA, 64 nt, Homo Sapiens
auauauaaaaacuuuaugauucuuucuaaauaagagguuuuaaaguaaaugauauuauugauac

SEQ ID NO: 74893 - RNA, 64 nt, Homo Sapiens
uaguagagacgggguuucaccacguuggccgggcagguuuuaaacucuugaccucauguuccac

SEQ ID NO: 74894 - RNA, 64 nt, Homo Sapiens
cagguaguuaauccauuucuaaugaauaauuuuaagguuuuaauccuuuccaaguguacaauaa

SEQ ID NO: 74895 - RNA, 64 nt, Homo Sapiens
aagcagauggucgggcacugcuucagcaagcaguagguuuuacugcugguuggaugugcaggaa

SEQ ID NO: 74896 - RNA, 64 nt, Homo Sapiens
cauuaacuuccacaaagaagcuuuagaucagacuagguuuuaauuaguaaccauggauaagaug

SEQ ID NO: 74897 - RNA, 64 nt, Homo Sapiens
aucacugcccuguugagagaggugagauacaaaaagguuuuagauacaaaauaguucugaaagu

SEQ ID NO: 74898 - RNA, 64 nt, Homo Sapiens
aauuagcaaguagugcauacaaaauuaagguuugagguuuuagauucccauuuuaagauggggg

SEQ ID NO: 74899 - RNA, 64 nt, Homo Sapiens
uuuuaauuguguaucaagugaaaaagaaacacugagguuuuaagcugcuguauauagcuuguga

SEQ ID NO: 74900 - RNA, 64 nt, Homo Sapiens
uuuucuauaacaaaacaaguagcucuaggaaaagagguuuuauuuuguaaacgaucauuuguga

SEQ ID NO: 74901 - RNA, 64 nt, Homo Sapiens
cccauagcagcuuugucucuaguuacuuuauugaagguuuuagaccaggaccuugagugucauu

SEQ ID NO: 74902 - RNA, 64 nt, Homo Sapiens
acagucuacauugagcauuuccacuuauuuuucaagguuuuaaaaaaagaacaaugacaaacac

SEQ ID NO: 74903 - RNA, 64 nt, Homo Sapiens
uauacauaauuacuuugaacagcaguuuauuuuaagguuuuauuaauagaugcagagguuuuac

SEQ ID NO: 74904 - RNA, 64 nt, Homo Sapiens
gcaguuuauuuuaagguuuucuaaauagaugcagagguuuuacauuuugaaguuauuuguguug

SEQ ID NO: 74905 - RNA, 64 nt, Homo Sapiens
uauuuuaaguauauauuacuauggauauagauacagguuuuaagaacugucacaucuauugaaa

SEQ ID NO: 74906 - RNA, 64 nt, Homo Sapiens
aaaguugauacaccuucuuaaaauuuaauuauucagguuuuacauuuaaacaguaaccaaaucu

SEQ ID NO: 74907 - RNA, 64 nt, Homo Sapiens
auaauagaacuaugacagucuggcaaugcguuacagguuuuaugcacagauggguccuccaugc

SEQ ID NO: 74908 - RNA, 64 nt, Homo Sapiens
ggcuggaagaugaagccaugauagcuacagagaaagguuuuagacuccaguuuaccuuucucuu

SEQ ID NO: 74909 - RNA, 64 nt, Homo Sapiens
ggucugaaacauuacuuggcagccaagaauuuggagguuuuaaaauggugcuaauucuguccuc

SEQ ID NO: 74910 - RNA, 64 nt, Homo Sapiens
agacuuuaugaacaguuauucuaucaacuuuuaaagguuuuaaaccugcccagaaauuaccuug

SEQ ID NO: 74911 - RNA, 64 nt, Homo Sapiens
agaaggcuagguucagcaaaauaaguguaucagcagguuuuaucaugaucaguaaaaauguucc

SEQ ID NO: 74912 - RNA, 64 nt, Homo Sapiens
gugucagccacagcgaaucccaugucuugguuauagguuuuauguuuuguuuugugggucauag

SEQ ID NO: 74913 - RNA, 64 nt, Homo Sapiens
auugugagaguagcaaguccagggagagcuaaagagguuuuaucuguauuuccuaauuucaaau

SEQ ID NO: 74914 - RNA, 64 nt, Homo Sapiens
uugucuuuuugcugguagauuauuugcuuaacacagguuuuauuauuauuacuguuuaagugau

SEQ ID NO: 74915 - RNA, 64 nt, Homo Sapiens
uagauuuagacaaauguuaauaaguucuugcuggagguuuuaaagggaugauaaauuacacuuu

SEQ ID NO: 74916 - RNA, 64 nt, Homo Sapiens
aacuaaagaucauaauguugucuuguaauauauuuauuuacaaaacacuucauuauuuauaaag

SEQ ID NO: 74917 - RNA, 64 nt, Homo Sapiens
cgcaacagaaucucuguggcccacaaggcuaaaauauuuacauucucacccauuacagaaaaag

SEQ ID NO: 74918 - RNA, 64 nt, Homo Sapiens
ucauaggcucaagauuguacaaagucaccucuacuauuuacacaauuuaacccagaaccagagu

SEQ ID NO: 74919 - RNA, 64 nt, Homo Sapiens
aauuauuuuauguaauccucuaguuuacaaagcauauuuacaccugcauuuguguaguacuuua

SEQ ID NO: 74920 - RNA, 64 nt, Homo Sapiens
acaaguuaccuaccacauuucacuuuaguguaccuauuuacagaaagauuaaacugccaccugc

SEQ ID NO: 74921 - RNA, 64 nt, Homo Sapiens
uggucuuuucauggcauaugagcaaauaauaaacuauuuacacuacuauucuguaauauguugu

SEQ ID NO: 74922 - RNA, 64 nt, Homo Sapiens
uuucccacugauaguugauuuuugaggcaucuaauauuuacauauuugccuucugaacuuuguu

SEQ ID NO: 74923 - RNA, 64 nt, Homo Sapiens
uugccuucugaacuuuguuuugaccuguauccuuuauuuacauuggguuuuucuuucguaguuu

SEQ ID NO: 74924 - RNA, 64 nt, Homo Sapiens
cuagcauauaggaaauauuuauauaauuaguuuauauuuacacagggccaaaggcacauuaugu

SEQ ID NO: 74925 - RNA, 64 nt, Homo Sapiens
ugggagaaaugucuauuuaguuuagcuccugagauauuuacaacuuauuaaaaauugauagaau

SEQ ID NO: 74926 - RNA, 64 nt, Homo Sapiens
aaugaaguagcugacacauauaacacagcaagaguauuuacagguuuauuucuugccauauuua

SEQ ID NO: 74927 - RNA, 64 nt, Homo Sapiens
aauucauauauccaggcaacuaaccaacagaaguuauuuacagauguuguuguuuuaacauguu

SEQ ID NO: 74928 - RNA, 64 nt, Homo Sapiens
gaauuccaauuucauuucugcuguaguccuuuauuauuuacacucuuuggcugcuagaacucau

SEQ ID NO: 74929 - RNA, 64 nt, Homo Sapiens
uauacuccuuuggcugcuagaugugaagagugacuauuuacaugagcuacuuuagaaauagaaa

SEQ ID NO: 74930 - RNA, 64 nt, Homo Sapiens
uuauaaaaugacuuaaaaaugguacauugaggaguauuuacauuaaaaaagaaagaacaugggu

SEQ ID NO: 74931 - RNA, 64 nt, Homo Sapiens
cggaaacuccucggcugcuugguuuuacagauacuauuuacaggugggcuucccagccgcucac

SEQ ID NO: 74932 - RNA, 64 nt, Homo Sapiens
aagccauuguugagaauuagauuaaauggagcauuauuuacaaagaagaaaacauuuuguuuuu

SEQ ID NO: 74933 - RNA, 64 nt, Homo Sapiens
uugcuaaccuaguuuguuacuuuccuucugaaaauauuuacauuugauggcuccugcagcacuu

SEQ ID NO: 74934 - RNA, 64 nt, Homo Sapiens
aaauguuaaugagauguauuuauuugaaguaauuuauuuacagguccacccuuuuaaaaauuau

SEQ ID NO: 74935 - RNA, 64 nt, Homo Sapiens
uugguuucugcaauauuuuuuauaacaauuauuauauuuacaauuuucaaucaaacauuuccua

SEQ ID NO: 74936 - RNA, 64 nt, Homo Sapiens
uuaggaugcaauuacgaguguaaacugugugccuuauuuacacuuuauugucucccgcuucuca

SEQ ID NO: 74937 - RNA, 64 nt, Homo Sapiens
guacaguggaauaucuuagauacuuuuuggaaaguauuuacauaaguuauaucacaauuaaaau

SEQ ID NO: 74938 - RNA, 64 nt, Homo Sapiens
aucuuaccuugcaguuauugacuuuauauucaauuauuuacaucaaauaaugaaauaacugaaa

SEQ ID NO: 74939 - RNA, 64 nt, Homo Sapiens
aauacaaauuuaaaaaccaauacaguauaacaacuauuuacauagugcuuacauuguauuaggu

SEQ ID NO: 74940 - RNA, 64 nt, Homo Sapiens
ugcuuuagaaaaaaaauucaaauuuauaguaguauauuuacauuuuuguuguuguuguuguucu

SEQ ID NO: 74941 - RNA, 64 nt, Homo Sapiens
ugggauuacaggcaugagccacugcaccuggcuauauuuacauuuaauagaaacauaucuagca

SEQ ID NO: 74942 - RNA, 64 nt, Homo Sapiens
uggccccucaagcaccguuaauuuacauuccaguuauuuacaugauaauucaugacauucugaa

SEQ ID NO: 74943 - RNA, 64 nt, Homo Sapiens
ucauguggacucagaaaaaccucauuaauaucacuauuuacaacgcugccacauagacuuuguu

SEQ ID NO: 74944 - RNA, 64 nt, Homo Sapiens
uuaucuucuuaauuuuaggucuaaaauaacacaguauuuacaugccagauuacuguacuguagg

SEQ ID NO: 74945 - RNA, 64 nt, Homo Sapiens
ccucuaucaugcaaaaaaaugguuuauggaacuuuauuuacacucucauaagcauauguauacu

SEQ ID NO: 74946 - RNA, 64 nt, Homo Sapiens
gucauuuaggauccaugcagaccuggaguggaucuauuuacauauugugcuuacaauauuuuug

SEQ ID NO: 74947 - RNA, 64 nt, Homo Sapiens
guauuaagcccacaguauauuacuucuucuguaauauuuacaauaaauuacuauagcaaaguag

SEQ ID NO: 74948 - RNA, 64 nt, Homo Sapiens
aagaacucaccaggguuuagaagacaggagagauuauuuacaagauuaguaagaucucuuucua

SEQ ID NO: 74949 - RNA, 64 nt, Homo Sapiens
aacuuagcaaacuuuugaaucuuucuuuuauugcuauuuacacauacauacacacauacaaaac

SEQ ID NO: 74950 - RNA, 64 nt, Homo Sapiens
ucuuuauacuauuuuacaguaaccacaaucuaaauauuuacauauacccaaaauuaacuuaugc

SEQ ID NO: 74951 - RNA, 64 nt, Homo Sapiens
auauauauuguucuuuucagugguuuauucaucauauuuacaguaagauucuuauagcuacauu

SEQ ID NO: 74952 - RNA, 64 nt, Homo Sapiens
aauuccacauaucagugauauuuggagagaaaacuauuuacaaauuugaacauuuuucuaauga

SEQ ID NO: 74953 - RNA, 64 nt, Homo Sapiens
uaaauagauuagugggaaaaaacuagaagacagauauuuacauuacaaaaacaugaaggacucc

SEQ ID NO: 74954 - RNA, 64 nt, Homo Sapiens
ccaaagcaauucuacugacacucugaaguaaacauauuuacaaucauccacucugacugauuuc

SEQ ID NO: 74955 - RNA, 64 nt, Homo Sapiens
cuguaaauaagagcuuuuguacuagcccaguauuuauuuacauugcuuuguaauauaaaucugu

SEQ ID NO: 74956 - RNA, 64 nt, Homo Sapiens
aauuagaagauaaugagagaauuaaugggguuuauauuuacauuaucucucaacuauguagccc

SEQ ID NO: 74957 - RNA, 64 nt, Homo Sapiens
gugauaaacauaacuugccaacagucucuaugcuuauuuacaucuucuacuguucaaacuaaga

SEQ ID NO: 74958 - RNA, 64 nt, Homo Sapiens
auauuguccaaaaggaaugcuguucuuaaagcauuauuuacaguaggaacuggggaguaaaucu

SEQ ID NO: 74959 - RNA, 64 nt, Homo Sapiens
uuuuucauuuuauuucguauaaaaaaauuaaacauauuuacauauagaaagauuuuuugcuaag

SEQ ID NO: 74960 - RNA, 64 nt, Homo Sapiens
cauauuacugaacucaguguauuauuauuauuauuauuuacaguaagaagaauugggucuuuuu

SEQ ID NO: 74961 - RNA, 64 nt, Homo Sapiens
auaugacuaauuuggggaaacuuugaaaagagaauauuuacaauacuuaacuaguuaucagauc

SEQ ID NO: 74962 - RNA, 64 nt, Homo Sapiens
gaguuauuuuuuguauugauaaauauauauuauauauuuacaagaauauauucaaauuauguau

SEQ ID NO: 74963 - RNA, 64 nt, Homo Sapiens
ucugauaaauauuaaaucauauugcuaucauguauauuuacacaacuauuuacaaguuuuaaaa

SEQ ID NO: 74964 - RNA, 64 nt, Homo Sapiens
uuuuaaaaauugcuaucauguuuguaaggccaacuauuuacaaguauuuacaguguguuguaau

SEQ ID NO: 74965 - RNA, 64 nt, Homo Sapiens
guguuguaauuuuguaaggcaugugggaaggauuuauuuacaguaaucauguaguuuguauaaa

SEQ ID NO: 74966 - RNA, 64 nt, Homo Sapiens
agcaaaacuuuuaaauauuuuagcccuuuuuauauauuuacacagagggagggaggaggaauac

SEQ ID NO: 74967 - RNA, 64 nt, Homo Sapiens
cuuaagacauauuagcaaguauuauugccgucauuauuuacauacggugugguaguaguugaaa

SEQ ID NO: 74968 - RNA, 64 nt, Homo Sapiens
aaugcauaaaaguauaauugaaaucugugguauuuauuuacaaacaugucuacaaaaauagauu

SEQ ID NO: 74969 - RNA, 64 nt, Homo Sapiens
guagaacucuguuacacauauuuuugacccauauuauuuacaaugucuugauaauucuaccuuu

SEQ ID NO: 74970 - RNA, 64 nt, Homo Sapiens
uucacucaucuaaaaaguaugcaucuuuaggauauauuuacauuugaaaaaaaucugccaaaua

SEQ ID NO: 74971 - RNA, 64 nt, Homo Sapiens
aauaggaugaucuacaagaaaugcucuucuucaauauuuacaauaaguuauauauaguuuggca

SEQ ID NO: 74972 - RNA, 64 nt, Homo Sapiens
uuagaauauugauuucuugaauuugauaauuuauuauuuacagccauaauuuguuuagugcuac

SEQ ID NO: 74973 - RNA, 64 nt, Homo Sapiens
uuuugccuuuuagugauauuuuuguaacuaugaauauuuacauauguacuuucaauuauguagc

SEQ ID NO: 74974 - RNA, 64 nt, Homo Sapiens
uuuaauuuaguuuacagaauaaaggcauaugcaauauuuacauucuauccuguacauuucacaa

SEQ ID NO: 74975 - RNA, 64 nt, Homo Sapiens
cucagaugucucugcucuccaacgccuuuuauucuauuuacaaguguagguacuucacauugca

SEQ ID NO: 74976 - RNA, 64 nt, Homo Sapiens
ucuuuaagauugagcuaaauuaucuaccauugccuauuuacaggauaaguacauucaggacaau

SEQ ID NO: 74977 - RNA, 64 nt, Homo Sapiens
uuuuuacugauuuuauuguguuguugguaacuaguauuuacagcuaaccuaucuauucauauuu

SEQ ID NO: 74978 - RNA, 64 nt, Homo Sapiens
aggugaacagcaaaaucaaggggccaagcccaucuauuuacaaacgcuuugauauauuccugga

SEQ ID NO: 74979 - RNA, 64 nt, Homo Sapiens
cauacuagaauuuuuauuucuuauuugucuuauauauuuacagcuauaaaccaugugaccucau

SEQ ID NO: 74980 - RNA, 64 nt, Homo Sapiens
uguuuuaaaaguugcacuaucuuaauguugaaaauauuuacaagggaacuguuuuacgugaagu

SEQ ID NO: 74981 - RNA, 64 nt, Homo Sapiens
uaauuuuaaauauuguuaguuuuaauauuccugauauuuacaaauauucauucuuauauacaau

SEQ ID NO: 74982 - RNA, 64 nt, Homo Sapiens
cuaguucagagccaagccuuucaaaucugguccauauuuacauugaaaagaaaguguuuuauuu

SEQ ID NO: 74983 - RNA, 64 nt, Homo Sapiens
aaaugaagauuacccucaaacuuagguaaccuuauauuuacaauucuaaacaaaauugcaauuu

SEQ ID NO: 74984 - RNA, 64 nt, Homo Sapiens
aaucaauugucuauauggaauuuaggauaaagaauauuuacaauaaagaauauuuacaauaaag

SEQ ID NO: 74985 - RNA, 64 nt, Homo Sapiens
ggaauuuaggauaaagaauauuuacaauaaagaauauuuacaauaaagaguuuauuauuauuug

SEQ ID NO: 74986 - RNA, 64 nt, Homo Sapiens
agaauuaauuggcuauauggaauuuaggauagaauauuuacaauaaagaguauuuacaauaaag

SEQ ID NO: 74987 - RNA, 64 nt, Homo Sapiens
auggaauuuaggauagaauauuuacaauaaagaguauuuacaauaaagaguuuguuauuauuug

SEQ ID NO: 74988 - RNA, 64 nt, Homo Sapiens
aaaaaaccuuaaacauagucugcuuaaggucucuuauuuacaaaagaccaugcagucaaugcau

SEQ ID NO: 74989 - RNA, 64 nt, Homo Sapiens
uaugcccagccaguccuggugccagguggguucauauuuacagaugcuccucucugcggccagg

SEQ ID NO: 74990 - RNA, 64 nt, Homo Sapiens
cacuuuuaguaaggaaauuacuagcuuguguugcuauuuacauaugaauuacugauuauuuuga

SEQ ID NO: 74991 - RNA, 64 nt, Homo Sapiens
auuguacacacuuugcugaauauuuugucaguuguauuuacaaagaaagguacuuucuuaagag

SEQ ID NO: 74992 - RNA, 64 nt, Homo Sapiens
uuuuaguggaccacauuuuaugugauaggagggauauuuacauacaugagguuuaauuuauuuu

SEQ ID NO: 74993 - RNA, 64 nt, Homo Sapiens
gagaauaaagaagaaaagacucccaaggagcaaguauuuacauuaagaagcaaaacugcuggug

SEQ ID NO: 74994 - RNA, 64 nt, Homo Sapiens
auacugaauuuucagucauaaaagcuuuacuauuuauuuacauauuuauucauguucaugguac

SEQ ID NO: 74995 - RNA, 64 nt, Homo Sapiens
aaaucuuguauaugcaucuuuguugcuuauuacauauuuacacacacaaccacaaauuuuaaac

SEQ ID NO: 74996 - RNA, 64 nt, Homo Sapiens
uuugaaaccaggggaugcacugaggcacaaguuggcuguucauccaacacauagaucauauguc

SEQ ID NO: 74997 - RNA, 64 nt, Homo Sapiens
caagagucuugguagauaagguaacacuacuucugcuguucaauagaaaauuaccuuuugauuu

SEQ ID NO: 74998 - RNA, 64 nt, Homo Sapiens
uccuacggaguuacguacuauuguuuaguucacagcuguucagggugacagugagcagauccag

SEQ ID NO: 74999 - RNA, 64 nt, Homo Sapiens
gacauaaauacguacuugcaaagauuccagaugagcuguucaugugggccccuugcugacuaua

SEQ ID NO: 75000 - RNA, 64 nt, Homo Sapiens
cagccaagaaaaauugcacagauaguguauauaagcuguucauucuguacagugaauuuuccga

SEQ ID NO: 75001 - RNA, 64 nt, Homo Sapiens
uauguaacaucuccugaggguguuuaguugcauggcuguucagaaagguauuaagggcuuaggc

SEQ ID NO: 75002 - RNA, 64 nt, Homo Sapiens
auuguuucugcuucugaaauuaaaacuugagcaggcuguucagcgagugagaagacaguuuauu

SEQ ID NO: 75003 - RNA, 64 nt, Homo Sapiens
acugaaccuuguaggaaauuugauuugaaguggagcuguucagaucacugugaggauucuauac

SEQ ID NO: 75004 - RNA, 64 nt, Homo Sapiens
gaaaaacaaauguuaccaaguuacuguauacaaagcuguucauacucaagaccucaaaauugag

SEQ ID NO: 75005 - RNA, 64 nt, Homo Sapiens
accaugccuagcucauuuaauagcugucaccauagcuguucaucuccaaccucagccugccaag

SEQ ID NO: 75006 - RNA, 64 nt, Homo Sapiens
aaaaucuaguuuaauacugcauuauuuauuuuccuaaggcuaaagaggagcaguccuaugcuuu

SEQ ID NO: 75007 - RNA, 64 nt, Homo Sapiens
ggggagaucuacaauuugaauauguguuacuuaauaaggcuaggcuggccaucaguugcuuauu

SEQ ID NO: 75008 - RNA, 64 nt, Homo Sapiens
aacaauggcugguucuagcccugagugacagucuuaaggcuagauccuucccauaguaucaucu

SEQ ID NO: 75009 - RNA, 64 nt, Homo Sapiens
ugucgcaugcaugaggcggggcuggugaagcuguuaaggcuaaauguggcaaacagggccgagg

SEQ ID NO: 75010 - RNA, 64 nt, Homo Sapiens
caacccuccccacgucuuccucauucuaccucucuaaggcuauggcacugaggaguauuucccc

SEQ ID NO: 75011 - RNA, 64 nt, Homo Sapiens
cuuauuuugugcugccagaagacacaagaucaaauaaggcuaugacgucaauggugagcugaug

SEQ ID NO: 75012 - RNA, 64 nt, Homo Sapiens
ugcagucugcccuccugcucugugauccugccauuaaggcuaugcuuuucucuuugccuuuuuu

SEQ ID NO: 75013 - RNA, 64 nt, Homo Sapiens
augaugugugcuaaaauuuuacacagcuauccaguaaggcuaucccaaauacuuuuuguuuuua

SEQ ID NO: 75014 - RNA, 64 nt, Homo Sapiens
acuugcuuuucuaacuaagagggcauuuccaaguuaaggcuaagacuccaugguggaaguuaaa

SEQ ID NO: 75015 - RNA, 64 nt, Homo Sapiens
cauugagcuauauugguuuuagaugcaagaccuauaaggcuaguuaugagaaaggucagcaaac

SEQ ID NO: 75016 - RNA, 64 nt, Homo Sapiens
auuugaggaauauaacuaauuggaauuucauuaauaaggcuaaaaucuuauuuuauaauacuuu

SEQ ID NO: 75017 - RNA, 64 nt, Homo Sapiens
ggguuuuuuggggggggaguuggcggggaggaaauaaggcuaacagagguugaccuaaaauuag

SEQ ID NO: 75018 - RNA, 64 nt, Homo Sapiens
ccuacccaggaaaggauugauguuuuccggcugauaaggcuaacuuuauuuaucuaaaaguaag

SEQ ID NO: 75019 - RNA, 64 nt, Homo Sapiens
auuuauuaaugauuuuuuucaacucauuuauaauuaaggcuaucaugaucugcauuuugccaga

SEQ ID NO: 75020 - RNA, 64 nt, Homo Sapiens
guacuacaaaagagacuauccgaaaacugaaaaauaaggcuaguagcaacuuagaguaaaaauu

SEQ ID NO: 75021 - RNA, 64 nt, Homo Sapiens
gauagggaaaggguggaugcgcuuccuucaucucuaaggcuaaguugucuuucaagugaaacca

SEQ ID NO: 75022 - RNA, 64 nt, Homo Sapiens
ggaggagacucauuuuaaccugccaggaagagaguaaggcuagaauccuuuugaacacuaauga

SEQ ID NO: 75023 - RNA, 64 nt, Homo Sapiens
gcaaucuggucuauagacuuuuaacucaagaagcuaaggcuagacuuguuaccuucguugaaug

SEQ ID NO: 75024 - RNA, 64 nt, Homo Sapiens
aaaacuuguauucauaauguguauaauuuccugguaaggcuaacuccugaucguuucuguagaa

SEQ ID NO: 75025 - RNA, 64 nt, Homo Sapiens
gaggacacugaggccccacaaggccucaucuccuuaaggcuagugccugaggucacuguauagg

SEQ ID NO: 75026 - RNA, 64 nt, Homo Sapiens
gaauaaaaacgucuauaauuacaaggaguuuuguuaaggcuaauacaaugacagacugagcaaa

SEQ ID NO: 75027 - RNA, 64 nt, Homo Sapiens
guccagcuguauuuacuucucaacagacagcuuuuaaggcuaaccaccucagacuuuucauuca

SEQ ID NO: 75028 - RNA, 64 nt, Homo Sapiens
guaggagccagagagcuguaucccucuuggccgcuaaggcuaagguggaccacagagggcccaa

SEQ ID NO: 75029 - RNA, 64 nt, Homo Sapiens
ugacaaccagugguacuauuacagagauauaagauaaggcuacuuuucauuuuaaauaauacuu

SEQ ID NO: 75030 - RNA, 64 nt, Homo Sapiens
uuaggcccugcacuccaccugugccuuuggagguuaaggcuaggagcuguucuccccaccccag

SEQ ID NO: 75031 - RNA, 64 nt, Homo Sapiens
auugggggugaugaauggggcauuagugguugccuaaggcuagauacaaaaaauacuuuccgua

SEQ ID NO: 75032 - RNA, 64 nt, Homo Sapiens
cagaggugcaagccagaggcaauguaauaugcuguaaggcuagugcagaugggagcuuuuuaga

SEQ ID NO: 75033 - RNA, 64 nt, Homo Sapiens
auuguaucuuuuaagaaaacugauuuacauuuuguaaggcuauaaauaacaauguuaauauuuu

SEQ ID NO: 75034 - RNA, 64 nt, Homo Sapiens
gaaguuuugugcauuaaucuaucauauaugacauuaaggcuacauaucuucuagaucucuuuuu

SEQ ID NO: 75035 - RNA, 64 nt, Homo Sapiens
uuaagacugccuccuucucacauuacacaccuucuaaggcuaugucacccugagauauuuagaa

SEQ ID NO: 75036 - RNA, 64 nt, Homo Sapiens
acuuaacauucauagaggggacuaacuugacuuuuaaggcuaaagugagagaaagugugagcaa

SEQ ID NO: 75037 - RNA, 64 nt, Homo Sapiens
gcugugcucaccuuuuccugcuuugugccuugauuaaggcuacugacccuaaauuucugaagca

SEQ ID NO: 75038 - RNA, 64 nt, Homo Sapiens
auuuuaauuuuagacuacuugaaaaggccccuaauaaggcuagaggucuaagucccccaccccu

SEQ ID NO: 75039 - RNA, 64 nt, Homo Sapiens
agccguaggaggcucuucaguugggccccaaggauaaggcuacugauuugauacuaaaugaauc

SEQ ID NO: 75040 - RNA, 64 nt, Homo Sapiens
aacuggacuauccaauagguugccaccagccacauaaggcuauuuaaauuaauucaaauuaaau

SEQ ID NO: 75041 - RNA, 64 nt, Homo Sapiens
caucgaaaagaacaugggccacagagcuaagaaauaaggcuaacuaacguuagaauagugguua

SEQ ID NO: 75042 - RNA, 54 nt, Homo Sapiens
uacuuaauaaucacucuugucuuauaaggcuagcucaaagaucauaacucuuga

SEQ ID NO: 75043 - RNA, 64 nt, Homo Sapiens
uucuuuucacuguugugcucuacaaaauagauuuuaaggcuaacguuguacaacagaacacuug

SEQ ID NO: 75044 - RNA, 64 nt, Homo Sapiens
guuuagccaguaagauuuaaaacugaaaacauguuaaggcuauaauuuuuucuucccaggauca

SEQ ID NO: 75045 - RNA, 64 nt, Homo Sapiens
aauacauucucaucuuauaacuacaucuuauaaauaaggcuaauaacccuuagaacaccaccug

SEQ ID NO: 75046 - RNA, 64 nt, Homo Sapiens
aauccucugggauuggccgacugugagcugcagauaaggcuaucagccaccaaagagcaaugaa

SEQ ID NO: 75047 - RNA, 64 nt, Homo Sapiens
uuugcaauaucuucuggcuguuaauaaaaauauguaaggcuauauauuuuucuuuaaauaaagc

SEQ ID NO: 75048 - RNA, 64 nt, Homo Sapiens
cuccacaggacggacauuuuagaguuuaaauuauuaaggcuaucauucuuuuaguaaugucaua

SEQ ID NO: 75049 - RNA, 64 nt, Homo Sapiens
uauggagaugauacgguguuaaaaaaaaucaugguaaggcuacaauacucaaguaacaagguuu

SEQ ID NO: 75050 - RNA, 64 nt, Homo Sapiens
cugaacuugcagcugccuauagcauucuccuccauaaggcuagaggagagcuggauauaagcag

SEQ ID NO: 75051 - RNA, 64 nt, Homo Sapiens
aauuugaagcaacuccuugcuucuaauagauuuguaaggcuauuagcucucugccaucgaugua

SEQ ID NO: 75052 - RNA, 64 nt, Homo Sapiens
gauuguaaugggcuccuacuuguuuucagcauuuuaaggcuagaacuuauugucacacugugua

SEQ ID NO: 75053 - RNA, 64 nt, Homo Sapiens
caucuucaaagacguuuuccuccuagcuccacucuaaggcuaagcccuuggcuguaguugccuu

SEQ ID NO: 75054 - RNA, 64 nt, Homo Sapiens
ugauagaggguuauuuacucacaggggugcaauuuaaggcuaugaauauuaaugcaguauugca

SEQ ID NO: 75055 - RNA, 64 nt, Homo Sapiens
cagagggucgcacuuggacuauggugacuggaacuaaggcuacacuuaguucuugcuacacagg

SEQ ID NO: 75056 - RNA, 64 nt, Homo Sapiens
aacuaucaggugucuauaaucugcaaguuaugucuaaggcuagggugcagcagaguggcugaug

SEQ ID NO: 75057 - RNA, 64 nt, Homo Sapiens
uauucauaccacacugaaaugaacaacugaagaauaaggcuaagaaccaauaaaauauuucucu

SEQ ID NO: 75058 - RNA, 64 nt, Homo Sapiens
ucacgugccauacuccaccuguacacaauuacuguaaggcuaauauaaugacuaaacauacuau

SEQ ID NO: 75059 - RNA, 64 nt, Homo Sapiens
ggaauauccuuccugguucucaauauuuacuucuuaaggcuagcuagaaaguuauauuuauauu

SEQ ID NO: 75060 - RNA, 64 nt, Homo Sapiens
cuucaguuuuucuuuguaagugcagcauuuuucuuaaggcuaugugcucuucauagacacaucu

SEQ ID NO: 75061 - RNA, 64 nt, Homo Sapiens
cauguggguacugugucaucacaaaaucucucaguaaggcuauaugugauccucauuuugccuc

SEQ ID NO: 75062 - RNA, 64 nt, Homo Sapiens
aguuugcaugacuuucuggaggcauggaguuagguaaggcuacaugagaaauugagcuuuucca

SEQ ID NO: 75063 - RNA, 64 nt, Homo Sapiens
ugaagaguuacauaagcauuugaaugcucuaauauaaggcuaaugauuuucuguuaguguuuga

SEQ ID NO: 75064 - RNA, 64 nt, Homo Sapiens
caacuucucucuguauaggccucugaaauaucaauaaggcuaaauauuacuuuacacaguaaga

SEQ ID NO: 75065 - RNA, 64 nt, Homo Sapiens
cgauguaauucuuacuccuauuuuuaaaugcucuuaaggcuauugaaguuuaagaugccuugac

SEQ ID NO: 75066 - RNA, 64 nt, Homo Sapiens
uuuuggaaucauuaaacuugucuccagaaguuuuuaaggcuacaggaggucauuuaucugaguc

SEQ ID NO: 75067 - RNA, 64 nt, Homo Sapiens
acauuuaagaucuuguuuaaucauucauuaauguuaaggcuaauaugacugcaauaacaaugau

SEQ ID NO: 75068 - RNA, 64 nt, Homo Sapiens
gagggaguugacugcaggcaguuuuuaggccagauaaggcuagaucuuccugcaaugcacuugc

SEQ ID NO: 75069 - RNA, 64 nt, Homo Sapiens
aaggguggagggcagggaauggggccugagguauuaaggcuaagaggugggggacagggcccau

SEQ ID NO: 75070 - RNA, 64 nt, Homo Sapiens
agugccuugcagucuuugcccacuauacauaggcuaaggcuaagcucuuuguacuacugcaaac

SEQ ID NO: 75071 - RNA, 64 nt, Homo Sapiens
gcaugcaucacuucugcauuggaacagugggaauuaaggcuacuuuucuguauuuuucuuuucu

SEQ ID NO: 75072 - RNA, 64 nt, Homo Sapiens
uucauuuccagaaguagcaauuucaacauacuucuaaggcuaaaagcaaaucauaaacaguagu

SEQ ID NO: 75073 - RNA, 64 nt, Homo Sapiens
uaucaacuauucuaaauacagguaaugguauauuuaaggcuaccauaacauccuauuuagaggg

SEQ ID NO: 75074 - RNA, 64 nt, Homo Sapiens
gggcguuguguuuuacacaaaaccauuuuugaauuaaggcuaugauauuaagauagaaauuugg

SEQ ID NO: 75075 - RNA, 64 nt, Homo Sapiens
uugaaaguaugaaauguguugcuucugaguuauauaaggcuacuucaugacaagacugcuuugu

SEQ ID NO: 75076 - RNA, 64 nt, Homo Sapiens
auguugagagcucagaccaccacuuuacuacuccuaaggcuaaggugugccguggacgaguggc

SEQ ID NO: 75077 - RNA, 64 nt, Homo Sapiens
aauaacuggugcgcucccuuggcucauuuucccauaaggcuaaagggcuggcuuaggagcaagu

SEQ ID NO: 75078 - RNA, 64 nt, Homo Sapiens
ggacaucugcacaggacaguuuugguccccaaauuaaggcuauucuuuccaauggccgggggca

SEQ ID NO: 75079 - RNA, 64 nt, Homo Sapiens
agguuuuuaaacacuaaaauauauaauuuauaguuaaggcuaaaaaguauauuuauugcagagg

SEQ ID NO: 75080 - RNA, 64 nt, Homo Sapiens
guuaguuauacauauuagaagcauauuugccuaguaaggcuaguagaaccacauuucccaaagu

SEQ ID NO: 75081 - RNA, 64 nt, Homo Sapiens
uucagaacuuuguauuuucgaagggcacuucuuuuaaggcuacugauauugcuaugucaaagca

SEQ ID NO: 75082 - RNA, 64 nt, Homo Sapiens
cuuuuguugaauguauuugacuuaguucuuauuuuaaggcuaaaaaaacuuugucauauuuaag

SEQ ID NO: 75083 - RNA, 64 nt, Homo Sapiens
augcagaaaaggacuugugguuuuguuuuuaugcuaaggcuaguguacuagauguacuuuuucu

SEQ ID NO: 75084 - RNA, 64 nt, Homo Sapiens
aauaaggguuaucuuuaaguuuagaggcuacgaauaaggcuaugccgucucuugagcaugguuu

SEQ ID NO: 75085 - RNA, 64 nt, Homo Sapiens
aacacccugcugaagcucuucugacauauuucccuaaggcuaacuauaagaauguauagacaag

SEQ ID NO: 75086 - RNA, 64 nt, Homo Sapiens
auugauauuuaugacaauaauugcuacuugaguguaaggcuaauuauagaaacaucauucgaua

SEQ ID NO: 75087 - RNA, 64 nt, Homo Sapiens
acauggaaaaacaacuuagaagagaaauauuguuuaaggcuagccagugucacaaguacagaag

SEQ ID NO: 75088 - RNA, 64 nt, Homo Sapiens
uguaaaacacaagacugucacauaaaggagcauauaaggcuaaauauaugcuuugcagagaacu

SEQ ID NO: 75089 - RNA, 64 nt, Homo Sapiens
auacucuuccuaugaagagggaaugcguaugaauuaaggcuacuacugucacagaagaucauag

SEQ ID NO: 75090 - RNA, 64 nt, Homo Sapiens
acaggagaggaggugauguacacuuagagguaacuaaggcuaguuugaaaaccgugaauuaaga

SEQ ID NO: 75091 - RNA, 64 nt, Homo Sapiens
uuuuggucauuugacaucaggugcuuuagugcccuaaggcuaaaugugcuucaaaagggcaaau

SEQ ID NO: 75092 - RNA, 64 nt, Homo Sapiens
caaugaauguuuguacucagucacaaauuuacuguaaggcuaauggauuuaggaaguuuugauc

SEQ ID NO: 75093 - RNA, 64 nt, Homo Sapiens
cagcucugugugauucaaguucuggcagagcuuguaaggcuagagcccaggucugccgacaccc

SEQ ID NO: 75094 - RNA, 64 nt, Homo Sapiens
aaaagguagaagccacaguaaacuuccugggagcuaaggcuacuuuccuacuuuauauaagggc

SEQ ID NO: 75095 - RNA, 64 nt, Homo Sapiens
aaauacauucccuguuaucuaacuuuaacugaacuaaggcuaccaaauugaggauuaccaauua

SEQ ID NO: 75096 - RNA, 64 nt, Homo Sapiens
uugaagucuagaaugaaagacugaaacaaaagguuaaggcuagggcugcucuguuagacuggug

SEQ ID NO: 75097 - RNA, 64 nt, Homo Sapiens
uagaauuggguuaggugagaaagaaaguuaagguuaaggcuagaguugucuuuaaggguuaggg

SEQ ID NO: 75098 - RNA, 64 nt, Homo Sapiens
ugggagaguaccuguucaauagguaacuugauaauaaggcuaagccauucagaagaaauaaauu

SEQ ID NO: 75099 - RNA, 62 nt, Homo Sapiens
uuuguacaguguucaagugaauaaaaaccaugccuaaggcuagcucugaugugguucuuugg

SEQ ID NO: 75100 - RNA, 64 nt, Homo Sapiens
cugagaguucugaguccaaaggguguacguugcauaaggcuagagaccgcuuuuccuccuuucc

SEQ ID NO: 75101 - RNA, 64 nt, Homo Sapiens
guccuuuguuccuucauguaagaaaccugcuuuuuaaggcuauugacuacauuucuagaguuag

SEQ ID NO: 75102 - RNA, 64 nt, Homo Sapiens
ugcuuaauaaaucuucuguaaggauuuuagaugauaaggcuacaauucagaaucuucugaacca

SEQ ID NO: 75103 - RNA, 64 nt, Homo Sapiens
agccgaaugugccccauuguuuucuacgucuauuuaaggcuagguacaugcaucuguaauacag

SEQ ID NO: 75104 - RNA, 64 nt, Homo Sapiens
uguuccugacauauaguaggaguauacugaauucuaaggcuagcgggguaggggugggccacca

SEQ ID NO: 75105 - RNA, 64 nt, Homo Sapiens
cuccaaggcucugcaccaugccacacacuugcuguaaggcuagaagugaagaccuuauuaauag

SEQ ID NO: 75106 - RNA, 64 nt, Homo Sapiens
aauuaaauaauucaaacaucaaauaacuucaauuuaaggcuauggacuuugagauaauucugag

SEQ ID NO: 75107 - RNA, 64 nt, Homo Sapiens
ugcuuucaauuuauugucuugcuucauuaaaauguaaggcuaaggagagcauggaauuugucag

SEQ ID NO: 75108 - RNA, 64 nt, Homo Sapiens
ggacagagcugaauaggaaagacuugcuauugccuaaggcuaugugugacacccuccugaggac

SEQ ID NO: 75109 - RNA, 64 nt, Homo Sapiens
uccaguuuuguugagaauuguuuucuuacauuacuaaggcuaauaaugagauguaacucaugaa

SEQ ID NO: 75110 - RNA, 64 nt, Homo Sapiens
accugcuuuguugggguaugccucacguguacuauaaggcuagugaugccucauuccucaguuu

SEQ ID NO: 75111 - RNA, 64 nt, Homo Sapiens
aaacaugcauagcuauuuuuaucacucuaaucaguaaggcuacuaucuagacucgaaugcuuuc

SEQ ID NO: 75112 - RNA, 64 nt, Homo Sapiens
aauaauacucauaaugucucauuuuagugacuccuaaggcuaguccuuuuauaaacaacuuuuu

SEQ ID NO: 75113 - RNA, 64 nt, Homo Sapiens
uguacaacgacucugccucuaucuugcuauguacuaaggcuacccccugaaucuucuacugaac

SEQ ID NO: 75114 - RNA, 64 nt, Homo Sapiens
ccaugauuguaugaaguuuuaaaaaaaacuacagcagccaaagaaacuauauauauauauauau

SEQ ID NO: 75115 - RNA, 64 nt, Homo Sapiens
ugucugggaauaucauagaguaacaagugcuggucagccaaagaaacauucacugcuggugaac

SEQ ID NO: 75116 - RNA, 64 nt, Homo Sapiens
aaaugcugggauuacaggcaugagccacuguacccagccaaaauuguuuucuuuuuuaagugaa

SEQ ID NO: 75117 - RNA, 64 nt, Homo Sapiens
uggagcuuacagucuguucuggggaacagagauucagccaaagucaagaaacacuggaugccag

SEQ ID NO: 75118 - RNA, 64 nt, Homo Sapiens
uucugguguuauucugucuccucuucuuugucaucagccaaaacgugguuuuuaaagagaguca

SEQ ID NO: 75119 - RNA, 64 nt, Homo Sapiens
auccuaguguuccuauagugaaauaaguaggguucagccaaagcuuucuuuguuuuguaccuua

SEQ ID NO: 75120 - RNA, 64 nt, Homo Sapiens
cuucacagauggcuucucacagaugcccuccugccagccaaaccggacuuguucuuccugccuc

SEQ ID NO: 75121 - RNA, 64 nt, Homo Sapiens
gagaauuaguguguuauguggauaauguuauauacagccaaaguggauguuucuauuuggcaag

SEQ ID NO: 75122 - RNA, 64 nt, Homo Sapiens
gaacgggcagccacaggacugagcccucucacuccagccaaagaaaugggccugccugccucca

SEQ ID NO: 75123 - RNA, 64 nt, Homo Sapiens
cagaagaagugggagcagcuucuugggcugagugcagccaaaggggagccagaaaugggcaguu

SEQ ID NO: 75124 - RNA, 64 nt, Homo Sapiens
uccuuuuuacaauuugugauugcuaugccgaaugcagccaaaaugcucacucagauuguccguu

SEQ ID NO: 75125 - RNA, 64 nt, Homo Sapiens
ucaaaacaguuaaucucccuuauuuugggugguucagccaaaccuuuagcggaaacuacuaaau

SEQ ID NO: 75126 - RNA, 64 nt, Homo Sapiens
ccuccuguagcaguagggcccccagccagcgcuccagccaaagcggcggccccaggguuaauug

SEQ ID NO: 75127 - RNA, 64 nt, Homo Sapiens
uugcggcuggcaggcaggauguuuugaaauggugcagccaaaggccccgucuagcuuggcuggc

SEQ ID NO: 75128 - RNA, 64 nt, Homo Sapiens
cuaucugguaauaaaauuucgacucugggagacucagccaaaucgguggggcacccccaaauuu

SEQ ID NO: 75129 - RNA, 64 nt, Homo Sapiens
ugcagucggaaaagaugcagauuuguaggaaaugcagccaaagguguucuuuuuacauaaagga

SEQ ID NO: 75130 - RNA, 64 nt, Homo Sapiens
guuuagaaacacucagucucacagcaccucaguccagccaaaauggccuucauggaggguggua

SEQ ID NO: 75131 - RNA, 64 nt, Homo Sapiens
gcuucucaacccuagacaaagcagugagaccacccagccaaauuggugggcucuguuuaggagg

SEQ ID NO: 75132 - RNA, 64 nt, Homo Sapiens
ccugacagcagggucugcccaggccuccugacaccagccaaaaugagggaucccugcacccagg

SEQ ID NO: 75133 - RNA, 64 nt, Homo Sapiens
cuucauccggcaccuucuggugacaucucagaaucagccaaagauuugacucuccuuucuggga

SEQ ID NO: 75134 - RNA, 64 nt, Homo Sapiens
ccuggcacccccagggugaccugagugccugggucagccaaaccgaguggggcugaaggccagg

SEQ ID NO: 75135 - RNA, 64 nt, Homo Sapiens; identical to SEQ ID NO: 73323

SEQ ID NO: 75136 - RNA, 64 nt, Homo Sapiens; identical to SEQ ID NO: 73324

SEQ ID NO: 75137 - RNA, 64 nt, Homo Sapiens; identical to SEQ ID NO: 73325

SEQ ID NO: 75138 - RNA, 64 nt, Homo Sapiens; identical to SEQ ID NO: 73326

SEQ ID NO: 75139 - RNA, 64 nt, Homo Sapiens; identical to SEQ ID NO: 73327

SEQ ID NO: 75140 - RNA, 64 nt, Homo Sapiens; identical to SEQ ID NO: 73328

SEQ ID NO: 75141 - RNA, 64 nt, Homo Sapiens; identical to SEQ ID NO: 73329

SEQ ID NO: 75142 - RNA, 64 nt, Homo Sapiens; identical to SEQ ID NO: 73330

SEQ ID NO: 75143 - RNA, 64 nt, Homo Sapiens; identical to SEQ ID NO: 73331

SEQ ID NO: 75144 - RNA, 64 nt, Homo Sapiens; identical to SEQ ID NO: 73332

SEQ ID NO: 75145 - RNA, 64 nt, Homo Sapiens; identical to SEQ ID NO: 73333

SEQ ID NO: 75146 - RNA, 64 nt, Homo Sapiens; identical to SEQ ID NO: 73334

SEQ ID NO: 75147 - RNA, 64 nt, Homo Sapiens; identical to SEQ ID NO: 73335

SEQ ID NO: 75148 - RNA, 64 nt, Homo Sapiens; identical to SEQ ID NO: 73336

SEQ ID NO: 75149 - RNA, 64 nt, Homo Sapiens; identical to SEQ ID NO: 73337

SEQ ID NO: 75150 - RNA, 64 nt, Homo Sapiens; identical to SEQ ID NO: 73338

SEQ ID NO: 75151 - RNA, 64 nt, Homo Sapiens; identical to SEQ ID NO: 73339

SEQ ID NO: 75152 - RNA, 64 nt, Homo Sapiens; identical to SEQ ID NO: 73340

SEQ ID NO: 75153 - RNA, 64 nt, Homo Sapiens; identical to SEQ ID NO: 73341

SEQ ID NO: 75154 - RNA, 64 nt, Homo Sapiens; identical to SEQ ID NO: 73342

SEQ ID NO: 75155 - RNA, 64 nt, Homo Sapiens; identical to SEQ ID NO: 73343

SEQ ID NO: 75156 - RNA, 64 nt, Homo Sapiens; identical to SEQ ID NO: 73344

SEQ ID NO: 75157 - RNA, 64 nt, Homo Sapiens
accugcgaaagcugucaacuuuugugguuguagcaaguauuaauaaauauuuauaaauccucua

SEQ ID NO: 75158 - RNA, 64 nt, Homo Sapiens
gucuagcuaccuauccaauacuaaauaccccuuaaaguauuaaaugcacuaucugcuguaaaag

SEQ ID NO: 75159 - RNA, 64 nt, Homo Sapiens
uuugaguuccauuuuauaauuuuucucuauuauaaaguauuaauuacauauaagcaguaguacu

SEQ ID NO: 75160 - RNA, 64 nt, Homo Sapiens
uucuaaaagaaauaggaggcgcagcaagcuuauuaaguauuauuguaguaaaaacaucaaagau

SEQ ID NO: 75161 - RNA, 64 nt, Homo Sapiens
guaguucuuugagauaguugcuuaugcauauaguaaguauuacauucuuagaguagagcagagu

SEQ ID NO: 75162 - RNA, 64 nt, Homo Sapiens
cucauuaacacuuacauuuccauaaagaaaacucaaguauuaauaaaagagacuuuacuggcuu

SEQ ID NO: 75163 - RNA, 64 nt, Homo Sapiens
uugaauggaaaagcacuugcuaguaggaauccggaaguauuagagcucuuaauguauuccuuuu

SEQ ID NO: 75164 - RNA, 64 nt, Homo Sapiens
agcuucauuucauauaaacaguacugcuguagaaaaguauuaaucuuggccuuccuggugugca

SEQ ID NO: 75165 - RNA, 64 nt, Homo Sapiens
guaccaugaaauauccagaacauacuuauauguaaaguauuauuuauuugaaucuacaaaaaac

SEQ ID NO: 75166 - RNA, 64 nt, Homo Sapiens
gugccuugguuucuccuuuauuucuaaguggaaaaaguauuagccaccaucuuaccucacagug

SEQ ID NO: 75167 - RNA, 64 nt, Homo Sapiens
uguguuugauuuuaaaagggguauuauacagauaaaguauuacaagaacaagacauacuucaau

SEQ ID NO: 75168 - RNA, 64 nt, Homo Sapiens
auuaacugacuucagaaguaaugaaauuucuuuaaaguauuacuuuuauacuguacuuauugga

SEQ ID NO: 75169 - RNA, 64 nt, Homo Sapiens
uuaacucuuagaaguguuguaaaagaugcagaguaaguauuaugccccaguucagaaauuuggc

SEQ ID NO: 75170 - RNA, 64 nt, Homo Sapiens
aauacuuucugacagucaccugagccuuaaauguaaguauuacaugacaugcauucuguuucuu

SEQ ID NO: 75171 - RNA, 64 nt, Homo Sapiens
aagaacuuguccagaagaaaaaccuguuaaauucaaguauuaaaauuuuuagaucaaaaaggca

SEQ ID NO: 75172 - RNA, 64 nt, Homo Sapiens
uaaaaguauucccaguaugugugcagcaugaagaaaguauuagugcuucucaguguucucagug

SEQ ID NO: 75173 - RNA, 64 nt, Homo Sapiens
gguauuauacuguauaacccuacaaaauacauagaaguauuauuugccuucauaauagaaccca

SEQ ID NO: 75174 - RNA, 64 nt, Homo Sapiens
gguuuuuuuuauugauauaaauauuuuucaauagaaguauuagauucauguuguuauguaauca

SEQ ID NO: 75175 - RNA, 64 nt, Homo Sapiens
aaucaccucugcaaaaauucaauuagcugcaaagaaguauuaaugagagaaaaauuaaagcuaa

SEQ ID NO: 75176 - RNA, 64 nt, Homo Sapiens
gaccaucuaccugccuuauacuacacuuaggaaaaaguauuacauaugguuuauuuugaaacuu

SEQ ID NO: 75177 - RNA, 64 nt, Homo Sapiens
aaaaaguauuacauaugguuuauuuugaaacuucaaguauuauugccuuaaugucucuuaaccc

SEQ ID NO: 75178 - RNA, 64 nt, Homo Sapiens
auuauggugcuacugagcguuauguauuucuuuuaaguauuaccgcaguuaaaauguucuaucu

SEQ ID NO: 75179 - RNA, 64 nt, Homo Sapiens
cuaccaaagacacacucagguaauaaugcugaaaaaguauuagcuagauaaacaugaaugugau

SEQ ID NO: 75180 - RNA, 64 nt, Homo Sapiens
aaaaauccaccuuucucuaaucccauuagguuauaaguauuacacauaaaacuacaaaauaaag

SEQ ID NO: 75181 - RNA, 64 nt, Homo Sapiens
uagcauucaugcauauuggggaguugauuugaggaaguauuacuuaaaguggcuguuaaaaagg

SEQ ID NO: 75182 - RNA, 64 nt, Homo Sapiens
aagcuucuguguuugucuaaaaaaagaaaaugaaaaguauuauuaauuguccuuaugaaacaag

SEQ ID NO: 75183 - RNA, 64 nt, Homo Sapiens
uguaaacauauggguauuuuaggaaaauuguuuaaaguauuauacuaaaauuuuauuuuuaaaa

SEQ ID NO: 75184 - RNA, 64 nt, Homo Sapiens
aauaauauaugucuguauauacagaaaaaaauuaaaguauuauugggaauauuuuuuccuuaaa

SEQ ID NO: 75185 - RNA, 64 nt, Homo Sapiens
aacaauauuuugacucuauuaaauuuuagaagaaaaguauuacacuuggagaaguuuaaugaga

SEQ ID NO: 75186 - RNA, 64 nt, Homo Sapiens
cuuaacauaaugugucuuguagaauaguuauaaaaaguauuaguuucaaagauguuuuauuuuu

SEQ ID NO: 75187 - RNA, 64 nt, Homo Sapiens
aaauacuaaaacuacauguuaacauccaaauuuuaaguauuaugguuaauuuuacuaagaauaa

SEQ ID NO: 75188 - RNA, 64 nt, Homo Sapiens
guaacguauuguccuuccguaguuauuacacuaaaaguauuauauuuuucauaauucaaacaaa

SEQ ID NO: 75189 - RNA, 64 nt, Homo Sapiens
uuuauuaaauauaauguaaauacuggguaguuguaaguauuauuuuuguccuuguucuaggagu

SEQ ID NO: 75190 - RNA, 64 nt, Homo Sapiens
ucaacuuacuucaaaggcguugagaagaaacaacaaguauuaugguggagaaccauuaaaaauu

SEQ ID NO: 75191 - RNA, 64 nt, Homo Sapiens
uaauuaaguucaugauaguguaaguacagcuggaaaguauuaucggccuacgauccuucugauu

SEQ ID NO: 75192 - RNA, 64 nt, Homo Sapiens
gacugacucuguuauguaacucuucauuuauguuaaguauuaauaggucaaaaccaaaaugacc

SEQ ID NO: 75193 - RNA, 64 nt, Homo Sapiens
cuuggaacuuccaugauuauccacuuaaagaucaaaguauuauaugcugugugcuuuuuaggug

SEQ ID NO: 75194 - RNA, 64 nt, Homo Sapiens
ugggauuuauaaaccagcugugauuaacaauguaaaguauuaauuauugaacuuugaaccagau

SEQ ID NO: 75195 - RNA, 64 nt, Homo Sapiens
acuuuuucuugugugauucuuaacauuauagcacaaguauuaucucaguggauuauccggaaua

SEQ ID NO: 75196 - RNA, 64 nt, Homo Sapiens
aaaucuauaucgcuaguaaaggugaaggggaggaaaguauuaaagcuuguacaacaugguuugg

SEQ ID NO: 75197 - RNA, 64 nt, Homo Sapiens
gaaguuugcuguuuuuaaagaggugccuauuauaaaguauuacguacaucuaugguaguuuuug

SEQ ID NO: 75198 - RNA, 64 nt, Homo Sapiens
ggguggauugccucuaaggaccuucaccuagucaccuagucacagcuccuuucuggaccucagu

SEQ ID NO: 75199 - RNA, 64 nt, Homo Sapiens
uagucacaggguggauugccaccucaguccuucaccuagucaccuuaagauagcuccuuucugg

SEQ ID NO: 75200 - RNA, 64 nt, Homo Sapiens
gcucugaaaaugugucacauuuaugguuacuuucccuagucaauuuggccuuacagggcucuag

SEQ ID NO: 75201 - RNA, 64 nt, Homo Sapiens
gcucugaagaugugucacaucuaauuaugauuucccuagucaguaacacuugccuuacaaggcu

SEQ ID NO: 75202 - RNA, 64 nt, Homo Sapiens
auaauggcauaaaguuugggguuguucauauuaugaaccuaaaaucuaaagguuuuaucacuua

SEQ ID NO: 75203 - RNA, 64 nt, Homo Sapiens
uuauuuacaguagaugugguguuugagaugaaaagaaccuaacaaaguagacaagaauaaagug

SEQ ID NO: 75204 - RNA, 64 nt, Homo Sapiens
aaaaacaaaaauaacaucuuuuacauucuuggaaagucuauauguuucaugcaaauucuauauu

SEQ ID NO: 75205 - RNA, 64 nt, Homo Sapiens
caccaccucccuucauaacccugauaaucuuguuagucuauaccggcuguuuguuuuacagugu

SEQ ID NO: 75206 - RNA, 64 nt, Homo Sapiens
cuggaaauguuuauauuaaaacugauauaaggucagucuauauuuuaaaacggucucaaaaagu

SEQ ID NO: 75207 - RNA, 64 nt, Homo Sapiens
aaacuuagaugauauauaguguggaaaaugaaacagucuauaauugcauuuucuaguucugaaa

SEQ ID NO: 75208 - RNA, 64 nt, Homo Sapiens
acccuguucucuuucccuuuaaugaaaaaucaaucuuucuuaccgcauguaucacaagauaaga

SEQ ID NO: 75209 - RNA, 64 nt, Homo Sapiens
uaccacacuuuuuuuuaucuuuuuuucaaaauggcuuucuuacguaguuaugacugauaguggc

SEQ ID NO: 75210 - RNA, 64 nt, Homo Sapiens
uauauauauaauauuaaaaaggagaacaucugcacuuucuuauauccugaugccaagauuuuuu

SEQ ID NO: 75211 - RNA, 64 nt, Homo Sapiens
aucauggcacagauucuguaucauuuguggcuuucuuucuuaucgggaaacaaguugacauuug

SEQ ID NO: 75212 - RNA, 64 nt, Homo Sapiens
ggcaaaugauuuuauaaacaauggacaauauauacuuucuuaagaucuaagguacuuucuuaag

SEQ ID NO: 75213 - RNA, 64 nt, Homo Sapiens
auggacaauauauacuuucuuaagaucuaagguacuuucuuaagaucuaagaauuugcugaaag

SEQ ID NO: 75214 - RNA, 64 nt, Homo Sapiens
ucuuacccagugucagauaauuaauuacuaauuacuuucuuaaaaacaugaacuaugccagaau

SEQ ID NO: 75215 - RNA, 64 nt, Homo Sapiens
aaggagggcacccagcaccccggcgucucuggcccuuucuuauucuuuggcuccucauccaccg

SEQ ID NO: 75216 - RNA, 64 nt, Homo Sapiens
aaaccaauugauuuuauaauuuuuuaaauaauugcuuucuuaucaacauguauuuguauuaaac

SEQ ID NO: 75217 - RNA, 64 nt, Homo Sapiens
uucacauuguuuuuucugacaacccucaaaaauacuuucuuaaugcauagcuaugugaaaaaga

SEQ ID NO: 75218 - RNA, 64 nt, Homo Sapiens
auacccacauuucaauucuuaaccuuagugcuuucuuucuuaacaaaagauucaggcagcuuaa

SEQ ID NO: 75219 - RNA, 64 nt, Homo Sapiens
ucuugaaaauuuucuaauauuacagauuaaaagccuuucuuacaacuguaugagaaaauauuaa

SEQ ID NO: 75220 - RNA, 64 nt, Homo Sapiens
gguugcuuuagaguuggaguuuauuuguuuuuaucuuucuuaguuuucuuuagaguuggaauuu

SEQ ID NO: 75221 - RNA, 64 nt, Homo Sapiens
gguuucuuuagaguuggaauuuuuuuuuuuaaaccuuucuuagucuagcauaucaguuauacuu

SEQ ID NO: 75222 - RNA, 64 nt, Homo Sapiens
acgcaaccugaauugaaugaaccagcacggaagacuuucuuaaaaaaauugaacaaaacagggu

SEQ ID NO: 75223 - RNA, 60 nt, Homo Sapiens
gcacaaaacuacuuacucugagaagaacugcuuucuuauauuguuguacccccgauguaa

SEQ ID NO: 75224 - RNA, 64 nt, Homo Sapiens
uccuaaccccagaggcucccugcucucauuuuagcuuucuuaggguaagucccacgagccagcc

SEQ ID NO: 75225 - RNA, 64 nt, Homo Sapiens
uucauuauagaaaaaaccuguggcaaaaacguuucuuucuuauuuuuuuucuuuuccuaaaaca

SEQ ID NO: 75226 - RNA, 64 nt, Homo Sapiens
uuaagaauucuguacuuccaauuuauaaugaauacuuucuuagauuuuagguaggaggggagca

SEQ ID NO: 75227 - RNA, 64 nt, Homo Sapiens
uaauucuuaagucuuuugucugauuuuuaaaguacuuucuuauaaauuuggaucauguuaugau

SEQ ID NO: 75228 - RNA, 64 nt, Homo Sapiens
caagacaaaauaaaacucaccaucuccugaagaccuuucuuaccuuuuuuuaaaaacaaaaaau

SEQ ID NO: 75229 - RNA, 64 nt, Homo Sapiens
gauaaauagggacagggacaguuaaauugggagccuuucuuacaaccuugaugggauuuuuccc

SEQ ID NO: 75230 - RNA, 64 nt, Homo Sapiens
aauuauguguauauaaaucuuucuuacauaaggccuuucuuagguuaaaaucagaguaaguaug

SEQ ID NO: 75231 - RNA, 64 nt, Homo Sapiens
uaauucacugcagguuaagaccucagccaguucacuuucuuaggguugguugguaaugugccug

SEQ ID NO: 75232 - RNA, 64 nt, Homo Sapiens
ccaucucaaaaguuugggauuuuccuccucuuaacuuucuuaauauuuggacaugcaguugucg

SEQ ID NO: 75233 - RNA, 64 nt, Homo Sapiens
ugauacugaagacugccaaauacauaggaauuuucuuucuuaaaaaacaguaaugaagacuaua

SEQ ID NO: 75234 - RNA, 64 nt, Homo Sapiens
uguccuuacuuuaacuugaucuaauuauugcuuccuuucuuauuacuuuccuaauuuuucuaua

SEQ ID NO: 75235 - RNA, 64 nt, Homo Sapiens
cuuuccucucuaugaugugauaauacaguaaaagcuuucuuacccagcauagugggagagugga

SEQ ID NO: 75236 - RNA, 64 nt, Homo Sapiens
uagagagugacgacauggaaaaugaauuuaaccacuuucuuauuggguugucuugcuuucuuac

SEQ ID NO: 75237 - RNA, 64 nt, Homo Sapiens
augaauuuaaccacuuucuuauuggguugucuugcuuucuuacaugaacuuguuuuuuuaauca

SEQ ID NO: 75238 - RNA, 64 nt, Homo Sapiens
caaagcaacccaaaggcuuuucccuggaaaagcucuuucuuaccuaaagauaaaaccaauucac

SEQ ID NO: 75239 - RNA, 64 nt, Homo Sapiens
aucucuauauucuuucaaguaaccaagcuguugacuuucuuacuacuugcaguagccugucccc

SEQ ID NO: 75240 - RNA, 64 nt, Homo Sapiens
uacgugcgucaauauuguaaaaacccugccacugcuuucuuaacaaauuggagccaauccucuc

SEQ ID NO: 75241 - RNA, 64 nt, Homo Sapiens
aaauuugcuuucacuuaaaacuuuuauuccuuuacuuucuuaaccugccuauggaguagccguu

SEQ ID NO: 75242 - RNA, 64 nt, Homo Sapiens
uucccucauauuuucuugagaucaaacuuuacuucuuucuuauuuacuaagaauuugccuguuu

SEQ ID NO: 75243 - RNA, 64 nt, Homo Sapiens
agaacccaaggccacaaaucauaggcaugaagcacuuucuuaagacugaccuaacgcuggauua

SEQ ID NO: 75244 - RNA, 64 nt, Homo Sapiens
uguuuggaauaauauauauuuuuuaugcuuuugucuuucuuaccugauugauauuacauucacc

SEQ ID NO: 75245 - RNA, 64 nt, Homo Sapiens
uuaaaaguuuauuuuuacagaauauauuuaguaccuuucuuaaggaguaacugaauugaaucaa

SEQ ID NO: 75246 - RNA, 64 nt, Homo Sapiens
auuuaacuauuuuuauguuuauacuagguagggucuuucuuauguuucuguguuuuugguaugc

SEQ ID NO: 75247 - RNA, 64 nt, Homo Sapiens
auugggugguuuguaaccccuucagccuagccucucugcccauuuauuuccaaccccaacagac

SEQ ID NO: 75248 - RNA, 64 nt, Homo Sapiens
ccugacugacgccuuuugaugcucacgggaaauuucugcccaggaucucagccccaggcugguu

SEQ ID NO: 75249 - RNA, 64 nt, Homo Sapiens
ucccacacucaggccagcccgauucagggcugaaucugcccagucuccccaggugccccccggg

SEQ ID NO: 75250 - RNA, 64 nt, Homo Sapiens
acaggaagcugacccuggccccccaccaggggucucugcccagcucccaggguccagccugagc

SEQ ID NO: 75251 - RNA, 64 nt, Homo Sapiens
caccugucuccuucuuccugugcccuccagacugucugcccauaccaccucccaaacuccugcc

SEQ ID NO: 75252 - RNA, 64 nt, Homo Sapiens
uucccuucuucccaccugccuauccuguuuucugucugcccaccguccccuuccugucugccca

SEQ ID NO: 75253 - RNA, 64 nt, Homo Sapiens
uccuguuuucugucugcccacuguccccuuccugucugcccauaugucuuccugacccccgcuu

SEQ ID NO: 75254 - RNA, 64 nt, Homo Sapiens
uuucuaggcugggcuuggccauucccaccauuagucugcccaccuggccuucccuucucaggcu

SEQ ID NO: 75255 - RNA, 64 nt, Homo Sapiens
gggugcggcgcccccuugggacaagcccagcuccucugcccaagugucugccccacuccuucac

SEQ ID NO: 75256 - RNA, 64 nt, Homo Sapiens
uccaggucuuaguuucuuugacuuugaacacguuucugcccaucuccaguccuguggcugugug

SEQ ID NO: 75257 - RNA, 64 nt, Homo Sapiens
agcaccagaggucacucuccguaacugaagauguucugcccaccauucagacucuccugguugu

SEQ ID NO: 75258 - RNA, 64 nt, Homo Sapiens
guucuugcuauaaauaggucaggggaagcagcacucugcccaggccagcaacuugggcuaccuu

SEQ ID NO: 75259 - RNA, 64 nt, Homo Sapiens
ucggccucccaaaguucugguccugaccucguaaucugcccaccuggucaggcuggucucgaac

SEQ ID NO: 75260 - RNA, 64 nt, Homo Sapiens
cccugugacgucacacugcaccccuggggccccuucugcccaguugguggcugcuugccagggu

SEQ ID NO: 75261 - RNA, 64 nt, Homo Sapiens
ugccaucacaucccugauacgcccaaguauaggcucugcccagaggacuguuggaggagaguua

SEQ ID NO: 75262 - RNA, 64 nt, Homo Sapiens
aaccuguggagacaacccacaaggcaugugagcaucugcccagcaagcagagucaggagacccc

SEQ ID NO: 75263 - RNA, 64 nt, Homo Sapiens
cggccgcgaccccauuugggaggugaggagcaacucugcccagccgccccgucugagaagugag

SEQ ID NO: 75264 - RNA, 64 nt, Homo Sapiens
uggcaaccgccccgucugauaaguaaggagccccucugcccagcagccgccccgucugagaagu

SEQ ID NO: 75265 - RNA, 64 nt, Homo Sapiens
cagcagccgccccgucugagaagugaggagccccucugcccagcagccacccugucugggaagu

SEQ ID NO: 75266 - RNA, 64 nt, Homo Sapiens
ggccagccgccccguccgggaggugaggggcgccucugcccagcugccccuacugggaagugag

SEQ ID NO: 75267 - RNA, 64 nt, Homo Sapiens
auagaccucucaauuucuggaaaacugccuuuuaucugcccagaauucuaagcuggugccccac

SEQ ID NO: 75268 - RNA, 64 nt, Homo Sapiens
cucuaaggugggaucacuaagggauggggcagucucugcccaaacauaaagagaacucugggga

SEQ ID NO: 75269 - RNA, 64 nt, Homo Sapiens
cccccuaaccugccucuggccccaguucguuuccucugcccacuaaucccugcgcaggacuucc

SEQ ID NO: 75270 - RNA, 64 nt, Homo Sapiens
aucucuauggacaguuccguauagacucaacucaucugcccaaccaaguauguuccuccugaau

SEQ ID NO: 75271 - RNA, 64 nt, Homo Sapiens
gcaaagaugcuucaguccaguaccacaggacaacucugcccauauagcaaggcuuccuuguggg

SEQ ID NO: 75272 - RNA, 64 nt, Homo Sapiens
cuuugggcaugagaugcucacaaaggcuggaauaucugcccaugcaaucuaggccuugaagaaa

SEQ ID NO: 75273 - RNA, 64 nt, Homo Sapiens
gcugccgcgguggccccuagaugugugagccccuucugcccacacaagagccaugccuucucuc

SEQ ID NO: 75274 - RNA, 64 nt, Homo Sapiens
augcuaugacgugcgcuauggaagggcgccaucuucugcccaccgaggguggcuucuuugagga

SEQ ID NO: 75275 - RNA, 64 nt, Homo Sapiens
ugagggcaggaggccccugcggaggcagcguggaucugcccacacauaggcuacuggaauaguu

SEQ ID NO: 75276 - RNA, 64 nt, Homo Sapiens
uugcucuagggcaacccagggcagaggggccaggucugcccagcguuuaccacugcugucaagc

SEQ ID NO: 75277 - RNA, 64 nt, Homo Sapiens
cccuguggccucuuggagagcucagugccuccccucugcccagcgaggcuguucccuguccugc

SEQ ID NO: 75278 - RNA, 64 nt, Homo Sapiens
cuccccaacccacauaccucaagccauguccucaucugcccacccaguuuaacaccuuaaucuu

SEQ ID NO: 75279 - RNA, 64 nt, Homo Sapiens
ccugaugaccaagaccucuuuugaccccaacauuucugcccauccagagggaagaugaauacac

SEQ ID NO: 75280 - RNA, 64 nt, Homo Sapiens
auuacuuauccucaccuagccaaggcuugucuagucugcccaaaaagcgccucaccuuagcauu

SEQ ID NO: 75281 - RNA, 64 nt, Homo Sapiens
ugcucucccuccuuuccucucccuugagcuugguucugcccagcacucgugcuuguucacauaa

SEQ ID NO: 75282 - RNA, 64 nt, Homo Sapiens
gcaccuuacaaacagcagucugcucccaugacccucugcccacuuccauuggucuccaggcccc

SEQ ID NO: 75283 - RNA, 64 nt, Homo Sapiens
uuggccuuaaaaagugcuggcugaccccaggugaucugcccaccgccaggcuggucucaaauuc

SEQ ID NO: 75284 - RNA, 64 nt, Homo Sapiens
cugaaaguuccuacccuuuuacaagaauaaaggcucugcccaggcuuaucaccccugcugggug

SEQ ID NO: 75285 - RNA, 64 nt, Homo Sapiens
ccugaaugugugccuuaaaggggugcugguucacucugcccagcuacacugggcagaguuggca

SEQ ID NO: 75286 - RNA, 64 nt, Homo Sapiens
cggggcccagcugugauuuuaucaaggcaccuccucugcccacucccugggaggugagggccug

SEQ ID NO: 75287 - RNA, 64 nt, Homo Sapiens
gucaggguggucucaaacuccugaccugaggcgaucugcccaccucggccucccaaagugcugg

SEQ ID NO: 75288 - RNA, 64 nt, Homo Sapiens
uugguuuaauaguuaaaagcugcuguagauuuauucugcccacaacuuggggguccuuucugga

SEQ ID NO: 75289 - RNA, 64 nt, Homo Sapiens
gcguugagcguacgauggaggccuaccucucguuucugcccagcccucuguggccaggagcccu

SEQ ID NO: 75290 - RNA, 64 nt, Homo Sapiens
augccacagugguacucugugucuggcaggcuacucugcccaccccagcaucagcacagcucuc

SEQ ID NO: 75291 - RNA, 64 nt, Homo Sapiens
ucuuccugcccagcccccaacccagucucuggccucugcccaacgagccuggcugggcuugcaa

SEQ ID NO: 75292 - RNA, 64 nt, Homo Sapiens
gugcucuccagggaggggucagacguccuugugaucugcccagggugucacggaaggagauuuu

SEQ ID NO: 75293 - RNA, 64 nt, Homo Sapiens
uagggccacgcaggcaggggcgucaagggguuucucugcccaaggaagacagaacauggagaac

SEQ ID NO: 75294 - RNA, 64 nt, Homo Sapiens
cuuaagccaugacuagccugguggcguguuaguuucugcccaguucuacccccucaugugcuuc

SEQ ID NO: 75295 - RNA, 64 nt, Homo Sapiens
ccgcugcaaagguuaggacucauugauugcugcuucugcccaggagugucugugccuuggugac

SEQ ID NO: 75296 - RNA, 64 nt, Homo Sapiens
ucuggaaaacaacacacggucagcagagcugccaucugcccacgguguagguggguuguggggu

SEQ ID NO: 75297 - RNA, 64 nt, Homo Sapiens
guggcucugaggcagucugcgcuguggcccugccucugcccagcgagaggccgugggcucugga

SEQ ID NO: 75298 - RNA, 64 nt, Homo Sapiens
aggcgccuuccucuguccuuccugcucuuucuucucugcccaggccgcugcagcugcacagccu

SEQ ID NO: 75299 - RNA, 64 nt, Homo Sapiens
gcuguagacgucccccauaggucgccccagggccucugcccacccgagccccaccacucucaga

SEQ ID NO: 75300 - RNA, 64 nt, Homo Sapiens
aaaagcuccagcaggcgcugccuucacccacggaucugcccaggcugaaggcacacgcucaaug

SEQ ID NO: 75301 - RNA, 64 nt, Homo Sapiens
cagccccuucccuugcucggggaaagcccccaauucugcccacacccauuuauuuccuuccuuc

SEQ ID NO: 75302 - RNA, 64 nt, Homo Sapiens
ccuuccuuccuucuuuuuuguuuuugcccccaauucugcccauacccauuucuuucuuuccuuc

SEQ ID NO: 75303 - RNA, 64 nt, Homo Sapiens
cagaccacacacaucuggaacgcugugggcaucuucugcccaugggcuccauuuggcaccugcu

SEQ ID NO: 75304 - RNA, 64 nt, Homo Sapiens
uucuggucaguuucacacagaagucacgagggccucugcccaggaccuucuauucacauuucaa

SEQ ID NO: 75305 - RNA, 64 nt, Homo Sapiens
ugugugguucaucuuuuuuuuaggccccugccugucugcccaucugccccucacccacccgagg

SEQ ID NO: 75306 - RNA, 64 nt, Homo Sapiens
cugucugcccaucugccccucacccacccgaggcucugcccaccgccuggaccugcccaccccu

SEQ ID NO: 75307 - RNA, 64 nt, Homo Sapiens
ccugcccucacuccccagugggucagcuucuuccucugcccaguuggguugcagacacauugca

SEQ ID NO: 75308 - RNA, 64 nt, Homo Sapiens
ugaccuuuucagggguaacaggacacuguggagcucugcccagacagggagaaucugcaugugg

SEQ ID NO: 75309 - RNA, 64 nt, Homo Sapiens
ggggcuggggaaagggauggggagguucagacauucugcccagaccucgucaccacggucagga

SEQ ID NO: 75310 - RNA, 64 nt, Homo Sapiens
cccuuucuacuuucccugcccugaggauuacagcucugcccagggaacugaaggcugacaaguu

SEQ ID NO: 75311 - RNA, 64 nt, Homo Sapiens
ccccucgaagugggccgggccggccccaccugccucugcccagauuugcccuccuccugcucug

SEQ ID NO: 75312 - RNA, 64 nt, Homo Sapiens
caccugccucugcccagauuugcccuccuccugcucugcccaggagguggcguccagcagucca

SEQ ID NO: 75313 - RNA, 64 nt, Homo Sapiens
cugugguuagucaauggcuucacagaucuucacaucugcccauuaccaccaccaacaacaucaa

SEQ ID NO: 75314 - RNA, 64 nt, Homo Sapiens
gauccagcugcccuuccuuagaaagacaaacacaucugcccaaugacuauggcuugaguaggau

SEQ ID NO: 75315 - RNA, 64 nt, Homo Sapiens
cagcugacuuauguagauuuaagcugcuaauaugcuacuuaaccaucuauuaaugcaccauuaa

SEQ ID NO: 75316 - RNA, 64 nt, Homo Sapiens
ggacaaaaaaaaaaaaagccgauauaguagcuagcuacuuaagcauccauggguauugcuccau

SEQ ID NO: 75317 - RNA, 64 nt, Homo Sapiens
auggucacaaaaagcuacuguacugagaugucagcuacuuaaaaauuuguucauuccagaaaca

SEQ ID NO: 75318 - RNA, 64 nt, Homo Sapiens
ggugauuuucuguuacuuuuugucuuuuggaaaacuacuuaaagaacugagcugcugccuauag

SEQ ID NO: 75319 - RNA, 64 nt, Homo Sapiens
uuaguggucagaaauguauuuaauuaauuaguaucuacuuaaauaugaauuguuaauauggcag

SEQ ID NO: 75320 - RNA, 64 nt, Homo Sapiens
uugguagauauugaauggcuuuacugcuuuaauucuacuuaauugcuaaaaaaucacaauuuuu

SEQ ID NO: 75321 - RNA, 64 nt, Homo Sapiens
uggaaagacacgcccauguccagggaaucuccugcuacuuaauguuaagaaaaugccuuuuacu

SEQ ID NO: 75322 - RNA, 64 nt, Homo Sapiens
aaaugccuuuuacucagggaagccuggacacguccuacuuaagaacccccaggacugcugcugg

SEQ ID NO: 75323 - RNA, 64 nt, Homo Sapiens
cuccaaaugcuucuuccaguucauuuuucagccaucaguucaagagccaaugccuuuuuaaaau

SEQ ID NO: 75324 - RNA, 64 nt, Homo Sapiens
gauguauuuucaaauagaguucaggaucugcaauucaguucaacacaaguuuguugagcuuuaa

SEQ ID NO: 75325 - RNA, 64 nt, Homo Sapiens
uagcaauuuaaucaaguaauuuuauaaauaguugucaguucacaacaacagucuauugcauuga

SEQ ID NO: 75326 - RNA, 64 nt, Homo Sapiens
aaaauaauuuggucaaacaacaaaaacccacuugucaguucagucagccaagcaacugacaaau

SEQ ID NO: 75327 - RNA, 64 nt, Homo Sapiens
caagcaacugacaaaucaaaaacuaucgacuugaucaguucagcaguuggugaguuugucaagc

SEQ ID NO: 75328 - RNA, 64 nt, Homo Sapiens
gcccaugugauacugauugcagacaccuaauucuucaguucacuuguaagauacacuuuaagcc

SEQ ID NO: 75329 - RNA, 64 nt, Homo Sapiens
acucaugugauacugauuccagacaccuaauucuucaguucacuguuaagauaaacuguaaucc

SEQ ID NO: 75330 - RNA, 64 nt, Homo Sapiens
auccucugguuuuucuaaaggaguguggcccacaucaguucaacgagcuaugaaggcucccugg

SEQ ID NO: 75331 - RNA, 64 nt, Homo Sapiens
uagcccagcucugaacuuucucgauaaaaugccaucaguucaccuuuaaagacacacauuccuu

SEQ ID NO: 75332 - RNA, 64 nt, Homo Sapiens
gcagcuuaggaugcuauuuugagauguaugauauucaguucauucaccugauuacuuugguugc

SEQ ID NO: 75333 - RNA, 64 nt, Homo Sapiens
cugggugagaauugggacucuguugcuggucuucucaguucauuuccugagguggauuuacuga

SEQ ID NO: 75334 - RNA, 64 nt, Homo Sapiens
auggucucaguguuaauacugagaaaaaguccugucaguucagaaaaaaugugaagucuacuuu

SEQ ID NO: 75335 - RNA, 64 nt, Homo Sapiens
aacaaaaaucaccaauauccaagacaugaagauaucaguucaacaaauacuguaguuaagagac

SEQ ID NO: 75336 - RNA, 64 nt, Homo Sapiens
aauuuguaucaauacuauguuuugguuguaauauucaguucacucacccaauguacaaccaaug

SEQ ID NO: 75337 - RNA, 64 nt, Homo Sapiens
aagagauaaacgaccaaacucaguucgaccaaacucaguucaaaccauuucagccaaacuguag

SEQ ID NO: 75338 - RNA, 64 nt, Homo Sapiens
agguugucuguuuuuuuuuuuuuaaauaauugcaucaguucauugaccucaucauuaauaagug

SEQ ID NO: 75339 - RNA, 64 nt, Homo Sapiens
uaucacaccccaaguggauauuggugcagcuuuuucaguucagauuuggaccaauauccucaga

SEQ ID NO: 75340 - RNA, 64 nt, Homo Sapiens
aaauggacuggcaaugugauaccugcuguaacccucaguucaaaugugggcuacucagugcaga

SEQ ID NO: 75341 - RNA, 64 nt, Homo Sapiens
gggaggaugugugugugugcgauacuaaacaccaucaguucagaccaagaaagaaaauguuauc

SEQ ID NO: 75342 - RNA, 64 nt, Homo Sapiens
acuuugacaucauucagugaccuuguagaggaaaucaguucauuagcuggugugguugcaguga

SEQ ID NO: 75343 - RNA, 64 nt, Homo Sapiens
aaaggaaagaaacaaaacuuucgacuggauucugucaguucaaaauccaguggguaaaugagag

SEQ ID NO: 75344 - RNA, 64 nt, Homo Sapiens
gcauuaacuacaagugaacucaaaccacuuuggaucaguucacaugugccccaaguuggaugag

SEQ ID NO: 75345 - RNA, 64 nt, Homo Sapiens; identical to SEQ ID NO: 23154

SEQ ID NO: 75346 - RNA, 64 nt, Homo Sapiens; identical to SEQ ID NO: 23155

SEQ ID NO: 75347 - RNA, 64 nt, Homo Sapiens; identical to SEQ ID NO: 23156

SEQ ID NO: 75348 - RNA, 64 nt, Homo Sapiens; identical to SEQ ID NO: 23157

SEQ ID NO: 75349 - RNA, 64 nt, Homo Sapiens
gagagggucugcccugccucacuccccucuucagucccaguagacucugcucccuagcccugag

SEQ ID NO: 75350 - RNA, 64 nt, Homo Sapiens
ccucaaauuuauuuaccagucagcuucuugcuguucccaguagaaucgcuagcucuucuccaga

SEQ ID NO: 75351 - RNA, 64 nt, Homo Sapiens
caaaauaagcagcuugcuucugaaaugcugucuuucccaguagcuacucaccugccucuggugg

SEQ ID NO: 75352 - RNA, 64 nt, Homo Sapiens
aaguuacaggcuagcacaauaccuaacucauguuucccaguacaccuguagauauuacuguacu

SEQ ID NO: 75353 - RNA, 64 nt, Homo Sapiens
gcuucauuaaacccagaaagaauguucagaaagccuauuccaucaacugugaaagcuggggaau

SEQ ID NO: 75354 - RNA, 64 nt, Homo Sapiens
aagcagcaacuauucacaaaauaucaccaaaaaccuauuccacuuacauccaaggcacugucac

SEQ ID NO: 75355 - RNA, 64 nt, Homo Sapiens
aagaaaagugagccacaugcguagaggucuccggcuauuccagaaccuagagcuggagugagga

SEQ ID NO: 75356 - RNA, 64 nt, Homo Sapiens
gagcugggacauuuccccauccucuggggugaggcuauuccagcauuccccaagaacaaguuac

SEQ ID NO: 75357 - RNA, 64 nt, Homo Sapiens
gaaauuggccgaguucaaccauucacugcaaugccuauuccaaacuuuaaaucuaucuauugca

SEQ ID NO: 75358 - RNA, 64 nt, Homo Sapiens
agcgcacggcggcaaguuuucaagcacugaguuucuauuccaagaucauagacuuacuaaagag

SEQ ID NO: 75359 - RNA, 64 nt, Homo Sapiens
cagaauauacauuuuuuucagcaccacaccacaccuauuccaaaauugaccacauaguuggaag

SEQ ID NO: 75360 - RNA, 64 nt, Homo Sapiens
guacaaggaggagcugguacuauuccuucugaaacuauuccaaucaaugggaaaagagggaauc

SEQ ID NO: 75361 - RNA, 64 nt, Homo Sapiens
gggcacucaguacacauuccgucaggcccugcaucuauuccaagugugucuuuccauagucagg

SEQ ID NO: 75362 - RNA, 64 nt, Homo Sapiens
ucccugggacuuccugcucaguguccccuguucccuauuccaucugguggaagggaaagguggu

SEQ ID NO: 75363 - RNA, 64 nt, Homo Sapiens
ucuccauuguauuuaaaccaaaaugaacugauacuuguuggaauguaugugaacuaauugcaau

SEQ ID NO: 75364 - RNA, 64 nt, Homo Sapiens
gugucuccuuuuugccaagcacauucugauuuucuuguuggaacacaggucuaguuucuaaagg

SEQ ID NO: 75365 - RNA, 64 nt, Homo Sapiens
aaauacuacuacacuauuacgugaaagccuuucuuuguuggaucaauguuugccuugaaugggg

SEQ ID NO: 75366 - RNA, 53 nt, Homo Sapiens
accauccagagcuagugaccccauuguuggagcguguucuccgcgagaaguga

SEQ ID NO: 75367 - RNA, 64 nt, Homo Sapiens
accaaauauaaucccaaguauccucucuccuuccuuguuggagaugucuuaccucucagcuccc

SEQ ID NO: 75368 - RNA, 64 nt, Homo Sapiens
guguauuacugcaacuugaaucacucuuuuacuguuguuggauauaaacuuauccuguaccaau

SEQ ID NO: 75369 - RNA, 64 nt, Homo Sapiens
uaaacuaauuuguauggguuaaaguuaccuauuauuguuggaaauaguuagaugucuuauuauu

SEQ ID NO: 75370 - RNA, 64 nt, Homo Sapiens
agcuugcuuuaguuagauguaugcugucuuggucuuguuggaggccuaagccuuagaagaagag

SEQ ID NO: 75371 - RNA, 64 nt, Homo Sapiens
uuugagauuuauuuuaucucacagguuuguguaauuguuggaaaauuuuuaaacuucuaaguga

SEQ ID NO: 75372 - RNA, 64 nt, Homo Sapiens
cuuguuucucauuguaaagcuucaugucuuuuguuuguuggaaaauuuuuacuuauagaaacuu

SEQ ID NO: 75373 - RNA, 64 nt, Homo Sapiens
auguaaaccgccuccacgugccugccgaagugaauuguuggagaacguagucuuuuguauuuuc

SEQ ID NO: 75374 - RNA, 64 nt, Homo Sapiens
uaaacgacgauuugcugcugcaagauugacuaguuuguuggacuuuuguucggugccagccgac

SEQ ID NO: 75375 - RNA, 64 nt, Homo Sapiens
uuuuacaguguuuaagauagcaaauuuuucuaucuuguuggauuaaggaacuuaauuuuagagc

SEQ ID NO: 75376 - RNA, 64 nt, Homo Sapiens
cuuuguuccacuuuuuguuugccacugaccucuauuguuggagaaaagccacacaggaguaggu

SEQ ID NO: 75377 - RNA, 64 nt, Homo Sapiens
cgccaauagcaauaucuaggaaugauuuuuaaaguuguuggagauuuaagaccaagacuauuaa

SEQ ID NO: 75378 - RNA, 64 nt, Homo Sapiens
aaaauaguagauuuuaauuuagccguuucacuuuuuguuggagauuuuaucaacagcaaacuuc

SEQ ID NO: 75379 - RNA, 64 nt, Homo Sapiens
aagaggagagguugcuggagaacaagacgagagguuguuggagcgagguugcugagauuguugg

SEQ ID NO: 75380 - RNA, 64 nt, Homo Sapiens
aagacgagagguuguuggagagagguugcugagauuguuggaaccgccugaacgaagagcagga

SEQ ID NO: 75381 - RNA, 64 nt, Homo Sapiens
aagaggagaaguugcuggagagagguugcucagguuguuggagccaccugaaccaagagcagga

SEQ ID NO: 75382 - RNA, 65 nt, Homo Sapiens
ucaucuucaguugaaugcccucacuccaagacuggaugcuggaucucauagaaaauucacagcca

SEQ ID NO: 75383 - RNA, 65 nt, Homo Sapiens
acucacauaacuugauuauucacuccucugaaaagaugcuggauaggcuaccaaaguucccaagu

SEQ ID NO: 75384 - RNA, 65 nt, Homo Sapiens
aggugcuugaugaugaccaggagugugcucugggaaugcuggaggucccccugugccagauccuc

SEQ ID NO: 75385 - RNA, 65 nt, Homo Sapiens
uuuauggcucuagcugcguacugacuauaaaauagaugcuggacucugguugguaaggucccuuc

SEQ ID NO: 75386 - RNA, 65 nt, Homo Sapiens
guaacuguuaaaaugugaaagcuguauuugcuuaaaugcuggaaaguuuuaguccacuauauauu

SEQ ID NO: 75387 - RNA, 65 nt, Homo Sapiens
cuauacuguccagccaggacaagucauguguuugcaugcuggauggaggcugcgucaggcucuua

SEQ ID NO: 75388 - RNA, 65 nt, Homo Sapiens
guugaagagguguaagaagaacaggaaagguuuagaugcuggagagucuccagagcagacuucug

SEQ ID NO: 75389 - RNA, 65 nt, Homo Sapiens
cuuuguauuuuugaagcggcaaagugcuugacugcaugcuggaaaguguuuagcauucccuuguc

SEQ ID NO: 75390 - RNA, 65 nt, Homo Sapiens
acagcccucaccggugaauaaacauaagaaaaaucaugcuggagggaagcccuacacauguggca

SEQ ID NO: 75391 - RNA, 65 nt, Homo Sapiens
uuuaauugguccucaaugcuuaauaaauauaauucaugcuggagagaaacuucacaugugaaccg

SEQ ID NO: 75392 - RNA, 65 nt, Homo Sapiens
augguccucaacccuuaaugaacguaagugaauucaugcuggagcaaaaugcuucacaugcgaag

SEQ ID NO: 75393 - RNA, 65 nt, Homo Sapiens
cuguaccugccagcaggagcaugauggggacuuccaugcuggaauugcucccugauuaaaaugag

SEQ ID NO: 75394 - RNA, 65 nt, Homo Sapiens
ucucugcacacgcuagcucuccuucgccuucugccaugcuggaaguagccugaggcccucaccag

SEQ ID NO: 75395 - RNA, 65 nt, Homo Sapiens
cuuauucuuccaaacaguaucgcuaguaaaauagcaugcuggacuucagaccucagggauccuuu

SEQ ID NO: 75396 - RNA, 65 nt, Homo Sapiens
guggcagcuaaacauuaaauucgcaugaaccacagaugcuggagaucaccagaccggggagagaa

SEQ ID NO: 75397 - RNA, 65 nt, Homo Sapiens
gcgagugaguugcccauuaauuugugaugacuaaaaugcuggaaauuaggguuccugugauuaau

SEQ ID NO: 75398 - RNA, 65 nt, Homo Sapiens
ucuuugaaccauuucaagucggccauggaacacauaugcuggaaaaaauugaauuagcauaauug

SEQ ID NO: 75399 - RNA, 65 nt, Homo Sapiens
ggcgucacaccuguugaggagugggguggcuuugaaugcuggaaauggcuucauagugaagugcc

SEQ ID NO: 75400 - RNA, 65 nt, Homo Sapiens
cuucugcccuucucgguguccaggcuccuugggugaugcuggaguugucauggccgcaguucagu

SEQ ID NO: 75401 - RNA, 65 nt, Homo Sapiens
aacucccaagaaaccaggcaggcagaagcuccugaaugcuggacuagacaaacuacaugcuggcu

SEQ ID NO: 75402 - RNA, 65 nt, Homo Sapiens
caaacaaguagugaucaguuuauacuuugauauuuaugcuggaaauggauagaaguucaaucaga

SEQ ID NO: 75403 - RNA, 65 nt, Homo Sapiens
ggacucacauuggggcgaaugaaccaaguuucgccaugcuggaugaugaaauggauucccauccc

SEQ ID NO: 75404 - RNA, 65 nt, Homo Sapiens
gccucucacccuggaaaggaguugagggacaucagaugcuggaacccucacugaaaguccagaau

SEQ ID NO: 75405 - RNA, 65 nt, Homo Sapiens
gagcuccuagcaucagaggaguguuuggggacauuaugcuggaaauccaccccuuggugcuggca

SEQ ID NO: 75406 - RNA, 65 nt, Homo Sapiens
ucaugauuuuuacccucccuuuaaaccgagcacugaugcuggacuguaugucaccaauauaugau

SEQ ID NO: 75407 - RNA, 65 nt, Homo Sapiens
gaguguauguaugugaagaucacccagauuuuaucaugcuggaaaauauaugagggagaacgccu

SEQ ID NO: 75408 - RNA, 65 nt, Homo Sapiens
cuggaaggguucccuuguccuuaaugaagaggcccaugcuggagagauagagaacacaguggcua

SEQ ID NO: 75409 - RNA, 65 nt, Homo Sapiens
uuggauucuagcacuggguuccugagugguugaagaugcuggacacuggucucucagcaaacacu

SEQ ID NO: 75410 - RNA, 65 nt, Homo Sapiens
uggauauuuaauuuauguuuauguagcuguaacauaugcuggaauuauuacaauuaaaaauagug

SEQ ID NO: 75411 - RNA, 65 nt, Homo Sapiens
uguagaggguuuagucccgagggcuuaguaaaggaaugcuggauguccuagcucugggggcaaag

SEQ ID NO: 75412 - RNA, 65 nt, Homo Sapiens
agccuggaaggaggcaauaaagaccagaguuuaucaugcuggacaagaggaggcugugaaugcug

SEQ ID NO: 75413 - RNA, 65 nt, Homo Sapiens
cccagaggcacagccggggccugccuagcacucacaugcuggacaggucugggagaggcagagug

SEQ ID NO: 75414 - RNA, 65 nt, Homo Sapiens
uacacaagacuuuccccauacucugucucccuauaaugcuggagcggcuacuaaaaaggauaaaa

SEQ ID NO: 75415 - RNA, 65 nt, Homo Sapiens
ucacagggggcuuugcugaggugcgcucaauaaaaaugcuggaauugccgccccuccccgaugug

SEQ ID NO: 75416 - RNA, 65 nt, Homo Sapiens
aaccaggccuuucccgcuuucccaaaagcugggaaaugcuggaggaccacuaucucuugggagcc

SEQ ID NO: 75417 - RNA, 65 nt, Homo Sapiens
ccaguacuuuacccuuaauacacauaagauaauuaaugcuggagagaaacccuacaaaugugaag

SEQ ID NO: 75418 - RNA, 65 nt, Homo Sapiens
ccaauccucaacccuuacuacacauuagauaauucaugcuggagagaaacccuacaaaugugaaa

SEQ ID NO: 75419 - RNA, 65 nt, Homo Sapiens
gaaaucuuacaaaugucaucgacaucagagaauccaugcuggacauucacauucacaccucaaua

SEQ ID NO: 75420 - RNA, 65 nt, Homo Sapiens
gaaaccuuauaaaugucauguucaucaucgaacucaugcuggagaauaucguucauauauugcua

SEQ ID NO: 75421 - RNA, 65 nt, Homo Sapiens
gaaaucuuacaaaugucaucgacaucagagaauccaugcuggacauucacauucacaccucauua

SEQ ID NO: 75422 - RNA, 65 nt, Homo Sapiens
gaaaccuuauaaaugucauguucacuggugaacucaugcuggagaacaucguucaugccuugcau

SEQ ID NO: 75423 - RNA, 65 nt, Homo Sapiens
uugacccaccuugggauuuuguccuauaaagagccaugcuggaaugaccagguugucacuugcuu

SEQ ID NO: 75424 - RNA, 65 nt, Homo Sapiens
aagacauuccaaauauaacuaacaucagagaacucaugcuggagaaauguggaaggcauuccauc

SEQ ID NO: 75425 - RNA, 65 nt, Homo Sapiens
augucauuuuaaacauugguaggccuugguacaugaugcuggauuaccucucuuaaaaugacacc

SEQ ID NO: 75426 - RNA, 65 nt, Homo Sapiens
gagagucuggucauguggaggugggguuuauugggaugcuggagaagagcugccaggaaguguuu

SEQ ID NO: 75427 - RNA, 63 nt, Homo Sapiens
guaacucaguguuugcuugcgacuuauuuauaaauauuguaaguuugugucgaugaguguaag

SEQ ID NO: 75428 - RNA, 63 nt, Homo Sapiens
ugagcgagaaaaauguggauguacuguuuguauauauuguauauauuaaaacagagauaugug

SEQ ID NO: 75429 - RNA, 63 nt, Homo Sapiens
gggaauucaaauuuuucuaaacucaugguaaguauauuguaaaauacauauguacuaagaauu

SEQ ID NO: 75430 - RNA, 63 nt, Homo Sapiens
ugaguacccgcuugguuuuuuuuugguaauuaaauauuguaugauuuaucugguucaaggaag

SEQ ID NO: 75431 - RNA, 63 nt, Homo Sapiens
agauuuuggcacuauauuuaauuggaagguaaaauauuguacaugugauccagaguaaaugag

SEQ ID NO: 75432 - RNA, 63 nt, Homo Sapiens
aacaacacuuugucagugcuuuugaaccuuucaauauuguagcaugcuugaggaguuuuuccc

SEQ ID NO: 75433 - RNA, 63 nt, Homo Sapiens
cuugaaugugcaccugagggugcuuuguguaauauauuguacacuacagcaucuuauauuuuu

SEQ ID NO: 75434 - RNA, 61 nt, Homo Sapiens
uaaaaagcaguuugauguagagauauuuuaaauauuguacacuuugccuuuuugaguaaca

SEQ ID NO: 75435 - RNA, 63 nt, Homo Sapiens
uauucaagauguuacaaaauuuacauuuagaaaauauuguaguauuugaauacugucaacuug

SEQ ID NO: 75436 - RNA, 63 nt, Homo Sapiens
uuaaauuaauuuuaauaaauuauauaauuauacauauuguaaaauaaagaccgguauuuuauu

SEQ ID NO: 75437 - RNA, 63 nt, Homo Sapiens
ugcugaccacaaaguuucuggauguuuuauuaaauauuguacguguuuacaguugggaauuua

SEQ ID NO: 75438 - RNA, 63 nt, Homo Sapiens
augauugcuuucagauaacaagauaccaaucuuauauuguauuuugacugcucuaaaaugauu

SEQ ID NO: 75439 - RNA, 63 nt, Homo Sapiens
auugggaaaacaugagacuggucauauugaugaauauuguaacaugugaauugugauccauuu

SEQ ID NO: 75440 - RNA, 63 nt, Homo Sapiens
uuuuaacauuguaaaauuuugagucagauuuuaauauuguaaaaucuugggucaaauaauuca

SEQ ID NO: 75441 - RNA, 63 nt, Homo Sapiens
uuaaauauguaaauguuuuucaaaguugagguaauauuguauagaauuuuauagccuacauuu

SEQ ID NO: 75442 - RNA, 63 nt, Homo Sapiens
agcucuggcugccugucagcucccuuggauacuauauuguaugauuucuuccuuucccacuaa

SEQ ID NO: 75443 - RNA, 63 nt, Homo Sapiens
uuauugacugggagccugacugauguauuauauauauuguauacuguauucuuaaaguaagcu

SEQ ID NO: 75444 - RNA, 63 nt, Homo Sapiens
auuugggcuuuauuuuuuucuguguacuguacuauauuguaaaagggauuuuagcagagacuu

SEQ ID NO: 75445 - RNA, 63 nt, Homo Sapiens
ccagauggaagccuucuuuuucuccuuuaccucauauuguaauaaagcucugauuucugacuc

SEQ ID NO: 75446 - RNA, 63 nt, Homo Sapiens
ccuaucuguaugucugccuaauuaaaaaaauauauauuguauuaugcuaccugcauuuguuua

SEQ ID NO: 75447 - RNA, 63 nt, Homo Sapiens
aauacauugugcuauauguaaauguguaaauaaauauuguaauuuucucacaaagucugugaa

SEQ ID NO: 75448 - RNA, 63 nt, Homo Sapiens
uuuuguguaauuuucucuuaacugauugcucugauauuguaaacacaauagauguagcucuau

SEQ ID NO: 75449 - RNA, 63 nt, Homo Sapiens
cuuuuaccaugaauucuugaguuuacaucaauaauauuguauauuaaggggaucagaaguagg

SEQ ID NO: 75450 - RNA, 63 nt, Homo Sapiens
gcgaacagcacuauagcaaaagaagaucguuccauauuguacgccccauuaaauuacaguguu

SEQ ID NO: 75451 - RNA, 63 nt, Homo Sapiens
aguauagagacagacagcugaauggcuuucugcauauuguauaguauaccuagacauagaaac

SEQ ID NO: 75452 - RNA, 63 nt, Homo Sapiens
cauaaauauuucuggcuuuugaguaguguauuuauauuguauaucauacuuucaacuguagac

SEQ ID NO: 75453 - RNA, 63 nt, Homo Sapiens
gguauauucuuuaaaauaguguugauaacuggaauauuguauguaugcuuggagaugcuuugu

SEQ ID NO: 75454 - RNA, 63 nt, Homo Sapiens
aaacguagcccugugcuguaucauggccauaguauauuguaaccuuugucuaaucauuggauu

SEQ ID NO: 75455 - RNA, 63 nt, Homo Sapiens
ugaggagaaaacaauuccuuagaagucuuaaauauauuguacucuuuagaucucccaugugua

SEQ ID NO: 75456 - RNA, 63 nt, Homo Sapiens
uuaaagaaaauacuuauaaaacaugccuucuauauauuguaacauauauauacacacauauac

SEQ ID NO: 75457 - RNA, 63 nt, Homo Sapiens
gaaaauaucuucaagaaaagaucacuauagggaauauuguauauuuaugaauuuucuuugggg

SEQ ID NO: 75458 - RNA, 63 nt, Homo Sapiens
uuguaauuucaaccagaagucauauaguguuguauauuguaaacucaccuuuuauggucguag

SEQ ID NO: 75459 - RNA, 63 nt, Homo Sapiens
uaugugaugaaaaugcauuguguguacauaucuauauuguauaauuguucauucagaggguga

SEQ ID NO: 75460 - RNA, 63 nt, Homo Sapiens
auuaaacuuuaauaaaacuuaaaaagagauaaaauauuguaccuuuuguacuggcauuaacaa

SEQ ID NO: 75461 - RNA, 63 nt, Homo Sapiens
auguuaaacuucaauuccugcuuauugccgcuuauauuguacauugucagcagauaucaguaa

SEQ ID NO: 75462 - RNA, 63 nt, Homo Sapiens
ugauuuguaucguaugauuaaucuuuacaauuuauauuguaaaagcugugccagcacauguuc

SEQ ID NO: 75463 - RNA, 63 nt, Homo Sapiens
guaauuuuacuuuaaauuauuaucuuuauuuucauauuguacauguagauucuaacauuuaug

SEQ ID NO: 75464 - RNA, 63 nt, Homo Sapiens
aucacuugucuucuagagguuucucacgaucccauauuguauuguucagaauuacuuuugcuc

SEQ ID NO: 75465 - RNA, 63 nt, Homo Sapiens
acuuuggugcauuguuauuuugcagauguucaaauauuguaaaauaccagaaagcucuacauu

SEQ ID NO: 75466 - RNA, 63 nt, Homo Sapiens
uagagaaaaauuuucauugaucuguuaaugaucauauuguaugucauuccaaauaagaacuag

SEQ ID NO: 75467 - RNA, 63 nt, Homo Sapiens
guuauuauagggcuuuuggggaucaggacuauaauauuguacaauaaucgacuuuuuaaaugu

SEQ ID NO: 75468 - RNA, 63 nt, Homo Sapiens
aauaaugacucaaacggcccuuuuugucaaaguauauuguaauugauaugaaaugagauucua

SEQ ID NO: 75469 - RNA, 63 nt, Homo Sapiens
gcuggguuccaucaacaccccuaguucuacacaauauuguaaugagugagguauauuaggaga

SEQ ID NO: 75470 - RNA, 63 nt, Homo Sapiens
uccaggaugaacuaggagaaaaaugucucuuucauauuguaagguauugucuguugggcuggg

SEQ ID NO: 75471 - RNA, 63 nt, Homo Sapiens
uauggauuuuuuuauuguuuucucuuuuuuauaauauuguacagugaaugccaucuucuuccu

SEQ ID NO: 75472 - RNA, 63 nt, Homo Sapiens
uccuuacuguuuuaucuauugggauaugauauaauauuguauuagauauaguaucucugugcg

SEQ ID NO: 75473 - RNA, 63 nt, Homo Sapiens
uauuguuaaaugcaaaaaggauguauuuauuuuauauuguauagcaaauguccauuuguguaa

SEQ ID NO: 75474 - RNA, 63 nt, Homo Sapiens
uugugguuucucaguagagagcuauaugggacuauauuguagaauacuguguaucuaucauua

SEQ ID NO: 75475 - RNA, 63 nt, Homo Sapiens
uuuacuguagguuuucaaccaaauguaaacacuauauuguagacauaacacaaaccagugguc

SEQ ID NO: 75476 - RNA, 63 nt, Homo Sapiens
aauguaagcaaaggcucugaagaauuauguaauauauuguacauuaggaucugcaaacaauga

SEQ ID NO: 75477 - RNA, 63 nt, Homo Sapiens
gagcuguuaaaaaguauuauuauaagugaccguauauuguaaacucuauauuaacgcugguuu

SEQ ID NO: 75478 - RNA, 63 nt, Homo Sapiens
ccaguauaauuuucugacagaaaaauuuaggggauauuguaacuauaccaauaaaaagcauuu

SEQ ID NO: 75479 - RNA, 63 nt, Homo Sapiens
auugaauuuaaaacuucuaaaaauaacaggcaaauauuguagcuauauuacagugggauuuua

SEQ ID NO: 75480 - RNA, 63 nt, Homo Sapiens
caccugauuacuuugguugcagcacaacuguauauauuguauaaccgaaauugauuauuuuca

SEQ ID NO: 75481 - RNA, 63 nt, Homo Sapiens
uuacauauauaucaagugugcuuagaaaaauguauauuguaaagcaggugagcuucauuugau

SEQ ID NO: 75482 - RNA, 63 nt, Homo Sapiens
uagggaguagagacucauaucauggccuuuuaaauauuguaauaaaggcaaauagauauuugc

SEQ ID NO: 75483 - RNA, 63 nt, Homo Sapiens
agcccuucucguuucuuuuuuaaacuaaucaccauauuguaaauuucaggguuuuuuuuuuuu

SEQ ID NO: 75484 - RNA, 63 nt, Homo Sapiens
ggcaguaaauggaaaacaauacguaugucauggauauuguagguuuccuuaugcuguuuuuac

SEQ ID NO: 75485 - RNA, 63 nt, Homo Sapiens
acuauauaagacauuaagagaacaaagagugaaauauuguaaaugcuauuauacuguuaucca

SEQ ID NO: 75486 - RNA, 63 nt, Homo Sapiens
agauccccuaaacuugcauacccaguuuuuuggauauuguaauaaaaaaaaguauuaugacaa

SEQ ID NO: 75487 - RNA, 63 nt, Homo Sapiens
uaacuuaaauaauuuaagccaauaaauaauauuauauuguauuuaacccauuauuccucaccu

SEQ ID NO: 75488 - RNA, 63 nt, Homo Sapiens
ugaggcucaaugaaaccugacaaagagacuguaauauuguaguugcuccagaaugucaagggc

SEQ ID NO: 75489 - RNA, 63 nt, Homo Sapiens
auuauauguaacuuuguugcucuguauggcauaauauuguauccauaaacaugguaauuuuga

SEQ ID NO: 75490 - RNA, 63 nt, Homo Sapiens
auacagaauuucauggugauaucagaaauguaaauauuguacaguauugucauguacaagcgu

SEQ ID NO: 75491 - RNA, 63 nt, Homo Sapiens
cuucucuuuaauucccaccuaagccucuggguaauauuguaaauauuguuuuaaaaugcauca

SEQ ID NO: 75492 - RNA, 63 nt, Homo Sapiens
aguuuuauggcaugauuuauauauggcauauuuauauuguauauucuggaaaaaaaauauaua

SEQ ID NO: 75493 - RNA, 63 nt, Homo Sapiens
guuauuuuauaaauaugugcauauugucauaaaauauuguaugauuaauugauuuaaauaaug

SEQ ID NO: 75494 - RNA, 63 nt, Homo Sapiens
uuggaacuuccuuucagcucaagagguucagcuauauuguauuugugcaguguaaucacuacu

SEQ ID NO: 75495 - RNA, 63 nt, Homo Sapiens
accucugauuuuucacucaaguuugggcugauuauauuguaaugauguuagauaauacucaac

SEQ ID NO: 75496 - RNA, 63 nt, Homo Sapiens
auuuauuagccauaugcagaauuucuaaugaugauauuguacagcuucuaauucacuuuucag

SEQ ID NO: 75497 - RNA, 63 nt, Homo Sapiens
uaagucauuuuauauggaaaggcuuacaaaucaauauuguaagcauucauuauuuaagaaugu

SEQ ID NO: 75498 - RNA, 63 nt, Homo Sapiens
uuuuguaaaucucccauuuuuguaagaaaauauauauuguauuuauacauuuuuacuuuggau

SEQ ID NO: 75499 - RNA, 63 nt, Homo Sapiens
aauuaaacugggcaauagccuaagaaggggggaauauuguaacacaaauuuaaacccacuacg

SEQ ID NO: 75500 - RNA, 63 nt, Homo Sapiens
agaaggaaaaggcagggagcgagggagaagacuauauuguacacaccuuauauuuacguauga

SEQ ID NO: 75501 - RNA, 63 nt, Homo Sapiens
cuuguuuaggccacuaucauagauauauuucaaauauuguacuacucaguguuaaguauugaa

SEQ ID NO: 75502 - RNA, 63 nt, Homo Sapiens
auuauaacugggcaagcauggaaaaauacaauuauauuguaaauaaugaauaauaaguacaau

SEQ ID NO: 75503 - RNA, 63 nt, Homo Sapiens
uacuuacauauguaauuguugcaauguacagaaauauuguauaacugcccuaaaaugucucug

SEQ ID NO: 75504 - RNA, 63 nt, Homo Sapiens
acaguuuugaaaacagauuucaagcagauuucuauauuguauuaaugcuagacaaauaguuug

SEQ ID NO: 75505 - RNA, 63 nt, Homo Sapiens
auaaacauguuuuuuaacauuuccugauuguacauauuguaaagauaaugguuuuaaaauaug

SEQ ID NO: 75506 - RNA, 63 nt, Homo Sapiens
ucucacaacaauggcuaccuagcauauaauucuauauuguauugguaauaaaccuuaggaacu

SEQ ID NO: 75507 - RNA, 63 nt, Homo Sapiens
uuaauuuuuauuugcaauuauuauucaggcuauauauuguagcuguauuuguucuagucauuu

SEQ ID NO: 75508 - RNA, 63 nt, Homo Sapiens
uauuggaaguaauaucaaacauauguuuaauaaauauuguacuauguaacaaaacaacugaag

SEQ ID NO: 75509 - RNA, 63 nt, Homo Sapiens
uuguugcacacuauguaacauuguggcugcagaauauuguaaucuucauacucugcauauaau

SEQ ID NO: 75510 - RNA, 63 nt, Homo Sapiens
gcucagugauuaaauggguuauaaacccaauacauauuguacuagugugugugucuacacagg

SEQ ID NO: 75511 - RNA, 63 nt, Homo Sapiens
auuugaauauacagccuacugaaaaaauugaauauauuguagguguuguucaaaagauaauug

SEQ ID NO: 75512 - RNA, 63 nt, Homo Sapiens
aaaauccugaaacaaugggggauuguuuuuuguauauuguagcagcccagccacugucucaca

SEQ ID NO: 75513 - RNA, 63 nt, Homo Sapiens
agaugguacuugaauucuuuaacaguucuguuaauauuguacauuuaacacauuuucuugagu

SEQ ID NO: 75514 - RNA, 63 nt, Homo Sapiens
uuuucaaauuguuaucaauuguguuuuggaauaauauuguaccauuuuauacacccucaggca

SEQ ID NO: 75515 - RNA, 63 nt, Homo Sapiens
aauuuguuaaauucuaaacuaguauucaguguaauauuguauuagcuaaacuacugguuagaa

SEQ ID NO: 75516 - RNA, 63 nt, Homo Sapiens
guuuuuauugcuuguuggauaaaagacugaccaauauuguacaguuacacauuuuucagauau

SEQ ID NO: 75517 - RNA, 63 nt, Homo Sapiens
aagaaaauaaguuauaacuguuucuguauuuaaauauuguaaaacaaaauagcuggcgagugc

SEQ ID NO: 75518 - RNA, 58 nt, Homo Sapiens
auuuauauuuucagugaucuaauuguugauauuguauuuggagacacaccaaaaguaa

SEQ ID NO: 75519 - RNA, 63 nt, Homo Sapiens
uuuguaaauuuuggaaagauuaauacuauaaauauauuguauagcacugaaguugucugaagg

SEQ ID NO: 75520 - RNA, 63 nt, Homo Sapiens
guuaaacuguauuucugaugcggauucucuuuaauauuguacagaaaaagguuauacguacca

SEQ ID NO: 75521 - RNA, 63 nt, Homo Sapiens
uuuuuuaagucuucuugaagcuuuucuaauuggauauuguauuuacaaauguuuaaaauaugg

SEQ ID NO: 75522 - RNA, 63 nt, Homo Sapiens
ucuuuguacagagacaucuuacagugauuguacauauuguacagcuuugcacagcuugcacuu

SEQ ID NO: 75523 - RNA, 63 nt, Homo Sapiens
ucauagggcuuuuguuuauuuauaguguucugcauauuguaauuuuuuaugggaauucuuuua

SEQ ID NO: 75524 - RNA, 63 nt, Homo Sapiens
uauguauauaaauacauagacaucaacuuuucuauauuguaugauucaagccaauguuuuuug

SEQ ID NO: 75525 - RNA, 63 nt, Homo Sapiens
aagcauauguagcacuucaccagauggggcaacauauuguaugcaccuuuguauuuuuauuau

SEQ ID NO: 75526 - RNA, 63 nt, Homo Sapiens
aaaagacugaaacaaugcauaucgacucuaucaauauuguauaaugguaaaauaauagaaaug

SEQ ID NO: 75527 - RNA, 63 nt, Homo Sapiens
guaguauacuugguaagauaaacacuugaauuuauauuguaugcaucauucgaaucauccuua

SEQ ID NO: 75528 - RNA, 63 nt, Homo Sapiens
uccaccguacucugugaaucguguaccgguaauauauuguauuuuccauaagcuugcugaaua

SEQ ID NO: 75529 - RNA, 63 nt, Homo Sapiens
ugcacuuuuccauggaauaaauaugacauguuuauauuguaaaauuaugauuuguagcuucau

SEQ ID NO: 75530 - RNA, 63 nt, Homo Sapiens
uguucuuuuuuccauguaaaaauaaggauuaacauauuguaaaauugcgguaucaacaaugug

SEQ ID NO: 75531 - RNA, 63 nt, Homo Sapiens
aauccaugauuuugaauguaugcauuugacacaauauuguaauacauuagcugcaauuuuuuu

SEQ ID NO: 75532 - RNA, 63 nt, Homo Sapiens
cagauuuugcacgccaaacuccggcaugacuuuauauuguauaagguugcauggacuguacga

SEQ ID NO: 75533 - RNA, 63 nt, Homo Sapiens
acuuuuuuuuaguauuugcccggggggaaaaagauauuguauuaucauauaugcuuuuuugca

SEQ ID NO: 75534 - RNA, 63 nt, Homo Sapiens
agcugauaaaaauuuuacauuuguaaaauuaauauauuguacugguacaaaauaguuuuaaau

SEQ ID NO: 75535 - RNA, 63 nt, Homo Sapiens
uauauuuaguuguaaaccaagugaucaaacuacauauuguaaagcccauuuuuaaaauacauu

SEQ ID NO: 75536 - RNA, 63 nt, Homo Sapiens
caauagccccaugaaaagaagcaucacccaaggauauuguaaaaaggauguaacaaggagaua

SEQ ID NO: 75537 - RNA, 63 nt, Homo Sapiens
gggguggcacuggagagccauggcagucgugagauauuguauguguaugcacaugaucaugug

SEQ ID NO: 75538 - RNA, 63 nt, Homo Sapiens
auuuucuauaauuauagagaucuuacuauuaggauauuguagcuucauuuaccaauaaauuau

SEQ ID NO: 75539 - RNA, 63 nt, Homo Sapiens
ugcaacuucagggagaaauaagauuguguuugaauauuguagguagaugcauuuguaauuaag

SEQ ID NO: 75540 - RNA, 63 nt, Homo Sapiens
aacuguauauaauuguuauuuuuguccuuaaaaauauuguacauacuugguuguuaacauggu

SEQ ID NO: 75541 - RNA, 63 nt, Homo Sapiens
cacuguuauauuuaacuauauauaaauacgcauauauuguaauuuuaaugucugcuuagcacc

SEQ ID NO: 75542 - RNA, 63 nt, Homo Sapiens
uccaccucagccacauauguguuuguguuuaggauauuguaaaucuuugcuaaguaguguuuu

SEQ ID NO: 75543 - RNA, 63 nt, Homo Sapiens
aucuuagauagauauauuuuuuuuuauuuuuaaauauuguacuauuuauggugguggggcuuu

SEQ ID NO: 75544 - RNA, 63 nt, Homo Sapiens
aaaaugaagaauauguagauaauggacugggauauauuguauuucucauguuaaagccucuuc

SEQ ID NO: 75545 - RNA, 63 nt, Homo Sapiens
auguguuucauucuaguaagaaaaccucaaaggauauuguaggauauaaaucuuacuugaaaa

SEQ ID NO: 75546 - RNA, 63 nt, Homo Sapiens
acagaugaguaaguggagguguuauguaaaggcauauuguacucgaaaucugaagaccugcag

SEQ ID NO: 75547 - RNA, 63 nt, Homo Sapiens
aaucauuucauaugauuuucugccacauuaaacauauuguaugccucacaguuuacaggauuc

SEQ ID NO: 75548 - RNA, 63 nt, Homo Sapiens
gaguugcuucugagguacauuuugaaugacagcauauuguaagaaaaaaaaaggugaauaaaa

SEQ ID NO: 75549 - RNA, 63 nt, Homo Sapiens
gcuugguuagaguaaaggacgaggucauuagccauauuguauauaucgucaagcaacacacac

SEQ ID NO: 75550 - RNA, 63 nt, Homo Sapiens
cuaguuaaauuugaauuccuuggaauuuaucguauauuguauucacugagauuaugaagggac

SEQ ID NO: 75551 - RNA, 63 nt, Homo Sapiens
aacuaaucugaugaaauggaaaauuauucugcaauauuguaauucauaguuugacuuuucaua

SEQ ID NO: 75552 - RNA, 63 nt, Homo Sapiens
auuaccacaaguuauguucagauuuucaagaggauauuguauuuccuuuuucccugggcuggu

SEQ ID NO: 75553 - RNA, 63 nt, Homo Sapiens
ugguacaacuaaauuaaaacucuugguggucacauauuguauauaaacaaaacaauaugcuuu

SEQ ID NO: 75554 - RNA, 63 nt, Homo Sapiens
agucuuguuaaaaugauggacuccucuaagaccauauuguaaguuauuaacuaauguaauguc

SEQ ID NO: 75555 - RNA, 63 nt, Homo Sapiens
ucaugcuguuuaugugugacacuauauauaagaauauuguauguaaugugugcguaucauguc

SEQ ID NO: 75556 - RNA, 63 nt, Homo Sapiens
guagagauaaaagcaguagggauugaaaauuuuauauuguaaucacagagcuauaaaaugcug

SEQ ID NO: 75557 - RNA, 63 nt, Homo Sapiens
ugaauuaucucauguuggcaauauuuuuaacauauauuguacucuaaaaauugaaauaaauau

SEQ ID NO: 75558 - RNA, 63 nt, Homo Sapiens
uauuuaaaugaucauccgacugccuuggugcuaauauuguaugucucugggaaaaaaauaugc

SEQ ID NO: 75559 - RNA, 63 nt, Homo Sapiens
ugauaauaauuauguccuauuucugauggcaaaauauuguauagaucuuuacauagcuuagug

SEQ ID NO: 75560 - RNA, 63 nt, Homo Sapiens
uucucagauaagaaaaaugugggagauaugauuauauuguauuuguuaucaggaguauuuuga

SEQ ID NO: 75561 - RNA, 63 nt, Homo Sapiens
ucuauucuuugcagcucaaggacaggucacaucauauuguaaucagugcuugucaaauuugcu

SEQ ID NO: 75562 - RNA, 63 nt, Homo Sapiens
agauguaacauggcuuagagcaguuagcaguggauauuguacagauccucaaaaggaaauauu

SEQ ID NO: 75563 - RNA, 63 nt, Homo Sapiens
auggauacuugaaggacuuuucaugaggguuaaauauuguaauagcuuucuuagucauuuuga

SEQ ID NO: 75564 - RNA, 63 nt, Homo Sapiens
aguaauaaauguauuguugaugugugaaguaauauauuguacaaaugauguuuuauguuauua

SEQ ID NO: 75565 - RNA, 63 nt, Homo Sapiens
ugacccuuuaugucuuuaaaaauaaaacagauuauauuguacucaauaaucagagaaguguaa

SEQ ID NO: 75566 - RNA, 63 nt, Homo Sapiens
uuauuaagauugccaaaaacguuugguuguaauauauuguacuacuuaaacaacuauuuuuug

SEQ ID NO: 75567 - RNA, 63 nt, Homo Sapiens
gaucagcagcucucauuuuauuccauuaacaguauauuguacugagugaaaauauaagcauau

SEQ ID NO: 75568 - RNA, 63 nt, Homo Sapiens
uggcaguuaugaauguauauggaccaaaacagaauauuguagauaaaggcaaauuaagauaua

SEQ ID NO: 75569 - RNA, 63 nt, Homo Sapiens
uucuuaucucuguauacuguuuacacacacaguauauuguaaauuuuaaggcucuguuagaaa

SEQ ID NO: 75570 - RNA, 63 nt, Homo Sapiens
uaaugaaugcuucauaguggaaauauuugaaauauauuguaaaauacagaacagacuuauuuu

SEQ ID NO: 75571 - RNA, 63 nt, Homo Sapiens
uuucuauuucagggaagaagugcuauaucuccuauauuguauuuuuguagaaaauuuguauuu

SEQ ID NO: 75572 - RNA, 63 nt, Homo Sapiens
ucuaacauaguuuuuauggaccaaggaacuuguauauuguauaagcuuuaguaaaagguacau

SEQ ID NO: 75573 - RNA, 63 nt, Homo Sapiens
gcauuuuauggaaagaaaguugggucugagauuauauuguaauuuuauacuuucuauagacag

SEQ ID NO: 75574 - RNA, 63 nt, Homo Sapiens
uugggucauuuagaagccugacaacucauuuucauauuguaaucuauguuuauaauacuacua

SEQ ID NO: 75575 - RNA, 51 nt, Homo Sapiens
acgacaugguggagcaauaguauauuguauguuguaaaguguucugucauu

SEQ ID NO: 75576 - RNA, 63 nt, Homo Sapiens
ugagggcaaagaaaguccuuagauaaagagagaauauuguaugggccaucaaccauuuacuuu

SEQ ID NO: 75577 - RNA, 63 nt, Homo Sapiens
aggaaaaugaagcacagaauuacucagucuuccauauuguauuugacuucauaucaaucuagu

SEQ ID NO: 75578 - RNA, 63 nt, Homo Sapiens
gacaaaaacaaguaaauauauauggucauauacauauuguauauauauucauauacaaacaug

SEQ ID NO: 75579 - RNA, 63 nt, Homo Sapiens
gcuguuggauuugauacauuaaaucuuaauguaauauuguaagacuuuugagaauauacuuga

SEQ ID NO: 75580 - RNA, 63 nt, Homo Sapiens
uuugggauuaacuagcauuauuuugccaccuuuauauuguauuuauaaaaaaaaaaguacuau

SEQ ID NO: 75581 - RNA, 63 nt, Homo Sapiens
uggguugcuuguuuuuuaggugacaaaaauaaaauauuguauuuuaauucauggguuuuuuug

SEQ ID NO: 75582 - RNA, 63 nt, Homo Sapiens
augaacuuuuuucuaggacuuugguuacuauacauauuguauauuuuaagaauucuuuauaca

SEQ ID NO: 75583 - RNA, 63 nt, Homo Sapiens
uuauaaaugucauuugacuaugucaaucuguauauauuguaccuuaauaugaaaaacaaauuu

SEQ ID NO: 75584 - RNA, 63 nt, Homo Sapiens
uaugaaaauauuuuguuuuaaaaugaacuaugaauauuguacaguuaauuuccucacugagga

SEQ ID NO: 75585 - RNA, 63 nt, Homo Sapiens
ccuguggcaugaaaaauagcuuauccauguuauauauuguacuuacguagagcauucgaaguu

SEQ ID NO: 75586 - RNA, 63 nt, Homo Sapiens
cuacaaccaggaaccuauguguggugaaggcagauauuguaaaguuuucuuuuaugacagagg

SEQ ID NO: 75587 - RNA, 63 nt, Homo Sapiens
auauuuucugcuuuuugacuagaugacuuuuuaauauuguaaaaauaugccgaaccuaacuac

SEQ ID NO: 75588 - RNA, 63 nt, Homo Sapiens
guauuguuauuguaaaaugaaaguagcacgaucauauuguacuaacuucauuccuagccauga

SEQ ID NO: 75589 - RNA, 63 nt, Homo Sapiens
caaucuuuauguguaacuccgauuauuuuuuuaauauuguaugauaaaaugaauugcucccca

SEQ ID NO: 75590 - RNA, 63 nt, Homo Sapiens
gugcagcuagagaauuauagaaacuucugccuuauauuguacguuuugggugggacauauuuc

SEQ ID NO: 75591 - RNA, 63 nt, Homo Sapiens
gcuauuuucauguuugaagcauacuuuacuaaaauauuguaugaaguaguaauaaagaauaaa

SEQ ID NO: 75592 - RNA, 63 nt, Homo Sapiens
cccaagaagaaauugauuuaauuuucuuccaagauauuguauuuaaagccauaguuuucuugg

SEQ ID NO: 75593 - RNA, 63 nt, Homo Sapiens
uauauauaauauauaaaguuuuguaugcuguauauauuguaaauaguauuacaugaacaauau

SEQ ID NO: 75594 - RNA, 63 nt, Homo Sapiens
ucacaugccuucuaaacgugcuacaacauuagaauauuguaacgggauuuggcuaugccuuca

SEQ ID NO: 75595 - RNA, 63 nt, Homo Sapiens
agcaaauuugcagcuguuguaucuauauuagaaauauuguauguuagacuuguauuccuauuu

SEQ ID NO: 75596 - RNA, 63 nt, Homo Sapiens
aaaguuauccucucauuuuuaugaaaauguuaaauauuguaaguguaaacauuucaacucugu

SEQ ID NO: 75597 - RNA, 63 nt, Homo Sapiens
uagauauaaaaggccuuuuucaaguaacuauguauauuguaaauuguaaaucugacuucuuug

SEQ ID NO: 75598 - RNA, 63 nt, Homo Sapiens
agaacuauuuauuucaccccggacagaagaucuauauuguacccacaguccaaaauacaaauu

SEQ ID NO: 75599 - RNA, 63 nt, Homo Sapiens
aaagaaaucuuuccugugaauuaaaucagcaaaauauuguaauuuucccuuguauuuuuauaa

SEQ ID NO: 75600 - RNA, 63 nt, Homo Sapiens
uguuaugauaaucuuucuccacuguucuaauauauauuguauuuuuauuugauagcuugggau

SEQ ID NO: 75601 - RNA, 63 nt, Homo Sapiens
cugccugauuuuuuucaugugucuguguuuguaauauuguauaguaucuugugcuaggugagg

SEQ ID NO: 75602 - RNA, 63 nt, Homo Sapiens
cuuugugaacaagguagaauauaaauacauaauauauuguauauauauuauaguucucuaaua

SEQ ID NO: 75603 - RNA, 63 nt, Homo Sapiens
guauuuagauuccuccccccauuauucacaaucauauuguauuucggaaccccaaugcagagc

SEQ ID NO: 75604 - RNA, 63 nt, Homo Sapiens
caugcugugcucuuugaagagauuucaacaagaauauuguauguuaaagcaucagagauggua

SEQ ID NO: 75605 - RNA, 63 nt, Homo Sapiens
guaauguuauugaagaacuaaugaacagguaacauauuguagaaaauuagucuuucauuguuu

SEQ ID NO: 75606 - RNA, 63 nt, Homo Sapiens
cucuuuacuucaaacagcaaaaaaguggggggcauauuguaguccugucauuuaaguuaugua

SEQ ID NO: 75607 - RNA, 63 nt, Homo Sapiens
ucauuaauguuuuuuuguucugaaagugauauuauauuguacauguaaaauuaauuuaaauau

SEQ ID NO: 75608 - RNA, 63 nt, Homo Sapiens
cuauaggaauuagauucuucuauaaaagucaccauauuguauccuauagaaaaguuaaggucu

SEQ ID NO: 75609 - RNA, 63 nt, Homo Sapiens
uucuguucuauauuuucuucaccuacucuccaaauauuguaaugcaaaaagucucaguaauga

SEQ ID NO: 75610 - RNA, 63 nt, Homo Sapiens
acguguucagugugaauaguguuuaaguugaaaauauuguaaaaaaauuauauuuuuucaaaa

SEQ ID NO: 75611 - RNA, 63 nt, Homo Sapiens
uuuugauugcaucauuaguuaauuauuuucuucauauuguagauuuucugcagucacccauac

SEQ ID NO: 75612 - RNA, 63 nt, Homo Sapiens
caauguuuauuucccccaauuuguguguauguaauauuguacggauuuacucuugauuuuucu

SEQ ID NO: 75613 - RNA, 63 nt, Homo Sapiens
ucauccuccaucucaaaaugaacuuggaauuaaauauuguaagauauguauaaugcuggccau

SEQ ID NO: 75614 - RNA, 63 nt, Homo Sapiens
aaccagaacaucuuuuggcauuccacuaaguauauauuguaaauuuaaugaacaaucaagguu

SEQ ID NO: 75615 - RNA, 63 nt, Homo Sapiens
acuuuuuucuuuaaagcuagucauuucaaaagcauauuguauuuuuuugaaugacuacaguau

SEQ ID NO: 75616 - RNA, 63 nt, Homo Sapiens
cacugcuguuuuuaugauucaggcuuauaacaaauauuguauccuuuauuucugauaagacau

SEQ ID NO: 75617 - RNA, 63 nt, Homo Sapiens
acugugauugauagcauuguaagaaucgggacaauauuguauucaacuguuuuauuuuuuaua

SEQ ID NO: 75618 - RNA, 63 nt, Homo Sapiens
guguaugaaucagucacaaugaauuuuacuugaauauuguauguugcauuccacuucauuuga

SEQ ID NO: 75619 - RNA, 63 nt, Homo Sapiens
uuuuuaaaaaccauguuguguuuuuugaagcucauauuguaucaaauaauggaucaauuaauu

SEQ ID NO: 75620 - RNA, 63 nt, Homo Sapiens
acaauaauauagaacuguugauuuuuauacuauauauuguagucauugcuaaucugaacuauu

SEQ ID NO: 75621 - RNA, 63 nt, Homo Sapiens
auuuauauuugccuuauguuaucguguaugauaauauuguaucucaccucagauaaaauuggu

SEQ ID NO: 75622 - RNA, 63 nt, Homo Sapiens
aguuacagcucuguaguuuagucagugucguuuauauuguagcauugucccccagugggcaua

SEQ ID NO: 75623 - RNA, 63 nt, Homo Sapiens
ugauuauugauaacugucauuuugaauuucuugauauuguaaugucucugcaagauuuuguuc

SEQ ID NO: 75624 - RNA, 63 nt, Homo Sapiens
cuaauacauugucuagcauuuaguuauccuauuauauuguaaaaauuugagccuucaaacuug

SEQ ID NO: 75625 - RNA, 63 nt, Homo Sapiens
uuaccugaauaauucaauuuuucuacauucuuaauauuguauauucuuuuucuuuuaguucua

SEQ ID NO: 75626 - RNA, 63 nt, Homo Sapiens
ugugucugguauuuacagcacuaauuuuugcauauauuguaaaaggaacauaacacuugcauu

SEQ ID NO: 75627 - RNA, 63 nt, Homo Sapiens
gacuuugguaugugauaccaagacaagacugucauauuguagaaaagugaugaguucugaaca

SEQ ID NO: 75628 - RNA, 63 nt, Homo Sapiens
aggaugugcuauuaagagcagucauuuaaaaagauauuguaccuugauguuuaguuugcuuua

SEQ ID NO: 75629 - RNA, 63 nt, Homo Sapiens
aaaccacuuccucauuugauacugauuauaaaaauauuguaauugaccaaguacacauaaaau

SEQ ID NO: 75630 - RNA, 63 nt, Homo Sapiens
auaaacaaaaaauagaacuugagaauauuaaguauauuguaaagagaggaagguaaagaagaa

SEQ ID NO: 75631 - RNA, 63 nt, Homo Sapiens
uuuuguaucaauagcauaaucaguuaaguguaaauauuguaugaaacauuaaauuauuuugua

SEQ ID NO: 75632 - RNA, 63 nt, Homo Sapiens
cagagaacuuucuuuucucugcaagaauguuacauauuguauagauaaaugagugacauuuca

SEQ ID NO: 75633 - RNA, 63 nt, Homo Sapiens
uugcauuaaaaaugcauauacuuuaauaaauguauauuguauuguauacugcaugauuuuauu

SEQ ID NO: 75634 - RNA, 63 nt, Homo Sapiens
guacagauguguaugggaaaccccaaccccuauauauuguaaauagaugggcugggcuaaaca

SEQ ID NO: 75635 - RNA, 63 nt, Homo Sapiens
aagaaugagccaccgugccuggccuauuuuauuauauuguaauauauuuuauuauauuagcca

SEQ ID NO: 75636 - RNA, 63 nt, Homo Sapiens
cuuuuauacaaaguaucuauaugagauucuucuauauuguacagaguggggcaaaacacgccc

SEQ ID NO: 75637 - RNA, 63 nt, Homo Sapiens
uggggagaaauaaauuuuguuucagaauuuuguauauuguaggaauccuuugagaaugugauu

SEQ ID NO: 75638 - RNA, 63 nt, Homo Sapiens
ugucaauuuuuauauguucuguguuuaguuuacauauuguaauucauuuuuaagagaguacag

SEQ ID NO: 75639 - RNA, 63 nt, Homo Sapiens
guccuuuuucacuugcaccuuuuuuauaagaauauauuguaauacuaaaaaauauuaaauuca

SEQ ID NO: 75640 - RNA, 63 nt, Homo Sapiens
uucuuuuaaugaccaaccuuagguaaaacaaaaauauuguaauccuagaaauuauccuccagc

SEQ ID NO: 75641 - RNA, 63 nt, Homo Sapiens
uuuucucaaaugcaucaauucucuaaaauuccuauauuguaacuugccuuuuuuuaaaaaagu

SEQ ID NO: 75642 - RNA, 63 nt, Homo Sapiens
agaaaaaagcaccuuugaaauuccaaacaaauuauauuguacuuguaucuuuuuaccuauuuu

SEQ ID NO: 75643 - RNA, 63 nt, Homo Sapiens
cuguaaaaauagcaaccacuuauggcacuguauauauuguagacuuguuuucucuguuuuaug

SEQ ID NO: 75644 - RNA, 63 nt, Homo Sapiens
uauuugcuuuuauaauugccuccuuguuuugguauauuguaaaauaauuuaaauaauguauuu

SEQ ID NO: 75645 - RNA, 63 nt, Homo Sapiens
ucauacauuuaaacugucuuguucagcauaccaauauuguauguuacaaaucaucauuucuaa

SEQ ID NO: 75646 - RNA, 63 nt, Homo Sapiens
uaaaaucugucaucccaugcagacaggaaaacaauauuguauaacagaccacuuccugaguag

SEQ ID NO: 75647 - RNA, 63 nt, Homo Sapiens
gcccugggcccaacaguuuguacuucaugaaacauauuguacauuuuacauaguuuaauuuaa

SEQ ID NO: 75648 - RNA, 63 nt, Homo Sapiens
ucucuaccucuaacaguaaaaucuuucuuuaugauauuguauuaauccucuuguagggaucac

SEQ ID NO: 75649 - RNA, 63 nt, Homo Sapiens
aacaucuuaauuuuguuauagcggcgaaacacgauauuguacuggcgugagccaccgcgcccg

SEQ ID NO: 75650 - RNA, 63 nt, Homo Sapiens
aaucucacuagccgcagcuuuaaccucaaggagauauuguaugcagaaacaguagaaccugug

SEQ ID NO: 75651 - RNA, 63 nt, Homo Sapiens
auuaucaaaaguauugguuaucaguguuagaggauauuguaguaccacauaguacuuauucag

SEQ ID NO: 75652 - RNA, 63 nt, Homo Sapiens
gaauaaaaauguuuuauugauaaauacacauauauauuguacauauacauauguauauauauu

SEQ ID NO: 75653 - RNA, 63 nt, Homo Sapiens
auuuccauguuaaugaucuaaacauuaagggccauauuguaagaggaacaaauaaagacaaac

SEQ ID NO: 75654 - RNA, 63 nt, Homo Sapiens
auagaauuucgaagagacauaacuucucugucuauauuguaauaacucaagcccucaaggccc

SEQ ID NO: 75655 - RNA, 63 nt, Homo Sapiens
guuagauguuuguugagcuguccucuuagaagaauauuguauuaaaucuaacauuauuacuuu

SEQ ID NO: 75656 - RNA, 63 nt, Homo Sapiens
cuauuauauaauacagaauucuaaaauaagaacauauuguacaguuuuccuuuauuucuacau

SEQ ID NO: 75657 - RNA, 63 nt, Homo Sapiens
aauuauuugcaucuuucagugaaagcuuacgcuauauuguaugaugacauauaauuuauauau

SEQ ID NO: 75658 - RNA, 63 nt, Homo Sapiens
auuuagacugaugauacuaaaauauuuuaauauauauuguaaaaaugauuuuuuuagcauuuu

SEQ ID NO: 75659 - RNA, 63 nt, Homo Sapiens
uguucaucuuuguuguuuuaacuacacguauaaauauuguaacaaaaccuguguucuuuacac

SEQ ID NO: 75660 - RNA, 63 nt, Homo Sapiens
acugugcuuaucuuguaaaguugagaugcuuaaauauuguacugucaacucuuaaauggagac

SEQ ID NO: 75661 - RNA, 63 nt, Homo Sapiens
uucuuuguugcaaguggcaggaaacaauguacaauauuguauauuuccaauacaauauaaguu

SEQ ID NO: 75662 - RNA, 63 nt, Homo Sapiens
uauuguguguguguguguguuuuuuuaaaauuuauauuguaaauuugccuguaacaagccaga

SEQ ID NO: 75663 - RNA, 63 nt, Homo Sapiens
ucuaaugagaauuauauuuaauauucaaaggcuauauuguaaugaauucauuuauuuaauaga

SEQ ID NO: 75664 - RNA, 63 nt, Homo Sapiens
aaguuauaagugucugucuuaucuuuacuacacauauuguaacaaauucaauauccuagucuu

SEQ ID NO: 75665 - RNA, 63 nt, Homo Sapiens
uauacaguuauaaaauuaaaaguuugaaaagcaauauuguauauuuuuaucuauauaaaauaa

SEQ ID NO: 75666 - RNA, 63 nt, Homo Sapiens
ggcuaacuuauacauauuuuuaaagaaauauuuauauuguauuuauauaauguauaaaugguu

SEQ ID NO: 75667 - RNA, 63 nt, Homo Sapiens
ucaccuuuaaacgccuuuuuuuaaaauuauaaaauauuguaaagcagggucucaacuuuuaaa

SEQ ID NO: 75668 - RNA, 63 nt, Homo Sapiens
ugucaauuuguauaucaugaaacacuucucaucauauuguauguaaguaauugcauuucugcu

SEQ ID NO: 75669 - RNA, 63 nt, Homo Sapiens
gugagcauauauauuuuaaaauacuuucuuuggauauuguaauucuuaacugguuguaaauua

SEQ ID NO: 75670 - RNA, 63 nt, Homo Sapiens
gcuuguaaaacugcauucuugggcaaaauauuuauauuguauauaaaugguuggcagcuuauu

SEQ ID NO: 75671 - RNA, 63 nt, Homo Sapiens
uucuaaaauugaaagacaagaaauuuagugccaauauuguacagacagaaauuccauguauga

SEQ ID NO: 75672 - RNA, 63 nt, Homo Sapiens
cuaccauagugagccaugauaugugugaaaacaauauuguauaaaauuugguuucaaguguac

SEQ ID NO: 75673 - RNA, 63 nt, Homo Sapiens
aacuuaauaggaacccuguggcagugaaacuugauauuguauuaagaacuguaaggcaaucgg

SEQ ID NO: 75674 - RNA, 63 nt, Homo Sapiens
gcugcugugcguggaaaaagucagaauaaauuaauauuguauuuauuuacuucuaaucuuaaa

SEQ ID NO: 75675 - RNA, 63 nt, Homo Sapiens
cagccuauuguaggaggggguucuuuguuuucaauauuguauuugaucacuuuuuugcacucc

SEQ ID NO: 75676 - RNA, 63 nt, Homo Sapiens
aagaacaucuuguaagauacuguuucagcagugauauuguauaucuaguuauuaaaaguugcu

SEQ ID NO: 75677 - RNA, 63 nt, Homo Sapiens
auguaccuaauccaaauauccagguaaaaacagauauuguaccuuaagacauuuucaugcuuc

SEQ ID NO: 75678 - RNA, 63 nt, Homo Sapiens
uaacuucugcuuuaaaaaagucucucaauuggaauauuguagaaacugccugugaauauaucu

SEQ ID NO: 75679 - RNA, 63 nt, Homo Sapiens
auugcacuauauuagguuaagcaagcuaaauaaauauuguaaaagaaaccagaauuuuagaca

SEQ ID NO: 75680 - RNA, 63 nt, Homo Sapiens
gccaguuucucagaauaaaaacuuucuuuuuagauauuguacauagauugcuuccuucauguc

SEQ ID NO: 75681 - RNA, 63 nt, Homo Sapiens
uccuuuaauauacuccuuaagauaguuguaaagauauuguaucuugaaauaccuauucaagaa

SEQ ID NO: 75682 - RNA, 63 nt, Homo Sapiens
guguauuuuuacuuuaguccgaaaccgaaagcuauauuguacuuuaauauaugugccgaacaa

SEQ ID NO: 75683 - RNA, 63 nt, Homo Sapiens
uaugagauucauaaagacuuuucagcuagccacauauuguaugaaugcuacgugauagacaau

SEQ ID NO: 75684 - RNA, 63 nt, Homo Sapiens
cucaauuguguauagaagaauuucuuccaugcaauauuguauauauuucaguugagcugcugu

SEQ ID NO: 75685 - RNA, 63 nt, Homo Sapiens
ugaaaggcugcagugccagucacuuaaaaagggauauuguaaauuucacagcccucgacuuug

SEQ ID NO: 75686 - RNA, 63 nt, Homo Sapiens
ugagaaaauaaacaucugagugcaauauuuuaaauauuguauuaugcuaaacagaugucuucu

SEQ ID NO: 75687 - RNA, 63 nt, Homo Sapiens
uuauguugaaauugcaaccauguaauuuauugaauauuguacaaucgaguguugaauauauca

SEQ ID NO: 75688 - RNA, 63 nt, Homo Sapiens
ucuuaauauuaugaccaagaauuuucaauuuauauauuguauuuucaaauuuuaagcaaucau

SEQ ID NO: 75689 - RNA, 63 nt, Homo Sapiens
uauauauaaaaagaaacgucucuuuauuuuuguauauuguauugaaaucucaaaacuguacug

SEQ ID NO: 75690 - RNA, 63 nt, Homo Sapiens
uagaaaaguuuuauugguagaugaguaaauaaaauauuguaaaaaaacuuauugucuauaaag

SEQ ID NO: 75691 - RNA, 63 nt, Homo Sapiens
cccuccucagucuuugggggauucaaaugcaugauauuguauguaccugggaaauuugccgau

SEQ ID NO: 75692 - RNA, 63 nt, Homo Sapiens
agagagaaaccauuaaaaguuucacugucagauauauuguaggugcuaauacuggauuucguc

SEQ ID NO: 75693 - RNA, 63 nt, Homo Sapiens
cauuccuguuaagcugccaaaaauuaaagugcaauauuguauauuuuuaagaacaaauuuaaa

SEQ ID NO: 75694 - RNA, 63 nt, Homo Sapiens
uuucuauuuucugaccucuaagccuaaauuaagauauuguauauguaaugaugacauaguuga

SEQ ID NO: 75695 - RNA, 63 nt, Homo Sapiens
uuuccauucagacaauauaucauaacuuaauaaauauuguauuuuagauauauucucuaauaa

SEQ ID NO: 75696 - RNA, 63 nt, Homo Sapiens
uuuuuuuuucauuaacugagcaagacuuucaggauauuguagaugcacagaugguagguuguc

SEQ ID NO: 75697 - RNA, 63 nt, Homo Sapiens
uaguucuauuagaaauaaguaguaaauuuugauauauuguacauacacacgugugugugugug

SEQ ID NO: 75698 - RNA, 63 nt, Homo Sapiens
uauuuggguuuaaaaugacuaaaugcuuuaaacauauuguagcuuaagauauauguguuaaga

SEQ ID NO: 75699 - RNA, 63 nt, Homo Sapiens
gccaauauaauauaguuaauuugcuccuuugucauauuguaauauucuucaccaacauuucau

SEQ ID NO: 75700 - RNA, 63 nt, Homo Sapiens
guuaaaaaaaucuaugcagcagucuuuguuuuaauauuguacuucauaauucacacaaacauc

SEQ ID NO: 75701 - RNA, 63 nt, Homo Sapiens
guaaaagaacuguacaauuuuuuaaauaacaaaauauuguauucauuaaccauuuagagguca

SEQ ID NO: 75702 - RNA, 63 nt, Homo Sapiens
cuauuuuugcauaaaauaaguuuuuaaacuuuuauauuguacaccuaucaaaacagcaggaaa

SEQ ID NO: 75703 - RNA, 63 nt, Homo Sapiens
acaaaguaaaaauauaugagguaugugacagcuauauuguauuuuaagccuacuagagccauu

SEQ ID NO: 75704 - RNA, 63 nt, Homo Sapiens
acuagaagaugaauacaaacauuugagaaaugcauauuguauuuggucaaaacggauuagggc

SEQ ID NO: 75705 - RNA, 63 nt, Homo Sapiens
gaagggauauuaagaaucuugaagaugaaauauauauuguaaacuuuguuuagaaaaaaaacu

SEQ ID NO: 75706 - RNA, 63 nt, Homo Sapiens
ugcaugcauaccgauauugggucauucugcagaauauuguaauuuugagagccuugaguauuu

SEQ ID NO: 75707 - RNA, 63 nt, Homo Sapiens
acaccauuuggaacuacugauaucuccagugaaauauuguauacaaaucuguggugcaaccac

SEQ ID NO: 75708 - RNA, 63 nt, Homo Sapiens
agcagugucacagcuaaaaacuuguguuuuugcauauuguaaaacacaccuuggguaguucug

SEQ ID NO: 75709 - RNA, 63 nt, Homo Sapiens
ucagccacugggacccgaggcagagugaauugaauauuguaaguuucucauaggaaguuuggu

SEQ ID NO: 75710 - RNA, 63 nt, Homo Sapiens
ugagugugguugugaaugauuucuuuugaagauauauuguaguagauguuacaauuuugucgc

SEQ ID NO: 75711 - RNA, 63 nt, Homo Sapiens
uugugcucuaaaauucuauuauacuacaauaauauauuguaaagauccuauagcucuuuuuuu

SEQ ID NO: 75712 - RNA, 63 nt, Homo Sapiens
aauuuugguaccaguuaaaaauacaaauguacuauauuguagucauuuuaaaguacacaaagg

SEQ ID NO: 75713 - RNA, 63 nt, Homo Sapiens
cuuuguuguaaaagcuaaaauaaacagcaugcuauauuguaauuguauuucuugcugaccaaa

SEQ ID NO: 75714 - RNA, 63 nt, Homo Sapiens
guccuuauuuguauaaacauuuguaugcacguuauauuguaauagcuuugccuguauuuauug

SEQ ID NO: 75715 - RNA, 63 nt, Homo Sapiens
uaccccaucucucucuuauaucacuugaaugauauauuguaagugagagguaaaggaaaaugu

SEQ ID NO: 75716 - RNA, 63 nt, Homo Sapiens
ucccaaggugucugguugagguaggacauauccauauuguaguaauguacuccugggaacugg

SEQ ID NO: 75717 - RNA, 63 nt, Homo Sapiens
cauuccuuucaaauaaagacaguugaaugccuuauauuguauaagauaagguagguagauauc

SEQ ID NO: 75718 - RNA, 63 nt, Homo Sapiens
uuguuauuuauuaaauuauuuccauuugguuaaauauuguauuuaacaaaacauguucagcuu

SEQ ID NO: 75719 - RNA, 63 nt, Homo Sapiens
auguaaauaauaaaagccaucagcauugaugcuauauuguauuuugcacauaaucaugcuauu

SEQ ID NO: 75720 - RNA, 63 nt, Homo Sapiens
uggguguaggacucuagugugggcugcuuuaucauauuguacuuauccagcaccacuugcaga

SEQ ID NO: 75721 - RNA, 63 nt, Homo Sapiens
auuauuauucuuaggaauagucugggguuuuucauauuguauugaaauccaggguauucagau

SEQ ID NO: 75722 - RNA, 63 nt, Homo Sapiens
auuuacuuguauaauucuauugcugcugcuuaaauauuguauaucuuaaauuucagcauaugu

SEQ ID NO: 75723 - RNA, 63 nt, Homo Sapiens
ugugcacaauguacauuaaauuuuauuuuuuaaauauuguauuuuugaauuuugauuuucuau

SEQ ID NO: 75724 - RNA, 63 nt, Homo Sapiens
acuuuugacaaugcucauuaugauuuucucaaaauauuguaaaacagcuuaauaguuuaugcg

SEQ ID NO: 75725 - RNA, 63 nt, Homo Sapiens
cagaagagauccaucaacagggguuuguaguauauauuguagggccuugugugccagacuaag

SEQ ID NO: 75726 - RNA, 63 nt, Homo Sapiens
guuugcucuccugccccucuguauuuuuauguuauauuguauacauauauuuguaucagaacu

SEQ ID NO: 75727 - RNA, 63 nt, Homo Sapiens
aaaguuguaaagaauuuugacaacacaaaaucuauauuguaaucuacagugggcaaaacuauc

SEQ ID NO: 75728 - RNA, 63 nt, Homo Sapiens
augcgugugccagacaccggagagcagauugucauauuguaacacacucaggugcucacaaau

SEQ ID NO: 75729 - RNA, 63 nt, Homo Sapiens
ccuagcacuuugggaggccaaacauaaaauccaauauuguaauauaaaggacaggcuggugcu

SEQ ID NO: 75730 - RNA, 63 nt, Homo Sapiens
uacuggacucaggaacuuuuugcuagugcuguaauauuguaaaaugaguuguagacacugauc

SEQ ID NO: 75731 - RNA, 63 nt, Homo Sapiens
gaaaauauuaugcacacuguucaucccucccugauauuguauuugccuuuugagggguuccca

SEQ ID NO: 75732 - RNA, 63 nt, Homo Sapiens
uguguaacauuuuguauauuuuccccaguguacauauuguaucggcugcugggguggcccugc

SEQ ID NO: 75733 - RNA, 63 nt, Homo Sapiens
cugaagaugaccagcucgugcagcagccacagcauauuguaaagaaagcccagugacaugggc

SEQ ID NO: 75734 - RNA, 63 nt, Homo Sapiens
gaaaaaaaaaaugcugaacauugcauauaacuuauauuguaagaaauacuguacaaugacuuu

SEQ ID NO: 75735 - RNA, 63 nt, Homo Sapiens
cgucuuaauuuuccauuggcuaugauggaauuaauauuguauuuuaaaaaugcauauugauca

SEQ ID NO: 75736 - RNA, 63 nt, Homo Sapiens
acaguauucaguuuucucaccucuugcuauuguauauuguagauuuuuuucauucauguguua

SEQ ID NO: 75737 - RNA, 63 nt, Homo Sapiens
auauaacaaaaaugaauuuuguuugauagauuuauauuguaaccuuuuucuaguucuugaaua

SEQ ID NO: 75738 - RNA, 63 nt, Homo Sapiens
uuacccugcagcuacauuguugaguuagugaugauauuguauaugcucauggucuuaacugga

SEQ ID NO: 75739 - RNA, 63 nt, Homo Sapiens
aaugugguuaucaaucacauacuuuuuuggauuauauuguagcaaaaaguugauuagcuuacc

SEQ ID NO: 75740 - RNA, 63 nt, Homo Sapiens
cuguaaaaacuguacaaagcuaauguauuuuucauauuguaaaguuucaauuguagaaacaac

SEQ ID NO: 75741 - RNA, 63 nt, Homo Sapiens
uuuuuacagugaagacuguuuucagcucuuuuuauauuguacauagucuuuuauguaauuuac

SEQ ID NO: 75742 - RNA, 63 nt, Homo Sapiens
gcggggaggaaagcaaaauccaacuaaugguauauauuguaggguacagaauagagcgugugc

SEQ ID NO: 75743 - RNA, 63 nt, Homo Sapiens
aaccuguguuugcauauuuuuuuggagugcagaauauuguaauuaaugucauaagugauuugg

SEQ ID NO: 75744 - RNA, 57 nt, Homo Sapiens
uuaugcauucucucaaguaacuaucaaauauuguaaaugcaauugcugcuaguucag

SEQ ID NO: 75745 - RNA, 63 nt, Homo Sapiens
gagaaaaaaauaacaacaacacagagucaggaaauauuguaggcaacugaggaccacuguccu

SEQ ID NO: 75746 - RNA, 63 nt, Homo Sapiens
gccugcuuuuguaaugaaaauauaaugaaaucaauauuguaagaaaauuuggcaaauaaugca

SEQ ID NO: 75747 - RNA, 63 nt, Homo Sapiens
caaaccuacaaaaauaaacuuaucuguuuugguauauuguacaauuaaagugauaaaacccca

SEQ ID NO: 75748 - RNA, 63 nt, Homo Sapiens
gugcauaucugguuauuugcuauagcacuggucauauuguauucucagaaucuggccuuccuu

SEQ ID NO: 75749 - RNA, 63 nt, Homo Sapiens
aguggauacaguugauuuguaaguaccuuuuacauauuguaaaguucaaugaaaggaaguuaa

SEQ ID NO: 75750 - RNA, 63 nt, Homo Sapiens
augacagauaaccuaauaauuuuaaaaacuuaaauauuguaauguaucuuaaaggacauaaaa

SEQ ID NO: 75751 - RNA, 63 nt, Homo Sapiens
aaaaauuuaaaauagguauuauauuaaaauaaaauauuguauuucuauaacugacagauguuu

SEQ ID NO: 75752 - RNA, 63 nt, Homo Sapiens
guauagaaaccuccauuuuuuuguagauauuuaauauuguacaaaaaauaaggaaccaugaca

SEQ ID NO: 75753 - RNA, 63 nt, Homo Sapiens
gcuuggcagaaaagaaaauauaauggccagaaaauauuguauuauuaucgcauuaucuuggca

SEQ ID NO: 75754 - RNA, 63 nt, Homo Sapiens
uaucuguagucguuuaaugucaucaaaaugcccauauuguaucaagucagguacaaauguaca

SEQ ID NO: 75755 - RNA, 63 nt, Homo Sapiens
gccuuauagaaucuaagcugccuuuucagccauauauuguacaacgugggugcuuguguuuga

SEQ ID NO: 75756 - RNA, 63 nt, Homo Sapiens
guauguacauuuuauauucaaauguauaaauguauauuguauugaaaggaaaugcaaacugua

SEQ ID NO: 75757 - RNA, 63 nt, Homo Sapiens
caaauaguuaacaucaggaagucgggaacugagauauuguaauaacagacaauauuaguuuag

SEQ ID NO: 75758 - RNA, 63 nt, Homo Sapiens
uaucuuugaaauuuuguacaauaucaauuauaaauauuguauuaagggacuuuauuuuguaac

SEQ ID NO: 75759 - RNA, 63 nt, Homo Sapiens
aacuucaaauauagagauauuuuuguacguuauauauuguauuaagggcauuuuaaaagcaau

SEQ ID NO: 75760 - RNA, 63 nt, Homo Sapiens
cuuuguuuuuuaucacuuaauguuauaucuuggauauuguauuacccuggguauuaaaaagaa

SEQ ID NO: 75761 - RNA, 63 nt, Homo Sapiens
ccaggaacuuuuugcuuuuaugaaaauagauucauauuguauuucccagugugucuuuuaugu

SEQ ID NO: 75762 - RNA, 63 nt, Homo Sapiens
uauauauaauaugaaaagauuaacuucauagagauauuguaaguagguaauuuuauuauuuaa

SEQ ID NO: 75763 - RNA, 63 nt, Homo Sapiens
uuuucacuggaauuacaaagcagaauuaaaauuauauuguagaaggaaacaccaagaaaagaa

SEQ ID NO: 75764 - RNA, 63 nt, Homo Sapiens
cuuugaacuuacucaggaaagccagcccccauaauauuguauuaccaaacaguaucgcuuugu

SEQ ID NO: 75765 - RNA, 63 nt, Homo Sapiens
gggcuggacuucuaccugcccucaaggguguguauauuguauaggggcaacuguaugaaaaau

SEQ ID NO: 75766 - RNA, 63 nt, Homo Sapiens
aaccuuauuuuuuauuauugccaauccccuaagauauuguauuuuacaaaucucccucuuccc

SEQ ID NO: 75767 - RNA, 63 nt, Homo Sapiens
ucuauaaauauaucuguauauaaagguuucuguauauuguauagagcuguguauaaacuggau

SEQ ID NO: 75768 - RNA, 63 nt, Homo Sapiens
auugacaaauaccaagaauuuuugcguauguuuauauuguauuguucuaaauaauggguagcc

SEQ ID NO: 75769 - RNA, 63 nt, Homo Sapiens
uacaucacagccuucucaaacagcucaagcaauauauuguauauugccauaucgucuggugaa

SEQ ID NO: 75770 - RNA, 63 nt, Homo Sapiens
uuugaaaauguuuaugccacagaauuugcuaauauauuguaaucacauuccuuaggaggacuu

SEQ ID NO: 75771 - RNA, 63 nt, Homo Sapiens
ugagccagcacucagcugugucagauuugauuaauauuguauuaaucucauggaugguucuca

SEQ ID NO: 75772 - RNA, 63 nt, Homo Sapiens
aggaaagcaguuagcuaaguguuuaauucaugaauauuguauacugcauccccuaccacaauu

SEQ ID NO: 75773 - RNA, 63 nt, Homo Sapiens
uuaaaugugaugauguaugccaaggugcuuuguauauuguaaagugcuauauaauuauaagau

SEQ ID NO: 75774 - RNA, 63 nt, Homo Sapiens
caggaaggauuaccaugaacuuauuuuaaauccauauuguaccagaaugacuaugucuguguu

SEQ ID NO: 75775 - RNA, 63 nt, Homo Sapiens
aggagcuguuuuuguuugaaguacugcaaaauuauauuguaacuuccccucaccccaguugca

SEQ ID NO: 75776 - RNA, 63 nt, Homo Sapiens
cuagaaaaaaaaaagcaguuuccaggcccauccauauuguaauuuuucuuuaucugcagauau

SEQ ID NO: 75777 - RNA, 63 nt, Homo Sapiens
gaaugaacaagguugccacaaucuggagacaagauauuguaagaaaugguaagguacucagga

SEQ ID NO: 75778 - RNA, 63 nt, Homo Sapiens
caguguuuugaauuauuaaagguaugaaauacaauauuguacuuguuaaucuuugugcuauau

SEQ ID NO: 75779 - RNA, 63 nt, Homo Sapiens
auacuuuaacuguacaauaauuuuauugcuguaauauuguaugguacaaagaaauaggcauua

SEQ ID NO: 75780 - RNA, 63 nt, Homo Sapiens
uuugcuuaaaauggggucgguccaaauguuucuauauuguagcucacccacguuccuuguaaa

SEQ ID NO: 75781 - RNA, 63 nt, Homo Sapiens
aauuuuaauagcuuaaauugauuuaauuuguaaauauuguacaggagacaguuucagaugauu

SEQ ID NO: 75782 - RNA, 63 nt, Homo Sapiens
agaccuccuuaugaaaaugauuacauaacauuaauauuguaucuuuauuuaugauuaucaauu

SEQ ID NO: 75783 - RNA, 63 nt, Homo Sapiens
aaaagacaugccuccauauguuggcuuaacugaauauuguaugcacuugccauggccugaaug

SEQ ID NO: 75784 - RNA, 63 nt, Homo Sapiens
ucuuuucauaggaaaugucagauuccaugacauauauuguaaucaggaggaagacuaguggug

SEQ ID NO: 75785 - RNA, 63 nt, Homo Sapiens
auauuuuguccuucccucuuuggcugaucuucuauauuguagugagaagugacacagaguaaa

SEQ ID NO: 75786 - RNA, 63 nt, Homo Sapiens
uacuguguaaaucuuguugacuuugacaauuccauauuguaaacaaucugcaaaacuguauag

SEQ ID NO: 75787 - RNA, 63 nt, Homo Sapiens
uuguguuugaggcuugucaaauuugugucuuaaauauuguacaccugagcccauaccuaauga

SEQ ID NO: 75788 - RNA, 63 nt, Homo Sapiens
auuugaagacagacuauauggcuguaaaguauuauauuguauggugaauaguuuguuaauauu

SEQ ID NO: 75789 - RNA, 63 nt, Homo Sapiens
gcauucacauuccacagguggacaucaggugcuauauuguauaagacucauuauuguuuacug

SEQ ID NO: 75790 - RNA, 63 nt, Homo Sapiens
aaaaauuaugugaauguggucaauuauaacaauauauuguaaucagcucacagcaaaauagag

SEQ ID NO: 75791 - RNA, 63 nt, Homo Sapiens
uuaaacugugugaaauuaaaguagccugauuucauauuguauuuggagaguuuuuuauauacu

SEQ ID NO: 75792 - RNA, 63 nt, Homo Sapiens
gaaauuagcuuguuugauauauucuguauaguuauauuguacuugaacauguguauuguauau

SEQ ID NO: 75793 - RNA, 63 nt, Homo Sapiens
ucucccacuguauucauuuaugaaucucuaaccauauuguaucacuaucaauucauccccaua

SEQ ID NO: 75794 - RNA, 63 nt, Homo Sapiens
uuuccaccagugauuuguauuaagacagcacuuauauuguacaauacuucagacuguuuuuuu

SEQ ID NO: 75795 - RNA, 63 nt, Homo Sapiens
gaaagguacuauauuugcuagacucuagacaagauauuguacauaaaagaauuuuuuugucuu

SEQ ID NO: 75796 - RNA, 63 nt, Homo Sapiens
uuuuggaaggggaggaaaauggcaaguguauuuauauuguaaccacaugcaaauaaaaagaau

SEQ ID NO: 75797 - RNA, 63 nt, Homo Sapiens
cucaaucagccauaaucccugcuuucagaguuuauauuguaccugccuaauccacccggcgug

SEQ ID NO: 75798 - RNA, 63 nt, Homo Sapiens
cggaauugaagucuuccccaaaaauauauguauauauuguaugucuucauccuugguagcggc

SEQ ID NO: 75799 - RNA, 63 nt, Homo Sapiens
gcuaaagacauggaccuucagcaguguaagaagauauuguacaguauauuuuaaaucuaugaa

SEQ ID NO: 75800 - RNA, 63 nt, Homo Sapiens
auguauauauuaugguagaaauaauauugaaggauauuguacuucacuagugcugccagagga

SEQ ID NO: 75801 - RNA, 63 nt, Homo Sapiens
ucccacugucagauuauauuaucuaacaauugaauauuguaaauauacuugucuuaccucuca

SEQ ID NO: 75802 - RNA, 63 nt, Homo Sapiens
uccuuuaaaagggggauuuccuuucugaaauacauauuguauuagcuucccagggcuuccaua

SEQ ID NO: 75803 - RNA, 63 nt, Homo Sapiens
auaaagccuugguuaucaacagguggaauguagauauuguaaagcuuuuugugaauuaaaagu

SEQ ID NO: 75804 - RNA, 63 nt, Homo Sapiens
auucaguaccauccacauuggaauauacauggaauauuguaaaaccuacaugagcagaugaaa

SEQ ID NO: 75805 - RNA, 63 nt, Homo Sapiens
ucaguauuugauguggucguguaaauauguacaauauuguaaauacauaaaaaauauacaaau

SEQ ID NO: 75806 - RNA, 63 nt, Homo Sapiens
gguuuuuccccaucuccuguagagcgaauuuacauauuguauuggguaaguguucacuacuuu

SEQ ID NO: 75807 - RNA, 63 nt, Homo Sapiens
cugugcuggggaacaaagcuuuugcaguaccuuauauuguaguuaaaauuuuauuuaacauau

SEQ ID NO: 75808 - RNA, 63 nt, Homo Sapiens
ugacuaaacgauuauaugaugagaagcaacaacauauuguauauuguucaaaugaucuucuag

SEQ ID NO: 75809 - RNA, 63 nt, Homo Sapiens
cucaguggauagcacucaauuuauuccguagugauauuguaacaauacugccauucccuucua

SEQ ID NO: 75810 - RNA, 63 nt, Homo Sapiens
uuaacuauuucuuuucucuuuaauccuuuaguuauauuguauuaaauaaaaauauaauacugc

SEQ ID NO: 75811 - RNA, 63 nt, Homo Sapiens
ucauuuuuuuauauagacuucagcccuuuguaaauauuguaacuggggaguauagaguagaaa

SEQ ID NO: 75812 - RNA, 63 nt, Homo Sapiens
aagcacuuuuuuccuuccgucaugcuucauacuauauuguauuguacuaaccccucaugcugg

SEQ ID NO: 75813 - RNA, 63 nt, Homo Sapiens
aaaagaacucagauucuugaagccaccguuuucauauuguaauguuagguguucucagagggg

SEQ ID NO: 75814 - RNA, 63 nt, Homo Sapiens
ugagccacugcgcccaaccuggaguguuuuuacauauuguaaaauuuuauuuccuaaccucaa

SEQ ID NO: 75815 - RNA, 63 nt, Homo Sapiens
gcgaauuuugugugauuuccugcccuuugcguuauauuguauaauaccaacguaaggaaauaa

SEQ ID NO: 75816 - RNA, 63 nt, Homo Sapiens
guugcuguaauaauuauuuuaagaaacuuuuaaauauuguaagaggauaucuaguuucucuau

SEQ ID NO: 75817 - RNA, 63 nt, Homo Sapiens
auuugagugaauguucccaaauauagcagacguauauuguaucauuaacauguuuguggaaga

SEQ ID NO: 75818 - RNA, 63 nt, Homo Sapiens
cagugacuucagugguauccuagucuaaaaugaauauuguaccuguguaaugccuuccugaaa

SEQ ID NO: 75819 - RNA, 63 nt, Homo Sapiens
gggaaaacaaaguguuuauucccuccaagggagauauuguaagccaaaggaauccucaaacuu

SEQ ID NO: 75820 - RNA, 63 nt, Homo Sapiens
caaaacacagcucuuaccuagaagcaauauaauauauuguaaaugaacuuuuugcauuggcuu

SEQ ID NO: 75821 - RNA, 63 nt, Homo Sapiens
auuugaucuuuuuuaugguuugauauucuguaaauauuguacaucugccuauucauugauaua

SEQ ID NO: 75822 - RNA, 63 nt, Homo Sapiens
auucaauaguuaauaaaaacaaaaauguaaaucauauuguaguauuuuaaauauaacacucaa

SEQ ID NO: 75823 - RNA, 63 nt, Homo Sapiens
guaauuuaaugugcuuaccagaaguguuccuggauauuguauuguugccuccugagugauaau

SEQ ID NO: 75824 - RNA, 63 nt, Homo Sapiens
uaaauugcuaauacuaauaguuuaccuuguuaaauauuguagauacuaaauuuuugccuacaa

SEQ ID NO: 75825 - RNA, 63 nt, Homo Sapiens
ccauuugaauuuucuucacuuuuaagguaauggauauuguagcugcaaccuugucucuugcag

SEQ ID NO: 75826 - RNA, 63 nt, Homo Sapiens
uugaagguuauaaauaugugcagacauguauuaauauuguacucugcuguucuuucuaacuga

SEQ ID NO: 75827 - RNA, 63 nt, Homo Sapiens
cacauauauugaugucuccaaauuucaccuauuauauuguacccauuaaugaacaucaucauu

SEQ ID NO: 75828 - RNA, 63 nt, Homo Sapiens
ucuuuagaauaguuuaauuguuagcuaagaagcauauuguaagaauaugauacaauuauaacg

SEQ ID NO: 75829 - RNA, 63 nt, Homo Sapiens
uuaacuguuucucugaucaaauuacuuauuuucauauuguauugaaggaauuuaaggagaggu

SEQ ID NO: 75830 - RNA, 63 nt, Homo Sapiens
uauauauuuuuuaaaaaucuuuucagcuucuauauauuguauguguuuauuaguuuugcauaa

SEQ ID NO: 75831 - RNA, 63 nt, Homo Sapiens
gagaaagggcagcccauugcccagaauuaacacauauuguagagacuuguaugcaaagguugg

SEQ ID NO: 75832 - RNA, 63 nt, Homo Sapiens
gcagcugucuuuuuauauguuuuuugacaaaucauauuguauucuuuuguacaaaaaagaacu

SEQ ID NO: 75833 - RNA, 63 nt, Homo Sapiens
cuauuacacuggagcuguuuuauagauaagucaauauuguaucaggcaagauaaaccaauguc

SEQ ID NO: 75834 - RNA, 63 nt, Homo Sapiens
aacauuuccuacguauuuuauuuuacauagaucauauuguauauaguuaguaucuuuauuaau

SEQ ID NO: 75835 - RNA, 63 nt, Homo Sapiens
aguuuugccaguucaagaauuuaauggaaucagauauuguaagcauucuuguguaauacuuca

SEQ ID NO: 75836 - RNA, 63 nt, Homo Sapiens
cuugcagcauauuagaacagacgauccaugcuaauauuguauuuucucuuaaaacauagcuuu

SEQ ID NO: 75837 - RNA, 63 nt, Homo Sapiens
aguguuucuguucaaauagagaccugaauucaaauauuguaguuuagguucaaacagaguaug

SEQ ID NO: 75838 - RNA, 63 nt, Homo Sapiens
ugcagaggaguuuucaagaggcuaucuggugugauauuguaauaggcugaaugcaaaagcaga

SEQ ID NO: 75839 - RNA, 63 nt, Homo Sapiens
gugauaaaaauaggugagagaucauaugaucuaauauuguauugauggaaguauagguaguau

SEQ ID NO: 75840 - RNA, 63 nt, Homo Sapiens
uuuugacagugaacauggucuaaaaaagggaagauauuguagaagauuucacacacacacgcg

SEQ ID NO: 75841 - RNA, 63 nt, Homo Sapiens
uucuuauaaguucguugugucuagagauuguuaauauuguaauuuaauguagacuuacuuuga

SEQ ID NO: 75842 - RNA, 63 nt, Homo Sapiens
auagagcuauucagauauuuuguuauuaaaagcauauuguauuuuauuuucucugguuuguac

SEQ ID NO: 75843 - RNA, 63 nt, Homo Sapiens
guagauuuuuuuaaaguucaauaauaucaauucauauuguaguuguuagcauucuacccagag

SEQ ID NO: 75844 - RNA, 63 nt, Homo Sapiens
uagcuguuuacagguuuuuauauaacuuguucuauauuguaaaccaaugaaggacaacuaauu

SEQ ID NO: 75845 - RNA, 63 nt, Homo Sapiens
guuacaguaaaauucaaccuuuggacuucauguauauuguacauguaagacucugauuucccu

SEQ ID NO: 75846 - RNA, 63 nt, Homo Sapiens
uuucauuagaaauaaguugccaauauggcaugcauauuguaacuuuaucuauugaauaggugu

SEQ ID NO: 75847 - RNA, 63 nt, Homo Sapiens
gaauuuuuacuuuuuugauuuuauacucugcaaauauuguaauuuugucuaggcaacuagugg

SEQ ID NO: 75848 - RNA, 63 nt, Homo Sapiens
aagacaaagacauuucaaauaacugcagaaaaaauauuguaguuugaauauuuaagcaauaaa

SEQ ID NO: 75849 - RNA, 63 nt, Homo Sapiens
guaaacuuagcccacaguggcaaauaaugaguaauauuguaauauguuccaguugcaccucag

SEQ ID NO: 75850 - RNA, 63 nt, Homo Sapiens
uuuucuuuaaagcccucuccuuuagaauuuaaaauauuguaccauugaagaguuuggaugugu

SEQ ID NO: 75851 - RNA, 63 nt, Homo Sapiens
ucauuuuuuuauuaacagcaacuaaaauuuuauauauuguaaccaguguuaaaagucuuaaaa

SEQ ID NO: 75852 - RNA, 63 nt, Homo Sapiens
gagccaucgcccagcccagaagcuaauuuuuuaauauuguauauggucuuauuuauacuugaa

SEQ ID NO: 75853 - RNA, 63 nt, Homo Sapiens
uuuguaaacccugucuugucaaauaaguguauaauauuguauuauuaauuuauuuuuacuuuc

SEQ ID NO: 75854 - RNA, 63 nt, Homo Sapiens
ugcauauguuaacuagcuugauuuaacuauuccauauuguauccacaauuuaugauaucacuu

SEQ ID NO: 75855 - RNA, 63 nt, Homo Sapiens
uguuauucacaaaauacucauucucauuuauguauauuguauguuuaacccccagugggauuu

SEQ ID NO: 75856 - RNA, 63 nt, Homo Sapiens
uuuauaaaugcaugucugauuguacuuguaacaauauuguaaugaacggcugugcaguaggcc

SEQ ID NO: 75857 - RNA, 63 nt, Homo Sapiens
aauuuguuuuaugauuuaaagcaucugguuugcauauuguauuguaauacugauacaguuugg

SEQ ID NO: 75858 - RNA, 63 nt, Homo Sapiens
uagguauuuauagcaugaagaaaaucagacuauauauuguagacuauguauuauucuaacaug

SEQ ID NO: 75859 - RNA, 63 nt, Homo Sapiens
caccuucuuguguauauuacuuggcaugagaugauauuguacuuguauaggauucuagcaauu

SEQ ID NO: 75860 - RNA, 63 nt, Homo Sapiens
caauuuuuuuaauuuuguauuuuccaagugugcauauuguacacuuuuuuggggauaugcuua

SEQ ID NO: 75861 - RNA, 63 nt, Homo Sapiens
uuuuuaguguggcuuuaguauggcuuccuuuuaauauuguacauacauuguaucuuuguuuua

SEQ ID NO: 75862 - RNA, 63 nt, Homo Sapiens
uccaaugcaaucaacucuguauuauauguauaaauauuguaauucugcaauuggggaaaauag

SEQ ID NO: 75863 - RNA, 63 nt, Homo Sapiens
acacuuuuaguauucaccaguuauuuuuacaccauauuguauuauguauauugucucguguuu

SEQ ID NO: 75864 - RNA, 63 nt, Homo Sapiens
cauauauacauauuuccuuuugccaaccuugagauauuguaugcacuccaaucuccaccuucc

SEQ ID NO: 75865 - RNA, 63 nt, Homo Sapiens
ugaaaaguuuuaaagauaugauuucuuuauuuuauauuguacaauuuaauuauuuccagauaa

SEQ ID NO: 75866 - RNA, 63 nt, Homo Sapiens
gaugggugggguggggaucuaugcacacugaugauauuguaggaguuaguguucucucauuua

SEQ ID NO: 75867 - RNA, 63 nt, Homo Sapiens
ggaauguacccauguacauaugugaacuuuuucauauuguauuaucaagguauagacuuuuuu

SEQ ID NO: 75868 - RNA, 63 nt, Homo Sapiens
aacuugacagaugaaggacuuuaguugaacuucauauuguaagaacuguuaauaaaaguuguc

SEQ ID NO: 75869 - RNA, 63 nt, Homo Sapiens
uuuuaaaacaguacauuccugaauaaaacaacaauauuguaucuuaaucaaggcugucugaug

SEQ ID NO: 75870 - RNA, 63 nt, Homo Sapiens
uauaaguucuuaagaauguccguccuuugucauauauuguaacuuuuuuuagccuuauuuguc

SEQ ID NO: 75871 - RNA, 63 nt, Homo Sapiens
cauuguagcuguucaugugucugcuucuauugcauauuguaaaauuauuaacuacuucccaaa

SEQ ID NO: 75872 - RNA, 63 nt, Homo Sapiens
aauuguuuuguuaauggaaaguuuaaguaaauuauauuguaauaaaaagguagauaaaccauu

SEQ ID NO: 75873 - RNA, 63 nt, Homo Sapiens
cuguguuguuacagucuuagagguugcaguacuauauuguaagcuuugguguuuguuuaauua

SEQ ID NO: 75874 - RNA, 63 nt, Homo Sapiens
aauuuugucaaagauguacuauugaaagguggaauauuguaaagccuuuuuaagcuguuucau

SEQ ID NO: 75875 - RNA, 63 nt, Homo Sapiens
cauauacuuuggcuguauugaguaggcauuuuaauauuguaaaaacaugauuugaugcuauaa

SEQ ID NO: 75876 - RNA, 63 nt, Homo Sapiens
cuuacaaaagcuguaaaaauuuuuuuuaaaguaauauuguauggaaucuccuaguaaaaguca

SEQ ID NO: 75877 - RNA, 63 nt, Homo Sapiens
uuagauuacaguagucccccgugggauaagauuauauuguauucugaagaauuuucaaggcgg

SEQ ID NO: 75878 - RNA, 63 nt, Homo Sapiens
gucaguguauaaaauaacacaaacauucaauguauauuguauauaagauguauuuguaugugu

SEQ ID NO: 75879 - RNA, 63 nt, Homo Sapiens
ugauaauaugaucguauucuguguauauaauauauauuguaugguauggguccauauguacgu

SEQ ID NO: 75880 - RNA, 63 nt, Homo Sapiens
gaagguagguauauugguggaauauuucacuuuauauuguaaaaaaaaauuuucaucuaaagu

SEQ ID NO: 75881 - RNA, 63 nt, Homo Sapiens
auaucuauuccguauuagaaguaaaguuuaaccauauuguaaacuucaguuuugaggccaugu

SEQ ID NO: 75882 - RNA, 63 nt, Homo Sapiens
ucuuaauauuuaacuuauucggacauuauugccauauuguaugacuugguaggaaaaaaagua

SEQ ID NO: 75883 - RNA, 63 nt, Homo Sapiens
gaaugccugccuuuccugguuauuuuuuguaccauauuguaaauuauauuauuuauucuuuac

SEQ ID NO: 75884 - RNA, 63 nt, Homo Sapiens
ugugugguuuaagcagugguacuguuguauaucauauuguaaaguaucauacugccaagaaaa

SEQ ID NO: 75885 - RNA, 63 nt, Homo Sapiens
aagaucuauaucugguauaacuauucuuguuuuauauuguauuauacuggaacagcucguguc

SEQ ID NO: 75886 - RNA, 63 nt, Homo Sapiens
uguguacgguauuuuuuauuugacuaaaucaauauauuguacagccuaaguuaauaaauguua

SEQ ID NO: 75887 - RNA, 63 nt, Homo Sapiens
acuggagacagugaugaaucagcuacaaagguaauauuguauuaaaaucauguuuaagauagc

SEQ ID NO: 75888 - RNA, 63 nt, Homo Sapiens
accaucucaagggaaaauggaggcuccagcagcauauuguaccgcuaccccuuugaaaggcug

SEQ ID NO: 75889 - RNA, 63 nt, Homo Sapiens
cgccagcacuuaagauuauauguuuacuaauguauauuguauuuuuugguaaggaccaaaaaa

SEQ ID NO: 75890 - RNA, 63 nt, Homo Sapiens
uguuguagugaaauuauacagauagaguuccauauauuguauuuguuucaaugguaaauccuu

SEQ ID NO: 75891 - RNA, 63 nt, Homo Sapiens
uugcacacugcuuuauuuucgaauaauaaugccauauuguauuuuucgcaaaaaaccuagcug

SEQ ID NO: 75892 - RNA, 63 nt, Homo Sapiens
acagcuuuaaaaauauuuauuguucuuguuaucauauuguaaauacaaccuguaucugcuggg

SEQ ID NO: 75893 - RNA, 63 nt, Homo Sapiens
uuucaguuagaaaucagccaccugagauugaaaauauuguaacucaccaaaaccaccccagug

SEQ ID NO: 75894 - RNA, 63 nt, Homo Sapiens
uuaugguguuggagugaagcaagaaaucuuuccauauuguacuaaauaaagaccacacgguua

SEQ ID NO: 75895 - RNA, 63 nt, Homo Sapiens
uuuagaaauguuuuguuaaauuugcaaacccagauauuguacacuuaaaacccaauugaguga

SEQ ID NO: 75896 - RNA, 63 nt, Homo Sapiens
uugcauguauccauaccugguaagccuuauauaauauuguaacaaagauaacauuguuauucu

SEQ ID NO: 75897 - RNA, 63 nt, Homo Sapiens
acacauuuuuaaaccuggcaaaagaugaagagaauauuguaaauauaaaaguuuaacuguugg

SEQ ID NO: 75898 - RNA, 63 nt, Homo Sapiens
cuuugggacuuugucaucuuccagaaaggaaacauauuguauauuuggcccagugugauugau

SEQ ID NO: 75899 - RNA, 63 nt, Homo Sapiens
guauaauuucguuguaaaaucuguaaguuguaaauauuguacauaguuaaaucuguauucugu

SEQ ID NO: 75900 - RNA, 63 nt, Homo Sapiens
cugcccggcccaagcucuacuuguguacaguguauauuguauaauagacaauugugucuacua

SEQ ID NO: 75901 - RNA, 63 nt, Homo Sapiens
aacuauauauuauauguauauuuauuuuaaauaauauuguauauuuuauguuuguaaauuguu

SEQ ID NO: 75902 - RNA, 63 nt, Homo Sapiens
auuuaaaguuuuuuucauuuuacgugagcaucuauauuguacagggcugggggggcccuuggc

SEQ ID NO: 75903 - RNA, 63 nt, Homo Sapiens
ggucuucuagggcacaaaacucacucuagguuuauauuguauguagcuuauauuuuuuacuaa

SEQ ID NO: 75904 - RNA, 63 nt, Homo Sapiens
auuuuguccuuuuacuuuuuuaaaaaauguuacauauuguaugcacugugcugaugcaagaau

SEQ ID NO: 75905 - RNA, 63 nt, Homo Sapiens
ucuaagugaaauaacucaggaauggagaaccaaauauuguacauccucacuuauaagugggag

SEQ ID NO: 75906 - RNA, 63 nt, Homo Sapiens
aauucuauauaauaagguacaacgaaaagaaauauauuguacaagcuguggguaaaauaugca

SEQ ID NO: 75907 - RNA, 63 nt, Homo Sapiens
acagguagaauuaucuaauuaaggcuuaaacccauauuguaaaaccugaacugaacaccauug

SEQ ID NO: 75908 - RNA, 63 nt, Homo Sapiens
uuuaaucauucauagugcugcuuaguaagaaaaauauuguauugauuagaauguuuaguccua

SEQ ID NO: 75909 - RNA, 63 nt, Homo Sapiens
uuucaaauguauaauauguuaucacuuugacugauauuguaauucauuucaccuguaaacugu

SEQ ID NO: 75910 - RNA, 63 nt, Homo Sapiens
aaacuuuucauuuagaaaucguguucacaaaauauauuguauuauugguucuuuaucuuuauu

SEQ ID NO: 75911 - RNA, 63 nt, Homo Sapiens
uaaauaaugaaaugcauuaaccucaucaguaucauauuguauacuacucagaauauaaugacu

SEQ ID NO: 75912 - RNA, 63 nt, Homo Sapiens
auaauaugaaggcuuauauuucucaaaggagaaauauuguacagaaaaucauauauccuaucu

SEQ ID NO: 75913 - RNA, 63 nt, Homo Sapiens
uuaacuacaguguaaguuucgugcaccuaauuuauauuguauuuaaaccaaagucucugacaa

SEQ ID NO: 75914 - RNA, 63 nt, Homo Sapiens
uuuuuauuucuguaagccaauacuauuucaaauauauuguacuuaaauggaaaacaaaaaccc

SEQ ID NO: 75915 - RNA, 63 nt, Homo Sapiens
aucaacauuuuuaaauuaaaauagcuauuuuauauauuguaguauacacuaugugcauuuaua

SEQ ID NO: 75916 - RNA, 63 nt, Homo Sapiens
agauucacggacccagagcuuuuccauguguuuauauuguaaauauuuuugauuucaucaaau

SEQ ID NO: 75917 - RNA, 63 nt, Homo Sapiens
guugaaacucuuauuagaaacuuucaguuggugauauuguauucuagaagauauaaaugagag

SEQ ID NO: 75918 - RNA, 63 nt, Homo Sapiens
aucucagaaguaguuugcugcuaauauauacauauauuguauaaaaagguauauuuugguuuu

SEQ ID NO: 75919 - RNA, 63 nt, Homo Sapiens
gcuuaaauauagucuugaagggcuuguuuugaaauauuguauauauuuuuucaaauguauaca

SEQ ID NO: 75920 - RNA, 63 nt, Homo Sapiens
cagggcaggcugccguugcuaaaugauuuaauaauauuguaauucuguauuucuuugggggga

SEQ ID NO: 75921 - RNA, 63 nt, Homo Sapiens
ccuugguuucagaagagaguaguuuuauuauaaauauuguauggacuuuguauauuaagagag

SEQ ID NO: 75922 - RNA, 63 nt, Homo Sapiens
uuuucuaagcauauucaaaauaugugaacuaugauauuguaauaugagauuuuuuaagggcuu

SEQ ID NO: 75923 - RNA, 63 nt, Homo Sapiens
uaacccaacacauuuuuaaauucauuucuggauauauuguagcgcuuacuagacgaacaaucu

SEQ ID NO: 75924 - RNA, 63 nt, Homo Sapiens
guucaauuucaacauguaugguuuccaaaaauaauauuguaaacuuugucagacauucuggag

SEQ ID NO: 75925 - RNA, 63 nt, Homo Sapiens
ucgugguaguccuuuccuguaacuguuaucauaauauuguauuaguaaccacuuuaaugcaau

SEQ ID NO: 75926 - RNA, 63 nt, Homo Sapiens
ccuuugucaaaccuuguuucuaguagacuuuaaauauuguaucgaauuuuuuccuugugcuuc

SEQ ID NO: 75927 - RNA, 63 nt, Homo Sapiens
uuuccuccauuacuuauuaauccauuagguuuuauauuguacuuacacaucucacuucagagu

SEQ ID NO: 75928 - RNA, 63 nt, Homo Sapiens
gaaauuauuuuccugagccuuuuguuuuacgguauauuguaaacuuuuauguuaaagaaaaaa

SEQ ID NO: 75929 - RNA, 63 nt, Homo Sapiens
acuguauucuuauguuguuugaaaaugcuauuuauauuguaaagaagcgggcgggugccccug

SEQ ID NO: 75930 - RNA, 63 nt, Homo Sapiens
cuguguaaaaauauuuuuuuuuaaucugcugccauauuguagcucaauacaaugugaauuugu

SEQ ID NO: 75931 - RNA, 63 nt, Homo Sapiens
ccuuaauuuguacugucugcggcauuuuuuauaauauuguauauagugacugacaaauauugu

SEQ ID NO: 75932 - RNA, 63 nt, Homo Sapiens
auuuuuuauaauauuguauauagugacugacaaauauuguauuacuguacauagagagacagg

SEQ ID NO: 75933 - RNA, 63 nt, Homo Sapiens
uaaaacuugaaguagugacaccuaccugcggucauauuguagagagaugcucaguguuaaaac

SEQ ID NO: 75934 - RNA, 63 nt, Homo Sapiens
auuucauuauuauuacccauacuguugccacucauauuguaagucaguuuuuucauugcuggu

SEQ ID NO: 75935 - RNA, 63 nt, Homo Sapiens
ugcuuuacaggaguuugucauguauugacuuuaauauuguauuuugguaauaaauuuuuuguu

SEQ ID NO: 75936 - RNA, 63 nt, Homo Sapiens
acaauggcuguagacuuguauauggcuccuuuaauauuguaaagaugcugauguacaauuguc

SEQ ID NO: 75937 - RNA, 63 nt, Homo Sapiens
gcccccuuucugcccugggggcccaggauguagauauuguacaaagguuucuaaaucccuucu

SEQ ID NO: 75938 - RNA, 63 nt, Homo Sapiens
gcuccagacuugggaaacuauucaugaauauuuauauuguaugguaauauaguuauugcacaa

SEQ ID NO: 75939 - RNA, 63 nt, Homo Sapiens
auuucuucuuuauuuuucuguaggauggagaugauauuguagcuguuuguacauaauguaauc

SEQ ID NO: 75940 - RNA, 63 nt, Homo Sapiens
ugagccaugugauaguuuuaccucauauuaaauauauuguacagaaguaaaaauaaucaugua

SEQ ID NO: 75941 - RNA, 63 nt, Homo Sapiens
uuugaaucauuguugcaggaggagaggaaaaaaauauuguauuaauuauggauggaggaagag

SEQ ID NO: 75942 - RNA, 63 nt, Homo Sapiens
aauauaaagacugugaaaaauuauacuugagaaauauuguacaacaccuucacaggaaagcau

SEQ ID NO: 75943 - RNA, 63 nt, Homo Sapiens
augccuuucuauuucaauugugguugcuauuccauauuguaggcacuuauuuauaagcccucu

SEQ ID NO: 75944 - RNA, 63 nt, Homo Sapiens
gauuucagacucucuuaugaaacauagauguauauauuguauagaauauuauuuucacauuga

SEQ ID NO: 75945 - RNA, 63 nt, Homo Sapiens
cuguaaauuuauucagcugcauaauauucucuaauauuguauaguaagaugagcaauugcaac

SEQ ID NO: 75946 - RNA, 63 nt, Homo Sapiens
gaugcuucugugaauuugaaaaaaaugaugaacauauuguaauuuuaaaaaauuagagugaag

SEQ ID NO: 75947 - RNA, 63 nt, Homo Sapiens
uaauaccggaguauuuuauggaacuaaaauuuaauauuguauauugugacuuccucuaaucac

SEQ ID NO: 75948 - RNA, 63 nt, Homo Sapiens
uccucuguuguaguuuaaacacuacgugcgucaauauuguaaaacccugccacugcuuucuua

SEQ ID NO: 75949 - RNA, 63 nt, Homo Sapiens
auugcagaguacagagaacugaaccagcuccugauauuguaguuagcagucuuccuggcuucu

SEQ ID NO: 75950 - RNA, 63 nt, Homo Sapiens
ugaauagauuuuuuuguaaauaugaccuuuaagauauuguauuauguaaaauauguauauacc

SEQ ID NO: 75951 - RNA, 63 nt, Homo Sapiens
gacaagggaaaccaugaguaaugccacaauggcauauuguaaaugucauuuuaaacauuggua

SEQ ID NO: 75952 - RNA, 63 nt, Homo Sapiens
uuagacauacgcuugucuccaauuuauaugcugauauuguacuuucaugaacuugauccuauu

SEQ ID NO: 75953 - RNA, 63 nt, Homo Sapiens
ggaucaauauuuugcuuuuuuuuuuaacagguuauauuguacaagcuguuuguaagcacgauu

SEQ ID NO: 75954 - RNA, 63 nt, Homo Sapiens
aaauauguacauaucuaggucauuuaugucuuuauauuguaauuagaauauuucagaaauaua

SEQ ID NO: 75955 - RNA, 63 nt, Homo Sapiens
uauuuauggcuaccuauguguuuguaagcagguauauuguauauuaguguauuaguaauacua

SEQ ID NO: 75956 - RNA, 63 nt, Homo Sapiens
uaguacuauuccuguuguaaaguuagauuuugcauauuguaucuaucaaaauauguuuggguu

SEQ ID NO: 75957 - RNA, 63 nt, Homo Sapiens
cuuucauaaguuguuaucuagucaauguaauguauauuguauugaaauuuacagugugcaaaa

SEQ ID NO: 75958 - RNA, 63 nt, Homo Sapiens
cagauuguaagaucuaguccggacuugcuguguauauuguaacguuaaaugaaaaaagaaccc

SEQ ID NO: 75959 - RNA, 63 nt, Homo Sapiens
aaucccuuaacaguuguauuuaacagaaauuguauauuguaauuuaaaauaauuauauaacug

SEQ ID NO: 75960 - RNA, 63 nt, Homo Sapiens
ucauauauuaccguuauguccucaaaauuugcaauauuguaguccaauacagucacacaucag

SEQ ID NO: 75961 - RNA, 63 nt, Homo Sapiens
uguucaaguauuguuaaugauuauguucaaugaauauuguaaauaaguugaccuucucuuaga

SEQ ID NO: 75962 - RNA, 63 nt, Homo Sapiens
uaauauuaucuuaucuauugggugguaugugaaauauuguacauagaccugaugaguuguggg

SEQ ID NO: 75963 - RNA, 63 nt, Homo Sapiens
gcuuuguuuuuucaguuugcuguuucuguagccauauuguauucugugucaaauaaaguccag

SEQ ID NO: 75964 - RNA, 63 nt, Homo Sapiens
ugucccccuggauagaacgugcauuuaaagaauauauuguacuuacugugacagcagauaaua

SEQ ID NO: 75965 - RNA, 63 nt, Homo Sapiens
uaccuguauauguuuuccugucuguauuccugcauauuguauaaaauauguaaagugcagucu

SEQ ID NO: 75966 - RNA, 63 nt, Homo Sapiens
uuuacucuuauuuucagaaacaucagaaaauauauauuguauguaacuagaucuaauauauau

SEQ ID NO: 75967 - RNA, 63 nt, Homo Sapiens
agagaauauauuaaaugguuuuuaaaauuaauaauauuguauuaaugaucagaaccauuuuac

SEQ ID NO: 75968 - RNA, 63 nt, Homo Sapiens
uuugucaccguaucauaugugcauuuaccauguauauuguacacauucacucccuugauguca

SEQ ID NO: 75969 - RNA, 63 nt, Homo Sapiens
uaggauagauagaaugguuauuuuaugcaagaaauauuguaccgcaagggugguuuggaugaa

SEQ ID NO: 75970 - RNA, 63 nt, Homo Sapiens
auuuucucucuuguuuuugguuuuucaccauugauauuguauuuagaagguuucaggugggug

SEQ ID NO: 75971 - RNA, 63 nt, Homo Sapiens
aguucucauguauugggggguggggguggguacauauuguauuugguauuuguguuccaguua

SEQ ID NO: 75972 - RNA, 63 nt, Homo Sapiens
acagcauucaugauguuaccuucacuuuucaaaauauuguagaaggauuuuucucaugcucuu

SEQ ID NO: 75973 - RNA, 63 nt, Homo Sapiens
ccuuucagcugccaguuuugaauaaugaauaucauauuguaucaucaaugcugauauuuaacu

SEQ ID NO: 75974 - RNA, 63 nt, Homo Sapiens
ugugaaacgaaaaaagcaauuuucaaaugguauauauuguaucccauuuuuguaaaaaaaaug

SEQ ID NO: 75975 - RNA, 63 nt, Homo Sapiens
guuauuuguguguguguguccgaucucacaaguauauuguaaacccuucggugggugggggcc

SEQ ID NO: 75976 - RNA, 63 nt, Homo Sapiens
guguaaagcacagauuucaacagagugcuuggcauauuguagggugcucaauggugguuuuua

SEQ ID NO: 75977 - RNA, 63 nt, Homo Sapiens
cuuaaaacgucaaucaacaaaacuuuguuuuaaauauuguaauuguggagaaaaguaaacuua

SEQ ID NO: 75978 - RNA, 63 nt, Homo Sapiens
uuuucuauaauuuaaauauaugcuaagucuuauauauuguagauaauacaguucggugagcua

SEQ ID NO: 75979 - RNA, 63 nt, Homo Sapiens
uguaugccaagaaaauucuuuuuauuggugccuauauuguaacaauuauuuuuaaugcauugu

SEQ ID NO: 75980 - RNA, 63 nt, Homo Sapiens
auuguaacuaaaaaagcugacauugacccagacauauuguacucuuucuaaaaauaauaauaa

SEQ ID NO: 75981 - RNA, 63 nt, Homo Sapiens
cauuagguuuaauuacaaaauuugaucacgaucauauuguagucucucaaagugcucuagaaa

SEQ ID NO: 75982 - RNA, 63 nt, Homo Sapiens
uccuggacauucauuccagagaaaugaaaaccuauauuguacuuguacucaaauauucauagg

SEQ ID NO: 75983 - RNA, 63 nt, Homo Sapiens
gugcagauaacaaaacugcuccuuuacuuaauuauauuguagucuauauaaaguuacuuuucc

SEQ ID NO: 75984 - RNA, 63 nt, Homo Sapiens
aaccuaaaacgcagagaaguaguguugcaguguauauuguaacaaaacguguuaucaauauag

SEQ ID NO: 75985 - RNA, 63 nt, Homo Sapiens
ucuuuugauguuucaaaaggauuugugaaaaauauauuguauuugaauuuacagugaugagaa

SEQ ID NO: 75986 - RNA, 63 nt, Homo Sapiens
uauuagggaagagaagaaugugcguacuguaucauauuguagcagcacuuucaagugagcugu

SEQ ID NO: 75987 - RNA, 63 nt, Homo Sapiens
uguuuauucuucauaugguauuuuugaagauauauauuguauggaagauaccuguguccaaaa

SEQ ID NO: 75988 - RNA, 63 nt, Homo Sapiens
cccucauuuguuuaucugauggguuguaaaagcauauuguacccaaggcagaagcuuggagga

SEQ ID NO: 75989 - RNA, 63 nt, Homo Sapiens
uguuuugucccaguuguauagcuuaguauugugauauuguauauuuggguguaaagcguuuuu

SEQ ID NO: 75990 - RNA, 63 nt, Homo Sapiens
caugguaaauuaauuguauaccuuugaaaagggauauuguaucuuaugaccuauuuagcaaug

SEQ ID NO: 75991 - RNA, 63 nt, Homo Sapiens
uugauuuggaaaaguauuggauuauuaauguuuauauuguacccuuucuggcaugccuguacu

SEQ ID NO: 75992 - RNA, 64 nt, Homo Sapiens
aucacuuggucaccuuggacgcugccauuucuccugaggacauaacaaccacaggugucucauu

SEQ ID NO: 75993 - RNA, 64 nt, Homo Sapiens
cacaggugucucauugcugcaaugguuuggagguugaggacaaccaggucauggguauguggag

SEQ ID NO: 75994 - RNA, 64 nt, Homo Sapiens
cuggcccaaaggccugucugggcccaucuggggcugaggacacacagauacauaaugacaccug

SEQ ID NO: 75995 - RNA, 64 nt, Homo Sapiens
agauacauaaugacaccugcagaaauguauucucugaggacacuuagaauaugaggaagagggu

SEQ ID NO: 75996 - RNA, 64 nt, Homo Sapiens
ccccaucaguuuuccucccucucagaccugucuuugaggacaaacagauuugucagcugucagg

SEQ ID NO: 75997 - RNA, 64 nt, Homo Sapiens
gagacuaugugguccaucgccuucauuguguaaaugaggacacagacuggcuuggucgcaguga

SEQ ID NO: 75998 - RNA, 64 nt, Homo Sapiens
gaagucccugaggcccccaggcuuuuguggguuaugaggacacacccggggcagggugggcagg

SEQ ID NO: 75999 - RNA, 64 nt, Homo Sapiens
acagaggcgggacucagagacucuagggugucccugaggacagcagcccccaagcaagucccuu

SEQ ID NO: 76000 - RNA, 64 nt, Homo Sapiens
gaggcaaagaaauaucaaguuauuguuucccagaugaggacaauauuuaaaccugagagauagg

SEQ ID NO: 76001 - RNA, 64 nt, Homo Sapiens
guggaggagggccgaggugggaaaaccugaagacugaggacaaauaggcccuagcggcagaaag

SEQ ID NO: 76002 - RNA, 64 nt, Homo Sapiens
auuuuuauuuugagcuuuaacaauugcagagauuugaggacauuagagggcauaaaggagcacu

SEQ ID NO: 76003 - RNA, 64 nt, Homo Sapiens
gaaacuaaauuuaaugucuggacugugaagucacugaggacaagcacuaucauugucuucucug

SEQ ID NO: 76004 - RNA, 64 nt, Homo Sapiens
aagaugagcucaacagucucaccaagaugggaccugaggacacaaaaugcuuauuguauugaga

SEQ ID NO: 76005 - RNA, 64 nt, Homo Sapiens
aucuugcuagagaaaagguguguauagguauauuugaggacagcuugggguauuccaugugacu

SEQ ID NO: 76006 - RNA, 64 nt, Homo Sapiens
uaauccaacuacuuggugcguuuauaaagggaacugaggacagcacaauggagacuuuuucagu

SEQ ID NO: 76007 - RNA, 64 nt, Homo Sapiens
aaaaaaaaacaauggaaggcagacagcaagucccugaggacacaucacacaguguccuguagcu

SEQ ID NO: 76008 - RNA, 64 nt, Homo Sapiens
aggaaaaaacaaaaacuccaaacccuucaguggaugaggacaaggucgcagaaaggcauucugu

SEQ ID NO: 76009 - RNA, 64 nt, Homo Sapiens
cugacccuccuccccgggguucacgccagggccuugaggacaggucaguacacaggucaggagc

SEQ ID NO: 76010 - RNA, 64 nt, Homo Sapiens
cccgucguaagaccugucacuggggaaggaagaaugaggacagugggcaggggaggggaagacc

SEQ ID NO: 76011 - RNA, 64 nt, Homo Sapiens
uuuuucucaccuucauucucuuuuuugcuuccucugaggacaucgauagguacagauucucuua

SEQ ID NO: 76012 - RNA, 64 nt, Homo Sapiens
caaggcauacaugaugacagaaaagcuucucagcugaggacacucuaaaagcagaaaagcuaac

SEQ ID NO: 76013 - RNA, 64 nt, Homo Sapiens
gcucccugggagaagcacugggucaggugaggucugaggacagcaggccuucccuaggggaagg

SEQ ID NO: 76014 - RNA, 64 nt, Homo Sapiens
ugaccacugaagggugucagcagagcacacggcaugaggacagagggaggggcacggggaguga

SEQ ID NO: 76015 - RNA, 56 nt, Homo Sapiens
augugguugucuccguuuaauagcacagacuugaaggaguuuaaaaggaggcugga

SEQ ID NO: 76016 - RNA, 64 nt, Homo Sapiens
auuaauuuaauuacuacuagguaauaauaaugggagacuugagugauaauaggggauuuuaaaa

SEQ ID NO: 76017 - RNA, 64 nt, Homo Sapiens
uuuuugaacuaaauagugguaaggaaaauaaaggagacuugaaauaaaaaaaaaaaaaaaaaaa

SEQ ID NO: 76018 - RNA, 64 nt, Homo Sapiens
cugggugugacggugcacacaacuuuauaauaagagacuugaaggagccacugugcguggccag

SEQ ID NO: 76019 - RNA, 64 nt, Homo Sapiens
cuguagacauuucuuuauugccuucuucucuuucagacuugaauuaaggguuacugaucacuua

SEQ ID NO: 76020 - RNA, 64 nt, Homo Sapiens
cuaccuuuggacugccuucccugguuacucugcgagacuugaguccaugaugcuuuccuagugc

SEQ ID NO: 76021 - RNA, 64 nt, Homo Sapiens
gugccuugcucaauggaagacauucagaacaccaagacuugaagacuucgggaaggugucugga

SEQ ID NO: 76022 - RNA, 64 nt, Homo Sapiens
aaaccaggguuuaucuuuugauugcuuugaaacuagacuugagguguuugcuaccugaacacuu

SEQ ID NO: 76023 - RNA, 64 nt, Homo Sapiens
aucuuuauaaagaaagauuaguguuuaagagcguagacuugagcuagacuacccagguugaaac

SEQ ID NO: 76024 - RNA, 64 nt, Homo Sapiens
aggaaaaaaccuagaaaugaugguuagaaucaggagacuugagaacuacgaggaacauggcagc

SEQ ID NO: 76025 - RNA, 64 nt, Homo Sapiens
uuugugccagaacuguccagaguugcccacagacagacuugacccauguggaaugagaaucuug

SEQ ID NO: 76026 - RNA, 64 nt, Homo Sapiens
ggccccugucccagccuggaaccggucccuggggagacuugaaaaccugucuguuguagaaaac

SEQ ID NO: 76027 - RNA, 64 nt, Homo Sapiens
cucacuggugaaacccaggauguagauagagggccacacccacccuguccagaguagagggcac

SEQ ID NO: 76028 - RNA, 64 nt, Homo Sapiens
guggguuucccagcuaacggacaagcuccccugccacacccagugcccacgcaugcucacauac

SEQ ID NO: 76029 - RNA, 64 nt, Homo Sapiens
uuucacaagcacugacccccgggccaggugauaucacacccaaaacacacagugcuuuaagaaa

SEQ ID NO: 76030 - RNA, 64 nt, Homo Sapiens
aacacacacacagugcuuuaggcacacacaugcacacacccauauguccccaaaugcaaacaca

SEQ ID NO: 76031 - RNA, 64 nt, Homo Sapiens
agauauauagagugaaaagucacucacauguuuccacacccaaauuauucaaaaauaaauaaua

SEQ ID NO: 76032 - RNA, 64 nt, Homo Sapiens
uauuuuuuguauuuuuacuguaggcaugcaccaccacacccagccuccugaguagcugggauua

SEQ ID NO: 76033 - RNA, 64 nt, Homo Sapiens
uaauuuuauuuuuugaaaagcaggcauauaccgccacacccagccacccaaauagcuggaacua

SEQ ID NO: 76034 - RNA, 64 nt, Homo Sapiens
guccucuuauucucuguuuuaaagcagaggagggcacacccacacugggauacugggccuuggu

SEQ ID NO: 76035 - RNA, 64 nt, Homo Sapiens
gucacguaagagaacaucuuccagcugccuuuuucacacccacuccagcccucugccccaguuu

SEQ ID NO: 76036 - RNA, 64 nt, Homo Sapiens
cucauuuccacccaaccccaggauuuccacagcacacacccacaggccuggaccugggaugaag

SEQ ID NO: 76037 - RNA, 64 nt, Homo Sapiens
gagcccaggggaaggccaggcuggaccccggcuccacacccacauccagccugcaggccucucu

SEQ ID NO: 76038 - RNA, 64 nt, Homo Sapiens
uucuuuuaccugugccaccagcucuggagacauccacacccauucccagguguccuuccaggcc

SEQ ID NO: 76039 - RNA, 64 nt, Homo Sapiens
gcauccugaagcaguaggaccauuagugugcgugcacacccacguggcacacuguguggugacc

SEQ ID NO: 76040 - RNA, 64 nt, Homo Sapiens
ugacaacgugaccacaccacacaugccuccaacacacacccacagucuaaacaucucuccuucu

SEQ ID NO: 76041 - RNA, 64 nt, Homo Sapiens
cucagugagcccuucucccauuccagaucaucagcacacccacacccaccauaggucucucucc

SEQ ID NO: 76042 - RNA, 64 nt, Homo Sapiens
gagcccuucucccauuccagaucaucagcacacccacacccaccauaggucucucuccuccggu

SEQ ID NO: 76043 - RNA, 64 nt, Homo Sapiens
ugaggcuccacuucuguugaauaugagcggcugucacacccaugagcaaguuuccuugauggaa

SEQ ID NO: 76044 - RNA, 64 nt, Homo Sapiens
ccuguuuacucguaccaaaaaugaagacaagccccacacccaccucagcccuugcuuggccaug

SEQ ID NO: 76045 - RNA, 64 nt, Homo Sapiens
uugcucauccacuucccuacacaucuauggguaucacacccaagacuacccaccaagcucauac

SEQ ID NO: 76046 - RNA, 64 nt, Homo Sapiens
acccaagacuacccaccaagcucauacagggaaccacacccaacacuuagacaugcgaacaagc

SEQ ID NO: 76047 - RNA, 64 nt, Homo Sapiens
uuuccaaagacccugagacacucaccuuggaggccacacccaacugguggcccacaccuaucuu

SEQ ID NO: 76048 - RNA, 64 nt, Homo Sapiens
ccccacauccugugccuccaccaacacgcaggagcacacccagcggccuggcagcucagcuucc

SEQ ID NO: 76049 - RNA, 64 nt, Homo Sapiens
aguacacacgcgugcgcauacacacacccacaggcacacccacccaggcaggggggcagguaca

SEQ ID NO: 76050 - RNA, 64 nt, Homo Sapiens
ggcacacccaccaguacacaggggcagguacacacacacccacagggagcaucuggcaggcagg

SEQ ID NO: 76051 - RNA, 64 nt, Homo Sapiens
cuugugcggggccaggcugggaagcacccagcaucacacccagggaagcgaggcggaugcccug

SEQ ID NO: 76052 - RNA, 64 nt, Homo Sapiens
gcuuccucucggcgcaccccuggggacgcccacccacacccacuguguguucagggacugagcc

SEQ ID NO: 76053 - RNA, 64 nt, Homo Sapiens
aucauauuugcaacucuucucucucuuucuuccccacacccaagaggaggauuggugguagggg

SEQ ID NO: 76054 - RNA, 64 nt, Homo Sapiens
accuugcacugcacaaccuuccuucugcuucucccacacccaguauuugcagaagggcaaagcu

SEQ ID NO: 76055 - RNA, 64 nt, Homo Sapiens
uaauuuuuuuguauuuuuagcaggugcccaccaccacacccagccccaggaguagcugggacua

SEQ ID NO: 76056 - RNA, 64 nt, Homo Sapiens
uaauuuuuuuuuuuuuuuugcaagcaugcaccaccacacccagcccugaguagccggggagcua

SEQ ID NO: 76057 - RNA, 64 nt, Homo Sapiens
aagaaauccccaagaucaucugggucucccucuccacacccagaacugaggcuuggauaucuuc

SEQ ID NO: 76058 - RNA, 64 nt, Homo Sapiens
ucccuccaggcuugggcagggagacucgcagaugcacacccacaaguauucaguucucaaacuc

SEQ ID NO: 76059 - RNA, 52 nt, Homo Sapiens
ugauacagaagaucagcuaagacacacccagcccagauucaacaggaaaccg

SEQ ID NO: 76060 - RNA, 64 nt, Homo Sapiens
ucuucagaggagcuggaacugucuaccccagggacacacccauuucguugcuacccaaguggau

SEQ ID NO: 76061 - RNA, 64 nt, Homo Sapiens
uucagcauguuggucagagacacggucacugauucacacccagucccugccacagaccgucuca

SEQ ID NO: 76062 - RNA, 64 nt, Homo Sapiens
ucucagacacgcacagugggccugcugcaugauucacacccagucccugccacagaccgucuca

SEQ ID NO: 76063 - RNA, 64 nt, Homo Sapiens; identical to SEQ ID NO: 76062

SEQ ID NO: 76064 - RNA, 64 nt, Homo Sapiens
cuccccauggggcagaguggucuccuuacgugcucacacccagucagcuugggucccuaucucu

SEQ ID NO: 76065 - RNA, 64 nt, Homo Sapiens
gagcaaaccgauggucagggagagggcuagagcucacacccagcucggaauagaucuucccuga

SEQ ID NO: 76066 - RNA, 64 nt, Homo Sapiens
cccuuccccauagauaggccauuggcucccaagucacacccacucucacccaucccaccccucc

SEQ ID NO: 76067 - RNA, 64 nt, Homo Sapiens
cccaugccaaggccucccucgggacaccccuacacacacccaggcagaccccuagggauuuaaa

SEQ ID NO: 76068 - RNA, 64 nt, Homo Sapiens
cacugaagcuccucccugccagcgcagugccggccacacccauggagaugggcggccccgcccc

SEQ ID NO: 76069 - RNA, 64 nt, Homo Sapiens
gcaucucggaguucagacuccugaaggaaauccacacacccagaaaguggggacaucaggguag

SEQ ID NO: 76070 - RNA, 64 nt, Homo Sapiens
cggggccuccccucccugcuaggaggcaacucgucacacccaagcugcuggccuccagucccau

SEQ ID NO: 76071 - RNA, 64 nt, Homo Sapiens
uacaugcccugcuuccacguggcugccacgcugacacacccacauucaccaaacccacccgcgc

SEQ ID NO: 76072 - RNA, 64 nt, Homo Sapiens
cugggcgagacccagcaguggacagcaugguccucacacccagcucccugcacacccaggccag

SEQ ID NO: 76073 - RNA, 64 nt, Homo Sapiens
aguggacagcaugguccucacacccagcucccugcacacccaggccagccaccccucccgcucg

SEQ ID NO: 76074 - RNA, 64 nt, Homo Sapiens
aggcaggacagccaugagguggggcugcagccggcacacccagugguggagggccggcgcugcc

SEQ ID NO: 76075 - RNA, 64 nt, Homo Sapiens
aaggucccugcguggggaggugucacaccaggggcacacccagggccaccuggguguaggagag

SEQ ID NO: 76076 - RNA, 64 nt, Homo Sapiens
cagagucaaugccuucaugggaagggcucccagccacacccagaguggcccaaagcuguugaag

SEQ ID NO: 76077 - RNA, 64 nt, Homo Sapiens
ugcccucggagugccacacaugcccagaccuucucacacccacacaaauaggcucugccgugca

SEQ ID NO: 76078 - RNA, 64 nt, Homo Sapiens
cucccaaguagcugggacuacaggcacacgccaccacacccaacuaauuuuuguauuuuuagua

SEQ ID NO: 76079 - RNA, 64 nt, Homo Sapiens
cucccaaagugcugggauuacaggcaugagccaccacacccagcgagacgggguuucauuaugu

SEQ ID NO: 76080 - RNA, 64 nt, Homo Sapiens
cccucccacaggcaagaaccagaggcccaggcugcacacccauuucagccaucaagaacccaca

SEQ ID NO: 76081 - RNA, 64 nt, Homo Sapiens
uggcgggaacgcgagaagggcaccagcagcauuccacacccagcucuuccucaccuuccugucu

SEQ ID NO: 76082 - RNA, 64 nt, Homo Sapiens
uggcagccgguuguaagccuugcacgggacagaccacacccaccgcaaccucauccccucagca

SEQ ID NO: 76083 - RNA, 64 nt, Homo Sapiens
cauccacucucaaccccguccccuucgcacugaccacacccaccccguucggccccgccccccg

SEQ ID NO: 76084 - RNA, 64 nt, Homo Sapiens
cuucccuugcucggggaaagcccccaauucugcccacacccauuuauuuccuuccuuccuuccu

SEQ ID NO: 76085 - RNA, 64 nt, Homo Sapiens
ugggauuacaggcaugagccaccgugcccggcuucacacccauuucuuuaaaaaggaucccgua

SEQ ID NO: 76086 - RNA, 64 nt, Homo Sapiens
agcuuuccaugacccgggagaccuagagaagcugcacacccagggguuccugucccuccgggag

SEQ ID NO: 76087 - RNA, 64 nt, Homo Sapiens
cagaacucccaggucacaugccucccccaacccccacacccauguccucugauccuguccggug

SEQ ID NO: 76088 - RNA, 64 nt, Homo Sapiens
ugugggccaggugcauucacucagaguggggccacacacccaucuacccaguuuccacaagaug

SEQ ID NO: 76089 - RNA, 64 nt, Homo Sapiens
caucuacccaguuuccacaagauguggcuccugccacacccacagggcagccuccuccaaaucc

SEQ ID NO: 76090 - RNA, 64 nt, Homo Sapiens
ugccucccaaguaacugggacuauagcaugccaccacacccagcugauuaucauauuuuuuuuu

SEQ ID NO: 76091 - RNA, 64 nt, Homo Sapiens; identical to SEQ ID NO: 76090

SEQ ID NO: 76092 - RNA, 64 nt, Homo Sapiens
cugacaguucccagugagagaaaugcugaaaguacacugggaucacugggacacugucuuauga

SEQ ID NO: 76093 - RNA, 64 nt, Homo Sapiens
cccagugagagaaaugcugaaaguacacugggaucacugggacacugucuuaugaagguuugcu

SEQ ID NO: 76094 - RNA, 64 nt, Homo Sapiens
uaaugggguguggggugccacuugccaugggaagcacugggaagcggaugggccacggauggag

SEQ ID NO: 76095 - RNA, 64 nt, Homo Sapiens
aguccuuugcuuuggggcccacuugucuagacuccacugggaagcuuuugguucuuuuauaaag

SEQ ID NO: 76096 - RNA, 64 nt, Homo Sapiens
agccgccagcagggaaaucuuucucuauagccggcacugggagcuugcagggacaguccccacc

SEQ ID NO: 76097 - RNA, 64 nt, Homo Sapiens
gagaaccgcagucuuucgaggcgaucgcuaaccucacugggacaacuucugaaacacucuuguu

SEQ ID NO: 76098 - RNA, 64 nt, Homo Sapiens
caggcccagguaugaaugagaggagggauccccgcacugggagagcaggaugggauugaugggc

SEQ ID NO: 76099 - RNA, 64 nt, Homo Sapiens
agagccacggguccugggucggucuggccagaugcacugggaacaccucccacagcccuccacu

SEQ ID NO: 76100 - RNA, 64 nt, Homo Sapiens
uuuauagguguagcuugauuucaguucaaauccccacugggauuguuuuguuggggcaggcagg

SEQ ID NO: 76101 - RNA, 64 nt, Homo Sapiens
agagagguuagguaacuugcucaaggucacacagcacugggacuggaagccagcucuguagaac

SEQ ID NO: 76102 - RNA, 64 nt, Homo Sapiens
aucuauuuuauuaccuugaauauuuaauauuuuucacugggagguuugaagcuuacaaaaugag

SEQ ID NO: 76103 - RNA, 64 nt, Homo Sapiens
cgaggggcugugcugcaggccuccccucgaaagacacugggaggucagcauguuccacaggugu

SEQ ID NO: 76104 - RNA, 53 nt, Homo Sapiens
cagggcccccucccagcugagagcacugggacgcccaccgccccuuucccucc

SEQ ID NO: 76105 - RNA, 64 nt, Homo Sapiens
uaacaauaccaauagcuaggacccggcugcugugcacugggacuggggauuccacauguuugcc

SEQ ID NO: 76106 - RNA, 64 nt, Homo Sapiens
gcacuggucugacccaggacuuuggagccacccacacugggaagacuaggcuaggcagucgguc

SEQ ID NO: 76107 - RNA, 64 nt, Homo Sapiens
ccucaagugauccucccaccucagccugccaaagcacugggauuacaggcaugagccaccaugc

SEQ ID NO: 76108 - RNA, 64 nt, Homo Sapiens
ggaggagaggacaagggaaaucagcucuuggcuccacugggaugagaguggggaugacaugcac

SEQ ID NO: 76109 - RNA, 64 nt, Homo Sapiens
cagaggcuauuguccccuaacaccagacagacaacacugggaaaagacagggcugauaagcuaa

SEQ ID NO: 76110 - RNA, 64 nt, Homo Sapiens
cugugucaaguauaagguuuuucagcaggaguuacacugggagccugagguccucaccuuccuc

SEQ ID NO: 76111 - RNA, 64 nt, Homo Sapiens
ucaugcuguccaggacuucuggcccuguguucaccacugggaaaacguacuucagacuggauag

SEQ ID NO: 76112 - RNA, 64 nt, Homo Sapiens
augcauggggcucugggggaaugcugggaaaaugggcaagcagagugcacagcccucguucugc

SEQ ID NO: 76113 - RNA, 64 nt, Homo Sapiens
acuacuggacuuucaacuggcuuuccuuaggucaggcaagcagacagcuccccacugaagaggu

SEQ ID NO: 76114 - RNA, 64 nt, Homo Sapiens
guaccuacuauaauacaguagcuaacauguauugagcacagauuuuuuuugguaaaacugugaa

SEQ ID NO: 76115 - RNA, 64 nt, Homo Sapiens
ugcaagcuuuaccaaguaauuggcaugacaucugagcacagaaauuaaggcaaaaaaccaaagc

SEQ ID NO: 76116 - RNA, 64 nt, Homo Sapiens
ucugaaagcccgccucuguccuaaaauacaaacaagcacagacauuaaaccuggauacuauaug

SEQ ID NO: 76117 - RNA, 64 nt, Homo Sapiens
guaauuaggugaaaacagcccagguccucccgggagcacagaggggcuaggggcugguccuucu

SEQ ID NO: 76118 - RNA, 64 nt, Homo Sapiens
cuggaaaagugucccagcuuagggauaagugucuagcacagaauggggcacacaguaggugcuu

SEQ ID NO: 76119 - RNA, 64 nt, Homo Sapiens
ggauggcuggauugagcaaugagcagagccaagcagcacagaguccccuggggcuagaggugga

SEQ ID NO: 76120 - RNA, 64 nt, Homo Sapiens
agagacucucccccuugucagccuuccugggcugagcacagauuaccgggucugacaugccagu

SEQ ID NO: 76121 - RNA, 64 nt, Homo Sapiens
cuuagguuugccacaugcagauauauggccacaaagcacagagggaaaccccuuagagagaagc

SEQ ID NO: 76122 - RNA, 64 nt, Homo Sapiens
agcaccaacguugaacagcuagagaagcucugauagcacagaucaagagcgagcccagcagcac

SEQ ID NO: 76123 - RNA, 64 nt, Homo Sapiens
agcucugauagcacagaucaagagcgagcccagcagcacagagauuuaugggcagggcccuaga

SEQ ID NO: 76124 - RNA, 64 nt, Homo Sapiens
gcggcuuccccaucgccuucuggcugcugcagucagcacagagaacagcuuccccaucgccuuc

SEQ ID NO: 76125 - RNA, 64 nt, Homo Sapiens
gcggcuuccccauugccuucuggccgcugcagucagcacagagaacggcuuccccaucgccuuc

SEQ ID NO: 76126 - RNA, 64 nt, Homo Sapiens
auggcuuccccauugccuucaggcagcugcaguuagcacagaggccgucagccugugaacugcc

SEQ ID NO: 76127 - RNA, 64 nt, Homo Sapiens
caagcuacucugacauuaugagaaugaccagagcagcacagaaaauucaggaagauaguaucuc

SEQ ID NO: 76128 - RNA, 64 nt, Homo Sapiens
acaaaguuaauucaaaaagacuuaauuccaggaaagcacagaggugaagaacugcagccaagac

SEQ ID NO: 76129 - RNA, 64 nt, Homo Sapiens
gggcacagcaccccuccccggcaucugccagcucagcacagaagacaccgaaugugcaucugga

SEQ ID NO: 76130 - RNA, 64 nt, Homo Sapiens
gguuugagugaacccucuuucaaagacaauaaauagcacagaauuguccgugcuucugugaggc

SEQ ID NO: 76131 - RNA, 64 nt, Homo Sapiens
uguuguuuucauuucuguuauaaguaaaacuaaaagcacagaauggugggaaaggggcuauaau

SEQ ID NO: 76132 - RNA, 64 nt, Homo Sapiens
auaaacagucucuuuuuuacaaagccuguguuagagcacagauuuaccuaggcuugaagauuug

SEQ ID NO: 76133 - RNA, 64 nt, Homo Sapiens
gccagccccuuagacagaggcagcaacuuguccuagcacagaugugggcuuccuggagcagaag

SEQ ID NO: 76134 - RNA, 64 nt, Homo Sapiens
gucuggauaacuuccacaggaugggggaaagcaaagcacagagacuuuuauaucccauuuauag

SEQ ID NO: 76135 - RNA, 64 nt, Homo Sapiens
ccagagccaggaaccucucacccggugggggcacagcacagaccccucccaccaaccaaccaca

SEQ ID NO: 76136 - RNA, 64 nt, Homo Sapiens
ccagaggcaggaaccucucacccggugggggcacagcacagaccccucccaccaaccagccaca

SEQ ID NO: 76137 - RNA, 64 nt, Homo Sapiens
ccagagccaggaaccucucacccagugggggcacagcacagaccccucccaccaaccagccaca

SEQ ID NO: 76138 - RNA, 64 nt, Homo Sapiens
ccaaagccaggaaccucucacccgguggggacacagcacagaccccucccaccaaccagccacu

SEQ ID NO: 76139 - RNA, 64 nt, Homo Sapiens
uguuucgugcauuggaagacuagagcugauccagagcacagauccuccaucuguuugguggggg

SEQ ID NO: 76140 - RNA, 64 nt, Homo Sapiens
cagaggagagucccagagcaggcguccgcgcgccagcacagaaaugcccgccucuaguucccaa

SEQ ID NO: 76141 - RNA, 64 nt, Homo Sapiens
cuccccggacucggagggggcaaggcugcgucaaagcacagaggccugccucuccaucucucac

SEQ ID NO: 76142 - RNA, 64 nt, Homo Sapiens
ucugcuguagcuuuaaugcagaagcagaaacaggagcacagaccugaggagaaugauagagagu

SEQ ID NO: 76143 - RNA, 64 nt, Homo Sapiens
gacugucaagcauccccuguccccaaguuccaaaagcacagacucaaagggaaaccccccaguc

SEQ ID NO: 76144 - RNA, 64 nt, Homo Sapiens
ccccgagguguguguaggaggcggaggcccgcagagcacagagcaggagaagggcuugggcccu

SEQ ID NO: 76145 - RNA, 64 nt, Homo Sapiens
auacauucuucaacagcauuucaccucuuaccacagcacagaacggaugauuugggcauuacga

SEQ ID NO: 76146 - RNA, 64 nt, Homo Sapiens
cuagaagcaccugcugacacaccugggggcucacagcacagaacccagagcccuacacuccacg

SEQ ID NO: 76147 - RNA, 64 nt, Homo Sapiens
ccgaggugggaaauggugucccugucccucccaaagcacagagcacagaaaugaggccguuuac

SEQ ID NO: 76148 - RNA, 64 nt, Homo Sapiens
gggaaauggugucccugucccucccaaagcacagagcacagaaaugaggccguuuacauggcga

SEQ ID NO: 76149 - RNA, 64 nt, Homo Sapiens
cccauggaagcccagggagacgaaagcucaggggagcacagaagccucccccaucagggcccac

SEQ ID NO: 76150 - RNA, 64 nt, Homo Sapiens
ccuguccuugugcagucugcgacccccucagaccagcacagagacugggugggguggguguuga

SEQ ID NO: 76151 - RNA, 64 nt, Homo Sapiens
agguugagaccaugcagucaccccucauucucacagcacagauguaccugcaugcccagccuua

SEQ ID NO: 76152 - RNA, 64 nt, Homo Sapiens
cagcccgugggucucugucuaagaggcucaggcaagcacagaggauugggaaagacucuuaauu

SEQ ID NO: 76153 - RNA, 64 nt, Homo Sapiens
agugugaggacccuuuucccccgcuugcugugaaagcacagauucauugacuacaguacacugu

SEQ ID NO: 76154 - RNA, 64 nt, Homo Sapiens
ccaugcauuuuuuuuuuuacaguucucaaggaagagcacagaacaauuucucauuucauauuug

SEQ ID NO: 76155 - RNA, 59 nt, Homo Sapiens
ugcggaggaucuacuugugagcuaucugccccaggcaggccucgccuccagcagcccca

SEQ ID NO: 76156 - RNA, 64 nt, Homo Sapiens
acgcaggacucuggagccagaguagaggcuguggcccaggcacuaccugcuggcucccaccuau

SEQ ID NO: 76157 - RNA, 64 nt, Homo Sapiens
aaauguagcccauuaccacauguagccuuggagacccaggcaaggacaaguacacguguacuca

SEQ ID NO: 76158 - RNA, 64 nt, Homo Sapiens
cagagaauccucaccaguucucaccaaccuuccccccaggcaagggcagcugccagcauggugc

SEQ ID NO: 76159 - RNA, 64 nt, Homo Sapiens
uguuugcagcugaagaaacagugucaccugccugcccaggcagcucccuggggacagaggccuu

SEQ ID NO: 76160 - RNA, 64 nt, Homo Sapiens
aaggugcugcuggucuccuggccccuucugaggacccaggcaccccguccuccuccaggccgcc

SEQ ID NO: 76161 - RNA, 64 nt, Homo Sapiens
cccucgucaccuacuccccguaccaccccaccugcccaggcagcggaggaggcccaggccacag

SEQ ID NO: 76162 - RNA, 64 nt, Homo Sapiens
cagcagccccugcagagccucgugcacaggagcccccaggcaguagaaccagcugcaacagcug

SEQ ID NO: 76163 - RNA, 64 nt, Homo Sapiens
ccuuaguucccugauccucuuugggugggguuuccccaggcauaggcugucuggcauggcucau

SEQ ID NO: 76164 - RNA, 64 nt, Homo Sapiens
gaugacuccuggacagugaaaaacuuggaaccuucccaggcagggggaacuggugcuugcuggg

SEQ ID NO: 76165 - RNA, 64 nt, Homo Sapiens
ggcugcugcaggaggccaggcccaggccagagaccccaggcagccugagcucuuggaugugguc

SEQ ID NO: 76166 - RNA, 64 nt, Homo Sapiens
auucuguggcucagcacacaggacugacccacagcccaggcagcggguguguggagauggcgcc

SEQ ID NO: 76167 - RNA, 64 nt, Homo Sapiens
cugcccaggcccacaagccccuccccugggcucucccaggcagggagaauggggagagggaccu

SEQ ID NO: 76168 - RNA, 64 nt, Homo Sapiens
agaggaugguugucccuggggagggcccucuggccccaggcaaccuuagccccucagaacaggg

SEQ ID NO: 76169 - RNA, 64 nt, Homo Sapiens
ggggcguucucccaaagauuaucaagaggagacccccaggcagacuuuugaagagcaaagggaa

SEQ ID NO: 76170 - RNA, 58 nt, Homo Sapiens
cuccgggcgugugaagaacacggcggggcccaggcagcucacugagagggucccauga

SEQ ID NO: 76171 - RNA, 64 nt, Homo Sapiens
caguuaacugagaauuggagaggacaggcuaggucccaggcacagcgagggcccugggcuuggg

SEQ ID NO: 76172 - RNA, 64 nt, Homo Sapiens
ggugcuggagcuaggucuccaggugggccugguucccaggcagcaggugggaacccugggccug

SEQ ID NO: 76173 - RNA, 64 nt, Homo Sapiens
cuuauggcaucaggggcaaaaagucacagcuuaucccaggcacccuggcagguucucagagccu

SEQ ID NO: 76174 - RNA, 64 nt, Homo Sapiens
uccucccuguuuauaugcguacagccugguaacccccaggcaugcaaauauacaaucuguaaca

SEQ ID NO: 76175 - RNA, 64 nt, Homo Sapiens
uguuagcagagucugucucuaauguccagccacccccaggcaucuuugcacagcaugaggcaaa

SEQ ID NO: 76176 - RNA, 52 nt, Homo Sapiens
caaccuugucccaaggaaucggcccaggcagauauucaagaaggugcaguga

SEQ ID NO: 76177 - RNA, 64 nt, Homo Sapiens
ccucugcggaaacuuuccuugaggagagcgcacacccaggcagcgcgccugggagucccggaag

SEQ ID NO: 76178 - RNA, 64 nt, Homo Sapiens
accaggccagggguugauuugaaacccuggcagucccaggcagccauuuguaaccaaggggugc

SEQ ID NO: 76179 - RNA, 64 nt, Homo Sapiens
accgacaggcagcccaagggccuggacaccccuccccaggcaggugcugccccaggaggacugu

SEQ ID NO: 76180 - RNA, 64 nt, Homo Sapiens
gggccuggggccccaagccggggcgucugagcuccccaggcaugaccaaaccucaguggagggg

SEQ ID NO: 76181 - RNA, 64 nt, Homo Sapiens
cugguguucgccccggacaagcgguuaagcgcgacccaggcacugcagcaccccuacgugcaga

SEQ ID NO: 76182 - RNA, 64 nt, Homo Sapiens
ccccacagaguccccccgugcagccaagaacguucccaggcagaacuccgcuccccugcuccaa

SEQ ID NO: 76183 - RNA, 64 nt, Homo Sapiens
acaugagcagugcccaggggucugagcagcagggcccaggcagcucacugggagcccuuggugu

SEQ ID NO: 76184 - RNA, 64 nt, Homo Sapiens
uccccaggcccucacugggacuggccccagugugcccaggcaauauucagaacagacccugugc

SEQ ID NO: 76185 - RNA, 64 nt, Homo Sapiens
cccaguccugguugggaucaugguguguggagcacccaggcagagagccagggcuaggcccugg

SEQ ID NO: 76186 - RNA, 64 nt, Homo Sapiens
cagcugcaggcgcucuccucgcucucuccucucucccaggcaggauccugugcugugcacaccu

SEQ ID NO: 76187 - RNA, 64 nt, Homo Sapiens
gcuuugcugcuuaugagcacagaggaauucaguccccaggcagcccugccucugacuccaagag

SEQ ID NO: 76188 - RNA, 64 nt, Homo Sapiens
acaccacauugccucaacaaccggccccagagugcccaggcacuccugagguagcuucuggaaa

SEQ ID NO: 76189 - RNA, 64 nt, Homo Sapiens
ccacccacgcccagugcgggucugcuugcccugccccaggcagcccuccucuucacucagugcu

SEQ ID NO: 76190 - RNA, 64 nt, Homo Sapiens
ggucacuacagccugauuggcugggaaaccguggcccaggcaguuaugcguacugguuguugag

SEQ ID NO: 76191 - RNA, 64 nt, Homo Sapiens
ucaaaggcccaccagcccggcgcucaugcugagccccaggcacgcagggccggccaccucucuc

SEQ ID NO: 76192 - RNA, 64 nt, Homo Sapiens
uggccugcaugaacuaccagaugaguaagggaaccccaggcaggcggcccugccacagccccca

SEQ ID NO: 76193 - RNA, 64 nt, Homo Sapiens
aauagagaagaaaucccuuugcuagauagggucccccaggcaguccccaguggcgggacacagg

SEQ ID NO: 76194 - RNA, 64 nt, Homo Sapiens
gacucccggccugggcccccaggauucuaggacccccaggcagccccuuggacuggucccgggu

SEQ ID NO: 76195 - RNA, 64 nt, Homo Sapiens
uggaaacagguucuugcauguggauguguguuuccccaggcagacggccccucucuucccagca

SEQ ID NO: 76196 - RNA, 64 nt, Homo Sapiens
aaagacucccaaaaugugccaagaauuucccagucccaggcagggcaggggaaacuaagggcaa

SEQ ID NO: 76197 - RNA, 64 nt, Homo Sapiens
ggcugcugcugggcucagugaaguugcugcuucucccaggcaaggcuguggaccauggaguggc

SEQ ID NO: 76198 - RNA, 64 nt, Homo Sapiens
agccuguccugccuguggccaugacccugccucucccaggcaggggcccgcgauguggaacugc

SEQ ID NO: 76199 - RNA, 64 nt, Homo Sapiens
uuucagcugauuggcagcagucaagucccuguuccccaggcaggucuucuguuuugccccaugg

SEQ ID NO: 76200 - RNA, 64 nt, Homo Sapiens
ucccagacacaucccacacggccugugcacacaucccaggcaugagcugugaccaucccaggag

SEQ ID NO: 76201 - RNA, 64 nt, Homo Sapiens
ccugugcuugcagccaggucaggcccagcugcagcccaggcaggagcagucgccuuucccaccc

SEQ ID NO: 76202 - RNA, 64 nt, Homo Sapiens
agucuccaggccugguccacggacuggcagggaccccaggcacaagagcugccaccccucugcc

SEQ ID NO: 76203 - RNA, 64 nt, Homo Sapiens
cggggcuccuaggcuggugcugcagagacgcagccccaggcagccagcagggaacggaggcugc

SEQ ID NO: 76204 - RNA, 64 nt, Homo Sapiens
gagagcccgccugccuccacgacccugggaggaccccaggcaggggacaaaagccuguuccaga

SEQ ID NO: 76205 - RNA, 64 nt, Homo Sapiens
gcucuguguuuugucuguuacggccggagaaccucccaggcagggccugguguggggucugaga

SEQ ID NO: 76206 - RNA, 64 nt, Homo Sapiens
ggagacguuuucuccauggcacuggcauggagggcccaggcaacccaacguaggccacucagca

SEQ ID NO: 76207 - RNA, 64 nt, Homo Sapiens
guucacauuuccaaaccuuuucugaaucucggaucccaggcaggguguaaugauggcaguagaa

SEQ ID NO: 76208 - RNA, 64 nt, Homo Sapiens
uccgaauuugugaaccugcuucugguaguuagaccccaggcagcuugacccguguguaacuucc

SEQ ID NO: 76209 - RNA, 64 nt, Homo Sapiens
aaugggaauggaccaaagagacguguuucguaagcccaggcacccccuccagagaaggacacaa

SEQ ID NO: 76210 - RNA, 64 nt, Homo Sapiens
aggguggguggguaccauggauguugcacuucugcccaggcagcucccccaggcaucgugugcc

SEQ ID NO: 76211 - RNA, 64 nt, Homo Sapiens
gugugccauguugcacuucuggggggagugaucccccaggcaucgacacugaccaugagucccu

SEQ ID NO: 76212 - RNA, 64 nt, Homo Sapiens
gugagggcuucuccaggggggaggcugaaaucaccccaggcacuucgucucaagcccccccuug

SEQ ID NO: 76213 - RNA, 64 nt, Homo Sapiens
ugcugcugccuguugugguuaucccaggccccagcccaggcagggauggguggcucagccucga

SEQ ID NO: 76214 - RNA, 64 nt, Homo Sapiens
caccuccugaaccuauccagacaccuucuccugacccaggcaccaccugcuuucggggcgaugg

SEQ ID NO: 76215 - RNA, 64 nt, Homo Sapiens
ccaccugcuuucggggcgauggccguagccuccucccaggcaccugucugcaucccucuggcca

SEQ ID NO: 76216 - RNA, 64 nt, Homo Sapiens
gccacuguccgcugucucccccuccccacccugucccaggcagcgguggggggaggaguggauu

SEQ ID NO: 76217 - RNA, 64 nt, Homo Sapiens
gagcgaccagcaggcuccucagacagggcccgggcccaggcagacucagaaucugauaccaaag

SEQ ID NO: 76218 - RNA, 64 nt, Homo Sapiens
gcagaggcaccggugaggaacaggcuuuauuccucccaggcacugcccgguggggaagggucuc

SEQ ID NO: 76219 - RNA, 64 nt, Homo Sapiens
gcagaggcccgguggggaagacagcugcguugcucccaggcacugugccagagguucagggaga

SEQ ID NO: 76220 - RNA, 64 nt, Homo Sapiens
ccccugcccccuucuuucccuuaggaaggugaugggucuguaucuuucucuagaaaugcagaaa

SEQ ID NO: 76221 - RNA, 64 nt, Homo Sapiens
uaaaggaaaaaguuaggagguguuuggacugucuggucuguagcagcuggaauucugagcuuug

SEQ ID NO: 76222 - RNA, 64 nt, Homo Sapiens
cuuacgcccuuuccuaggugaauucucccacaguggucuguaucucaacauuuucuuuuuaaag

SEQ ID NO: 76223 - RNA, 64 nt, Homo Sapiens
aaaauauauauauauaguuucuuuuuauugaucaggucuguaaauguguacuaaaaaaaucaga

SEQ ID NO: 76224 - RNA, 64 nt, Homo Sapiens
gaugaugcuacccaauuugggaauuuaguguuggggucuguacauggaaaagaaagacacuuga

SEQ ID NO: 76225 - RNA, 64 nt, Homo Sapiens
gcucaauuuuaggaagccuucccaugcaauccuaggucuguauugucuugacuugucauauucc

SEQ ID NO: 76226 - RNA, 64 nt, Homo Sapiens
uugguauucuaaccaaaguugacagacugugcgucugucuuaauggaugucuuaggaguugguu

SEQ ID NO: 76227 - RNA, 64 nt, Homo Sapiens
cacaaccuccgccuccuggguucaagggauucuccugucuuagccuccugaguagcugugauua

SEQ ID NO: 76228 - RNA, 64 nt, Homo Sapiens
acaugucucaauucccaugugcugugacuguagacugucuuaccauagacugucuuacccaucc

SEQ ID NO: 76229 - RNA, 64 nt, Homo Sapiens
caugugcugugacuguagacugucuuaccauagacugucuuacccauccccuggauaugcucuu

SEQ ID NO: 76230 - RNA, 64 nt, Homo Sapiens
aacaaagcaguugcucaguagaaagucuagauuucugucuuauaggugauuucugucuuauagg

SEQ ID NO: 76231 - RNA, 64 nt, Homo Sapiens
uagaaagucuagauuucugucuuauaggugauuucugucuuauaggugauuauaaucaagugua

SEQ ID NO: 76232 - RNA, 64 nt, Homo Sapiens
uaauggugcauuuauuauguugugguguuucgugcugucuuaaaaaagggaacaccuggcauuc

SEQ ID NO: 76233 - RNA, 64 nt, Homo Sapiens
cuuugaauguugacccucacuguuucuuuccucccugucuuagaggaaaaauaauaauaacucu

SEQ ID NO: 76234 - RNA, 64 nt, Homo Sapiens
acuuuuccaagcuuuuacauuaacgagcaggccucugucuuaaaagggacucaguauauuaauu

SEQ ID NO: 76235 - RNA, 64 nt, Homo Sapiens
gccacugcacucuauccuggguaacagcgagacucugucuuaaaaauaauaacaauaauaauaa

SEQ ID NO: 76236 - RNA, 64 nt, Homo Sapiens
aguuuaagcaaugguugaaauuuguagguacuaucugucuuauuuuguguguguuuagaggugu

SEQ ID NO: 76237 - RNA, 64 nt, Homo Sapiens
gcacaagaaaaagcauuggcaugagccaaagagucugucuuaauguuacuuuugaaaaucugcu

SEQ ID NO: 76238 - RNA, 64 nt, Homo Sapiens
aagguuacuucuugguucucaacagacagguccucugucuuaaaacaagcuccaagacuaaaca

SEQ ID NO: 76239 - RNA, 64 nt, Homo Sapiens
guuucuucauacugugucuguuuuacauauggcucugucuuauuggaaacagcuaaauuacaac

SEQ ID NO: 76240 - RNA, 64 nt, Homo Sapiens
uucacuuaggaagccacgugccaauaccuggcugcugucuuaacucguagucugggcacaggau

SEQ ID NO: 76241 - RNA, 64 nt, Homo Sapiens
ugacacaaggaaaccuucauggaucuucccuugccugucuuagucacagagagaaauaagagga

SEQ ID NO: 76242 - RNA, 64 nt, Homo Sapiens
ggaagggcagaccccgccaaugauuucucuucaccugucuuaagauuaaauaaaaaagaguguc

SEQ ID NO: 76243 - RNA, 64 nt, Homo Sapiens
agaugaaacuuacacuacuucuccaagccuuuugcugucuuaagaauaagaccugagauuaaca

SEQ ID NO: 76244 - RNA, 64 nt, Homo Sapiens
gcacugccucaguuaaagguuuaauuuuuguuuaaaccuagacgugcaacaaaaguuuuaccac

SEQ ID NO: 76245 - RNA, 64 nt, Homo Sapiens
gcugaaggccaaagccgccuacugguuuguaguuaaccuagagaagguugaaaaauuaauccua

SEQ ID NO: 76246 - RNA, 64 nt, Homo Sapiens
agaaccaagaagggcuagaaccuggaggggcuagaaccuagagaagcuaaaaccugagcuagaa

SEQ ID NO: 76247 - RNA, 64 nt, Homo Sapiens
cuagaaccuggagggcuagaaccuggagagcuagaaccuagaagggcuagaaccuggagggcug

SEQ ID NO: 76248 - RNA, 64 nt, Homo Sapiens
cuagaaccuggagggcuagaaccuggagggcuagaaccuagaagggcuagaaccuggagggcug

SEQ ID NO: 76249 - RNA, 64 nt, Homo Sapiens
cuagaaccuggagggcuagaaccuggagggcuagaaccuagaagggcuagaaccuggagggcua

SEQ ID NO: 76250 - RNA, 64 nt, Homo Sapiens
cuagaaccuggagggcuagaaccuggcagguuagaaccuagaagggcuagaaccuggagagcca

SEQ ID NO: 76251 - RNA, 64 nt, Homo Sapiens
caucaucucauuuaauccucccuuccucccuauuaaccuagagauuguuuuuguuuuuuauucu

SEQ ID NO: 76252 - RNA, 64 nt, Homo Sapiens
ucccuccccgcccucacccgccccacucccuccuaaccuagagauuguuacagaagcugaaauu

SEQ ID NO: 76253 - RNA, 64 nt, Homo Sapiens
aacuggaugggcugcagugaggugggggcgggugggcagggaaugggagaggggaagucuuggc

SEQ ID NO: 76254 - RNA, 64 nt, Homo Sapiens
gcgggugggcagggaaugggagaggggaagucuuggcagggaaaucccuuuuggccacacaguu

SEQ ID NO: 76255 - RNA, 64 nt, Homo Sapiens
cggcugugcccaguaugccucaggugggcugaggggcagggagcucuugaggucccuggagccc

SEQ ID NO: 76256 - RNA, 64 nt, Homo Sapiens
gcucaguggaagcaggacugggggucugggcuggggcagggauuucguccccacccccagccug

SEQ ID NO: 76257 - RNA, 64 nt, Homo Sapiens
ccccuccugccagucccuguccuccucacccccaggcagggaagcacagcccacacgugagcuc

SEQ ID NO: 76258 - RNA, 64 nt, Homo Sapiens
gggacagcccaggucacacgcacaauagggacagggcagggacaagugcuggacucucccgggc

SEQ ID NO: 76259 - RNA, 64 nt, Homo Sapiens
ugcugggggacugaccccucggaaugacacaaauggcagggagcagucaagggcagggagggga

SEQ ID NO: 76260 - RNA, 64 nt, Homo Sapiens
ggaggaaugacacaaauggcacacugcagucaagggcagggaggagaugagaugacugccaugu

SEQ ID NO: 76261 - RNA, 64 nt, Homo Sapiens
gccugcugcugggcgugaugucgcuggaggugcuggcagggacucugauuuggugguccgcgcu

SEQ ID NO: 76262 - RNA, 64 nt, Homo Sapiens
ccuggcucugaacuaguagaugauggugccagagggcagggagcucgccuggggagagggcugu

SEQ ID NO: 76263 - RNA, 64 nt, Homo Sapiens
acuaccccuggaccccuccugcccaagggugccuggcagggagccuucccgcguagccaggugg

SEQ ID NO: 76264 - RNA, 64 nt, Homo Sapiens
cacugccuuuggggcuccugggcacgggugagcuggcagggacaaggcagccagaaaaggagga

SEQ ID NO: 76265 - RNA, 64 nt, Homo Sapiens
augccugggggucccucaccagagacucggugcgggcagggagaaggaaguagccagggugaag

SEQ ID NO: 76266 - RNA, 64 nt, Homo Sapiens
aggcugaagaugugucuucucucuuggugggcuuggcagggacugagcuagggacuaacuguug

SEQ ID NO: 76267 - RNA, 64 nt, Homo Sapiens
auguaagugggcccacccggugggacccccguggggcagggagcugggcccgacauggcuccgg

SEQ ID NO: 76268 - RNA, 64 nt, Homo Sapiens
uucauacaaauucuucuaauugcugugugucccaggcagggagacgguuuccagggaggggccg

SEQ ID NO: 76269 - RNA, 64 nt, Homo Sapiens
ccagccaggccauucuuagucccuggguuggggaggcagggagcuagggcagggaccaaaugaa

SEQ ID NO: 76270 - RNA, 64 nt, Homo Sapiens
ucuuagucccuggguuggggaggcagggagcuagggcagggaccaaaugaacagaaagucucag

SEQ ID NO: 76271 - RNA, 64 nt, Homo Sapiens
auaauggaauggcuggagucugcuguugucagaaggcagggagggugaugaaggacugacccac

SEQ ID NO: 76272 - RNA, 64 nt, Homo Sapiens
cuucacagacaucccugaaaggaagccccuuuggggcagggaggugaggacuucaucucaacau

SEQ ID NO: 76273 - RNA, 64 nt, Homo Sapiens
gccggccccggagucucccaagagggagggacugggcagggacuguggaagagugggaggaagc

SEQ ID NO: 76274 - RNA, 64 nt, Homo Sapiens
cacugugcuuuucugagcuugcuuccuggaacugggcagggacucagaccagacuuuucagauu

SEQ ID NO: 76275 - RNA, 64 nt, Homo Sapiens
gcaggcacauggaggagcuugggggaugacuagaggcagggaggggacuauuuaugaaggcaaa

SEQ ID NO: 76276 - RNA, 64 nt, Homo Sapiens
agaaguaggcaugagggaucacagggccccagaaggcagggaaaggcucugaaagccagcugcc

SEQ ID NO: 76277 - RNA, 64 nt, Homo Sapiens
uaauaccuacacucuccaauuguaagagaaagggggcagggaagcaauauagcuuccauucuaa

SEQ ID NO: 76278 - RNA, 64 nt, Homo Sapiens
gaauugcuauguucaggauguucuagggggugggggcagggacucuuuucguaauaagcacuug

SEQ ID NO: 76279 - RNA, 64 nt, Homo Sapiens
ucuuggggucugggaggcccaggcuaagccauguggcagggaccgucuugcccugcuggccaca

SEQ ID NO: 76280 - RNA, 64 nt, Homo Sapiens
accccugcccugggacuggcagggcaggggcaggggcagggacaguggccaggcggcccgagga

SEQ ID NO: 76281 - RNA, 64 nt, Homo Sapiens
aaguuucucagcugggcucugaccuggggucuggggcagggaacgaacaugguggcuuugggcu

SEQ ID NO: 76282 - RNA, 64 nt, Homo Sapiens
gcuggacacuggccauuuucacuagaguuugccuggcagggaccgaucucugcccccuccucuc

SEQ ID NO: 76283 - RNA, 64 nt, Homo Sapiens
gacccagaaagaacacaguccaggcuaagucucaggcagggacauucccaacugucgcccccuu

SEQ ID NO: 76284 - RNA, 64 nt, Homo Sapiens
gagggaaccugcucacggcccugccuugccuuggggcagggagagggccuguaauucagccugc

SEQ ID NO: 76285 - RNA, 64 nt, Homo Sapiens
ggccuugaaagccauuggagggggaugaagcccaggcagggaaugggacagucaugggaaugug

SEQ ID NO: 76286 - RNA, 64 nt, Homo Sapiens
gucaugggaaugugggggauaaccccaguguggaggcagggacaauuccauguggaugucacca

SEQ ID NO: 76287 - RNA, 64 nt, Homo Sapiens
aagcccuugaagguuuggggagagggggguaucaggcagggagggggcagaggcaaaucaccgg

SEQ ID NO: 76288 - RNA, 64 nt, Homo Sapiens
ccaggaacaggacagggagaccuugugauggcggggcagggagccuguucguagggaagaugag

SEQ ID NO: 76289 - RNA, 64 nt, Homo Sapiens
guccgcacauuucuuaguauucccuccaggcuugggcagggagacucgcagaugcacacccaca

SEQ ID NO: 76290 - RNA, 64 nt, Homo Sapiens
ggcaccguaaguuugauuagugaugucugccacgggcagggauggaaggagcagugugaugucu

SEQ ID NO: 76291 - RNA, 64 nt, Homo Sapiens
ucaucucaaccauccccuccguggcaucaccuuaggcagggaaguguaagaaacacacugaggc

SEQ ID NO: 76292 - RNA, 64 nt, Homo Sapiens
caccuuaggcagggaaguguaagaaacacacugaggcagggaaguccccaggccccaggaagcc

SEQ ID NO: 76293 - RNA, 64 nt, Homo Sapiens
ggcagcugccacccccuucacuggugggaagggaggcagggacucuggggaggcagcaagcaug

SEQ ID NO: 76294 - RNA, 64 nt, Homo Sapiens
gccuggggcugacagggcucguggagccuacaccggcagggacacccgcuggaggguuggugcu

SEQ ID NO: 76295 - RNA, 64 nt, Homo Sapiens
ucccgggcuccugggcccuguucuuaggaucaguggcagggagaaacggguaucucuuuucucu

SEQ ID NO: 76296 - RNA, 64 nt, Homo Sapiens
ccccacucugagguuuccccaagagaaccagauuggcagggagaagcauuguggggcaauuguu

SEQ ID NO: 76297 - RNA, 64 nt, Homo Sapiens
acucucuucugcuaaaucgaggaaggagacacggggcagggagaagggcagggagcggcaggau

SEQ ID NO: 76298 - RNA, 64 nt, Homo Sapiens
ggcaggauggaaggagacacaaaaggcuggagagggcagggagccaggaagaaaaggcuugccc

SEQ ID NO: 76299 - RNA, 64 nt, Homo Sapiens
ucugagggagaugggcuugggggcuguaggaggaggcagggauuccagggugucaggaaggcag

SEQ ID NO: 76300 - RNA, 64 nt, Homo Sapiens
ucugaggcagaugggcuugggggcucuaggaggaggcagggacuccagggugucaggaaggcag

SEQ ID NO: 76301 - RNA, 64 nt, Homo Sapiens
gagaggagggauggagaagcuuaauugcauuucuggcagggaaggcugagucugggccacuugc

SEQ ID NO: 76302 - RNA, 64 nt, Homo Sapiens
cugcguggugcugggauguguagaugagagacagggcagggaauaccuugcuuagcgcccaagg

SEQ ID NO: 76303 - RNA, 64 nt, Homo Sapiens
gggcaguggcauuguuucugcuguggugggaacuggcagggagagggucaccuccacucugguu

SEQ ID NO: 76304 - RNA, 64 nt, Homo Sapiens
uccuuuggugcacucaccguccaccguuccccaaggcagggagagggaguggcccgucccuggg

SEQ ID NO: 76305 - RNA, 64 nt, Homo Sapiens
aaucaucugcggcuuaaacucaucucgcuugaagggcagggagaaacccaugaaucucaggcac

SEQ ID NO: 76306 - RNA, 64 nt, Homo Sapiens
auuccugcaggagcugcagccacccaaagugggaggcagggaggggagcaucugucugccacug

SEQ ID NO: 76307 - RNA, 64 nt, Homo Sapiens
uccuggaacaaagcgacaucgccagcagcaggcuggcagggagugguugaggucugggggccag

SEQ ID NO: 76308 - RNA, 64 nt, Homo Sapiens
ugccaccaugcuucucuguccaagggcccugaggggcagggagaagacuaaucagugggcacac

SEQ ID NO: 76309 - RNA, 64 nt, Homo Sapiens
gucagcccaccugaggcuggcugcuggugugaaaggcagggauucgugcucucagcagacagaa

SEQ ID NO: 76310 - RNA, 64 nt, Homo Sapiens
gggugugccgcucguacuccacgcagggguaugaggcagggagacugagaccucgggagugagg

SEQ ID NO: 76311 - RNA, 64 nt, Homo Sapiens
aggccugcccaugcaggagaccaucuggacaccgggcagggaagggguugggccucaggcaggg

SEQ ID NO: 76312 - RNA, 64 nt, Homo Sapiens
ucuggacaccgggcagggaagggguugggccucaggcagggagggggguggagacgaggagaug

SEQ ID NO: 76313 - RNA, 64 nt, Homo Sapiens
gcuucucugucucaugcucccaggcugcacagcaggcagggagggaggcaaggcaggggagugg

SEQ ID NO: 76314 - RNA, 64 nt, Homo Sapiens
ccacaagccuggcauuucagccagggcuggagaaggcagggacgccugggugagaggcaaaggg

SEQ ID NO: 76315 - RNA, 64 nt, Homo Sapiens
uuguuuuaaaauauuaugauuuggcuacagaccaggcagggaaagagacccgguaauuggaggg

SEQ ID NO: 76316 - RNA, 64 nt, Homo Sapiens
ggcaggccuucggggccccuuucgccugcuuccgggcagggacgaggccugguguccucgcucc

SEQ ID NO: 76317 - RNA, 64 nt, Homo Sapiens
uuaguagagcuaguaggcccuggucgucacucugggcagggaugccgucagccuugagggucgc

SEQ ID NO: 76318 - RNA, 64 nt, Homo Sapiens
ggucgccacccaccuguguguugcccucuguccuggcagggaaacauacaccccuugucucacc

SEQ ID NO: 76319 - RNA, 64 nt, Homo Sapiens
uucuugauaucaaggaaaguggggcacugagaaaggcagggacuugcccaagggcauauaguga

SEQ ID NO: 76320 - RNA, 64 nt, Homo Sapiens
cagggacuugcccaagggcauauagugagacaguggcagggaacccaaugcucugucucuggac

SEQ ID NO: 76321 - RNA, 64 nt, Homo Sapiens
gcuagaaacccagagauggaggcugucuugcuauggcagggaggugacagccugcuggcacugu

SEQ ID NO: 76322 - RNA, 64 nt, Homo Sapiens
agggcaccugaggagacuuuggggacagggcaggggcagggagggaaacugaggaaaucuucca

SEQ ID NO: 76323 - RNA, 64 nt, Homo Sapiens
ccucccaacagcucaaaauuaggccuugggcaggggcagggagagcugcugagccuaaagacug

SEQ ID NO: 76324 - RNA, 64 nt, Homo Sapiens
ucccaaugcagcgccuugucagccaaggugggcaggcagggacuguggcagcuuauguccaaag

SEQ ID NO: 76325 - RNA, 64 nt, Homo Sapiens
ucccgagggcagcgcagggauccggggaagcugcggcagggagcgggcgccggcuucguggcuc

SEQ ID NO: 76326 - RNA, 64 nt, Homo Sapiens
ggcugggggagcuagacaaaauucacacgggaggggcagggaugagacaauauugugcccuggg

SEQ ID NO: 76327 - RNA, 64 nt, Homo Sapiens
ggggucuucugagacuccaccaggagccggagagggcagggagccaaauccagcuaggagguua

SEQ ID NO: 76328 - RNA, 64 nt, Homo Sapiens
gggaacacagauuucuuuggggaaggguggggggggcagggaagggggagggggucaguuucug

SEQ ID NO: 76329 - RNA, 64 nt, Homo Sapiens
gggguguuggaugccuggauaccucagacgcuugggcagggaugcuucuccccccaccacuaac

SEQ ID NO: 76330 - RNA, 64 nt, Homo Sapiens
agcuuucuccggccucagggcagaaaaagggaauggcagggaguaagaggcgcugggcucggag

SEQ ID NO: 76331 - RNA, 64 nt, Homo Sapiens
aggacucaucugucagagugcacaugaaaaaucaggcagggaaucgaaacgacagugcuggagg

SEQ ID NO: 76332 - RNA, 64 nt, Homo Sapiens
aaguggugggugcauuggccuaggcugagcguggggcagggaauuaugggggcugugccccagg

SEQ ID NO: 76333 - RNA, 64 nt, Homo Sapiens
ccuacuuaagggaauaggccaggcuccauccggaggcagggaccaugccaggaggagccccugu

SEQ ID NO: 76334 - RNA, 64 nt, Homo Sapiens
uggguguuugugacaggcccugccugccacccuaggcagggaaagcugucaagacuccugccag

SEQ ID NO: 76335 - RNA, 64 nt, Homo Sapiens
uccaggcaugaucuuccccaucaggcugggcucuggcagggaccugcccaggauggagaugaga

SEQ ID NO: 76336 - RNA, 64 nt, Homo Sapiens
gggcugggaaagaacuuggaggggcaggcagcuaggcagggagggcgggccaggucuggcgcca

SEQ ID NO: 76337 - RNA, 64 nt, Homo Sapiens
ggugccuggcugggcuuugggggcccagggagguggcagggaagccgacugggcugcuggggca

SEQ ID NO: 76338 - RNA, 64 nt, Homo Sapiens
aaggcuuuccaaauaagaguggaggaaacagugaggcagggagacaguucagggaaaaaggaga

SEQ ID NO: 76339 - RNA, 64 nt, Homo Sapiens
agugcggugggugagaauccaagggugacuggguggcagggauggggaggcagcugagggucuc

SEQ ID NO: 76340 - RNA, 64 nt, Homo Sapiens
cagugcuaucugaugacggggaaacaaaauuauucucugagagggaaaggacauuugagggaaa

SEQ ID NO: 76341 - RNA, 64 nt, Homo Sapiens
gaacagcucaccuugucagacagccucagggcaucucugagacacaggggcagaaaaugacauu

SEQ ID NO: 76342 - RNA, 64 nt, Homo Sapiens
agggauggcuugaaaggaaggagacugaaaaacacucugagagcauacacuguccaaggccauu

SEQ ID NO: 76343 - RNA, 64 nt, Homo Sapiens
cacuccccaacagcuuuguugauguagcuuguaucucugagaauuuauuguauuaaaauuaaua

SEQ ID NO: 76344 - RNA, 64 nt, Homo Sapiens
uuuuacaaauacaagugaugugcagcuucuccggcucugagaagaacaccugagagcgcuuucc

SEQ ID NO: 76345 - RNA, 64 nt, Homo Sapiens
uagauuccuucucucaucaacgggaaaguacuuccucugagagugcgagugcaccaugcucacu

SEQ ID NO: 76346 - RNA, 64 nt, Homo Sapiens
ugagcccucauccugcaggcagagccccucagugcucugagaaaccugcccugaacucaccgcc

SEQ ID NO: 76347 - RNA, 64 nt, Homo Sapiens
cagaggaagccuaucuguggggcuggguacauuucucugagacucacggaauguaaguguugag

SEQ ID NO: 76348 - RNA, 64 nt, Homo Sapiens
agugagcucugaucuccaaguucuccuguaugaacucugagauccucgugauuguauagggcuc

SEQ ID NO: 76349 - RNA, 64 nt, Homo Sapiens
cauuucuguugcgcuacugacuuaaaagcuucuccucugagaaaugcagguuuuaaguaauuaa

SEQ ID NO: 76350 - RNA, 64 nt, Homo Sapiens
gagaagcugugcgugccccgggguggguaucuagcucugagaugaacucaguuauaggagaaaa

SEQ ID NO: 76351 - RNA, 64 nt, Homo Sapiens
cuaauccuuuuugccccaggcaaggucccuguaucucugagacaccccgauuggcuggagaauu

SEQ ID NO: 76352 - RNA, 64 nt, Homo Sapiens
gcagagcaacugaggagcucugcgagagugugcccucugagacagcccuguccgccccgcccag

SEQ ID NO: 76353 - RNA, 64 nt, Homo Sapiens
gcaccauaguaggggaaugucuaaagacccacugcucugagauguggucagagagguuucugug

SEQ ID NO: 76354 - RNA, 64 nt, Homo Sapiens
aacuacagcugguggaacagcaagccuaagucuucucugagaggaguuucgugagcugaagaac

SEQ ID NO: 76355 - RNA, 64 nt, Homo Sapiens
aauucaccauaauuauggugcaaggucagugugucucugagaucuaugucuguugguggcaaug

SEQ ID NO: 76356 - RNA, 64 nt, Homo Sapiens
ccaaggcagcagacuguuaaucagacaaacagaucucugagaaggugcaucagcugcuuugaag

SEQ ID NO: 76357 - RNA, 64 nt, Homo Sapiens
gggcagaugaacacggaggcucucuguugucugucucugagaucuuugugucugggaaugccua

SEQ ID NO: 76358 - RNA, 64 nt, Homo Sapiens
cccucuucuucccccaccccgcagaagguuuagccucugagaagguucugcuggggccaugaag

SEQ ID NO: 76359 - RNA, 64 nt, Homo Sapiens
gaggcggcauccccuaggccaguaguacccccagcucugagaaaccucucugucugcaccaggg

SEQ ID NO: 76360 - RNA, 64 nt, Homo Sapiens
cagcccugucugucuccaccccauccccucuugucucugagaaccauucucccaccccaaguuc

SEQ ID NO: 76361 - RNA, 64 nt, Homo Sapiens
ucuccccuggugucuguacuguguacacacaucccucugagaagcacaaggagacgacacgcgc

SEQ ID NO: 76362 - RNA, 64 nt, Homo Sapiens
ugccugauguugauguacuuuucuuguuccgauacucugagaagguaacagugcagauuccacg

SEQ ID NO: 76363 - RNA, 64 nt, Homo Sapiens
agugaaguccagggaaaggcaauccuugguagcucucugagaacuguguugaaauccugucaug

SEQ ID NO: 76364 - RNA, 64 nt, Homo Sapiens
cagaacccagagacaauacaaaaccccucacuuccucugagagggccaaaugcugugagucuga

SEQ ID NO: 76365 - RNA, 64 nt, Homo Sapiens
aaccuccuguacauguguucauguucccagccagcucugagacccaggaaccaaauauuccauu

SEQ ID NO: 76366 - RNA, 64 nt, Homo Sapiens
uuuuggaacccaauggaaucccacuuauucuugacucugagaacuuggcucucuuccccuacuu

SEQ ID NO: 76367 - RNA, 64 nt, Homo Sapiens
uuggaagcucuaggcauuguugguaggcugggcccucugagagguccuuguuuugaugucaccu

SEQ ID NO: 76368 - RNA, 64 nt, Homo Sapiens
agguccuugguugggucaaggcagcagcaccuuucucugagaagccugcccggggagcugcaga

SEQ ID NO: 76369 - RNA, 64 nt, Homo Sapiens
augcgagacucugauggaauacuugguaagaugacucugagaaaggccacccugcugcacuagg

SEQ ID NO: 76370 - RNA, 64 nt, Homo Sapiens
cuugggggucuccaccaguguugucccugccucacucugagagccgggcaccgcccuuucuucc

SEQ ID NO: 76371 - RNA, 64 nt, Homo Sapiens
agggcgggcuugaaggcccuagagaugggcucugcucugagagucucagcuuagcccagcauga

SEQ ID NO: 76372 - RNA, 64 nt, Homo Sapiens
caccccuguggcgagcaccgacccguccucccugcucugagacauauacagucacccuucucuc

SEQ ID NO: 76373 - RNA, 64 nt, Homo Sapiens
agccagcaguccacaguguucacagugcccuuuucucugagaagaggucagugauuggcugugu

SEQ ID NO: 76374 - RNA, 64 nt, Homo Sapiens
aaugugaaguguguugugaguuaaagaguuuuaccucugagauauugggaggggcgcucugaga

SEQ ID NO: 76375 - RNA, 64 nt, Homo Sapiens
aaagaguuuuaccucugagaaguugggaggggcgcucugagauuugagggguugggggaucggc

SEQ ID NO: 76376 - RNA, 64 nt, Homo Sapiens
caggcgaagcugguaccucuggcuacagcuugcucucugagaccuggggcuucacucggaucac

SEQ ID NO: 76377 - RNA, 64 nt, Homo Sapiens
ccucgcuuccucaaaaagaucacagagggaggagcucugagaacagucuccuucaacaguucgg

SEQ ID NO: 76378 - RNA, 64 nt, Homo Sapiens
uggguucaauuccuucaauuuuuaaaaaacuggucucugagaguuuuuuaaaucauugagagcc

SEQ ID NO: 76379 - RNA, 64 nt, Homo Sapiens
caagcacacuuugguuccuucuccgggcggcucucucugagacccaaggcugcagucccucagu

SEQ ID NO: 76380 - RNA, 64 nt, Homo Sapiens
aguauaucagaugacacuggcaauggaucucaggcucugagauaagaaagacaagugacagggg

SEQ ID NO: 76381 - RNA, 64 nt, Homo Sapiens
aucuagccuccccucuguccccuuccggagggggcucugagagaagaaaagaaggaagcaguug

SEQ ID NO: 76382 - RNA, 64 nt, Homo Sapiens
auuuauuuggaaauauucuaugaccacuuuacagaugaggaaacaggccucaagcguggagggg

SEQ ID NO: 76383 - RNA, 64 nt, Homo Sapiens
acaagucuugcugugcuuuauuugugaaacuuuaaugaggaaaaaacaaauaauaaauguucuc

SEQ ID NO: 76384 - RNA, 64 nt, Homo Sapiens
uguucagcaagaggaagggcgagaaggagcuuggaugaggaaacuucccuaagaaacaauggaa

SEQ ID NO: 76385 - RNA, 64 nt, Homo Sapiens
aaacuguggguaaucaaacugaaugaaugaaugaaugaggaagauacuauuugacugacugacu

SEQ ID NO: 76386 - RNA, 64 nt, Homo Sapiens
cagagggccuccaagugagaaauuuggauagagaaugaggaagagggccuugaaggauggauga

SEQ ID NO: 76387 - RNA, 64 nt, Homo Sapiens
aucauucacaacugagcaagauuaacucuccucaaugaggaagaaccagccagcuuacacaggc

SEQ ID NO: 76388 - RNA, 64 nt, Homo Sapiens
cuagcacuggcagagggcacuuauuauuauugacaugaggaaacuguuauuauaauuauaauua

SEQ ID NO: 76389 - RNA, 64 nt, Homo Sapiens
gggagggcaugauccuggcagauguggggcgggaaugaggaaaggaaguccuuguuggcagagg

SEQ ID NO: 76390 - RNA, 64 nt, Homo Sapiens
agcaaaagcagaaaccccuguguggcaagaaaaaaugaggaagagcaaaagacacuucuuacau

SEQ ID NO: 76391 - RNA, 64 nt, Homo Sapiens
agcaaaaguggaaaccccugggcagcaagagaaaaugaggaagagugaaaggcacuucuuacau

SEQ ID NO: 76392 - RNA, 64 nt, Homo Sapiens
ugaaucaccuagaaguggaauccuguuaugagucaugaggaaacgaagguugagaccaaugauu

SEQ ID NO: 76393 - RNA, 64 nt, Homo Sapiens
caaggcucagaggggcaaagaacuuguuuuauagaugaggaaacacagggucuacaauggggag

SEQ ID NO: 76394 - RNA, 64 nt, Homo Sapiens
guguuggcucacuacguagaacauauccaaaauaaugaggaaauaaugccuucaacugaaaaaa

SEQ ID NO: 76395 - RNA, 64 nt, Homo Sapiens
gccacaaauuguauggugaucuacaauguagaaaaugaggaaauauuuauuuacacucuugauu

SEQ ID NO: 76396 - RNA, 64 nt, Homo Sapiens
ggcuucaauuagaaguuacggacauaaaacacagaugaggaaagaaaaucaguagacauuucug

SEQ ID NO: 76397 - RNA, 64 nt, Homo Sapiens
cuuucuaugugauuuucaaucauccuagaggauuaugaggaaucuuacacaguguaaaugaaac

SEQ ID NO: 76398 - RNA, 64 nt, Homo Sapiens
caggcaaaauugguaccaaagggaaacauuaaccaugaggaagagcauuuuucuaaggagaaca

SEQ ID NO: 76399 - RNA, 64 nt, Homo Sapiens
ugacugcuuaauuggcaugagguuuccuuuugagaugaggaaaauguucugaaaauauggugau

SEQ ID NO: 76400 - RNA, 64 nt, Homo Sapiens
ucauagguuaccauuuuauagaagaucucauuauaugaggaaaaaaaaagcucaaggacuuuau

SEQ ID NO: 76401 - RNA, 64 nt, Homo Sapiens
gagaucacaucuuugucacuucagucaaacauuuaugaggaaauucagugaaaauaauuuuauu

SEQ ID NO: 76402 - RNA, 64 nt, Homo Sapiens
agagaagaaaccccgguacugagcagaagggaggaugaggaaaaugugugguuguggcaugugu

SEQ ID NO: 76403 - RNA, 64 nt, Homo Sapiens
cccagcccuugaggcagagguagcauuccgggggaugaggaaucuccccaugucccuggcacac

SEQ ID NO: 76404 - RNA, 64 nt, Homo Sapiens
cugaaaucagauggaaaagaggccucagguaaggaugaggaacuauuuaauugggggaacaaaa

SEQ ID NO: 76405 - RNA, 64 nt, Homo Sapiens
uagcuguacacucacugaaucacugaaauugaagaugaggaaaggaagccagugccuguguacu

SEQ ID NO: 76406 - RNA, 64 nt, Homo Sapiens
gacaggaggaagacguggguccgugagcgucaggaugaggaaaugccaaggagaguccuugcac

SEQ ID NO: 76407 - RNA, 64 nt, Homo Sapiens
ccaaggagaguccuugcaccugccugaaagcaggaugaggaaggauuuccccauuucuguuugc

SEQ ID NO: 76408 - RNA, 64 nt, Homo Sapiens
cauguauucagcuuuaguagggaacugguagaggaugaggaaaguucacuaccuauccaggagu

SEQ ID NO: 76409 - RNA, 64 nt, Homo Sapiens
gaacccacgaacauuccugguccaauuuuuggccaugaggaagauaauaggcacuuaaguggcu

SEQ ID NO: 76410 - RNA, 64 nt, Homo Sapiens
ggauucaggaagagccacuccucccaucuucccaaugaggaaaccacucugaacaggcacagcc

SEQ ID NO: 76411 - RNA, 64 nt, Homo Sapiens
ugaagcucagagcacaaaccuuguccauuuagcgaugaggaaagugagggugaguucugcugcc

SEQ ID NO: 76412 - RNA, 64 nt, Homo Sapiens
cgauacggcaaccaccacggaccuguggggaccaaugaggaaagagagaggcaggucugggcca

SEQ ID NO: 76413 - RNA, 64 nt, Homo Sapiens
aggcccccuuguccuuccuggguccugguccuucaugaggaacuagcccaucccugguggggcu

SEQ ID NO: 76414 - RNA, 64 nt, Homo Sapiens
aaaaaaaaaaaaaaaguuuaaucugaaucuaaccaugaggaaauaaucagacaaauccacauua

SEQ ID NO: 76415 - RNA, 64 nt, Homo Sapiens
aacucuguuggguguacucugcuaaguucuggggaugaggaaauuaauaaagguacagucuugc

SEQ ID NO: 76416 - RNA, 64 nt, Homo Sapiens
aagauaauucauacuggaaggaaacccuacaaauaugaggaaugucucaaagcuuuuuacugau

SEQ ID NO: 76417 - RNA, 64 nt, Homo Sapiens
ucuauguaaauaccagaauuuauaguagaaauauaugaggaagcgacacuucgaauauucuacu

SEQ ID NO: 76418 - RNA, 64 nt, Homo Sapiens
uaaggcuccuaggggagaaagucaccauuuacugaugaggaaaccuaaaggaggguuugugauu

SEQ ID NO: 76419 - RNA, 64 nt, Homo Sapiens
ccacgcaccuuccuuaguaagaucaucuccuccaaugaggaaacacuuguuaucaucuccauuu

SEQ ID NO: 76420 - RNA, 64 nt, Homo Sapiens
acaguuacgcuaacuccaaaauugagaacuagaaaugaggaaggcuccaggucugccauucgcu

SEQ ID NO: 76421 - RNA, 64 nt, Homo Sapiens
agaaauccugggguuggaccuucuuuucggauucaugaggaaagggcaccucagucucaacauu

SEQ ID NO: 76422 - RNA, 64 nt, Homo Sapiens
cuacuccuaugaccccgaagcuucguggcccuggaugaggaaucgccaucgagcgugccgcuuu

SEQ ID NO: 76423 - RNA, 64 nt, Homo Sapiens
uuaccgcauggaguugcuggccccuuguuggaugaugaggaauacaguaccuagagucugugcg

SEQ ID NO: 76424 - RNA, 62 nt, Homo Sapiens
ucaacaaggaaaacuucuaacuugucucuuccaugaggaaauaaauguggguugugcugcca

SEQ ID NO: 76425 - RNA, 64 nt, Homo Sapiens
agccacaaauguuuagaacucuucaacuucgguaaugaggaagaaggagaaagagcugggggaa

SEQ ID NO: 76426 - RNA, 61 nt, Homo Sapiens
auguuugcuguugauuuuuuguuugaacuuccuguuugacacagcccuacccaccugcccu

SEQ ID NO: 76427 - RNA, 61 nt, Homo Sapiens
uuccuguuugacaauguuugacccaccugcccuguuugaacaggagaggauggucagcccu

SEQ ID NO: 76428 - RNA, 61 nt, Homo Sapiens
ccaugaccgaggagccaacugggacuucuggcuguuugacauccucauguucccguugguc

SEQ ID NO: 76429 - RNA, 61 nt, Homo Sapiens
uuugccauugugugcucucagauuucuuccacuguuugacacccuccuuagagggcugcuc

SEQ ID NO: 76430 - RNA, 61 nt, Homo Sapiens
cuuuaagagagauguuuuugaaguaauauaccuguuugaagcagagaauauacuuuuccuc

SEQ ID NO: 76431 - RNA, 61 nt, Homo Sapiens
cuacuguagaacacuauuuuuuucaaauguccuguuugauaguuacugcucgccuguuaaa

SEQ ID NO: 76432 - RNA, 61 nt, Homo Sapiens
gucuaccuugugagcaggcuuuuggaagaaccuguuugaugcaaaaaagaaaaugaaaaac

SEQ ID NO: 76433 - RNA, 61 nt, Homo Sapiens
ccuuauuaugggagcccgucggucuuagaagcuguuugacauguauaauaaauggcauuga

SEQ ID NO: 76434 - RNA, 61 nt, Homo Sapiens
uaaaaaauaaaaaauagaaacaucacauuaccuguuugaugcucaaaccuuguuacagcau

SEQ ID NO: 76435 - RNA, 61 nt, Homo Sapiens
aaauuauuucuaggguuuaacuguacuucuacuguuugaaaaacuaucuuauuauaaaagg

SEQ ID NO: 76436 - RNA, 61 nt, Homo Sapiens
ucuagaacauguagacacuugagaaauguuucuguuugaagaaaauagagggagaaacaga

SEQ ID NO: 76437 - RNA, 61 nt, Homo Sapiens
ugaaggugugguaucaaacuucagguugaaacuguuugaagcauuauaaacauucauuuca

SEQ ID NO: 76438 - RNA, 61 nt, Homo Sapiens
uuuuuuucuaauauuucaguucuguauguaucuguuugauucccaaguacuggauuuuaaa

SEQ ID NO: 76439 - RNA, 61 nt, Homo Sapiens
ggauugaccuugguuauguguucuuuauuugcuguuugaauuaucuuaguaccuauggauu

SEQ ID NO: 76440 - RNA, 61 nt, Homo Sapiens
agacaugaguucuggaaggaacugaaagcuucuguuugaaggcacacccuucuugguugga

SEQ ID NO: 76441 - RNA, 61 nt, Homo Sapiens
agaaauugugucauauuggugugucuuucuccuguuugaaaaagccauaugaugacacaca

SEQ ID NO: 76442 - RNA, 61 nt, Homo Sapiens
ccugaaauaauuuaggacucucagaauucaucuguuugaaggucucagacuaaguaaugca

SEQ ID NO: 76443 - RNA, 61 nt, Homo Sapiens
auaugcacauuuaaaaaauaguuuguaccaucuguuugaguuuaugauuugaaaguuggaa

SEQ ID NO: 76444 - RNA, 61 nt, Homo Sapiens
cauaauguaucuuaugaaagcauuacccaaccuguuugaguugagaaugcauuuguccacc

SEQ ID NO: 76445 - RNA, 61 nt, Homo Sapiens
uugggaugauaagaaacaaaaauaaucccaacuguuugaaaguucgaaagaggggcauucu

SEQ ID NO: 76446 - RNA, 61 nt, Homo Sapiens
uuugugagggcaaaggggaggaaaugggguucuguuugaaaaaaaugaggggaucuuagau

SEQ ID NO: 76447 - RNA, 61 nt, Homo Sapiens
cucaugugcuucuucugaauacugaaugugacuguuugaaagcugguagaauucaucccuc

SEQ ID NO: 76448 - RNA, 61 nt, Homo Sapiens
agaccacaaaguucacaucuaucugcaguggcuguuugaccaccccuccuccugcgaagug

SEQ ID NO: 76449 - RNA, 61 nt, Homo Sapiens
cccuguaggcugcauucaggaugcaagcagucuguuugaacaagagccuugucugaccuua

SEQ ID NO: 76450 - RNA, 61 nt, Homo Sapiens
aucuguaaugaaaaugcugcuauagcucuagcuguuugacuggaaaaaucuguguguauug

SEQ ID NO: 76451 - RNA, 61 nt, Homo Sapiens
guuacgcuuuucuguuguucuuuucccuaagcuguuugaaagacaucuacauuucagugcu

SEQ ID NO: 76452 - RNA, 61 nt, Homo Sapiens
agcucuguguggguguuucucuggugcugagcuguuugagacaggguagacacguggagug

SEQ ID NO: 76453 - RNA, 61 nt, Homo Sapiens
uuugaugucguccaggcgucgaguuuuuauccuguuugaauacuccaaugaguguguuugu

SEQ ID NO: 76454 - RNA, 61 nt, Homo Sapiens
aaagaauauuggccaguauugcugcggucuccuguuugauacugcauuuucccccuuuaaa

SEQ ID NO: 76455 - RNA, 61 nt, Homo Sapiens
ccuauuaaugaaaaugacuauguuucguaaacuguuugagagaagcuuagauaauaauggc

SEQ ID NO: 76456 - RNA, 64 nt, Homo Sapiens
auguaaagauucaaaguuugcaugguauaaagugggcauuuaaucauaauucaaacaauuacac

SEQ ID NO: 76457 - RNA, 64 nt, Homo Sapiens
ucagccaaagaauauuguuaaagagucaaccacaggcauuuaaguuuucauuuuagucuuuucu

SEQ ID NO: 76458 - RNA, 64 nt, Homo Sapiens
aacccauuuguaugacuucaacaacgucaaggagggcauuuagaauuuagaaucugagcacauc

SEQ ID NO: 76459 - RNA, 64 nt, Homo Sapiens
aucccacucaaugccaaaucuuucaguccucaaaggcauuuaaguccaauagucaugcuuuaaa

SEQ ID NO: 76460 - RNA, 64 nt, Homo Sapiens
agcagcaguacuuggaagcuagacaaaaucaaaaggcauuuaacauaauucaggccuguuuggu

SEQ ID NO: 76461 - RNA, 64 nt, Homo Sapiens
cuucagaggcaggauaauauugugaaacagccaaggcauuuauuaggaaaacaaaauuaugugg

SEQ ID NO: 76462 - RNA, 64 nt, Homo Sapiens
auauaccacuggugugugugaguacaugcacuugggcauuuaauugcagaagucuccaauaugg

SEQ ID NO: 76463 - RNA, 64 nt, Homo Sapiens
uggcuagcaaaucaguaauuaagcuuuuuaacagggcauuuaaguugguaauugugugaaauau

SEQ ID NO: 76464 - RNA, 64 nt, Homo Sapiens
guccucuaauguugauuaauuguauuacuagggaggcauuuacauuauuuccaauggauauuuc

SEQ ID NO: 76465 - RNA, 64 nt, Homo Sapiens
uuggguaagccauaagcgaaucugccauugacuuggcauuuaccccccaagcuugaauuuucau

SEQ ID NO: 76466 - RNA, 64 nt, Homo Sapiens
ucuuaacaaacacaggaggacuuaauggcagcuuggcauuuaaugucaaaauccaagccguggc

SEQ ID NO: 76467 - RNA, 64 nt, Homo Sapiens
gcagcuuggcauuuaaugucaaaauccaagccguggcauuuaaugucaaaaugacuucagacca

SEQ ID NO: 76468 - RNA, 64 nt, Homo Sapiens
auugauaaaauggugauguguauuaauguuaguucaaccauauauuuauacugucuggggaugu

SEQ ID NO: 76469 - RNA, 64 nt, Homo Sapiens
uaaauagaggcuagcuaccuaggcuugucuauagcaaccauaauguugauguaaguaaugcggu

SEQ ID NO: 76470 - RNA, 64 nt, Homo Sapiens
cauuuuuauggcuuuuuacaguuucucauucugucaaccauauugaagugaaguggcauagucu

SEQ ID NO: 76471 - RNA, 64 nt, Homo Sapiens
ucccuauucgaaaauuagugcuggaauaucuggccaaccauaugcagaagaaugaaacugaacc

SEQ ID NO: 76472 - RNA, 64 nt, Homo Sapiens
auggagacaacagcauuaccugccucgguucccucaaccauauacaaguuaauuccucucucug

SEQ ID NO: 76473 - RNA, 64 nt, Homo Sapiens
ggcagaucccuucaucugucgauucagcgagaaacaaccauaggaggagcaagacugagacucu

SEQ ID NO: 76474 - RNA, 64 nt, Homo Sapiens
cagaugaccugaguuguggaugguagguggaucaaauggccacuggcauagggccagcucuaug

SEQ ID NO: 76475 - RNA, 64 nt, Homo Sapiens
agcagauaaguagcaguucaagccaccacgugagaauggccauaccuuuugauuuugcagaaaa

SEQ ID NO: 76476 - RNA, 64 nt, Homo Sapiens
acuuuaaguauacaaucuuuuuuuaauauagugaaauggccacucagaauuuaagcaagaaaua

SEQ ID NO: 76477 - RNA, 64 nt, Homo Sapiens
ucaacuuucauaauuuaaaauccuagcaaguaagaauggccaacucuuuccccagcaguuucug

SEQ ID NO: 76478 - RNA, 64 nt, Homo Sapiens
uuaaaauuagcuaguuucauacaugcauguauuaaauggccauuuaggggauacaagauuucuu

SEQ ID NO: 76479 - RNA, 64 nt, Homo Sapiens
uuauuuuauuuguauuuauauuguuuguuuuuuuaauggccauuacagguuguuuuuuguuugu

SEQ ID NO: 76480 - RNA, 64 nt, Homo Sapiens
uaccuggagccuuaucuucugaaggguuuuaaagaauggccaauuagcugagaagaauuaucua

SEQ ID NO: 76481 - RNA, 64 nt, Homo Sapiens
ggguguauuucauuccaggcccucagucuuuggcaauggccacccugguguuggcauauuggcc

SEQ ID NO: 76482 - RNA, 64 nt, Homo Sapiens
gggccugcuuagauugcaguugaucaguuuucauaauggccacugcuuccuuugacuucaggaa

SEQ ID NO: 76483 - RNA, 64 nt, Homo Sapiens
uuguggaacagcuguugaauuggacaguccuaaaaauggccagaaccuggauuaacaguauugu

SEQ ID NO: 76484 - RNA, 64 nt, Homo Sapiens
uuuccucggaaacacucuuguuccacgcugccuccuccucgagugccguggccaugggaagaug

SEQ ID NO: 76485 - RNA, 64 nt, Homo Sapiens
ccuuggggacguggcagauggucagccucugguucuccucgaguggcuagcucaugcugcucuu

SEQ ID NO: 76486 - RNA, 64 nt, Homo Sapiens
agcacaugccguacucuuauauguaccauugguugauaauuauaaugauucauuuggacuugaa

SEQ ID NO: 76487 - RNA, 64 nt, Homo Sapiens
aguagaaaugaguuguauggugaaucuguguagugauaauuauauaauuuauuuauuuugaaug

SEQ ID NO: 76488 - RNA, 64 nt, Homo Sapiens
auuaauaauaaucauaguaaagauauguaucuaggauaauuauaaaaaauacauaaucaugcuc

SEQ ID NO: 76489 - RNA, 64 nt, Homo Sapiens
ggacaacuguagugcagugaccaguuuugccgcagauaauuaaucugaagcuucuacuaggauc

SEQ ID NO: 76490 - RNA, 64 nt, Homo Sapiens
ugccaaaauccuggggcuuugcugcauucccuaagauaauuacaggaaaaagaaaauguaaaag

SEQ ID NO: 76491 - RNA, 64 nt, Homo Sapiens
ugccacauggaccaggaugaagagggaucaaagagauaauuagccaaaaacccaguagccuaga

SEQ ID NO: 76492 - RNA, 64 nt, Homo Sapiens
uauacauuucuuuuuucuauauggaugagcuaucauaauucaagcauuuuuagauuaaacugug

SEQ ID NO: 76493 - RNA, 64 nt, Homo Sapiens
uucaucugcuuucuagauuuacuaaaacuuugaaauaauucacucucugauuaucagaaguuuu

SEQ ID NO: 76494 - RNA, 64 nt, Homo Sapiens
guuuggauuacaugcacgugugagauuauuugcaauaauucauagguuccaaggguguugauga

SEQ ID NO: 76495 - RNA, 64 nt, Homo Sapiens
ugaugaauagucauacauuuuuuuggacuuuguuauaauucauugugguaagaaugauugaaau

SEQ ID NO: 76496 - RNA, 64 nt, Homo Sapiens
aaagcauuuaauugguccucaaugcuuaauaaauauaauucaugcuggagagaaacuucacaug

SEQ ID NO: 76497 - RNA, 64 nt, Homo Sapiens
cuucaauagguucucaacccuuacugugcacaagauaauucauucuggggaaaaaaaugcuaca

SEQ ID NO: 76498 - RNA, 64 nt, Homo Sapiens
cuuuaaaucuuccucagucuuuucuaaucauaagauaauucacacugaagagaaacugcaaacg

SEQ ID NO: 76499 - RNA, 64 nt, Homo Sapiens
ugagacugagccauaucugcacacuuuuaaaaaaauaauucagaucauuuaauaauucaaacca

SEQ ID NO: 76500 - RNA, 64 nt, Homo Sapiens
ccaacacuuuuaaaaaaauaaguuuuuucauuuaauaauucaaacauugggcuuccuuguacuu

SEQ ID NO: 76501 - RNA, 64 nt, Homo Sapiens
cuuuaaccaguuuucaacccuuauuacacauaagauaauucauagcggagagaaaccccacaaa

SEQ ID NO: 76502 - RNA, 64 nt, Homo Sapiens
cuuuaacugguccucaacucuuauuacacauaagauaauucacaguggagaaaaacccuacaaa

SEQ ID NO: 76503 - RNA, 64 nt, Homo Sapiens
cuuuaacaagucuucaacccuuucugcacauaauauaauucauacuggagagaaaccccacaaa

SEQ ID NO: 76504 - RNA, 64 nt, Homo Sapiens
agcgucugauaaauccuguaguccaagcucaggcauaauucagcauaagaaaauucacaccaga

SEQ ID NO: 76505 - RNA, 64 nt, Homo Sapiens
cuucagucauagcucagccauugcucagcaucagauaauucacaccagagagaaacccucugaa

SEQ ID NO: 76506 - RNA, 64 nt, Homo Sapiens
agaaugcauguuucacauugucuuagauauuuauauaauucaaaauuggaauguuauuauaaac

SEQ ID NO: 76507 - RNA, 64 nt, Homo Sapiens
ucauguuuaugcauuauuaagcugcacucagaaaauaauucagaauuuucaaagaauggagguu

SEQ ID NO: 76508 - RNA, 64 nt, Homo Sapiens
uuuaaagacucaagguggucuguaaacgacaagaauaauucaauucuuuuaaaguguuacuuuu

SEQ ID NO: 76509 - RNA, 64 nt, Homo Sapiens
uuccaucuuuuaaaaauauaaaaaucauggcaacauaauucacuuuuggaaauaauuuguaaua

SEQ ID NO: 76510 - RNA, 64 nt, Homo Sapiens
auucaacugcaucuccaaacaauucagugaagaaauaauucauggaaauaauuguauuucucug

SEQ ID NO: 76511 - RNA, 64 nt, Homo Sapiens
uagagugucccagaaaaaaaugacuaauuaaacaauaauucaagcucuuuugaagaucuauggu

SEQ ID NO: 76512 - RNA, 64 nt, Homo Sapiens
uuugcagguugcaaacaaauuuuauaucagcaaaauaauucaaucucaagugaguucuuaguau

SEQ ID NO: 76513 - RNA, 64 nt, Homo Sapiens
uagaaucuuguauuuuuuaauugagcuaaucaaaauaauucagccaagucuauuugaaauagaa

SEQ ID NO: 76514 - RNA, 64 nt, Homo Sapiens
agaagauucuuuaacaaauugaggagauugauucauaauucacaugucaauuuuuuauaguaau

SEQ ID NO: 76515 - RNA, 64 nt, Homo Sapiens
uuauaugaaagucaagaucuaaguaccuuuucauauaauucaaacugauugcuugugauauguu

SEQ ID NO: 76516 - RNA, 64 nt, Homo Sapiens
augugaucuuucuauaaccaugccauucacuuaaauaauucaugaagggaaugguuuaauuuaa

SEQ ID NO: 76517 - RNA, 64 nt, Homo Sapiens
ucuauucacauugaaauaaagaauuaucuagaugauaauucagauaauucaguuuguucauaga

SEQ ID NO: 76518 - RNA, 64 nt, Homo Sapiens
auugaaauaaagaauuaucuagaugauaauucagauaauucaguuuguucauagaauuacuuuc

SEQ ID NO: 76519 - RNA, 64 nt, Homo Sapiens
aguaaacacuagaaucaaauuauuagaacacaguauaauucagcaucguauaaaaaucugcuca

SEQ ID NO: 76520 - RNA, 64 nt, Homo Sapiens
aauuuuagauuaugguguaaaguuauauguauguauaauucaaccaaguuauucauuuuauuca

SEQ ID NO: 76521 - RNA, 64 nt, Homo Sapiens
uuucuauugauucucauaccuuacuaaauauaagauaauucauauuggagagaaauucuacaga

SEQ ID NO: 76522 - RNA, 64 nt, Homo Sapiens
uuuuaaccacuucucaacccugccuacacguaagauaauucauacuggaaggaaacccuacaaa

SEQ ID NO: 76523 - RNA, 64 nt, Homo Sapiens
uuuuuacugauucuuauaccuuacuaaacauaaaauaauucauaaaggagauaaauuauacaaa

SEQ ID NO: 76524 - RNA, 64 nt, Homo Sapiens
uuuuaacaaauccucauccauuaguaaacauaagauaauucauacuggagagaaaaccuacaaa

SEQ ID NO: 76525 - RNA, 64 nt, Homo Sapiens
uuuuaaccaauccucaacccuuacuacacauuagauaauucaugcuggagagaaacccuacaaa

SEQ ID NO: 76526 - RNA, 64 nt, Homo Sapiens
gcuuuuaaccaguccucaaacuuuauugaacaaaauaauucauacaggagagaaacccuacaaa

SEQ ID NO: 76527 - RNA, 64 nt, Homo Sapiens
cuagagagaaacccuacaaauuaugaaacaaaagauaauucauacuuuaacuggcucuuaaucc

SEQ ID NO: 76528 - RNA, 64 nt, Homo Sapiens
cuggagagaaauccuacaaauauuaaaacacaagauaauucauauuuaguguauuuucaacuuu

SEQ ID NO: 76529 - RNA, 64 nt, Homo Sapiens
cugucauacugaaaaugacauagcaauaugauagauaauucaguugacaucagauaauucaguc

SEQ ID NO: 76530 - RNA, 64 nt, Homo Sapiens
cuagcaauaugauagauaauucucuugacaucagauaauucagucccuuaacuaaacgcuuacu

SEQ ID NO: 76531 - RNA, 64 nt, Homo Sapiens
auuuugcauucuguaaauacguauuuuacuauauguugcauagugcauaucaauuguaggucau

SEQ ID NO: 76532 - RNA, 64 nt, Homo Sapiens
aauuguaggucauguauuuuuuggaaggaaagcuguugcauaucuaugguauauugugucaauc

SEQ ID NO: 76533 - RNA, 64 nt, Homo Sapiens; identical to SEQ ID NO: 38319

SEQ ID NO: 76534 - RNA, 64 nt, Homo Sapiens; identical to SEQ ID NO: 38320

SEQ ID NO: 76535 - RNA, 64 nt, Homo Sapiens; identical to SEQ ID NO: 38321

SEQ ID NO: 76536 - RNA, 64 nt, Homo Sapiens; identical to SEQ ID NO: 38322

SEQ ID NO: 76537 - RNA, 64 nt, Homo Sapiens; identical to SEQ ID NO: 38323

SEQ ID NO: 76538 - RNA, 64 nt, Homo Sapiens; identical to SEQ ID NO: 38324

SEQ ID NO: 76539 - RNA, 64 nt, Homo Sapiens; identical to SEQ ID NO: 76531

SEQ ID NO: 76540 - RNA, 64 nt, Homo Sapiens; identical to SEQ ID NO: 76532

SEQ ID NO: 76541 - RNA, 64 nt, Homo Sapiens; identical to SEQ ID NO: 38319

SEQ ID NO: 76542 - RNA, 64 nt, Homo Sapiens; identical to SEQ ID NO: 38320

SEQ ID NO: 76543 - RNA, 64 nt, Homo Sapiens; identical to SEQ ID NO: 38321

SEQ ID NO: 76544 - RNA, 64 nt, Homo Sapiens; identical to SEQ ID NO: 38322

SEQ ID NO: 76545 - RNA, 64 nt, Homo Sapiens; identical to SEQ ID NO: 38323

SEQ ID NO: 76546 - RNA, 64 nt, Homo Sapiens; identical to SEQ ID NO: 38324

SEQ ID NO: 76547 - RNA, 64 nt, Homo Sapiens; identical to SEQ ID NO: 61495

SEQ ID NO: 76548 - RNA, 64 nt, Homo Sapiens; identical to SEQ ID NO: 61496

SEQ ID NO: 76549 - RNA, 64 nt, Homo Sapiens; identical to SEQ ID NO: 61497

SEQ ID NO: 76550 - RNA, 64 nt, Homo Sapiens; identical to SEQ ID NO: 61498

SEQ ID NO: 76551 - RNA, 64 nt, Homo Sapiens; identical to SEQ ID NO: 61499

SEQ ID NO: 76552 - RNA, 64 nt, Homo Sapiens; identical to SEQ ID NO: 61500

SEQ ID NO: 76553 - RNA, 64 nt, Homo Sapiens; identical to SEQ ID NO: 61501

SEQ ID NO: 76554 - RNA, 64 nt, Homo Sapiens; identical to SEQ ID NO: 61502

SEQ ID NO: 76555 - RNA, 64 nt, Homo Sapiens; identical to SEQ ID NO: 61503

SEQ ID NO: 76556 - RNA, 64 nt, Homo Sapiens; identical to SEQ ID NO: 61504

SEQ ID NO: 76557 - RNA, 64 nt, Homo Sapiens; identical to SEQ ID NO: 61505

SEQ ID NO: 76558 - RNA, 64 nt, Homo Sapiens; identical to SEQ ID NO: 61506

SEQ ID NO: 76559 - RNA, 64 nt, Homo Sapiens; identical to SEQ ID NO: 61507

SEQ ID NO: 76560 - RNA, 64 nt, Homo Sapiens; identical to SEQ ID NO: 61508

SEQ ID NO: 76561 - RNA, 64 nt, Homo Sapiens; identical to SEQ ID NO: 61509

SEQ ID NO: 76562 - RNA, 64 nt, Homo Sapiens; identical to SEQ ID NO: 61510

SEQ ID NO: 76563 - RNA, 64 nt, Homo Sapiens; identical to SEQ ID NO: 61511

SEQ ID NO: 76564 - RNA, 64 nt, Homo Sapiens; identical to SEQ ID NO: 61512

SEQ ID NO: 76565 - RNA, 64 nt, Homo Sapiens; identical to SEQ ID NO: 61513

SEQ ID NO: 76566 - RNA, 64 nt, Homo Sapiens; identical to SEQ ID NO: 61514

SEQ ID NO: 76567 - RNA, 64 nt, Homo Sapiens; identical to SEQ ID NO: 61515

SEQ ID NO: 76568 - RNA, 64 nt, Homo Sapiens; identical to SEQ ID NO: 61516

SEQ ID NO: 76569 - RNA, 64 nt, Homo Sapiens; identical to SEQ ID NO: 61517

SEQ ID NO: 76570 - RNA, 64 nt, Homo Sapiens
uuucuuaaucugguaucaccucguguguucuuuggggcccuagaaacccuggcuuuugggagug

SEQ ID NO: 76571 - RNA, 64 nt, Homo Sapiens
ucaaagacagccccuauccuccauucuugagucagggcccuaggugaccuauucuaacucaagg

SEQ ID NO: 76572 - RNA, 64 nt, Homo Sapiens
ccuuuccugcccugcagucuaugucccagccccugggcccuagccuccuccgagcaccucaugc

SEQ ID NO: 76573 - RNA, 64 nt, Homo Sapiens
auugaggccuuaucccugcaugcacaaugcaugugggcccuaauacucauccauuucuauagga

SEQ ID NO: 76574 - RNA, 64 nt, Homo Sapiens
ccuagccccaucccuccccaacccaagggagucugggcccuaggugggcuccagcugccaagcc

SEQ ID NO: 76575 - RNA, 64 nt, Homo Sapiens
ugggcccaaguuucagaauacggacaacuuagcugggcccuacuagaggagcagucaggacuuc

SEQ ID NO: 76576 - RNA, 64 nt, Homo Sapiens
aaacccacugguucuuagcucuguggguaggaaggggcccuagaaagggccuaguuacuauccu

SEQ ID NO: 76577 - RNA, 64 nt, Homo Sapiens
ugucaguucuaacaguaguggaacaggagaaucugggcccuaggagcccuguaacucccaggag

SEQ ID NO: 76578 - RNA, 64 nt, Homo Sapiens
acgcuggaccacagggucccccucaagcaucucggggcccuauucucucugagcaccuggaggg

SEQ ID NO: 76579 - RNA, 64 nt, Homo Sapiens
cucaggcuugugccagggccugacuugggccugggggcccuagaacacuccuccuccugagccu

SEQ ID NO: 76580 - RNA, 64 nt, Homo Sapiens
aguggaaaagccuuuguaaauccaaaaaaggaaucaaauccacggcuccaggauuacucccucc

SEQ ID NO: 76581 - RNA, 64 nt, Homo Sapiens
cagcaaccagaaauguucuacacuggcccacuggcaaauccaacucccucauucccgcugaccu

SEQ ID NO: 76582 - RNA, 64 nt, Homo Sapiens
aaagggggaccagucauuuauaggcauuucaggccaaauccaugagaacauuagccacgagcca

SEQ ID NO: 76583 - RNA, 64 nt, Homo Sapiens
agcagggaucuguccccucugggagaaaacuuagcaaauccaucuaaaugccucaauacguucu

SEQ ID NO: 76584 - RNA, 64 nt, Homo Sapiens
aggcaggccuagcaguucccuuaccugaaguuuucaaauccauacugcaguucccucucguaau

SEQ ID NO: 76585 - RNA, 64 nt, Homo Sapiens
uucauaaaccguguuuuucaaaauaaguuuaugucaaauccagcuucccagaaacacuaauaau

SEQ ID NO: 76586 - RNA, 64 nt, Homo Sapiens
aucucccacuuaauggaaaggcaaagggguaccccaaauccagaggugccuacauuucaggcag

SEQ ID NO: 76587 - RNA, 64 nt, Homo Sapiens
uuuacuuuuauaugacauucuuauacugcugucucaaauccaaaaacauuucagagcucuuguc

SEQ ID NO: 76588 - RNA, 64 nt, Homo Sapiens
aacagaacuacuaacguuucaaguuuaccaagugcaaauccaagaagacccagaacggcgucac

SEQ ID NO: 76589 - RNA, 64 nt, Homo Sapiens
cugaacuuucucucauaggacgucgcuuggauuucaaauccacggucaccugcugcccuuugcc

SEQ ID NO: 76590 - RNA, 64 nt, Homo Sapiens
cccaagucugcuccuccaguugagacacaagucacaaauccaggcuucugaaacuucggaccaa

SEQ ID NO: 76591 - RNA, 64 nt, Homo Sapiens
gaaccuccguguguucacgucucaugaagcucuccaaauccaguccucuuggguuuuuauggaa

SEQ ID NO: 76592 - RNA, 64 nt, Homo Sapiens
cgcaggcccugaaaugagggcggcccuccaaauccaaauccagacgggacugcgcgugaggccc

SEQ ID NO: 76593 - RNA, 64 nt, Homo Sapiens
uccagacgcaggcccugaaaaggccccggcccuccaaauccaaaggaccucgggacugcgcgug

SEQ ID NO: 76594 - RNA, 63 nt, Homo Sapiens
ccucccuuuuuccuuguccccacacuccuacaccuaacucaccuaacucauacugugcuggag

SEQ ID NO: 76595 - RNA, 63 nt, Homo Sapiens
uuccuuguccccacacuccuacaccuaacucaccuaacucauacugugcuggagccacuaacu

SEQ ID NO: 76596 - RNA, 64 nt, Homo Sapiens
ccuucuuuagguaaccgagcauuuauuuaaccaacuauaccacugcauugggacgucugcacuu

SEQ ID NO: 76597 - RNA, 64 nt, Homo Sapiens
auucuaagaaagccacugcuuucucaucaucacucuauaccaauacuuauuucuggccaaauga

SEQ ID NO: 76598 - RNA, 64 nt, Homo Sapiens
cguugcagguguacugggcugucagggaucuuuucuauaccagaacugcggucacuauuuugua

SEQ ID NO: 76599 - RNA, 64 nt, Homo Sapiens
caccccaugccucagcuucaugucugucccauuccuauaccauccccacccuguuguauguauu

SEQ ID NO: 76600 - RNA, 64 nt, Homo Sapiens
uccuggugucaucacagccaagguuuuuagguugcuauaccaauggcuuauuaaaugaaaaugg

SEQ ID NO: 76601 - RNA, 64 nt, Homo Sapiens
augcaucacaucacuuuugaaauguaauucuggucuauaccauggaagucauaaauggacauua

SEQ ID NO: 76602 - RNA, 64 nt, Homo Sapiens
uuccagugagggcugcaggcuuccuagaggugugcuauaccaugcgucugucguugugcuuuuu

SEQ ID NO: 76603 - RNA, 64 nt, Homo Sapiens
uguguacagcgccaucucucuuccaccuccaagccuauaccagcgugugucugucucucuggcg

SEQ ID NO: 76604 - RNA, 64 nt, Homo Sapiens
auaugcuaggaguaggaugaccagaaguaauucucuauaccaagauaaaagucuuccucuugcc

SEQ ID NO: 76605 - RNA, 64 nt, Homo Sapiens
aggguuuugucuuauguuuaacauagucuuccaucuauaccacucagcucucugguuuacugga

SEQ ID NO: 76606 - RNA, 64 nt, Homo Sapiens
uccaaaauuauguaucuauuauauauaggccaaccuauaccacauuuuagugacguauuuuugu

SEQ ID NO: 76607 - RNA, 64 nt, Homo Sapiens
uguaguucuuuuucuguucuggccuaauaguucucuauaccaacucucaggugucuguauagau

SEQ ID NO: 76608 - RNA, 64 nt, Homo Sapiens
uauuugagaaaguaugauuucugaauuuuaucugcuauaccaguguguuuugaggauuuuaaaa

SEQ ID NO: 76609 - RNA, 64 nt, Homo Sapiens
ggaccaguguuaguagcugcaccuccaucaaaugcuauaccaauugaauaaccaauaaacagua

SEQ ID NO: 76610 - RNA, 64 nt, Homo Sapiens
ugagaauucuaggaagaauacuguuucuacuaaccuauaccaucuuuuaggaaaccauuucauu

SEQ ID NO: 76611 - RNA, 64 nt, Homo Sapiens
agguuacugugauaggcauuuauucauauucuuucuauaccacugucauuaauauauuaaaaag

SEQ ID NO: 76612 - RNA, 64 nt, Homo Sapiens
ccucugagucauuguuauaaaaaaucaguuaucacuauaccaugcuauaggagacugggcaaaa

SEQ ID NO: 76613 - RNA, 64 nt, Homo Sapiens
aaaaaaaaaaaaccaguuagcugcuauauaaacacuauaccaagcacuaggcuuagaggaaaag

SEQ ID NO: 76614 - RNA, 64 nt, Homo Sapiens
uuauugugauaaaguaugaauauuuuuagaaagucuauaccauguucuuucguuaaagauuugc

SEQ ID NO: 76615 - RNA, 64 nt, Homo Sapiens
auuuuuuuuuaaaucaaaagggagagaacaaaagcuauaccaaaagggccauguuucaagaaaa

SEQ ID NO: 76616 - RNA, 64 nt, Homo Sapiens
uccccggcacggcaaguacauggccugcugccugcuauaccauggagauguggugcccaaggau

SEQ ID NO: 76617 - RNA, 64 nt, Homo Sapiens
augggaaauuuccccaaauccuuucucauuuguucuauaccagauguaacacaaugaauuccag

SEQ ID NO: 76618 - RNA, 64 nt, Homo Sapiens
uuuuuguuuguuuauguuacuuugacaauaaauccuauaccagccugccugaagaaauucugcc

SEQ ID NO: 76619 - RNA, 64 nt, Homo Sapiens
ucguacauuuccuguugauccugccccguuauuacuauaccagguuuucagacuauuuuaauuc

SEQ ID NO: 76620 - RNA, 64 nt, Homo Sapiens
ucuaaauuuagaguucguaaaacaauaucucuuacuauaccauuuacuauuauaaauaaaguga

SEQ ID NO: 76621 - RNA, 50 nt, Homo Sapiens
uauuuagggaauaauuagaacuauaccagcaagaagacucugaaguauag

SEQ ID NO: 76622 - RNA, 64 nt, Homo Sapiens
cuauuauguaacauccagaagguuugcaccccuccuauaccauaugucugcuucuguccaggac

SEQ ID NO: 76623 - RNA, 64 nt, Homo Sapiens
auguuucuuuuaauugauuuaaaggacuugucuucuauaccacccuuguccucaucucagguaa

SEQ ID NO: 76624 - RNA, 64 nt, Homo Sapiens
gucuuucguuuccagccuuuucagagcccuuuugcuauaccacaugugacaaacagcuagagca

SEQ ID NO: 76625 - RNA, 64 nt, Homo Sapiens
gcugugggaaaaaugguaacgaagaauagggagucuauaccagucuuuuguuagugcuuuaugg

SEQ ID NO: 76626 - RNA, 64 nt, Homo Sapiens
uuaaguucugaccucaggccuuuuuuuccuucuacuauaccauuuguauugcuuuuuuuuuuuu

SEQ ID NO: 76627 - RNA, 64 nt, Homo Sapiens
uucaauaucgaguuccggaacucaacccugugaucuauaccaccugggcuacgugaauagcgcc

SEQ ID NO: 76628 - RNA, 64 nt, Homo Sapiens
acuucuuagcucaguaucaugucucucugcuucucuauaccaggaaauaauaugaaguagguug

SEQ ID NO: 76629 - RNA, 64 nt, Homo Sapiens
auauuuucauauucacaagauccuagaagcuaaucuauaccauaaucaugcuacacuuaacuuc

SEQ ID NO: 76630 - RNA, 64 nt, Homo Sapiens
gauaacugaaugaagcauuugaguauaacagacacuauaccaaaauaccaagcaacuguuuuga

SEQ ID NO: 76631 - RNA, 64 nt, Homo Sapiens
cagaagaucuccagucaccccauagagacucucucuauaccagcaugccgacacuggcuggugu

SEQ ID NO: 76632 - RNA, 64 nt, Homo Sapiens
aagcauucuuggggaaagagaaaucacugacauucuauaccaaugguucccaaaauuuuuuccc

SEQ ID NO: 76633 - RNA, 64 nt, Homo Sapiens
uuaucacagaauuuuuuuuccugcuggccuauugcuauaccaaugauguugaguggcauuuucu

SEQ ID NO: 76634 - RNA, 64 nt, Homo Sapiens
accuauuuuuacucuuacaaauauuuucaaaguucuauaccaguaaugaauaaauacaugcaua

SEQ ID NO: 76635 - RNA, 64 nt, Homo Sapiens
guaggacgacuauaguuaaguaauuucugguguucuauaccacuuuacagcuugguaggaggaa

SEQ ID NO: 76636 - RNA, 64 nt, Homo Sapiens
uuaggaaguauuaaaaauauagcgaggguaaauccuauaccacucuuaaauggaaggcauaguc

SEQ ID NO: 76637 - RNA, 64 nt, Homo Sapiens
auaaaauuuuaauuacauuuguauguauauguuccuauaccauaugcugccaaccauguguagg

SEQ ID NO: 76638 - RNA, 64 nt, Homo Sapiens
guuguugcuauuggauuccaaacugcuaugcccucuauaccaguggcugacaaggcauauaggg

SEQ ID NO: 76639 - RNA, 64 nt, Homo Sapiens
aucuccagaauuuguucucagucccaaacugaaacuauaccauucaaacaacagcgcuccccau

SEQ ID NO: 76640 - RNA, 64 nt, Homo Sapiens
caaugcauuauuuuuuuccuccuuuccuuccaaacuauaccacuguauuuaccacuucuaagag

SEQ ID NO: 76641 - RNA, 64 nt, Homo Sapiens
ucuguuugcuuauuccacauuaauuuacuuuucucuauaccaaaucacccauggaauaguuauu

SEQ ID NO: 76642 - RNA, 64 nt, Homo Sapiens
uuaaggauguugaguuauguagaaaaugucacaucuauaccaaauagcagaacacaagagagca

SEQ ID NO: 76643 - RNA, 64 nt, Homo Sapiens
agguaacugaaguaaggagacccagcccauuuaucuauaccaugggucauggccccucucuggg

SEQ ID NO: 76644 - RNA, 64 nt, Homo Sapiens
ucagccuucagcagaguuggcuuauugccugccucuauaccaauaagucagucaccuugcuccu

SEQ ID NO: 76645 - RNA, 64 nt, Homo Sapiens
ugacuccuucuuccaccccucuucuugcuaucuccuauaccaauaaauacgaagggcuguggaa

SEQ ID NO: 76646 - RNA, 64 nt, Homo Sapiens
cagcacagugugucauuugcagauuugugguuaccuauaccacgcuagguguuuugacauguuu

SEQ ID NO: 76647 - RNA, 64 nt, Homo Sapiens
aggaaaguacaaccagaauugaaaaccaacugaucuauaccaguucuuucaauuaauagucaag

SEQ ID NO: 76648 - RNA, 64 nt, Homo Sapiens
auuguucaaaauuggagauguacacauacauacccuauaccaagagggccgaaacucuucaccu

SEQ ID NO: 76649 - RNA, 64 nt, Homo Sapiens
cauuuagcugccuagugagaauuuuuccugagcucuauaccauguaaguuuuuuuuccacaggu

SEQ ID NO: 76650 - RNA, 64 nt, Homo Sapiens
cuuccuuagcuuauaaauaauugugaacaguacacuauaccauauggugaauaauaauuaacua

SEQ ID NO: 76651 - RNA, 64 nt, Homo Sapiens
caauccaaacguucaccuguuuccuuuccucaagcuauaccaguguaauaccaguuacccugug

SEQ ID NO: 76652 - RNA, 64 nt, Homo Sapiens
auuaguguuaaacucuuaaucgacuccugcaaaucuauaccagugagaaaucuuacaaauguau

SEQ ID NO: 76653 - RNA, 64 nt, Homo Sapiens
cuaguaauagagcuuacauauauuuguauaacugcuauaccacugaacugaauuuauuuuacaa

SEQ ID NO: 76654 - RNA, 64 nt, Homo Sapiens
ccaacagcuaaagcccccaguaucucuucagucucuauaccaauaaagugacccuguucucacu

SEQ ID NO: 76655 - RNA, 64 nt, Homo Sapiens
ccaacagcuaaagccccuggucccucugcagucucuauaccaauaaagugacccugcucucacu

SEQ ID NO: 76656 - RNA, 64 nt, Homo Sapiens
uugggauuaagagcuuucuagccagaaucuggaccuauaccaugggaaaauuuaggggugcugg

SEQ ID NO: 76657 - RNA, 64 nt, Homo Sapiens
uugcagguagggugguauaugcuuucagaugacacuauaccacuuuuauaacuaauccacguuu

SEQ ID NO: 76658 - RNA, 64 nt, Homo Sapiens
uuuaccguggcaaccgucaagcuauucucugucccuauaccaggugucaucaaauuuuuuucug

SEQ ID NO: 76659 - RNA, 64 nt, Homo Sapiens
aaguguaguuaccauacagaggcuagucagaacccuauaccauaacaaacuuauggguaauaaa

SEQ ID NO: 76660 - RNA, 64 nt, Homo Sapiens
gcaauguuuuuccuuuaaucaagccaaccacagucuauaccauauucccaagguuacuggauag

SEQ ID NO: 76661 - RNA, 64 nt, Homo Sapiens
uauuuaacuugaaauucaucaugggagucugcugcuauaccaggcacaagauaaaacuccaaaa

SEQ ID NO: 76662 - RNA, 64 nt, Homo Sapiens
ccaacagcuaaagcccccggucccucugcagucucuauaccaauaaaguggcccugcucucacu

SEQ ID NO: 76663 - RNA, 64 nt, Homo Sapiens
ucagaacauuacaugccuucaaaaugggauuguacuauaccaguaagugccacuucugugucuu

SEQ ID NO: 76664 - RNA, 64 nt, Homo Sapiens
gauauuauuaaaacuagaaagucaguuccccacucuauaccaaguaugcaaaaaguauuucucu

SEQ ID NO: 76665 - RNA, 64 nt, Homo Sapiens
uccuguccauuaaaauuuuuacuuggcaguuauucuauaccauucaaaaaaguuaacuuaugug

SEQ ID NO: 76666 - RNA, 64 nt, Homo Sapiens
agaaaaccuguucaggcaggcucugucacccuagcuauaccagcggggacuagacaguuagaga

SEQ ID NO: 76667 - RNA, 64 nt, Homo Sapiens
ggcccacagguggcagugggcagaggggaccccgcuauaccaccucgcugcuguuccacugucu

SEQ ID NO: 76668 - RNA, 64 nt, Homo Sapiens
uuuuugacuaaguuuaaacucaugaauuguuaugcuauaccaaucugcaguaaaaaaaauuuuu

SEQ ID NO: 76669 - RNA, 64 nt, Homo Sapiens
cuaaagagagugacaaaugcuuccuuaaugucuucuauaccagaauguaaauauuuuuguguuu

SEQ ID NO: 76670 - RNA, 64 nt, Homo Sapiens
auaauugaguuuucagugggaaauuaaccucucacuauaccaguaacucuuucaaaaccuuuug

SEQ ID NO: 76671 - RNA, 64 nt, Homo Sapiens
auuuuuucugagauuaauguaaucccuguggagacuauaccacuuucuacuuaucugagaagca

SEQ ID NO: 76672 - RNA, 64 nt, Homo Sapiens
ucuauuagagaaagaagcccuaaagcagaaagcucuauaccaagaaguccaaacccagcacgca

SEQ ID NO: 76673 - RNA, 64 nt, Homo Sapiens
cggcagcgaggcugggcuggccagccaccacugacuauaccaacugggccucugauguucuucc

SEQ ID NO: 76674 - RNA, 64 nt, Homo Sapiens
ucaagaccagccuggccaacauggugaaacccaucuauaccaaaaauacaaaaauuagccgggu

SEQ ID NO: 76675 - RNA, 64 nt, Homo Sapiens
uaccugggcuucgggcaggacguggcuccccacgcuauaccaucaauuccgggcacggcagcgc

SEQ ID NO: 76676 - RNA, 64 nt, Homo Sapiens
ggggggccccagucuaagcuaaccacuuguaccacuauaccacuggaggugcugugugugaguc

SEQ ID NO: 76677 - RNA, 64 nt, Homo Sapiens
augaguacugccccaccccucccugccaagcagucuauaccagcaugccccucccuccccacgg

SEQ ID NO: 76678 - RNA, 64 nt, Homo Sapiens
ugcagaacagcuguggagacucuaaccugaagaucuauaccaaacgucgucugcuuaccacgua

SEQ ID NO: 76679 - RNA, 64 nt, Homo Sapiens
auggcuuggcuaauaagcaugcaauuccauauaucuauaccaucuuguaacucacuguguuagu

SEQ ID NO: 76680 - RNA, 64 nt, Homo Sapiens
ucagaugaacucuguucaucaugauugauuauugcuauaccaaaacgucaccauuacuuaaaag

SEQ ID NO: 76681 - RNA, 64 nt, Homo Sapiens
ugagcacccauugcucaccaucuucucucucucucuauaccaucggaugcuuagugcccucacu

SEQ ID NO: 76682 - RNA, 64 nt, Homo Sapiens
acuauaaauggaaaaucauuuuauaaaaaggaaacuauaccauuacauaaacuuuauaaaccuu

SEQ ID NO: 76683 - RNA, 64 nt, Homo Sapiens
uuucugcagcuaagggcagaggcugugccuagggcuauaccaccacuagcaucuguauuugaga

SEQ ID NO: 76684 - RNA, 64 nt, Homo Sapiens
caaaccaauucaccaacacaggaaaaccccgucucuauaccaacaaaaggucaauaaggucaag

SEQ ID NO: 76685 - RNA, 64 nt, Homo Sapiens
guauaauauuguauuauuaauuuauuuuuacuuucuauaccauuucaaaacacauuacacuaag

SEQ ID NO: 76686 - RNA, 64 nt, Homo Sapiens
cauuauauuaaaaacacaaaauuaagaagauugacuauaccaaacucugccauagaaauggcag

SEQ ID NO: 76687 - RNA, 64 nt, Homo Sapiens
gugugucuuccaacuuucauugaaaaugccauaucuauaccauauuuuauucgagucacugaug

SEQ ID NO: 76688 - RNA, 64 nt, Homo Sapiens
agaaagcaacagguaagauaggcuuucucucucccuauaccaaguaauuuauaccuacacagau

SEQ ID NO: 76689 - RNA, 64 nt, Homo Sapiens
gcugggauuacaggcgucagccaccgcgccuggccuauaccaguauuuucuaguuuaaaggagg

SEQ ID NO: 76690 - RNA, 64 nt, Homo Sapiens
gaauuccaguagaaagaaacaugacuacacugugcuauaccagauuuauucuagaauugcagaa

SEQ ID NO: 76691 - RNA, 64 nt, Homo Sapiens
aggauuuaccuaauuguccaauucuacgugcucucuauaccaaaacaaaaaaaaaaagcuaucc

SEQ ID NO: 76692 - RNA, 64 nt, Homo Sapiens
auaaaaucuaaaauuaaggaugagagauaaaaagcuauaccauauuauuguuacagauaaaacu

SEQ ID NO: 76693 - RNA, 64 nt, Homo Sapiens
uuuuuagugacaguugagguccaucccacaaguucuauaccauaucucuccuuuuaggaguaag

SEQ ID NO: 76694 - RNA, 64 nt, Homo Sapiens
ccugagugcaggucuuggcgccuguagagacacucuauaccaggcacagaacuuaaaaugaacg

SEQ ID NO: 76695 - RNA, 64 nt, Homo Sapiens
ugcuugcaagcguaauauccaacaguuuaagguacuauaccacaugguaaccuacuguuugcca

SEQ ID NO: 76696 - RNA, 64 nt, Homo Sapiens
caggauccaaaugaagagaauuuuuaccugcaggcuauaccaacaccaguuccuuuaagcaguc

SEQ ID NO: 76697 - RNA, 64 nt, Homo Sapiens
gucugccacuacuuggagugaccaagccuggugucuauaccaaaacgucccuugugacaacacc

SEQ ID NO: 76698 - RNA, 64 nt, Homo Sapiens
aucugccgcuaccuggacuggacaaaccuggcgucuauaccaaccagaccccugugggaggucc

SEQ ID NO: 76699 - RNA, 64 nt, Homo Sapiens
uuuaagaaaaaaaugauucuauacacaugaaccccuauaccaaugguucucuacugccuccuga

SEQ ID NO: 76700 - RNA, 64 nt, Homo Sapiens
cugauuuuugaaaagugaaucauuuugguuuugccuauaccaucgaacacaaauaccaaaacug

SEQ ID NO: 76701 - RNA, 64 nt, Homo Sapiens
gacugaaaaaaaaaauccuggaggagaaagcucucuauaccaaagacagagggggaaauaagag

SEQ ID NO: 76702 - RNA, 64 nt, Homo Sapiens
uaaacauuuucauaguucugaaauauuuugggaucuauaccaaucuggugauuucaguucugug

SEQ ID NO: 76703 - RNA, 64 nt, Homo Sapiens
ugggaucaccccagccacaagcccuucgagggcccuauaccauggcccaccuuggagcagagag

SEQ ID NO: 76704 - RNA, 64 nt, Homo Sapiens
uuccacagagcaugcaagaacuucuacaaaacuucuauaccacacagaagcugaaagagacucu

SEQ ID NO: 76705 - RNA, 64 nt, Homo Sapiens
gcaggggagccuauaaggagagcgaugcccacuccuauaccacccuuguaacccaguagacuug

SEQ ID NO: 76706 - RNA, 64 nt, Homo Sapiens
aaucuugggaacugaagccagucauguaaacauacuauaccaaucuagucccuaacaguguuuu

SEQ ID NO: 76707 - RNA, 64 nt, Homo Sapiens
uucagagaucucucuucccaaauguguaaauauucuauaccagauaaguuuaaauaagaaauuu

SEQ ID NO: 76708 - RNA, 64 nt, Homo Sapiens
uugaaucucguucuuuguguccuuacuuucugcccuauaccaucaauaggggaagagugguccu

SEQ ID NO: 76709 - RNA, 64 nt, Homo Sapiens
uacccuaaacugcauaauucugaaguuauauuuccuauaccauuuccguaauucuuauuccaua

SEQ ID NO: 76710 - RNA, 64 nt, Homo Sapiens
gacucuugcucugguuguugcacuccuucccugucuauaccacuuuucuuccugcaucuuggga

SEQ ID NO: 76711 - RNA, 64 nt, Homo Sapiens
gagcacagccuggacauuauccugcuugcuccgccuauaccacaagauaacccuggcccuacag

SEQ ID NO: 76712 - RNA, 64 nt, Homo Sapiens
acagcagcaggggccugaaaucuggacucuguuccuauaccacaagccuugcccaguuguucuc

SEQ ID NO: 76713 - RNA, 63 nt, Homo Sapiens
gaucacgugaggucaagaguucaagaccagccuggccaauauggugaaaccccaucucuacua

SEQ ID NO: 76714 - RNA, 63 nt, Homo Sapiens
cagaucacgagaucaggaguucaagaccagccuggccaauaugaugaaaccccgucucuacua

SEQ ID NO: 76715 - RNA, 63 nt, Homo Sapiens
uuggugggguuuuccccccuuuuuuauggaguuggccaauaggauugaguuggggcuccagua

SEQ ID NO: 76716 - RNA, 63 nt, Homo Sapiens
ucacacuaaguuguaaacauaggagaagcauuuggccaauaaaguuguugaaacucuauagac

SEQ ID NO: 76717 - RNA, 63 nt, Homo Sapiens
gaucaccugaggucaggaguucgaguccagccuggccaauaugcugaaacccugucucuacua

SEQ ID NO: 76718 - RNA, 58 nt, Homo Sapiens
uccaguuuuccaggcuguaagaaaaaagggccaauaaccagacugcugagguugccca

SEQ ID NO: 76719 - RNA, 63 nt, Homo Sapiens
ucagaauauaagacucaaggaguuugacuugguggccaauaccugccuuccaaagagauccua

SEQ ID NO: 76720 - RNA, 63 nt, Homo Sapiens
gucuguuuuuaaaaccauaggugggacagcuauggccaauaggcuauaaagagacauuuagca

SEQ ID NO: 76721 - RNA, 63 nt, Homo Sapiens
accacagacaccauauauccuucugcauccuuuggccaauaaaaguugcuggagaaccaaacc

SEQ ID NO: 76722 - RNA, 63 nt, Homo Sapiens
aacagaccgggaccuugucuuuagcgucagcuaggccaauagggccauaagccucccauuuug

SEQ ID NO: 76723 - RNA, 63 nt, Homo Sapiens
guaaaaccccgugucuauuaucgagacuagccuggccaauaugagauaccugaagucaggagu

SEQ ID NO: 76724 - RNA, 63 nt, Homo Sapiens
guaucuugacuuuaucaaagaggaaucuccuauggccaauaagauggggguagccccaaaagg

SEQ ID NO: 76725 - RNA, 63 nt, Homo Sapiens
uucuuuugaugugcagaagcagccaccacaucuggccaauaguaguacugggauuuaggcaug

SEQ ID NO: 76726 - RNA, 63 nt, Homo Sapiens
auguaucugcauauguuuucgucuucuguuaggggccaauaaaugcauaaaucaaugguucaa

SEQ ID NO: 76727 - RNA, 63 nt, Homo Sapiens
uccgagacggagucuugcucugccacugugcccggccaauacauuauuauuaacuuaaggcug

SEQ ID NO: 76728 - RNA, 63 nt, Homo Sapiens
acagcacuccaggccagcucaagaagcaaagcaggccaauagaaaugcaauauuuuuaauuua

SEQ ID NO: 76729 - RNA, 63 nt, Homo Sapiens
uggaucacaaggucaggaguucaagaccagccuggccaauauggugaaaguccgucucuacua

SEQ ID NO: 76730 - RNA, 63 nt, Homo Sapiens
gaucacuugaggucaggaguucgagaccagccuggccaauacggcaaaaccucaucauuacua

SEQ ID NO: 76731 - RNA, 63 nt, Homo Sapiens
aaucaugaagagaguuaaugguuaacagacauuggccaauaacaaaacaccccauggacugug

SEQ ID NO: 76732 - RNA, 63 nt, Homo Sapiens
ggauuaauaucuguguuccauuuuguggcccaaggccaauauaucacuuuucacuucuggcuu

SEQ ID NO: 76733 - RNA, 63 nt, Homo Sapiens
gcagaacaguauggugacugauucuacccaaugggccaauauucccagacaucugggaaccaa

SEQ ID NO: 76734 - RNA, 63 nt, Homo Sapiens
uucccuaacauccacaguguaacaaaaaacaggggccaauaaacucaaaaaagaaaaacaaaa

SEQ ID NO: 76735 - RNA, 63 nt, Homo Sapiens
ucgagaucagccugaccaacgcagaucacuugaggccaauaguacuuugggaggcugaggugg

SEQ ID NO: 76736 - RNA, 63 nt, Homo Sapiens
augaaaccccaucucuacuaucgagagcagccuggccaauauggaucacuugaggucaggagu

SEQ ID NO: 76737 - RNA, 63 nt, Homo Sapiens
gcaagacccugugucuaaaaaugagaccaucuuggccaauauaguuaauuugaggguaggggu

SEQ ID NO: 76738 - RNA, 63 nt, Homo Sapiens
gagauuaaaauaugucaucauucagaccaugauggccaauaugugcauuauucuugucuccuu

SEQ ID NO: 76739 - RNA, 63 nt, Homo Sapiens
gaucauuugaggccaggaguucaagaccagucuggccaauauggagaaaccuugucucuacua

SEQ ID NO: 76740 - RNA, 63 nt, Homo Sapiens
ggguuaagggaggguacuguugacaccagcuauggccaauagcugggcuguccugaggggugg

SEQ ID NO: 76741 - RNA, 63 nt, Homo Sapiens
uaauuuaucucuuguuugaaucugucauucaaaggccaauaauuuaaguugcuaucagcugau

SEQ ID NO: 76742 - RNA, 63 nt, Homo Sapiens
guuucaagauuuuuuuuuaauguuccagaagauggccaauagagaacauucaagggaaauggg

SEQ ID NO: 76743 - RNA, 63 nt, Homo Sapiens
cacaauauuaacuaaugccaguagugccauagaggccaauaugauauuuucaucuguuuacuu

SEQ ID NO: 76744 - RNA, 63 nt, Homo Sapiens
ccaccaucaccucaaacccaugaaauauuaccuggccaauaucuguugucaucacuuggucca

SEQ ID NO: 76745 - RNA, 63 nt, Homo Sapiens
uccuggccuagaaaaauaucuuacccaugagcuggccaauacucaauuuauuuguggcuuauu

SEQ ID NO: 76746 - RNA, 63 nt, Homo Sapiens
guuugucacuaguuuuucauuauuaaaugcugaggccaauaccaagaaguuuauuuucuauau

SEQ ID NO: 76747 - RNA, 63 nt, Homo Sapiens
cagaucaugaugucaggaguuugagaccagccuggccaauauggugaaacccugucucuacaa

SEQ ID NO: 76748 - RNA, 63 nt, Homo Sapiens
auuauuuuaucuuuaagcaugcuacuuuuacuuggccaauauuuucuuauguuaacuuuugcu

SEQ ID NO: 76749 - RNA, 63 nt, Homo Sapiens
aucucaacaccugugggagagcuuuuuaguaugggccaauaaagaaaaccucagucauugcau

SEQ ID NO: 76750 - RNA, 63 nt, Homo Sapiens
ugccuaguaaauguuaacugugcaaguggcugaggccaauaggaacuagcuuugcucuuuaga

SEQ ID NO: 76751 - RNA, 63 nt, Homo Sapiens
gaguuagaaugaaaacucauauuggcccggaaaggccaauaaaaaggaccagagaauucuuag

SEQ ID NO: 76752 - RNA, 63 nt, Homo Sapiens
auaagauggacgccauaaucacugucuccuuuuggccaauauccaguaagcagcaccuccaag

SEQ ID NO: 76753 - RNA, 63 nt, Homo Sapiens
gugaaaccccgucucuacuaucgagaccagccuggccaauauguggaucacaaggucaggagu

SEQ ID NO: 76754 - RNA, 63 nt, Homo Sapiens
ucaaaaugaucuuuagugccuuuauuccuuucaggccaauaauccacccaaaaauuagaaugu

SEQ ID NO: 76755 - RNA, 63 nt, Homo Sapiens
auuugaaccuuucucauggauuuuuguggugugggccaauaugguguuuacauuauauaauuc

SEQ ID NO: 76756 - RNA, 63 nt, Homo Sapiens
agcauucucucugacauuuagaaauuucaaguuggccaauaauuagcucagauagcuaauuag

SEQ ID NO: 76757 - RNA, 63 nt, Homo Sapiens
agaagggccucacaagacaauaaucuuccguuaggccaauaaaaagcaguaaaaauuguucau

SEQ ID NO: 76758 - RNA, 63 nt, Homo Sapiens
cauuaaaauaaccugaaggaaacuuucguuaugggccaauauuagcucuuauggaaacugauu

SEQ ID NO: 76759 - RNA, 63 nt, Homo Sapiens
agccugcucccacacugucacuggaugucauggggccaauaaaaucuccugcaauuguguauc

SEQ ID NO: 76760 - RNA, 63 nt, Homo Sapiens
aggauuuuucugcaggacuuuaaagcuuugaaaggccaauaucccauaggcuaacuuuaaaca

SEQ ID NO: 76761 - RNA, 63 nt, Homo Sapiens
auucugggaagaaaaaaaaaacauuaaugaagaggccaauaauaugaagggaaucauggauca

SEQ ID NO: 76762 - RNA, 63 nt, Homo Sapiens
cuggaaaugguuuaccuaaaagcuacagaaccaggccaauauauuuugaaauauugaugcaga

SEQ ID NO: 76763 - RNA, 63 nt, Homo Sapiens
agauccccucaacugucuacuuguugcagugagggccaauaauuaugaaauugucaggcugcu

SEQ ID NO: 76764 - RNA, 63 nt, Homo Sapiens
cugaaauggcuccugcacuuaaauucgcugggaggccaauaggccucccucaccuguuauaaa

SEQ ID NO: 76765 - RNA, 63 nt, Homo Sapiens
uuuagauuauuuuaucugguagaagaaugagaaggccaauaguaguuucuauuuaguuauuua

SEQ ID NO: 76766 - RNA, 63 nt, Homo Sapiens
ccucugccccagacaugggaagggaccuaagcuggccaauagcagaauaggagugauggguga

SEQ ID NO: 76767 - RNA, 63 nt, Homo Sapiens
aucauugaauuuucuguguuuucaggcaaauuuggccaauauuuuuuauaaaauuguugacau

SEQ ID NO: 76768 - RNA, 63 nt, Homo Sapiens
cagcuccacauucuuuguugacgugacacuaacggccaauaauaugcuucuuaauuaucaaau

SEQ ID NO: 76769 - RNA, 63 nt, Homo Sapiens
cuguauaacuccuugccaugcaaacucucaagaggccaauauauuccuggccauguuugaaug

SEQ ID NO: 76770 - RNA, 63 nt, Homo Sapiens
augacucuagcugggcaccuuggaccuccagcuggccaauagaagagacaggagacaggaagc

SEQ ID NO: 76771 - RNA, 63 nt, Homo Sapiens
aaucugugcagucaucaacaaaagggagaacauggccaauagucauaugugaagacagagcag

SEQ ID NO: 76772 - RNA, 63 nt, Homo Sapiens
uaauaaccguauuuuucacagggugacaaauugggccaauaaaucugccaucuuugaacucau

SEQ ID NO: 76773 - RNA, 63 nt, Homo Sapiens
uaacccaaugccugugaagcagucagcccuuauggccaauaacuuuucaccaaugagccuuag

SEQ ID NO: 76774 - RNA, 63 nt, Homo Sapiens
uuuuuaaaaaauagagcuuguacacauauuauaggccaauauuaucguucaucuagugagcaa

SEQ ID NO: 76775 - RNA, 63 nt, Homo Sapiens
gggauguggaauuuuuauacuucaucuugagguggccaauaugcauuuagggaguuaucuguu

SEQ ID NO: 76776 - RNA, 63 nt, Homo Sapiens
aacauguuugaauugucaaaccaaauacaacugggccaauauaaaaauagccaauuaacacaa

SEQ ID NO: 76777 - RNA, 63 nt, Homo Sapiens
ccuaucacacuuuggaaguauucuuuuagaaaaggccaauauauuuuaacuuuuuguuuuuau

SEQ ID NO: 76778 - RNA, 63 nt, Homo Sapiens
ugaggggaggaggaaugggagagggggcucaggggccaauaaacucugccuugaguccuccua

SEQ ID NO: 76779 - RNA, 63 nt, Homo Sapiens
ccauuucauaaaccauguuauguucucagcucuggccaauacucaguggaaagagcacgagga

SEQ ID NO: 76780 - RNA, 63 nt, Homo Sapiens
gcaaaacccugucucuacuaucaagaccagccuggccaauaugaaucacuugagucuaggagu

SEQ ID NO: 76781 - RNA, 63 nt, Homo Sapiens
gaugccccgaugccuuccuguucugaacagcggggccaauaaucucugagccucugucucugc

SEQ ID NO: 76782 - RNA, 63 nt, Homo Sapiens
gcagcaacacugauacuugugugcaccugauuuggccaauaggaucaacagugaaaagacaga

SEQ ID NO: 76783 - RNA, 63 nt, Homo Sapiens
aacaacaagacucuuuuuguacuaccauacucuggccaauaccagagcauaucagcagaguag

SEQ ID NO: 76784 - RNA, 63 nt, Homo Sapiens
cagaugcacugauauauaugcauuugcuguuuuggccaauauuuugaaaauguaugagcugag

SEQ ID NO: 76785 - RNA, 63 nt, Homo Sapiens
acccaggaacuguaaauuuaaaccuaaauauuuggccaauaguuuucagacuuaaagcaucau

SEQ ID NO: 76786 - RNA, 63 nt, Homo Sapiens
caugaccucuuccaggcauuugggagaacauaaggccaauaaugacuuuguaaguucuuauuc

SEQ ID NO: 76787 - RNA, 63 nt, Homo Sapiens
augcuuuauaaucuuccaguaaaauuuugaauuggccaauaacuuucaauagcauaaugaaau

SEQ ID NO: 76788 - RNA, 63 nt, Homo Sapiens
uaugauguuauggugaucauuagcuugauaaagggccaauaaagaccugucucaccauguaca

SEQ ID NO: 76789 - RNA, 63 nt, Homo Sapiens
agcaguuauuugauuugugcucacuuuugauauggccaauaaaaccauaccgacugagcuucu

SEQ ID NO: 76790 - RNA, 63 nt, Homo Sapiens
cggaucaugaggucaagaguucgagaccagccuggccaauauggugaaaccccgucucuauug

SEQ ID NO: 76791 - RNA, 63 nt, Homo Sapiens
gugaaacccugucucuacuauugagacuagccuggccaauauguggaucacaaugucaggagu

SEQ ID NO: 76792 - RNA, 63 nt, Homo Sapiens
uaagcauuuuuuccaugagauuuccagagaaaaggccaauaccuuaaaaaaggaaaaauaugg

SEQ ID NO: 76793 - RNA, 63 nt, Homo Sapiens
gaagaugacgcacucggaagagucguuuccuguggccaauaauaccagucacuuacuccaaga

SEQ ID NO: 76794 - RNA, 63 nt, Homo Sapiens
aucacgaggucaggaguucgagaccagcagccuggccaauauagugaaacuucgucucuacua

SEQ ID NO: 76795 - RNA, 63 nt, Homo Sapiens
cagcagaagcaggguacccuuuggggagcaggaggccaauaaaaaguucagaguucauuggau

SEQ ID NO: 76796 - RNA, 63 nt, Homo Sapiens
cuggacugcuucuuuuggcucuccgacaacuccggccaauaaacacuuucugaauugaguuug

SEQ ID NO: 76797 - RNA, 63 nt, Homo Sapiens
cuuucuuucaaaacaauacgaaaacuuuacuagggccaauaaaucagaacuugccagcuccuc

SEQ ID NO: 76798 - RNA, 63 nt, Homo Sapiens
gugaaacccugucucuacuaucgagaccagccuggccaauaaggaucacuugaggucaggagu

SEQ ID NO: 76799 - RNA, 63 nt, Homo Sapiens
gaaacccuaccccuuccaugccccgggacuuggggccaauacguuaguacaugggagggcuag

SEQ ID NO: 76800 - RNA, 63 nt, Homo Sapiens
uugugacauuuuuguagcgaaaacaauuuguuaggccaauauuugcuuacaguuuuccuauuc

SEQ ID NO: 76801 - RNA, 63 nt, Homo Sapiens
ucuuaucaaucuguucuuuuauuaugcagaaauggccaauaucauaauuguaaaaagaaugaa

SEQ ID NO: 76802 - RNA, 63 nt, Homo Sapiens
cggaucacaaggucaggaguucgagaccagccuggccaauauggugaaaccccaucucuacua

SEQ ID NO: 76803 - RNA, 63 nt, Homo Sapiens
gaucaccugaggucaggaguucgagacaagcguggccaauauggcaaagcccagucucuacua

SEQ ID NO: 76804 - RNA, 63 nt, Homo Sapiens
aaggaugaaaacaagugucuucacuaagcguauggccaauaaaugggacccaaacguucaauc

SEQ ID NO: 76805 - RNA, 63 nt, Homo Sapiens
aagauaauucucauuuguguuugucuuuuaaaaggccaauaaaauaucuuucaguaucauugu

SEQ ID NO: 76806 - RNA, 63 nt, Homo Sapiens
auucauuaugacugcuccaggaagggcuaauggggccaauauauuauugccugucauguggca

SEQ ID NO: 76807 - RNA, 63 nt, Homo Sapiens
gaagccgagggcuguuuugucggugcccucacaggccaauaggccaggucagggucccggagc

SEQ ID NO: 76808 - RNA, 63 nt, Homo Sapiens
gcucugguuuuauaauaucuuggguaucucuaaggccaauaaggauaacauuaucuacccaga

SEQ ID NO: 76809 - RNA, 63 nt, Homo Sapiens
gccaagaccaugggaaaaaaagccaugcucacuggccaauaaagagcuugaugcugccuggcc

SEQ ID NO: 76810 - RNA, 63 nt, Homo Sapiens
aaaagucaguagggacauugcagaagcuugaaaggccaauaccagaacacaggcugaugcuuc

SEQ ID NO: 76811 - RNA, 63 nt, Homo Sapiens
auucagacuuucaaaauaaagauguaaaugacuggccaauaauaaccauuuuaggaagguguu

SEQ ID NO: 76812 - RNA, 63 nt, Homo Sapiens
aaaacauaucaguuugaauacuugaaucaugcaggccaauauuauaaugugaaaagguaucua

SEQ ID NO: 76813 - RNA, 63 nt, Homo Sapiens
accccacucacuuuguaacuucaucacugacccggccaauaaggacccugugcgucuucuccc

SEQ ID NO: 76814 - RNA, 63 nt, Homo Sapiens
caaaaaugcagugccaggagugcuaaaccuagaggccaauacugaugaccuggaaggugaucc

SEQ ID NO: 76815 - RNA, 63 nt, Homo Sapiens
uggacugggagcguuuuagcgaccaccucauguggccaauaaacuucuaacuuguuucuugac

SEQ ID NO: 76816 - RNA, 63 nt, Homo Sapiens
uaauguugugacaucauauccugccagaacaaaggccaauauacuuuuucuauugcuaggagc

SEQ ID NO: 76817 - RNA, 63 nt, Homo Sapiens
uaccaugagaagaagugucccguuuuguccaguggccaauagcaagauaugaaccggucggga

SEQ ID NO: 76818 - RNA, 63 nt, Homo Sapiens
cuguacuaugaugggcuucuguucucugcugagggccaauacccuacuguggggagagauggc

SEQ ID NO: 76819 - RNA, 63 nt, Homo Sapiens
ugucccugggguggcuaggcaggaguggcguggggccaauacccagaccccuucagccaccag

SEQ ID NO: 76820 - RNA, 63 nt, Homo Sapiens
ugugcaagaaagggagaccuaagggugaacaguggccaauaaaaacccuagagaacaaacauc

SEQ ID NO: 76821 - RNA, 63 nt, Homo Sapiens
aucuaccugccacugccccuccugugugucccaggccaauaaacaucgugggugaggguaucc

SEQ ID NO: 76822 - RNA, 63 nt, Homo Sapiens
ccaacaagacaaaugaacugguccaacucuguaggccaauaaaaucuccgcauuugugugugu

SEQ ID NO: 76823 - RNA, 63 nt, Homo Sapiens
ugcuccugccagagagguuuuuuaugaaacagaggccaauacaggugaugaaaaugacccaca

SEQ ID NO: 76824 - RNA, 63 nt, Homo Sapiens
acaguggacaucaugacgagcgagcggccccucggccaauaagucugguggucucccccugcu

SEQ ID NO: 76825 - RNA, 63 nt, Homo Sapiens
acaauuccugcugaaaaacauggggugauggguggccaauaccgccagggauuuuuaauuaaa

SEQ ID NO: 76826 - RNA, 63 nt, Homo Sapiens
acacucuuauucugccuuacagccaccaugcccggccaauacugugcugggauuacacgcgug

SEQ ID NO: 76827 - RNA, 63 nt, Homo Sapiens
gaccccacaguggggcuggaccagggcccuggaggccaauaaagagcuuucuggguagacccu

SEQ ID NO: 76828 - RNA, 63 nt, Homo Sapiens
caaagcccccuugggggaacuguggcugcugggggccaauaaagcuguguaacuugaucgugg

SEQ ID NO: 76829 - RNA, 63 nt, Homo Sapiens
cagaucaugaggucaggaguuugagaccagccuggccaauauggugaaaccacgucucuauua

SEQ ID NO: 76830 - RNA, 63 nt, Homo Sapiens
gugagcugagaucuucccacugcacuccagccuggccaauaagaccugucuccagcaagaccc

SEQ ID NO: 76831 - RNA, 63 nt, Homo Sapiens
uggcagaaacucuauaagccagaagagagugggggccaauauucaacauucuuaaagaaaaga

SEQ ID NO: 76832 - RNA, 63 nt, Homo Sapiens
gaucaccuaaggucaggaguucgagaccagccuggccaauauggugaaaccccaucucuacua

SEQ ID NO: 76833 - RNA, 63 nt, Homo Sapiens
cugaucacaaggucaagaguucgugaccagccuggccaauauggugaaaccccaugucuacua

SEQ ID NO: 76834 - RNA, 63 nt, Homo Sapiens
acaggggcaacugguuuggcaaccccacauccaggccaauaaagaugugugagcugggugugu

SEQ ID NO: 76835 - RNA, 63 nt, Homo Sapiens
acuucagcacgucucaacagaagaccaccaaauggccaauaaguaagugaaaauguauucaau

SEQ ID NO: 76836 - RNA, 63 nt, Homo Sapiens
gugaaacccgucucuacuaaucgagaccauccuggccaauaugcggaucacaaggucaggaga

SEQ ID NO: 76837 - RNA, 63 nt, Homo Sapiens
cacguaacaaugcucgacauaagauacccagauggccaauaaggaauagacauuucuccaaag

SEQ ID NO: 76838 - RNA, 63 nt, Homo Sapiens
aaagacauuuccuaccugcacaugaugacucaaggccaauaauguaaccuaugucagacacua

SEQ ID NO: 76839 - RNA, 63 nt, Homo Sapiens
cuauauuuauucuuauuugaagccacuaugcccggccaauaagcugggacuacaggcaugcgc

SEQ ID NO: 76840 - RNA, 63 nt, Homo Sapiens
gauuugccuuuaaaacucugcauguuaacuguaggccaauauauugcuuguuggaugaauuug

SEQ ID NO: 76841 - RNA, 63 nt, Homo Sapiens
uugacagcucauuuugaagacauucacaaaaugggccaauaguaacuuaauuuucauuuuccu

SEQ ID NO: 76842 - RNA, 63 nt, Homo Sapiens
uugaaggucuucccaacccucuuaugauuuaauggccaauauucagcucuaagaauaauuuua

SEQ ID NO: 76843 - RNA, 63 nt, Homo Sapiens
gccaugugaugaugaggguccuguggcucucagggccaauaaaagggccucuugggauuuacu

SEQ ID NO: 76844 - RNA, 63 nt, Homo Sapiens
caacccaacaugaaaagguguucucacuuaagaggccaauaaauguuucccuucacggaucaa

SEQ ID NO: 76845 - RNA, 63 nt, Homo Sapiens
gaucacuugaggucaggaguucaagaccagccuggccaauauggugaaacccagucucuacua

SEQ ID NO: 76846 - RNA, 63 nt, Homo Sapiens
uacaggaguacagguuuugacacaagaacaguuggccaauacuggugcccaagccuggauuaa

SEQ ID NO: 76847 - RNA, 63 nt, Homo Sapiens
ucuguugagaauuuucauggagauuaugugguuggccaauaaagauagaugacauuucaaucu

SEQ ID NO: 76848 - RNA, 63 nt, Homo Sapiens
ccagaccuggccucucuucauuucauuauuauuggccaauauuucuuucagccauuucauuuc

SEQ ID NO: 76849 - RNA, 63 nt, Homo Sapiens
cuugugacagaugccaggagguagaugugugcuggccaauaaaggccccuaccugauuccccg

SEQ ID NO: 76850 - RNA, 63 nt, Homo Sapiens
uaugcaaaaauucaucuuucggugauugugggcggccaauacauaccuucuguaacuccuccc

SEQ ID NO: 76851 - RNA, 63 nt, Homo Sapiens
auaacuuaaaacuuuugugaggaagauuaauguggccaauaaaaccuuuaaauguuaaguguc

SEQ ID NO: 76852 - RNA, 63 nt, Homo Sapiens
acucucugucguagacacaccgauaggaccaauggccaauagauauuaaaagcaaacccucac

SEQ ID NO: 76853 - RNA, 63 nt, Homo Sapiens
cagaaauauauccaaaaaccaacauuucauauuggccaauaaauuuguuuaugaugcucugca

SEQ ID NO: 76854 - RNA, 63 nt, Homo Sapiens
agcaauggggucccuggccugugaggcauugagggccaauaggugcagauguccuugaagaga

SEQ ID NO: 76855 - RNA, 64 nt, Homo Sapiens
aaagcagaagaaaugacagccacagcgaaauccuggugaagagcaagggagacaaggaaacggg

SEQ ID NO: 76856 - RNA, 64 nt, Homo Sapiens
auccagaaguugaauuuuuaauguugcaagugagggugaagaagaucuuuguugacucaggagu

SEQ ID NO: 76857 - RNA, 64 nt, Homo Sapiens
ggaaagaacacauaauaaacaagaaaaaaacagaggugaagaaaaauccaagucugaacgggaa

SEQ ID NO: 76858 - RNA, 64 nt, Homo Sapiens
gcaagcauuucacuggcagccuccacuagaauuuggugaagaggaggaggaggagauugaugac

SEQ ID NO: 76859 - RNA, 64 nt, Homo Sapiens
acuagguguaaaaggugcuggccaaaugguucagggugaagagggcucuugauucaggggcugg

SEQ ID NO: 76860 - RNA, 64 nt, Homo Sapiens
gccugguccuugagccccugaguuguggggguagggugaagagcauaucccacaagaggcccca

SEQ ID NO: 76861 - RNA, 64 nt, Homo Sapiens
agcucagcagaggcugugguacaacaugguccuuggugaagaccugcaccccuggaaccuccca

SEQ ID NO: 76862 - RNA, 64 nt, Homo Sapiens
ugucugacagagacgggagcucugaguguccacgggugaagaagugaguguccacgggugaaga

SEQ ID NO: 76863 - RNA, 64 nt, Homo Sapiens
ugaguguccacgggugaagaagugaguguccacgggugaagaagugaguauguuucaccuggac

SEQ ID NO: 76864 - RNA, 64 nt, Homo Sapiens
gagggucucacaguuccuuauuuacaaugaaaggggugaagagucggcgcaggcuugcucuucu

SEQ ID NO: 76865 - RNA, 64 nt, Homo Sapiens
guuagguguuuuagguacauacuagaucagggcuggugaagaagauacgccacugauaacuaaa

SEQ ID NO: 76866 - RNA, 64 nt, Homo Sapiens
uguaaacaguggaaacacugugggaguuucccauggugaagaguggaacgaaggcgauaugaac

SEQ ID NO: 76867 - RNA, 64 nt, Homo Sapiens
ugaagaguggaacgaaggcgauaugaacugaaggggugaagacuugauuuuggagagggcaaca

SEQ ID NO: 76868 - RNA, 64 nt, Homo Sapiens
gaaccuuugggccgugcccccauuuuccguacauggugaagaacugcagccgggcuugugugca

SEQ ID NO: 76869 - RNA, 64 nt, Homo Sapiens
agaguccagguggccuuggagaggaaagaggaacggugaagacaagcugcgagagcugggagcu

SEQ ID NO: 76870 - RNA, 64 nt, Homo Sapiens
ggugaagacaagcugcgagagcugggagcuggagggugaagaggugaacacuugagugguuaga

SEQ ID NO: 76871 - RNA, 64 nt, Homo Sapiens
guacccacaggaucccaucccccgacccuggcacacgggccaagcucaccuagugucacguucc

SEQ ID NO: 76872 - RNA, 64 nt, Homo Sapiens
ucgacgucacacauauuaaugcagcaacgacgucacgggccauggcaugacgucacaccgagau

SEQ ID NO: 76873 - RNA, 64 nt, Homo Sapiens
cccccuugacacauccaggcgaugucuuuacuagagcugaaagggcuccuuggauguggagaca

SEQ ID NO: 76874 - RNA, 64 nt, Homo Sapiens
acuuguccaaggucucacgucuugaggcucugagagcugaaaaccccacuuucuggaugacaga

SEQ ID NO: 76875 - RNA, 64 nt, Homo Sapiens
aaaguaccuaaacauucgugaaaugauuuuuuuuagcugaaaaaugcuggcaagaagaauuuua

SEQ ID NO: 76876 - RNA, 64 nt, Homo Sapiens
caagaauauaaagauguauuauuuuaagccaaggagcugaaauauaucucaguuuauaaauuca

SEQ ID NO: 76877 - RNA, 64 nt, Homo Sapiens
uaguagaucucaauguuuuauaauuccuuaaaacagcugaaaauugggacaacauacuuuacgc

SEQ ID NO: 76878 - RNA, 64 nt, Homo Sapiens
auuccacuucauccuaugaggacuguguugccagagcugaaauagucuguggcagguugacaca

SEQ ID NO: 76879 - RNA, 64 nt, Homo Sapiens
uugccaucaagcaacccucaagugugagcagagcagcugaaaucgugccaguugcuggagaggu

SEQ ID NO: 76880 - RNA, 64 nt, Homo Sapiens
ucuuuuugccucagacagcuaaguuuaauuugguagcugaaauacacccaugcguaagcuaccc

SEQ ID NO: 76881 - RNA, 64 nt, Homo Sapiens
caaaagcagaggauugaacagggaacuuagaagaagcugaaauagccucagguuucuagaggaa

SEQ ID NO: 76882 - RNA, 64 nt, Homo Sapiens
aucugagucccaggagcugcccagaguugcugggagcugaaaaaucacauccuggccuggcaca

SEQ ID NO: 76883 - RNA, 64 nt, Homo Sapiens
aucauucauucuuagcucuuaauuguucauuuugagcugaaaugcugcauuuuaauuuuaacca

SEQ ID NO: 76884 - RNA, 64 nt, Homo Sapiens
uacuuggguauucucugauugcaauggacauggaagcugaaaauagguccagagaaccuggcau

SEQ ID NO: 76885 - RNA, 64 nt, Homo Sapiens
aaucugaugcucaggccugccugcaggaggggggagcugaaaggaaagguggaaggagaaacag

SEQ ID NO: 76886 - RNA, 64 nt, Homo Sapiens
uuagaagcaagaugaaaaaauuauauuuuuuaaaagcugaaaauaacuuguauuuucauauaau

SEQ ID NO: 76887 - RNA, 64 nt, Homo Sapiens
auaccuuagauuucuagguaacaugcaaaacugcagcugaaauaguguguguguguguuugcag

SEQ ID NO: 76888 - RNA, 64 nt, Homo Sapiens
cccugacauucaugauccaauuuuucugaccaggagcugaaagaucacucugacaugacaguau

SEQ ID NO: 76889 - RNA, 64 nt, Homo Sapiens
agaaaugauaaugcuuccaaagauuaaaagugagagcugaaaagacuaaggaaaauaacugaaa

SEQ ID NO: 76890 - RNA, 64 nt, Homo Sapiens
caugccuauugacagauaaaaagguauauauccaagcugaaaagggauaaaagggugcauuuua

SEQ ID NO: 76891 - RNA, 64 nt, Homo Sapiens
cugcuggcuccagaguuugauucacuucagguggagcugaaauuuuaaaccacguaguuaucuu

SEQ ID NO: 76892 - RNA, 64 nt, Homo Sapiens
auaacauagcuccgaaagggagagcagagauggcagcugaaacucacucugugcugggcuuugg

SEQ ID NO: 76893 - RNA, 64 nt, Homo Sapiens
uuacaacuagauauuaguuuuagaggaaggaaauagcugaaaaacuaaauuugcuuuggugaaa

SEQ ID NO: 76894 - RNA, 64 nt, Homo Sapiens
acauuuagcuccccuucuucaugagcaucuguagagcugaaaguauucuggaacuuuagacaga

SEQ ID NO: 76895 - RNA, 64 nt, Homo Sapiens
uagagcugaaaguauucuggaacuuuagacagaaagcugaaaggaaucugcagucuccugcugc

SEQ ID NO: 76896 - RNA, 64 nt, Homo Sapiens
uagcagaguuuaacucuucuuauggccugagcacagcugaaaucuuccaaaccucaaaaacuau

SEQ ID NO: 76897 - RNA, 64 nt, Homo Sapiens
uaugcauguaaaaacuuugaaggucuucagcauaagcugaaauaucaaugugcaacauacaggu

SEQ ID NO: 76898 - RNA, 64 nt, Homo Sapiens
uuuuuacaucuacguuguuguauuacauuuuucacuuaagcagucuugcaaaaugggacugcaa

SEQ ID NO: 76899 - RNA, 64 nt, Homo Sapiens
uaccauuauuguaaguagccuaccaaaugauucucuuaagcauuacaauaaauguucauuaaaa

SEQ ID NO: 76900 - RNA, 64 nt, Homo Sapiens
aaguaaaccucuucccguggaggaccaauaaacagccuccuauagaaugucaauaacauuuuaa

SEQ ID NO: 76901 - RNA, 64 nt, Homo Sapiens
uuaaaauacuguauucgcauuuauacgugugcuugccuccuaauuauuugguagaguaacaccu

SEQ ID NO: 76902 - RNA, 64 nt, Homo Sapiens
ggaccucauuauuucaagaggaacccaaaguccagccuccuacauagaugcugccccacgaagg

SEQ ID NO: 76903 - RNA, 64 nt, Homo Sapiens
cgaccuccccagcucaagcaauccucccaccucagccuccuaaguaccugguacuacaggcgcg

SEQ ID NO: 76904 - RNA, 64 nt, Homo Sapiens
aggugcugcuucuccacaggugcggccuggcccggccuccuaaaggccacacccuccccacgca

SEQ ID NO: 76905 - RNA, 64 nt, Homo Sapiens
auccgccgccuuccacgcuaggauguaagaggucgccuccuauuguacauuuggggaaagccuu

SEQ ID NO: 76906 - RNA, 64 nt, Homo Sapiens
caggccuggguggagggaguggcaagucaggcgugccuccuacaagcuuccuaaccucuuaagc

SEQ ID NO: 76907 - RNA, 64 nt, Homo Sapiens
auaaaagauugugggaaauggucauuugcugagcgccuccuaguugccaggcacuggagggcgc

SEQ ID NO: 76908 - RNA, 64 nt, Homo Sapiens
cacuuacgacaucacuuccauugugugcauguuuguuauagaggagguuuuaggcuacaauauu

SEQ ID NO: 76909 - RNA, 64 nt, Homo Sapiens
uaauguacacugucacaucuuuacagucuuguauguuauagaauacaaaauaaguugaugguuu

SEQ ID NO: 76910 - RNA, 64 nt, Homo Sapiens
auaguguuggcuuagucuagcacuacuguuaccuguuauagaaagauauuaaaauuuuugaaau

SEQ ID NO: 76911 - RNA, 64 nt, Homo Sapiens
ugcugaguuuggcauagauauaauuaaacaguaaguuauagacuguguucagauacuuacacca

SEQ ID NO: 76912 - RNA, 64 nt, Homo Sapiens
auaacucaucguuuacaguaucagugaugcauuuguuauagaguaaaccaaugauugcugaaaa

SEQ ID NO: 76913 - RNA, 64 nt, Homo Sapiens
acucaugauuucuauuuuuguuuuuaaaauuaauguuauagaaggcacuuuucacuucugugug

SEQ ID NO: 76914 - RNA, 64 nt, Homo Sapiens; identical to SEQ ID NO: 73933

SEQ ID NO: 76915 - RNA, 64 nt, Homo Sapiens; identical to SEQ ID NO: 73934

SEQ ID NO: 76916 - RNA, 64 nt, Homo Sapiens; identical to SEQ ID NO: 73935

SEQ ID NO: 76917 - RNA, 64 nt, Homo Sapiens; identical to SEQ ID NO: 73936

SEQ ID NO: 76918 - RNA, 64 nt, Homo Sapiens; identical to SEQ ID NO: 73937

SEQ ID NO: 76919 - RNA, 64 nt, Homo Sapiens; identical to SEQ ID NO: 73938

SEQ ID NO: 76920 - RNA, 64 nt, Homo Sapiens; identical to SEQ ID NO: 73939

SEQ ID NO: 76921 - RNA, 64 nt, Homo Sapiens; identical to SEQ ID NO: 73940

SEQ ID NO: 76922 - RNA, 64 nt, Homo Sapiens; identical to SEQ ID NO: 73941

SEQ ID NO: 76923 - RNA, 64 nt, Homo Sapiens; identical to SEQ ID NO: 73942

SEQ ID NO: 76924 - RNA, 64 nt, Homo Sapiens; identical to SEQ ID NO: 73943

SEQ ID NO: 76925 - RNA, 64 nt, Homo Sapiens; identical to SEQ ID NO: 73944

SEQ ID NO: 76926 - RNA, 64 nt, Homo Sapiens; identical to SEQ ID NO: 73945

SEQ ID NO: 76927 - RNA, 64 nt, Homo Sapiens; identical to SEQ ID NO: 73946

SEQ ID NO: 76928 - RNA, 64 nt, Homo Sapiens; identical to SEQ ID NO: 73947

SEQ ID NO: 76929 - RNA, 64 nt, Homo Sapiens; identical to SEQ ID NO: 73948

SEQ ID NO: 76930 - RNA, 64 nt, Homo Sapiens; identical to SEQ ID NO: 73949

SEQ ID NO: 76931 - RNA, 64 nt, Homo Sapiens; identical to SEQ ID NO: 73950

SEQ ID NO: 76932 - RNA, 64 nt, Homo Sapiens; identical to SEQ ID NO: 73951

SEQ ID NO: 76933 - RNA, 64 nt, Homo Sapiens; identical to SEQ ID NO: 73952

SEQ ID NO: 76934 - RNA, 64 nt, Homo Sapiens; identical to SEQ ID NO: 73953

SEQ ID NO: 76935 - RNA, 64 nt, Homo Sapiens; identical to SEQ ID NO: 73954

SEQ ID NO: 76936 - RNA, 64 nt, Homo Sapiens; identical to SEQ ID NO: 73955

SEQ ID NO: 76937 - RNA, 62 nt, Homo Sapiens
ucuucccuaccuguuucacauccguaagauuuaagauauacauuuuuugagagguagucugu

SEQ ID NO: 76938 - RNA, 62 nt, Homo Sapiens
gauucuucuuauuucaugguagguugucuuuaaagauauaaaaauuaggaugccuuuaugaa

SEQ ID NO: 76939 - RNA, 62 nt, Homo Sapiens
uaaaauaaaguauuaauacuuuaaagucaaauaagauauaguguuuacauucuuuagguccu

SEQ ID NO: 76940 - RNA, 62 nt, Homo Sapiens
uaauuuauuguuucuugguuucaccuuuguauaagauauagccaagacugaagaaaccaaau

SEQ ID NO: 76941 - RNA, 62 nt, Homo Sapiens
uuaaauuauauaaaauguaucugucuauaaagaagauauaaaauugugacuuuauucuacug

SEQ ID NO: 76942 - RNA, 62 nt, Homo Sapiens
aaaguaaauaauuguuuuaaaucuauuuuguaaagauauaaaguacaauagaauuucuggag

SEQ ID NO: 76943 - RNA, 62 nt, Homo Sapiens
ugucauuuucucuugaauauuccuuuucuauuaagauauauucuucugauuuuuaauuugua

SEQ ID NO: 76944 - RNA, 62 nt, Homo Sapiens
aagggccauucaguacaucaaacauuuuuauaaagauauaccuaaauagcucuguggguuuu

SEQ ID NO: 76945 - RNA, 62 nt, Homo Sapiens
ggggguaaaguauuaaaaauugauugaaucauaagauauaagcuaacaaaggaaaauauaag

SEQ ID NO: 76946 - RNA, 62 nt, Homo Sapiens
uucuuuacugcaguuaaaucauagauuaagaaaagauauaauauuuuguaauaucauucuaa

SEQ ID NO: 76947 - RNA, 62 nt, Homo Sapiens
aaugacuaaaugcuuuaaacauauuguagcuuaagauauauguguuaagauauauacaugag

SEQ ID NO: 76948 - RNA, 62 nt, Homo Sapiens
uuaaacauauuguagcuuaagauauauguguuaagauauauacaugagaaacuuuaaaaggu

SEQ ID NO: 76949 - RNA, 62 nt, Homo Sapiens
uguauuuauaccucagauauagauuauuauuuaagauauacuacauagauaaagcaugauaa

SEQ ID NO: 76950 - RNA, 62 nt, Homo Sapiens
uggauauucaauuuugauggguguuccucaugaagauauacauuugaguauuuuggauauca

SEQ ID NO: 76951 - RNA, 62 nt, Homo Sapiens
cucucuuaaaauacccauugccccagaccuggaagauauaacauucaguucccaccaucuga

SEQ ID NO: 76952 - RNA, 62 nt, Homo Sapiens
caaacagaccauaaauaaggaaacgaugaaauaagauauauacaaggugagugugacuuccc

SEQ ID NO: 76953 - RNA, 62 nt, Homo Sapiens
uacugccuuaugacauagccaaauaauucuguaagauauaccucuuccucauauguuaaaua

SEQ ID NO: 76954 - RNA, 62 nt, Homo Sapiens
augcugagccuuaaaacccagugugacuguagaagauauaaugcggacaugauuugaauuua

SEQ ID NO: 76955 - RNA, 62 nt, Homo Sapiens
ucacaguguccauacaaauuaguuccagagggaagauauaccacaaaauuacucaaaaauuu

SEQ ID NO: 76956 - RNA, 62 nt, Homo Sapiens
cggucuuuucuaaacuuuaacaugagacuuaaaagauauaauaagggaaaagauaagcagau

SEQ ID NO: 76957 - RNA, 62 nt, Homo Sapiens
gaaaaccuagaaaaaauuaauaaauuccuugaaagauauaaccccccaagauugaaccaaga

SEQ ID NO: 76958 - RNA, 62 nt, Homo Sapiens
auaggaagaggggaagucaguuucucuugcagaagauauaauucuguauuuagaaaaccugu

SEQ ID NO: 76959 - RNA, 62 nt, Homo Sapiens
aguucugacuuauuguuugggcuacacuuugaaagauauauuaguucugagccauuuauucu

SEQ ID NO: 76960 - RNA, 62 nt, Homo Sapiens
uuguauguguuuauucuucaccaaaauuuuugaagauauauacuauaugaagauaccugugu

SEQ ID NO: 76961 - RNA, 64 nt, Homo Sapiens
aaagugauaguuaacuggauuuguuaggugagggugaggccaagggugacuuccagguuccuga

SEQ ID NO: 76962 - RNA, 64 nt, Homo Sapiens
auaauaaaaaauaauaaaaauccuuaggauaacuugaggccaggaguuugagaccagugugacc

SEQ ID NO: 76963 - RNA, 64 nt, Homo Sapiens
ucucuuuuuuguaauuuguuuuugcaaaucauugugaggccacuuuuucuuucuuucuuucuuu

SEQ ID NO: 76964 - RNA, 64 nt, Homo Sapiens
ucucuuuuuuguaauuuguuguugcaaaucauugugaggccacuuuucuuuccccuuccuuccu

SEQ ID NO: 76965 - RNA, 64 nt, Homo Sapiens
gcuggaaagacacauauggcgaaagucaaguaucugaggccacuugcaacauugugacaaagaa

SEQ ID NO: 76966 - RNA, 64 nt, Homo Sapiens
aguuuaagaagacuuagauucauuuauugcuaucugaggccacuagugagauuucagaucucuc

SEQ ID NO: 76967 - RNA, 64 nt, Homo Sapiens
ccucuccuggaaccaccucuuccugggaucgggcugaggccagggaaugacacucucaaauugu

SEQ ID NO: 76968 - RNA, 64 nt, Homo Sapiens
uguuggcagccaacugcuccccccucucccugagugaggccagggauaucauccaggcccaagg

SEQ ID NO: 76969 - RNA, 64 nt, Homo Sapiens
uuagguuaugguagugcucagacaucugcaguguugaggccagucacuguuggaagucauccaa

SEQ ID NO: 76970 - RNA, 64 nt, Homo Sapiens
agucacuguuggaagucauccaagaagcccauuuugaggccauuuugagccuuacucuuaaguu

SEQ ID NO: 76971 - RNA, 64 nt, Homo Sapiens
ucuaagaccuuuucuucagaaguugcuuuccuuuugaggccaccaaaguaauuuagggaaacag

SEQ ID NO: 76972 - RNA, 64 nt, Homo Sapiens
ucacuaccaugauagucuacauucugauaagcugugaggccacugccaagggagggagaaaugg

SEQ ID NO: 76973 - RNA, 64 nt, Homo Sapiens
ugggagaagggcugaccucugaggggcugaggggugaggccagggcccuccagggggaggggua

SEQ ID NO: 76974 - RNA, 64 nt, Homo Sapiens
ggcuuacucccugggcagucuugggggccagagcugaggccaguccauauuacaguggcugggc

SEQ ID NO: 76975 - RNA, 64 nt, Homo Sapiens
acuugaguauuuacuaacaccauacaucaggaaaugaggccagaacagcacugcuuccaugcuu

SEQ ID NO: 76976 - RNA, 64 nt, Homo Sapiens
aguuugagacuagacugggcgaggaaggauagcuugaggccaggcaacacuuugggaggcugag

SEQ ID NO: 76977 - RNA, 64 nt, Homo Sapiens
aaggaccaagaacaguugaguuguuacugcccagugaggccaccgcccuucaauagacuugccc

SEQ ID NO: 76978 - RNA, 64 nt, Homo Sapiens
auugacucuuugggccuaaaaagccugugaucccugaggccagauuacuaauuccaucccagaa

SEQ ID NO: 76979 - RNA, 64 nt, Homo Sapiens
cgugauggcucaccccuguaaucccagcacuuugugaggccaaggugggcggaucacuugaggc

SEQ ID NO: 76980 - RNA, 64 nt, Homo Sapiens
cagcacuuugugaggccaaggugggcggaucacuugaggccaggaauuugaaaccagccugggc

SEQ ID NO: 76981 - RNA, 64 nt, Homo Sapiens
agaggcaggaguggcccuggggccugggccgcggugaggccaccucugaacccuuggggacgag

SEQ ID NO: 76982 - RNA, 64 nt, Homo Sapiens
uggccccaccugcuccucaggggcucuggcguccugaggccaccgaggggacccguggaugggg

SEQ ID NO: 76983 - RNA, 64 nt, Homo Sapiens
aguucgagaccacccugggcgugggaggaucgcuugaggccaggcagcacuuugggaggucgag

SEQ ID NO: 76984 - RNA, 64 nt, Homo Sapiens
auccccucucaaaggcugugggaaccccuggaacugaggccacgggagcacuuggcccuggcca

SEQ ID NO: 76985 - RNA, 64 nt, Homo Sapiens
ugugcguccaggggaacagcuaguggcaccuguaugaggccaaggacacugccaucagggcugu

SEQ ID NO: 76986 - RNA, 64 nt, Homo Sapiens
ugucagacugaauuucuuuuuuacaagacaacgcugaggccaguuuugcucuagcuguuugucc

SEQ ID NO: 76987 - RNA, 64 nt, Homo Sapiens
agaaaaugaguucucaaggagggaaugcuuugcuugaggccacacagcagguugguagcaaaga

SEQ ID NO: 76988 - RNA, 64 nt, Homo Sapiens
guugucagcacuggaggagaccccgccaguggggugaggccagccaagucccuguguuacgaau

SEQ ID NO: 76989 - RNA, 64 nt, Homo Sapiens
cucaggggaaccauggggcuuucuggaguuguggugaggccaccaggcugaagucagcucagac

SEQ ID NO: 76990 - RNA, 64 nt, Homo Sapiens
aacaaauggaguagcaucccccuggggcacuugcugaggccaagccacucacauccucacuuug

SEQ ID NO: 76991 - RNA, 64 nt, Homo Sapiens
agguccaggccgcaaugagacuaggcauaguaccugaggccaggcaaaaaauaaaaaaaauuag

SEQ ID NO: 76992 - RNA, 64 nt, Homo Sapiens
aguucaagaccagccugggcacgggaggaucacuugaggccaggcaacccuuuggaagguaaag

SEQ ID NO: 76993 - RNA, 64 nt, Homo Sapiens
gcaggcccauccgucucuucccuccagagcuagcugaggccaacccugccccucccccacagag

SEQ ID NO: 76994 - RNA, 64 nt, Homo Sapiens
aucaccugaccugggggucacauaggggagguugugaggccaccuaauaauacuucaccuaccu

SEQ ID NO: 76995 - RNA, 64 nt, Homo Sapiens
guuuaggaggugagaaaaagugugaucacuaaaaugaggccaagcaccuaccauuuuccuuuau

SEQ ID NO: 76996 - RNA, 64 nt, Homo Sapiens
aguuuaaguuacagaacuaugcaggaggauugcuugaggccaggcagcgcuuugggaggcugag

SEQ ID NO: 76997 - RNA, 64 nt, Homo Sapiens
ggcuaggaguucuaagaacaccaccacacaggagugaggccaggugcucccucgcuggcaagcc

SEQ ID NO: 76998 - RNA, 64 nt, Homo Sapiens
uucuuagccaaaaaccuaggcagcuuggcuggucugaggccaccagccagccaagugccaaggu

SEQ ID NO: 76999 - RNA, 64 nt, Homo Sapiens
gcuccuuaucagcuuccaggcuggucccauguaaugaggccagggccagggccagucccuccag

SEQ ID NO: 77000 - RNA, 64 nt, Homo Sapiens
ucaaucccugugccgccccaggacccugaggaacugaggccacgcgcuuguacauacgccaugg

SEQ ID NO: 77001 - RNA, 64 nt, Homo Sapiens
gcaacuccccuacaucaaaucaagaaacaccgagugaggccauauuaagagaaagucaccugcc

SEQ ID NO: 77002 - RNA, 64 nt, Homo Sapiens
gcaauuccccuacaucaaaucccgaaacaccaagugaggccauauggaaauuaagaaaaagucg

SEQ ID NO: 77003 - RNA, 64 nt, Homo Sapiens
agaaauuguauugcugcguagaaucugaacacacugaggccaccuagcaagguaguaacuaguc

SEQ ID NO: 77004 - RNA, 64 nt, Homo Sapiens
aguguuucccauaugccccuggagccccacuuauugaggccagcagaauaggugcagagaugaa

SEQ ID NO: 77005 - RNA, 64 nt, Homo Sapiens
cagcacuuuggaaggcugaggaaggaggaucgcuugaggccaggaguuugagacuagccuaggc

SEQ ID NO: 77006 - RNA, 64 nt, Homo Sapiens
uggcuacuucagaggcugagguggaaggaucacuugaggccaggaguuugaggcugcagugagu

SEQ ID NO: 77007 - RNA, 64 nt, Homo Sapiens
ggggcuggggaggcaggccugugggggcugaggcugaggccaaaucucacuccccaaggcucgg

SEQ ID NO: 77008 - RNA, 64 nt, Homo Sapiens
gugaaaggucccagacuucggccaaggucagcccugaggccaggaaguugcugaggccaaggua

SEQ ID NO: 77009 - RNA, 64 nt, Homo Sapiens
guagccaaggucagcccugagcaaaggaaguugcugaggccaaguuccccgauuuggggcucga

SEQ ID NO: 77010 - RNA, 64 nt, Homo Sapiens
cagggcaacacagcaagaccugaggccagguguuugaggccagcgcugaggugguuguauugcu

SEQ ID NO: 77011 - RNA, 64 nt, Homo Sapiens
uguuugaggccagccagggcgugguuguauugcuugaggccaggcagcacugugggaggcugag

SEQ ID NO: 77012 - RNA, 64 nt, Homo Sapiens
ucucggcucccgcaccccuuuucccuuauggcucugaggccaucggcugucucugcauuucauu

SEQ ID NO: 77013 - RNA, 64 nt, Homo Sapiens
cacccaccucuccgggggacuugacaaggggcccugaggccaagggaggucacuccucccucca

SEQ ID NO: 77014 - RNA, 64 nt, Homo Sapiens
ugcucuaauaucgauggucccucuuacucccuccugaggccagcguguaccuucagggaugggg

SEQ ID NO: 77015 - RNA, 64 nt, Homo Sapiens
aacgugcaaauuugcagguguacuggaggccuccugaggccagguucguugauggucuuuucug

SEQ ID NO: 77016 - RNA, 64 nt, Homo Sapiens
aguuucaugaaugcaugcucaguuuauuaaaauccauaaccauguaauucuuguaauauguuga

SEQ ID NO: 77017 - RNA, 64 nt, Homo Sapiens
uuuuauauagcagcaaaagauaagaauaaaaucacauaaccaaguugaagcuuccuuggcaaag

SEQ ID NO: 77018 - RNA, 64 nt, Homo Sapiens
cccccugcccuagcucuucucuaacuugguuaaccauaaccauaaccagauucccuugcaaucg

SEQ ID NO: 77019 - RNA, 64 nt, Homo Sapiens
gcccuagcucuucucuaacuugguuaaccauaaccauaaccagauucccuugcaaucgauuucu

SEQ ID NO: 77020 - RNA, 64 nt, Homo Sapiens
guagaaauauuuuuaagcuccucugaugcagcagcaaugcaaauuaugacauagugaauauaga

SEQ ID NO: 77021 - RNA, 64 nt, Homo Sapiens
uuaagccucaacaauccaaaucuacaaacuuuaacaaugcaagucuuacucuaauuuuuaagua

SEQ ID NO: 77022 - RNA, 64 nt, Homo Sapiens
gccaagaaaguauaagggucuuuuuuaauugcaacaaugcaaaaugggcagccuuuuuuuuuuu

SEQ ID NO: 77023 - RNA, 64 nt, Homo Sapiens
aaaacaaaauuccauuacagaaugcaaugcaauucaaugcaaugauacuguacugauacuauuc

SEQ ID NO: 77024 - RNA, 64 nt, Homo Sapiens
caaugcaaugaaaacaaaaugauacuauucaaugcaaugcaauuaguaaacuggauacuguacu

SEQ ID NO: 77025 - RNA, 64 nt, Homo Sapiens
caauucaaugcaaugaaaacguacugauacuauucaaugcaauggaagaaguaaacuggauacu

SEQ ID NO: 77026 - RNA, 64 nt, Homo Sapiens
aaauuguuaugcaugaaaccagugguagaagaaacaaugcaagacauacauuuccacuaugguc

SEQ ID NO: 77027 - RNA, 64 nt, Homo Sapiens
gucgguuucaggaauuucaaaagaaaucugacgucaaugcaauuauccauuauuuaaaagcuau

SEQ ID NO: 77028 - RNA, 64 nt, Homo Sapiens
aaaaacugcuguaaacacaggggacacagcuuaacaaugcaacuuuuaauuacuguuuucuuuu

SEQ ID NO: 77029 - RNA, 64 nt, Homo Sapiens
agucuaguacuuauuacaugcugcuauacacaagcaaugcaagaaaaaaacuuacuggguaggu

SEQ ID NO: 77030 - RNA, 64 nt, Homo Sapiens
aucuuauuucucaucuuuaaauuacucaacuuuacaaugcaaacgaagugugcauuuauuagcu

SEQ ID NO: 77031 - RNA, 64 nt, Homo Sapiens
gggucuugcuggcuaaaaugaccgugaacgacugcaaugcaagccuaaaauugugccagcgagc

SEQ ID NO: 77032 - RNA, 59 nt, Homo Sapiens
aagaagcuccaaaccuauagaacaaaaugugcaaucacagaagcacaugggauguaauc

SEQ ID NO: 77033 - RNA, 64 nt, Homo Sapiens
aacccagcauuccugaucuggguaccaauauuucugcaaucaguuuggcaauuuuuggauuagc

SEQ ID NO: 77034 - RNA, 64 nt, Homo Sapiens
ugggaaaaauauuaaauuauguauuuaagcauugugcaaucacuugcaucuuuuuuguuuaauu

SEQ ID NO: 77035 - RNA, 64 nt, Homo Sapiens
uucuguucaauuuuagccugaucagcuucaggucugcaaucaaauugguagcaaaacugagaaa

SEQ ID NO: 77036 - RNA, 64 nt, Homo Sapiens
gcugacugcagccuugaccucaggaguacaguagugcaaucacagggucuugcucuugcccagg

SEQ ID NO: 77037 - RNA, 64 nt, Homo Sapiens
auuagaauuuguaaggaaggcaacaccucguucaugcaaucagcaaaugaagaaaagucucucu

SEQ ID NO: 77038 - RNA, 64 nt, Homo Sapiens
gggaaauuuucaugcacgcucaagagggcauagaugcaaucauuacaaaauuucaaaacaaaaa

SEQ ID NO: 77039 - RNA, 64 nt, Homo Sapiens
aaggaaagacuuuuuaaaaaaagaagacagggaaugcaaucagguuuuuaugaagcacauacaa

SEQ ID NO: 77040 - RNA, 64 nt, Homo Sapiens
uuucugacguaauguaauucaggaagacagacgcugcaaucacagauuuuaaaaaauuguuugc

SEQ ID NO: 77041 - RNA, 64 nt, Homo Sapiens
guuuauuuuacguaaaauaaacuguuguuuccaaugcaaucaacucuguauuauauguauaaau

SEQ ID NO: 77042 - RNA, 64 nt, Homo Sapiens
gucucauucuaucggccaggcuggagugcaguggugcaaucacagcucacugcagccuuguccu

SEQ ID NO: 77043 - RNA, 64 nt, Homo Sapiens
guuucucaaguguuuuggagaaaaaaaucaacccugcaaucacuuuuuggaauugucuugauuu

SEQ ID NO: 77044 - RNA, 60 nt, Homo Sapiens
ugacagagcaccuaggauaaagugcagugaugcaaucacagcucaccucagugcggccuu

SEQ ID NO: 77045 - RNA, 64 nt, Homo Sapiens
uauuuuuuuuuguagagguggggaagugcagugaugcaaucacagcucaccucagugcggccuu

SEQ ID NO: 77046 - RNA, 64 nt, Homo Sapiens
agaaauacgccuuuuuuuuuuacuggggugagaggggcaugaagauucuuuuucuccuacuuuu

SEQ ID NO: 77047 - RNA, 64 nt, Homo Sapiens
cccaaggcagcugaggcagugguggaggagcccagggcaugaaggaccuauuggggcuggcccu

SEQ ID NO: 77048 - RNA, 64 nt, Homo Sapiens
uacccagcacaggcggggcuggaauucuggcggagggcaugagccugggacuccaugucacguu

SEQ ID NO: 77049 - RNA, 64 nt, Homo Sapiens
gcaucccucuguaugaauaugaaaucagagaccagggcaugauguugcuaggauuagagccucu

SEQ ID NO: 77050 - RNA, 64 nt, Homo Sapiens; identical to SEQ ID NO: 62936

SEQ ID NO: 77051 - RNA, 64 nt, Homo Sapiens; identical to SEQ ID NO: 62937

SEQ ID NO: 77052 - RNA, 64 nt, Homo Sapiens; identical to SEQ ID NO: 62938

SEQ ID NO: 77053 - RNA, 64 nt, Homo Sapiens; identical to SEQ ID NO: 62939

SEQ ID NO: 77054 - RNA, 64 nt, Homo Sapiens; identical to SEQ ID NO: 62940

SEQ ID NO: 77055 - RNA, 64 nt, Homo Sapiens; identical to SEQ ID NO: 62941

SEQ ID NO: 77056 - RNA, 64 nt, Homo Sapiens; identical to SEQ ID NO: 62942

SEQ ID NO: 77057 - RNA, 64 nt, Homo Sapiens; identical to SEQ ID NO: 62943

SEQ ID NO: 77058 - RNA, 64 nt, Homo Sapiens; identical to SEQ ID NO: 62944

SEQ ID NO: 77059 - RNA, 64 nt, Homo Sapiens; identical to SEQ ID NO: 62945

SEQ ID NO: 77060 - RNA, 64 nt, Homo Sapiens; identical to SEQ ID NO: 62946

SEQ ID NO: 77061 - RNA, 64 nt, Homo Sapiens; identical to SEQ ID NO: 62947

SEQ ID NO: 77062 - RNA, 64 nt, Homo Sapiens; identical to SEQ ID NO: 62948

SEQ ID NO: 77063 - RNA, 64 nt, Homo Sapiens; identical to SEQ ID NO: 62949

SEQ ID NO: 77064 - RNA, 64 nt, Homo Sapiens; identical to SEQ ID NO: 62950

SEQ ID NO: 77065 - RNA, 64 nt, Homo Sapiens; identical to SEQ ID NO: 62951

SEQ ID NO: 77066 - RNA, 64 nt, Homo Sapiens; identical to SEQ ID NO: 62952

SEQ ID NO: 77067 - RNA, 64 nt, Homo Sapiens; identical to SEQ ID NO: 62953

SEQ ID NO: 77068 - RNA, 64 nt, Homo Sapiens; identical to SEQ ID NO: 62954

SEQ ID NO: 77069 - RNA, 64 nt, Homo Sapiens; identical to SEQ ID NO: 62955

SEQ ID NO: 77070 - RNA, 64 nt, Homo Sapiens; identical to SEQ ID NO: 62956

SEQ ID NO: 77071 - RNA, 64 nt, Homo Sapiens; identical to SEQ ID NO: 62957

SEQ ID NO: 77072 - RNA, 64 nt, Homo Sapiens; identical to SEQ ID NO: 62958

SEQ ID NO: 77073 - RNA, 64 nt, Homo Sapiens; identical to SEQ ID NO: 62959

SEQ ID NO: 77074 - RNA, 64 nt, Homo Sapiens; identical to SEQ ID NO: 62960

SEQ ID NO: 77075 - RNA, 64 nt, Homo Sapiens; identical to SEQ ID NO: 62961

SEQ ID NO: 77076 - RNA, 64 nt, Homo Sapiens; identical to SEQ ID NO: 62962

SEQ ID NO: 77077 - RNA, 64 nt, Homo Sapiens; identical to SEQ ID NO: 62963

SEQ ID NO: 77078 - RNA, 64 nt, Homo Sapiens; identical to SEQ ID NO: 62964

SEQ ID NO: 77079 - RNA, 64 nt, Homo Sapiens; identical to SEQ ID NO: 62965

SEQ ID NO: 77080 - RNA, 64 nt, Homo Sapiens; identical to SEQ ID NO: 62966

SEQ ID NO: 77081 - RNA, 64 nt, Homo Sapiens; identical to SEQ ID NO: 62967

SEQ ID NO: 77082 - RNA, 64 nt, Homo Sapiens; identical to SEQ ID NO: 62968

SEQ ID NO: 77083 - RNA, 64 nt, Homo Sapiens; identical to SEQ ID NO: 62969

SEQ ID NO: 77084 - RNA, 64 nt, Homo Sapiens; identical to SEQ ID NO: 62970

SEQ ID NO: 77085 - RNA, 64 nt, Homo Sapiens; identical to SEQ ID NO: 62971

SEQ ID NO: 77086 - RNA, 64 nt, Homo Sapiens; identical to SEQ ID NO: 62972

SEQ ID NO: 77087 - RNA, 64 nt, Homo Sapiens; identical to SEQ ID NO: 62973

SEQ ID NO: 77088 - RNA, 64 nt, Homo Sapiens; identical to SEQ ID NO: 62974

SEQ ID NO: 77089 - RNA, 64 nt, Homo Sapiens; identical to SEQ ID NO: 62975

SEQ ID NO: 77090 - RNA, 64 nt, Homo Sapiens; identical to SEQ ID NO: 62976

SEQ ID NO: 77091 - RNA, 64 nt, Homo Sapiens; identical to SEQ ID NO: 62977

SEQ ID NO: 77092 - RNA, 64 nt, Homo Sapiens; identical to SEQ ID NO: 62978

SEQ ID NO: 77093 - RNA, 64 nt, Homo Sapiens; identical to SEQ ID NO: 62979

SEQ ID NO: 77094 - RNA, 64 nt, Homo Sapiens; identical to SEQ ID NO: 62980

SEQ ID NO: 77095 - RNA, 64 nt, Homo Sapiens; identical to SEQ ID NO: 62981

SEQ ID NO: 77096 - RNA, 64 nt, Homo Sapiens; identical to SEQ ID NO: 62982

SEQ ID NO: 77097 - RNA, 64 nt, Homo Sapiens; identical to SEQ ID NO: 62983

SEQ ID NO: 77098 - RNA, 64 nt, Homo Sapiens; identical to SEQ ID NO: 62984

SEQ ID NO: 77099 - RNA, 64 nt, Homo Sapiens; identical to SEQ ID NO: 62985

SEQ ID NO: 77100 - RNA, 64 nt, Homo Sapiens; identical to SEQ ID NO: 62986

SEQ ID NO: 77101 - RNA, 64 nt, Homo Sapiens; identical to SEQ ID NO: 62987

SEQ ID NO: 77102 - RNA, 64 nt, Homo Sapiens; identical to SEQ ID NO: 62988

SEQ ID NO: 77103 - RNA, 64 nt, Homo Sapiens; identical to SEQ ID NO: 62989

SEQ ID NO: 77104 - RNA, 64 nt, Homo Sapiens; identical to SEQ ID NO: 62990

SEQ ID NO: 77105 - RNA, 64 nt, Homo Sapiens; identical to SEQ ID NO: 62991

SEQ ID NO: 77106 - RNA, 64 nt, Homo Sapiens; identical to SEQ ID NO: 62992

SEQ ID NO: 77107 - RNA, 64 nt, Homo Sapiens; identical to SEQ ID NO: 62993

SEQ ID NO: 77108 - RNA, 64 nt, Homo Sapiens; identical to SEQ ID NO: 62994

SEQ ID NO: 77109 - RNA, 64 nt, Homo Sapiens; identical to SEQ ID NO: 62995

SEQ ID NO: 77110 - RNA, 64 nt, Homo Sapiens; identical to SEQ ID NO: 62996

SEQ ID NO: 77111 - RNA, 64 nt, Homo Sapiens; identical to SEQ ID NO: 62997

SEQ ID NO: 77112 - RNA, 64 nt, Homo Sapiens; identical to SEQ ID NO: 62998

SEQ ID NO: 77113 - RNA, 64 nt, Homo Sapiens; identical to SEQ ID NO: 62999

SEQ ID NO: 77114 - RNA, 64 nt, Homo Sapiens; identical to SEQ ID NO: 63000

SEQ ID NO: 77115 - RNA, 64 nt, Homo Sapiens; identical to SEQ ID NO: 63001

SEQ ID NO: 77116 - RNA, 64 nt, Homo Sapiens; identical to SEQ ID NO: 63002

SEQ ID NO: 77117 - RNA, 64 nt, Homo Sapiens; identical to SEQ ID NO: 63003

SEQ ID NO: 77118 - RNA, 64 nt, Homo Sapiens; identical to SEQ ID NO: 63004

SEQ ID NO: 77119 - RNA, 64 nt, Homo Sapiens; identical to SEQ ID NO: 63005

SEQ ID NO: 77120 - RNA, 64 nt, Homo Sapiens; identical to SEQ ID NO: 63006

SEQ ID NO: 77121 - RNA, 64 nt, Homo Sapiens; identical to SEQ ID NO: 63007

SEQ ID NO: 77122 - RNA, 64 nt, Homo Sapiens; identical to SEQ ID NO: 63008

SEQ ID NO: 77123 - RNA, 64 nt, Homo Sapiens; identical to SEQ ID NO: 63009

SEQ ID NO: 77124 - RNA, 64 nt, Homo Sapiens; identical to SEQ ID NO: 63010

SEQ ID NO: 77125 - RNA, 64 nt, Homo Sapiens; identical to SEQ ID NO: 63011

SEQ ID NO: 77126 - RNA, 64 nt, Homo Sapiens; identical to SEQ ID NO: 63012

SEQ ID NO: 77127 - RNA, 64 nt, Homo Sapiens; identical to SEQ ID NO: 63013

SEQ ID NO: 77128 - RNA, 64 nt, Homo Sapiens; identical to SEQ ID NO: 63014

SEQ ID NO: 77129 - RNA, 64 nt, Homo Sapiens; identical to SEQ ID NO: 63015

SEQ ID NO: 77130 - RNA, 64 nt, Homo Sapiens
acagugugugaucaaguguguccaccccuucgggucucagcauggacgugugcauguuaugagc

SEQ ID NO: 77131 - RNA, 64 nt, Homo Sapiens
caggccuaggaucagggaccagaggauccuaucuucucagcacccagcccaccccuuccuguag

SEQ ID NO: 77132 - RNA, 64 nt, Homo Sapiens
acugccucaucugccacgccucugaugagaccucucucagcaccgcgguccuuucagcucccag

SEQ ID NO: 77133 - RNA, 64 nt, Homo Sapiens
gguacgucugcucaugaccagcggcagccccgacucucagcacuuaccaucaugcggaaaagca

SEQ ID NO: 77134 - RNA, 64 nt, Homo Sapiens
caguccgaaagcaugugggaggcugguucugcacucucagcaugcagcccaugagaaggaauga

SEQ ID NO: 77135 - RNA, 64 nt, Homo Sapiens
uuggaagaaaucccagaagcuagaaauaaagagaucucagcagcggccacuguuagguuuccuu

SEQ ID NO: 77136 - RNA, 64 nt, Homo Sapiens
cugggcucggcauuccgaagccaggaacgccucaucucagcagcgacauuugggagagggaugc

SEQ ID NO: 77137 - RNA, 62 nt, Homo Sapiens
agagaaaucacuaggacuacagcucagccuguucucagcagucauugucucaaaauucuuga

SEQ ID NO: 77138 - RNA, 64 nt, Homo Sapiens
ggcuagugaaggacgccuuuuugacucuucuuggucucagcauguugacugggauuggaaauaa

SEQ ID NO: 77139 - RNA, 64 nt, Homo Sapiens
uacuuaucuuuucagcaguauauaugugcugaaaucucagcaugaaagcauugcaugaguaaag

SEQ ID NO: 77140 - RNA, 64 nt, Homo Sapiens
aaaugagaguaauaaaacuuggcuucucucuaccucucagcacuaaugauggucaaaugccuua

SEQ ID NO: 77141 - RNA, 64 nt, Homo Sapiens
gguguggauuuagguuauacugggggagaacuuuucucagcacagauucuaugccagcuucuuu

SEQ ID NO: 77142 - RNA, 64 nt, Homo Sapiens
auuuuuccuucaaaaucaucuugugcgcgugcuuucucagcagcguaugacaacucuacagaag

SEQ ID NO: 77143 - RNA, 64 nt, Homo Sapiens
aucaguccugauugaauuucaaaaaacagcagagucucagcaugaaguuuuuuagacccaaaga

SEQ ID NO: 77144 - RNA, 64 nt, Homo Sapiens
aaauccucauaggagcuauaaagcaggcugcugaucucagcaguugauauggugguugugccuc

SEQ ID NO: 77145 - RNA, 64 nt, Homo Sapiens
cauuuacauguuuucgaacacagaauagcucuuuucucagcaucauuauugcucuuucagcauc

SEQ ID NO: 77146 - RNA, 64 nt, Homo Sapiens
agcccauagacuacaguucuucagaggccauaugucucagcaaguacugguuauauucuuuuuu

SEQ ID NO: 77147 - RNA, 64 nt, Homo Sapiens
uguauucuuagaccaaaaaucauaaccugcuguuucucagcaaagccuugcucucuggagcuua

SEQ ID NO: 77148 - RNA, 64 nt, Homo Sapiens
guuugaccuuuuuaaaacgaaaagagagacaaagucucagcacauuccaaggagugguagaaac

SEQ ID NO: 77149 - RNA, 64 nt, Homo Sapiens
auaauuggacuagauaccuugguacuguugaccuucucagcaucucccuuuugccuuagauggc

SEQ ID NO: 77150 - RNA, 64 nt, Homo Sapiens
guugaacugggcuaccucucugcaaaguucacugucucagcaaaucaguagguguuaguauggu

SEQ ID NO: 77151 - RNA, 64 nt, Homo Sapiens
aucgucauguuuuucugauguuccuaaagccaccucucagcagagaggagagccaucuauuuug

SEQ ID NO: 77152 - RNA, 64 nt, Homo Sapiens
ggacuuuuccccugugaagggggcugccaggacaucucagcacucccgccuggagcucucagca

SEQ ID NO: 77153 - RNA, 64 nt, Homo Sapiens
gcugccaggacaucucagcacucccgccuggagcucucagcaucacugaagguaccacagugua

SEQ ID NO: 77154 - RNA, 64 nt, Homo Sapiens
gggucugauggcuucuagggaugcucugcgugugucucagcaccgcuaucucagccacuuucag

SEQ ID NO: 77155 - RNA, 64 nt, Homo Sapiens
gaccccugcccuuuccccgccagagaccucaggcucucagcacauuccacaggcuccugagucc

SEQ ID NO: 77156 - RNA, 64 nt, Homo Sapiens
aaucuuguuuaucacuuuaaaaaauucaguaauaucucagcagucaggcuucugguugugaaau

SEQ ID NO: 77157 - RNA, 64 nt, Homo Sapiens
uucauuuuuucugaauauuagagggaaaacugcaucucagcauucgugaacauggaacugcuaa

SEQ ID NO: 77158 - RNA, 64 nt, Homo Sapiens
cuugcugugcucucugcugagcccaugcaacauaucucagcauuucauguuuuuaaguaaguug

SEQ ID NO: 77159 - RNA, 64 nt, Homo Sapiens
gacagauugaacaccugcaaaacugcuagcguaaucucagcacauacgcagcuaggaaguuugu

SEQ ID NO: 77160 - RNA, 64 nt, Homo Sapiens
gagcaugugagaacauagcaguagggaccaaaagucucagcacacuuaccuccgauuaugccuu

SEQ ID NO: 77161 - RNA, 64 nt, Homo Sapiens
caaacuggacaguagacaucaugaucccuccaguuagcucuaauuacagaccccaccaguacag

SEQ ID NO: 77162 - RNA, 64 nt, Homo Sapiens
cuauucaggacuaagucccuuacugcaaauguguuagcucuaacaucucccacaagcuagagga

SEQ ID NO: 77163 - RNA, 64 nt, Homo Sapiens
cccacuaucuacuagaauuucguuuucguuuauuuagcucuauccccguucucuaacuuccuua

SEQ ID NO: 77164 - RNA, 64 nt, Homo Sapiens
gcauggcuugguaaccuguuccguuuggacaguauagcucuagaagccacgugucuagcggcua

SEQ ID NO: 77165 - RNA, 64 nt, Homo Sapiens; identical to SEQ ID NO: 50680

SEQ ID NO: 77166 - RNA, 64 nt, Homo Sapiens; identical to SEQ ID NO: 50681

SEQ ID NO: 77167 - RNA, 64 nt, Homo Sapiens; identical to SEQ ID NO: 50682

SEQ ID NO: 77168 - RNA, 64 nt, Homo Sapiens; identical to SEQ ID NO: 50683

SEQ ID NO: 77169 - RNA, 64 nt, Homo Sapiens; identical to SEQ ID NO: 50684

SEQ ID NO: 77170 - RNA, 64 nt, Homo Sapiens; identical to SEQ ID NO: 50685

SEQ ID NO: 77171 - RNA, 64 nt, Homo Sapiens; identical to SEQ ID NO: 50686

SEQ ID NO: 77172 - RNA, 64 nt, Homo Sapiens; identical to SEQ ID NO: 50687

SEQ ID NO: 77173 - RNA, 64 nt, Homo Sapiens; identical to SEQ ID NO: 50688

SEQ ID NO: 77174 - RNA, 64 nt, Homo Sapiens; identical to SEQ ID NO: 50689

SEQ ID NO: 77175 - RNA, 64 nt, Homo Sapiens; identical to SEQ ID NO: 50690

SEQ ID NO: 77176 - RNA, 64 nt, Homo Sapiens; identical to SEQ ID NO: 50691

SEQ ID NO: 77177 - RNA, 64 nt, Homo Sapiens; identical to SEQ ID NO: 50692

SEQ ID NO: 77178 - RNA, 64 nt, Homo Sapiens; identical to SEQ ID NO: 50693

SEQ ID NO: 77179 - RNA, 62 nt, Homo Sapiens; identical to SEQ ID NO: 50694

SEQ ID NO: 77180 - RNA, 62 nt, Homo Sapiens; identical to SEQ ID NO: 50695

SEQ ID NO: 77181 - RNA, 62 nt, Homo Sapiens; identical to SEQ ID NO: 50696

SEQ ID NO: 77182 - RNA, 62 nt, Homo Sapiens; identical to SEQ ID NO: 50697

SEQ ID NO: 77183 - RNA, 62 nt, Homo Sapiens; identical to SEQ ID NO: 50698

SEQ ID NO: 77184 - RNA, 62 nt, Homo Sapiens; identical to SEQ ID NO: 50699

SEQ ID NO: 77185 - RNA, 62 nt, Homo Sapiens; identical to SEQ ID NO: 50700

SEQ ID NO: 77186 - RNA, 62 nt, Homo Sapiens; identical to SEQ ID NO: 50701

SEQ ID NO: 77187 - RNA, 62 nt, Homo Sapiens; identical to SEQ ID NO: 50702

SEQ ID NO: 77188 - RNA, 62 nt, Homo Sapiens; identical to SEQ ID NO: 50703

SEQ ID NO: 77189 - RNA, 64 nt, Homo Sapiens; identical to SEQ ID NO: 50680

SEQ ID NO: 77190 - RNA, 64 nt, Homo Sapiens; identical to SEQ ID NO: 50681

SEQ ID NO: 77191 - RNA, 64 nt, Homo Sapiens; identical to SEQ ID NO: 50682

SEQ ID NO: 77192 - RNA, 64 nt, Homo Sapiens; identical to SEQ ID NO: 50683

SEQ ID NO: 77193 - RNA, 64 nt, Homo Sapiens; identical to SEQ ID NO: 50684

SEQ ID NO: 77194 - RNA, 64 nt, Homo Sapiens; identical to SEQ ID NO: 50685

SEQ ID NO: 77195 - RNA, 64 nt, Homo Sapiens; identical to SEQ ID NO: 50686

SEQ ID NO: 77196 - RNA, 64 nt, Homo Sapiens; identical to SEQ ID NO: 50687

SEQ ID NO: 77197 - RNA, 64 nt, Homo Sapiens; identical to SEQ ID NO: 50688

SEQ ID NO: 77198 - RNA, 64 nt, Homo Sapiens; identical to SEQ ID NO: 50689

SEQ ID NO: 77199 - RNA, 64 nt, Homo Sapiens; identical to SEQ ID NO: 50690

SEQ ID NO: 77200 - RNA, 64 nt, Homo Sapiens; identical to SEQ ID NO: 50691

SEQ ID NO: 77201 - RNA, 64 nt, Homo Sapiens; identical to SEQ ID NO: 50692

SEQ ID NO: 77202 - RNA, 64 nt, Homo Sapiens; identical to SEQ ID NO: 50693

SEQ ID NO: 77203 - RNA, 62 nt, Homo Sapiens; identical to SEQ ID NO: 50694

SEQ ID NO: 77204 - RNA, 62 nt, Homo Sapiens; identical to SEQ ID NO: 50695

SEQ ID NO: 77205 - RNA, 62 nt, Homo Sapiens; identical to SEQ ID NO: 50696

SEQ ID NO: 77206 - RNA, 62 nt, Homo Sapiens; identical to SEQ ID NO: 50697

SEQ ID NO: 77207 - RNA, 62 nt, Homo Sapiens; identical to SEQ ID NO: 50698

SEQ ID NO: 77208 - RNA, 62 nt, Homo Sapiens; identical to SEQ ID NO: 50699

SEQ ID NO: 77209 - RNA, 62 nt, Homo Sapiens; identical to SEQ ID NO: 50700

SEQ ID NO: 77210 - RNA, 62 nt, Homo Sapiens; identical to SEQ ID NO: 50701

SEQ ID NO: 77211 - RNA, 62 nt, Homo Sapiens; identical to SEQ ID NO: 50702

SEQ ID NO: 77212 - RNA, 62 nt, Homo Sapiens; identical to SEQ ID NO: 50703

SEQ ID NO: 77213 - RNA, 64 nt, Homo Sapiens; identical to SEQ ID NO: 50680

SEQ ID NO: 77214 - RNA, 64 nt, Homo Sapiens; identical to SEQ ID NO: 50681

SEQ ID NO: 77215 - RNA, 64 nt, Homo Sapiens; identical to SEQ ID NO: 50682

SEQ ID NO: 77216 - RNA, 64 nt, Homo Sapiens; identical to SEQ ID NO: 50683

SEQ ID NO: 77217 - RNA, 64 nt, Homo Sapiens; identical to SEQ ID NO: 50684

SEQ ID NO: 77218 - RNA, 64 nt, Homo Sapiens; identical to SEQ ID NO: 50685

SEQ ID NO: 77219 - RNA, 64 nt, Homo Sapiens; identical to SEQ ID NO: 50686

SEQ ID NO: 77220 - RNA, 64 nt, Homo Sapiens; identical to SEQ ID NO: 50687

SEQ ID NO: 77221 - RNA, 64 nt, Homo Sapiens; identical to SEQ ID NO: 50688

SEQ ID NO: 77222 - RNA, 64 nt, Homo Sapiens; identical to SEQ ID NO: 50689

SEQ ID NO: 77223 - RNA, 64 nt, Homo Sapiens; identical to SEQ ID NO: 50690

SEQ ID NO: 77224 - RNA, 64 nt, Homo Sapiens; identical to SEQ ID NO: 50691

SEQ ID NO: 77225 - RNA, 64 nt, Homo Sapiens; identical to SEQ ID NO: 50692

SEQ ID NO: 77226 - RNA, 64 nt, Homo Sapiens; identical to SEQ ID NO: 50693

SEQ ID NO: 77227 - RNA, 62 nt, Homo Sapiens; identical to SEQ ID NO: 50694

SEQ ID NO: 77228 - RNA, 62 nt, Homo Sapiens; identical to SEQ ID NO: 50695

SEQ ID NO: 77229 - RNA, 62 nt, Homo Sapiens; identical to SEQ ID NO: 50696

SEQ ID NO: 77230 - RNA, 62 nt, Homo Sapiens; identical to SEQ ID NO: 50697

SEQ ID NO: 77231 - RNA, 62 nt, Homo Sapiens; identical to SEQ ID NO: 50698

SEQ ID NO: 77232 - RNA, 62 nt, Homo Sapiens; identical to SEQ ID NO: 50699

SEQ ID NO: 77233 - RNA, 62 nt, Homo Sapiens; identical to SEQ ID NO: 50700

SEQ ID NO: 77234 - RNA, 62 nt, Homo Sapiens; identical to SEQ ID NO: 50701

SEQ ID NO: 77235 - RNA, 62 nt, Homo Sapiens; identical to SEQ ID NO: 50702

SEQ ID NO: 77236 - RNA, 62 nt, Homo Sapiens; identical to SEQ ID NO: 50703

SEQ ID NO: 77237 - RNA, 64 nt, Homo Sapiens; identical to SEQ ID NO: 50680

SEQ ID NO: 77238 - RNA, 64 nt, Homo Sapiens; identical to SEQ ID NO: 50681

SEQ ID NO: 77239 - RNA, 64 nt, Homo Sapiens; identical to SEQ ID NO: 50682

SEQ ID NO: 77240 - RNA, 64 nt, Homo Sapiens; identical to SEQ ID NO: 50683

SEQ ID NO: 77241 - RNA, 64 nt, Homo Sapiens; identical to SEQ ID NO: 50684

SEQ ID NO: 77242 - RNA, 64 nt, Homo Sapiens; identical to SEQ ID NO: 50685

SEQ ID NO: 77243 - RNA, 64 nt, Homo Sapiens; identical to SEQ ID NO: 50686

SEQ ID NO: 77244 - RNA, 64 nt, Homo Sapiens; identical to SEQ ID NO: 50687

SEQ ID NO: 77245 - RNA, 64 nt, Homo Sapiens; identical to SEQ ID NO: 50688

SEQ ID NO: 77246 - RNA, 64 nt, Homo Sapiens; identical to SEQ ID NO: 50689

SEQ ID NO: 77247 - RNA, 64 nt, Homo Sapiens; identical to SEQ ID NO: 50690

SEQ ID NO: 77248 - RNA, 64 nt, Homo Sapiens; identical to SEQ ID NO: 50691

SEQ ID NO: 77249 - RNA, 64 nt, Homo Sapiens; identical to SEQ ID NO: 50692

SEQ ID NO: 77250 - RNA, 64 nt, Homo Sapiens; identical to SEQ ID NO: 50693

SEQ ID NO: 77251 - RNA, 62 nt, Homo Sapiens; identical to SEQ ID NO: 50694

SEQ ID NO: 77252 - RNA, 62 nt, Homo Sapiens; identical to SEQ ID NO: 50695

SEQ ID NO: 77253 - RNA, 62 nt, Homo Sapiens; identical to SEQ ID NO: 50696

SEQ ID NO: 77254 - RNA, 62 nt, Homo Sapiens; identical to SEQ ID NO: 50697

SEQ ID NO: 77255 - RNA, 62 nt, Homo Sapiens; identical to SEQ ID NO: 50698

SEQ ID NO: 77256 - RNA, 62 nt, Homo Sapiens; identical to SEQ ID NO: 50699

SEQ ID NO: 77257 - RNA, 62 nt, Homo Sapiens; identical to SEQ ID NO: 50700

SEQ ID NO: 77258 - RNA, 62 nt, Homo Sapiens; identical to SEQ ID NO: 50701

SEQ ID NO: 77259 - RNA, 62 nt, Homo Sapiens; identical to SEQ ID NO: 50702

SEQ ID NO: 77260 - RNA, 62 nt, Homo Sapiens; identical to SEQ ID NO: 50703

SEQ ID NO: 77261 - RNA, 64 nt, Homo Sapiens
uuagaaauagcuuuaacuuugcuuaaacuacaaacacaagcaaaacuucacggggucauacuac

SEQ ID NO: 77262 - RNA, 64 nt, Homo Sapiens
ugcuuauguuagaaauaagacaaccccagccaaucacaagcagccuacuaacauauaauuaggu

SEQ ID NO: 77263 - RNA, 64 nt, Homo Sapiens
uggacuuuccaguaauagcuugguagauauccugcacaagcagcuuaaggagaaagugaaucau

SEQ ID NO: 77264 - RNA, 64 nt, Homo Sapiens
caccggaacuccuauaauguaccaauagugaucucacaagcacuuggacuucagagauuaaguc

SEQ ID NO: 77265 - RNA, 64 nt, Homo Sapiens
aaacaaaauccuuuuaucucaguuauuugcccaucacaagcacauuuuuaaaauguugcuuugu

SEQ ID NO: 77266 - RNA, 64 nt, Homo Sapiens
cagccauccuugugccuucaccucugauguguuucacaagcacguaguucaacccagauaggga

SEQ ID NO: 77267 - RNA, 64 nt, Homo Sapiens
cuuaugacuuaaaaaaaaaaauucuuuuuggaaacacaagcauuucuuuaaggaugaccggaug

SEQ ID NO: 77268 - RNA, 64 nt, Homo Sapiens
aaggaugaccggauguugccguauguauuuauggcacaagcagguguugucuaagcaguuucuc

SEQ ID NO: 77269 - RNA, 64 nt, Homo Sapiens
cucuguaagagcuuuacauuagcuguuacacaagcacaagcauggaaaaugcaggcauuacacc

SEQ ID NO: 77270 - RNA, 64 nt, Homo Sapiens
agcaugcucuguaagagcuuuacaccagcuguuacacaagcacagguacugaaaaugcaggcau

SEQ ID NO: 77271 - RNA, 64 nt, Homo Sapiens
acucugagcauuuuuaaaaguuuguuuacaauuccacaagcaaaagcucuaauuuaaccagauu

SEQ ID NO: 77272 - RNA, 64 nt, Homo Sapiens
cucuucagagaucaucagaaaagaggugggaauacacaagcaggugcauguaagcccaaaagcu

SEQ ID NO: 77273 - RNA, 64 nt, Homo Sapiens
gcacucuguuccccucccccagcaccacucugggcacaagcagggauuucuggucaaccccaca

SEQ ID NO: 77274 - RNA, 64 nt, Homo Sapiens
acucugggcacaagcagggcuuucuggucaaccccacaagcaccggcgcuaggggacuugggga

SEQ ID NO: 77275 - RNA, 64 nt, Homo Sapiens
cugaucagccucccagaccugauuugguuagaagcacaagcaaagaggaggaagauggugacau

SEQ ID NO: 77276 - RNA, 64 nt, Homo Sapiens
ucacaccucccagugagagacagagucccccaaacacaagcacaacagggagccgagugccccu

SEQ ID NO: 77277 - RNA, 64 nt, Homo Sapiens
cacguggucucgccuucccuucuuccugcagguucccgccaagccaugugacagagugcucaca

SEQ ID NO: 77278 - RNA, 64 nt, Homo Sapiens
uugagugugggagaggagaccaggucacccgauucccgccaagccggaagucccugcagcacca

SEQ ID NO: 77279 - RNA, 64 nt, Homo Sapiens
cugcuguuggcccgggagaguucggggagcccuacccgccaaacagguccgggagggcuggggc

SEQ ID NO: 77280 - RNA, 64 nt, Homo Sapiens
aaggcguucccaccgcccggaaauccccccucuccccgccaaaaaaaaccuuuaauuccaaaag

SEQ ID NO: 77281 - RNA, 64 nt, Homo Sapiens
agaggguguuugccagucugagugucccgcggugcccgccaacccgcuuccugacugaccugag

SEQ ID NO: 77282 - RNA, 64 nt, Homo Sapiens
ucgaaaccacagcccuuaccccaaucccacgagccccgccaacgaaccacaggugcugggcuuu

SEQ ID NO: 77283 - RNA, 64 nt, Homo Sapiens
gcccccaagguggucaugacuggucucauuugcagaagucuaagaauguaccuuuuucuggccg

SEQ ID NO: 77284 - RNA, 64 nt, Homo Sapiens
agaaacucaaaggaggaagacauaauuagggaaagaagucuauuugaugaauauguguguguaa

SEQ ID NO: 77285 - RNA, 64 nt, Homo Sapiens
uuuauccugcccauguucacuccauuguaggguugaagucuagcuugugauauuuucuggccug

SEQ ID NO: 77286 - RNA, 57 nt, Homo Sapiens
augaugaagcuaacacuugaauuuucugaagucuagcuuaacaucuuugguuuuccu

SEQ ID NO: 77287 - RNA, 64 nt, Homo Sapiens
gaggcuucccacacugccaggggagccucacugugaagucuaggcucagacaggcaucaacaaa

SEQ ID NO: 77288 - RNA, 64 nt, Homo Sapiens
augugggaggcugaggaugguucaacagacaccugaagucuagcauaguuucaauucauguaag

SEQ ID NO: 77289 - RNA, 64 nt, Homo Sapiens
gauguauauaaugugcuaaaacuauacuuuuugggaagucuagaauuagccacuuauaucuuag

SEQ ID NO: 77290 - RNA, 64 nt, Homo Sapiens
aaauauacuuuucccuauuuaaguauggauuauggaagucuaguuucuagauugaauuuaaagu

SEQ ID NO: 77291 - RNA, 64 nt, Homo Sapiens
ggggucuuacucaaguacuaccaucuagcuuuuugaagucuauguauauacaacaaaguuucug

SEQ ID NO: 77292 - RNA, 64 nt, Homo Sapiens
uccuuuuaacuuuuuuggucuaaaaaaaauuugagaagucuacugccacugacauuucuuuuuu

SEQ ID NO: 77293 - RNA, 64 nt, Homo Sapiens
uugacagcuagcaaggcgacauccauuuggggaugaagucuacuuguauucuuucauuacagau

SEQ ID NO: 77294 - RNA, 64 nt, Homo Sapiens
ccaggccaaccagcccaaaaccauugggaacacggaagucuauuauaagaccgaucuccugacc

SEQ ID NO: 77295 - RNA, 64 nt, Homo Sapiens
accagccagacuggguuaagucuccggcagcugggaagucuagaucccuggaaguguaucacuu

SEQ ID NO: 77296 - RNA, 64 nt, Homo Sapiens
auuucugccuuucuccuaaaacauucuguaucuagaagucuaaauguguguucagugacaucau

SEQ ID NO: 77297 - RNA, 64 nt, Homo Sapiens
accuugagucaaaugaaugguucugaauacgguggaagucuauaaggauucgauggcaaugaau

SEQ ID NO: 77298 - RNA, 64 nt, Homo Sapiens
auuauuuguaaugaacacaagccucucuugaguagaagucuaaaucacauuaugauuauuuuau

SEQ ID NO: 77299 - RNA, 64 nt, Homo Sapiens
aguguguggcccaugaauugaacaauuuaaccuugaagucuauauccgugauauuaugucgauu

SEQ ID NO: 77300 - RNA, 64 nt, Homo Sapiens
uauguauugcauuauaucauugcaauaauuauuggaagucuagauaucgagccaucccaggugu

SEQ ID NO: 77301 - RNA, 64 nt, Homo Sapiens
cacugugauguuuuuacgugaauauguugaaguagaagucuaccauauuauuuuauaaaauguu

SEQ ID NO: 77302 - RNA, 64 nt, Homo Sapiens
auguauuuugugauguacuaaggauacugguccugaagucuaccaaauauuauagugcauuuua

SEQ ID NO: 77303 - RNA, 64 nt, Homo Sapiens
guagauaagacgauugucauacacuaccucuugugaagucuacuuuuuuuuuauuucuacuuga

SEQ ID NO: 77304 - RNA, 64 nt, Homo Sapiens
ugaagugcacagccaaagucgcaaacaaaaaggugaagucuaaaaucuaguguaaaaaacaaca

SEQ ID NO: 77305 - RNA, 64 nt, Homo Sapiens
aauucucuguucugguggcaauuuaauauccauugaagucuauguuucaauuacuccauguuuu

SEQ ID NO: 77306 - RNA, 64 nt, Homo Sapiens
ccaaaauccuuuuuaucaaaaaaacucuuuugaggaagucuaugagugauuuauuuguguuaau

SEQ ID NO: 77307 - RNA, 64 nt, Homo Sapiens
uuagaccucuaagcccuuuuuucuggauugcaacgaagucuaguaguuuuuuaguccuuuaacu

SEQ ID NO: 77308 - RNA, 64 nt, Homo Sapiens
gauauuggucauguuuauuuuauaguagccucaagaagucuauugaaccuuauuucucaaaacu

SEQ ID NO: 77309 - RNA, 64 nt, Homo Sapiens
caggccaggaccacacaguccccagacucagcuggaagucuaccugcuggacagccuccgccaa

SEQ ID NO: 77310 - RNA, 64 nt, Homo Sapiens
cuaaggucuggccuugccccuuugcucugccccugaagucuaucugcaggauggucuucacagg

SEQ ID NO: 77311 - RNA, 64 nt, Homo Sapiens
aaaggcaaaaccugaaccaccuucugcacuuaaagaagucuaacaguacaaauacacuaucuau

SEQ ID NO: 77312 - RNA, 64 nt, Homo Sapiens
uaguguuuuauuuaccugacaaauggaaguuauagaagucuaauaauguuaagcaccaguaauu

SEQ ID NO: 77313 - RNA, 64 nt, Homo Sapiens
guccuucuuuaucugugauaauuuucuguguucugaagucuacuuugucuaaaaauaacauacg

SEQ ID NO: 77314 - RNA, 64 nt, Homo Sapiens
auauaaaggaucaaauuaauuuaaauaugauucugaagucuacagaacuuuuaguucugugcug

SEQ ID NO: 77315 - RNA, 64 nt, Homo Sapiens
cuuauuuuaguuauaacuauauuugacugacuuggaagucuaagagaaaacaugcaguuugggc

SEQ ID NO: 77316 - RNA, 64 nt, Homo Sapiens
ugcagguucugaccaagaacucaguacacuucaugaagucuacucuagaaugauuccagcuucc

SEQ ID NO: 77317 - RNA, 64 nt, Homo Sapiens
ugggcuucugggaaagcuuuaugaaauugaagaggaagucuaccuaugugaucagguguggcca

SEQ ID NO: 77318 - RNA, 64 nt, Homo Sapiens
cucuacccagggcaucccucuccaccucugccuggaagucuauaaccaaggccagcgcagguua

SEQ ID NO: 77319 - RNA, 64 nt, Homo Sapiens
ccucaggggcucccgcccuuaggacccccaacaugaagucuaggaggagaggccacuucccacc

SEQ ID NO: 77320 - RNA, 64 nt, Homo Sapiens
auauuuuucagccuauaaagugguauucuguucugaagucuaagaggaauuuucaauauuugau

SEQ ID NO: 77321 - RNA, 64 nt, Homo Sapiens
uaguuuuccuuuuggaucuggacuuuuaucugaggaagucuagguuuuaauuccuaaagauccu

SEQ ID NO: 77322 - RNA, 64 nt, Homo Sapiens
aacaauaaccaaauaaaaacuugauaggaucuuugaagucuauuuaaauauucauuccauuaca

SEQ ID NO: 77323 - RNA, 64 nt, Homo Sapiens
caauuuaaauuaggaaauauauaugaaugucguugaagucuauuuugagacugcuaaagcuauu

SEQ ID NO: 77324 - RNA, 64 nt, Homo Sapiens
cuuagaaccagguggcuggucaccuggauguacagaagucuaacuggugaaggaauaucauuua

SEQ ID NO: 77325 - RNA, 64 nt, Homo Sapiens
uggagucagauaguuguugggagggggaggacaagaagucuauuguuuggacuguguuugucuc

SEQ ID NO: 77326 - RNA, 64 nt, Homo Sapiens
aacucugccugagacuuucagugcacuguauauagaagucuaaaacacaccuaagagaaaaaga

SEQ ID NO: 77327 - RNA, 64 nt, Homo Sapiens
gaauuaauuuuuuaaaagaacacaggaaaaaauagaagucuacuagccaggaauucccauguua

SEQ ID NO: 77328 - RNA, 64 nt, Homo Sapiens
uauucagaaucuuuguuaagaaaauacaacaaaggaagucuaaaguagggagauauuuaaguau

SEQ ID NO: 77329 - RNA, 64 nt, Homo Sapiens
uucaccaauuauggaaacauuuuagucauaaugagaagucuauuaguuuuaaaaaaucuauauu

SEQ ID NO: 77330 - RNA, 64 nt, Homo Sapiens
aauggaugaaacuucaaauuaucuuauuuggauagaagucuauauucuagccucauuugcauga

SEQ ID NO: 77331 - RNA, 64 nt, Homo Sapiens
aacuuaccgugagcgacaaagaugauuuaaaagggaagucuagaguuccuagucucccucacag

SEQ ID NO: 77332 - RNA, 64 nt, Homo Sapiens
gugccauuccuguccuuaaggcacagucucaucagaagucuaauaccugggcagguuuauaaca

SEQ ID NO: 77333 - RNA, 64 nt, Homo Sapiens
cuaagagcagaacuccuaccccaaaagaagccuggaagucuaauuaagaguagcauaaggaacc

SEQ ID NO: 77334 - RNA, 64 nt, Homo Sapiens
uuauccauuucuuuuacucuguguaaagacuugagaagucuaauucacaggcaaaccaauacag

SEQ ID NO: 77335 - RNA, 64 nt, Homo Sapiens
cuguagaagagucuaaaacauuaguaugcacauugaagucuaaauugauacgaauguuaugcau

SEQ ID NO: 77336 - RNA, 64 nt, Homo Sapiens
ucuagugaagguacccugaccaguuugggcuucagaagucuaaguaaagcuggugaaguuuggc

SEQ ID NO: 77337 - RNA, 64 nt, Homo Sapiens
aagaaagguaaagagucuagauuugucccugagugaagucuagaaacuuguuucuuuuaauuuu

SEQ ID NO: 77338 - RNA, 64 nt, Homo Sapiens
uucguaaagucauauaaaaguugucuugaauagagaagucuaugcuauuccuguucaguauucu

SEQ ID NO: 77339 - RNA, 64 nt, Homo Sapiens
agugcacuguaauaauucauucauguucacacuugaagucuaguauguuuguaaagugcaugag

SEQ ID NO: 77340 - RNA, 64 nt, Homo Sapiens
cugagaaaaaguccugucaguucagaaaaaaugugaagucuacuuuaguauuccuguaauacua

SEQ ID NO: 77341 - RNA, 64 nt, Homo Sapiens
gacaaauccuucuagaauuugccucuuugggacugaagucuaaggggcugagaccaagaaggga

SEQ ID NO: 77342 - RNA, 64 nt, Homo Sapiens
caccauuccugcucuccagcgccagcuggaaccugaagucuaaaccauggacauggugaccaca

SEQ ID NO: 77343 - RNA, 64 nt, Homo Sapiens
aacccauggaaaaaugccauuggcuacacaauuggaagucuaagugaaauaggagggaaaccuu

SEQ ID NO: 77344 - RNA, 64 nt, Homo Sapiens
cccacccuauggccuagcuucagguacuucaguugaagucuaaacucagguaacuuggaaugua

SEQ ID NO: 77345 - RNA, 64 nt, Homo Sapiens
ucuauaugaucuugauauuguuuuauaauaauuugaagucuaaaagacugcauuuuuaaacaag

SEQ ID NO: 77346 - RNA, 64 nt, Homo Sapiens
cagggugagugagauaaccaaugccaaacuuuuugaagucuaauuuuugaggggugagcucauu

SEQ ID NO: 77347 - RNA, 64 nt, Homo Sapiens
aagaauuaauuacacagaagggauuugaucaaaagaagucuagugagauaaccaaggugauuca

SEQ ID NO: 77348 - RNA, 64 nt, Homo Sapiens
uaaguuucauaugcugcccuuaaauguuuaagaagaagucuaaaucaaauaaauuaaauuacau

SEQ ID NO: 77349 - RNA, 64 nt, Homo Sapiens
ggagaaaccauuccaguaugaaucuuaaguuuuggaagucuaaacugacuaguuuuauuuauaa

SEQ ID NO: 77350 - RNA, 64 nt, Homo Sapiens
uugaauuugcuguuucaagcauuuguacauauuagaagucuaaggaguagcaagucagugggag

SEQ ID NO: 77351 - RNA, 64 nt, Homo Sapiens
ucuccuucaucaucauauaugaaguuuauuuugagaagucuacauugcuuacauuuuaauugag

SEQ ID NO: 77352 - RNA, 64 nt, Homo Sapiens
uauucuuccaaagaauuguaauccuccccacacugaagucuagggguugcgaaucccuccugag

SEQ ID NO: 77353 - RNA, 64 nt, Homo Sapiens
caucuucagguuaccauuauuuuuuaaugagcaggaagucuagaaaugauaacuagacuguaug

SEQ ID NO: 77354 - RNA, 64 nt, Homo Sapiens
ggaaaacagaaaguaagacccucagaaaaccaaugaagucuaagagaaauaaaauuuaguggac

SEQ ID NO: 77355 - RNA, 64 nt, Homo Sapiens
uggauuacagucaguuaaaaugaaaugcaacacugaagucuauaacaugaaaugauuauuaaau

SEQ ID NO: 77356 - RNA, 64 nt, Homo Sapiens
caauuccaagaaaauaucacuguaaugagucagugaagucuagaaucauacuuaacauuucauu

SEQ ID NO: 77357 - RNA, 64 nt, Homo Sapiens
cauaaacuaucaaagagaaauguagcugauuaaggaagucuaguaauuucuuuaagccuuccuu

SEQ ID NO: 77358 - RNA, 64 nt, Homo Sapiens
accuuaggaguuaauuaaacgauacaacauucuagaagucuauuugauucagguacaccauuaa

SEQ ID NO: 77359 - RNA, 64 nt, Homo Sapiens
aaaaauaaaauaauuauaaaaaaagaaacacuuugaagucuauacacacuguuccagugucuau

SEQ ID NO: 77360 - RNA, 64 nt, Homo Sapiens
cugcuucccuaaagcagaauuguuauucauuuaagaagucuaauaugauauacauucauccuag

SEQ ID NO: 77361 - RNA, 64 nt, Homo Sapiens
cauuuagauccugguuucauaacuuccuguacuugaagucuaaaagcagaaaauaaaggaagca

SEQ ID NO: 77362 - RNA, 64 nt, Homo Sapiens
gcugggaagaaauuccaucauucuugaugguuuggaagucuauugcaaacuuaguucuggugau

SEQ ID NO: 77363 - RNA, 64 nt, Homo Sapiens
cccagggauggcuccaguugaagugagggagacagaagucuaggaucacugagcacucauuuag

SEQ ID NO: 77364 - RNA, 64 nt, Homo Sapiens
caaggaacaagaaucucacucuuaccugcgccaggaagucuaaccugucucagucuuccgcagg

SEQ ID NO: 77365 - RNA, 64 nt, Homo Sapiens
cauaacagcuuucuuucccaugaguucaccuagagaagucuaagacauuuccucuuugagacuc

SEQ ID NO: 77366 - RNA, 64 nt, Homo Sapiens
caagauuaacaaauuucauaaguuuuaaccuuuagaagucuaagcaaggaaauaaaaauucugc

SEQ ID NO: 77367 - RNA, 64 nt, Homo Sapiens
acaugauacaugugggccugcucacaguggaguugaagucuaauuauccaucaaaaaaugcacu

SEQ ID NO: 77368 - RNA, 64 nt, Homo Sapiens
aauggcaguuacagacagguuaacagaagcuacugaagucuacagauaaucaaaaaacuuaaua

SEQ ID NO: 77369 - RNA, 64 nt, Homo Sapiens
acccuuuucucgccgcaagaagcccauuccuauggaagucuagcaaagcaauacgacucagccc

SEQ ID NO: 77370 - RNA, 64 nt, Homo Sapiens
uucauaucuagauuuucaaacaaagccccaagaugaagucuaauucugaaaauaucucacaauu

SEQ ID NO: 77371 - RNA, 64 nt, Homo Sapiens
agagauguuccucuuuaaucaugaaacaccuuaagaagucuauaaugcaauccuuaguccuacc

SEQ ID NO: 77372 - RNA, 64 nt, Homo Sapiens
guuuggggcuggggguuggagaauaaaagcaggagaagucuaugggauucuagaaauaguaccu

SEQ ID NO: 77373 - RNA, 64 nt, Homo Sapiens
agugaaguaggugugacuugcccacuugaaggaagaagucuaagaguccuguuugcagggaagc

SEQ ID NO: 77374 - RNA, 64 nt, Homo Sapiens
gguugugguuggauggaggagaugaucuugucuggaagucuagagucuuuguugguuagaggac

SEQ ID NO: 77375 - RNA, 64 nt, Homo Sapiens
caaacacagaguuugaacuauaauacuaaggccugaagucuagcuuggauauaugcuacaauaa

SEQ ID NO: 77376 - RNA, 64 nt, Homo Sapiens
auuucuagcuaauuguuaauuauaauuaugcucagaagucuauuuaaugagcucugacuguacu

SEQ ID NO: 77377 - RNA, 64 nt, Homo Sapiens
gcuuacaacaauuuuccucacagucuggaggccagaagucuaaaaucaaagugucagcagaguu

SEQ ID NO: 77378 - RNA, 64 nt, Homo Sapiens
uuuccuauuaccuuagauugcaaaccagucuagggaagucuaugagaaaguagcauuuaauuaa

SEQ ID NO: 77379 - RNA, 64 nt, Homo Sapiens
ugaccugugagaaugaagcuggagcccagcgucagaagucuaguuuuauaggcagcuguccugu

SEQ ID NO: 77380 - RNA, 64 nt, Homo Sapiens
cuuugagccagguacaguaacaugccuccauugggaagucuagaaauuaagaauggagcuuaac

SEQ ID NO: 77381 - RNA, 64 nt, Homo Sapiens
agcugggaggaaaagaaaagccacuccuccaaaggaagucuaggccugggccccaccaccuagg

SEQ ID NO: 77382 - RNA, 64 nt, Homo Sapiens
uccaguuuuccuucuccagcccucaugcucugaggaagucuaagucauucuucacaggcaggaa

SEQ ID NO: 77383 - RNA, 64 nt, Homo Sapiens
uuugguuccuaacaugccucacauaaugaauuucgaagucuaaucuaaaagauauacagagaag

SEQ ID NO: 77384 - RNA, 64 nt, Homo Sapiens
uaaaucuagaaaucagcuuuuaaaaauauugucugaagucuaacaaaaguuuucaccucuaaug

SEQ ID NO: 77385 - RNA, 64 nt, Homo Sapiens
auuuguugucccauaauugauaguaugaagcaaugaagucuauuauuagucaaaaauaccauuu

SEQ ID NO: 77386 - RNA, 64 nt, Homo Sapiens
agccucuaacauggccacuucucagcacguccaagaagucuaacuaucaaaaagggcagacuuc

SEQ ID NO: 77387 - RNA, 64 nt, Homo Sapiens
ggaagucugagaugauaaauauuucaaggucagugaagucuaucaaucauucuccccuuccuca

SEQ ID NO: 77388 - RNA, 64 nt, Homo Sapiens
gguaaggaaaucaaucaugaucucuauccccacagaagucuacacagaacuccauguuuguuuc

SEQ ID NO: 77389 - RNA, 64 nt, Homo Sapiens
gaauuaguaguguucccaucuaaugcugccaaaggaagucuaaguggagacuucuuaucaaaag

SEQ ID NO: 77390 - RNA, 64 nt, Homo Sapiens
augaaagaaaucugaauccaguuaaggcuagguugaagucuagagacuggugcugaaacaaaag

SEQ ID NO: 77391 - RNA, 64 nt, Homo Sapiens
agacaacauuaugacacuuuaaaacaguagcaaagaagucuauuuauuaacccacaaauguagc

SEQ ID NO: 77392 - RNA, 64 nt, Homo Sapiens
uuuguggagacagggcuggacuugaaaggaagaagaagucuaaaagaaaacaucauuugcaaag

SEQ ID NO: 77393 - RNA, 64 nt, Homo Sapiens
cacaggcaguuguguucccagguagaggcuagaggaagucuaucugguggaggccgcuaagcau

SEQ ID NO: 77394 - RNA, 64 nt, Homo Sapiens
augugaaacacuuugccuccaaggaguuggaagugaagucuauggccaaagaaaugaacauucc

SEQ ID NO: 77395 - RNA, 64 nt, Homo Sapiens
ugcaauaaaugugaggaaguauuuaauaaaaaaugaagucuaaaugugucagagaauuuaugug

SEQ ID NO: 77396 - RNA, 64 nt, Homo Sapiens
cacucuagaaaguauguuuguguugguuuuuuaagaagucuaaaugaaguuauuaauaccugaa

SEQ ID NO: 77397 - RNA, 64 nt, Homo Sapiens
uccggacaaaagcuguuagaaacugaaaggacacgaagucuagcucuauagaaaaccauuuacc

SEQ ID NO: 77398 - RNA, 64 nt, Homo Sapiens
gcugaacugacaaugaagggauuuaagugaaggagaagucuaacaaacacuuggcauacaaaau

SEQ ID NO: 77399 - RNA, 64 nt, Homo Sapiens
cagaggagcaccaggacggcaggaggaaagggaggaagucuacagagaggacuggcugcccugg

SEQ ID NO: 77400 - RNA, 64 nt, Homo Sapiens
aggagccacuugugacuccauccuaggaaauggugaagucuauuugguaaucuguagaaccuuc

SEQ ID NO: 77401 - RNA, 64 nt, Homo Sapiens
ugcuguugagcuuaaucuuuaaauacaaaacugagaagucuaguauggagacauaaggaaaauu

SEQ ID NO: 77402 - RNA, 64 nt, Homo Sapiens
uggauuguaggaaaguuaagcaggcaccauccuggaagucuaccccuagguggucgagagaccu

SEQ ID NO: 77403 - RNA, 64 nt, Homo Sapiens
agaccugcuggacaaauucugggggcaguucagugaagucuagagugugugggcggggggggug

SEQ ID NO: 77404 - RNA, 64 nt, Homo Sapiens
aagaaggaaauggcucaguaccccccaauguggagaagucuaucccagugugucuggccgcauu

SEQ ID NO: 77405 - RNA, 64 nt, Homo Sapiens
auggagcauuuuuugagaagggacccaauucucugaagucuacggccuaccuucucucacaggg

SEQ ID NO: 77406 - RNA, 64 nt, Homo Sapiens
ugacuacugcaccuggacagccuccucuuuucuagaagucuauuuauauugucauuuuauaaca

SEQ ID NO: 77407 - RNA, 64 nt, Homo Sapiens
uggggaggagaagugaggccagaagaccaugggugaagucuagaaaggccuaacccauuacacc

SEQ ID NO: 77408 - RNA, 64 nt, Homo Sapiens
aaaucuagaaggaauuagaguuuucuuuuuugaagaagucuaauaauuuguuuuuugaaugggu

SEQ ID NO: 77409 - RNA, 64 nt, Homo Sapiens
cacaggagaugauauaucuguagagauaauuucugaagucuauauuauguaaaaguguauuugu

SEQ ID NO: 77410 - RNA, 64 nt, Homo Sapiens
ucccaguaacccuugcaguuuuccuugcaaauaagaagucuauuguuuaucacacugguuccau

SEQ ID NO: 77411 - RNA, 64 nt, Homo Sapiens
cagaguagauuaacugaaugaccaaagagcaacagaagucuagugauucuugucuuugagguuc

SEQ ID NO: 77412 - RNA, 64 nt, Homo Sapiens
uauguaauucuauuaauagaaacagcuguguaaagaagucuaaaauuuucacuauuuccaauga

SEQ ID NO: 77413 - RNA, 64 nt, Homo Sapiens
aagcugggucaggggccuugaaacuggagaaguggaagucuaugguuggucugaguaaguaacu

SEQ ID NO: 77414 - RNA, 62 nt, Homo Sapiens
cccugagaccacaucugcauauguuuuuuguuaugaagucuaagauuguggcuacuuaauaa

SEQ ID NO: 77415 - RNA, 64 nt, Homo Sapiens
uuacugacagaaauugacuggacugucauugugugaagucuaggaggaaauguccauuuuaauu

SEQ ID NO: 77416 - RNA, 64 nt, Homo Sapiens
uuaaaaaaaagauggaguuuucuaacgugaggaugaagucuacacuucagauuaaaaaggguua

SEQ ID NO: 77417 - RNA, 64 nt, Homo Sapiens
ugccuguagagauagagcuauguggccccauagcgaagucuaaaaguuacuguccacccggugg

SEQ ID NO: 77418 - RNA, 64 nt, Homo Sapiens
gaagaaauaguuuuaugcaacuaguugauuguuugaagucuaugauguaccauaauuaacuugg

SEQ ID NO: 77419 - RNA, 64 nt, Homo Sapiens
cugggcacuuccuuguaaaaucuaguuuuggcaagaagucuauuaggucaguuuagcaagaaca

SEQ ID NO: 77420 - RNA, 64 nt, Homo Sapiens
ccaccgaggccaguccuaguucuugguccagggagaagucuaggcaggauaaaucauaucuuac

SEQ ID NO: 77421 - RNA, 64 nt, Homo Sapiens
gccagagacuucaagucuaucugaaaagucuccagaagucuaaccccagauaaauagccaacag

SEQ ID NO: 77422 - RNA, 64 nt, Homo Sapiens
uccugcuuagccuaaacauaauuccuucgcaacagaagucuaaagucucuacugaauucuucua

SEQ ID NO: 77423 - RNA, 63 nt, Homo Sapiens
gaauauuggugagcugcauauauaaauuugacagauagcuauuuacauagccuucuaaguaaa

SEQ ID NO: 77424 - RNA, 63 nt, Homo Sapiens
aggauuuaaaauacagaaacaguuuauguauaggauagcuauaaguaaauacugaaacacauu

SEQ ID NO: 77425 - RNA, 63 nt, Homo Sapiens
uagucuugugucuuguuugaagcuagauagcuagauagcuagacaaagagaaguaagagagau

SEQ ID NO: 77426 - RNA, 63 nt, Homo Sapiens
uagcuagauagucuugugucagagagauagcuagauagcuagagggggcgccaaagagaagua

SEQ ID NO: 77427 - RNA, 63 nt, Homo Sapiens
uagcuagauagcuagauagugagaaguaagagagauagcuagaugacacaugggggcgccaaa

SEQ ID NO: 77428 - RNA, 63 nt, Homo Sapiens
caucugauugguuuacugcucacaugauuacuugauagcuaaggaucuaauucuguuuccucu

SEQ ID NO: 77429 - RNA, 63 nt, Homo Sapiens
uaagucgguaaccuuaaacuguaaagucaucaggauagcuaguuucuuguguaaauagaaacu

SEQ ID NO: 77430 - RNA, 64 nt, Homo Sapiens
caaugccugcugccuccagauggagauccaggcugcuggagaucagacuuggugggaaguaagc

SEQ ID NO: 77431 - RNA, 64 nt, Homo Sapiens
caggcugcuggagauccaauuuggugggaaguaagcuggagauccaccuccacuguaccaagac

SEQ ID NO: 77432 - RNA, 64 nt, Homo Sapiens
caugccugaaaucccacuacuuugggaggcugaggcuggagaauugcuugaggcuagugagcug

SEQ ID NO: 77433 - RNA, 64 nt, Homo Sapiens
ucaguuuauacucuuaauuuaauuuucuuucugagcuggagaacuggcuuugcacuuugguuac

SEQ ID NO: 77434 - RNA, 64 nt, Homo Sapiens
ggaagaauugugccuugcauuugauuuuucuaaagcuggagaaauucagggcugggccaugugg

SEQ ID NO: 77435 - RNA, 64 nt, Homo Sapiens
acaggagcucacccagggcuugggugagcgagaggcuggagaacaggccaggauagccaagccc

SEQ ID NO: 77436 - RNA, 64 nt, Homo Sapiens
uccauguacuuuggaaucucucaacugauaaagagcuggagaacuggccacgaugaaacagauu

SEQ ID NO: 77437 - RNA, 64 nt, Homo Sapiens
gcggggucucugaagguccuggucuggccaggaggcuggagaauggaucaagcucaucgacuuu

SEQ ID NO: 77438 - RNA, 64 nt, Homo Sapiens
cagguuaagagauccuguuuauucuaauccccaagcuggagaaaaaugagcucacuggaaauuc

SEQ ID NO: 77439 - RNA, 64 nt, Homo Sapiens
ccccccgacccucagcguaccggcaggauggggagcuggagagcccggagcagugucugucuga

SEQ ID NO: 77440 - RNA, 64 nt, Homo Sapiens
augcagagcgccgugaguucgagacgggugggcggcuggagaccggccgcuccagggguggcug

SEQ ID NO: 77441 - RNA, 64 nt, Homo Sapiens
ggugggcggcuggagaccauccgcuccagggguggcuggagacgccucugccgccuccccacgg

SEQ ID NO: 77442 - RNA, 64 nt, Homo Sapiens
gguggggagaugggcauuuggagagucucauguagcuggagacguuaagagcugagcacaccac

SEQ ID NO: 77443 - RNA, 64 nt, Homo Sapiens
ugcauggagggcuguaaagccacggauuccccucgcuggagaggcuccugucugauagcgguag

SEQ ID NO: 77444 - RNA, 64 nt, Homo Sapiens
cccauggccacgaggaagcaaucuaaaagcuguagcuggagaagcauauuaauuauuuuccaaa

SEQ ID NO: 77445 - RNA, 64 nt, Homo Sapiens
auuuaaguacuaucuuugucaagaauucuauuuugcuggagacugaaugggaaaguauuuuuga

SEQ ID NO: 77446 - RNA, 64 nt, Homo Sapiens
gagcaaguuguggggagccauugagaggggcagggcuggagaagaaaagaaagcauuguuuuaa

SEQ ID NO: 77447 - RNA, 64 nt, Homo Sapiens
ggugugaacccaggaggcggcuugggaggcugaggcuggagaauggcgccuguagucccagcag

SEQ ID NO: 77448 - RNA, 64 nt, Homo Sapiens
uuguccugaauaaggagauccagagccagcagcggcuggagagccuguccgagacacccgggcc

SEQ ID NO: 77449 - RNA, 64 nt, Homo Sapiens
auagcaacagcaauuuccgggaggucuuggagaagcuggagagcgaccccgucugccagcgccu

SEQ ID NO: 77450 - RNA, 64 nt, Homo Sapiens
cgugccuguagucccagcuacucgggaggcugaggcuggagaguugcucaaacccgggaggcgg

SEQ ID NO: 77451 - RNA, 64 nt, Homo Sapiens
ccaaugugcaccaauaugccuaacuagcuagccagcuggagauaauuuaccagggaauguuuca

SEQ ID NO: 77452 - RNA, 64 nt, Homo Sapiens
cugccaccaugcucugcguguaccagcuaagaaugcuggagacuuagccauccccacccacuug

SEQ ID NO: 77453 - RNA, 64 nt, Homo Sapiens
acuggaaaggugucucagucuuuccucuuuuacagcuggagaucucaggagcugugccaagcac

SEQ ID NO: 77454 - RNA, 64 nt, Homo Sapiens
gcucugcucagcccugagaggaguguucgcucgcgcuggagaaggugccugccgaggcgggaca

SEQ ID NO: 77455 - RNA, 64 nt, Homo Sapiens
gacccagcccucuggcugagcaaggaccggcgcugcuggagacuugugggcaagaaggagcugg

SEQ ID NO: 77456 - RNA, 64 nt, Homo Sapiens
aguccugcuuucucuggagugagcagguguccgggcuggagaagugugauugaaagccauugag

SEQ ID NO: 77457 - RNA, 64 nt, Homo Sapiens
aagccuggggcacguccugucacguggcagugcagcuggagaggugcggggcucuuguuggccg

SEQ ID NO: 77458 - RNA, 64 nt, Homo Sapiens
uaucccccgccccucaagcauucuccuugaggcagcuggagagcaaaagauccaggcccuccac

SEQ ID NO: 77459 - RNA, 64 nt, Homo Sapiens
gugucugcuuucugccuccuugaggagugacagggcuggagacugucugggguauuuccccugc

SEQ ID NO: 77460 - RNA, 64 nt, Homo Sapiens
gacugagccccaguaaccccgcuuggcucuuccagcuggagaaggcugggcucuccagagcugg

SEQ ID NO: 77461 - RNA, 64 nt, Homo Sapiens
agaaccugauguaccugaagcagauccuguauuugcuggagaaauucguggcugugcuaggggg

SEQ ID NO: 77462 - RNA, 64 nt, Homo Sapiens
cugccuggcgccgugcccuuccuuuguccugcccgcuggagacaguguuugucgugggcguggu

SEQ ID NO: 77463 - RNA, 64 nt, Homo Sapiens
cugauaccuauaaguucacccccaccccacagcugcuggagagaaaucccaagaggcagcccuu

SEQ ID NO: 77464 - RNA, 64 nt, Homo Sapiens
gaacaggaccugugagcagcugcauuggccuggagcuggagaguaaggcuguaggaucuuugga

SEQ ID NO: 77465 - RNA, 64 nt, Homo Sapiens
cgcuggacccagccaccuuguaugagguggaagagcuggagacggccacugagcgcuaccugca

SEQ ID NO: 77466 - RNA, 64 nt, Homo Sapiens
ugagcgcuaccugcacguacgcccccagccuuuggcuggagaggaucccccugcuuaccaggcc

SEQ ID NO: 77467 - RNA, 64 nt, Homo Sapiens
augagaggcuguggcagcaggagacucugcaggagcuggagaggcugcgggagcuggagaggau

SEQ ID NO: 77468 - RNA, 64 nt, Homo Sapiens
aggagacucugcaggagcuggagaggcugcgggagcuggagaggaugcuggagcugggguggga

SEQ ID NO: 77469 - RNA, 64 nt, Homo Sapiens
cugacaggacagcuuuaagccaccugcggaaggagcuggagaauagcuacaagcagaggcugaa

SEQ ID NO: 77470 - RNA, 64 nt, Homo Sapiens
cuggcaggacagcuuuaagccaccugcggaaggagcuggagaauagcuacaagcagaggcugaa

SEQ ID NO: 77471 - RNA, 64 nt, Homo Sapiens
caaggcaggaaagucugaguugggagugacaguggcuggagagaagcagaucugugcaacgugc

SEQ ID NO: 77472 - RNA, 64 nt, Homo Sapiens
aaguuuuguuugauucugagacucucuugggaacgcuggagagcuugugcacagccucuggaag

SEQ ID NO: 77473 - RNA, 64 nt, Homo Sapiens
gaaccuggucugauuccuuccaacgugcacuucagcuggagaaagaaaccaagaagggaagcgg

SEQ ID NO: 77474 - RNA, 64 nt, Homo Sapiens
ucagucuuguuccagugacaguuggaaggccucugcuggagagacaccagcucucagggcagag

SEQ ID NO: 77475 - RNA, 64 nt, Homo Sapiens
aggagaacugaacccggaccugcucacugcccuggcuggagaggagcacaacagaugccacguc

SEQ ID NO: 77476 - RNA, 64 nt, Homo Sapiens
agaggcucaccacaagccuggcauuucagccagggcuggagaaggcagggacgccugggugaga

SEQ ID NO: 77477 - RNA, 64 nt, Homo Sapiens
guacuuuacccuuaauacacauaagauaauuaaugcuggagagaaacccuacaaaugugaagaa

SEQ ID NO: 77478 - RNA, 64 nt, Homo Sapiens
auccucaacccuuacuacacauuagauaauucaugcuggagagaaacccuacaaaugugaaaaa

SEQ ID NO: 77479 - RNA, 64 nt, Homo Sapiens
uggccacaccugggcuaaagauaauaauaauaaagcuggagacuagacucugucucaaauaaua

SEQ ID NO: 77480 - RNA, 64 nt, Homo Sapiens
aaagguaaguugugggagcugacuaugagcaguggcuggagauccugacgaggacgaggaggag

SEQ ID NO: 77481 - RNA, 64 nt, Homo Sapiens
ugugggagagggaugaugaagagagagagggccugcuggagagcauagggucuggaacaccagg

SEQ ID NO: 77482 - RNA, 64 nt, Homo Sapiens
ugauauaaugcgggugagaguaaugaggcuuggggcuggagaggacaagauggguaaacccuca

SEQ ID NO: 77483 - RNA, 64 nt, Homo Sapiens
gugugcagagguuugugucuccagggaacccacggcuggagagaaauagggagaugcaggaagu

SEQ ID NO: 77484 - RNA, 64 nt, Homo Sapiens
cucacugccaggccagcggcuuccgcugagacucgcuggagaggcggcucccguguccguccac

SEQ ID NO: 77485 - RNA, 64 nt, Homo Sapiens
cugaucgccuaggagagggccucguaguggcacagcuggagauaguuucaaagucuaaaccacc

SEQ ID NO: 77486 - RNA, 64 nt, Homo Sapiens
ucuuaaaaugacaaaaaguguccauaaagaggcugcuggagagugcguggccauagggagccga

SEQ ID NO: 77487 - RNA, 64 nt, Homo Sapiens
caguaccccagcucaugggggacucagcaagcaagcguggcaccaucuuggaucugagccgguc

SEQ ID NO: 77488 - RNA, 64 nt, Homo Sapiens
cuagugcucugaguaggaccguaaccgccuccgugcguggcauauggucccugcaugcuguuca

SEQ ID NO: 77489 - RNA, 64 nt, Homo Sapiens
uugaugagcugauagaugauauaugagagacuaugcguggcacaauacuuuguuacacucuuca

SEQ ID NO: 77490 - RNA, 64 nt, Homo Sapiens
ugaaugguuaccucacugcugaaaacccagaggggcguggcacacucgcuuguguggaaaagcc

SEQ ID NO: 77491 - RNA, 64 nt, Homo Sapiens
acagaagcacuguaaagggcggaguacuggcugugcguggcagggggcaggaugugagaggugg

SEQ ID NO: 77492 - RNA, 64 nt, Homo Sapiens
uguguacagcuuaccccugcgccccuuaaccccugcguggcaaccuguaccauggaguccugca

SEQ ID NO: 77493 - RNA, 64 nt, Homo Sapiens
uuguccuucauggguagagucaggaagcccgguggcguggcacaacacacuuuggucauuucuc

SEQ ID NO: 77494 - RNA, 64 nt, Homo Sapiens
ugaugucuuagaaaggaaggugaauauagucaaagcguggcauugagauaauuggacugaagac

SEQ ID NO: 77495 - RNA, 64 nt, Homo Sapiens
ccugcguacccacugccaggacccucucagacaagcguggcacagccaugcugaccuuccaucu

SEQ ID NO: 77496 - RNA, 64 nt, Homo Sapiens
gcuagugggccucccccugcagcggggaggggcugcguggcacagggagccagagccgguggga

SEQ ID NO: 77497 - RNA, 64 nt, Homo Sapiens
ggcucugcaugcccgugacaagccccugggaagggcguggcagguccccauuuaccaucagcuc

SEQ ID NO: 77498 - RNA, 64 nt, Homo Sapiens
guuuuaaaaauaguucucuuauucauuugccugagcguggcacacucguguuguuauauagacc

SEQ ID NO: 77499 - RNA, 64 nt, Homo Sapiens
cucacagggaacacgggacaacaugcacgccugggcguggcagcgcccacaggucucgagacgc

SEQ ID NO: 77500 - RNA, 64 nt, Homo Sapiens
ucucuucccaucaaaucauccagcucaguguggggcguggcagggggguaaaugaagccagcca

SEQ ID NO: 77501 - RNA, 64 nt, Homo Sapiens
ucuuuggugucugcucagaaguguccucccauuggcguggcauuugacuuuaacccgcccaccu

SEQ ID NO: 77502 - RNA, 64 nt, Homo Sapiens
gcccagacacagaagaggcucugcaggugcugcugcguggcauacugacaaagcuuggaagagc

SEQ ID NO: 77503 - RNA, 64 nt, Homo Sapiens
ucuaaauugaucauucauaagugucucugacaaugcguggcacagccuuaugagaacauggugu

SEQ ID NO: 77504 - RNA, 64 nt, Homo Sapiens
caccaccccagugaggaccuuccacucagcaucagcguggcagucugacugaaggggcuuggcu

SEQ ID NO: 77505 - RNA, 64 nt, Homo Sapiens
ggaagacgauucccauauucuucacaacuugcgugcguggcagcguauacauuggcuuggaaug

SEQ ID NO: 77506 - RNA, 60 nt, Homo Sapiens
cacgcacgcacccacccacggucucugcaggcguggcacgcucuguaucccaaagcuuaa

SEQ ID NO: 77507 - RNA, 64 nt, Homo Sapiens
gcugggagcuugccaggaacccaguggccagggagcguggcacuuaccuuugucccuugcuuca

SEQ ID NO: 77508 - RNA, 64 nt, Homo Sapiens
agggaggaaacuguauccaugcaugcaugauaaugcguggcagagacugcaacagggauugugu

SEQ ID NO: 77509 - RNA, 64 nt, Homo Sapiens
cuccuaggggcugagaggugagcucuagagggcugcguggcauccuacgcgggccguacagagg

SEQ ID NO: 77510 - RNA, 64 nt, Homo Sapiens
uauugaagcauuucucagugaguuuucuggaauggcguggcacagaagagcugcuucugcaggg

SEQ ID NO: 77511 - RNA, 64 nt, Homo Sapiens
uuugaggacucugcggaucacaggugaaaaguuggcguggcaugugcuuguucuggaagagauu

SEQ ID NO: 77512 - RNA, 64 nt, Homo Sapiens
ugucagcuuuucaccuuucagaaguccuugcucugcguggcaucacaggacacggaccuucaug

SEQ ID NO: 77513 - RNA, 64 nt, Homo Sapiens
ugcaugcacaagugugugugugccugcgugcugugcguggcagggugugugugugugugucugg

SEQ ID NO: 77514 - RNA, 64 nt, Homo Sapiens
guuccucuggaagcugugacuggaauaaacccccgcguggcacugcugaguccucucuggcugg

SEQ ID NO: 77515 - RNA, 64 nt, Homo Sapiens
gaggcagucgcccugcggugccccuccgcggaaggcguggcaggcagaaagacaccgcgggcgg

SEQ ID NO: 77516 - RNA, 64 nt, Homo Sapiens
auggcaggauuccacauuucaccuuguuauaccugcguggcaccccuaggaaugcauuguccuc

SEQ ID NO: 77517 - RNA, 64 nt, Homo Sapiens
caggugucuuugcuguguuugagaaaggcgcugagcguggcaugaaccuucuguuacucccugg

SEQ ID NO: 77518 - RNA, 64 nt, Homo Sapiens
gcaugucuuggaaccugucuacuaagcucugccagcguggcagaagcaucuacucagcaagguc

SEQ ID NO: 77519 - RNA, 64 nt, Homo Sapiens
cauggugauggaugauauccucuuagccuggugggcguggcaugugcuuuuuaaaacaucaucu

SEQ ID NO: 77520 - RNA, 64 nt, Homo Sapiens
ggagacuguggaggcaguggucccacggcugacagcguggcagccuggggcugcuuuuuauugu

SEQ ID NO: 77521 - RNA, 64 nt, Homo Sapiens
cagaaaaggaguggggggcagucaccacugcugggcguggcauccgccuugggccuuucuccga

SEQ ID NO: 77522 - RNA, 64 nt, Homo Sapiens
cuuucuguucauaaaacagaacauaugcuaagaagcguggcauuucaaaaauccauuuugccuu

SEQ ID NO: 77523 - RNA, 64 nt, Homo Sapiens
aaggguuccacgugcauuugugcuuccccuguuugcguggcagcugcauagaaaaggauucugg

SEQ ID NO: 77524 - RNA, 64 nt, Homo Sapiens
caccagguccacagaacuaccaccggcuccccgagcguggcagccagcgggugugucagccucu

SEQ ID NO: 77525 - RNA, 64 nt, Homo Sapiens
gcuccgaggcuucuccagagcugggagcuggcuggcguggcaagggcaugcucuggggcagugu

SEQ ID NO: 77526 - RNA, 64 nt, Homo Sapiens
uuggccuccuggcugcuuucuccccuuccccccagcguggcaggaucucuuccuguuagcaagg

SEQ ID NO: 77527 - RNA, 64 nt, Homo Sapiens
aaggccuuuuccagcagcugggagcucccggauugcguggcacagcugaggggccucugugaug

SEQ ID NO: 77528 - RNA, 64 nt, Homo Sapiens
ugccucuguauuauaaaugagaaaugacaauaaagcguggcauuacacaucucgugaaaacuca

SEQ ID NO: 77529 - RNA, 64 nt, Homo Sapiens
cucuugacucugacucuccucuggcgacaucuuggcguggcagcgguggccaccgccagagcuc

SEQ ID NO: 77530 - RNA, 64 nt, Homo Sapiens
ggaauuuuaaaaaguuggccuaaaaauguuccaugcguggcagcaaccaugcagagugacugaa

SEQ ID NO: 77531 - RNA, 64 nt, Homo Sapiens
uuugcaaggggcuggggccccaccauuuuuggcagcguggcagcugcgccugagcugcaugcgc

SEQ ID NO: 77532 - RNA, 64 nt, Homo Sapiens
gccaaggcccacccacugcccaguggccuggcuggcguggcagggagcguuggaccuucaugaa

SEQ ID NO: 77533 - RNA, 64 nt, Homo Sapiens
cacccgcagucuccuggacaacuuggaccuccaugcguggcacuacacugcguagauuugccgc

SEQ ID NO: 77534 - RNA, 64 nt, Homo Sapiens
uuuaauucauaaauuauuuugaaaaagaaaauuugcguggcauuagaauuuuuauaccaauucu

SEQ ID NO: 77535 - RNA, 64 nt, Homo Sapiens
gggacguaaguggcgcagucacuugauccacgcagcguggcacuacucauacuuucccguugac

SEQ ID NO: 77536 - RNA, 64 nt, Homo Sapiens
cacaauacuggcacuauaaagucaguauugcuaagcguggcauuagggacagcugagauugagu

SEQ ID NO: 77537 - RNA, 64 nt, Homo Sapiens
cgcuguaugaaaggagagaguguaaaguuuccgugcguggcacuucucggauaguugcuauuuu

SEQ ID NO: 77538 - RNA, 64 nt, Homo Sapiens
acaaccuuugggaacuaaacaguuuucagagauggcguggcacugcauccuugguucuugcuuu

SEQ ID NO: 77539 - RNA, 64 nt, Homo Sapiens
caaaguggggaggagacaguucaagccauggcaggcguggcaagagaccacuccucaccccagc

SEQ ID NO: 77540 - RNA, 64 nt, Homo Sapiens
cuccaggaauaaacauucuuucucuguguugugugcguggcagccucccugggucccccagacc

SEQ ID NO: 77541 - RNA, 64 nt, Homo Sapiens
gacguaccugggaguuugaaucaggcccauuugagcguggcagccguguugggugaagguccgg

SEQ ID NO: 77542 - RNA, 64 nt, Homo Sapiens
cacguggaagcagggcauguaugugggugugucagcguggcagcggcgcggguggguuugguga

SEQ ID NO: 77543 - RNA, 64 nt, Homo Sapiens
ucuuugaagcaaagccugucaguauuaacccagugcguggcaugugcuuacugguguuuccgac

SEQ ID NO: 77544 - RNA, 64 nt, Homo Sapiens
cagagcaagccuagauccuugaaagcaaugucaggcguggcaguggggaagccauggaggcugg

SEQ ID NO: 77545 - RNA, 64 nt, Homo Sapiens
ggcaguggugcuaggaggacagaaggcuauaugggcguggcagaggcugguuaacaagggcuua

SEQ ID NO: 77546 - RNA, 64 nt, Homo Sapiens
ccaagguuuggcuuucacgcgcuccauugccccggcguggcaggccauuccaagcccuuccggg

SEQ ID NO: 77547 - RNA, 64 nt, Homo Sapiens
cuacaacuguugcuauguguagagggugcucagagcguggcaugagagcaaggagaccauggcu

SEQ ID NO: 77548 - RNA, 64 nt, Homo Sapiens
uccuugucaccccgaaccuuguaaucgugugcuggcguggcagcccuggcuaaguuaaucccca

SEQ ID NO: 77549 - RNA, 64 nt, Homo Sapiens
ucugagugucuggcugaucacaucagagaggucugcguggcaguuuggggcugucacgugacca

SEQ ID NO: 77550 - RNA, 64 nt, Homo Sapiens
ccucacuguguuggaggaugaacgggucgugauggcguggcaacccagauccaaaccgcaggca

SEQ ID NO: 77551 - RNA, 64 nt, Homo Sapiens
cugugaccgaccccuccccagcuucuaggugcccgcguggcauccucuguagaggguagcugug

SEQ ID NO: 77552 - RNA, 56 nt, Homo Sapiens
cugugaccccuccccagugcgggcccgcguggcaucagggcagcuguggcuucuag

SEQ ID NO: 77553 - RNA, 64 nt, Homo Sapiens
uuuguccguguucuguuuaauguucaggaugugagcguggcaaaauguuuuucacaaaauguau

SEQ ID NO: 77554 - RNA, 64 nt, Homo Sapiens
ccuuacucccagccgacuguagccugcagagagugcguggcaauccacacaggagagaauauac

SEQ ID NO: 77555 - RNA, 64 nt, Homo Sapiens
acguuugcguuuggaccugucugugcguucuccugcguggcaguccugauuuccaugcuucugg

SEQ ID NO: 77556 - RNA, 64 nt, Homo Sapiens
uuuggaugugcgugugugucugcgugugccaugugcguggcacgcauaugagugugugugcgug

SEQ ID NO: 77557 - RNA, 64 nt, Homo Sapiens
aaauuuaagaucaccuccucagcuagcuuagagugcguggcacgggccccccgcccccgagauc

SEQ ID NO: 77558 - RNA, 64 nt, Homo Sapiens
ggccucccacuccucccagcccgggagaugcuccgcguggcaccacccuccuugcuggggguag

SEQ ID NO: 77559 - RNA, 64 nt, Homo Sapiens
uugucucuaguguucagaaguuuggcugugaugugcguggcauggaaguuuuuggguguauucu

SEQ ID NO: 77560 - RNA, 64 nt, Homo Sapiens
ucccaugucuacuaaaauacaaaaaauuagccaggcguggcagcaugcgccuauagucccagcc

SEQ ID NO: 77561 - RNA, 64 nt, Homo Sapiens
gcccucucugugccucuccuagcugggggccggggcguggcagguggcggggcccacucaggac

SEQ ID NO: 77562 - RNA, 64 nt, Homo Sapiens
gcaggguguccugggauagguuuccuaggcaggggcguggcagagcagguaggcgcccugcagc

SEQ ID NO: 77563 - RNA, 64 nt, Homo Sapiens
uaccaaugccaagauaauucacucuacucagccggcguggcaaauauaaaacuuacagagcgug

SEQ ID NO: 77564 - RNA, 64 nt, Homo Sapiens
uugggaagggagggagagggggcgcagcucgcaggcguggcaacuugaccuugggggaauauuu

SEQ ID NO: 77565 - RNA, 64 nt, Homo Sapiens
uugugagcauuguguggaauuuuacaccuggccugcguggcagccucuuccaguugagguguuu

SEQ ID NO: 77566 - RNA, 64 nt, Homo Sapiens
guggggaauccaagggucaccccagcuugcucgggcguggcacaucguccuuguccugaggggc

SEQ ID NO: 77567 - RNA, 64 nt, Homo Sapiens
gggugggcacauuggugucugugggaggaagggggcguggcaagaccagccaggccacccagcc

SEQ ID NO: 77568 - RNA, 64 nt, Homo Sapiens
ggcugcgaguguuccugagaggauggcgaggacagcguggcacucugggguggcuaucaauauu

SEQ ID NO: 77569 - RNA, 64 nt, Homo Sapiens
uuuccuguucuuguucgcagcccaaguguuugcugcguggcagaaacagugucccacugaccuc

SEQ ID NO: 77570 - RNA, 64 nt, Homo Sapiens
gacuugaauagacacuucaccaaagagcauacacgcguggcaaacaagcacacgaaaagacguu

SEQ ID NO: 77571 - RNA, 64 nt, Homo Sapiens
ucaugccgguaaucucagcacagccuccaucaaggcguggcagcggagggauuccaaaaagucu

SEQ ID NO: 77572 - RNA, 64 nt, Homo Sapiens
ggcagcacaguggaagugggagccugguccuuccccugcccauggagagcucuuuaagggaucc

SEQ ID NO: 77573 - RNA, 64 nt, Homo Sapiens
cccaccagcccccaggugaggcuuccagcugggaccugcccagacaggcugagccugggcgugg

SEQ ID NO: 77574 - RNA, 64 nt, Homo Sapiens
cccaagcccugcccgccucuccccccacgcucaaccugcccacuuguccaggccuggccucuuu

SEQ ID NO: 77575 - RNA, 64 nt, Homo Sapiens
uuuggcucacucugccaugagaacaggacaccauccugcccagcccagacgggguugcuccugg

SEQ ID NO: 77576 - RNA, 64 nt, Homo Sapiens
gcugcggcucuggcccacugagccaccgcgcccuccugcccacgggaggacaagcaauaacucu

SEQ ID NO: 77577 - RNA, 64 nt, Homo Sapiens
ggggcuuaggaaccuucucccuucuugggucugcccugcccauacugagccugccaaagugccu

SEQ ID NO: 77578 - RNA, 64 nt, Homo Sapiens
gcuuugggaggccaaggcagcauggcguaaugggccugcccaauaaccagcaggugugguggcu

SEQ ID NO: 77579 - RNA, 64 nt, Homo Sapiens
uagccguccauggcaccagcacaccacugcccugccugcccacucuacuugugacugaaggggc

SEQ ID NO: 77580 - RNA, 64 nt, Homo Sapiens
ggugggaacuggaggaguggcccuuggcucuaucccugcccagacacaucuaggguuguccugc

SEQ ID NO: 77581 - RNA, 64 nt, Homo Sapiens
ggccgagggacagggugaggugugccaccaccuuccugcccacagaguccacacauuauaguca

SEQ ID NO: 77582 - RNA, 64 nt, Homo Sapiens
ccucauccccaucuucucaguccucagggcaaccccugcccaaccaaggaugugacauggcuuc

SEQ ID NO: 77583 - RNA, 64 nt, Homo Sapiens
agauagaagaccuggacuccccaccugcaagagcccugcccaggacaaccuccugggaccacug

SEQ ID NO: 77584 - RNA, 64 nt, Homo Sapiens
aguggaugaugugggaguuggcugccgaugccuuccugcccagauugagugaaaggagggugag

SEQ ID NO: 77585 - RNA, 64 nt, Homo Sapiens
gagcuuuaccuuucccaagcagccccacagggaaccugcccagaacacaacuguccaagcucuc

SEQ ID NO: 77586 - RNA, 64 nt, Homo Sapiens
ccucgucaccacagggacucccuggaagaccgugccugcccagccagaaccccugcccuggcag

SEQ ID NO: 77587 - RNA, 64 nt, Homo Sapiens
ggacauguacauuuccccuuuggggaacugucaaccugcccacgccccaccaccccggggucuc

SEQ ID NO: 77588 - RNA, 64 nt, Homo Sapiens
acugccauuccuuucuaaguguguuuuauggcauccugcccacaaagaacucacagucugauua

SEQ ID NO: 77589 - RNA, 64 nt, Homo Sapiens
gcuucacagguugacuaguaucuguggguaccucccugcccagguuauucacucacaagccacc

SEQ ID NO: 77590 - RNA, 56 nt, Homo Sapiens
augagaugacugaugugugauguugcccugcccagaaagggcccugcccuagaccc

SEQ ID NO: 77591 - RNA, 64 nt, Homo Sapiens
ccuucacaacggucagcacuccucucccagccccccugcccacuguucucaauaaaaugugagu

SEQ ID NO: 77592 - RNA, 64 nt, Homo Sapiens
guuucugggccucacggugcggacagggaugccgccugcccaguaacgggguuggggaccgaaa

SEQ ID NO: 77593 - RNA, 64 nt, Homo Sapiens
cccucucagaggaacggggucucuacccguccagccugcccagaauucauccccccggccaccu

SEQ ID NO: 77594 - RNA, 64 nt, Homo Sapiens
ugaagcaaggggcaaggcugggccccuagcuuguccugcccauuccuccagguguugaucuuga

SEQ ID NO: 77595 - RNA, 64 nt, Homo Sapiens
cuggucccuggcaacaggaaccugggcagcuuauccugcccacagguaagccccugggagcauc

SEQ ID NO: 77596 - RNA, 64 nt, Homo Sapiens
gaucuucccuguguggucccucccuucgugugccccugcccagccucuuggcaccuccuguuua

SEQ ID NO: 77597 - RNA, 64 nt, Homo Sapiens
uggaggguuucaaacaagacaaaaggcauuccucccugcccaaucccagugcagucaaggccaa

SEQ ID NO: 77598 - RNA, 64 nt, Homo Sapiens
gacccuuggccuugugagcccugaaagucugguuccugcccagugccuauggcaccuuucccuu

SEQ ID NO: 77599 - RNA, 64 nt, Homo Sapiens
aacuguggacuuuugcuuccauuuauaccaauuaccugcccagugcauccagccccacacccuc

SEQ ID NO: 77600 - RNA, 64 nt, Homo Sapiens
agggaccauggagcaguggcggcccagugcucuuccugcccaccugggccuuuccuaugggcaa

SEQ ID NO: 77601 - RNA, 64 nt, Homo Sapiens
cuucgcucacgccccagcgcggaggcgccuccuuccugcccaccgacaccagacugcaauaacu

SEQ ID NO: 77602 - RNA, 64 nt, Homo Sapiens
uaggacccugccaggucccgcgcaccaucccugcccugcccacgugguauugcugggcuccugg

SEQ ID NO: 77603 - RNA, 64 nt, Homo Sapiens
cuguuccugaucagcccguaucaucugaggccugccugcccacccugccacccuccccucccuu

SEQ ID NO: 77604 - RNA, 64 nt, Homo Sapiens
aagguagaugccaacuggagggccagaccuguguccugcccauguccuccuugguggacguuuc

SEQ ID NO: 77605 - RNA, 64 nt, Homo Sapiens
acguuucuguuuacucagagcugcuagagaccauccugcccauccgaguucugagauugggacu

SEQ ID NO: 77606 - RNA, 64 nt, Homo Sapiens
gucucugcuaugauggugguauccgaggccuuucccugcccagucuggugccugccccacauug

SEQ ID NO: 77607 - RNA, 64 nt, Homo Sapiens
ccauggggauccaagaccugagauaaagcaacagccugcccagaucccucuguucauccuaucc

SEQ ID NO: 77608 - RNA, 64 nt, Homo Sapiens
aaguauuaccugcggcgacucuccauugcagacgccugcccaucgacaccugccauugccuccu

SEQ ID NO: 77609 - RNA, 64 nt, Homo Sapiens
gcuccauuuuggaggcaggcgaugcauucucauaccugcccacaugcuggcucaacuucaccaa

SEQ ID NO: 77610 - RNA, 64 nt, Homo Sapiens
ccuucuuccucaccucucagccuccagaucccuuccugcccaucccuucccuacaaugcccacu

SEQ ID NO: 77611 - RNA, 64 nt, Homo Sapiens
ugaaugugaguggcaaguggcuuaucuggagccaccugcccaagucuuacuaaaaugcagcugu

SEQ ID NO: 77612 - RNA, 64 nt, Homo Sapiens
aguucuggaaagguggccuucaaagcauaguuuaccugcccacguuggugaaagaaagcacauc

SEQ ID NO: 77613 - RNA, 64 nt, Homo Sapiens
ucccgcacccugcguuuagguggaggucaccucuccugcccagcacgaacuuuaggaacacagu

SEQ ID NO: 77614 - RNA, 64 nt, Homo Sapiens
caaacaguaguacaagcuccccucagccagccugccugcccagcgaggcccccagguucaaggu

SEQ ID NO: 77615 - RNA, 64 nt, Homo Sapiens
gugccaccugguacagguagguggcgcucacguuccugcccaaaugcagcccaucggggaguca

SEQ ID NO: 77616 - RNA, 64 nt, Homo Sapiens
cagacuguggcuccuuccucauuguccuuaccguccugcccauagaucuaauaccauccugccc

SEQ ID NO: 77617 - RNA, 64 nt, Homo Sapiens
guccuuaccguccugcccauagaucuaauaccauccugcccauuggaaggagauggcauagaga

SEQ ID NO: 77618 - RNA, 64 nt, Homo Sapiens
gggacacucccccugcucucucccuccuucuccaccugcccacccuuccugcaugggagagcug

SEQ ID NO: 77619 - RNA, 64 nt, Homo Sapiens
uccugggcucucccagggaacuaucucccaaagaccugcccaccucuuugccucguccaggucu

SEQ ID NO: 77620 - RNA, 64 nt, Homo Sapiens
auacugacccauugaaccccgucacccugugcuuccugcccaagcgcacgcacacaagacggga

SEQ ID NO: 77621 - RNA, 64 nt, Homo Sapiens
uggaggguccuggggacggcagagcugcuggccuccugcccagggcagccucucuggccauugc

SEQ ID NO: 77622 - RNA, 64 nt, Homo Sapiens
agcccugagcucagcugcagccacagcuccuaccccugcccagccaugagccccaaggcugggg

SEQ ID NO: 77623 - RNA, 64 nt, Homo Sapiens
acauccagccuguggcuuugcccggagcccccagccugcccacuccagcccgaguagagggcau

SEQ ID NO: 77624 - RNA, 64 nt, Homo Sapiens
cuaggaggcagcggggauagggcagagauggaggccugcccagaaacccugagaggccuaauag

SEQ ID NO: 77625 - RNA, 64 nt, Homo Sapiens
accaggucgguucccgaggccccccguccgccauccugcccaccuccacccaccuccgcaucca

SEQ ID NO: 77626 - RNA, 64 nt, Homo Sapiens
caaaaagggcuucgggggagugguuacccugcucccugcccagugacaagcccuccuuuccccu

SEQ ID NO: 77627 - RNA, 64 nt, Homo Sapiens
uccuuuccccugggggcccuccuuuccccugcucccugcccagcuacggggcccuccuuucagc

SEQ ID NO: 77628 - RNA, 64 nt, Homo Sapiens
gaagggaaggccugcagagggagcccuccagcccccugcccacacucuuuguccuggugcccag

SEQ ID NO: 77629 - RNA, 64 nt, Homo Sapiens
cccuccuuugccuguguccucucugugugggugcccugcccacccagaagcagugaagguucuu

SEQ ID NO: 77630 - RNA, 64 nt, Homo Sapiens
agaguggaucucacagcccauuaggugcuaaccaccugcccagaggggaagugagggaaaaacg

SEQ ID NO: 77631 - RNA, 64 nt, Homo Sapiens
ggccguggugacucacgggccccggcuccccucgccugcccaggaggccaggaacccaagccac

SEQ ID NO: 77632 - RNA, 64 nt, Homo Sapiens
ccgccucagccugccaccucccgccauccaccguccugcccacgugcuggcugucccuguggac

SEQ ID NO: 77633 - RNA, 64 nt, Homo Sapiens
cugcacuggguucucuccuucuucuuccugcuguccugcccaagaacugagggucuccccggcc

SEQ ID NO: 77634 - RNA, 64 nt, Homo Sapiens
cccucugcccugccagagacagacccaugcgcugccugcccaccgugccccuuuguccccaugu

SEQ ID NO: 77635 - RNA, 64 nt, Homo Sapiens
cccucaaugucuaccucugaagccuccuucccugccugcccaccccuccaugcuccacgcaggc

SEQ ID NO: 77636 - RNA, 64 nt, Homo Sapiens
gcccugagacuauuugcugugggcucuccuccagccugcccagggcccacccagaugccucugg

SEQ ID NO: 77637 - RNA, 64 nt, Homo Sapiens
cccuucccagucagggcuccagaguccugcccagccugcccauccuuuccgggcacaagaaacc

SEQ ID NO: 77638 - RNA, 64 nt, Homo Sapiens
cugcccauccccuucccagucaagaaaccagaguccugcccagcaacuguagucuuuccgggca

SEQ ID NO: 77639 - RNA, 64 nt, Homo Sapiens
guggcagcuguggcauccacuguggcaucuccguccugcccaccuucuuaagaggcgagaugga

SEQ ID NO: 77640 - RNA, 64 nt, Homo Sapiens
gucucaauuuaaaaugauccauggccacagggcuccugcccaggggcuugucaccuuccccucc

SEQ ID NO: 77641 - RNA, 64 nt, Homo Sapiens
cuccccauaccgggccucuggcccagaccuaagcccugcccacaaagacuaauggaugccagug

SEQ ID NO: 77642 - RNA, 64 nt, Homo Sapiens
agggcaaguacagccacuguaaauaacccucgucccugcccaggaacccagacuggacuucagu

SEQ ID NO: 77643 - RNA, 64 nt, Homo Sapiens
ccuacugccucccgcugccgcagcgcacuccuccccugcccaagcaccuuugccuccugaggcg

SEQ ID NO: 77644 - RNA, 64 nt, Homo Sapiens
cuggggcaccuuugccuccugggcugguccagggccugcccaggggggcggcgcugcucagcuu

SEQ ID NO: 77645 - RNA, 64 nt, Homo Sapiens
gagcggacccuccucuuugguuaacguuguagggccugcccauggggccagcugccccauucuu

SEQ ID NO: 77646 - RNA, 64 nt, Homo Sapiens
ugcaacucccccccaacaauccaucagaacccugccugcccacccugcuuuuuaggccucacuc

SEQ ID NO: 77647 - RNA, 64 nt, Homo Sapiens
uggccuccuggcccgcccuccgggggacgccugcccugcccaggagcccugccgggcacaugcc

SEQ ID NO: 77648 - RNA, 64 nt, Homo Sapiens
cuaccagcuccuccagcccuugagcacauaguguccugcccacccagacggccggccggaccuc

SEQ ID NO: 77649 - RNA, 64 nt, Homo Sapiens
cagggugaggaaagggcuccuuuccucacccgccccugcccagacugcuguugcacgggagaac

SEQ ID NO: 77650 - RNA, 64 nt, Homo Sapiens
ugcccgugugccuacccacucagaugcugcgggaccugcccagcuccuaaucaaguaucugagc

SEQ ID NO: 77651 - RNA, 64 nt, Homo Sapiens
uucuugggaaguagagauguggcggcuuucccacccugcccacagcaggcccuccugcccagcu

SEQ ID NO: 77652 - RNA, 64 nt, Homo Sapiens
uggcggcuuucccacccugcccacagcaggcccuccugcccagcugcucuugucagcccucugg

SEQ ID NO: 77653 - RNA, 64 nt, Homo Sapiens
ccaaugcccagagugaccaagcagcaccagcaggccugcccaggaugcugaaagcagauuucuu

SEQ ID NO: 77654 - RNA, 64 nt, Homo Sapiens
auccuugccccacuggugagaggaggaccuugugccugcccagagccugcaggacagcacgccu

SEQ ID NO: 77655 - RNA, 64 nt, Homo Sapiens
cagaugcugcuugcucagaaacaacccgugcaucccugcccauggauucugcaggaccuagaag

SEQ ID NO: 77656 - RNA, 64 nt, Homo Sapiens
cucaggcccaugagguaugggugcacuccagaccccugcccaggucucccugccugggggcuau

SEQ ID NO: 77657 - RNA, 64 nt, Homo Sapiens
accuggcucaucccucaggcgaccuggugugucaccugcccaccuggggcagaggccaggaggg

SEQ ID NO: 77658 - RNA, 64 nt, Homo Sapiens
gccucuauccugucuguccccaccccagcuguccccugcccagggagcuggcauaaaagcacga

SEQ ID NO: 77659 - RNA, 64 nt, Homo Sapiens
ggcagcugcuugagaacagagacugcuaccccauccugcccaugcaggcaggcucuugccagcc

SEQ ID NO: 77660 - RNA, 64 nt, Homo Sapiens
ccgcagagggcagacgccacccuggacugcucucccugcccagcugggccucucuggccuauuc

SEQ ID NO: 77661 - RNA, 63 nt, Homo Sapiens
acgccuguccccgggacugagcugccaugccagccugcccacagcagccuccuagaguuagca

SEQ ID NO: 77662 - RNA, 64 nt, Homo Sapiens
agagaguagugacacucaggauccaaaagcuagcccugcccaccccagccccuggaccugcuua

SEQ ID NO: 77663 - RNA, 64 nt, Homo Sapiens
cucggagcucgccugcccugcuuggcucugaggaccugcccagcgcucaaagggaacggaagcc

SEQ ID NO: 77664 - RNA, 64 nt, Homo Sapiens
gccuacuugcccuagcaugaggcucugagagccaccugcccaccaaucuggugaggauaauggu

SEQ ID NO: 77665 - RNA, 64 nt, Homo Sapiens
cccacccuccauuccggaccccaugggcccagccccugcccaucuaguugguuuggggacccug

SEQ ID NO: 77666 - RNA, 64 nt, Homo Sapiens
cugacacccugugacugagccuguguccugucugccugcccagccaugcuccaucggcugugag

SEQ ID NO: 77667 - RNA, 64 nt, Homo Sapiens
augguggcagccgccaggcgagcaggcugcuuucccugcccagucaugcaccucccccucuggg

SEQ ID NO: 77668 - RNA, 64 nt, Homo Sapiens
ugugcuggcaaucagggccgcaguguguucugcgccugcccagagcugacuccugauuuaaccg

SEQ ID NO: 77669 - RNA, 64 nt, Homo Sapiens
ucuuccuucgugagcuggcccgucccugauccucccugcccaaguaggguggauccuugccagg

SEQ ID NO: 77670 - RNA, 64 nt, Homo Sapiens
aggaauggguccaggugugguccagcaagcccucccugcccagagggugcacagccucccuccc

SEQ ID NO: 77671 - RNA, 64 nt, Homo Sapiens
aaagcuugacaagacacucgagugaaaaaagucaccugcccaaucgagaagcccacaagaucug

SEQ ID NO: 77672 - RNA, 64 nt, Homo Sapiens
aaacaccgagugaggccauauuaagagaaagucaccugcccaagcucaagcccccagcuggaag

SEQ ID NO: 77673 - RNA, 64 nt, Homo Sapiens
accugacccuggcgugugcuacugcacaauuccaccugcccagggcaccugcagacgcaggggg

SEQ ID NO: 77674 - RNA, 64 nt, Homo Sapiens
ccagacagacagcaccugcagguccucccccaacccugcccaagggaaggauggcucuggccuc

SEQ ID NO: 77675 - RNA, 64 nt, Homo Sapiens
cucccuccacuccucucaacucccauccuccagcccugcccaccuuucuaucagacgugcuccc

SEQ ID NO: 77676 - RNA, 64 nt, Homo Sapiens
caccccucagaugcguucgcauagcccuggugcuccugcccagcggaagacccugaccguguac

SEQ ID NO: 77677 - RNA, 64 nt, Homo Sapiens
ucaccugccccucuguucucuccccucacauccuccugcccagcuccucacauacccacacauu

SEQ ID NO: 77678 - RNA, 64 nt, Homo Sapiens
ccgcgcguuccuucgcacacugugauuuugcccuccugcccacgcagaccugcagcgggcaaag

SEQ ID NO: 77679 - RNA, 64 nt, Homo Sapiens
ucgggguuggcuucuucccaggccuugcaugggcccugcccacaagcacacccucaggccgagg

SEQ ID NO: 77680 - RNA, 64 nt, Homo Sapiens
uuuccagugggguuugaagcagaguucagggaacccugcccaagguccuccuguucagacauuc

SEQ ID NO: 77681 - RNA, 64 nt, Homo Sapiens
acaggacugggccgggcccagggccucuggcuucccugcccaauccucccuggagaagggacau

SEQ ID NO: 77682 - RNA, 64 nt, Homo Sapiens
caggaccacuagcuaagcaagccaggagaagaccccugcccaaguggcucuugggacaacgugc

SEQ ID NO: 77683 - RNA, 64 nt, Homo Sapiens
acuccagguguggaccggccgcagcccccacugaccugcccauguccagagggacuggacagcc

SEQ ID NO: 77684 - RNA, 57 nt, Homo Sapiens
cagaagccccggagauguagacgccacccugcccacccccgggauccugcccccaag

SEQ ID NO: 77685 - RNA, 64 nt, Homo Sapiens
cuggucagaguggcgugagcugcccggcgccugcccugcccaagugaccagggaagugugugug

SEQ ID NO: 77686 - RNA, 64 nt, Homo Sapiens
augaguggccagcgccagggcccaggccauguggccugcccagccucaaugucacuugguggcg

SEQ ID NO: 77687 - RNA, 64 nt, Homo Sapiens
ugcaucuuuugcagcccacuuaccugucucccugccugcccaucaccuugucuuucugucuguu

SEQ ID NO: 77688 - RNA, 64 nt, Homo Sapiens
ccucucuugagggagcagcagcaaucucccaccuccugcccaucggacaccccgaagcccaccu

SEQ ID NO: 77689 - RNA, 64 nt, Homo Sapiens
ucacucucucccuugaugauagcaccacaucgucccugcccaucgagcagaggccugaagcgga

SEQ ID NO: 77690 - RNA, 64 nt, Homo Sapiens
uuggggugguggcaccagagggagagggggguacccugcccaccagcugccacaggcauauggu

SEQ ID NO: 77691 - RNA, 64 nt, Homo Sapiens
cuggucauuugcuguccgcucacacagaagcagcccugcccagccggcugggaaggucucugau

SEQ ID NO: 77692 - RNA, 64 nt, Homo Sapiens
gcagguggcucuuacagcucucccaggcacacacccugcccauuacaagcagggaagugaaagg

SEQ ID NO: 77693 - RNA, 64 nt, Homo Sapiens
ugaacacagcggcugccaguugacugggugcacaccugcccagggcaccauaauccaguggggg

SEQ ID NO: 77694 - RNA, 64 nt, Homo Sapiens
agacuuuuauuuauuuuuuuaguuaucaguaauuccugcccagaucugcauugguuauaauaac

SEQ ID NO: 77695 - RNA, 64 nt, Homo Sapiens
gagaggcuuggucggucuccgcccaccccucaguccugcccacacucaacaucuggagauacag

SEQ ID NO: 77696 - RNA, 64 nt, Homo Sapiens
gugcucuaaacccugcucagcagacccucccccuccugcccacucacgaggcccugcugaaguc

SEQ ID NO: 77697 - RNA, 64 nt, Homo Sapiens
uggggcugcauucccuggagacucacugcaaguuccugcccaggaggcugagggcaccccaucc

SEQ ID NO: 77698 - RNA, 64 nt, Homo Sapiens
aguagucguacacggagacuggcagcgccgacguccugcccaccacgcacucccggagagcacg

SEQ ID NO: 77699 - RNA, 64 nt, Homo Sapiens
accggaagcagcacgugugagcugggccaggagcccugcccaccuccgugcagcugaccugccc

SEQ ID NO: 77700 - RNA, 64 nt, Homo Sapiens
gcacaugcugauacacacuguuguuaggccugcaccugcccauccagaaagcagcagcugccuu

SEQ ID NO: 77701 - RNA, 64 nt, Homo Sapiens
ccugcuccggcucacacacgcccugccugcccucccugcccagcuguaaggaccgggggucucc

SEQ ID NO: 77702 - RNA, 64 nt, Homo Sapiens
gcagauaaacagacccccuucugcuccgcuuccuccugcccagccaggcaacacccucaaccgg

SEQ ID NO: 77703 - RNA, 63 nt, Homo Sapiens
uuccaaaugcugagcccugauccaaaguugucuccugcccaugagcaccacagucaggccuug

SEQ ID NO: 77704 - RNA, 64 nt, Homo Sapiens
uugcuuagcccacaauucuccauuucacuugaccccugcccaccucuccaaccuaacuggcuua

SEQ ID NO: 77705 - RNA, 64 nt, Homo Sapiens
uccaggccucucccaccucaaaucuccuuggggcccugcccaccgggacacacccugauagcac

SEQ ID NO: 77706 - RNA, 64 nt, Homo Sapiens
ccgaggcagggcuggggcuucccccuccgcugccccugcccaccggaaaccgaggccaccgccc

SEQ ID NO: 77707 - RNA, 64 nt, Homo Sapiens
gcccuggcaccagagacgccaguccucgagucgcccugcccagaccacaccaguccucccaggg

SEQ ID NO: 77708 - RNA, 64 nt, Homo Sapiens
gcacucuuugguucucugcugagggagaagagccccugcccacuagacacaaacaaaccaacca

SEQ ID NO: 77709 - RNA, 64 nt, Homo Sapiens
cccggccagaucccuggagcauucuugaauucugccugcccacccacucgcuuguugaagauga

SEQ ID NO: 77710 - RNA, 64 nt, Homo Sapiens
uggccuauaccccagccguggucuccugccccugccugcccauccauuugcugcaggcauggcu

SEQ ID NO: 77711 - RNA, 64 nt, Homo Sapiens
gcagccuucugugaccccgcugugguaaguccagccugcccagggcugcugagggcugccucuu

SEQ ID NO: 77712 - RNA, 64 nt, Homo Sapiens
uuucuggcucaggcuguaaaaguagcugagccauccugcccauuccuggagguccuacagguga

SEQ ID NO: 77713 - RNA, 64 nt, Homo Sapiens
ucaguauagacguauccaaugggaaaacagcggaccugcccagagcagggaggugucguggaac

SEQ ID NO: 77714 - RNA, 64 nt, Homo Sapiens
ggugcaucgucucaacaccaccaaguuuguaggaccugcccaaguucuaguaguauucaaaacu

SEQ ID NO: 77715 - RNA, 64 nt, Homo Sapiens
ugcccuugccugguuccauauggcuccuuccagcccugcccaccaagugcagcucccacuuucc

SEQ ID NO: 77716 - RNA, 64 nt, Homo Sapiens
gcccugcccaccaagugcagcucccacuuuccauccugcccauacgccccucuucccccgacau

SEQ ID NO: 77717 - RNA, 64 nt, Homo Sapiens
acgccagagcuucagugagguuuccgagccucucccugcccauccucaccacugaggccacgac

SEQ ID NO: 77718 - RNA, 64 nt, Homo Sapiens
agguaccgcucuccaaggugugcuagcagugggcccugcccaacuucaggcagaacagggaggc

SEQ ID NO: 77719 - RNA, 64 nt, Homo Sapiens
gcucggccugggagucgggcggccccggucaggcccugcccagagagcuccugguuccugaacu

SEQ ID NO: 77720 - RNA, 64 nt, Homo Sapiens
ccucacccacccgaggcucugcccaccgccuggaccugcccaccccugaaagacuggccccugg

SEQ ID NO: 77721 - RNA, 64 nt, Homo Sapiens
guaggccuggcaugaggggugagguggcucagcaccugcccaggugagagguuccuggcgcccu

SEQ ID NO: 77722 - RNA, 64 nt, Homo Sapiens
cccucccccaacaagaucucggcugagagggcuaccugcccagcggagcagauggccugccuuu

SEQ ID NO: 77723 - RNA, 64 nt, Homo Sapiens
agccagggcuacacuacaaauuauagauguuagcccugcccaacccugcccugguauguuuuuc

SEQ ID NO: 77724 - RNA, 64 nt, Homo Sapiens
accaagcaagcagcaagcaagccgcuacccucggccugcccaccucgcagacagcccagagccu

SEQ ID NO: 77725 - RNA, 64 nt, Homo Sapiens
acccaggcccgccucccccuugcucucaggccacccugcccaggcuggguuuuguaccaguccc

SEQ ID NO: 77726 - RNA, 64 nt, Homo Sapiens
cuuaccgagcaaggugggugccucagcggugagcccugcccacuagccgggccaagcgcuggcc

SEQ ID NO: 77727 - RNA, 64 nt, Homo Sapiens
gcaggaggacagagugcccuggggcauccaccuuccugcccaggggacguggcgcugucggugu

SEQ ID NO: 77728 - RNA, 64 nt, Homo Sapiens
ggaugccccuggcccugccucacugugaccugcuccugcccacgugcagcaccugucaccuuuu

SEQ ID NO: 77729 - RNA, 64 nt, Homo Sapiens
gucaggcugcucucggacuccugaucucaggugaccugcccaccucggccucccgaagugcugg

SEQ ID NO: 77730 - RNA, 64 nt, Homo Sapiens
guuugcugggcauaagcuucacaggacgggagaaccugcccaugguggacugucguucuccaca

SEQ ID NO: 77731 - RNA, 64 nt, Homo Sapiens
uucuucuccgagccccaggcagcggugauucagcccugcccaaccugauucugaugacugcgga

SEQ ID NO: 77732 - RNA, 64 nt, Homo Sapiens
ggaggggcgccugcugagcacuuccgccccucacccugcccagccccugccaugagcucugggc

SEQ ID NO: 77733 - RNA, 64 nt, Homo Sapiens
caucuguccccucucuccacacccagccccugcuccugcccaggcugcccugcccagcgccuca

SEQ ID NO: 77734 - RNA, 64 nt, Homo Sapiens
cuccacacccagccccugcuccugcccaggcugcccugcccagcgccucaucagccucugccuu

SEQ ID NO: 77735 - RNA, 64 nt, Homo Sapiens
ugaucuuccccaucaggcugggcucuggcagggaccugcccaggauggagaugagagaggguga

SEQ ID NO: 77736 - RNA, 50 nt, Homo Sapiens
aggacaucuaccuggaguagccugcccaccgcucugucuccuggccgucu

SEQ ID NO: 77737 - RNA, 64 nt, Homo Sapiens
caccccacgcacgccccgugcuguguuccugggcccugcccauggccucaauaaacucucugcu

SEQ ID NO: 77738 - RNA, 64 nt, Homo Sapiens
ugggaaucugaggcagaggacccauucacccccaccugcccacugcugaggugcuacccggagc

SEQ ID NO: 77739 - RNA, 64 nt, Homo Sapiens
auaggccucugcuaccugccggccuugggcaaguccugcccaccucucauccuggccccaccag

SEQ ID NO: 77740 - RNA, 64 nt, Homo Sapiens
aacuguaucugauuucacuacuuaccccacccucccugcccaucgcacugcacuggaguugucu

SEQ ID NO: 77741 - RNA, 64 nt, Homo Sapiens
uggcacugcacuggaguugugugaacagugggagccugcccaccaguggggaggagcgucucaa

SEQ ID NO: 77742 - RNA, 64 nt, Homo Sapiens
cacuggccuucccuccugccuauucccuccucagccugcccacguggggacuugagggggguca

SEQ ID NO: 77743 - RNA, 64 nt, Homo Sapiens
cuuacucucugccuaccugccugagccauguucaccugcccacuuguccccugcugccugccca

SEQ ID NO: 77744 - RNA, 64 nt, Homo Sapiens
gagccauguucaccugcccacuuguccccugcugccugcccaaacaccccaccauuggccuguc

SEQ ID NO: 77745 - RNA, 64 nt, Homo Sapiens; identical to SEQ ID NO: 75315

SEQ ID NO: 77746 - RNA, 64 nt, Homo Sapiens; identical to SEQ ID NO: 75316

SEQ ID NO: 77747 - RNA, 64 nt, Homo Sapiens; identical to SEQ ID NO: 75317

SEQ ID NO: 77748 - RNA, 64 nt, Homo Sapiens; identical to SEQ ID NO: 75318

SEQ ID NO: 77749 - RNA, 64 nt, Homo Sapiens; identical to SEQ ID NO: 75319

SEQ ID NO: 77750 - RNA, 64 nt, Homo Sapiens; identical to SEQ ID NO: 75320

SEQ ID NO: 77751 - RNA, 64 nt, Homo Sapiens; identical to SEQ ID NO: 75321

SEQ ID NO: 77752 - RNA, 64 nt, Homo Sapiens; identical to SEQ ID NO: 75322

SEQ ID NO: 77753 - RNA, 64 nt, Homo Sapiens
aagggaggccugaggggcaggccccacucugcugaggccagaggaaccuucacccagcacccau

SEQ ID NO: 77754 - RNA, 64 nt, Homo Sapiens
ugaacauucauguguaggaacucaggggagacuuaggccagaggcccucccccggggucuccac

SEQ ID NO: 77755 - RNA, 64 nt, Homo Sapiens
uccagggcugcacugugguggaggagaaggaaguaggccagaaguuccagagagagucaugcug

SEQ ID NO: 77756 - RNA, 64 nt, Homo Sapiens
uuuagugcuaggggaagaugcccauccugggccaaggccagaaccccuucucccacugggcucc

SEQ ID NO: 77757 - RNA, 64 nt, Homo Sapiens
cugugggcaggcaggcagggcugugcuguggcccaggccagagcgaucuggaccaguuucccug

SEQ ID NO: 77758 - RNA, 64 nt, Homo Sapiens
gaaagggcagugcaggggagcuucagcugccuggaggccagaagucucucaacaucacauacag

SEQ ID NO: 77759 - RNA, 64 nt, Homo Sapiens
uauagucauacucacacaaaaaauagaaaacaccaggccagaacgcugacaucuaaaacuaaau

SEQ ID NO: 77760 - RNA, 64 nt, Homo Sapiens
ccaagaaaccaagcguaucucucaaggcaaccugaggccagacacgucaacucaucagcucuuc

SEQ ID NO: 77761 - RNA, 64 nt, Homo Sapiens
uauugcuuagcagggcauuugacuacuuuaucugaggccagaacucucacacacagcuaucaag

SEQ ID NO: 77762 - RNA, 64 nt, Homo Sapiens
cagauaaaggaacuuuuauuaaagccugagacucaggccagaauuaggagggagcuuuuugaag

SEQ ID NO: 77763 - RNA, 64 nt, Homo Sapiens
ccacaaguaugaugacuaggccaagcugcacaggaggccagaaaagugguaaacugugguuucc

SEQ ID NO: 77764 - RNA, 64 nt, Homo Sapiens
ggauuauuccuccuuugcuguggucccgugggagaggccagacuacccaguagguuuucuguug

SEQ ID NO: 77765 - RNA, 64 nt, Homo Sapiens
ucgggccagcugccccauucagccagggaagaggaggccagagggcugguaaauauuuacauuc

SEQ ID NO: 77766 - RNA, 64 nt, Homo Sapiens
caauuuuggagggcaagacauccucaaaggaaucaggccagacugggaugauuguaaaauuugc

SEQ ID NO: 77767 - RNA, 64 nt, Homo Sapiens
cuggacuccugcaaugagggugagggaaguccccaggccagacgaaguuggucaacagaucugg

SEQ ID NO: 77768 - RNA, 64 nt, Homo Sapiens
ggcaugcucuggaacccagcuccagcuuccagcuaggccagaagguacacauuuccuaucuucc

SEQ ID NO: 77769 - RNA, 64 nt, Homo Sapiens
cuuugguggccuugccccgcucugcagcacagacaggccagaugcauuuguccuuugccuagcu

SEQ ID NO: 77770 - RNA, 64 nt, Homo Sapiens
agucacaggugacucagcagugacccugugugccaggccagauccaaacugagagggaaggugu

SEQ ID NO: 77771 - RNA, 64 nt, Homo Sapiens
cauauggcauagaauugugagagaauguuuugaaaggccagaggguggccuuuuuccccaaaca

SEQ ID NO: 77772 - RNA, 64 nt, Homo Sapiens
ccccaggguugacaaggggccguccuuuccacacaggccagaagaggucuucaggcgaaccgac

SEQ ID NO: 77773 - RNA, 64 nt, Homo Sapiens
cggcgaauugaagggcuaagagucccagauagcuaggccagagcuggaagcagacaguaagggg

SEQ ID NO: 77774 - RNA, 64 nt, Homo Sapiens
agaaaugaggaugucugucccugucugccugggcaggccagauuccuccccagcagccgggucu

SEQ ID NO: 77775 - RNA, 64 nt, Homo Sapiens
auuuaauugugaaaggagacuuugcagauaaaugaggccagaauggcauguuuuauaauuaacu

SEQ ID NO: 77776 - RNA, 64 nt, Homo Sapiens
aggcucuggugcagagcacuucaaauauguccucaggccagauacugauugcuaguagagagac

SEQ ID NO: 77777 - RNA, 64 nt, Homo Sapiens
agccgagagccccuucuguuuugggaggccagagaggccagacaccccgcccucccacaccugc

SEQ ID NO: 77778 - RNA, 64 nt, Homo Sapiens
ggccagacaagccgagagcccacaccugcuugggaggccagagaccacacuugccccgcccucc

SEQ ID NO: 77779 - RNA, 64 nt, Homo Sapiens
gccgcaaauaccucuucuagcccuuagaagucugaggccagacugacugagggggccugaagcu

SEQ ID NO: 77780 - RNA, 64 nt, Homo Sapiens
auggggaagcaaccccagagcaggcagacaucagaggccagagugccuagcccgacaugaagcu

SEQ ID NO: 77781 - RNA, 64 nt, Homo Sapiens
uguuuguugcacuaaaaugaggauccagggcagcaggccagagaaagcaaaggugcacuccaga

SEQ ID NO: 77782 - RNA, 64 nt, Homo Sapiens
uggagugggaagggagcauugcagccuaagaagaaggccagagagggaaaaggcaggugcuuuu

SEQ ID NO: 77783 - RNA, 64 nt, Homo Sapiens
uggagggaagaccugaaagagaggacugguucugaggccagaaaggugugaggagagaggagga

SEQ ID NO: 77784 - RNA, 64 nt, Homo Sapiens
gagacuccgucucaaaacaagcacuccagccuggaggccagaguugagccaagacuacgccacu

SEQ ID NO: 77785 - RNA, 64 nt, Homo Sapiens
aucgcuugaaccugggaggugcuucuggaggcugaggccagagaggcaugugccuguaauccca

SEQ ID NO: 77786 - RNA, 62 nt, Homo Sapiens
uacugaaaccaaaauauauuugcuucaucugccccuacuaaccaucccccugccugcugccu

SEQ ID NO: 77787 - RNA, 62 nt, Homo Sapiens
ugcccugcgugcugguuccuucagaccccuaacccuacuaaccagcaggcucaucucaccuc

SEQ ID NO: 77788 - RNA, 64 nt, Homo Sapiens; identical to SEQ ID NO: 77753

SEQ ID NO: 77789 - RNA, 64 nt, Homo Sapiens; identical to SEQ ID NO: 77754

SEQ ID NO: 77790 - RNA, 64 nt, Homo Sapiens; identical to SEQ ID NO: 77755

SEQ ID NO: 77791 - RNA, 64 nt, Homo Sapiens; identical to SEQ ID NO: 77756

SEQ ID NO: 77792 - RNA, 64 nt, Homo Sapiens; identical to SEQ ID NO: 77757

SEQ ID NO: 77793 - RNA, 64 nt, Homo Sapiens; identical to SEQ ID NO: 77758

SEQ ID NO: 77794 - RNA, 64 nt, Homo Sapiens; identical to SEQ ID NO: 77759

SEQ ID NO: 77795 - RNA, 64 nt, Homo Sapiens; identical to SEQ ID NO: 77760

SEQ ID NO: 77796 - RNA, 64 nt, Homo Sapiens; identical to SEQ ID NO: 77761

SEQ ID NO: 77797 - RNA, 64 nt, Homo Sapiens; identical to SEQ ID NO: 77762

SEQ ID NO: 77798 - RNA, 64 nt, Homo Sapiens; identical to SEQ ID NO: 77763

SEQ ID NO: 77799 - RNA, 64 nt, Homo Sapiens; identical to SEQ ID NO: 77764

SEQ ID NO: 77800 - RNA, 64 nt, Homo Sapiens; identical to SEQ ID NO: 77765

SEQ ID NO: 77801 - RNA, 64 nt, Homo Sapiens; identical to SEQ ID NO: 77766

SEQ ID NO: 77802 - RNA, 64 nt, Homo Sapiens; identical to SEQ ID NO: 77767

SEQ ID NO: 77803 - RNA, 64 nt, Homo Sapiens; identical to SEQ ID NO: 77768

SEQ ID NO: 77804 - RNA, 64 nt, Homo Sapiens; identical to SEQ ID NO: 77769

SEQ ID NO: 77805 - RNA, 64 nt, Homo Sapiens; identical to SEQ ID NO: 77770

SEQ ID NO: 77806 - RNA, 64 nt, Homo Sapiens; identical to SEQ ID NO: 77771

SEQ ID NO: 77807 - RNA, 64 nt, Homo Sapiens; identical to SEQ ID NO: 77772

SEQ ID NO: 77808 - RNA, 64 nt, Homo Sapiens; identical to SEQ ID NO: 77773

SEQ ID NO: 77809 - RNA, 64 nt, Homo Sapiens; identical to SEQ ID NO: 77774

SEQ ID NO: 77810 - RNA, 64 nt, Homo Sapiens; identical to SEQ ID NO: 77775

SEQ ID NO: 77811 - RNA, 64 nt, Homo Sapiens; identical to SEQ ID NO: 77776

SEQ ID NO: 77812 - RNA, 64 nt, Homo Sapiens; identical to SEQ ID NO: 77777

SEQ ID NO: 77813 - RNA, 64 nt, Homo Sapiens; identical to SEQ ID NO: 77778

SEQ ID NO: 77814 - RNA, 64 nt, Homo Sapiens; identical to SEQ ID NO: 77779

SEQ ID NO: 77815 - RNA, 64 nt, Homo Sapiens; identical to SEQ ID NO: 77780

SEQ ID NO: 77816 - RNA, 64 nt, Homo Sapiens; identical to SEQ ID NO: 77781

SEQ ID NO: 77817 - RNA, 64 nt, Homo Sapiens; identical to SEQ ID NO: 77782

SEQ ID NO: 77818 - RNA, 64 nt, Homo Sapiens; identical to SEQ ID NO: 77783

SEQ ID NO: 77819 - RNA, 64 nt, Homo Sapiens; identical to SEQ ID NO: 77784

SEQ ID NO: 77820 - RNA, 64 nt, Homo Sapiens; identical to SEQ ID NO: 77785

SEQ ID NO: 77821 - RNA, 62 nt, Homo Sapiens; identical to SEQ ID NO: 77786

SEQ ID NO: 77822 - RNA, 62 nt, Homo Sapiens; identical to SEQ ID NO: 77787

SEQ ID NO: 77823 - RNA, 64 nt, Homo Sapiens; identical to SEQ ID NO: 77753

SEQ ID NO: 77824 - RNA, 64 nt, Homo Sapiens; identical to SEQ ID NO: 77754

SEQ ID NO: 77825 - RNA, 64 nt, Homo Sapiens; identical to SEQ ID NO: 77755

SEQ ID NO: 77826 - RNA, 64 nt, Homo Sapiens; identical to SEQ ID NO: 77756

SEQ ID NO: 77827 - RNA, 64 nt, Homo Sapiens; identical to SEQ ID NO: 77757

SEQ ID NO: 77828 - RNA, 64 nt, Homo Sapiens; identical to SEQ ID NO: 77758

SEQ ID NO: 77829 - RNA, 64 nt, Homo Sapiens; identical to SEQ ID NO: 77759

SEQ ID NO: 77830 - RNA, 64 nt, Homo Sapiens; identical to SEQ ID NO: 77760

SEQ ID NO: 77831 - RNA, 64 nt, Homo Sapiens; identical to SEQ ID NO: 77761

SEQ ID NO: 77832 - RNA, 64 nt, Homo Sapiens; identical to SEQ ID NO: 77762

SEQ ID NO: 77833 - RNA, 64 nt, Homo Sapiens; identical to SEQ ID NO: 77763

SEQ ID NO: 77834 - RNA, 64 nt, Homo Sapiens; identical to SEQ ID NO: 77764

SEQ ID NO: 77835 - RNA, 64 nt, Homo Sapiens; identical to SEQ ID NO: 77765

SEQ ID NO: 77836 - RNA, 64 nt, Homo Sapiens; identical to SEQ ID NO: 77766

SEQ ID NO: 77837 - RNA, 64 nt, Homo Sapiens; identical to SEQ ID NO: 77767

SEQ ID NO: 77838 - RNA, 64 nt, Homo Sapiens; identical to SEQ ID NO: 77768

SEQ ID NO: 77839 - RNA, 64 nt, Homo Sapiens; identical to SEQ ID NO: 77769

SEQ ID NO: 77840 - RNA, 64 nt, Homo Sapiens; identical to SEQ ID NO: 77770

SEQ ID NO: 77841 - RNA, 64 nt, Homo Sapiens; identical to SEQ ID NO: 77771

SEQ ID NO: 77842 - RNA, 64 nt, Homo Sapiens; identical to SEQ ID NO: 77772

SEQ ID NO: 77843 - RNA, 64 nt, Homo Sapiens; identical to SEQ ID NO: 77773

SEQ ID NO: 77844 - RNA, 64 nt, Homo Sapiens; identical to SEQ ID NO: 77774

SEQ ID NO: 77845 - RNA, 64 nt, Homo Sapiens; identical to SEQ ID NO: 77775

SEQ ID NO: 77846 - RNA, 64 nt, Homo Sapiens; identical to SEQ ID NO: 77776

SEQ ID NO: 77847 - RNA, 64 nt, Homo Sapiens; identical to SEQ ID NO: 77777

SEQ ID NO: 77848 - RNA, 64 nt, Homo Sapiens; identical to SEQ ID NO: 77778

SEQ ID NO: 77849 - RNA, 64 nt, Homo Sapiens; identical to SEQ ID NO: 77779

SEQ ID NO: 77850 - RNA, 64 nt, Homo Sapiens; identical to SEQ ID NO: 77780

SEQ ID NO: 77851 - RNA, 64 nt, Homo Sapiens; identical to SEQ ID NO: 77781

SEQ ID NO: 77852 - RNA, 64 nt, Homo Sapiens; identical to SEQ ID NO: 77782

SEQ ID NO: 77853 - RNA, 64 nt, Homo Sapiens; identical to SEQ ID NO: 77783

SEQ ID NO: 77854 - RNA, 64 nt, Homo Sapiens; identical to SEQ ID NO: 77784

SEQ ID NO: 77855 - RNA, 64 nt, Homo Sapiens; identical to SEQ ID NO: 77785

SEQ ID NO: 77856 - RNA, 62 nt, Homo Sapiens; identical to SEQ ID NO: 77786

SEQ ID NO: 77857 - RNA, 62 nt, Homo Sapiens; identical to SEQ ID NO: 77787

SEQ ID NO: 77858 - RNA, 64 nt, Homo Sapiens
cagaacuuuccagcucccccucaucaugccuccuccuuccuaccugccuccccucugcuggugc

SEQ ID NO: 77859 - RNA, 64 nt, Homo Sapiens
cucucucaucuuacuuuuucuucucagauuucucccuuccuagaacauucucucuguuuagcac

SEQ ID NO: 77860 - RNA, 64 nt, Homo Sapiens
uguuguugcuguuggucauuuggccugccuuuucccuuccuauuucacuuugccucccaucaca

SEQ ID NO: 77861 - RNA, 64 nt, Homo Sapiens
aaauaaagucaucuaacuauuaaaaaaaaaacacccuuccuaacccuucuuuucuuaaaauucc

SEQ ID NO: 77862 - RNA, 64 nt, Homo Sapiens
ucucaauagucuuuaaacccauaaucucucaauaccuuccuauugucugcucugaugaaaccca

SEQ ID NO: 77863 - RNA, 64 nt, Homo Sapiens
ucucaauagucuuuaagcccccagucucucaauaccuuccuauuuaaguccgcucugaugaaac

SEQ ID NO: 77864 - RNA, 64 nt, Homo Sapiens
acuuacgcuucaaguuucauaaauauugaacauaccuuccuaccauucuaaaauucagcuuuaa

SEQ ID NO: 77865 - RNA, 64 nt, Homo Sapiens
gucaugguuuguuauagagagcaagacaagucauccuuccuacuaaugugugugcucuauugau

SEQ ID NO: 77866 - RNA, 64 nt, Homo Sapiens
acuugaugcaugugguuugguucccuucuugcauccuuccuauauccucccuuuccuuccuaau

SEQ ID NO: 77867 - RNA, 62 nt, Homo Sapiens
uucccuucuugcauccuuccacuccucccuuuccuuccuaauugccccagaaugccaacuaa

SEQ ID NO: 77868 - RNA, 64 nt, Homo Sapiens
caucuuugauuuuucuuuagcuucaucaguccuuccuuccuaaucucuaauccccugaagccua

SEQ ID NO: 77869 - RNA, 64 nt, Homo Sapiens
gguacuuagucuguguccaugugauccaaaauuaccuuccuauugcauuuccuacuccuuugcu

SEQ ID NO: 77870 - RNA, 64 nt, Homo Sapiens
auuuacucgcuuuguuuaauggauuccaccccugccuuccuaggugaccuuggacaaauucucg

SEQ ID NO: 77871 - RNA, 64 nt, Homo Sapiens
auauauguccucaaaauccccauaaauauccaucccuuccuagauggcauuaacuuucauuuua

SEQ ID NO: 77872 - RNA, 64 nt, Homo Sapiens
ugcccucugggcuccuuugguaacagauggagcuccuuccuagcuagggagaccuuaugagaag

SEQ ID NO: 77873 - RNA, 64 nt, Homo Sapiens
ucuuuucuuccuuccucuucucucuuccuucccuccuuccuacucuuccuacuuuccuucauuc

SEQ ID NO: 77874 - RNA, 64 nt, Homo Sapiens
uuccuucauucucucuuccuugguucccuucuuuccuuccuacuucuugucucuucagaguaaa

SEQ ID NO: 77875 - RNA, 64 nt, Homo Sapiens
ggcauuuucuuuaacuuccauggcugccucuuugccuuccuagguuguagauugagccauacuc

SEQ ID NO: 77876 - RNA, 64 nt, Homo Sapiens
acuuagcccccucugacaauagucaguccauuugccuuccuagucuggguaccuuguuccaggc

SEQ ID NO: 77877 - RNA, 60 nt, Homo Sapiens
auagccaccgucuacagauggcuuaguuaagucauccacagcccaagggcggggcuaugc

SEQ ID NO: 77878 - RNA, 60 nt, Homo Sapiens
caaauuuaauuuugcagauuauuuuagucugucauccagaaaaugugucagcaugcauag

SEQ ID NO: 77879 - RNA, 60 nt, Homo Sapiens
gcaucuucagccucgugcuccgucaugaacgucauccacacucacggagaaggcggcgcc

SEQ ID NO: 77880 - RNA, 60 nt, Homo Sapiens
gcuacaucgccaaccagaucuuucgugaaggucauccagguucaagcacgagaugcagca

SEQ ID NO: 77881 - RNA, 64 nt, Homo Sapiens; identical to SEQ ID NO: 72197

SEQ ID NO: 77882 - RNA, 64 nt, Homo Sapiens; identical to SEQ ID NO: 72198

SEQ ID NO: 77883 - RNA, 64 nt, Homo Sapiens; identical to SEQ ID NO: 72199

SEQ ID NO: 77884 - RNA, 64 nt, Homo Sapiens; identical to SEQ ID NO: 72200

SEQ ID NO: 77885 - RNA, 64 nt, Homo Sapiens; identical to SEQ ID NO: 72201

SEQ ID NO: 77886 - RNA, 64 nt, Homo Sapiens; identical to SEQ ID NO: 72202

SEQ ID NO: 77887 - RNA, 64 nt, Homo Sapiens
ugagauauuuugcucacuaucccuccccacuugcuucccugauaugugcucugagcuucccuga

SEQ ID NO: 77888 - RNA, 64 nt, Homo Sapiens
cuccccacuugcuucccugauaugugcucugagcuucccugaaccaggaucugccuauuacugc

SEQ ID NO: 77889 - RNA, 64 nt, Homo Sapiens
uagucuccagcccagcuuuuccccaaccaguggguucccugaguccagagccuaugccccuaga

SEQ ID NO: 77890 - RNA, 64 nt, Homo Sapiens
ccuggggcggcccaccccugccaagcuugccaacuucccugagguggaugucuuugugcuauua

SEQ ID NO: 77891 - RNA, 64 nt, Homo Sapiens
guuguuuggcugauggaauaaagggcuuagggacuucccugaggccucuggacccaucugucuu

SEQ ID NO: 77892 - RNA, 64 nt, Homo Sapiens
aaagccugaaccaugccugccaugucuugucuuauucccugaggcucccuugacucaggacugu

SEQ ID NO: 77893 - RNA, 64 nt, Homo Sapiens
gcagacugccuucuuucacccuguccugauagacuucccugaucuagauauccuucgucaugac

SEQ ID NO: 77894 - RNA, 64 nt, Homo Sapiens
auuuggcccaccuccugugucgggugacugacuguucccugaugcgcaugcccucagccacaag

SEQ ID NO: 77895 - RNA, 64 nt, Homo Sapiens
caggaaaaugaacauggacuacuuugcuaccaucuucccugaagaggaagggauucggcuuuca

SEQ ID NO: 77896 - RNA, 64 nt, Homo Sapiens
ccuaggccgucacaccacaccaagaacauauuguuucccugaccccagcagguguagggccuga

SEQ ID NO: 77897 - RNA, 64 nt, Homo Sapiens
cucugagcuuaugaucacacuuucaaaugaccauuucccugaugauuugaaucuguuuucuuag

SEQ ID NO: 77898 - RNA, 64 nt, Homo Sapiens
cucugcaaagaguagcucaucaggcauaccuuaguucccugaucucauuugggugggguuuccc

SEQ ID NO: 77899 - RNA, 64 nt, Homo Sapiens
ggugggaggcggguggguggagugucugggaaguuucccugaaagccccucaccccugugugcu

SEQ ID NO: 77900 - RNA, 64 nt, Homo Sapiens
ggagcuaaaucccaccagccauuagaaauucuacuucccugacugggaagcagcuuccugggag

SEQ ID NO: 77901 - RNA, 64 nt, Homo Sapiens
cugcccccugcuugaauugaguggugccauuugauucccugacagcagcaagcaaaaguugucu

SEQ ID NO: 77902 - RNA, 64 nt, Homo Sapiens
uuugucuugagcaggcaccaucagaaguuguugguucccugauuaaggcagccagaccucuuuu

SEQ ID NO: 77903 - RNA, 64 nt, Homo Sapiens
agccuugaaggggguugaggaccucuccuucucuuucccugaaacccccagaggaacugcuccc

SEQ ID NO: 77904 - RNA, 64 nt, Homo Sapiens
gaaccaaagcgaauuuuaaaauauauauauauauuucccugaaguaaaagauaaauauuauauu

SEQ ID NO: 77905 - RNA, 64 nt, Homo Sapiens
ugggagauguggaaaagccacacagaguggacuguucccugaggacucaggcccaaagccucga

SEQ ID NO: 77906 - RNA, 64 nt, Homo Sapiens
cuucugaagguugcugucuggcugagaacaccucuucccugagguguccaucuuuagcgcaugg

SEQ ID NO: 77907 - RNA, 64 nt, Homo Sapiens
ggcuugaauguguuugcccaaaagaaaaaggaacuucccugaguaucuacaagcuucaguaacu

SEQ ID NO: 77908 - RNA, 64 nt, Homo Sapiens
ucugcagccauggcuuugcaagaacugcaccagcuucccugauggaaaucgaggaggcgagacu

SEQ ID NO: 77909 - RNA, 64 nt, Homo Sapiens
ccugggagccucacguauuuugcgaaaagcgagguucccugaucccaacuauugccugggaucu

SEQ ID NO: 77910 - RNA, 64 nt, Homo Sapiens
caucugcugguagcaggcugggacagucccuuccuucccugaaacccugcucuauugcaauucc

SEQ ID NO: 77911 - RNA, 64 nt, Homo Sapiens
ucucugacuuguccuaggccgauuucucuauggcuucccugagaaaggugaggcccaaaggaga

SEQ ID NO: 77912 - RNA, 64 nt, Homo Sapiens
aaccaagaacauguucuauggaaacaugccccucuucccugaauacagggcuucugauuacuca

SEQ ID NO: 77913 - RNA, 64 nt, Homo Sapiens
acagggaagcaccuggcucauguggagccacacauucccugaccauaucucaggguaggaacca

SEQ ID NO: 77914 - RNA, 64 nt, Homo Sapiens
cgggagguguccucgccuggccagaaacguguguuucccugaugcugccuucagccuccucacu

SEQ ID NO: 77915 - RNA, 64 nt, Homo Sapiens
caguucgucccacacauccuagcauuucuuaugguucccugagugguuucuccuguuuggugaa

SEQ ID NO: 77916 - RNA, 64 nt, Homo Sapiens
uacuguguugauuucuuuaaugguuugacuuuuuuucccugagggugagggaugggugggaaga

SEQ ID NO: 77917 - RNA, 64 nt, Homo Sapiens
gguggucuugugaguugugcagggugaagaccgcuucccugagacaggggcaguggugcugaug

SEQ ID NO: 77918 - RNA, 64 nt, Homo Sapiens
acccagagaggaaucagacuaccugcauccguaguucccugaaaccuggaagcuguguccuugc

SEQ ID NO: 77919 - RNA, 64 nt, Homo Sapiens
caccaggaauguuaaagucaggaaugcggccgcauucccugaguagaucagugcuugaguuugg

SEQ ID NO: 77920 - RNA, 64 nt, Homo Sapiens
ccagcuuucugcuuccugaguuuaauuuuaugcuuucccugauucuccucuccucucugguagg

SEQ ID NO: 77921 - RNA, 64 nt, Homo Sapiens
uucucuaguuagaugucagucuucuccugccucauucccugacugguucaugaggacuuugccu

SEQ ID NO: 77922 - RNA, 64 nt, Homo Sapiens
ccucgccuccuucagccuccuccucccucaucuguucccugaugucacauucccugugcaaucu

SEQ ID NO: 77923 - RNA, 64 nt, Homo Sapiens
ccaccaugugccagguggcaucugccuuacugccuucccugaggagcugggacaugcugggcag

SEQ ID NO: 77924 - RNA, 64 nt, Homo Sapiens
gcuggauuccgaaaaggccgggaagccagucuccuucccugaagcaagcccaggagaagacucu

SEQ ID NO: 77925 - RNA, 64 nt, Homo Sapiens
guucacugguucggggcugacuuugagaucuuuguucccugaggugccaggcaggcaacuuuag

SEQ ID NO: 77926 - RNA, 64 nt, Homo Sapiens
cacacccucaggccgagggugcagacugaugcucuucccugauggagacccugagaucuucccc

SEQ ID NO: 77927 - RNA, 64 nt, Homo Sapiens
aguuaauccccaccgcuuucagugguagaaagaauucccugagugggccaggcuggugcccucc

SEQ ID NO: 77928 - RNA, 64 nt, Homo Sapiens
acagauaaugucuuuuaaucuagcuccgcucauguucccugagccgagccacuuguaggcacau

SEQ ID NO: 77929 - RNA, 64 nt, Homo Sapiens
cgggagucaaaaucagcaucgcuauaauaaagauuucccugagaaucagggucaauuacagaua

SEQ ID NO: 77930 - RNA, 64 nt, Homo Sapiens
gcuuccgucuaucaaaaagcccccuuggcccagguucccugagcugugggauucugcacuggug

SEQ ID NO: 77931 - RNA, 64 nt, Homo Sapiens
ccugagcugugggauucugcacuggugcuuuggauucccugauauguuccuucaaaucugcuga

SEQ ID NO: 77932 - RNA, 64 nt, Homo Sapiens
uuucucaguucaggaacauuugagccuuugaaaguucccugaagagaagaaacugugaaguaua

SEQ ID NO: 77933 - RNA, 64 nt, Homo Sapiens
uuuuacugaggggcugugugccauccccuccccuuucccugauccccuggacaauugaggaugc

SEQ ID NO: 77934 - RNA, 64 nt, Homo Sapiens
uccugucuaaaaugucaccccuucccugagaggcuucccugaccagucccugcucaggugucac

SEQ ID NO: 77935 - RNA, 64 nt, Homo Sapiens
ggcuucccugaccuccugucgcucaggugucaccuucccugagacucacuuuauucaagucccu

SEQ ID NO: 77936 - RNA, 64 nt, Homo Sapiens
gcagugggagaggcccucugugaaucaugggcauuucccugagauguuguugauacagcauaag

SEQ ID NO: 77937 - RNA, 64 nt, Homo Sapiens
ccacacaggcucagcucucuccaccacccagcucuucccugaccuucacgaagggauggcucuc

SEQ ID NO: 77938 - RNA, 64 nt, Homo Sapiens
gaaaggagccugagugauucucuuuucuucuuguuucccugauuaugaugagcuuccauuguuc

SEQ ID NO: 77939 - RNA, 64 nt, Homo Sapiens
ggcucccucucccaccugucugcauagaaaggcagaauuagacauagcaugcuuuggaaaagca

SEQ ID NO: 77940 - RNA, 64 nt, Homo Sapiens
gaaucuggccaacaacuuugguucauccuuuagugaauuagaggauuuggcuacccugaguaua

SEQ ID NO: 77941 - RNA, 64 nt, Homo Sapiens
aauguugaauuucugaaugauaaguaacaagauagaauuagaaauaaagaauaauuuggaguaa

SEQ ID NO: 77942 - RNA, 64 nt, Homo Sapiens
gcccuggaggucacucacaaugaugagugaucaagaauuagaguggggaacaggagagaggcaa

SEQ ID NO: 77943 - RNA, 64 nt, Homo Sapiens
auguuauucaugcuauaaagaguaaacguuugaugaauuagaagagaugcucuuuuccaagcua

SEQ ID NO: 77944 - RNA, 64 nt, Homo Sapiens
aucuguuacuguuuaauuucaauucuucuggugagaauuagaaaugaaauauuuuuuauucauu

SEQ ID NO: 77945 - RNA, 64 nt, Homo Sapiens
acugcaagaacuguuuuuacccauggcauggguggaauuagaguggaauaaggauguuaacuug

SEQ ID NO: 77946 - RNA, 64 nt, Homo Sapiens
gcacaugcacgccgggauuccucugcugccauuugaauuagaagaaaauaauuuauaugcaugc

SEQ ID NO: 77947 - RNA, 64 nt, Homo Sapiens
aaaacuugaaaaucagcuuuggccaucuaccugagaauuagaaagucugauuuuuggaauuaga

SEQ ID NO: 77948 - RNA, 64 nt, Homo Sapiens
ccaucuaccugagaauuagaaagucugauuuuuggaauuagaaaucaugauuguaggcugggca

SEQ ID NO: 77949 - RNA, 64 nt, Homo Sapiens
agaucccccgucccccagucaaaagaaaaacaaugaauuagaaguaagcuugugcacaauguuu

SEQ ID NO: 77950 - RNA, 64 nt, Homo Sapiens
ucuccccauucugcuagcaaguaaaugugauuaggaauuagacccaggccauugggccuaagug

SEQ ID NO: 77951 - RNA, 64 nt, Homo Sapiens
auuagaaaaaucaccauuuuaauaaaucuagaaggaauuagagguuucuuuuuugaagaagucu

SEQ ID NO: 77952 - RNA, 64 nt, Homo Sapiens
gaaauaggaaaugauuuuccauacagcuguugaagaauuagaggugaaugugaggucacuagua

SEQ ID NO: 77953 - RNA, 64 nt, Homo Sapiens
uuggucuaaaauauuuguaauguauauuaaaagguucaaaaauauuuguauaaaucuaaguuau

SEQ ID NO: 77954 - RNA, 64 nt, Homo Sapiens
acacaugauuuugauuaugcuacaugauauauguuucaaaaagaauuagcauagaaauccuggu

SEQ ID NO: 77955 - RNA, 64 nt, Homo Sapiens
auccuggucuccuagccaaaaaaaucaaaggauuuucaaaaaaacgaaucuguauguugaggca

SEQ ID NO: 77956 - RNA, 64 nt, Homo Sapiens
cagauuuaacccagaaccagggaguuuuaaauucuucaaaaacucuaaaccugauacgaaugca

SEQ ID NO: 77957 - RNA, 64 nt, Homo Sapiens
aaagaaaugccagaauacaagcaacuaccuaugguucaaaaaauagagcucaguagaauccugg

SEQ ID NO: 77958 - RNA, 64 nt, Homo Sapiens
caauuauaggaguauuuauguaacuaucuuaugcuucaaaaaacaaaaguauuugugugcaugu

SEQ ID NO: 77959 - RNA, 64 nt, Homo Sapiens
gugcaucauaguucuacaguuuguuuuuguuuucuucaaaaaagcuguaagagaauuaucugca

SEQ ID NO: 77960 - RNA, 64 nt, Homo Sapiens
auauuuaauauuauauuacauucauugaaaucuguucaaaaacagauuaagacaaacauuuaug

SEQ ID NO: 77961 - RNA, 64 nt, Homo Sapiens
auuaaguagaacugcccuugccggaauagugaucuucaaaaaacccuugcuuuuaggggaggga

SEQ ID NO: 77962 - RNA, 64 nt, Homo Sapiens
guaacaaaauauuuuguagauuacauauugauuuuucaaaaauuaaaaauguauuucaaacuau

SEQ ID NO: 77963 - RNA, 64 nt, Homo Sapiens
uaaaaaucaggagauuccuuuuuuuuuacaaaguuucaaaaacucucagacauauaguuuuuuu

SEQ ID NO: 77964 - RNA, 64 nt, Homo Sapiens
cacuuuuccaaauggcgacauccccaacugaagcuucaaaaagcuccagggaccccuauccuga

SEQ ID NO: 77965 - RNA, 64 nt, Homo Sapiens
ugaaauauaaggcacguuuuauggaggccuuauuuucaaaaauggugagagaggaaaaaaaagu

SEQ ID NO: 77966 - RNA, 64 nt, Homo Sapiens
cccuuucugguugugagagauguguaggaacacauucaaaaagcugcuggcuuuuuugaagacu

SEQ ID NO: 77967 - RNA, 64 nt, Homo Sapiens
uggaauucuguucauuuguuagcaguucaccuauuucaaaaauuaaauguauaccuguaacugc

SEQ ID NO: 77968 - RNA, 64 nt, Homo Sapiens
uacaaaauaaaguuacauugguuuauauuuucaauucaaaaaugcuuuuuauuuuuuaauuauu

SEQ ID NO: 77969 - RNA, 64 nt, Homo Sapiens
uacaaaguauuuuucccaaagauagcuuuacuauuucaaaaauugucaaauuaaugcaugcucc

SEQ ID NO: 77970 - RNA, 64 nt, Homo Sapiens
aaaucacaguuuauuuaaauaauuuuaaugacuuuucaaaaacaauuuauugaugcaaaaagca

SEQ ID NO: 77971 - RNA, 61 nt, Homo Sapiens
acauuuuuauuaguggauagcguuguuggaauucaaaaaacagacaauauugccauagaaa

SEQ ID NO: 77972 - RNA, 64 nt, Homo Sapiens
agucuugacuaaugguucccgguuuagcugaagauucaaaaaaaaaaaaaaaagcuuuaugcua

SEQ ID NO: 77973 - RNA, 64 nt, Homo Sapiens
ugcaaaggaauugcuuugcaggaaauauuuaauuuucaaaaacauaaugauuaauguuccaauu

SEQ ID NO: 77974 - RNA, 64 nt, Homo Sapiens
aagaggcccuaagacugguagaaauuaaaaggauuucaaaaacuuucuauuccuuucuuaaacc

SEQ ID NO: 77975 - RNA, 64 nt, Homo Sapiens
gaauuaaaaguuauucaagaaaaugaacaugcucuucaaaaagaugcacuuaguauuaaguuga

SEQ ID NO: 77976 - RNA, 64 nt, Homo Sapiens
auaauucuaaaauaaaauauuggcacaaagagauuucaaaaauaucacugcauccuauagaaga

SEQ ID NO: 77977 - RNA, 64 nt, Homo Sapiens
ucaaauuagccucaugaagauuccagucuuuaauuucaaaaacuccucugucagcaugaaagua

SEQ ID NO: 77978 - RNA, 64 nt, Homo Sapiens
aagcauggacuccccaguauaaaacuuuuuauaguucaaaaauuauagcaauaauuuugcacug

SEQ ID NO: 77979 - RNA, 64 nt, Homo Sapiens
aaaaaaaaaaaaacuucagugagcgagacuugguuucaaaaaaauacacuccagccuggcgaca

SEQ ID NO: 77980 - RNA, 64 nt, Homo Sapiens
cugaccaaaacaaacaaacacacuaugaagauguuucaaaaaauauucaguuuucaggaugaua

SEQ ID NO: 77981 - RNA, 64 nt, Homo Sapiens
acaaauagaacuaucauaugcaacauggacuuucuucaaaaauuuagagcagccauguggagaa

SEQ ID NO: 77982 - RNA, 64 nt, Homo Sapiens
caaaaaauaugacagccguguuaaggugacuauuuucaaaaagagagauaucaucucauccuaa

SEQ ID NO: 77983 - RNA, 64 nt, Homo Sapiens
uguuuauaucacauagacauuucuuuauuuauuuuucaaaaaaauuuuaaguuaauugaacuuu

SEQ ID NO: 77984 - RNA, 64 nt, Homo Sapiens
ucagagauauuacucuuugauauugcuaaaacauuucaaaaaacaguuuagcaguacaagcuuc

SEQ ID NO: 77985 - RNA, 64 nt, Homo Sapiens
auagcaguaguagaaguuuuguggguuaaauguuuucaaaaauuugcugucuuaccucuugcua

SEQ ID NO: 77986 - RNA, 64 nt, Homo Sapiens
aaaaauaaaagaaaaaggaaguaaauaauccuccuucaaaaaauguacuucuuuuagaccacca

SEQ ID NO: 77987 - RNA, 64 nt, Homo Sapiens
aauugaaaacauguaaccacaagaaguugucauuuucaaaaacuucuauauagguggaaaacaa

SEQ ID NO: 77988 - RNA, 64 nt, Homo Sapiens
uuauuuugcuaaacaguuuacuaacacauuacauuucaaaaacuauuuugguaccuuucaaaua

SEQ ID NO: 77989 - RNA, 64 nt, Homo Sapiens
ucugcucuugucagaacauugggacaauuggucguucaaaaacauucauccucuuacugcaagu

SEQ ID NO: 77990 - RNA, 64 nt, Homo Sapiens
gaaagaaaaaaaugguguuugacguugauggaaauucaaaaauauauauggaacugaaacauua

SEQ ID NO: 77991 - RNA, 64 nt, Homo Sapiens
aguguuaacaaauugcugagaucccacggagucuuucaaaaaucucuguagaguuagucuucuc

SEQ ID NO: 77992 - RNA, 64 nt, Homo Sapiens
cagcauaaccuuggcuugauuaaggaauucuacuuucaaaaauuaaucugauaauaguaacaag

SEQ ID NO: 77993 - RNA, 64 nt, Homo Sapiens
ucaacaaaagauugguccuuggugaaauaaacuuuucaaaaaugaauguucuuuucaaaaaaua

SEQ ID NO: 77994 - RNA, 64 nt, Homo Sapiens
uggugaaauaaacuuuucaaaaaugaauguucuuuucaaaaaauaaaguagaaaaaugcacuua

SEQ ID NO: 77995 - RNA, 64 nt, Homo Sapiens
aaauuagccgggcaugauggcaucucuacuaaaauucaaaaacaugggcaucauagcaagaccu

SEQ ID NO: 77996 - RNA, 64 nt, Homo Sapiens
ucucucccaggaccucggauuucuaagugggacauucaaaaaaccaacucccucucugugcauu

SEQ ID NO: 77997 - RNA, 64 nt, Homo Sapiens
cuguuaauguauacuacuggaaagaaaauuuuuuuucaaaaaugacauaacucugcugaaugua

SEQ ID NO: 77998 - RNA, 64 nt, Homo Sapiens
aaaaucauugucaaaauuaauugcagucuaaaacuucaaaaacugauuauggccuuuuuaagua

SEQ ID NO: 77999 - RNA, 64 nt, Homo Sapiens
auacuaccaacccugaacgucucaggacaaauaauucaaaaaagagaucuacauuuucuggaaa

SEQ ID NO: 78000 - RNA, 64 nt, Homo Sapiens
aauauuucugcaugcuauugcaagugguaagguuuucaaaaagcuguuuucuaguuauugcuag

SEQ ID NO: 78001 - RNA, 64 nt, Homo Sapiens
cagaaaugccaaauugaugguuaauuguugcugcuucaaaaauaaguauaaaauuaauauguaa

SEQ ID NO: 78002 - RNA, 64 nt, Homo Sapiens
guauuaccauuaaagucauuaguauaauauugcuuucaaaaagaaaugguagacaaaacuauaa

SEQ ID NO: 78003 - RNA, 64 nt, Homo Sapiens
caugcaacacaccuggagcagguuauuuugaggauucaaaaagguuaaagaggauccaccccag

SEQ ID NO: 78004 - RNA, 64 nt, Homo Sapiens
agaaaguauacauuuuugcuuagaacuuuaaaaguucaaaaauauuuugauucaaagaccaaac

SEQ ID NO: 78005 - RNA, 64 nt, Homo Sapiens
ucugcuuuugcaucuuugggucucaaaauacguguucaaaaauuccuaugugaguuucagaaau

SEQ ID NO: 78006 - RNA, 64 nt, Homo Sapiens
cagaauuuauagaauaauuucauuuuacaguaucuucaaaaauacuagugauauggcaucguug

SEQ ID NO: 78007 - RNA, 64 nt, Homo Sapiens
aauguauguguagauauaacuuaaauauggagcuuucaaaaagcacaaauaggcuggacauggu

SEQ ID NO: 78008 - RNA, 64 nt, Homo Sapiens
gccacugcacuccagccugagugacagagagagauucaaaaaacaaaaaaaaagcaaaaauaua

SEQ ID NO: 78009 - RNA, 64 nt, Homo Sapiens
uugucacaacugcaaacaauaccugaguggaguauucaaaaacuugcuuagaaagaaaacucua

SEQ ID NO: 78010 - RNA, 64 nt, Homo Sapiens
ucaggcgugccaacucuugcaagguaaauagucuuucaaaaauaauucuaaaugcacaccuccu

SEQ ID NO: 78011 - RNA, 64 nt, Homo Sapiens
ucagaaaaguuggccaugguaagaagaugagagauucaaaaauaucauuuaauacuuauuuaaa

SEQ ID NO: 78012 - RNA, 64 nt, Homo Sapiens
uuauuuuuuaaaacacagagaaaagagaggguccuucaaaaaaacaaguuguuaauguuauauu

SEQ ID NO: 78013 - RNA, 64 nt, Homo Sapiens
aaaaacaaaauaguuuuuuaagcuauaguuuguuuucaaaaaggguugcaauuacuggcucuca

SEQ ID NO: 78014 - RNA, 64 nt, Homo Sapiens
augcuauuguuuagacuuuccauuucauuuguacuucaaaaaauaagcugaaccagugucuuua

SEQ ID NO: 78015 - RNA, 64 nt, Homo Sapiens
ucagcagcaauugaaaugcuauggaaacaguaucuucaaaaaaauaguauauuaagacaugcug

SEQ ID NO: 78016 - RNA, 64 nt, Homo Sapiens
ggccaacauggugaaacccggucucuacuaaaaauucaaaaauuaccuaggcgucauggggcau

SEQ ID NO: 78017 - RNA, 64 nt, Homo Sapiens
agaaagcacuuuuuuguaauguuuguuuuaaugguucaaaaaaaaucuuucuuauaaagagcau

SEQ ID NO: 78018 - RNA, 64 nt, Homo Sapiens
gaguugcagagcauauaauaaaacauaaagcuaguucaaaaaacuuugagauagaaauuuucaa

SEQ ID NO: 78019 - RNA, 64 nt, Homo Sapiens
uaaagcuaguucaaaaaacguugagauagaaauuuucaaaaacauauggcucuagaucuuuucu

SEQ ID NO: 78020 - RNA, 64 nt, Homo Sapiens
cuuuaauguacaaguguaaaauaugacuuuccuuuucaaaaauaauacauuauuuuaaucauau

SEQ ID NO: 78021 - RNA, 64 nt, Homo Sapiens
uauuuaaaaucuuugaaagauuuaucaauacccuuucaaaaauaaucaaaucugcuuuucaaag

SEQ ID NO: 78022 - RNA, 64 nt, Homo Sapiens
ccaccccaccccacccuucacaccuggcugauuuuucaaaaaguuuuuuuguagaaacaggguc

SEQ ID NO: 78023 - RNA, 64 nt, Homo Sapiens
aguugaauauuugucugaacauuuuauuucaaaguucaaaaaaacagaggcugcaaaauucauu

SEQ ID NO: 78024 - RNA, 64 nt, Homo Sapiens
uggauuuuauuuuaaugugacuagaugucaccacuucaaaaaaucaauuuguucuuagaaccug

SEQ ID NO: 78025 - RNA, 64 nt, Homo Sapiens
auguacacagaguaucuggagaauaaaacccaaauucaaaaaaaaaaaugauaauuuauuuuua

SEQ ID NO: 78026 - RNA, 64 nt, Homo Sapiens
auaagcacauggguaaaaaugagggugauccuuauucaaaaauaacaucugacuacuauaaaaa

SEQ ID NO: 78027 - RNA, 64 nt, Homo Sapiens
cuuccuuguaauuauacuuaagaucuucaauuucuucaaaaaaugaaggaucaaaauuuuccag

SEQ ID NO: 78028 - RNA, 64 nt, Homo Sapiens
agggaacuauaaccuuaggauuccugaaaagaauuucaaaaaaaaaauaaagacacuguugcca

SEQ ID NO: 78029 - RNA, 64 nt, Homo Sapiens
guccuguuagaauuuccaucuguucagaagaugcuucaaaaauuguguuuuacucauuuuaggc

SEQ ID NO: 78030 - RNA, 64 nt, Homo Sapiens
uugacagggaugcaugugagggguagccuucaguuucaaaaaaacagugagcagucaaguuaau

SEQ ID NO: 78031 - RNA, 64 nt, Homo Sapiens
cuauuauaaauuguaauauauuccccauugugucuucaaaaacguauaaaugaaugacaaagcu

SEQ ID NO: 78032 - RNA, 64 nt, Homo Sapiens
agaaaaggagagaaaguaacuguuuacucaaucauucaaaaaaggccaggcuacacacagaaaa

SEQ ID NO: 78033 - RNA, 64 nt, Homo Sapiens
auuguuauuuagguuaaauauuagccaaacaaccuucaaaaagcagucuuuuacuaccucuggg

SEQ ID NO: 78034 - RNA, 64 nt, Homo Sapiens
aaggcaaaauaaagacuguucugucaaaaacguuuucaaaaaugugcaaccuagaauucuguua

SEQ ID NO: 78035 - RNA, 64 nt, Homo Sapiens
aacaggugcuccaggcuuugauuauagauacgacuucaaaaauaugcuaagacgcuugacuuau

SEQ ID NO: 78036 - RNA, 64 nt, Homo Sapiens
gaauaaagagaagauuugaauuuucaguuucauuuucaaaaacuauuuaccaaaacaaauggag

SEQ ID NO: 78037 - RNA, 64 nt, Homo Sapiens
gcuacacugauguuuuucuuuacuaaggauacuauucaaaaauuaacauuuucaucucaguaag

SEQ ID NO: 78038 - RNA, 64 nt, Homo Sapiens
uuauuuuuuauuaaacaaaaugaaaaagauccuuuucaaaaaggugauccugaaaauaaaacua

SEQ ID NO: 78039 - RNA, 64 nt, Homo Sapiens
ugagcuaucugaaaacuguuauuccuaaguaauguucaaaaaugauaaguaaucuggauaccuu

SEQ ID NO: 78040 - RNA, 64 nt, Homo Sapiens
auuugauuauuuuuuuuaaaaagagaacaggucuuucaaaaagcuaugaauauguguggcagug

SEQ ID NO: 78041 - RNA, 64 nt, Homo Sapiens
gcacaaauuaaaguaguaaacuugaaaacuuuuuuucaaaaaaauauguuuacuauugcucuua

SEQ ID NO: 78042 - RNA, 64 nt, Homo Sapiens
acugguauauucuuaguaacuuuucuaugaacucuucaaaaauggucacagaaugccuuuuaaa

SEQ ID NO: 78043 - RNA, 64 nt, Homo Sapiens
acugguuguuuagagugacugaugaagugcaacuuucaaaaacauuuuugaugacaucaccagc

SEQ ID NO: 78044 - RNA, 64 nt, Homo Sapiens
gacuucacaauuauaauaaauguguggaaaagucuucaaaaaaauuucacaccuugcaaaagga

SEQ ID NO: 78045 - RNA, 64 nt, Homo Sapiens
uaaagaaaagcuguuaccaaucuuacugaaacuguucaaaaacauggaugcagagggacuccuc

SEQ ID NO: 78046 - RNA, 64 nt, Homo Sapiens
cucugcccaaaggcuccuagaucugauaaacaacuucaaaaaaguuucaggauacaaaaucugu

SEQ ID NO: 78047 - RNA, 64 nt, Homo Sapiens
gguuuuuauaaugaaguuguuacagaauuacauuuucaaaaaaaaaguagauuuuucaauguuu

SEQ ID NO: 78048 - RNA, 64 nt, Homo Sapiens
aaaauuccagugucuguauacuuucagagcuggguucaaaaaaacccccaugaaggcagcugag

SEQ ID NO: 78049 - RNA, 64 nt, Homo Sapiens
auaaauuguugaguauuacaucauuuacuugagguucaaaaauaauucauuuuaaauuaaguag

SEQ ID NO: 78050 - RNA, 64 nt, Homo Sapiens
uucacauuucaaauaauaacaauacuuuuuguuuuucaaaaauaaaaugcaauguuauauaaag

SEQ ID NO: 78051 - RNA, 64 nt, Homo Sapiens
ucaucugagcuggaugcaguccuucugugacacauucaaaaauuauguacuguauuuaaaaaaa

SEQ ID NO: 78052 - RNA, 64 nt, Homo Sapiens
ucuucucggggacaacaucuuuucaauuuguuuuuucaaaaauccagagccuauaauuuuuauu

SEQ ID NO: 78053 - RNA, 64 nt, Homo Sapiens
aaaauuuuucauuauuagcucaaguucuuaaaauuucaaaaauucauuaccagcaucugaauuu

SEQ ID NO: 78054 - RNA, 54 nt, Homo Sapiens
uuuugugaaauugcacagauacuguucaaaaagacuucuccagaaagauacuaa

SEQ ID NO: 78055 - RNA, 64 nt, Homo Sapiens
aauuaauuugaccuugaguuaaauauaagaaaaguucaaaaacuaguuaaaacauauguuucaa

SEQ ID NO: 78056 - RNA, 64 nt, Homo Sapiens
uaagaaaaguucaaaaacuaguuaaaacauauguuucaaaaauaguauuuuucuuguaguguua

SEQ ID NO: 78057 - RNA, 64 nt, Homo Sapiens
uugguucaaucugaagaaaggagcaguugaaaguuucaaaaacuugagagagcacuacuugaga

SEQ ID NO: 78058 - RNA, 64 nt, Homo Sapiens
acagcccacuuauccaucugggcuuugaaaauucuucaaaaaacaaacaugcagcugccgacga

SEQ ID NO: 78059 - RNA, 64 nt, Homo Sapiens
auugggaccaaaaaaugcacauaaagauaauauauucaaaaaaucauuaauguaauuccucugg

SEQ ID NO: 78060 - RNA, 64 nt, Homo Sapiens
auccaggguacuccuggacaagcaacacauaaguuucaaaaaauucauauuuuucaaaugaaga

SEQ ID NO: 78061 - RNA, 64 nt, Homo Sapiens
uauccucaaguguagauuucucaguaaagagaacuucaaaaaauaguuguauugucaaccccag

SEQ ID NO: 78062 - RNA, 64 nt, Homo Sapiens
aacaaaacaaaacaaaacaagaccacaauuguucuucaaaaacacccaccaagaaaauguaaaa

SEQ ID NO: 78063 - RNA, 64 nt, Homo Sapiens
ucagggaggaccccugcccuccgcugcuccucuguccugcuagccuuccuccaggaagcacacu

SEQ ID NO: 78064 - RNA, 64 nt, Homo Sapiens
uuggugaccccguggcuuccugucugcuggccucuccugcuacuuaucacuucaccacgaacuc

SEQ ID NO: 78065 - RNA, 64 nt, Homo Sapiens
aacccacagccuugaauaauucaucauuugugcuuccugcuagaagacagaaacuaggguuuag

SEQ ID NO: 78066 - RNA, 64 nt, Homo Sapiens
aauuucuuauuaauuaaucugggccuguuacucauccugcuaucugugaucugugggacugucu

SEQ ID NO: 78067 - RNA, 64 nt, Homo Sapiens
ugcccccagaucccacugggguccauuugggggguccugcuacacuccaccgauccccaaggaa

SEQ ID NO: 78068 - RNA, 64 nt, Homo Sapiens
cagaccagaccguuugccuuuucaaguuuccuaguccugcuacaagaugagcuucuuccguggu

SEQ ID NO: 78069 - RNA, 64 nt, Homo Sapiens
uagauuucuagugacuuguacuuuauuaaauucauccugcuaaugacucauaguuccucuuguu

SEQ ID NO: 78070 - RNA, 64 nt, Homo Sapiens
uuuuuuucuuaagcuuucugccaggagaaaauucuccugcuaacgacuuacuggacuggcaccg

SEQ ID NO: 78071 - RNA, 64 nt, Homo Sapiens
uaacaaacuguccaauuaggagccuuguuacauuuccugcuauuuaacaugcaagagagagaga

SEQ ID NO: 78072 - RNA, 64 nt, Homo Sapiens
aaaagcuuuugcauguguccaaaggcccaaguccuccugcuagggcccaagcagcuuguuuugc

SEQ ID NO: 78073 - RNA, 64 nt, Homo Sapiens
uuguauucagagcucauaaagaugccauuugaucagaugccaaucuuagauguauaauccuuga

SEQ ID NO: 78074 - RNA, 64 nt, Homo Sapiens
ugaucagaugccaauuuguaauguauaauccuugagaugccauugcaauauauagaggucuuag

SEQ ID NO: 78075 - RNA, 64 nt, Homo Sapiens
acuacuuccauaacuaacucagaauggaaauaagagaugccagagaacagaaguaauggauaac

SEQ ID NO: 78076 - RNA, 64 nt, Homo Sapiens
cugccagaaaucuggaaacaacaugaaggccuuuagaugccaguuagagccucuccugcuucua

SEQ ID NO: 78077 - RNA, 64 nt, Homo Sapiens
gauaccucauuaaacuuggcuuagugaagaagagagaugccaaaggaaugaaccaacccuucac

SEQ ID NO: 78078 - RNA, 64 nt, Homo Sapiens
ucagccugggagacuccugccaagcccucauuaaagaugccacccugggcugcccuggcaccua

SEQ ID NO: 78079 - RNA, 64 nt, Homo Sapiens
acacagaguuugggcacacacugcccucccuccgagaugccagaaguuuuuccacagccuugga

SEQ ID NO: 78080 - RNA, 64 nt, Homo Sapiens
agagggacaggccuaaucaacugaaacuccucggagaugccaucucugucucccugggugccag

SEQ ID NO: 78081 - RNA, 64 nt, Homo Sapiens
cacuuauuuuuauuuucagaagacaaaagaaccaagaugccaacuggcugcgaaugcucuaucu

SEQ ID NO: 78082 - RNA, 64 nt, Homo Sapiens
auguuucuuuaauaauuaauuuucaucuucuauaagaugccaugugaagaaguuguggaaaugu

SEQ ID NO: 78083 - RNA, 64 nt, Homo Sapiens
uuccccugugagugacauguuuugaggaaauugaagaugccaucgcagggcuggacucaguaau

SEQ ID NO: 78084 - RNA, 64 nt, Homo Sapiens
aauggggacaugacuucuggcccugcccaaucagagaugccaaaggaaucuguggagacgccag

SEQ ID NO: 78085 - RNA, 64 nt, Homo Sapiens
acuguccugguuuuucacaccaaugaaguauuauagaugccaauccaaaaccucagaauuucag

SEQ ID NO: 78086 - RNA, 64 nt, Homo Sapiens
cccaccucccaagccccaagagguguaccuuuucagaugccauuuuacaggcggaaaugcucca

SEQ ID NO: 78087 - RNA, 64 nt, Homo Sapiens
agacacuacauuacccuaaugcagaugccaaaaaagaugccaacucuuacccucucuuucaauu

SEQ ID NO: 78088 - RNA, 64 nt, Homo Sapiens
aaagaugccaacagacacuaucucuuucaauugcagaugccaaauuugcuucuuuuucuuaccc

SEQ ID NO: 78089 - RNA, 64 nt, Homo Sapiens
acuuggagcugaucuuuacugagcucgccguggcagaugccaugcucaggacguucauguggau

SEQ ID NO: 78090 - RNA, 64 nt, Homo Sapiens
cauaagcuuccugaggccucccuggaagcugagcagaugccagcaccaugcuuccuguacaucc

SEQ ID NO: 78091 - RNA, 64 nt, Homo Sapiens
gggugcugcgcagcaucccuagucucuacccaguagaugccacuagcccuccucucccagugac

SEQ ID NO: 78092 - RNA, 64 nt, Homo Sapiens
ggauguugagcagcaucucuggccuguacccaguagaugccacccaguugugacaauuaaaagu

SEQ ID NO: 78093 - RNA, 64 nt, Homo Sapiens
uuuggucugaguugugacccccccauaguuggugagaugccaaguuccccgcccagcuugccca

SEQ ID NO: 78094 - RNA, 64 nt, Homo Sapiens
gugcccugcaggaccucccucuggaggagaggggagaugccaaggcugcccacacucccagcug

SEQ ID NO: 78095 - RNA, 64 nt, Homo Sapiens
agaccccaaggccagggccuuucccgcugcaucaagaugccaaucccuuugugggcuucaccag

SEQ ID NO: 78096 - RNA, 64 nt, Homo Sapiens
accgagagaaguggcccaaggucacgcaacucugagaugccacauuucauuugaucuuguacac

SEQ ID NO: 78097 - RNA, 64 nt, Homo Sapiens
cugugucggggccauggugcgugcguguggggggagaugccacauccuaagaggcugcgugcag

SEQ ID NO: 78098 - RNA, 64 nt, Homo Sapiens
caagacacagccaggaacccgguaguccaaaggcagaugccagaccagggagcuguagcaagag

SEQ ID NO: 78099 - RNA, 64 nt, Homo Sapiens
ucugucuugacaacuggaaaagaauguuggaaaaagaugccaagguuccuuccuuuggguuacu

SEQ ID NO: 78100 - RNA, 64 nt, Homo Sapiens
aguguucaaaguuguauuuuauacuuuguaaaugagaugccaguauggagaguauuucacaaaa

SEQ ID NO: 78101 - RNA, 64 nt, Homo Sapiens
gaaacuaagaaucuuacuaacagauuguaaaaaacaaaaacaaauauaugugucuuaaugcagu

SEQ ID NO: 78102 - RNA, 62 nt, Homo Sapiens
ccugaaaacugcuuggcauuaaguaaaacaaacaaaaacaaaacuacaaaagaaaaauauaa

SEQ ID NO: 78103 - RNA, 64 nt, Homo Sapiens
aguuugugauauagcagagguaauaaaacaacaacaaaaacagcgaguaaaacuggugggucuu

SEQ ID NO: 78104 - RNA, 55 nt, Homo Sapiens
uaccccccuacuuaauguaaaaacacaaaaacagaacgcaccaagccgaaaguaa

SEQ ID NO: 78105 - RNA, 64 nt, Homo Sapiens
uucccccgcauuugguggauuuuuuauuauuauucaaaaacauaacugaguuuuuuaaaagagg

SEQ ID NO: 78106 - RNA, 64 nt, Homo Sapiens
ccaacuauuuaguaagcccggauagacuuauugccaaaaacaaaaaauagcuuucaaaagaaau

SEQ ID NO: 78107 - RNA, 64 nt, Homo Sapiens
aaacacaaaaguaacuuguuuaucucagucuguacaaaaacaguaaggaggcagaaagccaagc

SEQ ID NO: 78108 - RNA, 64 nt, Homo Sapiens
gccagcuuaaccuggucugaggugagacuaaacacaaaaacaguagauaaaucucucccuaaaa

SEQ ID NO: 78109 - RNA, 64 nt, Homo Sapiens
uuagaaaaaaacaacaaagcuuaugcccuguuugcaaaaacaauacaaaguauuuuuuuaccug

SEQ ID NO: 78110 - RNA, 64 nt, Homo Sapiens
cuaaccacaguugaagagaaugggguaaaagguacaaaaacaaaagaugccaacuuuuuuccuu

SEQ ID NO: 78111 - RNA, 64 nt, Homo Sapiens
cacacaaaaaacugagaacucuuguuuagcuuagcaaaaacaaauuuagcgaacucuagcaaaa

SEQ ID NO: 78112 - RNA, 64 nt, Homo Sapiens
uauagacaaauauuuugauuauguaagaaaacugcaaaaacaaagggcugccagagguucugau

SEQ ID NO: 78113 - RNA, 64 nt, Homo Sapiens
gucgcuuuugccuuuucaaaccccuaauuaaguacaaaaacagaugauacuugaaugugauuua

SEQ ID NO: 78114 - RNA, 64 nt, Homo Sapiens
uacuuaaguuaaugguauagaguauuuauuuuuucaaaaacagcuguuauaucuaaauuuaaac

SEQ ID NO: 78115 - RNA, 64 nt, Homo Sapiens
cuauuuuuauuggaacuucaagcucucuuggucacaaaaacauguuuaaaugugccuauuucac

SEQ ID NO: 78116 - RNA, 64 nt, Homo Sapiens
aaacuaagcauuuaauagaaaccaauaacuugaacaaaaacacugagaaagggaauacuaucua

SEQ ID NO: 78117 - RNA, 64 nt, Homo Sapiens
caacaacaacaaaauuauaaaaaaacccaaaaaacaaaaacaaagagugagacugcaucucaaa

SEQ ID NO: 78118 - RNA, 64 nt, Homo Sapiens
aauuagucgggugugguggcaaaaacaacaaaaacaaaaacacaguaaaacccugucucuacug

SEQ ID NO: 78119 - RNA, 64 nt, Homo Sapiens
aacacaaauuagucgggugucuacugaaaaacaacaaaaacaaaaacaugguaaaacccugucu

SEQ ID NO: 78120 - RNA, 64 nt, Homo Sapiens
auauauuucuguuaaacagucagcugccuguuugcaaaaacauaguuucaacacaauuuuggau

SEQ ID NO: 78121 - RNA, 64 nt, Homo Sapiens
cuucuugguauaaaagacucucacugccgaagaccaaaaacaaguggugaauggggaggaaaug

SEQ ID NO: 78122 - RNA, 64 nt, Homo Sapiens
aguuguuauuguuaucccuugaaagcgagggugacaaaaacaacaaaacaccguuauaaacaca

SEQ ID NO: 78123 - RNA, 64 nt, Homo Sapiens
gauucuauauauugaaaucagaaaaccuaccaaacaaaaacaucagaagcugcugccauaauga

SEQ ID NO: 78124 - RNA, 64 nt, Homo Sapiens
aauuauaaacuaguccauccucugcacaggucugcaaaaacaaagaugauuaagacuuacauuu

SEQ ID NO: 78125 - RNA, 64 nt, Homo Sapiens
uccuucagauucuacggaaugaacugauacaagacaaaaacaguguuuuaccuguaauuaauaa

SEQ ID NO: 78126 - RNA, 64 nt, Homo Sapiens
uuuuguaucuuugguuuuuguguuuugcugcacacaaaaacaaaagauauaaaaauggaucaua

SEQ ID NO: 78127 - RNA, 64 nt, Homo Sapiens
cuuaucacauuuaagucauugcuaauuuuauaaacaaaaacaaugguuuuacuuugcaucuccc

SEQ ID NO: 78128 - RNA, 64 nt, Homo Sapiens
aguuuggguccuacuguuguuauuaaaaacagaacaaaaacaaaacacacacacacacaaaaac

SEQ ID NO: 78129 - RNA, 64 nt, Homo Sapiens
uaaaaacagaacaaaaacaaaacacacacacacacaaaaacagaaacaaaaaaaaccagcauua

SEQ ID NO: 78130 - RNA, 64 nt, Homo Sapiens
aaaaacuauacaagcuucccuggaaaacacacagcaaaaacaauacaucuacaaacaaccuggc

SEQ ID NO: 78131 - RNA, 64 nt, Homo Sapiens
ucuuguaccaccacuuccggcucggaagugaauucaaaaacagagauggggagcgaucaguucu

SEQ ID NO: 78132 - RNA, 64 nt, Homo Sapiens
cagccugggcaacagagcgagacuccaucucaaacaaaaacaagaacaaaaacaaacauaaagu

SEQ ID NO: 78133 - RNA, 64 nt, Homo Sapiens
cagagcgagacuccaucucaaacaaaaacaagaacaaaaacaaacauaaaguuggcacagaaaa

SEQ ID NO: 78134 - RNA, 64 nt, Homo Sapiens
gauuucaugaagaagacacuaaaaacaauugcaacaaaaacagaaauugacaaauggggccuca

SEQ ID NO: 78135 - RNA, 64 nt, Homo Sapiens
aaagaugaauaaauaaaauaaaaugacacaaggccaaaaacaaauggguuuaacugaccagagc

SEQ ID NO: 78136 - RNA, 64 nt, Homo Sapiens
ucuccacaggaauaugguuccauuaggcugggagcaaaaacaauguuuuuuaagauugagaaua

SEQ ID NO: 78137 - RNA, 64 nt, Homo Sapiens
uaucuccaaaaaaagaaagaaaaaauacaaaaaacaaaaacaaaaaaaaaagaggguaauguac

SEQ ID NO: 78138 - RNA, 64 nt, Homo Sapiens
ugaauagguuuagaauagcuuuucugggguguaccaaaaacauuuaaugauuuuuauaaaccgu

SEQ ID NO: 78139 - RNA, 64 nt, Homo Sapiens
aaaaacuaaguugcuuucuucuuuggggaaaaaacaaaaacaaaacuguaucucacuuuaaacu

SEQ ID NO: 78140 - RNA, 64 nt, Homo Sapiens
agaguauauauguguauauauauauagauauauucaaaaacauugcaucauuuauaugaacuau

SEQ ID NO: 78141 - RNA, 64 nt, Homo Sapiens
cuuucgucuucaguugaauuggugaaaacaucaacaaaaacaaaacccacugugucuuaaaaua

SEQ ID NO: 78142 - RNA, 64 nt, Homo Sapiens
aggaauucaguugggcaaugauaacuuuuaugggcaaaaacauucuauuauagugaacuaauga

SEQ ID NO: 78143 - RNA, 64 nt, Homo Sapiens
uguuucaaauggcacuaucuucuuuucaguacuacaaaaacagaauaauuuugaaguuuuagaa

SEQ ID NO: 78144 - RNA, 64 nt, Homo Sapiens
aaaaucucauuauuucaaaaugauagacauauaccaaaaacaagucuauaaugugaguaguuac

SEQ ID NO: 78145 - RNA, 64 nt, Homo Sapiens
aacauuuuuuauacauuugguuauguugauaaaccaaaaacauuugauuaauaaaauaucuauu

SEQ ID NO: 78146 - RNA, 64 nt, Homo Sapiens
aaagcaacccaguccccaacguaaaaaacaaaaacaaaaacaaaugggaaaaauaaaagaaaau

SEQ ID NO: 78147 - RNA, 64 nt, Homo Sapiens
aacaaaaaagcaacccagucgaaaauguaaaaaacaaaaacaaacaaaaaugggaaaaauaaaa

SEQ ID NO: 78148 - RNA, 64 nt, Homo Sapiens
aaaaaugugauuuguuucugaaacauuuagaaaacaaaaacaaauuuugaaauuuucucuugua

SEQ ID NO: 78149 - RNA, 64 nt, Homo Sapiens
cagcgauacguaaucaaaauaccuauguuuugaacaaaaacaacuacuggcagauuaacauaca

SEQ ID NO: 78150 - RNA, 64 nt, Homo Sapiens
ucauccaaauuaaauuucaacauacugaaagaaucaaaaacaaagugcauuucggcauuugugc

SEQ ID NO: 78151 - RNA, 64 nt, Homo Sapiens
acucagucaaaugauauguugagaauaguuacagcaaaaacauacugcuguauguuaguauuau

SEQ ID NO: 78152 - RNA, 64 nt, Homo Sapiens
ugcaacagaagcaaaaauuccaugacgaagacgccaaaaacaauauaggcacaggcaaagauuu

SEQ ID NO: 78153 - RNA, 64 nt, Homo Sapiens
caaugggcaauggauucucuuucgaugaaccugacaaaaacaagcaccuauaauuuuuuugauc

SEQ ID NO: 78154 - RNA, 64 nt, Homo Sapiens
cguagacugauggaacagaagcauaguacuggcacaaaaacacaaggcuacaguaaccaaaaca

SEQ ID NO: 78155 - RNA, 64 nt, Homo Sapiens
auuucaaguacccuguauucuggaugcuaaaaaacaaaaacaaacaaaaaaacaaaaacaaaaa

SEQ ID NO: 78156 - RNA, 64 nt, Homo Sapiens
ucuggaugcuaaaaaacaaaaacaaacaaaaaaacaaaaacaaaaaaacaaaaccagaaucagg

SEQ ID NO: 78157 - RNA, 64 nt, Homo Sapiens
guugcaggcacaacaguuuagaacuucauccuggcaaaaacaaauguauuguacaucucggucu

SEQ ID NO: 78158 - RNA, 64 nt, Homo Sapiens
gcggcuucccccuuucguaccagugugauuguaacaaaaacaauuugauuucugcugcagaagg

SEQ ID NO: 78159 - RNA, 64 nt, Homo Sapiens
aguauguuuuaaaugcuuuguugcacugauaaaacaaaaacaaaccggcgucuucaaaaacaaa

SEQ ID NO: 78160 - RNA, 64 nt, Homo Sapiens
uugcacugauaaaacaaaaauuuuccggcgucuucaaaaacaaagcucagguuaaaugaaauag

SEQ ID NO: 78161 - RNA, 64 nt, Homo Sapiens
acaaaacauaaaauauaaacuaaaaaaacaaaaacaaaaacaaaguuugaauggaggacgccag

SEQ ID NO: 78162 - RNA, 64 nt, Homo Sapiens
aacaaaacaaaacauaaaaucgccaguaaaaaaacaaaaacaaaguaaauguuugaauggagga

SEQ ID NO: 78163 - RNA, 64 nt, Homo Sapiens
acacacaccacacacacgcgaguuucuccaaaaacaaaaacaaaguuacaauucauaaugcagc

SEQ ID NO: 78164 - RNA, 64 nt, Homo Sapiens
aacaaaacacacaccacacaugcagcaguuucuccaaaaacaaaaaagugguuacaauucauaa

SEQ ID NO: 78165 - RNA, 64 nt, Homo Sapiens
aaagacugauaucgcaccuaaaaaaaaacaaaaacaaaaacaaacagagcaaggcucugucuca

SEQ ID NO: 78166 - RNA, 64 nt, Homo Sapiens
aacaaaaaagacugauaucggucucaaaaaaaaacaaaaacaaagggugacagagcaaggcucu

SEQ ID NO: 78167 - RNA, 64 nt, Homo Sapiens
ugugggaagaucugaaucuggggccguuugaaagcaaaaacaaaccacugucucugcuucugaa

SEQ ID NO: 78168 - RNA, 64 nt, Homo Sapiens
guaacucuuugcauuuucugucccacaagauaugcaaaaacaaugcaauaauauucauuuaaaa

SEQ ID NO: 78169 - RNA, 64 nt, Homo Sapiens
auccagaagcuuugaauuaauaauuaaggaauuucaaaaacaccucugaaacgaaaaaagaaau

SEQ ID NO: 78170 - RNA, 64 nt, Homo Sapiens
augauaauaaaacaguggucaugccuacaaguugcaaaaacaguggcaauggcaucagagccca

SEQ ID NO: 78171 - RNA, 64 nt, Homo Sapiens
auguuguacgugaagauucugaggucuuuaaaaacaaaaacagacaaccgaguucuaguucccu

SEQ ID NO: 78172 - RNA, 64 nt, Homo Sapiens
guaacuugguuuucauguguuuuuucugauguuccaaaaacaaccuucacgaugucacuacuug

SEQ ID NO: 78173 - RNA, 64 nt, Homo Sapiens
ugaagccugguaaaauuaacaccugucugaaaaucaaaaacauggcuucccagcagcucuccug

SEQ ID NO: 78174 - RNA, 64 nt, Homo Sapiens
cgcauucucuaguaguauauaucgugccugucuucaaaaacauuucccuuuuuauacucauucc

SEQ ID NO: 78175 - RNA, 64 nt, Homo Sapiens
auuugugcccucuuuuauauaauauuuuuuaaaacaaaaacauuucuauuaaaacuguuguuaa

SEQ ID NO: 78176 - RNA, 64 nt, Homo Sapiens
uugaaaagacugcuaggaagcaauuaaggggaagcaaaaacaucauuugauuagcuuugaguca

SEQ ID NO: 78177 - RNA, 64 nt, Homo Sapiens
ugauuuguuuuaguaagaaauuaagaggaaaauacaaaaacagcgccauuucauugccuuaauu

SEQ ID NO: 78178 - RNA, 64 nt, Homo Sapiens
acccuuugcuguaucacuguaaaaaaaacaaaaacaaaaacaaauccucuuuccuuuccaguua

SEQ ID NO: 78179 - RNA, 64 nt, Homo Sapiens
aacaaaacccuuugcuguaucaguuaaaaaaaaacaaaaacaaacuucuuuccucuuuccuuuc

SEQ ID NO: 78180 - RNA, 64 nt, Homo Sapiens
ccaacauggugcaaccucgucuuuacuaaaaauacaaaaacaaaaauuagccaggggugguggu

SEQ ID NO: 78181 - RNA, 64 nt, Homo Sapiens
acuccagccugggagacagagcaagacuccaucucaaaaacaaaaacaaaacaaaacaacaaca

SEQ ID NO: 78182 - RNA, 64 nt, Homo Sapiens
gccugggagacagagcaagacuccaucucaaaaacaaaaacaaaacaaaacaacaacaaaaaaa

SEQ ID NO: 78183 - RNA, 64 nt, Homo Sapiens
aaguaucaauguguaugugguugauuguugagaacaaaaacaaaauuguguuuaacuuuguauu

SEQ ID NO: 78184 - RNA, 64 nt, Homo Sapiens
caguacuguggcucaggauagggaaacuuuaaaacaaaaacaccugaucuuccauccaagugga

SEQ ID NO: 78185 - RNA, 64 nt, Homo Sapiens
cuuuuuuuauucaaaaguaaagagaaaaaaaucacaaaaacaaauuugaagaaaaaaaagaaaa

SEQ ID NO: 78186 - RNA, 64 nt, Homo Sapiens
caggcugccauaauauauuuaaagaaaaaaaaaacaaaaacaaaguuagugaauuuggaaauaa

SEQ ID NO: 78187 - RNA, 64 nt, Homo Sapiens
ucaggaacaacggcuaauuuaaugaaaagcaaaacaaaaacaauguuacaaguugauaucguug

SEQ ID NO: 78188 - RNA, 64 nt, Homo Sapiens
gaauauaaaagcucuuuuccccaugucgcugauucaaaaacauguauuucuuaaaagacuagau

SEQ ID NO: 78189 - RNA, 64 nt, Homo Sapiens
agacuagauucuauggaucaaacagagguugaugcaaaaacaccacuguuaagguguaaaguga

SEQ ID NO: 78190 - RNA, 64 nt, Homo Sapiens
aacuugggaaacugaaaguguucccauauagcuucaaaaacaaaaacaaauguguuauccgacg

SEQ ID NO: 78191 - RNA, 64 nt, Homo Sapiens
ggaaacugaaaguguucccauauagcuucaaaaacaaaaacaaauguguuauccgacggauacu

SEQ ID NO: 78192 - RNA, 64 nt, Homo Sapiens
gcagaugcauauugugucugaaaaaaaacaaaaacaaaaacaugguugcacuuuuaguuuuuuu

SEQ ID NO: 78193 - RNA, 64 nt, Homo Sapiens
aacauggcagaugcauauuguuuuuuaaaaaaaacaaaaacaaagacuuuguugcacuuuuagu

SEQ ID NO: 78194 - RNA, 64 nt, Homo Sapiens
caguugguguggaauggucagaaauauaacuugccaaaaacacacauuugccuaacaggaaucu

SEQ ID NO: 78195 - RNA, 64 nt, Homo Sapiens
aaugcagaauuucuggggcucugccuuaagaauacaaaaacagacugagguuuacgagauuugg

SEQ ID NO: 78196 - RNA, 64 nt, Homo Sapiens
aucucuucagaccccuuugccuuuaaaaaaaaaacaaaaacaaaaacaaaaaaacccauaaugc

SEQ ID NO: 78197 - RNA, 64 nt, Homo Sapiens
ucagaccccuuugccuuuaaaaaaaaaacaaaaacaaaaacaaaaaaacccauaaugcccacag

SEQ ID NO: 78198 - RNA, 64 nt, Homo Sapiens
caaaugagaugggaugaaauccuaugacaguaagcaaaaacagaaccaugaaaaaugauuggac

SEQ ID NO: 78199 - RNA, 64 nt, Homo Sapiens
auagauuuuaaggcuuugaaaaugguuaauuucucaaaaacaucaauguccaaacaucuaccuu

SEQ ID NO: 78200 - RNA, 64 nt, Homo Sapiens
uauagcaagaccccucacuacaaaaauaaaacaucaaaaacaaaaacaauuagcugggcaugau

SEQ ID NO: 78201 - RNA, 64 nt, Homo Sapiens
aagaccccucacuacaaaaauaaaacaucaaaaacaaaaacaauuagcugggcaugauggcaca

SEQ ID NO: 78202 - RNA, 64 nt, Homo Sapiens
ggugaccgagggaggcucugucucaaaagcaaagcaaaaacaaaaacaaaaacaccuaaaaaac

SEQ ID NO: 78203 - RNA, 64 nt, Homo Sapiens
cgagggaggcucugucucaaaagcaaagcaaaaacaaaaacaaaaacaccuaaaaaaccugcag

SEQ ID NO: 78204 - RNA, 64 nt, Homo Sapiens
aggcucugucucaaaagcaaagcaaaaacaaaaacaaaaacaccuaaaaaaccugcaguuuugu

SEQ ID NO: 78205 - RNA, 64 nt, Homo Sapiens
aagaaaagcuguuaccaaucuuacugaaacuguucaaaaacauggaugcagagggacuccuccc

SEQ ID NO: 78206 - RNA, 64 nt, Homo Sapiens
agacuuaaugaugaacaccccaaagcaauugcaacaaaaacaaaaauugacaagugggaccuaa

SEQ ID NO: 78207 - RNA, 64 nt, Homo Sapiens
agaggaaucacacugcacagaccacuguacugcucaaaaacaugaugugggaaagccuucaguu

SEQ ID NO: 78208 - RNA, 64 nt, Homo Sapiens
aaaaggcucauacuggagagaccaccaaucugcucaaaaacaugauguggaaaagcauuccgau

SEQ ID NO: 78209 - RNA, 64 nt, Homo Sapiens
gaaaggcggggaagaaggaugaaaccuuuaaaaacaaaaacaaaaacaucaaugaguaggcauu

SEQ ID NO: 78210 - RNA, 64 nt, Homo Sapiens
cggggaagaaggaugaaaccuuuaaaaacaaaaacaaaaacaucaaugaguaggcauuuuauag

SEQ ID NO: 78211 - RNA, 64 nt, Homo Sapiens
ggaaguguaagaaauugaagaguucuaaggcuuucaaaaacacucagucaaaaauuuaaaaucu

SEQ ID NO: 78212 - RNA, 64 nt, Homo Sapiens
aauuuaaaaucuuaaauguguaagucacccccaccaaaaacaaaagagaagaaaaagaauagaa

SEQ ID NO: 78213 - RNA, 64 nt, Homo Sapiens
accugggugacagagugagauuccaucugaaaaacaaaaacaaaaacagaaaacaaacaaacaa

SEQ ID NO: 78214 - RNA, 64 nt, Homo Sapiens
gugacagagugagauuccaucugaaaaacaaaaacaaaaacagaaaacaaacaaacaaaaaaca

SEQ ID NO: 78215 - RNA, 64 nt, Homo Sapiens
aaaucauuugaaaucacuguagcaaaaacaagaacaaaaacaccuuuguuugcuuugaagaaaa

SEQ ID NO: 78216 - RNA, 64 nt, Homo Sapiens
aacaaaaacaccaaaucauucuuugaagaaaaagcaaaaacaagaagaccaaaucauuuguuug

SEQ ID NO: 78217 - RNA, 64 nt, Homo Sapiens
uucuuuaugucaagguuaaugucugaaauuugaccaaaaacaucauuaauuuauaauaauacau

SEQ ID NO: 78218 - RNA, 64 nt, Homo Sapiens
acaaaacagugacacucacuuaauaaaacuaggucaaaaacaaacaccccaaggaagcaauauu

SEQ ID NO: 78219 - RNA, 64 nt, Homo Sapiens
uuuccugugagguaugacaguuugcucaaacuucagccaacaggggugucugcuucugcugcac

SEQ ID NO: 78220 - RNA, 64 nt, Homo Sapiens
ccaagcauccuuuucuaaaaagugacuuaaaauaagccaacagacucucccagaccacacaacu

SEQ ID NO: 78221 - RNA, 64 nt, Homo Sapiens
ggaauaaacucaaucuuuucuuucccaagcuccuagccaacacuauccuugggagaaagaaauu

SEQ ID NO: 78222 - RNA, 64 nt, Homo Sapiens
cuguaaaucaagucaucucaagucuagugaagacagccaacagaaacaaaaccuagcauaggga

SEQ ID NO: 78223 - RNA, 64 nt, Homo Sapiens
uuuaaggcaguaguuuuacuccucuguuacuuaaagccaacaauugaugugaauucaaauuuua

SEQ ID NO: 78224 - RNA, 64 nt, Homo Sapiens
uugugaaacaaugacuggaaauaccuuaugacacagccaacauuguugauagaaagcacaggag

SEQ ID NO: 78225 - RNA, 64 nt, Homo Sapiens
cuucugauggaaggcgggauugauggaaggugggagccaacaccggugggagccaacacccuuc

SEQ ID NO: 78226 - RNA, 64 nt, Homo Sapiens
cuucugauggaaggugggagugauggaaggugggagccaacaccggugggagccaacacccuuc

SEQ ID NO: 78227 - RNA, 64 nt, Homo Sapiens; identical to SEQ ID NO: 78226

SEQ ID NO: 78228 - RNA, 64 nt, Homo Sapiens; identical to SEQ ID NO: 78226

SEQ ID NO: 78229 - RNA, 64 nt, Homo Sapiens
cuucugauggaaggugggagugauggaaggugggagccaacaccuucccugggccagcaucuuc

SEQ ID NO: 78230 - RNA, 64 nt, Homo Sapiens
aggcuauuaaaaaagucuacgcguagcagaguuaaaucucaaauauuuagaagaaagauguuug

SEQ ID NO: 78231 - RNA, 64 nt, Homo Sapiens
uuagauccuaagauguguuccucaaauuuuggcgaaucucaaaaagcaggguuucuuuucuuca

SEQ ID NO: 78232 - RNA, 64 nt, Homo Sapiens
gcagcgcuacaauuuucauuuaaguagagaaauaaaucucaaauaaaugacaaguuuuacuagc

SEQ ID NO: 78233 - RNA, 64 nt, Homo Sapiens
aaaagacuugcuucaagguguuaguuuaaaaaacaaucucaaacauggcaaaauguuugcuacc

SEQ ID NO: 78234 - RNA, 64 nt, Homo Sapiens
uucaguuuuggccuucuguccuuuauuagaggaaaaucucaaucugaagauucugaaaaccuau

SEQ ID NO: 78235 - RNA, 64 nt, Homo Sapiens
ucauuuuugauauucaaauuaggacaugguuagcaaucucaauuuucuacaugcuguaacuauc

SEQ ID NO: 78236 - RNA, 64 nt, Homo Sapiens
aaaguuaugcucauccagacuuuuaagggagaaaaaucucaaccacuggugcuuugaaaaucuu

SEQ ID NO: 78237 - RNA, 64 nt, Homo Sapiens
aauuauuuuugaguuuauuaagacuacaagaugaaaucucaauaauucgcaacucauaauccgu

SEQ ID NO: 78238 - RNA, 64 nt, Homo Sapiens
ucgcuuugucacccaggcuggagugcaauggcacaaucucaacucaccgcaaccuccgccuccc

SEQ ID NO: 78239 - RNA, 64 nt, Homo Sapiens
uaguauuugugauaagagcacaaaacaauuuucuaaucucaaagagcuuauauucuaguggggu

SEQ ID NO: 78240 - RNA, 64 nt, Homo Sapiens
ccuuauaagcauuccuuccuauaugagaaucucaaaucucaaugcccaacagggaugucacuug

SEQ ID NO: 78241 - RNA, 64 nt, Homo Sapiens
cucaaugccuuauaagcauuucacuugauaugagaaucucaaaugccguuucccaacagggaug

SEQ ID NO: 78242 - RNA, 64 nt, Homo Sapiens
uuuagaguuagguaguacagguaagggggaaauuguaaagaauuagcagaauuaggcauaugua

SEQ ID NO: 78243 - RNA, 64 nt, Homo Sapiens
uccaacugcaguuuacaauuuuuguucuucuccuguaaagaaugucaaugguuaucaccuucaa

SEQ ID NO: 78244 - RNA, 64 nt, Homo Sapiens
ggagugggaguuaguggggauuaguauguggguaguaaagaauuggacuuggggauuacugaga

SEQ ID NO: 78245 - RNA, 64 nt, Homo Sapiens
cuaggauuuuaugguaugagaggugaaaucaaugguaaagaagcaugcagugacugugcucgaa

SEQ ID NO: 78246 - RNA, 64 nt, Homo Sapiens
ugacagaucguggucagcagcccagaagcccauaguaaagaaaacuuaaaauagcaugcauucu

SEQ ID NO: 78247 - RNA, 64 nt, Homo Sapiens
cuuucgaaguaacuguggucuuagguucggcugaguaaagaaaaaggauuuuucuucgaguuag

SEQ ID NO: 78248 - RNA, 64 nt, Homo Sapiens
cuguaggcuugcaggcuacccgcccugagauuugguaaagaacacugccuuguuccccaucagu

SEQ ID NO: 78249 - RNA, 64 nt, Homo Sapiens
aagaaaauucauacuugagagaaauccuacaaauguaaagaauguggcaaaccuuuggaugauc

SEQ ID NO: 78250 - RNA, 64 nt, Homo Sapiens
aagagaauuuauaccagagagaaacccuacacauguaaagaauguggcaaagccuucaauaggu

SEQ ID NO: 78251 - RNA, 64 nt, Homo Sapiens
guggauauagcugcuggaccauuccaucuuauauguaaagaaaucuggaauuauuauuuuaaaa

SEQ ID NO: 78252 - RNA, 64 nt, Homo Sapiens
acaugugauuauaauuuuucuuagcauuuucuuuguaaagaacuacaauauaaacuaguuggug

SEQ ID NO: 78253 - RNA, 64 nt, Homo Sapiens
gaagcuaagcaguggguaccauaaaugcuuacauguaaagaaagaacccuuuuaaaaccuagau

SEQ ID NO: 78254 - RNA, 64 nt, Homo Sapiens
uugaagguggucauuccuucacacuaaagaagcuguaaagaacauuuuuuuuuuuuuuuaagua

SEQ ID NO: 78255 - RNA, 64 nt, Homo Sapiens
aguaggcauguuuuucuaauaaauuuauauauuuguaaagaaaacaacagaaaucuuuaugcaa

SEQ ID NO: 78256 - RNA, 64 nt, Homo Sapiens
augcagcccaguuaaauauugauuaucugugaugguaaagaacaacaguggugccagucaucaa

SEQ ID NO: 78257 - RNA, 64 nt, Homo Sapiens
uuaauuaauucugucauuuaacgugucaauaacaguaaagaauuccaagcuucuauaaaauugu

SEQ ID NO: 78258 - RNA, 64 nt, Homo Sapiens
gaucgcaggaauguggagaguaugcuccaagcauguaaagaaaagcucuggauccagaaggccu

SEQ ID NO: 78259 - RNA, 64 nt, Homo Sapiens
caggaacaugagauuuagcagacuaaggagaucuguaaagaaugaaccauaccacaaggcauac

SEQ ID NO: 78260 - RNA, 64 nt, Homo Sapiens
aaacuaauauggcagguuauaaugauccuuaaguguaaagaaaucagucaauuacaagaguaau

SEQ ID NO: 78261 - RNA, 64 nt, Homo Sapiens
aaacaguggagguaaaaauauaauuucauacauuguaaagaaaagcacccuuuaaauguguaaa

SEQ ID NO: 78262 - RNA, 64 nt, Homo Sapiens
aaagcacccuuuaaauguguaaagacaguguuuuguaaagaauuuuguuuaaaaaguuucuauu

SEQ ID NO: 78263 - RNA, 64 nt, Homo Sapiens
gaaugugagugguaaguauaucucaguuuaaaugguaaagaagaaauguaguuuacauuuguau

SEQ ID NO: 78264 - RNA, 64 nt, Homo Sapiens
cgcagaagauaagccauguuucuguauuguacauguaaagaaaaauaaaacuguuuaugauacu

SEQ ID NO: 78265 - RNA, 64 nt, Homo Sapiens
aaggggaaagaaacuacuuucuuccuugguguggguaaagaauagccuuagagcaaguuaagca

SEQ ID NO: 78266 - RNA, 64 nt, Homo Sapiens
aagagauaagggacgcuaccagggugguauucugguaaagaagagaucagaagccuucagauag

SEQ ID NO: 78267 - RNA, 64 nt, Homo Sapiens
ugaacagugaaguggcuugaauucauuucaugauguaaagaaacuugggagguuaauaccaagu

SEQ ID NO: 78268 - RNA, 64 nt, Homo Sapiens; identical to SEQ ID NO: 78267

SEQ ID NO: 78269 - RNA, 64 nt, Homo Sapiens
uguuuaaagaguuggaggaauuggggauugaguuguaaagaaaacuuacagaagaggcaacaau

SEQ ID NO: 78270 - RNA, 64 nt, Homo Sapiens
uuucauauuuaaagccaaauguaaauagaggucuguaaagaaaaauaauugccauagaaaguau

SEQ ID NO: 78271 - RNA, 64 nt, Homo Sapiens
uggaaaacccuucaguuuccgaaacccuaugaauguaaagaauggaacgaauucauacuggaga

SEQ ID NO: 78272 - RNA, 64 nt, Homo Sapiens
uggaaaagcauuccgauaccuaaacccuuuaaguguaaagaaugggaaggacucacacuggaga

SEQ ID NO: 78273 - RNA, 64 nt, Homo Sapiens
uagucauggcggagaagguugagacucugugaaaguaaagaagguacagaaaucauaugguaga

SEQ ID NO: 78274 - RNA, 64 nt, Homo Sapiens
gucuuucaggagguuugcucuuagaacuggugauguaaagaauggaaguagcuguaugagcagu

SEQ ID NO: 78275 - RNA, 64 nt, Homo Sapiens
uuuuugucuuuguugaaguauuuaauagaguaagguaaagaagauauuaagucccuuucaaaau

SEQ ID NO: 78276 - RNA, 64 nt, Homo Sapiens; identical to SEQ ID NO: 78274

SEQ ID NO: 78277 - RNA, 64 nt, Homo Sapiens; identical to SEQ ID NO: 78275

SEQ ID NO: 78278 - RNA, 64 nt, Homo Sapiens
uuagauaguaauugaagauauguauaaauauuacaaagaauaaaaauauauuacugucucuuua

SEQ ID NO: 78279 - RNA, 64 nt, Homo Sapiens
ugcaauuaaaccgagagaugucuuguuuuuuuaaaaagaauaguauuuaauagguuucugacuu

SEQ ID NO: 78280 - RNA, 64 nt, Homo Sapiens
auuucucuguaagggcaacgaacgugcuggcaucaaagaauaucaguuuacauauauaacaagu

SEQ ID NO: 78281 - RNA, 64 nt, Homo Sapiens
aauguuuucuuguugcuuuaacacuggaagauuuaaagaauaaaaacuccugcauaaacgauuu

SEQ ID NO: 78282 - RNA, 64 nt, Homo Sapiens
uuaauaauggaaugaacuaaaauaaacaagaacaaaagaauaguauaauuauaucaguaacaag

SEQ ID NO: 78283 - RNA, 64 nt, Homo Sapiens
uuaaguuuaauuuucucugggggcaugaucucacaaagaauacucaagucuuuuucuucuuaug

SEQ ID NO: 78284 - RNA, 64 nt, Homo Sapiens
gccauauuuagggaacauuuuuucugaggggccaaaagaauaaaggaccaaauuucuuagcuca

SEQ ID NO: 78285 - RNA, 64 nt, Homo Sapiens
cuuagcucauaucauugcuuuaaacauagaaguaaaagaauacugcauguuguggguugauuuu

SEQ ID NO: 78286 - RNA, 64 nt, Homo Sapiens
aaaccagccuuuaaaauaucauguccaggccuggaaagaauacaaauccagugcaaaauuaaac

SEQ ID NO: 78287 - RNA, 64 nt, Homo Sapiens
augcaaaucucaggguguugccucuaaagaaucuaaagaauagacaugcuuugggcuuacucag

SEQ ID NO: 78288 - RNA, 64 nt, Homo Sapiens
uauaccagugcucaucugacugaugaaaaagaggaaagaauaaucauuucuagauacugaggcu

SEQ ID NO: 78289 - RNA, 64 nt, Homo Sapiens
ucuuaauucaacccauaaucauuaaguacuuaacaaagaauauuuuacaagugauaguauuuca

SEQ ID NO: 78290 - RNA, 64 nt, Homo Sapiens
aauauuccagccccaaaugaaguaaaaaaauuaaaaagaauacagaaacucuucuaauaaauga

SEQ ID NO: 78291 - RNA, 64 nt, Homo Sapiens
aaguguggacagaccuauuuuaaauuggucuaaaaaagaauauuuuaaguaauagauuuccagc

SEQ ID NO: 78292 - RNA, 64 nt, Homo Sapiens
gcuuaaaugaugcuauguaaaaugucaugaguggaaagaauauuuguaguaguaacaagaauuu

SEQ ID NO: 78293 - RNA, 64 nt, Homo Sapiens
aauuuuucauuuaggaaagauuucuuagguuuugaaagaauacauuaaaauaaaaaacuugccc

SEQ ID NO: 78294 - RNA, 64 nt, Homo Sapiens
agacuucaguguuaauguucacaauauacuuucgaaagaauaaaauaguucuccuacaugaaga

SEQ ID NO: 78295 - RNA, 64 nt, Homo Sapiens
uuucgaaagaauaaaauaguucuccuacaugaagaaagaauaugucaggaaauaaggucacuuu

SEQ ID NO: 78296 - RNA, 64 nt, Homo Sapiens
ugugauagcugugcaugcauauggcuuuaaggauaaagaauaaaucucccaguuuacuuuaaaa

SEQ ID NO: 78297 - RNA, 64 nt, Homo Sapiens
uguuaaaaauuaagcuuuuaggaaacuaccacucaaagaauaauagaugccacauuucucucug

SEQ ID NO: 78298 - RNA, 57 nt, Homo Sapiens
cugaacauagaaauguguaauuaucagaaagaauaauggcuuucaaugaguuccuau

SEQ ID NO: 78299 - RNA, 64 nt, Homo Sapiens
uauaccuauguuaaugaaacaacagaaguacaaaaaagaauaucagauacaaaaaucaaucgug

SEQ ID NO: 78300 - RNA, 64 nt, Homo Sapiens
cuacaguucucucacaccaacaauucagcauaaaaaagaauaggauugaaaucugcauucaugc

SEQ ID NO: 78301 - RNA, 64 nt, Homo Sapiens
auacuuuacuaaaauauuguaauaaaguaguaauaaagaauaaaucauuuaaggauaaauaaaa

SEQ ID NO: 78302 - RNA, 64 nt, Homo Sapiens
uccuagccucuuccuggcuuccuuaggcccuaggaaagaauacugucccagugccaugcuuccu

SEQ ID NO: 78303 - RNA, 64 nt, Homo Sapiens
gugaaagggaacuguuuuagggaacauuggcaagaaagaauaguaaauccuuaacguuuguaug

SEQ ID NO: 78304 - RNA, 64 nt, Homo Sapiens
cuuuuacaaguggcuuuacauuuaaaaaagaauaaaagaauaucgcuucagaaauauauacugc

SEQ ID NO: 78305 - RNA, 64 nt, Homo Sapiens
agaauauccuuuuacaaguguauacugcuuuaaaaaagaauaaacaaagugugcuucagaaaua

SEQ ID NO: 78306 - RNA, 64 nt, Homo Sapiens
auuauggaagcacgauuuauuguuuuucauuuuuaaagaauauuuaaaaaugugugcucuuuac

SEQ ID NO: 78307 - RNA, 64 nt, Homo Sapiens
caauugagugccuaaugagauucuuucagugaaaaaagaauagcaaaggguaagugaagguuua

SEQ ID NO: 78308 - RNA, 64 nt, Homo Sapiens
uuaacuuuuaacauuaaaaucacuacuugcauguaaagaauaaucauguggagaaaauuauuca

SEQ ID NO: 78309 - RNA, 64 nt, Homo Sapiens
ucagaaugauuuuguugacagaggggaggaaaugaaagaauagaguacuuuagagcaacuuaau

SEQ ID NO: 78310 - RNA, 64 nt, Homo Sapiens
cauuuccuugaguaaaugagcugaaguguaaagcaaagaauagcagaagcagcuugguaggaug

SEQ ID NO: 78311 - RNA, 64 nt, Homo Sapiens
agccuggaugacagagcgagacuccgccucaaaaaaagaauacaaaugcuccaacauuauuuuu

SEQ ID NO: 78312 - RNA, 64 nt, Homo Sapiens
gucuuugauuaaucacaaaacuaagaauacauccaaagaauaguguuguaacuaugaaaaagaa

SEQ ID NO: 78313 - RNA, 64 nt, Homo Sapiens
gaauacauccaaagaauaguguuguaacuaugaaaaagaauacuuugaaagacaaagaacuuag

SEQ ID NO: 78314 - RNA, 64 nt, Homo Sapiens
ugcauguauuuaccucuucaaccaaaagggcaguaaagaauagggauaauauauuuuaauguaa

SEQ ID NO: 78315 - RNA, 64 nt, Homo Sapiens
gcccuauagccacauaaauauaaauuucauagaaaaagaauaaaagcggagauauauuuuuuga

SEQ ID NO: 78316 - RNA, 64 nt, Homo Sapiens
cacuuuuuaaagcuuuuggcguaauuccuggauuaaagaauaugaaaauguauaaauuucuuga

SEQ ID NO: 78317 - RNA, 64 nt, Homo Sapiens
agucacuauuauccuaccacauagagauaaguaaaaagaauaaacauuacagaaacaugagaaa

SEQ ID NO: 78318 - RNA, 64 nt, Homo Sapiens
agaaaaugugucauucauuuagauccuuuucuugaaagaauaacggagaucauuuaaaucuuac

SEQ ID NO: 78319 - RNA, 64 nt, Homo Sapiens
ucuaacuggucaguauucagccuuucuugugagaaaagaauaauacaacuacagcccucauuag

SEQ ID NO: 78320 - RNA, 64 nt, Homo Sapiens
accaggcaaagcuaaggaaggauauacuaguugaaaagaauaacccacuccucuucugggcauu

SEQ ID NO: 78321 - RNA, 64 nt, Homo Sapiens
accuuucccugguaguaguggucucauucacaaaaaagaauaauagauguaacuggagucacuu

SEQ ID NO: 78322 - RNA, 64 nt, Homo Sapiens
ugaccaucacagagauccagaucucuuuuggccaaaagaauaucaggcaaaguuuuuucccuac

SEQ ID NO: 78323 - RNA, 64 nt, Homo Sapiens
uaaaugacucugauuuuguuaaguaauaaugauuaaagaauaacgaauguauuaguguauuuua

SEQ ID NO: 78324 - RNA, 64 nt, Homo Sapiens
uacucuuuccaugcauauauacaacaguaucugaaaagaauacagcuugagcugagagacagac

SEQ ID NO: 78325 - RNA, 64 nt, Homo Sapiens
agcuggagagagagugaaguagggaaagagaaagaaagaauaaagggucaagugcauuggaccu

SEQ ID NO: 78326 - RNA, 64 nt, Homo Sapiens
acaagugcuuuuuaucuugaaauucaaccaacggaaagaauaugcauagaauaaugcauucuau

SEQ ID NO: 78327 - RNA, 64 nt, Homo Sapiens
uacccauaaccuauguugagccuugcuuaccagcaaagaauauuuuuaauguggauaucuaauu

SEQ ID NO: 78328 - RNA, 64 nt, Homo Sapiens
cagggaagcugccaaagaaugucgacgucgaaagaaagaauauguaaaaugucuggagagccga

SEQ ID NO: 78329 - RNA, 64 nt, Homo Sapiens
acaauaaaaguaaaccacaaaaaaauaccucaggaaagaauagaaagaaagucuaucuaaugac

SEQ ID NO: 78330 - RNA, 64 nt, Homo Sapiens
aaccccagaacuugagccuuguguauagauuuuaaaagaauauauauaucagccgggcgcggug

SEQ ID NO: 78331 - RNA, 64 nt, Homo Sapiens
cagcuugaagaaccaaaacagaaggaauauguacaaagaauaaauuuucugcucacgaugaguu

SEQ ID NO: 78332 - RNA, 64 nt, Homo Sapiens
gugaaaacaaauuccguaaaacuguuaguaucaaaaagaauaggaauacaguuuucuuuuccac

SEQ ID NO: 78333 - RNA, 64 nt, Homo Sapiens
uuuaauucugaguuccuuacacagcauuuuagggaaagaauacaggcaggaugacacuuugugu

SEQ ID NO: 78334 - RNA, 64 nt, Homo Sapiens
auuuauuuuaaauaaaugaauaaaauaaaauaaaaaagaauauucagucguuggcacauaaacu

SEQ ID NO: 78335 - RNA, 64 nt, Homo Sapiens
cuucuagcuuggagcuaaaugcugcucaugcugaaaagaauaaugucuauuucuuuguuugggu

SEQ ID NO: 78336 - RNA, 64 nt, Homo Sapiens
uuauguucagcuuaauuuuaaucauguccaagaaaaagaauaaacaggauguuuuauuucucac

SEQ ID NO: 78337 - RNA, 64 nt, Homo Sapiens
aauacuucuauuauucuuuuaauguaaaaaaauuaaagaauaaacugaaaauugaaaaaauuaa

SEQ ID NO: 78338 - RNA, 64 nt, Homo Sapiens
uguuuuguuugcauauuuaauuuuaaauuaaaccaaagaauauguuaauucugaaagagauuuu

SEQ ID NO: 78339 - RNA, 64 nt, Homo Sapiens
aaacauguuucaaagaaaaauaaggucaggagaaaaagaauaaugccuacagauuauccuucag

SEQ ID NO: 78340 - RNA, 64 nt, Homo Sapiens
guguuguaugucuuuuuugcuuuuuuuuuaaaaaaaagaauaacuuuuuuugccucuuuagauu

SEQ ID NO: 78341 - RNA, 64 nt, Homo Sapiens
ccuugaggauaacuugucaaaugccccaaagcauaaagaauauaauucugaaucccaaauucca

SEQ ID NO: 78342 - RNA, 64 nt, Homo Sapiens
uuuaaugauaugcuuguaaccauuuuguaauaauaaagaauagccaagaauagcauuguaaaag

SEQ ID NO: 78343 - RNA, 64 nt, Homo Sapiens
agcuaagguuuagauaaauacuaauaacaugugaaaagaauagauuuuuuaagugaaaauauag

SEQ ID NO: 78344 - RNA, 64 nt, Homo Sapiens
aaaaccuuagacguaauccauucauaaucaggguaaagaauaugauuaaaaaggaaagguucua

SEQ ID NO: 78345 - RNA, 64 nt, Homo Sapiens
uauucuugcaucuggccuuaucuauuuaaaaggaaaagaauaagauaaauuuuauggcaugucu

SEQ ID NO: 78346 - RNA, 64 nt, Homo Sapiens
uauuuuaagaggcaucuuacuauuauuuuauaaaaaagaauauuagaauauuuauuugaaguuu

SEQ ID NO: 78347 - RNA, 64 nt, Homo Sapiens
uauuugaaguuuuauuauuuauauuguuuaguguaaagaauauuuauuuucuaauuuuuucaac

SEQ ID NO: 78348 - RNA, 64 nt, Homo Sapiens
uguuuuccuuagcuccuucaugggcaugcuggugaaagaauaaauacauccaauuaaagcucau

SEQ ID NO: 78349 - RNA, 64 nt, Homo Sapiens
acaauaaacuucauauuuagaaugcaaagucuauaaagaauaauuuuacaugauccucaauauc

SEQ ID NO: 78350 - RNA, 64 nt, Homo Sapiens
gggaagaccugaaagucauuugaacauuuuaggaaaagaauauuggagagaaaaagguauuaaa

SEQ ID NO: 78351 - RNA, 64 nt, Homo Sapiens
uaaagugaaaacugaguuguugcugaccuccacaaaagaauauggaaaaaagccuugcuguaca

SEQ ID NO: 78352 - RNA, 64 nt, Homo Sapiens
uugcuuaagugucauucacucaagccuauuugugaaagaauauuagcaguagagaauuuaagca

SEQ ID NO: 78353 - RNA, 64 nt, Homo Sapiens
aucuuccauccaaguggaggaagagaaaucucuaaaagaauauggggcggggggcggggguaca

SEQ ID NO: 78354 - RNA, 64 nt, Homo Sapiens
aucaagaaugcaauccuauucacaauugccacaaaaagaauaaaauaccuaggaauacagcuaa

SEQ ID NO: 78355 - RNA, 64 nt, Homo Sapiens
gaauccuacacccacagaacccggcuuuguccccaaagaauaaaaacaccucucuaaaagcugc

SEQ ID NO: 78356 - RNA, 64 nt, Homo Sapiens
caggccagaagaaaaguugcccagcugucuacacaaagaauaugcuagaaaccuguuauaauug

SEQ ID NO: 78357 - RNA, 64 nt, Homo Sapiens
aacagccacugcucugaccaagauauucaaacagaaagaauaaggaacccauagaugaagauga

SEQ ID NO: 78358 - RNA, 64 nt, Homo Sapiens
cucauauauacuuuuuccaucuggauucuucacaaaagaauauguugugagcaucuuuccauga

SEQ ID NO: 78359 - RNA, 64 nt, Homo Sapiens
auggauauccaauuguuucacacaauuuuuuugaaaagaauauccuuggcagggcacgguagcu

SEQ ID NO: 78360 - RNA, 64 nt, Homo Sapiens
aauagaaguguaugaauugcugcgacaauuuugaaaagaauagaggaaacacccucacuguaug

SEQ ID NO: 78361 - RNA, 64 nt, Homo Sapiens
uauuaguacauuaguagguaaaugagcagauuuuaaagaauagaauauccagaagcagauucau

SEQ ID NO: 78362 - RNA, 64 nt, Homo Sapiens
uuuauuccauacugcaaagaaauuuugcaaauguaaagaauaugacaaggucuucaaacacaag

SEQ ID NO: 78363 - RNA, 64 nt, Homo Sapiens
aaacugggcaaaggccaugaauagaccuuucucaaaagaauacauacauguggcaauaagcaua

SEQ ID NO: 78364 - RNA, 64 nt, Homo Sapiens
agaaaauuauauuagaaaaagcuaaugaaugcagaaagaauaauucuuuauuagaaaauuccag

SEQ ID NO: 78365 - RNA, 64 nt, Homo Sapiens
uuaaugaacauauagaagccguuuuauuuaaaggaaagaauaugcucacaacuaagcauaggaa

SEQ ID NO: 78366 - RNA, 64 nt, Homo Sapiens
uguaagaaucaauugucuauauggaauuuaggauaaagaauauuuacaauaaagaauauuuaca

SEQ ID NO: 78367 - RNA, 64 nt, Homo Sapiens
cuauauggaauuuaggauaaagaauauuuacaauaaagaauauuuacaauaaagaguuuauuau

SEQ ID NO: 78368 - RNA, 64 nt, Homo Sapiens
guggggaaugggaagaagcaguuuacuuuagacuaaagaauauauuggggggccggguguagug

SEQ ID NO: 78369 - RNA, 64 nt, Homo Sapiens
acagagcgagacuccaucucaaaaaaaaaaaaaaaaagaauauauugacggaagaauagagagg

SEQ ID NO: 78370 - RNA, 61 nt, Homo Sapiens
gagcuaucucaucuaagugauuccugaugccaaagaauaugaaaauauuuaaguaaaaaca

SEQ ID NO: 78371 - RNA, 64 nt, Homo Sapiens
guaagucacccccaccaaaaacaaaagagaagaaaaagaauagaaagaauuauccagugucagc

SEQ ID NO: 78372 - RNA, 64 nt, Homo Sapiens
cuucacguagaacauugguauucgcuugagaaaaaaagaauaguugaaccuauuucucuuucuu

SEQ ID NO: 78373 - RNA, 64 nt, Homo Sapiens
aguagauguucuacuuuguucugcuguucucuagaaagaauauuugguuuuccuguauaggaau

SEQ ID NO: 78374 - RNA, 64 nt, Homo Sapiens
acuuagaaggguuaauuggaugaaacuauaacuuaaagaauaauuaaaucuuuuucaccaugga

SEQ ID NO: 78375 - RNA, 64 nt, Homo Sapiens
gauuuauauauucauucuuuuuaauaaauuuaggaaagaauaaaaccauaaaauugucauaaaa

SEQ ID NO: 78376 - RNA, 64 nt, Homo Sapiens
uuuaaacuucguguuuugucuaugagcuuagcguaaagaauauuuuuaguuuuuuguuugcuua

SEQ ID NO: 78377 - RNA, 64 nt, Homo Sapiens
gagaaagggagccgcugugcggugccuucagggcaaagaauagacacacguuaagcaauccaga

SEQ ID NO: 78378 - RNA, 61 nt, Homo Sapiens
ggcuuaacuacuucucccuccuuguccagcacuuuucuagcucucccguuccccaucucca

SEQ ID NO: 78379 - RNA, 61 nt, Homo Sapiens
ccacuguuuuuucucuguugggagggaagcucuuuucuaggagugucucaguucugcuuuu

SEQ ID NO: 78380 - RNA, 61 nt, Homo Sapiens
auuagaagcuagcugagguagcuugcagcaucuuuucuaguugaaauggugaacugauagg

SEQ ID NO: 78381 - RNA, 61 nt, Homo Sapiens
acaguucauuuuuuuccgguaggaauaacuccuuuucuacauccacgcuccauagagucuc

SEQ ID NO: 78382 - RNA, 61 nt, Homo Sapiens
auuucugucucugaaauaaccuuuuacuuggcuuuucuagauagcuuuauuugauuucgag

SEQ ID NO: 78383 - RNA, 61 nt, Homo Sapiens
auuucgaguggcaaaauguuuuuuauuacggcuuuucuauugcuguaugauacagaacucu

SEQ ID NO: 78384 - RNA, 61 nt, Homo Sapiens
acuuugucaagcaccucaguuacacauucgccuuuucuaggauugcauuucccaagugcua

SEQ ID NO: 78385 - RNA, 61 nt, Homo Sapiens
cccauuuuaguuuucuaggacugaaaggauucuuuucuacauuauacauguguguugucau

SEQ ID NO: 78386 - RNA, 61 nt, Homo Sapiens
ucacucguuucuaggguuuugguuuagcuuucuuuucuauuuguguucucuaaucaauagu

SEQ ID NO: 78387 - RNA, 61 nt, Homo Sapiens
gcauagucaggcugcaaauuaauggguuuuucuuuucuauugcuugaauuucuccccagaa

SEQ ID NO: 78388 - RNA, 61 nt, Homo Sapiens
gguuaccaguuauccaaucaugucaacuaaacuuuucuaaaaacucacuucggucucuguc

SEQ ID NO: 78389 - RNA, 61 nt, Homo Sapiens
caugcucuaccgcauuguagugaagguuuaucuuuucuaauucuuggacaacacuauuguu

SEQ ID NO: 78390 - RNA, 61 nt, Homo Sapiens
aaggccucuuacuuugggggagguggaagugcuuuucuacucagaccuaggggaaaacugc

SEQ ID NO: 78391 - RNA, 61 nt, Homo Sapiens
uuacugauaaccccuacaaucaagcuguuuucuuuucuaggcucuaaucuuucuacaugga

SEQ ID NO: 78392 - RNA, 61 nt, Homo Sapiens
aucaccaaacaauauguuaaaaauucugugccuuuucuauucucuggcaauaagccuucca

SEQ ID NO: 78393 - RNA, 61 nt, Homo Sapiens
uguuucaacuuuaagcccacacacucuguagcuuuucuaaaacaguacauuccauucaugc

SEQ ID NO: 78394 - RNA, 61 nt, Homo Sapiens
ggacuagggagggaggcagggaacguuuuuucuuuucuacaucuucacagguucggcuggg

SEQ ID NO: 78395 - RNA, 61 nt, Homo Sapiens
caaauauuguggguaguagggcugacugcugcuuuucuaaaaaguaguucuuuaguaucaa

SEQ ID NO: 78396 - RNA, 61 nt, Homo Sapiens
auuauaggugauuucuauuuucuucuguauacuuuucuaugcuuucuagauuaucuacaug

SEQ ID NO: 78397 - RNA, 61 nt, Homo Sapiens
uaaaaaaaacgcuccuuuguaggguuuuaaacuuuucuaauagauuuagauucacuuuugg

SEQ ID NO: 78398 - RNA, 61 nt, Homo Sapiens
auucaaaguacuaauaucuacaugguccacacuuuucuauuuuaaaaaauuguguucucuu

SEQ ID NO: 78399 - RNA, 61 nt, Homo Sapiens
gaaagccaccauagcuguguuuaaagucgagcuuuucuaaauuguaaaacuaucugaacca

SEQ ID NO: 78400 - RNA, 61 nt, Homo Sapiens
uucccucgcuggggcagugccuuuuuaaaaucuuuucuauucucugccuguuagacucuua

SEQ ID NO: 78401 - RNA, 61 nt, Homo Sapiens
uuuuaauuaauuaauuuauuuuuacuuauggcuuuucuaaugaacagggcaaacucuccau

SEQ ID NO: 78402 - RNA, 61 nt, Homo Sapiens
gguuaaaggucugaagcagcuuccacuaucccuuuucuaaauuaaagacguguuuuuaaaa

SEQ ID NO: 78403 - RNA, 61 nt, Homo Sapiens
uaaaaugaucucucuuucucucucucucucucuuuucuaagaaacaauuaugugcacuuug

SEQ ID NO: 78404 - RNA, 61 nt, Homo Sapiens
uagccuacaccuucucuuugguuuaguuuuccuuuucuauaacacucugaauugcuaaucu

SEQ ID NO: 78405 - RNA, 61 nt, Homo Sapiens
auguaaccuguaaccuuguuguuuaaguuuucuuuucuauuaauacucuguccuguggucc

SEQ ID NO: 78406 - RNA, 61 nt, Homo Sapiens
guaauugcuuaccugcacacaguuuuuuuuccuuuucuaaauuuguuugugaucauugaca

SEQ ID NO: 78407 - RNA, 61 nt, Homo Sapiens
aauguuuauugacaggucuuuucaaauaaugcuuuucuaauuaauagccaaagauuucaua

SEQ ID NO: 78408 - RNA, 61 nt, Homo Sapiens
uaaaagauaaaagagcgauacacaaagcuuucuuuucuaacuuuuccaagcaaaaucuaaa

SEQ ID NO: 78409 - RNA, 61 nt, Homo Sapiens
uucuaaagaaacccaugcugugaaauagagacuuuucuacugaucaucauaacucuguauc

SEQ ID NO: 78410 - RNA, 61 nt, Homo Sapiens
ugaaguucacaauaggucauaaggucucuuccuuuucuaaaauugaaagacaagaaauuua

SEQ ID NO: 78411 - RNA, 61 nt, Homo Sapiens
aucuuuauauacucugaagcauuucuucaaacuuuucuacuuuuauuugucauugauaccu

SEQ ID NO: 78412 - RNA, 61 nt, Homo Sapiens
ccaaugcuugaauaaguagaccccaagcauccuuuucuaaaaagugacuuaaaauaagcca

SEQ ID NO: 78413 - RNA, 61 nt, Homo Sapiens
ugauugaguaaaagcagcuuaaauuacuuuucuuuucuacauuaagaaauauauucucaac

SEQ ID NO: 78414 - RNA, 61 nt, Homo Sapiens
ugaguuguugauuuuaggagcucccuccuuucuuuucuaagggauuaauucccagaacccu

SEQ ID NO: 78415 - RNA, 61 nt, Homo Sapiens
aaacuguugaucagcaaaaaaccugcagcugcuuuucuaacucucagaccuuagguaacau

SEQ ID NO: 78416 - RNA, 61 nt, Homo Sapiens
guaauauuaaugagaagggagcauggggauucuuuucuaaggguagauuuuuauaaaacaa

SEQ ID NO: 78417 - RNA, 61 nt, Homo Sapiens
ccuccuguugguuacuaaucguauggauuugcuuuucuaaguucuugugugugaugaacca

SEQ ID NO: 78418 - RNA, 61 nt, Homo Sapiens
uauuuggugguuuauguuuacguuuacaagccuuuucuaagagagaaccuuucggaucacu

SEQ ID NO: 78419 - RNA, 61 nt, Homo Sapiens
gacugaaaguagaagucugucagacucagcucuuuucuagccuggccgccugaggggacac

SEQ ID NO: 78420 - RNA, 61 nt, Homo Sapiens
ggguggugcccuggccccgaggucaccccgacuuuucuaaaucuuguuugagugaagucau

SEQ ID NO: 78421 - RNA, 61 nt, Homo Sapiens
cuucccugucucaacaccugcuuugacccugcuuuucuauuauuacaucagucagcaucuu

SEQ ID NO: 78422 - RNA, 61 nt, Homo Sapiens
gcccauggcccagucacucaggggcgaguuucuuuucuaacauagcccuuucuuugccaug

SEQ ID NO: 78423 - RNA, 61 nt, Homo Sapiens
uuugccaugaggccaugaggcccgcuucauccuuuucuauuucccuagaaccuuaauggua

SEQ ID NO: 78424 - RNA, 61 nt, Homo Sapiens
agaucuuccaaagcacuauuuguuguaauaacuuuucuaaauguagugccuuuaaaggaaa

SEQ ID NO: 78425 - RNA, 61 nt, Homo Sapiens
aaaaguggguggcaauauucagugcuuaacacuuuucuagcguugguacaucugagaaaug

SEQ ID NO: 78426 - RNA, 61 nt, Homo Sapiens
gugaguuuguuuaguucauucuguacuacugcuuuucuauuauuacucucuucuccuacuu

SEQ ID NO: 78427 - RNA, 61 nt, Homo Sapiens
agaagcuuuuaaacuuuuuggucuuccugaucuuuucuacaugcucuuaacuacugauguu

SEQ ID NO: 78428 - RNA, 61 nt, Homo Sapiens
uuuacaguaaaaccucauuaugaaguguuugcuuuucuacugauacuggagucuuaucauu

SEQ ID NO: 78429 - RNA, 61 nt, Homo Sapiens
aagcuuuaacuguagugccuuacuucucucucuuuucuaaaacugugccuacauuuaaaaa

SEQ ID NO: 78430 - RNA, 61 nt, Homo Sapiens
uuuaaaccagaaaaccucaucucucuccuuucuuuucuaucaaaagucaaaagagaccugu

SEQ ID NO: 78431 - RNA, 61 nt, Homo Sapiens
ccucuugccacuuuuaaaaucaaugcuuaggcuuuucuaaggaaaugccuuguaccuacaa

SEQ ID NO: 78432 - RNA, 61 nt, Homo Sapiens
aggccuacaacuuuugccucagacuguuccccuuuucuaaggguauucaaguuuucaccuu

SEQ ID NO: 78433 - RNA, 61 nt, Homo Sapiens
ggaugcacuaaaguucucacuuuagugagaacuuuucuagcuauuccaauacagaguucuu

SEQ ID NO: 78434 - RNA, 61 nt, Homo Sapiens
uaugcagaauaagcucuuuauuggugucuuucuuuucuaauauaaauuauguuuaaauggc

SEQ ID NO: 78435 - RNA, 61 nt, Homo Sapiens
uuuuuuuguuuauuuuguuauuuguacaggucuuuucuauuaaaaaagauuaaaugccagc

SEQ ID NO: 78436 - RNA, 61 nt, Homo Sapiens
cuuuucuuuguuuucuuuugacuuuuuucuccuuuucuauuugaacuguuuuauuuuccug

SEQ ID NO: 78437 - RNA, 61 nt, Homo Sapiens
uacauauauaugaaaauuauuaugacacgcacuuuucuaaucauuguacauuucucagagu

SEQ ID NO: 78438 - RNA, 61 nt, Homo Sapiens
cuuucaguugaauaagggccaacuuauuguucuuuucuauuaaucaaugcacaguauaaag

SEQ ID NO: 78439 - RNA, 61 nt, Homo Sapiens
aucuaacaggguuaauuucacacugaugguucuuuucuacuuacagaagugucaacagaag

SEQ ID NO: 78440 - RNA, 61 nt, Homo Sapiens
uccccuucccucacacccugccucgcccccacuuuucuaguuaacuuuuuccauaucccuc

SEQ ID NO: 78441 - RNA, 61 nt, Homo Sapiens
uggcacguugcugccagugccccagacaguucuuuucuacccugcgggcccgcacguuuua

SEQ ID NO: 78442 - RNA, 61 nt, Homo Sapiens
uucugauguuuguaaccagacgcccguccuccuuuucuagucucauccucaucugugcaac

SEQ ID NO: 78443 - RNA, 61 nt, Homo Sapiens
cacuguuagagagagaccuaacucuucuuagcuuuucuacucggcgggcagagcggggccc

SEQ ID NO: 78444 - RNA, 61 nt, Homo Sapiens
gacuaagaguguuuaaggauuagguuagagucuuuucuacaagaggggcugcuggcugaau

SEQ ID NO: 78445 - RNA, 61 nt, Homo Sapiens
aaagaacagccuguaaaaucaaaaucauuuucuuuucuaacuuuaaugaaaagcagccccc

SEQ ID NO: 78446 - RNA, 61 nt, Homo Sapiens
ugcaguguuaucucuugucugaaauacuuaccuuuucuauaagaaaaacaaauguuaccaa

SEQ ID NO: 78447 - RNA, 61 nt, Homo Sapiens
uguaaaauacuguaauuguaucuuguguguucuuuucuauuuaacugaaauccuauauauu

SEQ ID NO: 78448 - RNA, 61 nt, Homo Sapiens
cuuccccugugcucccuuucucuccucucuccuuuucuagccuguucuuuacauggggcuc

SEQ ID NO: 78449 - RNA, 61 nt, Homo Sapiens
cugaccaagggugguuaagugacacauagaacuuuucuaagagaagacagacaaguugaca

SEQ ID NO: 78450 - RNA, 61 nt, Homo Sapiens
aggcugaagccuggagucugcccccacuucccuuuucuauaauccacccuucugcaggccc

SEQ ID NO: 78451 - RNA, 61 nt, Homo Sapiens
aguugcuucccauuuccucuuucuagccguccuuuucuagugugugcucacucuuccuagg

SEQ ID NO: 78452 - RNA, 61 nt, Homo Sapiens
uguaaauucaauuuggaguuuauuuaauugacuuuucuaucacguuggggcacaugccaac

SEQ ID NO: 78453 - RNA, 61 nt, Homo Sapiens
gcaugguguuugggcagcaggcaucauuuuccuuuucuagcuucauaggaauauugugagc

SEQ ID NO: 78454 - RNA, 61 nt, Homo Sapiens
auuggucgccaucugcacgccaggcggcauccuuuucuaugaaguguugacuuuguaaauc

SEQ ID NO: 78455 - RNA, 61 nt, Homo Sapiens
ccaggcucaccccucacccuuuuuuugguugcuuuucuaauaaagauggaacaguugucuu

SEQ ID NO: 78456 - RNA, 61 nt, Homo Sapiens
ccuugcccguuugccuguuccuauucagugucuuuucuauuuuuuccucucucguucaugc

SEQ ID NO: 78457 - RNA, 61 nt, Homo Sapiens
guggccauguuuucuacccagacaggcccugcuuuucuaggauguggccuuagagcaagaa

SEQ ID NO: 78458 - RNA, 61 nt, Homo Sapiens
ucuccuaguuuuagguuguuaccagcugugacuuuucuauuaguugggcgugcucuguggu

SEQ ID NO: 78459 - RNA, 61 nt, Homo Sapiens
cugagaucucaaugcgaaauugugcuaaaggcuuuucuacuugacuuacacagagcaaaau

SEQ ID NO: 78460 - RNA, 61 nt, Homo Sapiens
gagucugggcuuguuuguguuuuguugcuuucuuuucuauugagaaagacuuuuucacuuc

SEQ ID NO: 78461 - RNA, 61 nt, Homo Sapiens
uuuuauaugccgcugcuuugugagguuuuagcuuuucuauguguucuuuugaagcuugugc

SEQ ID NO: 78462 - RNA, 64 nt, Homo Sapiens
uaguuuaccuaaugcccuuaccuaauuagauuaugauaaauagguuugucauuuugcaaguuac

SEQ ID NO: 78463 - RNA, 64 nt, Homo Sapiens
uaaaugcauucauucuaaaaaauuuuuugaaccagauaaauaaaauuuuuuuuugacaccacag

SEQ ID NO: 78464 - RNA, 64 nt, Homo Sapiens
uacuacugagacacuucaauaucaaccucuucaugauaaauaucaacuauucuugucacuuggc

SEQ ID NO: 78465 - RNA, 64 nt, Homo Sapiens
auuuaugguuuaguacuuguuugcuguuuuuauggauaaauaagugccuugucucuugccauau

SEQ ID NO: 78466 - RNA, 64 nt, Homo Sapiens
acuuaggaggaaugcagauaaaaguaccuuguaagauaaauauaaauuggaguuaggaauuuca

SEQ ID NO: 78467 - RNA, 64 nt, Homo Sapiens
augagauuaaucuguauuauauaagaaaagaacugauaaauauuuauaaaaugacaaacuugga

SEQ ID NO: 78468 - RNA, 64 nt, Homo Sapiens
guguugcuaaugguuaaagaagucuguaucuagugauaaauauaccaguuuuuuuaaaaagaug

SEQ ID NO: 78469 - RNA, 64 nt, Homo Sapiens
uaaaaggcucaacuguaagccucuuagccaguuggauaaauauuuggggucaccuagccauuga

SEQ ID NO: 78470 - RNA, 64 nt, Homo Sapiens
caucuccuuaucuauaaaaaggggauauucuuaggauaaauacaugaaaaauuauacuugauag

SEQ ID NO: 78471 - RNA, 64 nt, Homo Sapiens
ccuuucuaaaguuguauauccucuggugugaaaggauaaauauggucuggcauugcauaaacuu

SEQ ID NO: 78472 - RNA, 64 nt, Homo Sapiens
uugagagcugccacccacaaaaaucuggacuauggauaaauaauaagagcaaaugcaacaaaac

SEQ ID NO: 78473 - RNA, 64 nt, Homo Sapiens
uauauauauauuuguaucucaaaacauauuuuuggauaaauauaugagaaacauuuaucuguau

SEQ ID NO: 78474 - RNA, 64 nt, Homo Sapiens
cuuacaaaagacaaugugcuugaaaauucagguggauaaauaguugcacuaacuuuaaagaaau

SEQ ID NO: 78475 - RNA, 64 nt, Homo Sapiens
aauguagggaagcuguaagcuuucagaacucauagauaaauaugaucauacucuauuaccaauu

SEQ ID NO: 78476 - RNA, 64 nt, Homo Sapiens
uauguggaauauucuuuuuauuucauaugaaacugauaaauauaaugcuuuauggagaguauau

SEQ ID NO: 78477 - RNA, 64 nt, Homo Sapiens
uacauuuuauuuucuugcugaugaacuggaauuggauaaauauugcaaguggaugaguuggaaa

SEQ ID NO: 78478 - RNA, 64 nt, Homo Sapiens
auuggacauuuucaucaaugcagucuaauguguagauaaauauuucaaccauaauaaguggauu

SEQ ID NO: 78479 - RNA, 64 nt, Homo Sapiens
auugguaggaauguuuucuuuuaagacaugccuggauaaauaaauauguaacaaacagccauau

SEQ ID NO: 78480 - RNA, 64 nt, Homo Sapiens
aaacugccaucaucauuugucugauuguugaacagauaaauacgcagucuugaauuuacucacg

SEQ ID NO: 78481 - RNA, 64 nt, Homo Sapiens; identical to SEQ ID NO: 78479

SEQ ID NO: 78482 - RNA, 64 nt, Homo Sapiens; identical to SEQ ID NO: 78480

SEQ ID NO: 78483 - RNA, 64 nt, Homo Sapiens
uccgggaacguugggagucaccugauucugcaaagauaaauaauaucccugcauuaucaaaaua

SEQ ID NO: 78484 - RNA, 64 nt, Homo Sapiens
uacgaaaaauuacaguuuacuuaaugaacauaaggauaaauagaaaaacugaaucaucauacau

SEQ ID NO: 78485 - RNA, 64 nt, Homo Sapiens
cuacuuuugauagcaugcuuuucuguaauaugaggauaaauaauaauaaaugucuccuucugug

SEQ ID NO: 78486 - RNA, 64 nt, Homo Sapiens
acuggguuauaagaaaaaauuuagcccuauagaugauaaauaucagcucuguccuucaaaccuu

SEQ ID NO: 78487 - RNA, 64 nt, Homo Sapiens
aacauagacuuaauuccaauaauuagggaaaauugauaaauaucugucaccaaaccacaagaaa

SEQ ID NO: 78488 - RNA, 64 nt, Homo Sapiens
uucuaagaccuuuuuuggauagucaaauauaagagauaaauaguuuaauuuuuucagaccuuuu

SEQ ID NO: 78489 - RNA, 64 nt, Homo Sapiens
uuuucagaccuuuuuuggauaguccaauauuagagauaaauaguuuaauuuuuucagauauaau

SEQ ID NO: 78490 - RNA, 64 nt, Homo Sapiens
ccuuuuuauaccucaguuuuuuguauuuuuaaaagauaaauauugaugccaguaguguucaaag

SEQ ID NO: 78491 - RNA, 64 nt, Homo Sapiens
uguuggacaagcauagaaagcuugggauccugaagauaaauauguaaaucucuuugccuaacaa

SEQ ID NO: 78492 - RNA, 64 nt, Homo Sapiens
uuuuuuuuccucauuuuucuuaaauccaaguuggccguuuuauuaguauguuucaaauguguau

SEQ ID NO: 78493 - RNA, 64 nt, Homo Sapiens
ugucuaugguagcugagccaaacacguaggauuuccguuuuaagguucacauggaaaagguuau

SEQ ID NO: 78494 - RNA, 64 nt, Homo Sapiens
acaaucagggcccaucuucugugcagagucccugccguuuuaggcccauucucagagaaugugu

SEQ ID NO: 78495 - RNA, 64 nt, Homo Sapiens
caugauccaacguuaacuacgacucccugagguuccguuuuacacgaaggugcauuuuuguuua

SEQ ID NO: 78496 - RNA, 64 nt, Homo Sapiens
caggaagacuucuugggaccuuuugaaucagauuccguuuuaguuuuguccuuuguuuccuacc

SEQ ID NO: 78497 - RNA, 64 nt, Homo Sapiens
ugacauugaaaacuuguguguuggucuaguuuguccguuuuauaggccaacuagaccacacuua

SEQ ID NO: 78498 - RNA, 64 nt, Homo Sapiens
auuuuuuaaaaaguaaaaguuucucagauacagaccguuuuaugaaagcauugauauuaguauc

SEQ ID NO: 78499 - RNA, 64 nt, Homo Sapiens
guguacaucuagcuaaaagugugguuuaucuaaaccguuuuaauaagcaagaugacugggaaau

SEQ ID NO: 78500 - RNA, 64 nt, Homo Sapiens
gagaaauccaauuuguaaaacuugaacaaugauaccguuuuauuuacuuaguagcaucacugug

SEQ ID NO: 78501 - RNA, 64 nt, Homo Sapiens
aagggggaggcuaaagcccaaaccucuuccccgcccguuuuacaggaggcacccaugccaucuc

SEQ ID NO: 78502 - RNA, 64 nt, Homo Sapiens
agguuuuguguuuguuugcuuugauuguaacgugccguuuuaaggggaggggcgauaaauaccu

SEQ ID NO: 78503 - RNA, 64 nt, Homo Sapiens
ccauacgccuugccagggcggcaggauugucacaccguuuuaggacucugugccacuuugagag

SEQ ID NO: 78504 - RNA, 64 nt, Homo Sapiens
augucagauaauuuucaccaguuuuuauuuggagccguuuuauuguguagaccauauuuacaua

SEQ ID NO: 78505 - RNA, 64 nt, Homo Sapiens
gguuuggcuuaguugaagagacauaccuacgcccccguuuuaugugcugcuuuuuggugucccg

SEQ ID NO: 78506 - RNA, 64 nt, Homo Sapiens
auuuugccuuuuuauguuuuguacaauuuaaaaaccguuuuaacuuuaacuuuauuuuccuguu

SEQ ID NO: 78507 - RNA, 64 nt, Homo Sapiens
ggaucuuuuuuaauguuuuaaaacagaugccugaccguuuuaaaucuaaaaaggaacugaggua

SEQ ID NO: 78508 - RNA, 64 nt, Homo Sapiens
gucauagccuagugcauuacucaugauguuuuagccguuuuaauggagcagaaaaucuauugcc

SEQ ID NO: 78509 - RNA, 64 nt, Homo Sapiens
ugguguuacuaagaugcuccuacacuuugugauaccguuuuaaggacauggugcauuuuuuuuu

SEQ ID NO: 78510 - RNA, 64 nt, Homo Sapiens
uuaguuagcauuuuucuuauuuccccaucaucauccguuuuaccugaacauuugugacugccca

SEQ ID NO: 78511 - RNA, 64 nt, Homo Sapiens
uccagguuucagaggaccuggcauugaaaagaauccguuuuauauuacaguggacccucugggu

SEQ ID NO: 78512 - RNA, 64 nt, Homo Sapiens
gagacuggaauaauuauggccggaaaacaaguacccguuuuaaguaagacaugguuuuccaugu

SEQ ID NO: 78513 - RNA, 64 nt, Homo Sapiens
ucaguaacuccuagacuuuuucucaucccaugccccguuuuaaauugucaguuuucccucugac

SEQ ID NO: 78514 - RNA, 64 nt, Homo Sapiens
aucuguaaaauaaaaacucaugauauacuuucauccguuuuaugaacggcuucauuaauuacug

SEQ ID NO: 78515 - RNA, 64 nt, Homo Sapiens
uuauauaaugagaaaugugcggcacuggagccacccguuuuaauauaacuuaagcuuugauagu

SEQ ID NO: 78516 - RNA, 64 nt, Homo Sapiens
auguaauauuuuagguaaucuauacccuguaaagccguuuuagauaagauacuuauuguccauu

SEQ ID NO: 78517 - RNA, 64 nt, Homo Sapiens
uaaacucccccuggaaaaaaaaaaaagagcaaaaccguuuuaaauuugaaaggauauuugucga

SEQ ID NO: 78518 - RNA, 64 nt, Homo Sapiens
ccucaaggccuauagccuguugccuaacucuguaccguuuuauuggaaguaggcucugggucca

SEQ ID NO: 78519 - RNA, 64 nt, Homo Sapiens
agagcuuuuacuugggcgcccugccccagucaggccguuuuagacggaaccguucgcacccggc

SEQ ID NO: 78520 - RNA, 64 nt, Homo Sapiens
aacuuauuuaaaugacagcaccugagaagaggaaccguuuuacacuggauguuucucauguaga

SEQ ID NO: 78521 - RNA, 64 nt, Homo Sapiens
uguuagaaaugacguguuuuaaugagaggccuccccguuuuauucuuugaggaguggggaaggg

SEQ ID NO: 78522 - RNA, 64 nt, Homo Sapiens
uguauuaaacuuucauaugccaaaaggguuugugccguuuuaucugccaucaguguuugaccug

SEQ ID NO: 78523 - RNA, 64 nt, Homo Sapiens
cuguuacugugguuuuguuuaaugccccccccccccguuuuaauauaucccuguacucuaauaa

SEQ ID NO: 78524 - RNA, 64 nt, Homo Sapiens
gugaauauagcaauauaguaucagaaauuaaaguccguuuuacuuuaaaacauagacugaucac

SEQ ID NO: 78525 - RNA, 64 nt, Homo Sapiens
aucucccuagggccccaccuggaccauuuucccuccguuuuauuuuguuaauuaaauucuuucc

SEQ ID NO: 78526 - RNA, 64 nt, Homo Sapiens
uggagaucauaauuuuauguuuagauaacuuguaccguuuuaaacaaaaaaguacaaaguuggc

SEQ ID NO: 78527 - RNA, 64 nt, Homo Sapiens
caauaaaaccaaugagugucgggagugaagaaacccguuuuauagccaaaaguaucaauaaacg

SEQ ID NO: 78528 - RNA, 64 nt, Homo Sapiens
ggccuauuccggaaaagaugcuugaugcccagccccguuuuaaggacauuaaaagcuaucaggc

SEQ ID NO: 78529 - RNA, 64 nt, Homo Sapiens
gauguugaguacauuuggcuugaaaaacaaagagccguuuuaauaaagaaguaucauucagggg

SEQ ID NO: 78530 - RNA, 64 nt, Homo Sapiens
auaaaauuuugcaugugccaaaugcaaauggcuaccguuuuacagaacggugucuuucuuuaua

SEQ ID NO: 78531 - RNA, 64 nt, Homo Sapiens
aaaggaaaacgugaacaaaccuaguuuccugguuccguuuuagaagcuuaaaacccaauacagu

SEQ ID NO: 78532 - RNA, 64 nt, Homo Sapiens
ugacuuguuuuaguauuuugugugccuuagauuuccguuuuaagacauguauauuuuugugagc

SEQ ID NO: 78533 - RNA, 64 nt, Homo Sapiens
aaauucaauuaggauuaauaaagauggcacuuucccguuuuauuccaguuuuauaaaaagugga

SEQ ID NO: 78534 - RNA, 64 nt, Homo Sapiens
gccaguguucaaaagauuguguaaaaguucaagcccguuuuagaaagccaacauuuuauguuau

SEQ ID NO: 78535 - RNA, 64 nt, Homo Sapiens
cuauuccuaucuguggauguaaguaaucacuaacccguuuuauugaucucacucagccgcagac

SEQ ID NO: 78536 - RNA, 64 nt, Homo Sapiens
caucagagucagugcuauaaugagggagaaaaauccguuuuaucguuucaagaggaacaaggga

SEQ ID NO: 78537 - RNA, 64 nt, Homo Sapiens
agacauuuccuaauuuaugguuuuuccaauuucuccguuuuauaguuuuuuucugaauaacauu

SEQ ID NO: 78538 - RNA, 64 nt, Homo Sapiens
uauugaaguguuuguucaguaugccaucuucaaaccguuuuauuuuccaucuguucuuguugca

SEQ ID NO: 78539 - RNA, 64 nt, Homo Sapiens
gacucacacaggacugaagcugggagguccagcuccguuuuaaaacuauuccucaugguggcuu

SEQ ID NO: 78540 - RNA, 64 nt, Homo Sapiens
aggccgcugggcugggaucaguguuauuuauuugccguuuuaauuuauggauucuccgcaccuc

SEQ ID NO: 78541 - RNA, 64 nt, Homo Sapiens
cuugacaaauuguguuuuuagugaauuucuuaaaccguuuuauuuagcccuccuucccucuuuc

SEQ ID NO: 78542 - RNA, 64 nt, Homo Sapiens
auuuuucccuuucaaauaaaacacuagucagguaccguuuuaucccagucguacucuuccaggu

SEQ ID NO: 78543 - RNA, 64 nt, Homo Sapiens
aaagaggaaacugaaguucuucuauauuuuauccccguuuuauagucugccccuaugugacagc

SEQ ID NO: 78544 - RNA, 64 nt, Homo Sapiens
ccagaaugaauagacuacacuucagccaaaauuaccguuuuagaaaaguuagauuuggggguua

SEQ ID NO: 78545 - RNA, 64 nt, Homo Sapiens
ccaaagguauuaacaugggccaagggaaucguuaccguuuuauacaggugauggauggguuugu

SEQ ID NO: 78546 - RNA, 64 nt, Homo Sapiens
ugauaugcuuguuagaacucuuuuuguccaugugccguuuuaacugcuguuugcggugaaaugc

SEQ ID NO: 78547 - RNA, 64 nt, Homo Sapiens
cuugauguguauaguaauaguugaguuuuguugcccguuuuaugguuccaaucuaaaguucuuu

SEQ ID NO: 78548 - RNA, 64 nt, Homo Sapiens
ucagcucuuguacuuuucaguggaaccuugauuaccguuuuacauacccuaaucccaugaugcc

SEQ ID NO: 78549 - RNA, 64 nt, Homo Sapiens
aacguauaagauuaggaugaucccucagucuucaccguuuuauaguauuuucaguaucacugga

SEQ ID NO: 78550 - RNA, 64 nt, Homo Sapiens
agaacauauauaaagggcauucucuacaaaugugccguuuuaagaauaaaacccccucaaaucu

SEQ ID NO: 78551 - RNA, 64 nt, Homo Sapiens
aaguggcaugugccuugaaaguguggaaagcugaccguuuuaagaauaaaauaucuuguagccu

SEQ ID NO: 78552 - RNA, 64 nt, Homo Sapiens
aaauuguauaugaacuuauucuuaaauaauugaaccguuuuauauucaaaugacuuaugaucgu

SEQ ID NO: 78553 - RNA, 64 nt, Homo Sapiens
aguggugcuguugagauauuuuaaaauauugccuccguuuuaucgaggagagaaauaauaacua

SEQ ID NO: 78554 - RNA, 64 nt, Homo Sapiens
gagcaguuuccuccagggauaaguaaauauggagccguuuuauuaguaugaaccgugaccagag

SEQ ID NO: 78555 - RNA, 64 nt, Homo Sapiens
cccacagaacaacgggaacgccucccuccagcacccguuuuaaucucuucagcagccacccggc

SEQ ID NO: 78556 - RNA, 64 nt, Homo Sapiens
ggggaagcaacauuuggaggccagggcccuuccuccguuuuaagucuaccuggugccugagagc

SEQ ID NO: 78557 - RNA, 64 nt, Homo Sapiens
aaagaaauuaaguucuugaaaauuuagccaaaucccguuuuaugggaaugcucuuuagaauuca

SEQ ID NO: 78558 - RNA, 64 nt, Homo Sapiens
uuacguuuugugaagagcaaagcacuuggaaucuccguuuuaaagcuucaaguguuaaaaaugc

SEQ ID NO: 78559 - RNA, 63 nt, Homo Sapiens
acaagauggaggaggaaugaagcugggguggggccguuuuagguagagccuuaaaaaugcuuc

SEQ ID NO: 78560 - RNA, 64 nt, Homo Sapiens
aauuuuuuguauuuuuaguagagacgggguuucaccguuuuagccgggauggucucgaucuccu

SEQ ID NO: 78561 - RNA, 64 nt, Homo Sapiens
ugaugaacugagaaacuuuuccauaaaacuugcaccguuuuacauuccuaacauuccacaaaag

SEQ ID NO: 78562 - RNA, 64 nt, Homo Sapiens
aaaagaacaaaaaagacacagaagcacgugugugccguuuuaggccuuauuuggcacagagacg

SEQ ID NO: 78563 - RNA, 64 nt, Homo Sapiens
uacuucccaacaacucuuagagguagguguauucccguuuuacagauaaggaaacugaggccca

SEQ ID NO: 78564 - RNA, 64 nt, Homo Sapiens
gaaccugaauagcucugcaaaaaacaccaaaggaccguuuuaucguuuucuguuguugcugugg

SEQ ID NO: 78565 - RNA, 64 nt, Homo Sapiens
aauaaacugagcgaccccaggccacgcucagugcccguuuuaccggcuuccgcgcccagcgcuc

SEQ ID NO: 78566 - RNA, 64 nt, Homo Sapiens
cucauuuccacucuaguugauugauguacauacuccguuuuaaauucggcgugauguugaucuu

SEQ ID NO: 78567 - RNA, 64 nt, Homo Sapiens
guaagggaaugccagucugaggaguuagaaguuaccguuuuauguaagguaauuaugaaagaca

SEQ ID NO: 78568 - RNA, 64 nt, Homo Sapiens
ugcaauguguaucugaaaagcaaggaauuugcagccguuuuacaaauaucuguggaacauguaa

SEQ ID NO: 78569 - RNA, 64 nt, Homo Sapiens
gagauuuuuccucauauuuaaaaugguuuugguuccguuuuacguagcauggaauugagcuacu

SEQ ID NO: 78570 - RNA, 64 nt, Homo Sapiens
auuuacucauuaucgccuuugggaagaaacaaacccguuuuaugguccauuuauagaauaaugu

SEQ ID NO: 78571 - RNA, 64 nt, Homo Sapiens
uucaaauuagaaguggauuucuguuucauuacuuccguuuuaaaaguuuuugccagagaguuuu

SEQ ID NO: 78572 - RNA, 64 nt, Homo Sapiens
gaggaguuuuaaaguacuguaacuuuaaaauaaauaacuacaaagcuucuuuguccaaacguca

SEQ ID NO: 78573 - RNA, 64 nt, Homo Sapiens
gguuuuaaauaguuuuucugacccuucugaaaaauaacuacauaagugcuucuuguugcugggu

SEQ ID NO: 78574 - RNA, 64 nt, Homo Sapiens
ugugagagagcugaguagaguguugguuuuuccauaacuacagggggaaaaaaagucauuaggc

SEQ ID NO: 78575 - RNA, 64 nt, Homo Sapiens
auugugccuccuguuuucucgaguggggacacuuuaacuacaguuuacaccucgggcgcauaaa

SEQ ID NO: 78576 - RNA, 63 nt, Homo Sapiens
gaauuaagccaucagggaaagggaucaugguacauuuaucacuaagaaccugguguguuucuu

SEQ ID NO: 78577 - RNA, 63 nt, Homo Sapiens
ucugauggcugaagaauguauuuccuucuugacauuuaucacccccugugcuuggaaaccuuu

SEQ ID NO: 78578 - RNA, 63 nt, Homo Sapiens
uguauauuaaugaauuauccaagauucgaugggauuuaucaguguguagauagcucuauaaug

SEQ ID NO: 78579 - RNA, 63 nt, Homo Sapiens
ucauuucuuauaaaaaacaaaacaacaacaauaauuuaucaaaauuggcauauuuaaagccua

SEQ ID NO: 78580 - RNA, 63 nt, Homo Sapiens
cuguuguaaugauguuuugaucauuuguauauuauuuaucacaauucaugguauuuuaagaga

SEQ ID NO: 78581 - RNA, 63 nt, Homo Sapiens
uuuuacaaagucauuuuaaggauugcugagaguauuuaucaggagauguuuauuauuagaaaa

SEQ ID NO: 78582 - RNA, 63 nt, Homo Sapiens
guuuaaagcuuugaauaucuauguauuaaaucaauuuaucacuuuaaagguuuuuuuuuuuau

SEQ ID NO: 78583 - RNA, 63 nt, Homo Sapiens
uuuuaauagggugagcuugauggcuguauuuagauuuaucacuuaaguuaaaugauugagagu

SEQ ID NO: 78584 - RNA, 63 nt, Homo Sapiens
cccugcuaaauaaugaaaaaacacuuuacuaaaauuuaucaaauuauacuggguucggauugu

SEQ ID NO: 78585 - RNA, 63 nt, Homo Sapiens
agcaguggugaggagugggagggcccagcaagcauuuaucagaaauagaaucacaauaggagg

SEQ ID NO: 78586 - RNA, 63 nt, Homo Sapiens
agcauauuguguucugaguggauagcugcauucauuuaucaccaggccaaugcagcuaauuuu

SEQ ID NO: 78587 - RNA, 63 nt, Homo Sapiens
ugcagauagccuauuuauuaacuaaagagacauauuuaucagugauauuucauuccuuuguuu

SEQ ID NO: 78588 - RNA, 63 nt, Homo Sapiens
aacaugaaaauauuuuauuuuuuuuuuauaaauauuuaucaaggccuauucauuauauguaua

SEQ ID NO: 78589 - RNA, 63 nt, Homo Sapiens
ucucuauuuugcuauuugccuuuuggauccaagauuuaucaucugucuucuuugaucauuuga

SEQ ID NO: 78590 - RNA, 63 nt, Homo Sapiens
uuggguuuuuguacugaaguuaagauuuugcagauuuaucaauuaucaauggauuaagaaguu

SEQ ID NO: 78591 - RNA, 63 nt, Homo Sapiens
ggauuaagaaguuuaagauugcuacuccuuaauauuuaucaauuuuacgguguuugaagacca

SEQ ID NO: 78592 - RNA, 63 nt, Homo Sapiens
uaaaaguugucauucuuaggaauuugguuugaaauuuaucaguuauacagaauugucauacug

SEQ ID NO: 78593 - RNA, 63 nt, Homo Sapiens
acuuuugaggcagccauuagguugaaaguauauauuuaucauauaaaacuugaugcguuuugc

SEQ ID NO: 78594 - RNA, 63 nt, Homo Sapiens
uuguuaucuguuguuaaguugaaauguauaaucauuuaucacuaaauugcacauugccuuuau

SEQ ID NO: 78595 - RNA, 63 nt, Homo Sapiens
uaucugccacaguaaauuaaagcauuacacaguauuuaucaguauuuuuuaaacauccugucc

SEQ ID NO: 78596 - RNA, 63 nt, Homo Sapiens
uugaccugguguucuucaucauucuugcuauggauuuaucaauuuuguuccucuuuuccaaaa

SEQ ID NO: 78597 - RNA, 63 nt, Homo Sapiens
ccaaacccauguauuagagaagaagggcgugaaauuuaucaccuaagcuuuccauucaggaag

SEQ ID NO: 78598 - RNA, 63 nt, Homo Sapiens
aagguauugaacacuggauuaaucagcauuguuauuuaucauugauuuuucaaaauaaaaguc

SEQ ID NO: 78599 - RNA, 63 nt, Homo Sapiens
aaauucuccuugucauuuuaagaaaacaaacaaauuuaucaugcugcaaugccaaugauugua

SEQ ID NO: 78600 - RNA, 63 nt, Homo Sapiens
aaaaagaaauucacugguucuuuacaaaauagaauuuaucaucaaguuauuacacaaacuuca

SEQ ID NO: 78601 - RNA, 63 nt, Homo Sapiens
uuucuaaguauauagaaagcuuguauaauucagauuuaucaauuuccugauuuaauguagacu

SEQ ID NO: 78602 - RNA, 63 nt, Homo Sapiens
aaugaccuauguuuagucacauuguuaguauucauuuaucaaacuugucaauuauguugugaa

SEQ ID NO: 78603 - RNA, 63 nt, Homo Sapiens
gauuauugacugcugagaaaaguguuguacagaauuuaucaugaggcacaaaacaugagagaa

SEQ ID NO: 78604 - RNA, 63 nt, Homo Sapiens
ucuaaugcaugugauuuaaucuauaugaacucuauuuaucaugaaagcuauccagggcuuaac

SEQ ID NO: 78605 - RNA, 63 nt, Homo Sapiens
uuaucaugaaaacuucuuugaaguaagcuugaaauuuaucauuuuguuauaugcugcuuaaua

SEQ ID NO: 78606 - RNA, 63 nt, Homo Sapiens
cauacggaaaguguuugagagcaaguaguugacauuuaucagcaaaucucuugcaagaacagc

SEQ ID NO: 78607 - RNA, 63 nt, Homo Sapiens
uaucucagauuguguagauaugcuauuuaaauaauuuaucaggaaauacugccuguagaguua

SEQ ID NO: 78608 - RNA, 63 nt, Homo Sapiens
uuuaugacccaaaucacaaucauauaaacaauuauuuaucacuaaacaugcaauuuaugaaaa

SEQ ID NO: 78609 - RNA, 63 nt, Homo Sapiens
gaucugauuccaaagagcacauugagcuauaugauuuaucagauggaaaacauaugugaugaa

SEQ ID NO: 78610 - RNA, 63 nt, Homo Sapiens
acugacuacuggaccggagcuaaugccuaaucuauuuaucaaaccaugaaaguguaaauacug

SEQ ID NO: 78611 - RNA, 63 nt, Homo Sapiens
guuggccggugugaugaguacacccucucuggcauuuaucacucauuucacuaguggccgaga

SEQ ID NO: 78612 - RNA, 63 nt, Homo Sapiens
cugagcgagucucuagagggaacuugucagugaauuuaucacuuuagugaaauuugaauugua

SEQ ID NO: 78613 - RNA, 63 nt, Homo Sapiens
gguuaugaaacucagaaaauuuaaggugccuccauuuaucaagaaaagaguuuaaacugaacu

SEQ ID NO: 78614 - RNA, 63 nt, Homo Sapiens
caauuuugguuuuucucauuugaaauguuuuugauuuaucaauauuugugguuuaacuuugug

SEQ ID NO: 78615 - RNA, 63 nt, Homo Sapiens
gaaucugagaaaguacuuucugguggcaaaugaauuuaucauuuuaguauaguuuucgauaaa

SEQ ID NO: 78616 - RNA, 63 nt, Homo Sapiens
cauauacacagucuauacaaugaaauaaugaauauuuaucauauugauacaaacugugaccuc

SEQ ID NO: 78617 - RNA, 63 nt, Homo Sapiens
uaaauucagauccuuucuccacacagcaaugacauuuaucaaucugacucagguguggcuguu

SEQ ID NO: 78618 - RNA, 63 nt, Homo Sapiens
uugaguuaugaaauuaccugcaagcugggauggauuuaucacaguucacugcagcuccuguca

SEQ ID NO: 78619 - RNA, 63 nt, Homo Sapiens
auuaaacacuguaaaagaaaugagaaaagagcaauuuaucaaauuccccaucaaugcugauuc

SEQ ID NO: 78620 - RNA, 64 nt, Homo Sapiens
uuuggaaauaccuggauauuugcuagaggaaaaaugaaagcaaaacuucguacacagugccuug

SEQ ID NO: 78621 - RNA, 64 nt, Homo Sapiens
auggucaaaaaauaagucaucagcacuuaagaaaugaaagcaacuuuugaaauuuucuguuaaa

SEQ ID NO: 78622 - RNA, 64 nt, Homo Sapiens
uuuaucacaaaauaaaaaagagaugaaauuuauaugaaagcauuuuucauucuaaagguaguua

SEQ ID NO: 78623 - RNA, 64 nt, Homo Sapiens
uuuggucuccuuuccccuccaucauucuggcccaugaaagcaacgcaagaccuuugugcuuuug

SEQ ID NO: 78624 - RNA, 64 nt, Homo Sapiens
ucuucaauccuucagucccagccagaagaaucucugaaagcauauugugaauguauacaaugua

SEQ ID NO: 78625 - RNA, 64 nt, Homo Sapiens
caguggccuuuugggaacccaaguuacguccuggugaaagcagaaaggaggagacaggauggcu

SEQ ID NO: 78626 - RNA, 64 nt, Homo Sapiens
gucuauaaaugaacucuuuguucccccuuaacugugaaagcagauugauugccccugggcguuc

SEQ ID NO: 78627 - RNA, 64 nt, Homo Sapiens
cagacaugucuguccucacaggccuuuaucaugcugaaagcacuccuaaauuuugcuuaaggaa

SEQ ID NO: 78628 - RNA, 64 nt, Homo Sapiens
uuuuauaaaaagaaagcccggucucuaugcccuuugaaagcaguuacuguggaccauguguggu

SEQ ID NO: 78629 - RNA, 64 nt, Homo Sapiens
aagcacuaauuaguuuaaaaugagcaaaagaucuugaaagcaaacccucaguugcagugaauug

SEQ ID NO: 78630 - RNA, 64 nt, Homo Sapiens
uuagaaagcaaguguuaccaaaguuguguuaucuugaaagcauuacagguaagggcauguuaug

SEQ ID NO: 78631 - RNA, 64 nt, Homo Sapiens
acauuuuugauagugacuuuggggucuucuucacugaaagcaccuuagaacuguacuauaagaa

SEQ ID NO: 78632 - RNA, 64 nt, Homo Sapiens
guuccaaugaauguacagcacuuccauuaacuuuugaaagcaacacagccuuaaacucaaugcu

SEQ ID NO: 78633 - RNA, 64 nt, Homo Sapiens
aaauauauauuugauauaccuuuguuccacauuuugaaagcaaaagaaaagccuuauauuuuag

SEQ ID NO: 78634 - RNA, 64 nt, Homo Sapiens
ucauggggaaugaauacuuuucaaaaauggaaacugaaagcaaggagaauuuuuuuuuaauggc

SEQ ID NO: 78635 - RNA, 64 nt, Homo Sapiens
auggaugugauucccaacacuacuuauuuacgugugaaagcaacuauucuccuguucagaauaa

SEQ ID NO: 78636 - RNA, 64 nt, Homo Sapiens
caguggccuauaaagaacauaauguuauuuuuacugaaagcaagagauugaaaaguuuugagaa

SEQ ID NO: 78637 - RNA, 64 nt, Homo Sapiens
uuagcuugaauuguauagauuuuuaaaaauucaaugaaagcauguuguuuaauuucuuuuuaaa

SEQ ID NO: 78638 - RNA, 64 nt, Homo Sapiens
uguuuaauuucuuuuuaaaaucacuguugggcuuugaaagcauugagaauauaauaugaaauua

SEQ ID NO: 78639 - RNA, 64 nt, Homo Sapiens
uaucagaacaauguaacauuuacaaaugacauauugaaagcaaaggcuguuuuauuuagccaag

SEQ ID NO: 78640 - RNA, 64 nt, Homo Sapiens
gaugauuaccauuaggaguuacuuuauguauuguugaaagcaaauuuuaaacaugauguuuuag

SEQ ID NO: 78641 - RNA, 64 nt, Homo Sapiens
uggauuacacaggagaaccaaccuaaauaaaaauugaaagcaagaaauuuuguaagauguuuuc

SEQ ID NO: 78642 - RNA, 64 nt, Homo Sapiens
uuaucaguagguacauggauguuuaggaaagauuugaaagcagauucucuacagacggauaucu

SEQ ID NO: 78643 - RNA, 64 nt, Homo Sapiens
agcuuaagcauuuuuucauauuaauaguggcaaaugaaagcauaauuacucuacuguucuuucu

SEQ ID NO: 78644 - RNA, 64 nt, Homo Sapiens
acauaugagaaaacugaccaaucaugaaguaaauugaaagcaggacugacaacuguuuaauuga

SEQ ID NO: 78645 - RNA, 64 nt, Homo Sapiens
aauauuaacugguauucaaacuccugaacaacuuugaaagcaguauagucugucaaaaucagaa

SEQ ID NO: 78646 - RNA, 64 nt, Homo Sapiens
auuuuuuuucauuagucaucugugccauuugagcugaaagcaggcaauacauuguugauggcau

SEQ ID NO: 78647 - RNA, 64 nt, Homo Sapiens
ccguaaggugaauuccuaaggaauuuagaaggaaugaaagcagcuuaucauuaggaaacaaaaa

SEQ ID NO: 78648 - RNA, 64 nt, Homo Sapiens
gagaacaaagacacaacauaauaaagauauucucugaaagcaauauaacgaaaugaaggcagaa

SEQ ID NO: 78649 - RNA, 64 nt, Homo Sapiens
cacaaaaccuugagugugcuaggggcuuagaaaaugaaagcaaagauucuuuacuugcaaauuc

SEQ ID NO: 78650 - RNA, 64 nt, Homo Sapiens
uucuaagcccugcgcacccgcagcagaugugugaugaaagcaucgauagagcugcacauucuug

SEQ ID NO: 78651 - RNA, 64 nt, Homo Sapiens
cauuugaaauuguuuucccuuucauuuuacccugugaaagcaucucuccuagagccuugcaaga

SEQ ID NO: 78652 - RNA, 64 nt, Homo Sapiens
agaagagggcuaagauacguuuucugucuugagcugaaagcacagucuacucuccuucguuuug

SEQ ID NO: 78653 - RNA, 64 nt, Homo Sapiens
aguuccucauucaaaucaccgcuuauuuugguacugaaagcaauaucggucucuaucucuaucu

SEQ ID NO: 78654 - RNA, 64 nt, Homo Sapiens
ggcgugaggagaggaaagcacggcaggaucagagugaaagcagagguugagaacagaagguggg

SEQ ID NO: 78655 - RNA, 64 nt, Homo Sapiens
gcucuggcucacaggccccaugaaauugaccuuuugaaagcaaaagagauggaaggaugagagg

SEQ ID NO: 78656 - RNA, 64 nt, Homo Sapiens
auacaggggaaggcuuggaccgccagccccaccuugaaagcagcccaguccccucagaggcccc

SEQ ID NO: 78657 - RNA, 64 nt, Homo Sapiens
uaaugggcaacuggacaaccaaguuaaccccaauugaaagcaccccuaggaccauugaacaccc

SEQ ID NO: 78658 - RNA, 64 nt, Homo Sapiens
gugcacugccaauaaguaucucuaauucaauaguugaaagcaaccugcaugcuaaucgugguuu

SEQ ID NO: 78659 - RNA, 64 nt, Homo Sapiens
gauuuugaaauguuuuuuuaaugucuuagaauccugaaagcauaggaauauguuguucuaaaau

SEQ ID NO: 78660 - RNA, 64 nt, Homo Sapiens
uuuugccaagguaguucaguauauuuauauuccuugaaagcaaugauuuuguguuuuuacguaa

SEQ ID NO: 78661 - RNA, 64 nt, Homo Sapiens
uaaaucuuguuuacugaugauuaugguuugcaucugaaagcaguuucaugucacuucuucggca

SEQ ID NO: 78662 - RNA, 64 nt, Homo Sapiens
agacuuuuauccccuucauggauugcugugaagaugaaagcauuuuuugcuuuacuuugcauuu

SEQ ID NO: 78663 - RNA, 64 nt, Homo Sapiens
cauagggaucagaaacuuuuucauauaaccugucugaaagcacacaaagucuuguuuacuacug

SEQ ID NO: 78664 - RNA, 64 nt, Homo Sapiens
cauuuucguagugacaguguggagaucuuuuuaaugaaagcaaacuauguggccucugcaaaga

SEQ ID NO: 78665 - RNA, 64 nt, Homo Sapiens; identical to SEQ ID NO: 48547

SEQ ID NO: 78666 - RNA, 64 nt, Homo Sapiens; identical to SEQ ID NO: 48548

SEQ ID NO: 78667 - RNA, 64 nt, Homo Sapiens; identical to SEQ ID NO: 48549

SEQ ID NO: 78668 - RNA, 64 nt, Homo Sapiens; identical to SEQ ID NO: 48550

SEQ ID NO: 78669 - RNA, 64 nt, Homo Sapiens; identical to SEQ ID NO: 48551

SEQ ID NO: 78670 - RNA, 64 nt, Homo Sapiens; identical to SEQ ID NO: 48552

SEQ ID NO: 78671 - RNA, 64 nt, Homo Sapiens; identical to SEQ ID NO: 48553

SEQ ID NO: 78672 - RNA, 64 nt, Homo Sapiens; identical to SEQ ID NO: 48554

SEQ ID NO: 78673 - RNA, 64 nt, Homo Sapiens; identical to SEQ ID NO: 48555

SEQ ID NO: 78674 - RNA, 64 nt, Homo Sapiens; identical to SEQ ID NO: 48556

SEQ ID NO: 78675 - RNA, 64 nt, Homo Sapiens; identical to SEQ ID NO: 48557

SEQ ID NO: 78676 - RNA, 64 nt, Homo Sapiens; identical to SEQ ID NO: 48558

SEQ ID NO: 78677 - RNA, 64 nt, Homo Sapiens; identical to SEQ ID NO: 48559

SEQ ID NO: 78678 - RNA, 64 nt, Homo Sapiens; identical to SEQ ID NO: 48560

SEQ ID NO: 78679 - RNA, 64 nt, Homo Sapiens; identical to SEQ ID NO: 48561

SEQ ID NO: 78680 - RNA, 64 nt, Homo Sapiens; identical to SEQ ID NO: 48562

SEQ ID NO: 78681 - RNA, 64 nt, Homo Sapiens; identical to SEQ ID NO: 48563

SEQ ID NO: 78682 - RNA, 64 nt, Homo Sapiens; identical to SEQ ID NO: 48564

SEQ ID NO: 78683 - RNA, 64 nt, Homo Sapiens; identical to SEQ ID NO: 48565

SEQ ID NO: 78684 - RNA, 64 nt, Homo Sapiens; identical to SEQ ID NO: 48566

SEQ ID NO: 78685 - RNA, 64 nt, Homo Sapiens; identical to SEQ ID NO: 48567

SEQ ID NO: 78686 - RNA, 64 nt, Homo Sapiens; identical to SEQ ID NO: 48568

SEQ ID NO: 78687 - RNA, 64 nt, Homo Sapiens; identical to SEQ ID NO: 48569

SEQ ID NO: 78688 - RNA, 64 nt, Homo Sapiens; identical to SEQ ID NO: 48570

SEQ ID NO: 78689 - RNA, 64 nt, Homo Sapiens; identical to SEQ ID NO: 48571

SEQ ID NO: 78690 - RNA, 64 nt, Homo Sapiens; identical to SEQ ID NO: 48572

SEQ ID NO: 78691 - RNA, 64 nt, Homo Sapiens; identical to SEQ ID NO: 48573

SEQ ID NO: 78692 - RNA, 64 nt, Homo Sapiens; identical to SEQ ID NO: 48574

SEQ ID NO: 78693 - RNA, 64 nt, Homo Sapiens; identical to SEQ ID NO: 48575

SEQ ID NO: 78694 - RNA, 64 nt, Homo Sapiens; identical to SEQ ID NO: 48576

SEQ ID NO: 78695 - RNA, 64 nt, Homo Sapiens; identical to SEQ ID NO: 48577

SEQ ID NO: 78696 - RNA, 64 nt, Homo Sapiens; identical to SEQ ID NO: 48578

SEQ ID NO: 78697 - RNA, 64 nt, Homo Sapiens; identical to SEQ ID NO: 48579

SEQ ID NO: 78698 - RNA, 64 nt, Homo Sapiens; identical to SEQ ID NO: 48580

SEQ ID NO: 78699 - RNA, 64 nt, Homo Sapiens; identical to SEQ ID NO: 48581

SEQ ID NO: 78700 - RNA, 64 nt, Homo Sapiens; identical to SEQ ID NO: 48582

SEQ ID NO: 78701 - RNA, 64 nt, Homo Sapiens; identical to SEQ ID NO: 48583

SEQ ID NO: 78702 - RNA, 64 nt, Homo Sapiens; identical to SEQ ID NO: 48584

SEQ ID NO: 78703 - RNA, 64 nt, Homo Sapiens; identical to SEQ ID NO: 48585

SEQ ID NO: 78704 - RNA, 64 nt, Homo Sapiens; identical to SEQ ID NO: 48586

SEQ ID NO: 78705 - RNA, 64 nt, Homo Sapiens; identical to SEQ ID NO: 48587

SEQ ID NO: 78706 - RNA, 64 nt, Homo Sapiens; identical to SEQ ID NO: 48588

SEQ ID NO: 78707 - RNA, 64 nt, Homo Sapiens; identical to SEQ ID NO: 48589

SEQ ID NO: 78708 - RNA, 64 nt, Homo Sapiens; identical to SEQ ID NO: 48590

SEQ ID NO: 78709 - RNA, 64 nt, Homo Sapiens; identical to SEQ ID NO: 48591

SEQ ID NO: 78710 - RNA, 64 nt, Homo Sapiens; identical to SEQ ID NO: 48592

SEQ ID NO: 78711 - RNA, 64 nt, Homo Sapiens; identical to SEQ ID NO: 48593

SEQ ID NO: 78712 - RNA, 64 nt, Homo Sapiens; identical to SEQ ID NO: 48594

SEQ ID NO: 78713 - RNA, 64 nt, Homo Sapiens; identical to SEQ ID NO: 48595

SEQ ID NO: 78714 - RNA, 64 nt, Homo Sapiens; identical to SEQ ID NO: 48596

SEQ ID NO: 78715 - RNA, 64 nt, Homo Sapiens; identical to SEQ ID NO: 48597

SEQ ID NO: 78716 - RNA, 64 nt, Homo Sapiens; identical to SEQ ID NO: 48598

SEQ ID NO: 78717 - RNA, 64 nt, Homo Sapiens; identical to SEQ ID NO: 48599

SEQ ID NO: 78718 - RNA, 64 nt, Homo Sapiens; identical to SEQ ID NO: 48600

SEQ ID NO: 78719 - RNA, 64 nt, Homo Sapiens; identical to SEQ ID NO: 48601

SEQ ID NO: 78720 - RNA, 64 nt, Homo Sapiens; identical to SEQ ID NO: 48602

SEQ ID NO: 78721 - RNA, 64 nt, Homo Sapiens; identical to SEQ ID NO: 48603

SEQ ID NO: 78722 - RNA, 64 nt, Homo Sapiens; identical to SEQ ID NO: 48604

SEQ ID NO: 78723 - RNA, 64 nt, Homo Sapiens; identical to SEQ ID NO: 48605

SEQ ID NO: 78724 - RNA, 64 nt, Homo Sapiens; identical to SEQ ID NO: 48606

SEQ ID NO: 78725 - RNA, 64 nt, Homo Sapiens; identical to SEQ ID NO: 48607

SEQ ID NO: 78726 - RNA, 55 nt, Homo Sapiens; identical to SEQ ID NO: 48608

SEQ ID NO: 78727 - RNA, 64 nt, Homo Sapiens; identical to SEQ ID NO: 48609

SEQ ID NO: 78728 - RNA, 64 nt, Homo Sapiens; identical to SEQ ID NO: 48610

SEQ ID NO: 78729 - RNA, 64 nt, Homo Sapiens; identical to SEQ ID NO: 48611

SEQ ID NO: 78730 - RNA, 64 nt, Homo Sapiens; identical to SEQ ID NO: 48612

SEQ ID NO: 78731 - RNA, 64 nt, Homo Sapiens; identical to SEQ ID NO: 48613

SEQ ID NO: 78732 - RNA, 64 nt, Homo Sapiens; identical to SEQ ID NO: 48614

SEQ ID NO: 78733 - RNA, 64 nt, Homo Sapiens; identical to SEQ ID NO: 48615

SEQ ID NO: 78734 - RNA, 64 nt, Homo Sapiens; identical to SEQ ID NO: 48616

SEQ ID NO: 78735 - RNA, 64 nt, Homo Sapiens; identical to SEQ ID NO: 48617

SEQ ID NO: 78736 - RNA, 64 nt, Homo Sapiens; identical to SEQ ID NO: 48618

SEQ ID NO: 78737 - RNA, 64 nt, Homo Sapiens; identical to SEQ ID NO: 48619

SEQ ID NO: 78738 - RNA, 64 nt, Homo Sapiens; identical to SEQ ID NO: 48620

SEQ ID NO: 78739 - RNA, 64 nt, Homo Sapiens; identical to SEQ ID NO: 48621

SEQ ID NO: 78740 - RNA, 64 nt, Homo Sapiens; identical to SEQ ID NO: 48622

SEQ ID NO: 78741 - RNA, 64 nt, Homo Sapiens; identical to SEQ ID NO: 48623

SEQ ID NO: 78742 - RNA, 64 nt, Homo Sapiens; identical to SEQ ID NO: 48624

SEQ ID NO: 78743 - RNA, 64 nt, Homo Sapiens; identical to SEQ ID NO: 48625

SEQ ID NO: 78744 - RNA, 64 nt, Homo Sapiens; identical to SEQ ID NO: 48626

SEQ ID NO: 78745 - RNA, 64 nt, Homo Sapiens; identical to SEQ ID NO: 48627

SEQ ID NO: 78746 - RNA, 64 nt, Homo Sapiens; identical to SEQ ID NO: 48628

SEQ ID NO: 78747 - RNA, 64 nt, Homo Sapiens; identical to SEQ ID NO: 48629

SEQ ID NO: 78748 - RNA, 64 nt, Homo Sapiens; identical to SEQ ID NO: 48630

SEQ ID NO: 78749 - RNA, 64 nt, Homo Sapiens; identical to SEQ ID NO: 48631

SEQ ID NO: 78750 - RNA, 64 nt, Homo Sapiens; identical to SEQ ID NO: 48632

SEQ ID NO: 78751 - RNA, 64 nt, Homo Sapiens; identical to SEQ ID NO: 48633

SEQ ID NO: 78752 - RNA, 64 nt, Homo Sapiens; identical to SEQ ID NO: 48634

SEQ ID NO: 78753 - RNA, 64 nt, Homo Sapiens; identical to SEQ ID NO: 48635

SEQ ID NO: 78754 - RNA, 64 nt, Homo Sapiens; identical to SEQ ID NO: 48636

SEQ ID NO: 78755 - RNA, 64 nt, Homo Sapiens; identical to SEQ ID NO: 48637

SEQ ID NO: 78756 - RNA, 64 nt, Homo Sapiens; identical to SEQ ID NO: 48638

SEQ ID NO: 78757 - RNA, 64 nt, Homo Sapiens; identical to SEQ ID NO: 48639

SEQ ID NO: 78758 - RNA, 64 nt, Homo Sapiens; identical to SEQ ID NO: 48640

SEQ ID NO: 78759 - RNA, 64 nt, Homo Sapiens; identical to SEQ ID NO: 48641

SEQ ID NO: 78760 - RNA, 64 nt, Homo Sapiens; identical to SEQ ID NO: 48642

SEQ ID NO: 78761 - RNA, 64 nt, Homo Sapiens; identical to SEQ ID NO: 48643

SEQ ID NO: 78762 - RNA, 64 nt, Homo Sapiens; identical to SEQ ID NO: 48644

SEQ ID NO: 78763 - RNA, 64 nt, Homo Sapiens; identical to SEQ ID NO: 48645

SEQ ID NO: 78764 - RNA, 64 nt, Homo Sapiens; identical to SEQ ID NO: 48646

SEQ ID NO: 78765 - RNA, 64 nt, Homo Sapiens; identical to SEQ ID NO: 48647

SEQ ID NO: 78766 - RNA, 64 nt, Homo Sapiens; identical to SEQ ID NO: 48648

SEQ ID NO: 78767 - RNA, 64 nt, Homo Sapiens; identical to SEQ ID NO: 48649

SEQ ID NO: 78768 - RNA, 64 nt, Homo Sapiens; identical to SEQ ID NO: 48650

SEQ ID NO: 78769 - RNA, 64 nt, Homo Sapiens; identical to SEQ ID NO: 48651

SEQ ID NO: 78770 - RNA, 64 nt, Homo Sapiens; identical to SEQ ID NO: 48652

SEQ ID NO: 78771 - RNA, 64 nt, Homo Sapiens; identical to SEQ ID NO: 48653

SEQ ID NO: 78772 - RNA, 64 nt, Homo Sapiens; identical to SEQ ID NO: 48654

SEQ ID NO: 78773 - RNA, 64 nt, Homo Sapiens; identical to SEQ ID NO: 48655

SEQ ID NO: 78774 - RNA, 64 nt, Homo Sapiens; identical to SEQ ID NO: 48656

SEQ ID NO: 78775 - RNA, 64 nt, Homo Sapiens; identical to SEQ ID NO: 48657

SEQ ID NO: 78776 - RNA, 64 nt, Homo Sapiens; identical to SEQ ID NO: 48658

SEQ ID NO: 78777 - RNA, 64 nt, Homo Sapiens; identical to SEQ ID NO: 48659

SEQ ID NO: 78778 - RNA, 64 nt, Homo Sapiens; identical to SEQ ID NO: 48660

SEQ ID NO: 78779 - RNA, 64 nt, Homo Sapiens; identical to SEQ ID NO: 48661

SEQ ID NO: 78780 - RNA, 64 nt, Homo Sapiens; identical to SEQ ID NO: 48662

SEQ ID NO: 78781 - RNA, 64 nt, Homo Sapiens; identical to SEQ ID NO: 48663

SEQ ID NO: 78782 - RNA, 64 nt, Homo Sapiens; identical to SEQ ID NO: 48664

SEQ ID NO: 78783 - RNA, 64 nt, Homo Sapiens; identical to SEQ ID NO: 48665

SEQ ID NO: 78784 - RNA, 64 nt, Homo Sapiens; identical to SEQ ID NO: 48666

SEQ ID NO: 78785 - RNA, 64 nt, Homo Sapiens; identical to SEQ ID NO: 48667

SEQ ID NO: 78786 - RNA, 64 nt, Homo Sapiens; identical to SEQ ID NO: 48668

SEQ ID NO: 78787 - RNA, 64 nt, Homo Sapiens; identical to SEQ ID NO: 48669

SEQ ID NO: 78788 - RNA, 64 nt, Homo Sapiens; identical to SEQ ID NO: 48670

SEQ ID NO: 78789 - RNA, 64 nt, Homo Sapiens; identical to SEQ ID NO: 48671

SEQ ID NO: 78790 - RNA, 64 nt, Homo Sapiens; identical to SEQ ID NO: 48672

SEQ ID NO: 78791 - RNA, 64 nt, Homo Sapiens; identical to SEQ ID NO: 48673

SEQ ID NO: 78792 - RNA, 64 nt, Homo Sapiens; identical to SEQ ID NO: 48674

SEQ ID NO: 78793 - RNA, 64 nt, Homo Sapiens; identical to SEQ ID NO: 48675

SEQ ID NO: 78794 - RNA, 64 nt, Homo Sapiens; identical to SEQ ID NO: 48676

SEQ ID NO: 78795 - RNA, 64 nt, Homo Sapiens; identical to SEQ ID NO: 48677

SEQ ID NO: 78796 - RNA, 64 nt, Homo Sapiens; identical to SEQ ID NO: 48678

SEQ ID NO: 78797 - RNA, 64 nt, Homo Sapiens; identical to SEQ ID NO: 48679

SEQ ID NO: 78798 - RNA, 64 nt, Homo Sapiens; identical to SEQ ID NO: 48680

SEQ ID NO: 78799 - RNA, 64 nt, Homo Sapiens; identical to SEQ ID NO: 48681

SEQ ID NO: 78800 - RNA, 64 nt, Homo Sapiens; identical to SEQ ID NO: 48682

SEQ ID NO: 78801 - RNA, 64 nt, Homo Sapiens; identical to SEQ ID NO: 48683

SEQ ID NO: 78802 - RNA, 64 nt, Homo Sapiens; identical to SEQ ID NO: 48684

SEQ ID NO: 78803 - RNA, 64 nt, Homo Sapiens; identical to SEQ ID NO: 48685

SEQ ID NO: 78804 - RNA, 64 nt, Homo Sapiens; identical to SEQ ID NO: 48686

SEQ ID NO: 78805 - RNA, 64 nt, Homo Sapiens; identical to SEQ ID NO: 48687

SEQ ID NO: 78806 - RNA, 64 nt, Homo Sapiens; identical to SEQ ID NO: 48688

SEQ ID NO: 78807 - RNA, 64 nt, Homo Sapiens; identical to SEQ ID NO: 48689

SEQ ID NO: 78808 - RNA, 64 nt, Homo Sapiens; identical to SEQ ID NO: 48690

SEQ ID NO: 78809 - RNA, 64 nt, Homo Sapiens; identical to SEQ ID NO: 48691

SEQ ID NO: 78810 - RNA, 64 nt, Homo Sapiens; identical to SEQ ID NO: 48692

SEQ ID NO: 78811 - RNA, 64 nt, Homo Sapiens; identical to SEQ ID NO: 48693

SEQ ID NO: 78812 - RNA, 64 nt, Homo Sapiens; identical to SEQ ID NO: 48694

SEQ ID NO: 78813 - RNA, 64 nt, Homo Sapiens; identical to SEQ ID NO: 48695

SEQ ID NO: 78814 - RNA, 64 nt, Homo Sapiens; identical to SEQ ID NO: 48696

SEQ ID NO: 78815 - RNA, 64 nt, Homo Sapiens; identical to SEQ ID NO: 48697

SEQ ID NO: 78816 - RNA, 64 nt, Homo Sapiens; identical to SEQ ID NO: 48698

SEQ ID NO: 78817 - RNA, 64 nt, Homo Sapiens; identical to SEQ ID NO: 48699

SEQ ID NO: 78818 - RNA, 64 nt, Homo Sapiens; identical to SEQ ID NO: 48700

SEQ ID NO: 78819 - RNA, 64 nt, Homo Sapiens; identical to SEQ ID NO: 48701

SEQ ID NO: 78820 - RNA, 64 nt, Homo Sapiens; identical to SEQ ID NO: 48702

SEQ ID NO: 78821 - RNA, 64 nt, Homo Sapiens; identical to SEQ ID NO: 48703

SEQ ID NO: 78822 - RNA, 64 nt, Homo Sapiens; identical to SEQ ID NO: 48704

SEQ ID NO: 78823 - RNA, 64 nt, Homo Sapiens; identical to SEQ ID NO: 48705

SEQ ID NO: 78824 - RNA, 64 nt, Homo Sapiens; identical to SEQ ID NO: 48706

SEQ ID NO: 78825 - RNA, 64 nt, Homo Sapiens; identical to SEQ ID NO: 48707

SEQ ID NO: 78826 - RNA, 64 nt, Homo Sapiens; identical to SEQ ID NO: 48708

SEQ ID NO: 78827 - RNA, 64 nt, Homo Sapiens; identical to SEQ ID NO: 48709

SEQ ID NO: 78828 - RNA, 64 nt, Homo Sapiens; identical to SEQ ID NO: 48710

SEQ ID NO: 78829 - RNA, 64 nt, Homo Sapiens; identical to SEQ ID NO: 48711

SEQ ID NO: 78830 - RNA, 64 nt, Homo Sapiens; identical to SEQ ID NO: 48712

SEQ ID NO: 78831 - RNA, 64 nt, Homo Sapiens; identical to SEQ ID NO: 48713

SEQ ID NO: 78832 - RNA, 64 nt, Homo Sapiens; identical to SEQ ID NO: 48714

SEQ ID NO: 78833 - RNA, 64 nt, Homo Sapiens; identical to SEQ ID NO: 48715

SEQ ID NO: 78834 - RNA, 64 nt, Homo Sapiens; identical to SEQ ID NO: 48716

SEQ ID NO: 78835 - RNA, 64 nt, Homo Sapiens; identical to SEQ ID NO: 48717

SEQ ID NO: 78836 - RNA, 64 nt, Homo Sapiens; identical to SEQ ID NO: 48718

SEQ ID NO: 78837 - RNA, 64 nt, Homo Sapiens; identical to SEQ ID NO: 48719

SEQ ID NO: 78838 - RNA, 64 nt, Homo Sapiens; identical to SEQ ID NO: 48720

SEQ ID NO: 78839 - RNA, 64 nt, Homo Sapiens; identical to SEQ ID NO: 48721

SEQ ID NO: 78840 - RNA, 64 nt, Homo Sapiens; identical to SEQ ID NO: 48722

SEQ ID NO: 78841 - RNA, 64 nt, Homo Sapiens; identical to SEQ ID NO: 48723

SEQ ID NO: 78842 - RNA, 64 nt, Homo Sapiens; identical to SEQ ID NO: 48724

SEQ ID NO: 78843 - RNA, 64 nt, Homo Sapiens; identical to SEQ ID NO: 48725

SEQ ID NO: 78844 - RNA, 64 nt, Homo Sapiens; identical to SEQ ID NO: 48726

SEQ ID NO: 78845 - RNA, 64 nt, Homo Sapiens; identical to SEQ ID NO: 48727

SEQ ID NO: 78846 - RNA, 64 nt, Homo Sapiens; identical to SEQ ID NO: 48728

SEQ ID NO: 78847 - RNA, 64 nt, Homo Sapiens; identical to SEQ ID NO: 48729

SEQ ID NO: 78848 - RNA, 64 nt, Homo Sapiens; identical to SEQ ID NO: 48730

SEQ ID NO: 78849 - RNA, 64 nt, Homo Sapiens; identical to SEQ ID NO: 48731

SEQ ID NO: 78850 - RNA, 64 nt, Homo Sapiens; identical to SEQ ID NO: 48732

SEQ ID NO: 78851 - RNA, 64 nt, Homo Sapiens; identical to SEQ ID NO: 48733

SEQ ID NO: 78852 - RNA, 64 nt, Homo Sapiens
cauuuauaaagaccguacaaacucagauccuugguaccccuaaaaagauugccaauuuucuuca

SEQ ID NO: 78853 - RNA, 64 nt, Homo Sapiens
cugauuuagacaagguauuauggucauuacuuuguaccccuauccuuccaagcacuucugguac

SEQ ID NO: 78854 - RNA, 64 nt, Homo Sapiens
gcccccaagcucucucacugaaugcugccucuucuaccccuauguccaaauuuucagccaccac

SEQ ID NO: 78855 - RNA, 64 nt, Homo Sapiens
cauaugccugcaugccauuaacaccagcuggcccuaccccuauaaugauccuguguccuaaauu

SEQ ID NO: 78856 - RNA, 64 nt, Homo Sapiens
gggggaaggccuugcugucaugugaaucccucaauaccccuaguaucuggcuggguuuucaggg

SEQ ID NO: 78857 - RNA, 64 nt, Homo Sapiens
acugagacuugugccuggaaugccugccccauuguaccccuagccccccuuuccccacuauuuc

SEQ ID NO: 78858 - RNA, 64 nt, Homo Sapiens
acagagacccuguauuuaauagaacaccaagaauuaccccuaaaauucacauuuuagaauaaca

SEQ ID NO: 78859 - RNA, 64 nt, Homo Sapiens
cccaaagguagcuuaaauaguuucaguaacauuuuaccccuacuuuccaugcacuuagaguugc

SEQ ID NO: 78860 - RNA, 64 nt, Homo Sapiens
agaugguaagaacaauuaauguguucuuaaguuuuaccccuauuuucuucauuauugucauugc

SEQ ID NO: 78861 - RNA, 64 nt, Homo Sapiens
uaacuaacuaugaacuauuuauuuccuccuccccuaccccuaguuaagugccacaaagacugug

SEQ ID NO: 78862 - RNA, 64 nt, Homo Sapiens
aacuuaaucuguuauuugaaaugacuucauacacuaccccuauaaguuugccaauaaaaccauc

SEQ ID NO: 78863 - RNA, 64 nt, Homo Sapiens
uguuagcaggaaagagugauuaagugagguuauuuaccccuaaaugguccauucugcauuguau

SEQ ID NO: 78864 - RNA, 64 nt, Homo Sapiens
guagaacauuuuuuaaauugaugagccuccccauuaccccuaaaaauggggauuucagguuucu

SEQ ID NO: 78865 - RNA, 64 nt, Homo Sapiens
uaaguacaaaaacagagucgacuugaaugugauuuaccccuaauaucacuuaauucagucugau

SEQ ID NO: 78866 - RNA, 64 nt, Homo Sapiens
ggguuuagaaccuaaguauuuaagcaaaaucuguuaccccuacacugagguucuauuugauuac

SEQ ID NO: 78867 - RNA, 64 nt, Homo Sapiens
gcauuagguagaaacaaauuucaaaugauagcaauaccccuauauaaaauuguucuuucuuagu

SEQ ID NO: 78868 - RNA, 64 nt, Homo Sapiens
accaggaaggucguuucacauucuguaguaaaaauaccccuacaaucauuuugguagggucuuc

SEQ ID NO: 78869 - RNA, 64 nt, Homo Sapiens
ccgucuccuguuuugucuuuuuuuucuuuucuccuaccccuaucuugggacauucagaaacugc

SEQ ID NO: 78870 - RNA, 64 nt, Homo Sapiens
gaaguaucuuucuacaaacgcagacaagcuccacuaccccuaaccugccaggaugcucaagucc

SEQ ID NO: 78871 - RNA, 64 nt, Homo Sapiens
gacugugaucuucaaucauccugcccaucucugguaccccuauaucacuccuuuuuuucaagaa

SEQ ID NO: 78872 - RNA, 64 nt, Homo Sapiens
uugccuuugcuuuuuuuuggagggaaauacucccuaccccuaauuuuguuacuacuuauauaga

SEQ ID NO: 78873 - RNA, 64 nt, Homo Sapiens
gugagcgagucccuuccugcauaaaguaggucguuaccccuaaauuuuucuuuuuuuaacugca

SEQ ID NO: 78874 - RNA, 64 nt, Homo Sapiens
uaaaccugaagcagguguuuuccuuauaggucacuaccccuaaaccuuaaaaauugaguugaug

SEQ ID NO: 78875 - RNA, 64 nt, Homo Sapiens
gguuagaacccgugacuguauucucucccuuggauaccccuaugccuacaucauauuccuuacc

SEQ ID NO: 78876 - RNA, 64 nt, Homo Sapiens
cacaagaauggccaaccuaauacuagcuuuagauuaccccuauauuucuuuugugggguguaac

SEQ ID NO: 78877 - RNA, 64 nt, Homo Sapiens
cagguuauucucuggagguugguggaugaagggguaccccuaggagaugugaaguguggguuug

SEQ ID NO: 78878 - RNA, 64 nt, Homo Sapiens
aguaaucuugacugaauggagaaaguuucugugcuaccccuacaaacccaugccucacugacag

SEQ ID NO: 78879 - RNA, 64 nt, Homo Sapiens
agcagauccagggaucagugagaggagugguguguaccccuaaauccucccaccccagcacugc

SEQ ID NO: 78880 - RNA, 64 nt, Homo Sapiens
uaccaacuuccacagcagucgacgcccuguagcauaccccuaggcuuauucaguuccagcucau

SEQ ID NO: 78881 - RNA, 64 nt, Homo Sapiens
aaauucucauacccccuuucccaaucaauuccucuaccccuagcccuaggcagccacagauuug

SEQ ID NO: 78882 - RNA, 64 nt, Homo Sapiens
gagggguggauaaacuaccccugccccaaaccucuaccccuaacuccaggucaggggugcguag

SEQ ID NO: 78883 - RNA, 64 nt, Homo Sapiens
caucccucagugucugugggggauugguuccaguuaccccuauagauaccaaaaucugcagaug

SEQ ID NO: 78884 - RNA, 64 nt, Homo Sapiens
uuggaaccaagaauugcagggaguggaguggaaauaccccuaagagacaggccacaggagggca

SEQ ID NO: 78885 - RNA, 64 nt, Homo Sapiens
cauccuuucuuucaaggguguugcucgucuuguuuaccccuagcgcucccugcauuccagggac

SEQ ID NO: 78886 - RNA, 64 nt, Homo Sapiens
guuucuccugcguaaccuuccagggccucagaacuaccccuacaggccucagaacuaccccuuc

SEQ ID NO: 78887 - RNA, 64 nt, Homo Sapiens
aucccaccagaauacgggucgccguccauagcaguaccccuaaauuagauugucugcugaugca

SEQ ID NO: 78888 - RNA, 64 nt, Homo Sapiens
caucucuccacggagcccaggaucaauuucucauuaccccuacaagaguccaccucucauugcu

SEQ ID NO: 78889 - RNA, 64 nt, Homo Sapiens
ugccagccuaggauuuugggcgucauucacccacuaccccuagugcuagucccagaggaugcug

SEQ ID NO: 78890 - RNA, 64 nt, Homo Sapiens
aauugggagaaauaucuuccaugaaccugagaauuaccccuaccucuggggaaacuuuugcccu

SEQ ID NO: 78891 - RNA, 64 nt, Homo Sapiens
gcaugguaucgauuuuuaauugaggaauuucucguaccccuacucugccagaaucaaauguaaa

SEQ ID NO: 78892 - RNA, 64 nt, Homo Sapiens
ucccccggcuauacuuuuaacguuuggguccuuuuaccccuauggcuauccggggcaauuguag

SEQ ID NO: 78893 - RNA, 64 nt, Homo Sapiens
auacugcauuucacucugggagccauagucaaaauaccccuaacuuuaucaguagaagugucac

SEQ ID NO: 78894 - RNA, 64 nt, Homo Sapiens
cuagaaacacacuagacagagguuccccaccuccuaccccuacucccuccuguaggaauugagc

SEQ ID NO: 78895 - RNA, 64 nt, Homo Sapiens
caggggcccccuaacuccugaugcaggagcccuauaccccuacauaggcucagaucccagaggg

SEQ ID NO: 78896 - RNA, 64 nt, Homo Sapiens
gugggugcuggcugcaaaaauuucuggcuucucuuaccccuauugcccccggcaauaaauuguu

SEQ ID NO: 78897 - RNA, 64 nt, Homo Sapiens
uguagggaaaaggacuugagaggaugaaguuuccuaccccuauuccaggagaccagagucucug

SEQ ID NO: 78898 - RNA, 64 nt, Homo Sapiens
uaaagcaagcaguucuugaaucccucuuugcccuuaccccuaaacaaucuuucaucauuuuacu

SEQ ID NO: 78899 - RNA, 64 nt, Homo Sapiens
ggaaagcuguaacucacgaagcccugagaccugcuaccccuaagaucgagcuuguuuucaguga

SEQ ID NO: 78900 - RNA, 64 nt, Homo Sapiens
cucuacuuuuucacccaaaccaauguccagcuuuuaccccuacuuucuuaaaccaauccuuuug

SEQ ID NO: 78901 - RNA, 64 nt, Homo Sapiens
uagauucuauacuuaacaucaacaccuauaugccuaccccuacccucuugagaacuauaaagug

SEQ ID NO: 78902 - RNA, 64 nt, Homo Sapiens
caagcaacuagaggccagaaauauuucccugucuuaccccuauuucucaguacacaaucauuua

SEQ ID NO: 78903 - RNA, 64 nt, Homo Sapiens
cugauuuucaagcuccucauuuacggcucugugcuaccccuagguagcaagagagaggcuggga

SEQ ID NO: 78904 - RNA, 64 nt, Homo Sapiens
ucucauuugcaguuuuuuuuagaagauuuagaaauaccccuauugugugauauuuuaggaauac

SEQ ID NO: 78905 - RNA, 64 nt, Homo Sapiens
auagaggaauaaaugucuucaguugucucuccauuaccccuaaguuauuaguuugucuaguuua

SEQ ID NO: 78906 - RNA, 64 nt, Homo Sapiens
gugguuucaaacauucaugauggauguauuuuccuaccccuaacuuaaggagaaaaaaaaaaag

SEQ ID NO: 78907 - RNA, 64 nt, Homo Sapiens
cgggggcauuaggguagggagaugaaucaaaaaauaccccuaguaaugcuuuauauuuuaauac

SEQ ID NO: 78908 - RNA, 64 nt, Homo Sapiens
ucacaguaaaaacacuuuuuugaguuauuaggcuuaccccuagcuuuugaccuuugcauuucau

SEQ ID NO: 78909 - RNA, 64 nt, Homo Sapiens
auaagucugggcagcucuauuuacuagccaggcauaccccuagcaguaaggaaggagaaagugg

SEQ ID NO: 78910 - RNA, 64 nt, Homo Sapiens
gaggucuccaaggccccagcaaagccauggcuucuaccccuaguuccccugacaggaaguucuu

SEQ ID NO: 78911 - RNA, 64 nt, Homo Sapiens
guuuguuguuuuuuuuacauuguuaaauguuccuuaccccuaaaggucaauguuaaguacaaca

SEQ ID NO: 78912 - RNA, 64 nt, Homo Sapiens
ucagaggaggucuuacggacccuuguagcuuccauaccccuauguuuaugguguuggagugaag

SEQ ID NO: 78913 - RNA, 64 nt, Homo Sapiens
gcgcggcggcccaggagcucagggggccacuggcuaccccuacucccccagaacccugaggcca

SEQ ID NO: 78914 - RNA, 64 nt, Homo Sapiens
guaggaaaguuaagcaggcaccauccuggaagucuaccccuagguggucgagagaccuguucuu

SEQ ID NO: 78915 - RNA, 57 nt, Homo Sapiens
cucacacccugaagacuugaacucugcuaccccuacugaaaucaagcuggaguacgu

SEQ ID NO: 78916 - RNA, 64 nt, Homo Sapiens
acugggacccacuggcccagucuuggcugcugcuuaccccuagccuugaugccugcccagggac

SEQ ID NO: 78917 - RNA, 64 nt, Homo Sapiens
aguuagaggagaaaaaggaauggagcagagccuguaccccuaacccuaacagcuaaaucaagga

SEQ ID NO: 78918 - RNA, 64 nt, Homo Sapiens
ugauacuaagguggaugccaaccagagaagcugcuaccccuacaucaucuccaaccggucagaa

SEQ ID NO: 78919 - RNA, 64 nt, Homo Sapiens
uuaaggcugagccagagcacgggugugguuuugauaccccuaagcuucugcuagggaccccacc

SEQ ID NO: 78920 - RNA, 64 nt, Homo Sapiens
aauguccaguuuugagugacaacuacuuuggcucuaccccuagagggguauuuggggagaaagu

SEQ ID NO: 78921 - RNA, 64 nt, Homo Sapiens
gcaaauacccaccagggagagcaagcccggguucuaccccuaauaacagcccucagacugucag

SEQ ID NO: 78922 - RNA, 64 nt, Homo Sapiens
cuagaaugugguugucagaagcaggugugggcccuaccccuaagaggagcaguccucagugggg

SEQ ID NO: 78923 - RNA, 64 nt, Homo Sapiens
uaaaacuauuuaagaguuuaugaaagaaaaaaaauaccccuaaaaauucauuuugcagaaagcc

SEQ ID NO: 78924 - RNA, 64 nt, Homo Sapiens
ggacugucacucuagcaucuaggacgaccaucucuaccccuagaccgggccaccuucuccuggg

SEQ ID NO: 78925 - RNA, 64 nt, Homo Sapiens
acaaagcuauuaaagggacaaaggcgaggggaguuaccccuaaacccguccuaagccuccccac

SEQ ID NO: 78926 - RNA, 64 nt, Homo Sapiens
cuaugaaaaaacaaaccaaaguagugcagaccuuuaccccuaguaaaauucagauauuuucuua

SEQ ID NO: 78927 - RNA, 64 nt, Homo Sapiens
aaucucuaaauaaaaaaagguaugguauaucuccuuaccagaaaugccagugaaauugcuuucc

SEQ ID NO: 78928 - RNA, 64 nt, Homo Sapiens
caaggcucuguuuauuccccuguuuuuugcaguguuaccagaauacagacuuauuggacaauua

SEQ ID NO: 78929 - RNA, 64 nt, Homo Sapiens
ggucguaaagaauacaaaugcugcagaggaauccuuaccagagauccagaaagaacaucgcaau

SEQ ID NO: 78930 - RNA, 64 nt, Homo Sapiens
ucuagaauuugauguuugaccauuuaugacuuaauuaccagagagccaguaaauuaggacagug

SEQ ID NO: 78931 - RNA, 64 nt, Homo Sapiens
aaccacucaucacaguauucaauaaccauugacauuaccagacacuauauagcuaagcuaaaag

SEQ ID NO: 78932 - RNA, 64 nt, Homo Sapiens
auaucuauuauagcaaaacacauuuuauuuuuuauuaccagagcauguauaucacaugaaccca

SEQ ID NO: 78933 - RNA, 64 nt, Homo Sapiens; identical to SEQ ID NO: 61116

SEQ ID NO: 78934 - RNA, 64 nt, Homo Sapiens; identical to SEQ ID NO: 61117

SEQ ID NO: 78935 - RNA, 64 nt, Homo Sapiens; identical to SEQ ID NO: 61118

SEQ ID NO: 78936 - RNA, 64 nt, Homo Sapiens; identical to SEQ ID NO: 61119

SEQ ID NO: 78937 - RNA, 64 nt, Homo Sapiens
aacuuuacugcagccgagguccaggccguggaggggguccuagcuccgcugcauucugcauccc

SEQ ID NO: 78938 - RNA, 64 nt, Homo Sapiens
ggguggagugggcaagggcacacccuguggcaggggguccuauaauuuuguguaaauaucugua

SEQ ID NO: 78939 - RNA, 64 nt, Homo Sapiens
cuguagaaccuugggcaaauaacuucaucuuuuuggguccuaauuuuccuccugucuaacugga

SEQ ID NO: 78940 - RNA, 64 nt, Homo Sapiens
ugccgagaaggaagccucccacgacugcccggcaggguccuagaaauuccccacccugaaagcc

SEQ ID NO: 78941 - RNA, 64 nt, Homo Sapiens
gaccuugaaugaugccuaggauggcagagccccuggguccuacuccauccuccagccuuugucc

SEQ ID NO: 78942 - RNA, 64 nt, Homo Sapiens
cuuuuaaauucaaauuuuaucuccagauggaaugggguccuagcaaccuccacauguucaacua

SEQ ID NO: 78943 - RNA, 64 nt, Homo Sapiens
accucugggcccugcaggaggccugggagggcaaggguccuacggagggaccaggugucuagag

SEQ ID NO: 78944 - RNA, 64 nt, Homo Sapiens
uacugaaccuacuaacccuuuaacauacaguuuaggguccuagcgcagaguccuuguuuaaagg

SEQ ID NO: 78945 - RNA, 64 nt, Homo Sapiens
uuugucaaucuuuggcauucgaauuccacacacgggguccuagagcccuucugagcaucagugg

SEQ ID NO: 78946 - RNA, 64 nt, Homo Sapiens
ugcacacuggccuuucugugcucugagcuuuaguggguccuagugauaaucuugcauugcuuuc

SEQ ID NO: 78947 - RNA, 64 nt, Homo Sapiens
agaaaggguuagcauuuuaacacucccacaagguggguccuacuaauuauggauucuuucaagc

SEQ ID NO: 78948 - RNA, 64 nt, Homo Sapiens
ccuucccggaugauccgaaaauggaaaggaucuuggguccuaucacagagagcaucuagccaug

SEQ ID NO: 78949 - RNA, 64 nt, Homo Sapiens
cuagaggggguaucccuaguagguguggggaggaggguccuaggauggaugguuugguggauug

SEQ ID NO: 78950 - RNA, 64 nt, Homo Sapiens
agccccugcuucuccaggccgaggcaugcaggcaggguccuagggagucacuauuggaggcaga

SEQ ID NO: 78951 - RNA, 64 nt, Homo Sapiens
gacaagguggcaucucaacccucugggccaaggaggguccuacaauccagacugugaaaucagc

SEQ ID NO: 78952 - RNA, 64 nt, Homo Sapiens
ucagauuugcccugcacuucuuguuccaugcuugggguccuaagaacaagccaucugaugccuc

SEQ ID NO: 78953 - RNA, 64 nt, Homo Sapiens
auuuuucugauuucuauaaucaaguuaagcuucaggguccuagacguaaaaggaauaaaauaag

SEQ ID NO: 78954 - RNA, 64 nt, Homo Sapiens
guguucuggucaucccugauuuuugaauaaucugggguccuaaucccuuaaaauucguuaaagu

SEQ ID NO: 78955 - RNA, 64 nt, Homo Sapiens
aggaaggugacuucucucugugcuaacccagggaggguccuaagacuucuggguucuuuccuuc

SEQ ID NO: 78956 - RNA, 64 nt, Homo Sapiens
ggugagugcuggugaugugagccuacaucaggguggguccuaagaaacauggcaaaccaggcug

SEQ ID NO: 78957 - RNA, 64 nt, Homo Sapiens
guaaagggcaugggaacagugagggacauaugugggguccuaacaauaucugcuaggcuggucu

SEQ ID NO: 78958 - RNA, 64 nt, Homo Sapiens
ucauauaugugagaaaaaccugaauauaggacagggguccuacuuuuuuccccaccucugucgc

SEQ ID NO: 78959 - RNA, 64 nt, Homo Sapiens
aauagauuccccauugccucauacguccaccaugggguccuaccacucaaaugcuuggcuucuc

SEQ ID NO: 78960 - RNA, 64 nt, Homo Sapiens
ugggggccugggugggcccucggucccaacuacaggguccuagccagguccuuguaucaugcca

SEQ ID NO: 78961 - RNA, 64 nt, Homo Sapiens
gccuuauuucaaaacaauucaugaauugaauggaggguccuaaugagaugguggucuauuaaau

SEQ ID NO: 78962 - RNA, 64 nt, Homo Sapiens
ccauacuccaaauuguauauuggauugcauuuugggguccuaggucauacguucuucaaaauua

SEQ ID NO: 78963 - RNA, 64 nt, Homo Sapiens
cagaguauccugggggugguggugggguggggggggguccuaaauguaaucacgaguaagauua

SEQ ID NO: 78964 - RNA, 64 nt, Homo Sapiens
uuacuuagaaguagauggugggggacagcggcguggguccuagccuggccagugaugcugcugg

SEQ ID NO: 78965 - RNA, 64 nt, Homo Sapiens
uuguugguuugaagaugaaccgacuuuuuaguuuggguccuacuguuguuauuaaaaacagaac

SEQ ID NO: 78966 - RNA, 64 nt, Homo Sapiens
cuuuuuugguuauaagcccuacacaugaagcucuggguccuagcguggaagauucccuauuuaa

SEQ ID NO: 78967 - RNA, 64 nt, Homo Sapiens
aagugccacuuccacuaagauauuuugacuuuaaggguccuaguaaagugcucuaaaaauuaaa

SEQ ID NO: 78968 - RNA, 64 nt, Homo Sapiens
uuuagguuuucccaggacagaauggucucagagaggguccuacuaggauucaguuccugccuau

SEQ ID NO: 78969 - RNA, 64 nt, Homo Sapiens
ccagugcuucuccaacacugaagcagaggcuuugggguccuagccauugugcuuggccccuggu

SEQ ID NO: 78970 - RNA, 64 nt, Homo Sapiens
ugccucccaacaguggggaagagugacucuccagggguccuaggccucaacuccucccauagau

SEQ ID NO: 78971 - RNA, 64 nt, Homo Sapiens
aauaacaugugacuccuuaauggacuuauucucaggguccuacucuaagaagaaucuaauagga

SEQ ID NO: 78972 - RNA, 64 nt, Homo Sapiens
uguguaaucuaucaaacacaccccuggccaaguuggguccuauaggaccugguacuauguacua

SEQ ID NO: 78973 - RNA, 64 nt, Homo Sapiens
gaaugagggaagacaaaaauggagggagggaaaaggguccuauauuagaagugcauguauaugu

SEQ ID NO: 78974 - RNA, 64 nt, Homo Sapiens
uugggucuuuugugucaacgcuauguauuaaguuggguccuaagcagcucugucauggugcuau

SEQ ID NO: 78975 - RNA, 64 nt, Homo Sapiens
uccauguguacuuauuacagucuuauuuaaccagggguccuaaccacuaacauugugacuuugc

SEQ ID NO: 78976 - RNA, 64 nt, Homo Sapiens
ccaggagaugggccuaaaauguucuggaucccuuggguccuaguguuauguuccagucugccca

SEQ ID NO: 78977 - RNA, 64 nt, Homo Sapiens
uaaugcgggggcuggaccaggcugaguccccacaggguccuaguggaggauguggaggggcggg

SEQ ID NO: 78978 - RNA, 64 nt, Homo Sapiens
uguguaaguagucaucgccacucaaguaggacaaggguccuacccaaggcuaggaccgcccugc

SEQ ID NO: 78979 - RNA, 64 nt, Homo Sapiens
gagcugagaccccggccccccuuggacuggcacaggguccuacagagucagaggaggccugaga

SEQ ID NO: 78980 - RNA, 64 nt, Homo Sapiens
auaugcaauuccacacugguaaccugcagcaguuggguccuaaugauggcauuagacuuucaua

SEQ ID NO: 78981 - RNA, 64 nt, Homo Sapiens
ugugacagccccgaugagcaccuggcuggcugcaggguccuaccucuggguuuccuggaagugg

SEQ ID NO: 78982 - RNA, 64 nt, Homo Sapiens
acaguaauuauuaucuggcacaucaaugaauuugggguccuauacacuugacuagagacaugcu

SEQ ID NO: 78983 - RNA, 64 nt, Homo Sapiens
aguuuugaguaugaugaaacuuaggcuugggaugggguccuacaauuuggggauuacuuuuuac

SEQ ID NO: 78984 - RNA, 64 nt, Homo Sapiens
aacuacucaguaaaagaacggcauguuauagccaggguccuacuguucacgaacugugcccaac

SEQ ID NO: 78985 - RNA, 64 nt, Homo Sapiens
uuacugucauugucuaaaagguccaguccauucuggguccuagacgugcauucuguaucagcug

SEQ ID NO: 78986 - RNA, 64 nt, Homo Sapiens
uauuuuuuauuuauaggauauacaguaacuauuuggguccuaugaaaauaguccuuaaagagcu

SEQ ID NO: 78987 - RNA, 64 nt, Homo Sapiens
ccuucccugagugcgggcugccccccgcccucauggguccuagcgggagaugcuucucuccuug

SEQ ID NO: 78988 - RNA, 64 nt, Homo Sapiens
cugcuggcauugagcugggguaauggguuuuagcggguccuaguuucuccccuuuccgucugaa

SEQ ID NO: 78989 - RNA, 64 nt, Homo Sapiens
ccuuuugucgccuggaugcagucuacuccuuucuggguccuaacccuuccuuuuccugggcuuc

SEQ ID NO: 78990 - RNA, 64 nt, Homo Sapiens
ccagcuacccagccccucucugugugcagccggaggguccuaagaauggcucccggagcuaacu

SEQ ID NO: 78991 - RNA, 64 nt, Homo Sapiens
caagcaggcccugggaugggaguggggcggaggaggguccuaagagcugauuauuuaauuucua

SEQ ID NO: 78992 - RNA, 64 nt, Homo Sapiens
gcggucucgcuggcacagcgccccguacacuaggggguccuacagcuacguggccgugggcagu

SEQ ID NO: 78993 - RNA, 64 nt, Homo Sapiens
gcgcgggcuaagccugcaggucugccugcucaugggguccuaaaaagcaagccgugccaggcca

SEQ ID NO: 78994 - RNA, 64 nt, Homo Sapiens
cacugaacguucagaugcauaccaaauuaugcauggguccuaaucacacauauaaggcuggcua

SEQ ID NO: 78995 - RNA, 64 nt, Homo Sapiens
auaugagaauuuugcuguugcugaugccugguguggguccuaaugauaucucuguauaacaaag

SEQ ID NO: 78996 - RNA, 64 nt, Homo Sapiens
agggccagcagcagcacaaccuugaccagagcuuggguccuaccugucuaccuggagugaacag

SEQ ID NO: 78997 - RNA, 64 nt, Homo Sapiens
ggccuuugauccuuugaagaccuucuucagcuguggguccuaaaggacaugcuggcagcaggcg

SEQ ID NO: 78998 - RNA, 64 nt, Homo Sapiens
gauccgggcucuccaggaauccacaaaccucaguggguccuacaugcaagaucugaggcucugc

SEQ ID NO: 78999 - RNA, 64 nt, Homo Sapiens
uuaagaguuguguucauguauuacagucacccuuggguccuaaaucccagcgcuccuaucaugu

SEQ ID NO: 79000 - RNA, 64 nt, Homo Sapiens
ccauaacaacuaaaucaaaaaaaaauugauaccuggguccuauuauuagccuggcagagcuuua

SEQ ID NO: 79001 - RNA, 64 nt, Homo Sapiens
uaccagucuuuaaaggcccaggaaaccucacgcuggguccuaaucagaaucccagccggccaau

SEQ ID NO: 79002 - RNA, 64 nt, Homo Sapiens
aaacuccacucuggacagcguggcuggcuugcagggguccuaagccggcccagagauuuggacu

SEQ ID NO: 79003 - RNA, 64 nt, Homo Sapiens
uccugggggaaggggagauccaggggagguuuagggguccuaucggucaggugguccuaggacc

SEQ ID NO: 79004 - RNA, 64 nt, Homo Sapiens
ccaggacuuccugugugaccgagccacggguccuggguccuagaggccagaugcacugggaaca

SEQ ID NO: 79005 - RNA, 64 nt, Homo Sapiens
uccucucagcagugggugacccuugacuucugcuggguccuaagagcugcagggcacuaaugac

SEQ ID NO: 79006 - RNA, 64 nt, Homo Sapiens
gugcugggaauacaucuguggacaagacaugcuuggguccuacuccuggagcacuguaaaaaga

SEQ ID NO: 79007 - RNA, 64 nt, Homo Sapiens
cuuaccucuccuccuuagcccaauaugcugucuuggguccuauucaaauaaaguuauuucuccu

SEQ ID NO: 79008 - RNA, 64 nt, Homo Sapiens
ucaaacaggcccaagcaaaggcuggaagacauuuggguccuagaagaagggauauccuugaaua

SEQ ID NO: 79009 - RNA, 64 nt, Homo Sapiens
guggggcauucccucuagauucagguuugggcagggguccuauagucccugccauggggcugcu

SEQ ID NO: 79010 - RNA, 64 nt, Homo Sapiens
uagguagggcugauggugcggaggaggugauaccggguccuagguaggggcaaccucguacuga

SEQ ID NO: 79011 - RNA, 64 nt, Homo Sapiens
cagccuggaucugagcucugucccugccaugcugggguccuacccauucgaucuuccuuucacc

SEQ ID NO: 79012 - RNA, 64 nt, Homo Sapiens
cuucccagggcaagaggaagcagcacugccccauggguccuagaggguuuggacucuaaaaucu

SEQ ID NO: 79013 - RNA, 64 nt, Homo Sapiens
cucaguuugaagaaguggggcauauggcggggugggguccuagcuucccuagggaccaggcacu

SEQ ID NO: 79014 - RNA, 64 nt, Homo Sapiens
uucauuugcuagugggacuacuggauguguuccuggguccuaugaagugcacuguccuucuguc

SEQ ID NO: 79015 - RNA, 64 nt, Homo Sapiens
auuucuguucaggaaaucuuuguaaaacauucagggguccuaccuuucuuuuccugaaauucac

SEQ ID NO: 79016 - RNA, 64 nt, Homo Sapiens
cagcuuuuuaaaauuauacuguuuaaauauguuuggguccuaaaauucuguauguguaagagau

SEQ ID NO: 79017 - RNA, 64 nt, Homo Sapiens
aaaagaagauggcagauacaggagagacgacagaggguccuaggcuggaauguuccuuucgaaa

SEQ ID NO: 79018 - RNA, 64 nt, Homo Sapiens
ugguguuuaaagauggguauuugucauacaauauggguccuaaauccaaccaacuacacauuuu

SEQ ID NO: 79019 - RNA, 64 nt, Homo Sapiens
gguucauaucaguuauguaggaccuuuggacccaggguccuacagauagauauggugugcccag

SEQ ID NO: 79020 - RNA, 64 nt, Homo Sapiens
uucauucuaaagcagcaagcuugucauacccaugggguccuauguugauagaaauggagaggua

SEQ ID NO: 79021 - RNA, 64 nt, Homo Sapiens
gaagagaguagaaacccuagggagcagugcuuuuggguccuagaaccuguugaguuucuaauga

SEQ ID NO: 79022 - RNA, 64 nt, Homo Sapiens
uauggcagaugucacagcuuuagguagguaaaaaggguccuagaugaaaaccuuggaguuuuuu

SEQ ID NO: 79023 - RNA, 64 nt, Homo Sapiens
ugcauucugaaauugacuuaaaaauuuuuaguguggguccuaaaguuuagagaugggcaaggag

SEQ ID NO: 79024 - RNA, 64 nt, Homo Sapiens
cccagcucuuccaugggaucaagucuggaaaccuggguccuaguugggagagagcugugugcag

SEQ ID NO: 79025 - RNA, 64 nt, Homo Sapiens
auguuuuuuuuucaguaguguacauaugcaaguaggguccuauuuaauguagaauuccuguggu

SEQ ID NO: 79026 - RNA, 64 nt, Homo Sapiens
aacucucucuagcauuuccgugcagagccaggcuggguccuaacccucagcugacucacagagc

SEQ ID NO: 79027 - RNA, 64 nt, Homo Sapiens
gccuuggugggggagccucuggaaugcauggggcggguccuagcuguuagggacauuuccaagc

SEQ ID NO: 79028 - RNA, 64 nt, Homo Sapiens
auguggcaggaaacagccauccuucugguuagauggguccuaccagcuucuggaauagacaguu

SEQ ID NO: 79029 - RNA, 64 nt, Homo Sapiens
gggaaauaaaauuauaaccguauaaaacugguuaggguccuacaaaaugaaauugccagaaaga

SEQ ID NO: 79030 - RNA, 64 nt, Homo Sapiens
ucaaacuguagggucacuuuugauugaggcaaagggguccuacuguaaguggaaaagacucacu

SEQ ID NO: 79031 - RNA, 64 nt, Homo Sapiens
ccccccaaguggagggaacagauccuggccugagggguccuagccuggagcaggcgccugcgcc

SEQ ID NO: 79032 - RNA, 64 nt, Homo Sapiens
uggcagccagccauagguuguuucuuugucuuccggguccuaaagagcacagagaaaauggagg

SEQ ID NO: 79033 - RNA, 64 nt, Homo Sapiens
ucagggagccugucccuuuauguucccaaauaaaggguccuagaagacuagaaagccaaggucu

SEQ ID NO: 79034 - RNA, 64 nt, Homo Sapiens
aucagggcauaacuaaggggguggaguccaggcuggguccuagaccagccugggaccaagggau

SEQ ID NO: 79035 - RNA, 64 nt, Homo Sapiens
acuuggauggacuuguauagacuguugccccccaggguccuaaauguugaggugggugggccug

SEQ ID NO: 79036 - RNA, 64 nt, Homo Sapiens
ggcaggugcugggaaaggccgugcaugccacccgggguccuacacuccucccugggacaauagu

SEQ ID NO: 79037 - RNA, 64 nt, Homo Sapiens
aacuguacauuugcaagauuguuaguguccacuaggguccuauuauagaccaugcauuuuugaa

SEQ ID NO: 79038 - RNA, 64 nt, Homo Sapiens
cagcagcgcacacaguggagggaugaggauggauggguccuaaccccugauuuugaugggaugu

SEQ ID NO: 79039 - RNA, 64 nt, Homo Sapiens
ugucuuucuuggccccugucucucuccauguuggggguccuaacucccccaccccauaucuacg

SEQ ID NO: 79040 - RNA, 64 nt, Homo Sapiens
ggaggccaccguuaccaacugaagcugggggccuggguccuacccugucuggucaugaccccau

SEQ ID NO: 79041 - RNA, 64 nt, Homo Sapiens
cacugaacaucauguuuguagacgcugacaggugggguccuaaugagagccaacacaugcucac

SEQ ID NO: 79042 - RNA, 64 nt, Homo Sapiens
aaaaugccccucccagauaacugucaaugguuauggguccuauacuuauuguggcugauauuaa

SEQ ID NO: 79043 - RNA, 64 nt, Homo Sapiens
ccccaugccagccauuguaaacagauuucuuuggggguccuagaggggggcagggaaggggaac

SEQ ID NO: 79044 - RNA, 64 nt, Homo Sapiens
guguuacucaaagcugugcacugaacgugugacaggguccuaugucaagcuuuuaaaauugacc

SEQ ID NO: 79045 - RNA, 64 nt, Homo Sapiens
gacagacccugcaguccuacuacagucuggagugggguccuaagaagaagggucccaccucaac

SEQ ID NO: 79046 - RNA, 64 nt, Homo Sapiens
agugcuccuuguccaucccugguaaggcuggguaggguccuaacagguggcccugugggcugag

SEQ ID NO: 79047 - RNA, 64 nt, Homo Sapiens
ccuuuaggcagugacauggcgggcuggggcucagggguccuaacgggcagggggcacuugagcu

SEQ ID NO: 79048 - RNA, 64 nt, Homo Sapiens
ugccaaagggguuccccugcgggaccugacugugggguccuagauggcuacugcacucuccacu

SEQ ID NO: 79049 - RNA, 64 nt, Homo Sapiens
agagagucacagguaccccaaggaguagaugccaggguccuaaguugaaaaugaugucgauugg

SEQ ID NO: 79050 - RNA, 64 nt, Homo Sapiens
cuacuguugauaguuuuaauuugucauauuuguuggguccuauuuacauuggcaagauaaauag

SEQ ID NO: 79051 - RNA, 64 nt, Homo Sapiens
cuguugacuucccauugcucuuggagccaccaaucaaagagauucaaagagauuccugcaggcc

SEQ ID NO: 79052 - RNA, 64 nt, Homo Sapiens
cccauugcucuuggagccaccaaucaaagagauucaaagagauuccugcaggccagaggcggaa

SEQ ID NO: 79053 - RNA, 64 nt, Homo Sapiens
acacugucauuuaaggcugugcuugugcuuuauacaaagagaaagagguggucuuaaggggaug

SEQ ID NO: 79054 - RNA, 64 nt, Homo Sapiens
uucugaugcauuaauaaaagcagccaaauagggccaaagagaaaaauaacaggacucuguacug

SEQ ID NO: 79055 - RNA, 64 nt, Homo Sapiens
ccuggcugccuggccguggcuucucuuuggcucccaaagagaaggacaguguugggaguaucug

SEQ ID NO: 79056 - RNA, 64 nt, Homo Sapiens
uugggaguaucugccguggcuucucuuuggcucccaaagagaaggacaguguugggaguaucug

SEQ ID NO: 79057 - RNA, 64 nt, Homo Sapiens
guaguguccaccuuacucaacaucagaaaauucacaaagagaugcccuguaaguguacuguaug

SEQ ID NO: 79058 - RNA, 64 nt, Homo Sapiens
gagcacaucuaguucaacaucagagcauucauaccaaagagaacucaugaauguaaugaagaug

SEQ ID NO: 79059 - RNA, 64 nt, Homo Sapiens
uuucaaagucuguuuaauugccuauuacuucucucaaagagaaccugaagucagaacacaugag

SEQ ID NO: 79060 - RNA, 64 nt, Homo Sapiens
guagcguaagagcugaguauaguaaguccucuuccaaagagauggcaauaugcugggcaucuac

SEQ ID NO: 79061 - RNA, 64 nt, Homo Sapiens
gcauguacuguaugggaggaugauccagauguuucaaagagaauuucucuuaguuuaguuaggu

SEQ ID NO: 79062 - RNA, 64 nt, Homo Sapiens
uauuagaaagcauuuucuagguguguuuaguguacaaagagacuuuauaacccuuacuggacaa

SEQ ID NO: 79063 - RNA, 64 nt, Homo Sapiens
uccucacccuggugcuuauggauauuaauuccugcaaagagaccaggagcaggagacugaaauc

SEQ ID NO: 79064 - RNA, 64 nt, Homo Sapiens
cuuugaaggagcaggagacuagucucgccaucgucaaagagaaauucuucugacuuagaauaua

SEQ ID NO: 79065 - RNA, 64 nt, Homo Sapiens
cuaaaaaaaaaaacaaaaaaugcuuauucuuuaacaaagagaaugccuaccauccccggaaggg

SEQ ID NO: 79066 - RNA, 64 nt, Homo Sapiens
gaaagaaagaaggaaggaaguauugauaauuggacaaagagagauaauaaagccaauuguauug

SEQ ID NO: 79067 - RNA, 64 nt, Homo Sapiens
ugagggagagacucugaggacauggagagagacucaaagagacuccaagauucaaagagacuaa

SEQ ID NO: 79068 - RNA, 64 nt, Homo Sapiens
gacauggagagagacucaaagagacuccaagauucaaagagacuaauagagacacagagaugga

SEQ ID NO: 79069 - RNA, 64 nt, Homo Sapiens
ugaaguauguaugucguacucuuaauuacccaaccaaagagaucugucccagaacauuucugug

SEQ ID NO: 79070 - RNA, 64 nt, Homo Sapiens
cucuauacagaauguauaucuacugugccuuacacaaagagaaauuauauacucaauaugguuu

SEQ ID NO: 79071 - RNA, 64 nt, Homo Sapiens
cugaaauuucuuuucuugggugaaauuaguauuccaaagagauuuuuuguuaaaucuagaaaca

SEQ ID NO: 79072 - RNA, 64 nt, Homo Sapiens
ggcaagauaaucccaaacuuugagauuugaacaacaaagagaaagacauuuaaaggauuaaaac

SEQ ID NO: 79073 - RNA, 64 nt, Homo Sapiens
agccgucaaguaguaagaagaacuuggaugccagcaaagagaauggggcugggcagaucuguga

SEQ ID NO: 79074 - RNA, 64 nt, Homo Sapiens
uggaaaccacagugaagaagacagcacugaugaccaaagagaagacacucauauuaagccuauu

SEQ ID NO: 79075 - RNA, 64 nt, Homo Sapiens
ccguaaggugcuuccuuuaacuguucggauaugccaaagagaaagaugcugguagugaugcugg

SEQ ID NO: 79076 - RNA, 64 nt, Homo Sapiens
ucuguaucccauaggcccaggcagguaguuuauucaaagagaacgcagacuccugccagauggg

SEQ ID NO: 79077 - RNA, 64 nt, Homo Sapiens
cuugacagacucacucggccucacuucauccuugcaaagagaauccuguacuucauccuugcaa

SEQ ID NO: 79078 - RNA, 64 nt, Homo Sapiens
auccuugcaaagagaauccuguacuucauccuugcaaagagaauccuguacuucacucagaaug

SEQ ID NO: 79079 - RNA, 64 nt, Homo Sapiens
uugcuugcaauguugguuuggcuauucauuugcacaaagagacuguggcucucuguugugagau

SEQ ID NO: 79080 - RNA, 64 nt, Homo Sapiens
auguuuuaugcucaccauuaugaauuggggucuucaaagagagaagguugaaaguggaaagcac

SEQ ID NO: 79081 - RNA, 64 nt, Homo Sapiens
cagugggaauagcagcuuguaguauugaaauaaucaaagagauaauuucagcucuuacaacaag

SEQ ID NO: 79082 - RNA, 64 nt, Homo Sapiens
agucuuuuuugcaaucuugaacuuucauuagcuucaaagagaagcuguauuuacaggagaaaga

SEQ ID NO: 79083 - RNA, 62 nt, Homo Sapiens
caacauggucaucauguuuucuauaugguuuuuccagcuagcaguacucccuuccauaccug

SEQ ID NO: 79084 - RNA, 62 nt, Homo Sapiens
cuucacucccaucaucaucuauuuucacacuauccagcuaagcaaagauuccuggaggcuga

SEQ ID NO: 79085 - RNA, 62 nt, Homo Sapiens
uaguagggagugggagggcuuauauugguuuuuccagcuauuaaggggacauauugugucgu

SEQ ID NO: 79086 - RNA, 62 nt, Homo Sapiens
aaaaauuaggcaugguggugcaugccuguaguuccagcuacuugggaggcugagacaggcga

SEQ ID NO: 79087 - RNA, 62 nt, Homo Sapiens
uuuucugugccauuuuaaauuuaacuuugacauccagcuauagacagaaauaauaagccacc

SEQ ID NO: 79088 - RNA, 62 nt, Homo Sapiens
ggggccuggggccuccuugccuggcuucuuccuccagcuauccucagggaagcuggagauuc

SEQ ID NO: 79089 - RNA, 62 nt, Homo Sapiens
uccuggacuaagccaaugacaccuuccaucuuuccagcuauggugacuggguuagguaugau

SEQ ID NO: 79090 - RNA, 62 nt, Homo Sapiens
gccauggucacgagucauuucugccugacugcuccagcuaacuuccagggucucagcaaacu

SEQ ID NO: 79091 - RNA, 62 nt, Homo Sapiens
auuagccaggcaugguggugggugccuguaguuccagcuacuugggaggcugaggugggaaa

SEQ ID NO: 79092 - RNA, 64 nt, Homo Sapiens
gaguugguaaaggguuaauacccugaguuuuacccagacucaagagaacauccauaauuugggg

SEQ ID NO: 79093 - RNA, 64 nt, Homo Sapiens
gggcuggauuuugguucccucugagccucguguccagacucagagccaagggcaggaccaaugg

SEQ ID NO: 79094 - RNA, 64 nt, Homo Sapiens
gcagcacuuccacaccaagauuccucugucccugcagacucagucccggccccgcuccugccca

SEQ ID NO: 79095 - RNA, 64 nt, Homo Sapiens
ccacugccuugccagucuugcccaucuucucuggcagacucagccccugggcgggcagcagcuc

SEQ ID NO: 79096 - RNA, 64 nt, Homo Sapiens
cugcaccucggaaaaauaccaacucagugaaauacagacucaaguuucgcuuuggauaauauuc

SEQ ID NO: 79097 - RNA, 64 nt, Homo Sapiens
ucuccugccucagccucccaaguagcugggauuacagacucaugccaccacgccagcuaauuuu

SEQ ID NO: 79098 - RNA, 64 nt, Homo Sapiens
gcguucccuccagaacucccagagccacagucuccagacucauggucaggcuccaccgcacaga

SEQ ID NO: 79099 - RNA, 64 nt, Homo Sapiens
accaucuacuauugauuuuauccuuucuugaggccagacucaucgcucccagugcuauucaggg

SEQ ID NO: 79100 - RNA, 64 nt, Homo Sapiens
gugggcugagugcugaguguuuaccugugggcaucagacucagcucgauggccagcauuacccu

SEQ ID NO: 79101 - RNA, 64 nt, Homo Sapiens
cuuuuuuaaacaauaaauguccacuaucuaauuccagacucacgacaaacuuguucaaccauca

SEQ ID NO: 79102 - RNA, 64 nt, Homo Sapiens
acccaggcuagagugcaauggcaccaucuuggcucacugcaaccucuaccuccuggguucaagc

SEQ ID NO: 79103 - RNA, 64 nt, Homo Sapiens
caccaggcuggagugcagugccgcaaucucggcucacugcaaccuccgccucccagguucaagc

SEQ ID NO: 79104 - RNA, 64 nt, Homo Sapiens
acccaggcugcagugcaauggcgcgaucucagcucacugcaaccuccaccuccggguucaagcg

SEQ ID NO: 79105 - RNA, 64 nt, Homo Sapiens
ugccagacuggagugcaguggcacgaucucggcucacugcaaccucugccucccggguucaagc

SEQ ID NO: 79106 - RNA, 64 nt, Homo Sapiens
agccaggcuggagugcaguggcauaaucucagcucacugcaaccucugcuucccggguucaagc

SEQ ID NO: 79107 - RNA, 64 nt, Homo Sapiens
gcccaggcuggaguguaguggcgcagucucagcucacugcaaccuccaccucccggguucaagu

SEQ ID NO: 79108 - RNA, 64 nt, Homo Sapiens
auuuugacaguucuacugauccguaaaugauaaccacugcaaauuuuuucaguauaaaauuuuu

SEQ ID NO: 79109 - RNA, 64 nt, Homo Sapiens
uaaccacugcaaauuuuuucaguauaaaauuuuucacugcaaaaaaauuucaguagaaaauaag

SEQ ID NO: 79110 - RNA, 64 nt, Homo Sapiens
ucugccuccuugguucaagcgcguggucuuggcucacugcaaccgcccaggcuggagugcguug

SEQ ID NO: 79111 - RNA, 64 nt, Homo Sapiens
ucugccuccugggugcaagcgcacgaucucggcucacugcaaccgcgcaggguggagugcggug

SEQ ID NO: 79112 - RNA, 64 nt, Homo Sapiens
uccaccucccggguucaagcguacgaucuuggcucacugcaaccacucaggcuggagugcagug

SEQ ID NO: 79113 - RNA, 64 nt, Homo Sapiens
uccgccucccagguucaagcgugugaucuuagcucacugcaaccacccaggcuggagugcugug

SEQ ID NO: 79114 - RNA, 64 nt, Homo Sapiens
uccgccuccuggguucaagcgcgcgaacucggcucacugcaaccgcccaggcuggagugcagug

SEQ ID NO: 79115 - RNA, 64 nt, Homo Sapiens
ccugccucccgggcucaagcgcgcaaucuuugcucacugcaacccccaggcugggggugcaaug

SEQ ID NO: 79116 - RNA, 64 nt, Homo Sapiens
uugaaaaauggcauucacucuuacagaugguguucacugcaagccccagaagcauauggcaugu

SEQ ID NO: 79117 - RNA, 64 nt, Homo Sapiens
ccccaagcuggaguacaaugacaggaucucggcucacugcaagcucugccucccggguucaagc

SEQ ID NO: 79118 - RNA, 64 nt, Homo Sapiens
acccaggcuggagugcaguggugcgaucucggcucacugcaagcuccgccucccggguucucac

SEQ ID NO: 79119 - RNA, 64 nt, Homo Sapiens
caggcuggagugcaauggugcaaugaccucggcucacugcaaccucugccuccuggguucaagu

SEQ ID NO: 79120 - RNA, 64 nt, Homo Sapiens
acccaggcuggagugcaauggcgcaaucucagcucacugcaaccucugccucccggguucaagc

SEQ ID NO: 79121 - RNA, 64 nt, Homo Sapiens
gcccaggcuggagugcaguggcgugaucuuggcucacugcaaccucugccucccagcuucaagc

SEQ ID NO: 79122 - RNA, 64 nt, Homo Sapiens
acccaggcuggagagcaguggcgugaucucggcucacugcaagcuccgccucccggguucacgc

SEQ ID NO: 79123 - RNA, 64 nt, Homo Sapiens
acccaggcuggaaugcaauggcaccaucuuggcucacugcaaccucugcuuccuggguucaagu

SEQ ID NO: 79124 - RNA, 64 nt, Homo Sapiens
acccaggcuagagugcgguggugugaucuuggcucacugcaaccucccccuccuggguucaagc

SEQ ID NO: 79125 - RNA, 64 nt, Homo Sapiens
gcucaggcuggagugcaguggugcaaucuuggcucacugcaaccuacaccucccggguucaagu

SEQ ID NO: 79126 - RNA, 64 nt, Homo Sapiens
gcucgcgcuggagugcaguggcaugaucucggcucacugcaagcuccgccucccagguucaugc

SEQ ID NO: 79127 - RNA, 64 nt, Homo Sapiens
acccaggcuggaaugcaguggugugaucuuggcucacugcaaccuccacuucccggguucaagc

SEQ ID NO: 79128 - RNA, 64 nt, Homo Sapiens
ucugccuccugggcucaagcgcgcaaucucggcucacugcaaccgccuaggcuggagugcagug

SEQ ID NO: 79129 - RNA, 64 nt, Homo Sapiens
uauuacuugguagcuuaaaauaguuuucuguugccacugcaacccaaacaguggcccccugcau

SEQ ID NO: 79130 - RNA, 64 nt, Homo Sapiens
caggcuggaggagugcaguggugugaucucagcucacugcaaccuccaccucccagguucaagc

SEQ ID NO: 79131 - RNA, 64 nt, Homo Sapiens
gcccaggcuggaacgcaguggugacaucucggcucacugcaaccuccaccucccagguucaagu

SEQ ID NO: 79132 - RNA, 64 nt, Homo Sapiens
gcccaggcuggagugcaguggcgcgaucucagcucacugcaaccuccgccucccagguucaagc

SEQ ID NO: 79133 - RNA, 64 nt, Homo Sapiens
uaaauaaaccccuaauuagccuuagaagaaaaaccacugcaagauauuaagcguguguaaaugg

SEQ ID NO: 79134 - RNA, 64 nt, Homo Sapiens
aaagcagggaggaaaccucugcagcucauucugccacugcaaagcugguguagccaugcuggug

SEQ ID NO: 79135 - RNA, 64 nt, Homo Sapiens
uccuucacaccccuuccaaaagucagucacagaccacugcaacaugccuucccugcuggaucau

SEQ ID NO: 79136 - RNA, 64 nt, Homo Sapiens
acccaggcuggagugcaguggcguagucucggcucacugcaagcuccgccucccggguucacgc

SEQ ID NO: 79137 - RNA, 64 nt, Homo Sapiens
auauaucuacagagagaaaauucuuauuuuuugccacugcaaaccgauaaccugaacuaauuug

SEQ ID NO: 79138 - RNA, 64 nt, Homo Sapiens
uacaguggggauuuuaucuguguccuacuagauacacugcaaacguaagcuaagcaauaguuua

SEQ ID NO: 79139 - RNA, 64 nt, Homo Sapiens
uccaccuccuggguucaaguaugccaucucagcucacugcaaccacacaggcuggaaugcagug

SEQ ID NO: 79140 - RNA, 64 nt, Homo Sapiens
uccgccucccaaguucacucgcgcgaucucagcucacugcaagcgcccaggcuggaguacagug

SEQ ID NO: 79141 - RNA, 64 nt, Homo Sapiens
uccuccuccuggauucaagcgcaugaucugggcucacugcaaccacccaggcuggaguguagug

SEQ ID NO: 79142 - RNA, 64 nt, Homo Sapiens
uccgccucccggguucacgcgcucgaucucggcucacugcaagcgcccaggcuggagugcagug

SEQ ID NO: 79143 - RNA, 64 nt, Homo Sapiens
uccgucucuuagguucaagcgcaugaucucagcucacugcaaccgcugaggcuggagugaaaug

SEQ ID NO: 79144 - RNA, 64 nt, Homo Sapiens
uccaccucccagguucaagcgugcaaucucggcucacugcaaccugcucugcuggagugcggug

SEQ ID NO: 79145 - RNA, 64 nt, Homo Sapiens
acccaggcuagagugcaauggcacgaucucggcucacugcaagcucugcguccuggguugacgc

SEQ ID NO: 79146 - RNA, 64 nt, Homo Sapiens
gcccaggcuggagugcaguggcgcgaucucgacucacugcaagcuccgccucccggguucacgc

SEQ ID NO: 79147 - RNA, 64 nt, Homo Sapiens
gccagggcuguagugcaguggugugaucauagcucacugcaaccuccaccucccaggcucaagc

SEQ ID NO: 79148 - RNA, 64 nt, Homo Sapiens
caggacuacacacuuguauauacauucuugagaacacugcaaugugaaaaucacguuugcuauu

SEQ ID NO: 79149 - RNA, 64 nt, Homo Sapiens
gcccaggcuggagugcaguggcgcgaucucggcucacugcaaccucugcccccuggguucaagc

SEQ ID NO: 79150 - RNA, 64 nt, Homo Sapiens
ugcccgggcuggaaugcaauggcgcgauucagcucacugcaaucuccgccucccggguucaagu

SEQ ID NO: 79151 - RNA, 64 nt, Homo Sapiens
uccuucucccagguucaagcgcgcgaucuaggcucacugcaaccguccaggcuggagugcagug

SEQ ID NO: 79152 - RNA, 64 nt, Homo Sapiens
ucucuccaggugcaauugaaacacgcccguugcccacugcaagugcggggaaggucucuccugg

SEQ ID NO: 79153 - RNA, 64 nt, Homo Sapiens
gcucaggcuggaguacaguggcauaaucacagcucacugcaaccucaauccugggcucaaguga

SEQ ID NO: 79154 - RNA, 64 nt, Homo Sapiens
ccccaggcuggagugcaguggcucgaucucugcucacugcaagcuccgccuccuggguucaugc

SEQ ID NO: 79155 - RNA, 64 nt, Homo Sapiens
ucugucuccuggguucaugcgcgcgaucucggcucacugcaagcgcccaggcuugagugcagug

SEQ ID NO: 79156 - RNA, 64 nt, Homo Sapiens
uccaccuccuggguucaagagugcaaucucagcucacugcaaucugccaggcuggagugcggug

SEQ ID NO: 79157 - RNA, 64 nt, Homo Sapiens
guaacuuggccagaugcuccagcauaugcacguucacugcaaagcacccuacugguuuugaaaa

SEQ ID NO: 79158 - RNA, 64 nt, Homo Sapiens
auggagaucgauuugauuuguuuauaagcagacacacugcaauuuacaaagaucucuuuacggu

SEQ ID NO: 79159 - RNA, 64 nt, Homo Sapiens
gcccagcccagaguacaguggcacuaucucagcucacugcaaucuccgccucccugguucaagu

SEQ ID NO: 79160 - RNA, 64 nt, Homo Sapiens
acccaggcuggagugcuguggugcaaucucggcucacugcaaccucugccucccgaguucaagc

SEQ ID NO: 79161 - RNA, 64 nt, Homo Sapiens
ggcauaaaaauuaaaguccuuaggcagaaaaagacacugcaaauauuaagaguggcuggcagag

SEQ ID NO: 79162 - RNA, 64 nt, Homo Sapiens
uccgccucccaaguucaagcgcacgaucucggcucacugcaaccgcccaggcuggagugcagug

SEQ ID NO: 79163 - RNA, 64 nt, Homo Sapiens
ucugccucccagguucaagcgcgcaauuucagcucacugcaaccacugaggcuggagugcagug

SEQ ID NO: 79164 - RNA, 64 nt, Homo Sapiens
ucagccuccccgauucacgcgcgcgaucucggcucacugcaagcacccagacuggagugcagug

SEQ ID NO: 79165 - RNA, 64 nt, Homo Sapiens
agagacgggcuggcuaacccuccuaauuaagggccacugcaaagaccccccaucugucucuucc

SEQ ID NO: 79166 - RNA, 64 nt, Homo Sapiens
cagccugggugacauagagagauagugauagugccacugcaauucagagguugcagugaacuga

SEQ ID NO: 79167 - RNA, 64 nt, Homo Sapiens
acccagguuggagugccauggcaugaucuuggcucacugcaaccuccaccuccugggucaagcc

SEQ ID NO: 79168 - RNA, 64 nt, Homo Sapiens
gcccaggcuggagugcaguggcacaaucucagcucacugcaagcuccgccuccuggguucacgc

SEQ ID NO: 79169 - RNA, 64 nt, Homo Sapiens
uccaccuccuggguuccagcgcgugaucucggcucacugcaacuacccgggcuggagugcagug

SEQ ID NO: 79170 - RNA, 64 nt, Homo Sapiens
agcuugcugccuccuuuuaaauguuuaagggacccacugcaagaaaugcacugauguuuucaua

SEQ ID NO: 79171 - RNA, 64 nt, Homo Sapiens
uucgccuccuggguucaagcgcaugaucucagcucacugcaaccacccaggcuggagugcaaug

SEQ ID NO: 79172 - RNA, 64 nt, Homo Sapiens
ucugccucccagguucaagcgcaugaucucggcucacugcaacugcccaggcuggagugcagug

SEQ ID NO: 79173 - RNA, 64 nt, Homo Sapiens
ucugccuccuagauucaagcgguugaucuuggcucacugcaacccccaggcuguguagugcagu

SEQ ID NO: 79174 - RNA, 64 nt, Homo Sapiens
gcccaggcuggagggcaauggcgcgaucucagcucacugcaaccuccgucuccuggguucuuga

SEQ ID NO: 79175 - RNA, 64 nt, Homo Sapiens
gcccaggcuggaguacaauggugcgaucuuggcucacugcaaccuccaccuccuggguucaagc

SEQ ID NO: 79176 - RNA, 64 nt, Homo Sapiens
gucacccaggcuggagugcaguggugcgaucgcucacugcaaccucagccuccuggauuuaagu

SEQ ID NO: 79177 - RNA, 64 nt, Homo Sapiens
acccaggcuggagugcaguggcgugaucuuggcucacugcaaccucugccuccuggguucaagc

SEQ ID NO: 79178 - RNA, 64 nt, Homo Sapiens
cuuuggaaaacuauugaagauugcuaaaaaauaccacugcaaagugauggaaaaggguggagaa

SEQ ID NO: 79179 - RNA, 64 nt, Homo Sapiens
acccagguuggagugcaguggcgugaucucagcucacugcaaccuccaccucgcagguucaagc

SEQ ID NO: 79180 - RNA, 64 nt, Homo Sapiens
uccuaagcuggagugcaguggcaucaucucagcucacugcaaccucugccucccagguucaagu

SEQ ID NO: 79181 - RNA, 64 nt, Homo Sapiens
ucugccuccuggguucaagcgugcgaucuuggcucacugcaaccgcccaggcuggagugcagug

SEQ ID NO: 79182 - RNA, 64 nt, Homo Sapiens
uuacuccuaggcucaaguuagugcaaucacagcucacugcaaccaccugagcucuagugcagua

SEQ ID NO: 79183 - RNA, 64 nt, Homo Sapiens
gcccaggcuggaaugcaguugugagaucucggcucacugcaagcuccgccucccggguucacgc

SEQ ID NO: 79184 - RNA, 64 nt, Homo Sapiens
acccaggcuggagugcaguggcaugauuucggcucacugcaaccucugucuccuggguucaaac

SEQ ID NO: 79185 - RNA, 64 nt, Homo Sapiens
uguggucacccaugcaucuuccacuggaacguuucacugcaaacacaccuuggagaaguggcau

SEQ ID NO: 79186 - RNA, 64 nt, Homo Sapiens
ggaccgagguucccacucugggcaaagccccucacacugcaagggauuguagauaacacugacu

SEQ ID NO: 79187 - RNA, 64 nt, Homo Sapiens
uuguguaaauuucucaaagaguugccuucaucuucacugcaauuuuucaguuugaaaauauuuu

SEQ ID NO: 79188 - RNA, 64 nt, Homo Sapiens
ucugccucccagguuccagcgugugaucucggcucacugcaaccacccaggcuggagugcagug

SEQ ID NO: 79189 - RNA, 64 nt, Homo Sapiens
ccagcccccuuugccaggggcagagcagcacugucacugcaaguaacagaagccuaguccuguu

SEQ ID NO: 79190 - RNA, 64 nt, Homo Sapiens
uccaccuccuggguucaugcgcgcgaucucggcucacugcaagcacccaggcuggagugcagug

SEQ ID NO: 79191 - RNA, 64 nt, Homo Sapiens
ggagcuggggcuggggcugcauucccuggagacucacugcaaguuccugcccaggaggcugagg

SEQ ID NO: 79192 - RNA, 64 nt, Homo Sapiens
gcccaggcuggagugcaguggcgugaucucggcucacugcaagcucggccuccuggguucaaau

SEQ ID NO: 79193 - RNA, 64 nt, Homo Sapiens
gcccaggcuggagugcaguggcgugaucucggcucacugcaaccuccacccccggggaucaagc

SEQ ID NO: 79194 - RNA, 64 nt, Homo Sapiens
acccagguucgaguucaguggugccaucucuguccacugcaaccuccacauccuggguucaagu

SEQ ID NO: 79195 - RNA, 64 nt, Homo Sapiens
ucccaggcuggagugcuauggugcaauuuuuguucacugcaaccucugccuuccaagaucaaga

SEQ ID NO: 79196 - RNA, 64 nt, Homo Sapiens
gcccagguuggagugcaguggcgcaaucucggcucacugcaagcuccgccucccggguucacgc

SEQ ID NO: 79197 - RNA, 64 nt, Homo Sapiens
acccaggcuggagugcaguggugugaucuuggcucacugcaaccuccgccuccuggguuccaac

SEQ ID NO: 79198 - RNA, 64 nt, Homo Sapiens
uccgccucccggguucaagcgcgcgaucuaggcucacugcaacucgccaggcuggagugcagug

SEQ ID NO: 79199 - RNA, 64 nt, Homo Sapiens
ucugccucccggguucaagugcgcgaucuuggcucacugcaaccgcucaggcuggagugccaug

SEQ ID NO: 79200 - RNA, 64 nt, Homo Sapiens
uccacuucucagguucaagcgcacaaucuuggcucacugcaaccugccaggcuggagugcagug

SEQ ID NO: 79201 - RNA, 64 nt, Homo Sapiens
uccgccuccuggguucacgcgcgcgaucucagcucacugcaagcgcccaggcuggagugcagug

SEQ ID NO: 79202 - RNA, 64 nt, Homo Sapiens
ucugccucccggguucaugcgcgcgaucucagcucacugcaagcgcccaggccagagugcagug

SEQ ID NO: 79203 - RNA, 64 nt, Homo Sapiens
uccgccuccuguguucaagcgcgugaucuuggcucacugcaacugcccaggcuggagugcagug

SEQ ID NO: 79204 - RNA, 64 nt, Homo Sapiens
guucugaaggugcccaggagcggcgaugcacucgcacugcaaaugccgcucucacguaugcgcc

SEQ ID NO: 79205 - RNA, 64 nt, Homo Sapiens
uugaugggccuucagauuauuuccaguuuuuugccacugcaaacaauaaacauccuuguacaua

SEQ ID NO: 79206 - RNA, 64 nt, Homo Sapiens
gcccaggcuggaguacaauggcacgaucuuggcucacugcaaccuccgccucccggguucaagc

SEQ ID NO: 79207 - RNA, 64 nt, Homo Sapiens
gcccaggcuggagugcaguggcgccaucucggcucacugcaaccuccgccucccagguucaagc

SEQ ID NO: 79208 - RNA, 64 nt, Homo Sapiens
ucugccucccguguucacacgcgugaucucggcucacugcaagcgcccaggcuagagugcagug

SEQ ID NO: 79209 - RNA, 64 nt, Homo Sapiens
uuuucuuuccaaaaucaggccucuauggauuauccacugcaaagcaaagaaaagacauugaaag

SEQ ID NO: 79210 - RNA, 64 nt, Homo Sapiens
acccaggugggagugugguggcacaaucucggcucacugcaaccuccaccuccugaguucaagc

SEQ ID NO: 79211 - RNA, 64 nt, Homo Sapiens
gcccaggcuggagugcagugucacgaucucagcucacugcaaccuccgccucccagguacaaga

SEQ ID NO: 79212 - RNA, 64 nt, Homo Sapiens
gaccguccuugugacuuuuuaaagagguggggcucacugcaacuggggagaacacuuagcauau

SEQ ID NO: 79213 - RNA, 64 nt, Homo Sapiens
acccaggcuggagugcaguggugugaucucggcucacugcaaccuccaccucccggauucaagu

SEQ ID NO: 79214 - RNA, 64 nt, Homo Sapiens
uccaccuccuggguucaagcgcacagucuuggcucacugcaaccgugcaggcuggagugcagug

SEQ ID NO: 79215 - RNA, 64 nt, Homo Sapiens
uccaccucccggguucaagcgcacgaucuuggcucacugcaaccgugcaggcuguagugcagug

SEQ ID NO: 79216 - RNA, 64 nt, Homo Sapiens
uccgccucccagguucaggcgcgcaaucuuggcucacugcaaccugccaggcuggagugcagug

SEQ ID NO: 79217 - RNA, 64 nt, Homo Sapiens; identical to SEQ ID NO: 68416

SEQ ID NO: 79218 - RNA, 64 nt, Homo Sapiens; identical to SEQ ID NO: 68417

SEQ ID NO: 79219 - RNA, 64 nt, Homo Sapiens; identical to SEQ ID NO: 68418

SEQ ID NO: 79220 - RNA, 64 nt, Homo Sapiens; identical to SEQ ID NO: 68419

SEQ ID NO: 79221 - RNA, 64 nt, Homo Sapiens; identical to SEQ ID NO: 68420

SEQ ID NO: 79222 - RNA, 64 nt, Homo Sapiens; identical to SEQ ID NO: 68421

SEQ ID NO: 79223 - RNA, 64 nt, Homo Sapiens; identical to SEQ ID NO: 68422

SEQ ID NO: 79224 - RNA, 64 nt, Homo Sapiens; identical to SEQ ID NO: 68423

SEQ ID NO: 79225 - RNA, 64 nt, Homo Sapiens; identical to SEQ ID NO: 68424

SEQ ID NO: 79226 - RNA, 64 nt, Homo Sapiens; identical to SEQ ID NO: 68425

SEQ ID NO: 79227 - RNA, 64 nt, Homo Sapiens; identical to SEQ ID NO: 68426

SEQ ID NO: 79228 - RNA, 64 nt, Homo Sapiens; identical to SEQ ID NO: 68427

SEQ ID NO: 79229 - RNA, 64 nt, Homo Sapiens; identical to SEQ ID NO: 68428

SEQ ID NO: 79230 - RNA, 64 nt, Homo Sapiens; identical to SEQ ID NO: 68429

SEQ ID NO: 79231 - RNA, 64 nt, Homo Sapiens; identical to SEQ ID NO: 68430

SEQ ID NO: 79232 - RNA, 64 nt, Homo Sapiens; identical to SEQ ID NO: 68431

SEQ ID NO: 79233 - RNA, 64 nt, Homo Sapiens; identical to SEQ ID NO: 68432

SEQ ID NO: 79234 - RNA, 64 nt, Homo Sapiens; identical to SEQ ID NO: 68433

SEQ ID NO: 79235 - RNA, 64 nt, Homo Sapiens; identical to SEQ ID NO: 68434

SEQ ID NO: 79236 - RNA, 64 nt, Homo Sapiens; identical to SEQ ID NO: 68435

SEQ ID NO: 79237 - RNA, 64 nt, Homo Sapiens; identical to SEQ ID NO: 68436

SEQ ID NO: 79238 - RNA, 64 nt, Homo Sapiens; identical to SEQ ID NO: 68437

SEQ ID NO: 79239 - RNA, 64 nt, Homo Sapiens; identical to SEQ ID NO: 68438

SEQ ID NO: 79240 - RNA, 64 nt, Homo Sapiens; identical to SEQ ID NO: 68439

SEQ ID NO: 79241 - RNA, 64 nt, Homo Sapiens; identical to SEQ ID NO: 68440

SEQ ID NO: 79242 - RNA, 64 nt, Homo Sapiens; identical to SEQ ID NO: 68441

SEQ ID NO: 79243 - RNA, 64 nt, Homo Sapiens; identical to SEQ ID NO: 68442

SEQ ID NO: 79244 - RNA, 64 nt, Homo Sapiens; identical to SEQ ID NO: 68443

SEQ ID NO: 79245 - RNA, 64 nt, Homo Sapiens; identical to SEQ ID NO: 68444

SEQ ID NO: 79246 - RNA, 64 nt, Homo Sapiens; identical to SEQ ID NO: 68445

SEQ ID NO: 79247 - RNA, 64 nt, Homo Sapiens; identical to SEQ ID NO: 68446

SEQ ID NO: 79248 - RNA, 64 nt, Homo Sapiens; identical to SEQ ID NO: 68447

SEQ ID NO: 79249 - RNA, 64 nt, Homo Sapiens
agccuguuuguuuuaguauccaaggaagagaccaaggagccagcuggcgggaaggggugggggu

SEQ ID NO: 79250 - RNA, 64 nt, Homo Sapiens
augaccuuuguuguaagucucccaacguccuauuaggagccacagcaggugaggcauuuggugc

SEQ ID NO: 79251 - RNA, 64 nt, Homo Sapiens
uugcagaucccucuuuuccaguucuccuuccucuaggagccauguuauccucugucccccauag

SEQ ID NO: 79252 - RNA, 64 nt, Homo Sapiens
gaguaaugggauugagcauuuauggcagcaacagaggagccacaaaauguucuuuguucuuugg

SEQ ID NO: 79253 - RNA, 64 nt, Homo Sapiens
uugcaccaaggacuugguagccuugcgcugguccaggagccauuacuuuuccucagaguuucug

SEQ ID NO: 79254 - RNA, 64 nt, Homo Sapiens
ugcucaggagaccccuuuccgcuccuguggaaacaggagccacccuagggcagguagcacugag

SEQ ID NO: 79255 - RNA, 64 nt, Homo Sapiens
cuagugaucacaccagggguacugccaagagcucaggagccaggauuauuguacuaucccugua

SEQ ID NO: 79256 - RNA, 64 nt, Homo Sapiens
cgaaauaaggccugucuuccccuuaggauguucaaggagccagauugugauaugucaccguaug

SEQ ID NO: 79257 - RNA, 64 nt, Homo Sapiens
gagggcucuggagcugugagcccaggacaagccaaggagccaacgcaugccugugggcuguccu

SEQ ID NO: 79258 - RNA, 64 nt, Homo Sapiens
acaggacccugcgugugagccccccugcugggucaggagccaacgguacauccgcccaccaugu

SEQ ID NO: 79259 - RNA, 64 nt, Homo Sapiens
cccucaccccacaaggggcacugugcccugggggaggagccaagucacccugcugaagaucacu

SEQ ID NO: 79260 - RNA, 64 nt, Homo Sapiens
cauggauuugaggcgugugauuacugcagcuugaaggagccaaccauucuuuaacaggacaaac

SEQ ID NO: 79261 - RNA, 64 nt, Homo Sapiens
gccucggcgcucaccuaagccgcagcagcuggggaggagccaaagcccggcgcagugggaagcu

SEQ ID NO: 79262 - RNA, 64 nt, Homo Sapiens
ugcggcgcagccaacccugacucacgggugcaccaggagccaggagcagacacacacagggaug

SEQ ID NO: 79263 - RNA, 64 nt, Homo Sapiens
ggcucuggccaagugcacgacccacccugcugguaggagccagcaugcccaggccugcccggug

SEQ ID NO: 79264 - RNA, 64 nt, Homo Sapiens
caagagcugcacucuugugcgacccuucccagggaggagccacccgucugcaagccacugcuga

SEQ ID NO: 79265 - RNA, 64 nt, Homo Sapiens
uaucccagccggauuuaaagcagucacuucagacaggagccacagggagccugugagggaguag

SEQ ID NO: 79266 - RNA, 64 nt, Homo Sapiens
ggugccgucauugcuggcuuaaagacaaggggccaggagccaacaccagaggccacuccacaac

SEQ ID NO: 79267 - RNA, 64 nt, Homo Sapiens
acuggguuucagggaaugggcaugccaggugccaaggagccaaacagauggcuuuccaggcagc

SEQ ID NO: 79268 - RNA, 64 nt, Homo Sapiens
uuggugcagcugcagccaggaggggagcgggcccaggagccaggcucagguccagcugguuccu

SEQ ID NO: 79269 - RNA, 64 nt, Homo Sapiens
ucgugccugcccugccucuccacgcacaguguuaaggagccaagaggagccacuucgcccagac

SEQ ID NO: 79270 - RNA, 64 nt, Homo Sapiens
ccugccucuccacgcacaguguuaaggagccaagaggagccacuucgcccagacuuuguuuccc

SEQ ID NO: 79271 - RNA, 64 nt, Homo Sapiens
cuggucuucccgagggucagaggaucccugugccaggagccaacacaggugcccaagaagaugg

SEQ ID NO: 79272 - RNA, 64 nt, Homo Sapiens
cuuuuggagagaaggcagcuggaggaggguguucaggagccagagcaaaaacccuccccaggaa

SEQ ID NO: 79273 - RNA, 64 nt, Homo Sapiens
cgcugugauuaccaucaguccauuuuaccgaggaaggagccaagguccaggcccacugaaggac

SEQ ID NO: 79274 - RNA, 64 nt, Homo Sapiens
uuuuaaagcuuuauaugccucaaauaucagggaaaggagccaaguccuugguauuuaguuuggu

SEQ ID NO: 79275 - RNA, 64 nt, Homo Sapiens
uguccugacuguccuacaaugcagcaacaggaccaggagccagggucacauaucaagucccgag

SEQ ID NO: 79276 - RNA, 64 nt, Homo Sapiens
agggcgggccaggagaaagauuaggcaggaagucaggagccagcuuuggacuccuuguuugccu

SEQ ID NO: 79277 - RNA, 64 nt, Homo Sapiens
gagaauucccugcccacuuucccacugccuucuaaggagccaaggccgaacgcuucccugggcu

SEQ ID NO: 79278 - RNA, 64 nt, Homo Sapiens
ggggcagccaccuugcaugagggaagagcucugaaggagccagauucucaguaggaacuuggaa

SEQ ID NO: 79279 - RNA, 64 nt, Homo Sapiens
ggaacgcacucggugguggaggccccauguucccaggagccaagauucguagcauccuugaggc

SEQ ID NO: 79280 - RNA, 64 nt, Homo Sapiens
aagccaggagugagaaggaauucagggagagcaaaggagccagugcugagaugcugcuguguug

SEQ ID NO: 79281 - RNA, 64 nt, Homo Sapiens
cuggcguggggccaggagcucugggccagugcccaggagccaucgggagccgccaggccugcag

SEQ ID NO: 79282 - RNA, 64 nt, Homo Sapiens
aacgcccggcaggcaggcgcguggugccugcagcaggagccaggacccggggccuggggucucu

SEQ ID NO: 79283 - RNA, 64 nt, Homo Sapiens
gaaaccuggagaagagaucaggugguuauucccgaggagccagaaaggauauauaaggcacugu

SEQ ID NO: 79284 - RNA, 64 nt, Homo Sapiens
uuuugugauagguauuggggucagaaugggcucaaggagccaucaguucgagauuccuucacug

SEQ ID NO: 79285 - RNA, 64 nt, Homo Sapiens
cccaccccuucuuuguguaggggaagaagaccccaggagccaagagccagccacuggcuggaca

SEQ ID NO: 79286 - RNA, 64 nt, Homo Sapiens
cacuggcuggacagggaagauggagaaggaggccaggagccagcacggagaugagccuggaccc

SEQ ID NO: 79287 - RNA, 64 nt, Homo Sapiens
uggauugauuguauccacucauuaauagcugagcaggagccacaagagauccucuaccacagac

SEQ ID NO: 79288 - RNA, 64 nt, Homo Sapiens
gagcuggugacacuugugugucaaauagggagccaggagccagguacauagaaccaaggagcac

SEQ ID NO: 79289 - RNA, 64 nt, Homo Sapiens
ggcucccaccccgagcauaucaggauaagcguccaggagccacguccugagggacucagcacaa

SEQ ID NO: 79290 - RNA, 64 nt, Homo Sapiens
ugggguacgacaggcuggggcacaggggguaccuaggagccaggggcccugugcccuccaaauu

SEQ ID NO: 79291 - RNA, 64 nt, Homo Sapiens
aaaaaaaaaaaaaaaaucucaauaaaaauagaaaauugcaaaaaauaguugaugagcuuaaaaa

SEQ ID NO: 79292 - RNA, 64 nt, Homo Sapiens
uuugacugucagcuacauguuauauuauaucuauauugcaaaauguaguucuuauauaucccua

SEQ ID NO: 79293 - RNA, 64 nt, Homo Sapiens
aauccaagugccuuucuguaugaguuuugccagcauugcaaaggaaugcugauuccaacaggac

SEQ ID NO: 79294 - RNA, 64 nt, Homo Sapiens
ucuuauuccaaacacaccugaaaauaucaagauuauugcaaaaaaauaaaaccauagaacuaug

SEQ ID NO: 79295 - RNA, 64 nt, Homo Sapiens
uucuuuuuuauuaccagguccauuuugccugacaauugcaaaucagagcauacaaaauaaaacu

SEQ ID NO: 79296 - RNA, 64 nt, Homo Sapiens
aacugaaauaaaaaauuauggauacguguuuugaauugcaaacuauuccucaggaauuccaauu

SEQ ID NO: 79297 - RNA, 64 nt, Homo Sapiens
uucccagugcccucuguccauaccuacuucuaggauugcaaaggagucuuccaacuagagaaaa

SEQ ID NO: 79298 - RNA, 64 nt, Homo Sapiens
uuuacuaagacaguaccuauuaggaaaaccaaauauugcaaauggucaauucgauuuuaauuuc

SEQ ID NO: 79299 - RNA, 64 nt, Homo Sapiens
uaacuuucaucucuagggauguuuaacauuuauaauugcaaaauaaaccaacuauaaaaaaaga

SEQ ID NO: 79300 - RNA, 64 nt, Homo Sapiens
gugcauuagcuauugacuuaggauuuuuaaauuaauugcaaaaucaugcauauguacuacagag

SEQ ID NO: 79301 - RNA, 64 nt, Homo Sapiens
uuuaaauauaaauuucagaggugaauuuugcuuuauugcaaagcuauaacuuaugaaaaguaca

SEQ ID NO: 79302 - RNA, 64 nt, Homo Sapiens
auagcauuuuagcaucaacuccuuaaaaccacagauugcaaagcauauugcaucucacucccac

SEQ ID NO: 79303 - RNA, 64 nt, Homo Sapiens
gugauguaguuuuaaccaguuauuuuuagacccgauugcaaauacacccauuccaaaugcaguu

SEQ ID NO: 79304 - RNA, 64 nt, Homo Sapiens
aaggaacuguguacgccauuuauggcaugauuagauugcaaagcaaugaacucaagaaggaauu

SEQ ID NO: 79305 - RNA, 64 nt, Homo Sapiens
ccguuuuuuuuuuuuuauuguuguuguuaauuuuauugcaaaguuguauucagcguacuugaau

SEQ ID NO: 79306 - RNA, 64 nt, Homo Sapiens
uugaagaaugccaucucugacuauauggccuuguauugcaaagcggaucaguggcuggggugcc

SEQ ID NO: 79307 - RNA, 64 nt, Homo Sapiens
cacuuugcacuucauagagaagguacauagagacauugcaaaaccugucuccauuugcuauccu

SEQ ID NO: 79308 - RNA, 64 nt, Homo Sapiens
aauuggugauacuucuaaacgugcuguacauuugauugcaaacauaaaacauuuuucauaauua

SEQ ID NO: 79309 - RNA, 64 nt, Homo Sapiens
aguacucugguuaauaaauguucacagauaaaaaauugcaaacauguaagagcuuuaaaauauu

SEQ ID NO: 79310 - RNA, 64 nt, Homo Sapiens
cuugaaagccacuugauccucaacauauacuauaauugcaaaggaaacaugaggccaucuuccc

SEQ ID NO: 79311 - RNA, 64 nt, Homo Sapiens
aucaguuacuuccuauuuuuauccuuaaaagaccauugcaaaucaguguaaggguuuuuccagu

SEQ ID NO: 79312 - RNA, 53 nt, Homo Sapiens
aagauauauuuuucauuugacauauugcaaaauuuucuuaggaaauuuguggg

SEQ ID NO: 79313 - RNA, 64 nt, Homo Sapiens
ccucacauacugaucuaggauuuuaaauuauuucauugcaaaguaauugugucucuccuuucac

SEQ ID NO: 79314 - RNA, 64 nt, Homo Sapiens
uaaaucaccuggaaggagagcauuacucaccaaaauugcaaaacaaggguaucaagaauuugug

SEQ ID NO: 79315 - RNA, 64 nt, Homo Sapiens
gauuuuuauauugcccuccaagugguagaagaagauugcaaaguccauguuaugcuaggugcac

SEQ ID NO: 79316 - RNA, 64 nt, Homo Sapiens
uugauuacuacuuuaagugauauucauuuaaaacauugcaaauuuauuuuauuuauuuaauuuu

SEQ ID NO: 79317 - RNA, 64 nt, Homo Sapiens
auuacaggcuugagccaccacgcccggcuaaaacauugcaaauuuaaaugagaguuuuaaaaau

SEQ ID NO: 79318 - RNA, 64 nt, Homo Sapiens
gaguacugcuguaaauacuaugucaguguguugaauugcaaaccguuggucccuuugcuucugu

SEQ ID NO: 79319 - RNA, 64 nt, Homo Sapiens
uccugaugcuaaacaguauugguugucuuuaaauauugcaaaaguccuccccuuucugucaauu

SEQ ID NO: 79320 - RNA, 64 nt, Homo Sapiens
gagcuggaugccggguuccagaaucgcugcacaguuccaacaggacagcgccuucccccaugcg

SEQ ID NO: 79321 - RNA, 64 nt, Homo Sapiens
gcuuucuuuggccucugacccugcugcccauucuuuccaacaucacagaugaacugccucuccu

SEQ ID NO: 79322 - RNA, 64 nt, Homo Sapiens
acucaagggugguuuccuggcugcacggcaccuguuccaacaccuacugugccucucaucaggu

SEQ ID NO: 79323 - RNA, 64 nt, Homo Sapiens
aggaaaugacugccuuccuugggaccaaggaccguuccaacagcauucacugccaguucuaaua

SEQ ID NO: 79324 - RNA, 64 nt, Homo Sapiens
ccagggcucucugcuguagauuggcugugccagcuuccaacagguuacuggcaaugccagugag

SEQ ID NO: 79325 - RNA, 64 nt, Homo Sapiens
gaauugguucauuuugcuuuacacaguagaucuguuccaacaguucuguguaaaccaaaugcua

SEQ ID NO: 79326 - RNA, 64 nt, Homo Sapiens
uaauccucuccaacuggauuucuuucuuaacuuuuuccaacacaaaagaugcacugccauauua

SEQ ID NO: 79327 - RNA, 64 nt, Homo Sapiens
gucuuuaggagugauuugcauacacaaguaaacauuccaacauugggcguuucccccaaugaaa

SEQ ID NO: 79328 - RNA, 64 nt, Homo Sapiens
gcaacaaaucaaauaacuuaaacaaaguaauaaauuccaacaaaucccacaaggaauaaguucc

SEQ ID NO: 79329 - RNA, 51 nt, Homo Sapiens
guaauaaauuccaacaaagcguuccaacaaaagaaaucccacaaggaauaa

SEQ ID NO: 79330 - RNA, 64 nt, Homo Sapiens
ucuuguugauagugauguauauuucucuuuagccuuccaacauucaguacuaaaauuaaugcag

SEQ ID NO: 79331 - RNA, 64 nt, Homo Sapiens
caauacuggucaacuuaaggaaagcaaguacaaguuccaacauggaucucuguuacaaaagaaa

SEQ ID NO: 79332 - RNA, 64 nt, Homo Sapiens
uuuagaacauagaguggcauggccgugcuggaaugacaaauaacuggcgugcuuuuuuuuugug

SEQ ID NO: 79333 - RNA, 64 nt, Homo Sapiens
uaaggcuaacuccugaucguuucuguagaaagaugacaaauaaagaaaaaguuauaauuauuaa

SEQ ID NO: 79334 - RNA, 64 nt, Homo Sapiens
gaguuggggagggagggaaugugggaggaauuaagacaaauauuucagacugguguaaaggaca

SEQ ID NO: 79335 - RNA, 64 nt, Homo Sapiens
ggaauuaagacaaauauuucagacugguguaaaggacaaauaugacaacgacgucaaggacucg

SEQ ID NO: 79336 - RNA, 64 nt, Homo Sapiens
aacauguaugcacacaaaacucaauaccuuuauagacaaauacgaggauuauuugggaagcgua

SEQ ID NO: 79337 - RNA, 64 nt, Homo Sapiens
cauuuucaucuuggcagcaauauuaaauucgugugacaaauaauauauauuuucuucuaaaacu

SEQ ID NO: 79338 - RNA, 64 nt, Homo Sapiens
aguucuuaaauacuaccaacccugaacgucucaggacaaauaauucaaaaaagagaucuacauu

SEQ ID NO: 79339 - RNA, 64 nt, Homo Sapiens
cauguaauauauagaauucuuugucuccauuugugacaaauauugugaauauuuucauguuugg

SEQ ID NO: 79340 - RNA, 64 nt, Homo Sapiens
ccagggucauacgacgccauugccagaaugaagugacaaauaugaacagaagaaaaugguugcu

SEQ ID NO: 79341 - RNA, 64 nt, Homo Sapiens
cccguuuccuuguccccuaauuauucaaggaagugacaaauauuguccagacaacuuacauaca

SEQ ID NO: 79342 - RNA, 64 nt, Homo Sapiens
aaauggacuaaauaauuuuauuuuuccaucauuagacaaauacaaguugaauaaguacuucaua

SEQ ID NO: 79343 - RNA, 64 nt, Homo Sapiens
guuuccuauauauauguauacaauucuuuaaugggacaaauauuguaccaagugacugguggcc

SEQ ID NO: 79344 - RNA, 64 nt, Homo Sapiens
gcuuuuccaguucuuagaaaauucuuuuuuuguagacaaauauucuauaaacuagaaucucuau

SEQ ID NO: 79345 - RNA, 64 nt, Homo Sapiens
uaaauugauaaagacauuugugcauagcucaugagacaaauacugauuuaauauuuuauucuuu

SEQ ID NO: 79346 - RNA, 64 nt, Homo Sapiens
gcuagcccuuaugaauauugaacuuaggaauugugacaaauauguaucugauauggucauuugu

SEQ ID NO: 79347 - RNA, 64 nt, Homo Sapiens
cucccagaauccucagggcacugaggguaggucugacaaauaaggccugcugugcgaauauagc

SEQ ID NO: 79348 - RNA, 64 nt, Homo Sapiens
gaauuaagccaucagggaaaugggaucaugguacauuuaucacuuaagaaccugguguguuucu

SEQ ID NO: 79349 - RNA, 64 nt, Homo Sapiens
ucugauggcugaagaauguauuuuccuucuugacauuuaucaccccccugugcuuggaaaccuu

SEQ ID NO: 79350 - RNA, 64 nt, Homo Sapiens
uuguauauuaaugaauuauccaagauucgaugggauuuaucaguguguagauagcucuauaaug

SEQ ID NO: 79351 - RNA, 64 nt, Homo Sapiens
gucauuucuuauaaaaaacaaaacaacaacaauaauuuaucaaaauuggcauauuuaaagccua

SEQ ID NO: 79352 - RNA, 64 nt, Homo Sapiens
cuguuguaaugauguuuugaaucauuuguauauuauuuaucacauauucaugguauuuuaagag

SEQ ID NO: 79353 - RNA, 64 nt, Homo Sapiens
uuuuacaaagucauuuuaagagauugcugagaguauuuaucagguagauguuuauuauuagaaa

SEQ ID NO: 79354 - RNA, 64 nt, Homo Sapiens
guuuaaagcuuugaauaucuuauguauuaaaucaauuuaucacuguuaaagguuuuuuuuuuua

SEQ ID NO: 79355 - RNA, 64 nt, Homo Sapiens
uuuuaauagggugagcuugauuggcuguauuuagauuuaucacuauaaguuaaaugauugagag

SEQ ID NO: 79356 - RNA, 64 nt, Homo Sapiens
gcccugcuaaauaaugaaaaaacacuuuacuaaaauuuaucaaauuauacuggguucggauugu

SEQ ID NO: 79357 - RNA, 64 nt, Homo Sapiens
uagcaguggugaggagugggagggcccagcaagcauuuaucagaaauagaaucacaauaggagg

SEQ ID NO: 79358 - RNA, 64 nt, Homo Sapiens
agcauauuguguucugagugugauagcugcauucauuuaucacccaggccaaugcagcuaauuu

SEQ ID NO: 79359 - RNA, 64 nt, Homo Sapiens
ugcagauagccuauuuauuauacuaaagagacauauuuaucaguugauauuucauuccuuuguu

SEQ ID NO: 79360 - RNA, 64 nt, Homo Sapiens
aacaugaaaauauuuuauuuauuuuuuuauaaauauuuaucaagggccuauucauuauauguau

SEQ ID NO: 79361 - RNA, 64 nt, Homo Sapiens
ucucuauuuugcuauuugccauuuuggauccaagauuuaucauccugucuucuuugaucauuug

SEQ ID NO: 79362 - RNA, 64 nt, Homo Sapiens
uuggguuuuuguacugaaguuuaagauuuugcagauuuaucaauuuaucaauggauuaagaagu

SEQ ID NO: 79363 - RNA, 64 nt, Homo Sapiens
ggauuaagaaguuuaagauuagcuacuccuuaauauuuaucaauuuuuacgguguuugaagacc

SEQ ID NO: 79364 - RNA, 64 nt, Homo Sapiens
auaaaaguugucauucuuaggaauuugguuugaaauuuaucaguuauacagaauugucauacug

SEQ ID NO: 79365 - RNA, 64 nt, Homo Sapiens
uacuuuugaggcagccauuagguugaaaguauauauuuaucauauaaaacuugaugcguuuugc

SEQ ID NO: 79366 - RNA, 64 nt, Homo Sapiens
uuuguuaucuguuguuaaguugaaauguauaaucauuuaucacuaaauugcacauugccuuuau

SEQ ID NO: 79367 - RNA, 64 nt, Homo Sapiens
guaucugccacaguaaauuaaagcauuacacaguauuuaucaguauuuuuuaaacauccugucc

SEQ ID NO: 79368 - RNA, 64 nt, Homo Sapiens
cuugaccugguguucuucaucauucuugcuauggauuuaucaauuuuguuccucuuuuccaaaa

SEQ ID NO: 79369 - RNA, 64 nt, Homo Sapiens
uccaaacccauguauuagagaagaagggcgugaaauuuaucaccuaagcuuuccauucaggaag

SEQ ID NO: 79370 - RNA, 64 nt, Homo Sapiens
aagguauugaacacuggauucaaucagcauuguuauuuaucauuugauuuuucaaaauaaaagu

SEQ ID NO: 79371 - RNA, 64 nt, Homo Sapiens
aaauucuccuugucauuuuaaagaaaacaaacaaauuuaucauggcugcaaugccaaugauugu

SEQ ID NO: 79372 - RNA, 64 nt, Homo Sapiens
uaaaaagaaauucacugguucuuuacaaaauagaauuuaucaucaaguuauuacacaaacuuca

SEQ ID NO: 79373 - RNA, 64 nt, Homo Sapiens
uuuucuaaguauauagaaagcuuguauaauucagauuuaucaauuuccugauuuaauguagacu

SEQ ID NO: 79374 - RNA, 64 nt, Homo Sapiens
aaugaccuauguuuagucacaauuguuaguauucauuuaucaaagcuugucaauuauguuguga

SEQ ID NO: 79375 - RNA, 64 nt, Homo Sapiens
gauuauugacugcugagaaaaaguguuguacagaauuuaucaugaaggcacaaaacaugagaga

SEQ ID NO: 79376 - RNA, 64 nt, Homo Sapiens
ucuaaugcaugugauuuaauccuauaugaacucuauuuaucauguaaagcuauccagggcuuaa

SEQ ID NO: 79377 - RNA, 64 nt, Homo Sapiens
uuaucaugaaaacuucuuugaaaguaagcuugaaauuuaucauuuuuguuauaugcugcuuaau

SEQ ID NO: 79378 - RNA, 64 nt, Homo Sapiens
ucauacggaaaguguuugagagcaaguaguugacauuuaucagcaaaucucuugcaagaacagc

SEQ ID NO: 79379 - RNA, 64 nt, Homo Sapiens
auaucucagauuguguagauaugcuauuuaaauaauuuaucaggaaauacugccuguagaguua

SEQ ID NO: 79380 - RNA, 64 nt, Homo Sapiens
uuuaugacccaaaucacaauacauauaaacaauuauuuaucacuuaaacaugcaauuuaugaaa

SEQ ID NO: 79381 - RNA, 64 nt, Homo Sapiens
gaucugauuccaaagagcacaauugagcuauaugauuuaucagauuggaaaacauaugugauga

SEQ ID NO: 79382 - RNA, 64 nt, Homo Sapiens
acugacuacuggaccggagcguaaugccuaaucuauuuaucaaaaccaugaaaguguaaauacu

SEQ ID NO: 79383 - RNA, 64 nt, Homo Sapiens
guuggccggugugaugaguaacacccucucuggcauuuaucacuucauuucacuaguggccgag

SEQ ID NO: 79384 - RNA, 64 nt, Homo Sapiens
cugagcgagucucuagagggaaacuugucagugaauuuaucacuauuagugaaauuugaauugu

SEQ ID NO: 79385 - RNA, 64 nt, Homo Sapiens
gguuaugaaacucagaaaauuuuaaggugccuccauuuaucaaguaaaagaguuuaaacugaac

SEQ ID NO: 79386 - RNA, 64 nt, Homo Sapiens
ucaauuuugguuuuucucauuugaaauguuuuugauuuaucaauauuugugguuuaacuuugug

SEQ ID NO: 79387 - RNA, 64 nt, Homo Sapiens
ugaaucugagaaaguacuuucugguggcaaaugaauuuaucauuuuaguauaguuuucgauaaa

SEQ ID NO: 79388 - RNA, 64 nt, Homo Sapiens
ucauauacacagucuauacaaugaaauaaugaauauuuaucauauugauacaaacugugaccuc

SEQ ID NO: 79389 - RNA, 64 nt, Homo Sapiens
cuaaauucagauccuuucuccacacagcaaugacauuuaucaaucugacucagguguggcuguu

SEQ ID NO: 79390 - RNA, 64 nt, Homo Sapiens
uugaguuaugaaauuaccugacaagcugggauggauuuaucacagguucacugcagcuccuguc

SEQ ID NO: 79391 - RNA, 64 nt, Homo Sapiens
auuaaacacuguaaaagaaacugagaaaagagcaauuuaucaaauuuccccaucaaugcugauu

SEQ ID NO: 79392 - RNA, 64 nt, Homo Sapiens
auguggcuagguguagaaugauguugaaaccacaggcuaaaauguagaucuggaaguaucugug

SEQ ID NO: 79393 - RNA, 64 nt, Homo Sapiens
cuagcugggauuacaggcacaagccaccaugccuggcuaaaauucuuuuguauuuuuacuacag

SEQ ID NO: 79394 - RNA, 64 nt, Homo Sapiens
uuaacguagauauuuuuauaagcuauagcuuuuaggcuaaaauuuugccuuuuuauaaaauuga

SEQ ID NO: 79395 - RNA, 64 nt, Homo Sapiens
uccagcuuugggggaccuggaagccuucagaagaggcuaaaauaaagguacccagaauuuuuag

SEQ ID NO: 79396 - RNA, 64 nt, Homo Sapiens
acuuggucaaauuuuaacauauggggaaagggaaggcuaaaaauggaauauugaagggccugac

SEQ ID NO: 79397 - RNA, 64 nt, Homo Sapiens
ggucuuaugugguucaacucucaacaguaaccugggcuaaaauauuaugguauaacuggguccc

SEQ ID NO: 79398 - RNA, 64 nt, Homo Sapiens
guccuguaagaagcggcauagaaggucuuuugagggcuaaaaaggccuccagggccucuccuug

SEQ ID NO: 79399 - RNA, 64 nt, Homo Sapiens
cuuccaggcugagagccggcagguggauccuguaggcuaaaagggcaccucugagggagcagag

SEQ ID NO: 79400 - RNA, 64 nt, Homo Sapiens
agugcugggauuacaggcuugagccaccacgcccggcuaaaacauugcaaauuuaaaugagagu

SEQ ID NO: 79401 - RNA, 64 nt, Homo Sapiens
ccucucuguggguuugucuugaccuggaaauuugggcuaaaacuuagaaaaaauucuuacauga

SEQ ID NO: 79402 - RNA, 64 nt, Homo Sapiens
accugcacuucugccaaggcaggaggcugggcagaaccagaacaaggccuggaaaagaaccaga

SEQ ID NO: 79403 - RNA, 64 nt, Homo Sapiens
aggcugggcagaaccagaaccaggccuggaaaagaaccagaaggaagagagccuggaaaagaac

SEQ ID NO: 79404 - RNA, 64 nt, Homo Sapiens
aaauuuuuuucuuuugaagguaaauuguaauuucaaccagaagugcauauaguguuguauauug

SEQ ID NO: 79405 - RNA, 64 nt, Homo Sapiens
guucuaguguagagucugagcaaauccaaccagcaaccagaaauugaccucacuggcccacugg

SEQ ID NO: 79406 - RNA, 64 nt, Homo Sapiens
cuguauuuaggauaauuucaucacuuuuaauucaaaccagaauaugugaauaagcagacagaaa

SEQ ID NO: 79407 - RNA, 64 nt, Homo Sapiens
ggggguggggguuacccaaauagguucacagaagaaccagaaauaaaaccugccuuucuagacu

SEQ ID NO: 79408 - RNA, 64 nt, Homo Sapiens
gaauguguguguuugagcaguuuacaaucuguccaaccagaaaacccccagguggugggaauaa

SEQ ID NO: 79409 - RNA, 64 nt, Homo Sapiens
ccuaaagaagaggaauuauaccguccguguuccuaaccagaaauaaagcagggcacugagacac

SEQ ID NO: 79410 - RNA, 64 nt, Homo Sapiens
gccaccucaaugcauugucaguuucccagggcuuaaccagaaccauaggucagcagagauuuca

SEQ ID NO: 79411 - RNA, 64 nt, Homo Sapiens
gccaccucaaugcauugucaguuucccagggcuuaaccagaaccauagguuggcagagauuuca

SEQ ID NO: 79412 - RNA, 64 nt, Homo Sapiens
cuuaaacauuauuauuaaaauugaagaacacauuaaccagaaagaaggauucuuaauuguuaau

SEQ ID NO: 79413 - RNA, 64 nt, Homo Sapiens
guuuauuagaugucauaugcguggcacuacccuuaaccagaauucugccacccuaaauuuccca

SEQ ID NO: 79414 - RNA, 64 nt, Homo Sapiens
caguuuuccuugagauaccuacaauccaagagugaaccagaaugcauacaguucuugacuuugg

SEQ ID NO: 79415 - RNA, 64 nt, Homo Sapiens
ggcuaaggcauacaguucuugcuggacugguuggaaccagaacaaaacaauuccccuguggccu

SEQ ID NO: 79416 - RNA, 64 nt, Homo Sapiens
ggaauaauguuacuuuggauaagccacagagacaaaccagaaacuuaucauuaguagauuuuau

SEQ ID NO: 79417 - RNA, 64 nt, Homo Sapiens
ccaaguggaucugcuggcaaaagagaguugaggaaaccagaagggcgcacacauacuagguuga

SEQ ID NO: 79418 - RNA, 64 nt, Homo Sapiens
cucccuggcugcuucacucaggaaagggaacuaaaaccagaauacacuaagaaguuucuaguuu

SEQ ID NO: 79419 - RNA, 64 nt, Homo Sapiens
uugcuaaaguucucuuucuuugagaaaacugaggaaccagaaugcuuagaguucauaaaauaau

SEQ ID NO: 79420 - RNA, 64 nt, Homo Sapiens
guuguauggauaugcgaaguguacugaaggugaaaaccagaaugcauguaauuuauugaauacu

SEQ ID NO: 79421 - RNA, 64 nt, Homo Sapiens
agacaaggcagcaggcauacauagaaauucugugaaccagaauggguuucaucugaaagcugcc

SEQ ID NO: 79422 - RNA, 64 nt, Homo Sapiens
gacuuuaaaauaagagaaaguuuuuaaaaaacuaaaccagaagagaugacagccaugaugaaac

SEQ ID NO: 79423 - RNA, 64 nt, Homo Sapiens
gagaauauguaugcgugaagcuaggugaagaugcaaccagaaagacucugaauacuuggagaaa

SEQ ID NO: 79424 - RNA, 64 nt, Homo Sapiens
ccauguuuguuacuaggauuaguuuaaucaaaguaaccagaaucccggccggccgagcauaaga

SEQ ID NO: 79425 - RNA, 64 nt, Homo Sapiens
uugcaaugugcugauuuuauuauuuauaacuuccaaccagaacuagauuuauugaaaaggcuac

SEQ ID NO: 79426 - RNA, 64 nt, Homo Sapiens
cugaaggcaaaucuccuuuguccauuuaccuggaaaccagaaugauuuugacauacaggagagc

SEQ ID NO: 79427 - RNA, 64 nt, Homo Sapiens
ugcauuucuuuauuucugucucauaauugucaaaaaccagaauuaggucaaguucauaguuucu

SEQ ID NO: 79428 - RNA, 64 nt, Homo Sapiens
gcguuccguagcucgcucuaugaaggccuggagaaaccagaauccaagaccuccauucacaacu

SEQ ID NO: 79429 - RNA, 64 nt, Homo Sapiens
ggagcgccuccgggcccccccgcccccgucccccaaccagaacaacaacgccauagacagcggc

SEQ ID NO: 79430 - RNA, 64 nt, Homo Sapiens
caguuaccuuacauagcacuugauacguguuaaaugaacauaugaauguaauuuauauauuccu

SEQ ID NO: 79431 - RNA, 64 nt, Homo Sapiens
aauuaccacucugaagucugcugacugugucucuugaacauacuuaggauauucugcacauuau

SEQ ID NO: 79432 - RNA, 64 nt, Homo Sapiens
aguugaaacuugaacaaauagauggucacauugcugaacauaauucuaaaauaaaauauuggca

SEQ ID NO: 79433 - RNA, 64 nt, Homo Sapiens
ugagacaaucaccacaguuauuacccaaauacuaugaacauauuuuuguaaaccagucauucug

SEQ ID NO: 79434 - RNA, 64 nt, Homo Sapiens
uaagacacaagguacugucuuuucugggucuguaugaacauaagagaucuuuucauucacgugc

SEQ ID NO: 79435 - RNA, 64 nt, Homo Sapiens
uugggccauuggugcaugcauucuuuugcaagacugaacauagucugacuguuucugaacuguc

SEQ ID NO: 79436 - RNA, 64 nt, Homo Sapiens
uuuaaaaacacuaugguagauguuaacagcccauugaacauacuuuuuuuuaaagugaaauauu

SEQ ID NO: 79437 - RNA, 64 nt, Homo Sapiens
uuugccaggaagaugaaaauaacauggguauuuuugaacauauuagacaucaucaaaauuagcu

SEQ ID NO: 79438 - RNA, 58 nt, Homo Sapiens
aagcuuuuaaccuaucuuaacaacuuacugaacauaagaaaauuuacacuagagagaa

SEQ ID NO: 79439 - RNA, 64 nt, Homo Sapiens
guggcagagcuuuuaaccaguccgcaaagcucacugaacauaaguuaauucauacuggagaaaa

SEQ ID NO: 79440 - RNA, 64 nt, Homo Sapiens
caucaucccucaaagugucauacaauuaagagagugaacauauccuuguggagaacaugcauac

SEQ ID NO: 79441 - RNA, 64 nt, Homo Sapiens
uaaaguguacuauuugauaaaacauaaaauaaacugaacauauuagcuuuauugagauauaauu

SEQ ID NO: 79442 - RNA, 64 nt, Homo Sapiens
gguguuagauguuagcacauuaacuucaaguuguugaacauaaagaaaauaauuucuucagaga

SEQ ID NO: 79443 - RNA, 64 nt, Homo Sapiens
cguuuccaacaaaguuuuacguuugaacaggaagugaacauagucuguuuaauuuauuuuuauu

SEQ ID NO: 79444 - RNA, 64 nt, Homo Sapiens
auacaaagacgauuuuuucaggcugugauuauggugaacauaacaaaacccaguagucaccaag

SEQ ID NO: 79445 - RNA, 64 nt, Homo Sapiens
agcuaaacagaaguuguugcuuaugaugugugagugaacauaugccacugccuggccuuuuuuu

SEQ ID NO: 79446 - RNA, 64 nt, Homo Sapiens
cuggucagagagaccucauccugcucuuuugugaugaacauauucaugaaauguggaagucagu

SEQ ID NO: 79447 - RNA, 64 nt, Homo Sapiens
uccuggaaggacacagugaugaauguacuaugucugaacauagaaacucgggcuugagugagaa

SEQ ID NO: 79448 - RNA, 64 nt, Homo Sapiens
auagaugaaauacgaaaaauuacaguuuacuuaaugaacauaaggauaaauagaaaaacugaau

SEQ ID NO: 79449 - RNA, 64 nt, Homo Sapiens
cgaacauuuuaacaauguuaauucuugcagaccaugaacauaagcuaccuucccauuuauaugc

SEQ ID NO: 79450 - RNA, 64 nt, Homo Sapiens
auuguuuucaguguuucuaauugugugcauccugcuuauguacaccgcaccuggaggcauggag

SEQ ID NO: 79451 - RNA, 64 nt, Homo Sapiens
uguaaggcugggcuucaaaauugguucucugacucuuauguauucggagaaguguugcccaaac

SEQ ID NO: 79452 - RNA, 64 nt, Homo Sapiens
uuauugacaaacucucccuucacuccgaaaguuccuuauguauauuuaaaagaaagccucagag

SEQ ID NO: 79453 - RNA, 64 nt, Homo Sapiens
caaagacauucugacaucuuaguauuugcauauucuuauguaugugaaaguuacaaauugcuug

SEQ ID NO: 79454 - RNA, 64 nt, Homo Sapiens
gcauaaaguuaccuacaucaauuaauuaaaugaacuuauguacagaaaacauguauaaauauaa

SEQ ID NO: 79455 - RNA, 64 nt, Homo Sapiens
uacuaaugcuuacaacuuucuaagaggguucuugcuuauguagcuuuuuauuauuuuaaguaac

SEQ ID NO: 79456 - RNA, 64 nt, Homo Sapiens
uuaaaaauuaggaaaucaaaucagugaauauuaccuuauguaaacauacaacuauacacuaaaa

SEQ ID NO: 79457 - RNA, 64 nt, Homo Sapiens
guccuccuugagccgagauugcagcuaacccucccuuauguagcauguggaagacccuuccaau

SEQ ID NO: 79458 - RNA, 64 nt, Homo Sapiens
gauauaaugcaaaaaaaaaaagagaaauguuugccuuauguauauucccuuuauuuccuuuacc

SEQ ID NO: 79459 - RNA, 64 nt, Homo Sapiens
uguuuuuccuuggaccuaaacagagaaaauaaugcuuauguaucugaagaaaaggucagaucua

SEQ ID NO: 79460 - RNA, 64 nt, Homo Sapiens
accauuuuaguaaaacaguccuguucaaguuguauucuuuuaaguucuuuuauucuccuuuccc

SEQ ID NO: 79461 - RNA, 64 nt, Homo Sapiens
uaaaacaguccuguucaaguuguauucuuuuaaguucuuuuauucuccuuucccugagauuuuu

SEQ ID NO: 79462 - RNA, 64 nt, Homo Sapiens
ugcacugugugaagggacucccuaugcucuugccuucuuuuaucuacccagcacaugccacaau

SEQ ID NO: 79463 - RNA, 64 nt, Homo Sapiens
cauaggugagaguuuuuaaauguaguguggcaguuucuuuuauauggaacaacagcaguguuau

SEQ ID NO: 79464 - RNA, 64 nt, Homo Sapiens
cugcuggauuuuguugugcaaggguucacaugcauucuuuuauauuuagucugcacagugagca

SEQ ID NO: 79465 - RNA, 64 nt, Homo Sapiens
cacaaugaauuguccuuaauuauugauaucuaauuucuuuuaacaaauuggagcugcuuaauca

SEQ ID NO: 79466 - RNA, 64 nt, Homo Sapiens
acuaguccuuuacuaauccacucaaccccaccacuucuuuuauaaaauuucaucucaggccucc

SEQ ID NO: 79467 - RNA, 64 nt, Homo Sapiens
acgauauuauuaguaagaaacuuauagucaauguuucuuuuaucuaugagacccauuccuauuu

SEQ ID NO: 79468 - RNA, 64 nt, Homo Sapiens
aauauaugggggaaaauuaucuuuuauuaauacuuucuuuuauuugagauauuauuuuaaauuu

SEQ ID NO: 79469 - RNA, 64 nt, Homo Sapiens
aauacuuucuuuuauuaauaauauuauuuuaaauuucuuuuauuacuuuuuaaaaauaacugag

SEQ ID NO: 79470 - RNA, 64 nt, Homo Sapiens
gaaauugucauuguuuuaucguagucuuuaaacauucuuuuaguuugguuugcuccagcauccg

SEQ ID NO: 79471 - RNA, 64 nt, Homo Sapiens
uuaauagaugugcauaaggugggguuaaagucguuucuuuuagucugucuuaaaaacaacugaa

SEQ ID NO: 79472 - RNA, 64 nt, Homo Sapiens
ccgauguuuauaaacugguaaucaaaaagguuuuuucuuuuaggugagugggaaaguauuaccc

SEQ ID NO: 79473 - RNA, 64 nt, Homo Sapiens
ugaaauaaaaugcuauauggcaccuaauuauuuuuucuuuuaaaaugccuuaaguugcagucuc

SEQ ID NO: 79474 - RNA, 64 nt, Homo Sapiens
acuguuccugcaguauuggauagcuaucucauacuucuuuuagaaagaagccuuuuucauuaag

SEQ ID NO: 79475 - RNA, 64 nt, Homo Sapiens
cagaguguccucuugguguauucuaaaacgagcauucuuuuaaaaaaccuaaaguuucuugaua

SEQ ID NO: 79476 - RNA, 64 nt, Homo Sapiens
uucuaaagagcucuucuauuuauacaugccuaaauucuuuuaaaauguagagggauaccugucu

SEQ ID NO: 79477 - RNA, 64 nt, Homo Sapiens
gaaaucucugccccuuuucugagcaguaugccucuucuuuuagaauuaaaugaaugcugcacag

SEQ ID NO: 79478 - RNA, 64 nt, Homo Sapiens
uuacgaauaaaaaauguauuucagauugguuuuauucuuuuauucaaauuuccuaauaacacaa

SEQ ID NO: 79479 - RNA, 64 nt, Homo Sapiens
cauuuacucagucauuucuuaaauuuacuuauuauucuuuuacuaugguuaaccuguagcuuau

SEQ ID NO: 79480 - RNA, 64 nt, Homo Sapiens
uuuguugauguuuuuugaagaccauguuuggccuuucuuuuaaaugggauuacaggcuugagca

SEQ ID NO: 79481 - RNA, 64 nt, Homo Sapiens
uuuuuuuuaauuguauuuuucuuauuugccauuuuucuuuuauuugcuuguggcagaaguuuuc

SEQ ID NO: 79482 - RNA, 64 nt, Homo Sapiens
ugucuuugcauuugagaggcuggcuaguuauuaauucuuuuacggaagcggugauaaaauucuu

SEQ ID NO: 79483 - RNA, 64 nt, Homo Sapiens
auaaacaaggggauuauucuuucuuucguguuuuuucuuuuauuaaaaugaaaccaucauuaua

SEQ ID NO: 79484 - RNA, 64 nt, Homo Sapiens
auacauguaauucuaccaaggucuucuuaauauguucuuuuaaaugauugaauuauauguucag

SEQ ID NO: 79485 - RNA, 64 nt, Homo Sapiens
gcuuaauaaauuguguuuccuccaagcuauucaauucuuuuaacuguuguagaagacaaaaugu

SEQ ID NO: 79486 - RNA, 64 nt, Homo Sapiens
aaaugaaaugugcguguugauagcaauaauuuguuucuuuuaaagauucuaaaaggucugagac

SEQ ID NO: 79487 - RNA, 64 nt, Homo Sapiens
cucuaacaagcgauucuaaaccaccuaugaguauuucuuuuagggcucacuuaaauacauguuu

SEQ ID NO: 79488 - RNA, 64 nt, Homo Sapiens
uucuaaauacaaucauauuaugcacccagccauguucuuuuacuggauuacaggcaugagccau

SEQ ID NO: 79489 - RNA, 64 nt, Homo Sapiens
auuuuuuuuuuuuuaagaguguauuuugauuguguucuuuuacuugcuuuuauauagugugcuu

SEQ ID NO: 79490 - RNA, 64 nt, Homo Sapiens
uuuuguuugugguauaaacauaaguuuuguuuauuucuuuuaaggauggauauuuagauucuuu

SEQ ID NO: 79491 - RNA, 64 nt, Homo Sapiens
uuuuguuuauuucuuuuaaggauggauauuuagauucuuuuaaguaauuaaaaacaacccuaau

SEQ ID NO: 79492 - RNA, 64 nt, Homo Sapiens
aauuauauguaaaugauauuaauuaagucuauucuucuuuuagauccuucccauuguugucaac

SEQ ID NO: 79493 - RNA, 64 nt, Homo Sapiens
uuauaucguguauauagcuuguacacaguguacauucuuuuaaauacaucuauuuuguguacuu

SEQ ID NO: 79494 - RNA, 64 nt, Homo Sapiens
augaagaaugucaucaauuauguacauauguauuuucuuuuaauacaaaguguaauuuugugcc

SEQ ID NO: 79495 - RNA, 64 nt, Homo Sapiens
gugccagugaaauggagucugaauaguuauguguuucuuuuaucccuggaaauauuuauuaaac

SEQ ID NO: 79496 - RNA, 64 nt, Homo Sapiens
acucuggcauaguucaugagcuuaauacauagcuuucuuuuaagaaaggagccuuuuuuuucaa

SEQ ID NO: 79497 - RNA, 64 nt, Homo Sapiens
uuggaaggagcccuaaguugucacucaguuuaauuucuuuuaaugguuaguuuagccuaaagau

SEQ ID NO: 79498 - RNA, 64 nt, Homo Sapiens
auggggagaaaucuauuucucaaaaaaaaaaaucuucuuuuacagaaauguugaguaaggugac

SEQ ID NO: 79499 - RNA, 64 nt, Homo Sapiens
aauucaguuuaguacaggagguuaaaaauggaauuucuuuuagcuuacuuagccuauaaaacua

SEQ ID NO: 79500 - RNA, 64 nt, Homo Sapiens
aacucagucuucagagccuccacuuaaguuaucauucuuuuagauacaaacaaaguaggauuua

SEQ ID NO: 79501 - RNA, 64 nt, Homo Sapiens
ugggcaaaaauuaaaacacagugcaaagcuuauuuucuuuuaucaaguaaagaauugagagugu

SEQ ID NO: 79502 - RNA, 64 nt, Homo Sapiens
acugacagcuagacaccuagauucugcuagccuguucuuuuaccaugcugaaacaucauuacag

SEQ ID NO: 79503 - RNA, 64 nt, Homo Sapiens
uaauggaaucacagaaaugauauucugcaagaauuucuuuuaaauaaaaaguuugggggugcaa

SEQ ID NO: 79504 - RNA, 64 nt, Homo Sapiens
gaucuuauugacaucagguauacuuggaagacauuucuuuuauucuucagcguaugaauuuaaa

SEQ ID NO: 79505 - RNA, 64 nt, Homo Sapiens
uaagcuuuauugugauuacguguauguuucuucuuucuuuuaagcagacccauaccuuuccagg

SEQ ID NO: 79506 - RNA, 64 nt, Homo Sapiens
caaaguacagaaaaauacuuugauuuuuauccauuucuuuuacucuguguaaagacuugagaag

SEQ ID NO: 79507 - RNA, 64 nt, Homo Sapiens
cugccuuuucacugaauguuugaaguauagcugcuucuuuuaacagaccucugugugaagcaag

SEQ ID NO: 79508 - RNA, 64 nt, Homo Sapiens
aaguauauuuguuauuuaaguuauugaauauacauucuuuuaaaagauugaauuaaauagaaac

SEQ ID NO: 79509 - RNA, 64 nt, Homo Sapiens
aagaaaaacugaugauuagaacuaagcgcuugccuucuuuuaaaaaaauucaucauggauaaaa

SEQ ID NO: 79510 - RNA, 64 nt, Homo Sapiens
ucucgugauugguuaguccaaucuuaaauguucauucuuuuaaaaacaaagaacuagagaagaa

SEQ ID NO: 79511 - RNA, 64 nt, Homo Sapiens
aauaaaauccuuccuucccaugcuuuuuuaguuuuucuuuuaaauuuguuuauugaguuggcuu

SEQ ID NO: 79512 - RNA, 64 nt, Homo Sapiens
aacuguucucugucccccaagguaauauagcucuuucuuuuauuaguuauauuaucuaccaaca

SEQ ID NO: 79513 - RNA, 64 nt, Homo Sapiens
uuaaagaacuauaagucagucuuucuguaccaauuucuuuuaauuauuuuugggauuauacuuc

SEQ ID NO: 79514 - RNA, 64 nt, Homo Sapiens
gguauaauacauacaaugcaugaaucauaauggauucuuuuauaaguuauuaauuuuuaugguu

SEQ ID NO: 79515 - RNA, 64 nt, Homo Sapiens
uuuugacuguuauagaaaccaaauauuuuacuguuucuuuuaaggacuaauauugucaaaaacu

SEQ ID NO: 79516 - RNA, 64 nt, Homo Sapiens
aaacucuuacuaaaauguuaacuuucuaaaaaccuucuuuuagaucuuccuugggccuuuggaa

SEQ ID NO: 79517 - RNA, 64 nt, Homo Sapiens
ugugaaaggaugaugaagaaaauaauuuuacuauuucuuuuaaaaguauguuuuggaaaaucaa

SEQ ID NO: 79518 - RNA, 64 nt, Homo Sapiens
uaaaaguuauucuagacaaucacuauuggcuuuuuucuuuuauuuuuaaaaaacucacauagag

SEQ ID NO: 79519 - RNA, 64 nt, Homo Sapiens
uccuucucacugcagccccaagcucuuauuaaccuucuuuuauguguucauuaaaugcagucau

SEQ ID NO: 79520 - RNA, 64 nt, Homo Sapiens
ucagaaugaagacagucugccuuagagccugcuauucuuuuagacauagggaggaugcauuauc

SEQ ID NO: 79521 - RNA, 64 nt, Homo Sapiens
uccagaaagaauucagcaauguuaucagaauuaauucuuuuauaugaguuuauguagcuugaua

SEQ ID NO: 79522 - RNA, 64 nt, Homo Sapiens
aguggugaaaguguucuauggauacuuauugcauuucuuuuauuaacauuauguaucauaugca

SEQ ID NO: 79523 - RNA, 64 nt, Homo Sapiens
uuuauuaaucucuguauccuuucuuucgugguaguucuuuuauuucuuuguacuuggagggcac

SEQ ID NO: 79524 - RNA, 64 nt, Homo Sapiens
cuucuuuucuuguagaacauaagcugaauuccuuuucuuuuaaauauguguuuuuaaaaaucua

SEQ ID NO: 79525 - RNA, 64 nt, Homo Sapiens
guacauuguuuacaucuggauuaguuguauucuauucuuuuacuuuauucuauuuugggaauuu

SEQ ID NO: 79526 - RNA, 64 nt, Homo Sapiens
aauaacaugucaugcugagacuccauaucuuacauucuuuuacuguggagcccagguccccuga

SEQ ID NO: 79527 - RNA, 64 nt, Homo Sapiens
ugaaauuaaaucaaacuguugagguauccauugauucuuuuauagcuuauucuucaguuaaaag

SEQ ID NO: 79528 - RNA, 64 nt, Homo Sapiens
caaaauauacaaaacuuuaucagggaaacuaagauucuuuuaaauuagaaaauauucucuauuu

SEQ ID NO: 79529 - RNA, 64 nt, Homo Sapiens
ccgucuccaaaaaaaaaaaaaauacaauuuuuauuucuuuuacuuuuuuuaguaaguuaaugua

SEQ ID NO: 79530 - RNA, 64 nt, Homo Sapiens
uuaaaugccuucuccuuuuuaccgauauuucuguuucuuuuaaccguucucaggagcacuuugc

SEQ ID NO: 79531 - RNA, 64 nt, Homo Sapiens
uuaaaaucccaguguucugaguuauugaaaggcuuucuuuuauuuugagagcuuuaggucuuuu

SEQ ID NO: 79532 - RNA, 64 nt, Homo Sapiens
uuaaaaagaaaaaacuuagcaaacuuuugaaucuuucuuuuauugcuauuuacacauacauaca

SEQ ID NO: 79533 - RNA, 64 nt, Homo Sapiens
uaugaucauugacaugugauuucaaaacacaguguucuuuuaaaaaucuauaauaugucaaaau

SEQ ID NO: 79534 - RNA, 64 nt, Homo Sapiens
gucuccuugcuuccugucuuauccuccaccgucuuucuuuuauacugacacaagaauggucuuu

SEQ ID NO: 79535 - RNA, 64 nt, Homo Sapiens
cacccugcucauccacucuacuaaugccucuucauucuuuuauacucagcuuucuuuaaaguuc

SEQ ID NO: 79536 - RNA, 64 nt, Homo Sapiens
uuuuucuccguugcaaagaauuuuuuuaaagcuuuucuuuuaaacaguagaauuuuuaaacaga

SEQ ID NO: 79537 - RNA, 64 nt, Homo Sapiens
auuuuuaagaacuugauccauccagcaucauuuauucuuuuaaaaagauccucagguccagaau

SEQ ID NO: 79538 - RNA, 64 nt, Homo Sapiens
ugacaauuugacuauucuuacuaaaauauugcuuuucuuuuaagauaaacauauuaaaauucuu

SEQ ID NO: 79539 - RNA, 64 nt, Homo Sapiens
aguggugccuauuaaagucagaaacuguagcugcuucuuuuacauauuuaaagugaguguuuaa

SEQ ID NO: 79540 - RNA, 64 nt, Homo Sapiens
cacuucuuuaucacaggugucuugaaacauuagcuucuuuuaccaaccugagaaaauuaggaug

SEQ ID NO: 79541 - RNA, 64 nt, Homo Sapiens
uauauuuauuucuaaauguuuugacugggcauuuuucuuuuaaugaaauauguggacugcucua

SEQ ID NO: 79542 - RNA, 64 nt, Homo Sapiens
guaagcuuccugacgacauggccaggccaagcuauucuuuuaaaauuacaggcgugagccacca

SEQ ID NO: 79543 - RNA, 64 nt, Homo Sapiens
uuuaauuuuuuugagacagaaguguuuaagauuuuucuuuuauuucuagagugucagccuuauc

SEQ ID NO: 79544 - RNA, 64 nt, Homo Sapiens
uggguggccgggagagacccuacugauuaaaguuuucuuuuauuacgauguauucagaagccuu

SEQ ID NO: 79545 - RNA, 64 nt, Homo Sapiens
auguauucagaagccuuuacagaaaugcuuuguuuucuuuuacggguuauugaaaggacgccuc

SEQ ID NO: 79546 - RNA, 64 nt, Homo Sapiens
agguguaguuaaacgaccucauuuuucagguuuauucuuuuagcgauuugggcuauaaaauauc

SEQ ID NO: 79547 - RNA, 64 nt, Homo Sapiens
uggaaauuuuuaugugaguugggacugccauauuuucuuuuaacaugcauaaccuaauuuuccu

SEQ ID NO: 79548 - RNA, 64 nt, Homo Sapiens
auguauaaaaauauuuuuucuaauccuccaguuauucuuuuauuucccucuguauaacugcauc

SEQ ID NO: 79549 - RNA, 64 nt, Homo Sapiens
guggaauauucauuugacaucugucucuuuucauuucuuuuaacuaccaugcccuugauauauc

SEQ ID NO: 79550 - RNA, 64 nt, Homo Sapiens
cucuauuuuuuauuuauuacaaugauuuucucccuucuuuuacaguagcacaaacaaaguaggg

SEQ ID NO: 79551 - RNA, 64 nt, Homo Sapiens
uuacuuuaaauauaauguuauuaauccucugcauuucuuuuaucuugauaacuccuagugaggg

SEQ ID NO: 79552 - RNA, 64 nt, Homo Sapiens
uggagaagccuagaugaaugagacaaauaccuacuucuuuuauuccuccuuuugguaaacaacu

SEQ ID NO: 79553 - RNA, 64 nt, Homo Sapiens
cuuauguggaauugaauuagagaacaaggcauuauucuuuuagggaaggugagagcuuauuugu

SEQ ID NO: 79554 - RNA, 64 nt, Homo Sapiens
aaggcauuugggguuggggaauuagagaaaaaaguucuuuuagugguaugaaacagccuaaugc

SEQ ID NO: 79555 - RNA, 64 nt, Homo Sapiens
auaaaauuaauauuuauaauguaacaucuuccaauucuuuuaaaauauguaguauguaauauau

SEQ ID NO: 79556 - RNA, 64 nt, Homo Sapiens
uuuuauuugagcuguuucaauuuaucuuugauuauucuuuuaauaguaacauuaguaaacuguc

SEQ ID NO: 79557 - RNA, 64 nt, Homo Sapiens
uucaaaaccuaauucccccacaguuccaaaacuguucuuuuaggcaguaauuacacgaggcaaa

SEQ ID NO: 79558 - RNA, 64 nt, Homo Sapiens
uccucuguggugaauuaaaccaacccccucucuuuucuuuuagcgaaaguauacuguauuuuac

SEQ ID NO: 79559 - RNA, 64 nt, Homo Sapiens
aguaacacgaaaucaucauagcuuacuuuguggguucuuuuaaauguuucaucuguggacaauu

SEQ ID NO: 79560 - RNA, 64 nt, Homo Sapiens
aauaaaagguacuuggcauuccuggccaaguaauuucuuuuagguauaggcgugagccacugca

SEQ ID NO: 79561 - RNA, 64 nt, Homo Sapiens
uacuauucauuuuuauuuaaucaucuuuugugauuucuuuuaaaaugcaaaacagguucagauu

SEQ ID NO: 79562 - RNA, 64 nt, Homo Sapiens
guagaaaauaauuuuuuacagacuauuauuuaucuucuuuuaguuguagaauuucugauugcau

SEQ ID NO: 79563 - RNA, 64 nt, Homo Sapiens
uuaugaaguaauguuaauuuuguaaguagauuuauucuuuuauuuaacuuuugaauuacauuuu

SEQ ID NO: 79564 - RNA, 64 nt, Homo Sapiens
aaguauaauuagaauguuuaagguucuaauuauuuucuuuuauaaauuuaaaagaaaaauugug

SEQ ID NO: 79565 - RNA, 61 nt, Homo Sapiens
gaauuaaauuuugugguaugaugucaucuuuuucuuuuaaauucucuuucauaaaaaguga

SEQ ID NO: 79566 - RNA, 64 nt, Homo Sapiens
aaacuggaauuuucaaacagacugcagauguuuuuucuuuuaacuucaguuuuuaaucgacugg

SEQ ID NO: 79567 - RNA, 64 nt, Homo Sapiens
agcacuucugcuacuaaaguuuccuuucacguauuucuuuuagcagccaauuugucuguuacau

SEQ ID NO: 79568 - RNA, 64 nt, Homo Sapiens
auguuuuuaggauuccccucaaugcagucaguguuucuuuuaaguauacaacaggagagagaug

SEQ ID NO: 79569 - RNA, 64 nt, Homo Sapiens
ccuacuuuucuuuauuagcuuucuccucauccauuucuuuuauaccuuuccuuuuuggggaguu

SEQ ID NO: 79570 - RNA, 64 nt, Homo Sapiens
auguucagaguucuauguaagguggguuuuauuuuucuuuuaagggauaguuuguaauaguaag

SEQ ID NO: 79571 - RNA, 64 nt, Homo Sapiens
uuaaagguuguaauugaaauacaagaaaagagccuucuuuuagaagaaagcaaguauauuuuug

SEQ ID NO: 79572 - RNA, 64 nt, Homo Sapiens
uuaaaauguuaaaauuuugugaccaugaauuucuuucuuuuauaaauuuucucauuuaaaaauc

SEQ ID NO: 79573 - RNA, 64 nt, Homo Sapiens
agcuaucacagguuuguuagcuaauaauaguauuuucuuuuaguugaguuagguuuuuccccau

SEQ ID NO: 79574 - RNA, 64 nt, Homo Sapiens
auuuacuuuuagaugaauggcauugugaaugccauucuuuuaaugaauuucaagagaauucucu

SEQ ID NO: 79575 - RNA, 64 nt, Homo Sapiens
ucucauccucuuuuccuuccuucuuuccuuucucuucuuuuaucuccaagguuaaucaggaaaa

SEQ ID NO: 79576 - RNA, 64 nt, Homo Sapiens
uaauaugcugagaauuauuuguuuucacugcuuuuucuuuuacaccacuggaagaccaaacaag

SEQ ID NO: 79577 - RNA, 64 nt, Homo Sapiens
uuuuuugcuccacauguacauacaaagcacuacauucuuuuauccaacaucaccccauuaagaa

SEQ ID NO: 79578 - RNA, 64 nt, Homo Sapiens
guuguagggccugcccauggggccagcugccccauucuuuuaacgaagaggaggccagaggucg

SEQ ID NO: 79579 - RNA, 64 nt, Homo Sapiens
gugccucuucagggacacagccugccagguucaguucuuuuaagccaugccaggaaucugccua

SEQ ID NO: 79580 - RNA, 64 nt, Homo Sapiens
caaguuugaucaacagcaaaauagaguucugaauuucuuuuaaagugaugauauauuauuuugu

SEQ ID NO: 79581 - RNA, 64 nt, Homo Sapiens
agaaauuacuuuuguaauuauuugcaauuaauuguucuuuuaucuuacaauuguuuaagccugu

SEQ ID NO: 79582 - RNA, 64 nt, Homo Sapiens
cuauacugcagaauauaguguaucaaaaacuuuuuucuuuuaaauuauuaaagugucuuuuaua

SEQ ID NO: 79583 - RNA, 64 nt, Homo Sapiens
aauuuuuuuuucuuuugauguugcaacuuuuggguucuuuuaaacugugauagugaugguaacu

SEQ ID NO: 79584 - RNA, 64 nt, Homo Sapiens
acuaaacaccucugaagacugcaaacuggauuaguucuuuuacuucaguguuuaauaagcagau

SEQ ID NO: 79585 - RNA, 64 nt, Homo Sapiens
uugguacacaaagaauguauucuucauagguuuauucuuuuaauaugugaacuauuauuaaagu

SEQ ID NO: 79586 - RNA, 64 nt, Homo Sapiens
aggaugggaacaugggaaugauaauauauauuuuuucuuuuaauauuuuauuuuucuuuuuaug

SEQ ID NO: 79587 - RNA, 64 nt, Homo Sapiens
uucuguuucugugaaacaauuauuuuaaauauuuuucuuuuaaaaauaacuuuuuaucaguaca

SEQ ID NO: 79588 - RNA, 64 nt, Homo Sapiens
aauguuuuauauauuuagggguuucuuccuuuuuuucuuuuaaaaguuguugcauguaugaaua

SEQ ID NO: 79589 - RNA, 64 nt, Homo Sapiens
aagauuuuugugugaccaugggcuuccauucuaguucuuuuacccccacuugcucagcagcuug

SEQ ID NO: 79590 - RNA, 64 nt, Homo Sapiens
uuacgugaagugaugaaauuauuucuuuucuuuuuucuuuuauaguuuuuaaaauguuuguuau

SEQ ID NO: 79591 - RNA, 64 nt, Homo Sapiens
auaugcuuuccgcaguccuaaaauuuuuuaaaauuucuuuuauauaacaugaaccuucauuugu

SEQ ID NO: 79592 - RNA, 64 nt, Homo Sapiens
aagcuccuguuuuuggaaagguuguuaugugguuuucuuuuaaaaaucccagcgccuuuuaaaa

SEQ ID NO: 79593 - RNA, 64 nt, Homo Sapiens
uacauuugaaaaugcccuuuaucucuguaaccauuucuuuuaugauggaagaugcuccuuaaaa

SEQ ID NO: 79594 - RNA, 64 nt, Homo Sapiens
uuacuuaaaaagaaaccucuaaaugaagauuuauuucuuuuaaugacugcaacaaaaaauguga

SEQ ID NO: 79595 - RNA, 64 nt, Homo Sapiens
cauaaauaacaugaaugaaagacccaaucugguuuucuuuuaccuaagaaccugggauauuccu

SEQ ID NO: 79596 - RNA, 64 nt, Homo Sapiens
cgaagcugggccuuguuuggucucauacuuaauuuucuuuuauauacauguuuuucuuuuacau

SEQ ID NO: 79597 - RNA, 64 nt, Homo Sapiens
gucucauacuuaauuuucuuuuauauacauguuuuucuuuuacaugcauauauauauauuuuau

SEQ ID NO: 79598 - RNA, 64 nt, Homo Sapiens
gcagucuaguguugaaaguuuuauuuuuccauuuuucuuuuaaguaaauuuuuuuuaaaaaauu

SEQ ID NO: 79599 - RNA, 64 nt, Homo Sapiens
accccuaucuguauuaaaaaaaaaucugauuuaauucuuuuauuuaucauaagggguuuaauuc

SEQ ID NO: 79600 - RNA, 64 nt, Homo Sapiens
accuauuaaacuuaaaacugccaaaugauuuuuguucuuuuaugugcgugauaaaaauacaaag

SEQ ID NO: 79601 - RNA, 64 nt, Homo Sapiens
agggggcccacaagcacgcccagcccccgccgaauucuuuuagcuucguaauuggaaccuuuga

SEQ ID NO: 79602 - RNA, 64 nt, Homo Sapiens
uccccaccugcuccgaagacaaaccaaccuccguuucuuuuauaaacagucggcuuuuucuuaa

SEQ ID NO: 79603 - RNA, 64 nt, Homo Sapiens
cagaaaaccagguuucuacauccaaagacugcuuuucuuuuagcugccagauuggauugugaau

SEQ ID NO: 79604 - RNA, 64 nt, Homo Sapiens
ugucugaaauggagaucacuguaaaacugucuuuuucuuuuaaauuacaaguacacugggguua

SEQ ID NO: 79605 - RNA, 64 nt, Homo Sapiens
gucccugcugggacucccuguauagcuucccaaguucuuuuacagucaguaucgugggcaugug

SEQ ID NO: 79606 - RNA, 64 nt, Homo Sapiens
uacccccuuuccuccucaccgcaacaguguuggcuucuuuuaagacggaugguguugcugcugg

SEQ ID NO: 79607 - RNA, 64 nt, Homo Sapiens
guguauuggcauguaauuugacuuuugucuuauuuucuuuuaaguggaaugaaaaaacucauuc

SEQ ID NO: 79608 - RNA, 64 nt, Homo Sapiens
aucuagacuauauuuugaggucucagaaucaacauucuuuuaaacuucccugcugcauguaaug

SEQ ID NO: 79609 - RNA, 64 nt, Homo Sapiens
caguaaguuaaguuguaaagacuuuggaauaaguuucuuuuaaaaauaugacauagccagugau

SEQ ID NO: 79610 - RNA, 64 nt, Homo Sapiens
aagccacauuucuaaaguuuauuuuuaugaaagcuucuuuuaagauuuugaaaucuauucugca

SEQ ID NO: 79611 - RNA, 64 nt, Homo Sapiens
uaaaaauagaagacagaaguauuaaaauuauauuuucuuuuauuuuaagucuucugccuucuuu

SEQ ID NO: 79612 - RNA, 64 nt, Homo Sapiens
uucuuucuuauaauauguuguaguuacuagugaauucuuuuaaaagcaauaccuagaguuagaa

SEQ ID NO: 79613 - RNA, 64 nt, Homo Sapiens
uuccgugguauacagcuccugugacauuugaaguuucuuuuaaagggguuuuucuuaaucaaag

SEQ ID NO: 79614 - RNA, 64 nt, Homo Sapiens
aaaauuaaaguaauuucacuuucauugcuaggauuucuuuuaaaucaauuuuucaaacucauuu

SEQ ID NO: 79615 - RNA, 64 nt, Homo Sapiens
caucuuuaggaauauauugaugguauacuaaauguucuuuuaacuauaaacucuauuccaguuu

SEQ ID NO: 79616 - RNA, 64 nt, Homo Sapiens
cuuuauuuugcucaauauuugaauauaaauaauuuucuuuuaauaaaucucauuugagauuuaa

SEQ ID NO: 79617 - RNA, 64 nt, Homo Sapiens
agcaaucccuuaugcauagagaaaauauaacaaguucuuuuaugagucaugcacauucaagaga

SEQ ID NO: 79618 - RNA, 64 nt, Homo Sapiens
ccuucucuuugauuuauuuuaguccaaguuccaguucuuuuagguucuuaauuuucuuuaauuu

SEQ ID NO: 79619 - RNA, 64 nt, Homo Sapiens
uccuauuuuuccaggaacuuuugcauuguaacuuuucuuuuacauaagaguccauugggguggu

SEQ ID NO: 79620 - RNA, 64 nt, Homo Sapiens
aaguuauugcugauucuugaucacaaaggaaauguucuuuuacuuaaaacuaauaauguuaccc

SEQ ID NO: 79621 - RNA, 64 nt, Homo Sapiens
aagucacaauacaugcuaauucugaaacagacguuucuuuuagugugaguucucaucuuuguuu

SEQ ID NO: 79622 - RNA, 64 nt, Homo Sapiens
uuaacuggaggucauggagauuuucuccuacauuuucuuuuaaaaguuuuauaguuucagaguu

SEQ ID NO: 79623 - RNA, 64 nt, Homo Sapiens
uaguauaccccuguauuuauuuguuuucuugaauuucuuuuaucauuguuuuguaguuuucacc

SEQ ID NO: 79624 - RNA, 64 nt, Homo Sapiens
gaagacccucaucucagaguagcccuuuccucuguucuuuuauuucuuuuucucuuugauugaa

SEQ ID NO: 79625 - RNA, 64 nt, Homo Sapiens
guguuuuggguuuuucucuuuguuuuuuucaagauucuuuuaaaggaguacugaagaauacuuu

SEQ ID NO: 79626 - RNA, 64 nt, Homo Sapiens
uggaaaccucuuacaugugagaugaauaguggaauucuuuuaaaugagaauagaugaaaauuuu

SEQ ID NO: 79627 - RNA, 64 nt, Homo Sapiens
gugguucugauagguacagauagacguuuuuuaguucuuuuagacaaauuuccacuuccucuga

SEQ ID NO: 79628 - RNA, 64 nt, Homo Sapiens
uuuguaaugaaugaagcgguaggcagguucuaauuucuuuuaaccuuuuaauuauguacaggca

SEQ ID NO: 79629 - RNA, 64 nt, Homo Sapiens
uguuuaggccaugacuucuacaagcagauuucuuuucuuuuaguuuagaagacaaaaaauuuca

SEQ ID NO: 79630 - RNA, 64 nt, Homo Sapiens
uaguuuagaagacaaaaaauuucaauacagauacuucuuuuagaaguaaauuuuuagauuuuau

SEQ ID NO: 79631 - RNA, 64 nt, Homo Sapiens
ugugucaaaagucucacuugggaguaguguuuuuuucuuuuagacauucugcagacaugcaggg

SEQ ID NO: 79632 - RNA, 64 nt, Homo Sapiens
guugguaucuccagccccccuccuuuuuuuguuuuucuuuuaguuauuuacuuuguuuguauaa

SEQ ID NO: 79633 - RNA, 64 nt, Homo Sapiens
gcagagaaagauaagaucaaaagguguuugguuuuucuuuuaauuuuuauuguaguuuuuuugg

SEQ ID NO: 79634 - RNA, 64 nt, Homo Sapiens
uugaacacuuuugcccugcagccucaguuuugaauucuuuuagcaacuuggauuagaggggccc

SEQ ID NO: 79635 - RNA, 64 nt, Homo Sapiens
guaaauuccuaacaggagaccacaaagguuucacuucuuuuagauccauccaauaugcgaaaaa

SEQ ID NO: 79636 - RNA, 64 nt, Homo Sapiens
caaccaaguuauuuuuuauauauuuuguuauuuauucuuuuaauaauggaauuuuuuuaaaaag

SEQ ID NO: 79637 - RNA, 64 nt, Homo Sapiens
ccacgaagacaucaagauacguugagauaguugguucuuuuaccaacuuuuuuggaaacuguug

SEQ ID NO: 79638 - RNA, 64 nt, Homo Sapiens
uggugguuucuauacaugaaucaguuucuguuguuucuuuuauguagguguuugggaucggacc

SEQ ID NO: 79639 - RNA, 64 nt, Homo Sapiens
auguguaagaaauaccccaaacaauuguugacuuuucuuuuacuuuaacaggggaaguacugau

SEQ ID NO: 79640 - RNA, 64 nt, Homo Sapiens
guaauggagcuuauggguaguuaagcccacuuuguucuuuuaaugaauuaucuuaagugagaug

SEQ ID NO: 79641 - RNA, 64 nt, Homo Sapiens
aguuucuaaguguaaaauuuaggcucugauguauuucuuuuaguuccccuacaauguuauacca

SEQ ID NO: 79642 - RNA, 64 nt, Homo Sapiens
auuauagguuggugccaaaaggcuuuauauuaaauucuuuuaguggaguagaaaaaacaauucu

SEQ ID NO: 79643 - RNA, 64 nt, Homo Sapiens
aaacauuaguuuucuccuguugucuguuauuuccuucuuuuauccucuuaacuggccauuaucu

SEQ ID NO: 79644 - RNA, 64 nt, Homo Sapiens
uuuauauuuuuuauuauaauuauuauuucuuaucuucuuuuauauuuuuuggaaaccaaauuua

SEQ ID NO: 79645 - RNA, 64 nt, Homo Sapiens
aaaauuuucuaaaauguauuuuagacuuccuguagggggcgauauacuaaauguauauaguaca

SEQ ID NO: 79646 - RNA, 64 nt, Homo Sapiens
uauauaguacauuuauacuaaauguauuccuguagggggcgauauacuaaauguauuuuagacu

SEQ ID NO: 79647 - RNA, 64 nt, Homo Sapiens
ggcgauauacuaaauguauuuuagacuuccuguagggggcgauaaaauaaaaugcuaaacaacu

SEQ ID NO: 79648 - RNA, 64 nt, Homo Sapiens
gagggcgaacugucgaaugucuggggcggggggcgggggcgaggcuacuaggaggagccaggga

SEQ ID NO: 79649 - RNA, 64 nt, Homo Sapiens
gcaacgggacugcugggagauggaguuuggggaggggggcgaaacccauucugggcgggcccag

SEQ ID NO: 79650 - RNA, 64 nt, Homo Sapiens
uccucccucgcccggcccgccuucucuggguuaggggggcgaugcggccggguggcaacgcacg

SEQ ID NO: 79651 - RNA, 64 nt, Homo Sapiens
ggagccgcacucuucgcccgcuccgggcaaaagcgggggcgaguguagagcgauccugggaaau

SEQ ID NO: 79652 - RNA, 62 nt, Homo Sapiens
gggaacaacuacccccuacccuucucccacaagcccccuacacuauuaaugcgaucuggcau

SEQ ID NO: 79653 - RNA, 62 nt, Homo Sapiens
ucccaccaccaccaugaagugaaggauagacugcccccuaccuuaggaggaccaugugguug

SEQ ID NO: 79654 - RNA, 62 nt, Homo Sapiens
uguggacuaaagaugaacuccucacuguccccgcccccuauuguccccaccgccucuucuuc

SEQ ID NO: 79655 - RNA, 62 nt, Homo Sapiens
ccaggcgguggaucaggcccggucccaccugugcccccuaaauguguuccugaccgaccccg

SEQ ID NO: 79656 - RNA, 62 nt, Homo Sapiens
cugguaacuaccaaaaucccggcuuccuuccagcccccuauuuauucugguaacuaccagga

SEQ ID NO: 79657 - RNA, 62 nt, Homo Sapiens
cugguaacuaccaggaggcuggcuuccuuccagcccccuauuucaaaucgaaucucccagga

SEQ ID NO: 79658 - RNA, 62 nt, Homo Sapiens
aggggccccauacgacagagugugccuuaaaggcccccuacaacucugcccagcccugaaug

SEQ ID NO: 79659 - RNA, 62 nt, Homo Sapiens
guaaccccucucucaccccgcuucagggcccugcccccuaauuggagggggcuugaggggca

SEQ ID NO: 79660 - RNA, 62 nt, Homo Sapiens
ugcgcccgcagcgcccucgccacgcgccccgggcccccuacccgcgcccggaacucgcucuc

SEQ ID NO: 79661 - RNA, 62 nt, Homo Sapiens
ucugucgacucugguggguccccacuccuggggcccccuaaccccaccccaggcagcggaag

SEQ ID NO: 79662 - RNA, 62 nt, Homo Sapiens
uuagagcagacaagggcucucagcccuggcaugcccccuaaagggaccaagguccuccuauu

SEQ ID NO: 79663 - RNA, 64 nt, Homo Sapiens
auuugaguccuaacuuggugcaagucuggcagcuagguagaaaaggcacucuagcagguguggu

SEQ ID NO: 79664 - RNA, 64 nt, Homo Sapiens
cacucuagcaggugugguaggagcacgccccagaagguagaaugugguggggugugauggaaca

SEQ ID NO: 79665 - RNA, 64 nt, Homo Sapiens
uuuuuauuuuuacuguuuuagauuuaacacacucagguagaauauuuuguuuuacaaaucacuu

SEQ ID NO: 79666 - RNA, 64 nt, Homo Sapiens
aaagcuguaaaguagauuuaaucauguaagcugcagguagaagcuagcacuucacagcaugguu

SEQ ID NO: 79667 - RNA, 64 nt, Homo Sapiens
gaucugugcccaugggucuccuuuuagcucaggaagguagaagaguauuccuuuggcuuggcau

SEQ ID NO: 79668 - RNA, 64 nt, Homo Sapiens
gacuucaaggucacgagguugaagggaauaugaaagguagaaguaagagccuauucgauagcua

SEQ ID NO: 79669 - RNA, 64 nt, Homo Sapiens
gucccaagguacauuguucuacuguuuuauacccagguagaaguuacacagcaauuuagcaaug

SEQ ID NO: 79670 - RNA, 64 nt, Homo Sapiens
ugcaugccuguggucccagcuacuugggaggcuaagguagaagaauugcuugaaccugggaggc

SEQ ID NO: 79671 - RNA, 64 nt, Homo Sapiens
uccuucacucaccgacuuguaauagcaggggcuuagguagaaguagguagaacagaacucacaa

SEQ ID NO: 79672 - RNA, 64 nt, Homo Sapiens
gaacucacaaaauagcagggauagccugggaggcagguagaacacaccuccucaguuccugugg

SEQ ID NO: 79673 - RNA, 64 nt, Homo Sapiens
acucucacugccauugccgagaguccuguuauugagguagaaacagaaaagaaagacguucuug

SEQ ID NO: 79674 - RNA, 64 nt, Homo Sapiens
acaaacaauuucuggcuuggggaggagucccucuagguagaacacaguaagugucaaagacuga

SEQ ID NO: 79675 - RNA, 64 nt, Homo Sapiens
aaggaagauuuucaguccugaacgugaauuauagagguagaacgucgcuaauaauuucugccau

SEQ ID NO: 79676 - RNA, 64 nt, Homo Sapiens
agucuugaugaaugugaaccaugucggaauuguuagguagaaaccugggcugggaggccucgga

SEQ ID NO: 79677 - RNA, 64 nt, Homo Sapiens
aucuauaacaguaauauugauucauucacauuccuguguuaagucauuuuauauggaaaggcuu

SEQ ID NO: 79678 - RNA, 64 nt, Homo Sapiens
uaaaagcuuugacuuaaacauugauauuucagaauguguuaaauagauuaagacacaguaaguu

SEQ ID NO: 79679 - RNA, 64 nt, Homo Sapiens
uguuuuuugauacauuccuaugcgcgcgugcguguguguuaaucugugugugugugugugugug

SEQ ID NO: 79680 - RNA, 64 nt, Homo Sapiens
cuuagugccaucaagaacccugacaacucugaaauguguuaacuggaggauuuucacuacguuu

SEQ ID NO: 79681 - RNA, 64 nt, Homo Sapiens
uucauuaaaauaauaguggugaauuauauguuauuguguuaaaaccucacuugccaaauucugg

SEQ ID NO: 79682 - RNA, 64 nt, Homo Sapiens
auugucuuccgaguuuuuugguuccuuuuuuaacuguguuaaaguacuugaaauguauugacug

SEQ ID NO: 79683 - RNA, 64 nt, Homo Sapiens
accaaagcaagugaaucuggugccaauaauaaacuguguuaaugguaugcuuuacugauaagug

SEQ ID NO: 79684 - RNA, 64 nt, Homo Sapiens
aacagcuguauuuuauguaugcacaguggcuccguguguuaaaaguuccuccacacauguaaag

SEQ ID NO: 79685 - RNA, 64 nt, Homo Sapiens
aauauuuagggccagaaaaauugaauccaaacaauguguuaaguggauucauguauuauuguua

SEQ ID NO: 79686 - RNA, 64 nt, Homo Sapiens
uuaggauuauuuacuuaccauuuuaaagaaccacuguguuaagucuaagacaaauauuuaaaca

SEQ ID NO: 79687 - RNA, 64 nt, Homo Sapiens
auaugcuuugcaggugcucaccucaugaucccuguguguuaagcccuuuaaaagaggggucaau

SEQ ID NO: 79688 - RNA, 64 nt, Homo Sapiens
aucaagucacagagaccucuacugauccuuucgcuguguuaaaagucuacuggauuucuuuacu

SEQ ID NO: 79689 - RNA, 64 nt, Homo Sapiens
gugucuaaauuugaauguuaagcagauggaaugcuguguuaaauaaaccucaaaaugucuaaga

SEQ ID NO: 79690 - RNA, 64 nt, Homo Sapiens
cccugcuucugacacugaaacuucccuuucugcuuguguuaaguauguguaaaaugugaaguga

SEQ ID NO: 79691 - RNA, 64 nt, Homo Sapiens
uaguuuguuuuaaagucaucuuuacuuucccaaauguguuaaauuuguaacuccucuuuggggu

SEQ ID NO: 79692 - RNA, 64 nt, Homo Sapiens
cuuuuuaagcuuauuguguuuaagaaaguagcuauguguuaaacagaggugauggcagcccuuc

SEQ ID NO: 79693 - RNA, 64 nt, Homo Sapiens
aauaucuauacagcacugauuuccuugaauauuguguguuaauugauauaucuucuagaggcaa

SEQ ID NO: 79694 - RNA, 64 nt, Homo Sapiens
aauugauauaucuucuagaggcaaaagguuuaaauguguuaaaaugguuauauugccuccuuuu

SEQ ID NO: 79695 - RNA, 64 nt, Homo Sapiens
acgauuuaggagaauguuaccuaggacauuuugauguguuaaguugaagaaagguaacucgugu
